United States Patent 11,078,247 (RNA ENCODING A THERAPEUTIC PROTEIN) - sequence listing, part 15

SEQ ID NO: 27759 - RNA, 1185 nt, Artificial Sequence
  derived and/or modified sequence opt1 from CBX6__Homo_sapiens__NP_001290423
auggagcugagcgccgugggcgagcgcgucuucgccgcggaguccaucaucaagcggcgcauccggaaggggcgcaucgaguaccucgugaaguggaagggcugggccaucaaguacagcaccugggagcccgaggagaacauccuggacucccggcugaucgccgccuucgagcagaaggagcgcgagcgggagcucuacgggccgaagaagcgcggccccaagcccaagaccuuccugcugaagcccagcgccuccgcgagcuccccgaagcuccacagcuccgccgccgugcaccggcugaagaaggacauccgccggugccaccgcaugagccggcgcccccugccccggcccgacccgcagggcgggucccccggccuccgcccgcccaucagccccuucuccgagacgguccggaucaucaaccgcaaggugaagccccgggagcccaagcgcaaccggaucauccugaaccugaaggugaucgacaagggggccggcgggggcggggcgggccagggcgccggggcccucgcccgccccaaggucccgagccgcaaccgggugaucggcaaguccaagaaguucagcgaguccgugcugcgcacccagauccggcacaugaaguucggggccuucgcgcuguacaagcccccgcccgcgccccucgucgcccccagccccggcaaggccgaggccuccgcccccggcccggggcugcugcucgccgcccccgccgcccccuacgacgcgcgcagcagcggcuccagcgggugccccuccccgacgccccagagcuccgaccccgacgacaccccgcccaagcugcugcccgagaccgugagccccuccgccccgagcuggcgggagcccgaggugcucgaccugucccugccgcccgagagcgccgccaccuccaagcgcgccccgcccgaggucaccgcggccgccggccccgcgccgcccaccgcccccgagcccgccggggccagcuccgagcccgaggccggcgacuggcggcccgagaugagccccugcuccaacgugguggucacggacgugaccagcaaccuccugaccgugaccaucaaggaguucugcaaccccgaggacuucgagaaggucgccgcgggcguggccggggccgccggcgggggcggguccaucggcgccagcaaguga

SEQ ID NO: 27760 - RNA, 756 nt, Artificial Sequence
  derived and/or modified sequence opt1 from CBX7__Homo_sapiens__NP_783640
auggagcugagcgccaucggcgagcaggucuucgccguggaguccauccgcaagaagcgggugcgcaaggggaagguggaguaccucgucaaguggaagggcuggccgcccaaguacagcaccugggagcccgaggagcacauccuggacccccggcuggugauggcguacgaggagaaggaggagcgcgaccgggccuccggguaccgcaagcggggccccaagcccaagcgccuccugcugcagcggcucuacagcauggaccugcgcuccagccacaaggccaaggggaaggagaagcugugcuucucccugaccugcccccucggcagcggcucccccgaggggguggucaaggccggcgcccccgagcugguggacaaggggccccucgugcccacgcugcccuucccccugcggaagccgcgcaaggcgcacaaguaccuccggcugagccgcaagaaguucccgccccggggccccaaccuggagucccacagccaccgccgggagcuguuccuccaggagccgcccgcccccgacguccugcaggccgccggggagugggagcccgcggcccagccgcccgaggaggaggccgacgccgaccucgccgagggcccgccgcccuggacccccgcgcugcccuccagcgaggugaccgugaccgacaucacggccaacuccaucaccgucaccuuccgcgaggcccaggccgccgagggcuucuuccgggaccgcagcgggaaguucuga

SEQ ID NO: 27761 - RNA, 1170 nt, Artificial Sequence
  derived and/or modified sequence opt1 from CBX8__Homo_sapiens__NP_065700
auggagcugagcgccgugggcgagcgcgucuucgccgcggaggcccuccugaagcggcgcauccggaaggggcgcauggaguaccuggugaaguggaagggcuggucccagaaguacagcaccugggagcccgaggagaacauccucgacgcccggcugcuggccgccuucgaggagcgcgagcgggagauggagcucuacgggccgaagaagcgcggccccaagcccaagaccuuccugcugaaggcgcaggccaaggccaaggccaagacguacgaguuccgguccgacagcgcgcgcgggauccggauccccuacccgggccgcagcccccaggaccucgccuccaccucccgggcccgcgagggccugcggaacauggggcugagcccgcccgccuccagcaccuccaccagcuccacgugccgcgccgaggcgccccgggaccgcgaccgggaccgcgaccgggaccgcgagcgcgaccgggagcgcgagcgggagcgcgagcgggagcgcgagcgggagcgcgagcgggagcgcggcaccagccggguggacgacaagcccuccagccccggggacuccagcaagaagcgcggccccaagccgcggaaggagcuccccgaccccucccagcgcccccugggggagccgagcgccggccugggcgaguaccucaaggggcggaagcuggacgacacccccagcggcgccgggaaguuccccgccggccacuccgucauccagcuggcccgccggcaggacagcgaccucgugcagugcggcgugaccucccccagcuccgcggaggccacggggaagcuggccgucgacaccuucccggcccgcgugaucaagcaccgggccgcguuccuggaggccaagggccagggggcccucgaccccaacggcacccgcgugcgccacgggagcggcccgcccuccagcggcgggggccuguaccgggacaugggggcccagggcgggcgccccucccugaucgcccggauccccgucgcgcgcauccucggcgaccccgaggaggagagcuggucccccagccugaccaaccuggagaaggugguggucacggacgugaccuccaacuuccucaccgugaccaucaaggagagcaacacggaccagggcuucuucaaggagaagcgguga

SEQ ID NO: 27762 - RNA, 510 nt, Artificial Sequence
  derived and/or modified sequence opt1 from CBY1__Homo_sapiens__NP_001002880
auggacaagugccagaagcacgacguggagugcgagaagcccgacgccaacgaggacagccugugcaacuccguccacgugcaguggccgggcgaggggagcaccggcuucgccuucauccgccccaagaugcccuucuucgggaacaccuucucccccaagaagacgccgccccgcaagagcgcgucccucagcaaccugcacucccuggaccggagcacccgggagguggagcucggccuggaguacgggucccccaccaugaaccuggccggccagagccucaaguucgagaacggccaguggaucgccgagaccggggucuccggcgggguggaccgccgggaggugcagcgccugcggcgccggaaccagcagcuggaggaggagaacaaccuccugcgccugaaggucgacauccuccuggacaugcugagcgaguccacggccgagagccaccucauggagaaggagcuggacgagcugcggaucucccgcaagcggaaguga

SEQ ID NO: 27763 - RNA, 2856 nt, Artificial Sequence
  derived and/or modified sequence opt1 from CC2D1A__Homo_sapiens__NP_060191
augcacaagcgcaagggccccccggggccccccggccggggggccgccgcggcccgccagcugggccuccugguggaccugagccccgacgggcucaugaucccggaggacggcgccaacgacgaggagcuggaggccgaguuccuggcccucgucggcgggcagccccccgcgcuggagaagcugaagggcaaggggccccucccgauggaggccaucgagaagauggccucccugugcaugcgggaccccgacgaggacgaggaggagggcaccgacgaggacgaccuggaggccgacgacgaccuccuggcggagcugaacgaggugcucggggaggagcagaaggccagcgagaccccccccccgguggcccagcccaagcccgaggccccccacccgggccuggagacgacccugcaggagcgccucgcccuguaccagaccgcgaucgaguccgcccggcaggccggcgacagcgccaagaugcgccgguacgaccgcgggcugaagacccucgagaaccugcuggccuccauccggaagggcaacgcgaucgacgaggccgacauccccccccccgucgccaucgggaagggcccggccagcacgcccaccuacucccccgcccccacccagccggcgccccgcaucgccagcgcccccgagccccgggugacccucgagggcccguccgccacggcccccgcgagcucccccgggcuggccaagccgcagaugccccccggccccugcagcccggggccccuggcccagcuccagucccgccagcgggacuacaagcuggccgcgcugcacgccaagcagcagggcgacaccaccgccgccgcccgccacuuccggguggcgaagagcuucgacgccguccucgaggcccugucccgcggggagcccguggaccugagcugccuccccccgccccccgaccagcugcccccggacccccccucccccccgagccagccccccacccccgccacggccccguccaccaccgaggugcccccccccccgcggacccugcucgaggcgcuggagcagcgcauggagcgguaccaggucgccgccgcccaggccaagagcaagggcgaccagcgcaaggcgcggaugcacgagcgcaucgugaagcaguaccaggacgccauccgcgcccacaaggccggccgggcgguggacgucgccgagcugcccgugcccccgggguucccccccauccagggccucgaggccacgaagcccacccagcagagccugguggggguccuggagaccgccaugaagcucgccaaccaggacgagggcccggaggacgaggaggacgaggugcccaagaagcagaacucccccguggcgcccaccgcccagccgaaggccccccccagccgcacgccccaguccgggagcgccccgaccgccaaggcgccccccaaggccaccuccacccgggcccagcagcagcuggccuuccuggagggccgcaagaagcagcuccugcaggccgcgcugcgggccaagcagaagaacgacgucgagggcgccaagaugcaccuccgccaggccaaggggcuggagcccaugcuggaggcgagccggaacggccugccgguggacaucacgaaggugccccccgcccccgucaacaaggacgacuucgcccucgugcagcgcccggggcccggccugucccaggaggccgcccggcgcuacggggagcugaccaagcucauccggcagcagcacgagaugugccugaaccacagcaaccaguucacccagcugggcaacaucaccgagacgaccaaguucgagaagcucgcggaggacugcaagcgcuccauggacauccugaagcaggccuucgugcggggccugcccacccccaccgcccgcuucgagcagcggacguucagcgucaucaagaucuucccggaccucuccagcaacgacaugcugcuguucaucgugaaggggaucaaccuccccaccccccccggccuguccccgggggaccuggacgucuucgugcgcuucgacuuccccuaccccaacguggaggaggcccagaaggacaagaccagcgucaucaagaacaccgacuccccggaguucaaggagcaguucaagcucugcaucaaccggagccaccgcggcuuccggcgcgccauccagacgaagggcaucaaguucgagguggugcacaaggggggccuguucaagaccgaccgcguccuggggaccgcgcagcucaagcuggacgcccuggagaucgccugcgaggugcgggagauccucgaggugcuggacggccgccggcccaccgggggccgccuggaggucauggugcggauccgcgagccccucaccgcccagcagcuggagacgaccaccgagcgguggcuggugaucgaccccgucccggccgcggugcccacccagguggccggccccaaggggaaggcccccccgguccccgcccccgcccgcgaguccggcaaccggagcgcgcgcccccuccacucccugagcgugcuggccuucgaccaggagcggcucgagcgcaagauccuggcccugcggcaggcccgccggccggugccccccgaggucgcgcagcaguaccaggacaucaugcagcgcagccaguggcagcgggcccagcucgagcaggggggcguggggauccgccgggaguacgccgcccagcuggagcgccagcugcaguucuacacggaggccgcgcggcgccucggcaacgacggcucccgcgacgccgccaaggaggcccuguaccggcgcaaccugguggagagcgagcuccagcggcugcgccgguga

SEQ ID NO: 27764 - RNA, 1806 nt, Artificial Sequence
  derived and/or modified sequence opt1 from CC2D1B__Homo_sapiens__XP_011539232
augaugcccggcccgcgcccccggaaggggccccaggcccgcggccaggggguggccgcggccaagcagaugggccuguucauggaguucgggcccgaggacaugcuccugggcauggacgaggccgaggacgacgaggaccuggaggccgagcuccuggcccugaccggcgaggcgcagaccacggggaagaagccggcccccaagggccaggcgccccuccccauggcccacaucgagaagcuggccgccgacugcaugcgggacgucgaggaggaggaggaggaggaggggcuggaggaggacgccgagcuccugaccgagcugcaggaggugcucggcguggacgaggagaccgagccgcuggacggggacgaggucgccgaccccggcggcagcgaggaggagaacgggcuggaggacaccgagccgcccgugcagacggccgugcucaccgcguccgcccccgccgcccaggccggcgcgagccaggggcugcacgcccugcucgaggagcgcauccacaacuaccgggaggccgccgccuccgcgaaggaggccggcgaggccgccaaggcccgccggugcgagcgcggccugaagacccuggagagccagcucgcguccguccggcgcgggcggaagaucaacgaggacgagaucccgccgcccguggcccugggcaagcgcccccuggcgccccaggagcccgccaaccggagccccgagaccgacccgcccgccccgcccgcccucgaguccgacaaccccagccagcccgagacgucccugcccgggaucagcgcccagcccguguccgaccuggaccccgacccccgcgcccuccugagcucccggcagcgcgaguacaaggucgccgcgcugagcgccaagcgggccggcgagcucgaccgcgcccgggagcugaugcgcaucgggaagcgguucggcgccgugcuggaggcgcucgagaagggccagcccguggaccuguccgccaugccgcccgcccccgaggaccugaagccccagcaggccagccaggccccgaccgcgcccuccgucaucccgcccgccguggagcgcgugcagcccgucauggcccccgacgugcccgccacccccguggcgccgaccgagagccagacgguccucgacgcccugcagcagcgccugaacaaguaccgggaggccgggauccaggcccgcuccggcggggacgagcggaaggcccgcaugcacgagcggaucgcgaagcaguaccaggacgccauccgcgcccaccgggccggccgcaaggugaacuucgccgagcuccccgugccgcccggguucccgcccauccccggccuggagagcaccaugggcgucgaggaggacgcgguggccgccacccuggccgccgcggagaagcucgccagcgccgaggacuccgcccccgcggacaaggacgaggacgagccgcccgggcaccuccagggcgagccgcccgcccaggcccccguggccaagaagcccgcccggcccaccguccccagcucccagcgccugcccgagccccgggcgagcuccagcaaggagucccccagcccguccgugcgcgagcagcuggcccugcuggaggcccggaagcuccaguaccagcgcgccgcccugcaggcgaagcggagccaggaccuggagcaggccaaggccuaccugcgcgucgccaaguggcucgaggcccagaucauccaggcgcgguccgggcgccccguggaccugagcaagggccccugcgaccuggggcggugccuccgccccuga

SEQ ID NO: 27765 - RNA, 4863 nt, Artificial Sequence
  derived and/or modified sequence opt1 from CC2D2A__Homo_sapiens__NP_001073991
augaacccccgcgaggagaaggugaagaucaucaccgaggaguucaucgagaacgacgaggacgccgacaugggccggcagaacaagaacagcaagguccgccggcagccgcgcaagaagcagccccccaccgccgugcccaaggagaugguguccgagaagagccaccuggggaacccgcaggagcccguccaggaggagcccaagacgcggcuccuguccaugaccgugcgccggggcccccgcagccugccgcccauccccuccaccagccggaccggguucgcggaguucuccaugcgcggccggaugcgcgagaagcuccaggccgcccggagcaaggccgaguccgcccugcugcaggagauccccacgccgcgcccccggcgccuccggagccccuccaagaaggagcuggagaccgaguucgggaccgagcccggcaaggagguggagcgcacccagcaggaggucgacagccaguccuacagccgggugaaguuccacgacuccgcgcgcaagaucaagccgaagccccaggugccccccggcuucccgagcgccgaggaggccuacaacuucuucacguucaacuucgaccccgagcccgagggguccgaggagaagcccaaggcccggcaccgcgcgggcaccaaccaggaggaggaggagggggaggaggaggagccgcccgcccagggcgggggcaaggagauggacgaggaggagcugcucaacggcgacgacgccgaggacuuccugcuggggcucgaccacgucgccgacgacuucguggccgugcgccccgcggacuacgagagcauccacgaccggcugcagauggagcgcgagaugcuguucauccccucccggcagaccgucccgaccuacaagaagcuccccgagaacgugcagccccgcuuccuggaggacgagggccuguacacgggggugcggccggaggucgcccgcaccaaccagaacaucauggagaaccggcuccugaugcaggaccccgagcgccggugguucggcgacgacggccgcauccuggcccuccccaaccccaucaagccguuccccagccggccccccgugcugacccaggagcagagcaucaaggccgagcuggagacccucuacaagaaggccgugaaguacguccacuccagccagcacgugauccgcuccggggacccgcccggcaacuuccagcuggacaucgacaucagcgggcugaucuucacgcaccaccccugcuucucccgggagcacgugcucgcggccaagcuggcccagcuguacgaccaguaccucgcccgccaccagcggaacaaggccaaguuccugaccgacaagcugcaggcgcuccgcaacgccguccagaccggccuggaccccgagaagccgcaccagagccuggacaccauccagaagacgaucaacgaguacaaguccgagauccggcagacccgcaaguuccgggacgccgagcaggagaaggaccgcacccuccugaagaccaucaucaagguguggaaggagaugaagagccugcgcgaguuccagcgguucacgaacaccccccucaagcuggugcugcgcaaggagaaggccgaccagaaggccgacgaggaggcguacgaggccgagauccaggccgagaucuccgagcuccuggaggagcacaccgaggaguacgcccagaagauggaggaguaccggaccagccugcagcaguggaaggcguggcgcaagguccagcgggccaagaagaagaagcgcaagcaggccgccgaggagcaccccggggacgagaucgccgagcccuacccggaggaggaccucgugaagcccuccccccccgagccgacggaccgggcggucaucgagcaggaggugcgcgagcgggccgcccagagccgccggcgccccugggagcccacccuggugcccgagcugucccucgccggcagcgucaccccgaacgaccagugcccccgggccgaggugucccgccgggaggacgugaagaagcgcagcgucuaccugaaggugcuguucaacaacaaggaggugucccggaccgucagccgcccccugggcgcggacuuccgggugcacuucgggcagaucuucaaccuccagaucgugaacuggccggagucccugacgcugcaggucuacgagaccgugggccacagcagccccacccuccuggccgagguguuccugcccauccccgagaccacggucgugaccgggcgcgccccgaccgaggagguggaguucuccagcaaccagcacgucacccucgaccacgagggcgugggguccggcgugcccuucagcuucgaggccgacggcuccaaccagcugacccugaugacgagcgggaaggucucccacagcguggccugggcgaucggcgagaacgggaucccccucauccccccgcugucccagcagaacaucggcuuccggagcgcccugaagaaggccgacgccaucuccagcaucgggaccuccggccucaccgacaugaagaagcuggcgaagugggccgccgagagcaagcuggaccccaacgaccccaacaacgccccccucaugcagcugaucuccguggccaccagcggcgaguccuacgucccggacuucuuccgccuggagcagcuccagcaggaguucaacuucgugagcgaccaggagcugaaccgcagcaagcgguuccgccugcuccaccugcggucccaggaggugcccgaguuccgcaacuacaagcagguccccguguacgaccgggagaucauggagaagguguuccaggacuacgagaagcgccugcgggaccgcaacgucaucgagacgaaggagcacaucgacacccaccgggcgaucguggccaaguaccuccagcaggugcgcgagagcgucaucaaccgguuccugaucgccaagcaguacuuccugcucgccgacaugaucguggaggaggaggugcccaacaucuccauccuggggcugagccucuucaagcuggccgagcagaagcgcccgcugcggccccgccggaagggccgcaagaaggucaccgcgcagaaccucuccgacggggacaucaagcugcuggugaacaucgugcgggccuacgacauccccguccgcaagcccgccgugagcaaguuccagcagccgucccggagcucccgcauguucagcgagaagcacgccgccucccccagcaccuacucccccacgcacaacgcggacuacccccucggccaggugcugguccgcccguucguggaggugagcuuccagcggaccgucugccacaccaccacggccgagggccccaaccccuccuggaacgaggagcuggagcuccccuuccgcgccccgaacggggacuacagcaccgccucccugcagagcgugaaggacguggucuucaucaacaucuucgacgaggugcugcacgacgugcucgaggacgaccgggagcgcggcuccgggauccacacccggaucgagcgccacuggcugggcugcgucaagaugcccuucagcaccaucuacuuccaggcgcggaucgacgggacguucaagaucgacauccccccggugcugcucggcuacagcaaggagcgcaacaugauccuggagcggggcuucgacuccguccgcagccuguccgaggggagcuacaucacccucuucaucaccaucgagccccagcuggugcccggcgaguccauccgggagaaguucgagagccaggaggacgagaagcugcuccaggccaccgagaaguuccaggccgagugcgcccugaaguuccccaaccgccagugccugacgaccgugaucgacaucuccgggaagaccgucuucaucacccgguaccucaagccgcugaaccccccccaggagcugcucaacguguaccccaacaaccugcaggccacggcggagcugguggcccgcuacgucagccucaucccguuccugcccgacaccguguccuucggcgggaucugcgaccuguggagcaccuccgaccaguuccucgaccugcuggccggcgacgaggaggagcacgccgugcuccugugcaacuacuuccugagccucggcaagaaggccuggcugcugauggggaacgcgauccccgagggccccaccgccuacguccucacgugggagcaggggcgguaccugaucuggaacccgugcuccggccacuucuacgggcaguucgacaccuucugcccccugaagaacgugggcugccucaucggccccgacaacaucugguucaacauccagcgcuacgagagcccccugcggaucaacuucgacgugacccgcccgaagcuguggaaguccuucuucagccggucccuccccuaccccgggcugagcuccguccagcccgaggagcugaucuaccagcgcagcgacaaggccgccgccgcggagcuccaggaccggaucgagaagauccugaaggagaagaucauggacuggcgcccgcgccaccugacccgguggaaccgcuacugcacgagcacccuccggcacuuccugccccugcucgagaagucccagggcgaggacguggaggacgaccaccgcgccgagcugcugaagcagcucggggacuaccgguucagcggcuucccccugcacaugcccuacuccgaggugaagccgcugaucgacgccgucuacagcaccggggugcacaacaucgacgugcccaacgucgaguucgcccucgccguguacauccaccccuaccccaagaacgugcuguccgucuggaucuacguggcgagccugauccgcaaccgguga

SEQ ID NO: 27766 - RNA, 3408 nt, Artificial Sequence
  derived and/or modified sequence opt1 from CCAR1__Homo_sapiens__NP_001269889
auggcccaguucggcgggcagaagaacccgcccugggccacccaguucaccgcgacggccgugagccagcccgccgcccugggcguccagcagcccucccuccugggggccagccccaccaucuacacccagcagaccgcgcuggccgccgccggccucacgacccagaccccggcgaacuaccagcugacccagacggccgcccugcagcagcaggccgccgcggccgccgccgcccuccagcagcugcagcagccccagcagacccugcucacccagcccgcgguggcccugcccaccucccugagccucuccacgccgcagcccaccgcccagaucaccgugagcuaccccacgccccgcuccagccagcagcagacccagccgcagaagcagcgggucuucaccgggguggugaccaagcugcacgacaccuucggcuucgucgacgaggacguguucuuccagcuguccgccgugaagggcaagacgccccaggucggggaccgcgugcucguggaggccaccuacaaccccaacaugcccuucaaguggaacgcgcagcggauccagacccugccgaaccagaaccagagccagacccagccccugcucaagacgccgcccgccguccugcagcccaucgcgccccagaccaccuucggcgugcagacccagccccagccccagucccugcuccaggcccagaucagcgccgccuccaucacgccgcugcugcagacccagccccagccccuccugcagcagccccagcagaaggccgggcugcuccagccgcccgugcgcaucgucagccagccccagccggcccggcgccuggacccgcccucccgguucagcggccgcaacgaccgcggggaccaggugcccaaccggaaggacgaccggucccgcgagcgggagcgcgagcggcgccggagccgcgagcggagcccccagcgcaagcggucccgcgagcgcagcccccggcgcgagcgggagcgcagcccccggcgcgugcggcgcgucgugccccgguacaccgugcaguucagcaaguucucccuggacugcccgagcugcgacaugauggagcuccgccggcgcuaccagaaccuguacauccccuccgacuucuucgacgcccaguucaccugggucgacgcguucccccugagccggcccuuccagcucggcaacuacugcaacuucuacgugaugcaccgcgagguggagucccuggagaagaacauggccauccuggacccgcccgacgccgaccaccucuacagcgccaaggucaugcugauggccucccccagcauggaggaccuguaccacaaguccugcgcgcucgccgaggacccccaggagcugcgggacggcuuccagcacccggcccgccuggugaaguuccucgucgggaugaagggcaaggacgaggccauggccaucgggggccacuggagccccucccuggacggccccgaccccgagaaggacccgagcgugcugaucaagacggcgauccggugcugcaaggcccucaccgggaucgaccuguccgugugcacccagugguaccgcuucgccgagauccgguaccaccgccccgaggagacccacaagggccgcacgguccccgcccacguggagaccgugguccuguucuuccccgacguguggcacugccucccgacccggagcgagugggagacccugucccgcggguacaagcagcagcugguggagaagcugcagggcgagcggaaggaggccgacggggagcaggacgaggaggagaaggacgacggcgaggcgaaggagaucagcacccccacgcacugguccaagcucgaccccaagaccaugaaggucaacgaccugcgcaaggagcuggagagccgggcccucagcuccaagggccucaagagccagcugaucgcccgccucaccaagcagcugaagguggaggagcagaaggaggagcagaaggagcuggagaaguccgagaaggaggaggacgaggacgacgaccgcaagagcgaggacgacaaggaggaggaggagcggaagcggcaggaggagaucgagcgccagcggcgcgagcggcgcuacauccucccggacgagcccgccaucaucgugcaccccaacugggcggccaaguccgggaaguucgacugcagcaucaugucccugagcguccugcucgacuaccggcuggaggacaacaaggagcacuccuucgaggugagccuguucgccgagcuguucaacgagaugcugcagcgcgacuucggcgugcggaucuacaagucccugcucagccugcccgagaaggaggacaagaaggagaaggacaagaaguccaagaaggacgagcgcaaggacaagaaggaggagcgggacgacgagaccgacgagccgaagcccaagcgccgcaagagcggggacgacaaggacaagaaggaggaccgggacgagcgcaagaaggaggacaagcggaaggacgacuccaaggacgacgacgagacggaggaggacaacaaccaggacgaguacgaccccauggaggccgaggaggccgaggacgaggaggacgaccgcgacgaggaggagaugaccaagcgggacgacaagcgcgacaucaaccgguacugcaaggagcgccccagcaaggacaaggagaaggagaagacccagaugaucaccaucaaccgggaccugcucauggcguucgucuacuucgaccagucccacugcggcuaccugcuggagaaggaccucgaggagauccuguacacgcuggggcuccaccugagccgcgcccaggugaagaagcugcucaacaaggugguccugcgggagagcugcuucuaccgcaagcugaccgacaccuccaaggacgaggagaaccacgaggagagcgagucccuccaggaggacaugcugggcaaccggcugcuccugccgacccccacggugaagcaggagagcaaggacguggaggagaacgucggccugaucguguacaacggggccaugguggacgucggcucccuccugcagaagcuggagaaguccgagaaggugcgcgccgagguggagcagaagcuccagcugcuggaggagaagaccgacgaggacgagaagaccauccucaaccuggagaacuccaacaagagccuguccggggagcuccgggaggucaagaaggaccugagccagcugcaggagaaccucaagaucuccgagaacaugaaccugcaguucgagaaccagaugaacaagaccauccgcaaccugagcacggugauggacgagauccacaccgugcucaagaaggacaacgucaagaacgaggacaaggaccagaaguccaaggagaacggcgccagcguguga

SEQ ID NO: 27767 - RNA, 2772 nt, Artificial Sequence
  derived and/or modified sequence opt1 from CCAR2__Homo_sapiens__NP_066997
augagccaguucaagcgccagcggaucaacccccugccgggcgggcgcaacuucuccggcaccgccagcaccucccuccuggggcccccccccggccugcucacgccgcccguggccaccgagcugagccagaacgcgcggcaccugcaggggggcgagaagcagcgcgucuucaccggcaucgugaccucccuccacgacuacuucgggguggucgacgaggagguguucuuccagcugagcguggucaagggccggcugccccagcucggggagaaggugcuggugaaggccgccuacaaccccggccaggccgucccguggaacgccgugaaggugcagacgcuguccaaccagccccuccugaagagccccgcgcccccgcugcuccacgucgccgcccuggggcagaagcagggcauccugggcgcccagccccagcucaucuuccagccccaccgcauccccccgcuguucccccagaagccccugucccucuuccagaccagccacacccugcaccugucccaccucaaccgguuccccgcgcgcgggccgcacggccggcuggaccaggggcgcagcgacgacuacgacuccaagaagcggaagcagcgcgccggcggcgagcccuggggggccaagaagccccggcacgaccugcccccguaccgcgugcaccucacccccuacacgguggacagccccaucugcgacuuccuggagcugcagcggcgcuaccggucccuccugguccccagcgacuuccuguccgugcaccucagcuggcuguccgccuucccgcugagccagcccuucagccuccaccaccccucccgcauccaggugagcuccgagaaggaggccgcgccggacgccggcgccgagcccaucaccgccgacagcgaccccgccuacuccagcaagguccugcugcucuccagccccgggcuggaggagcuguaccggugcugcaugcucuucguggacgacauggcggagccgcgcgagacccccgagcacccccugaagcagaucaaguuccugcucggccggaaggaggaggaggccgugcuggucgggggcgaguggucccccagccuggacggccucgacccgcaggccgacccccaggugcuggugcgcaccgccauccgcugcgcccaggcgcagacggggaucgaccuguccggcugcaccaagugguggcgguucgccgaguuccaguaccugcagcccgggcccccgcgccggcuccagaccgucguggucuaccugcccgacguguggaccaucaugcccacgcuggaggagugggaggcccucugccagcagaaggccgccgaggcggcccccccgacccaggaggcccagggcgagaccgagcccaccgagcaggcccccgacgcgcuggagcaggccgccgacacgagccgccggaacgccgagacccccgaggccaccacccagcaggagacggacaccgaccugccggaggcgcccccccccccgcucgagcccgccgugaucgcccgccccgggugcgucaaccugucccugcacggcaucguggaggaccggcgcccgaaggagcggaucagcuucgaggugaugguccucgccgagcuguuccuggagaugcuccagcgcgacuucggcuaccggguguacaagaugcugcugucccuccccgagaagguggucagcccccccgagccggagaaggaggaggccgcgaaggaggaggccaccaaggaggaggaggccaucaaggaggagguggugaaggagcccaaggacgaggcccagaacgaggggcccgccaccgaguccgaggcgccccugaaggaggacggccugcucccgaagccccugagcuccgggggcgaggaggaggagaagccccgcggggaggccagcgaggaccugugcgagauggcccucgaccccgagcugcugcuccugcgggacgacggcgaggaggaguucgccggcgcgaagcuggaggacagcgagguccgcuccguggccagcaaccaguccgagauggaguucagcucccuccaggacaugccgaaggagcuggaccccagcgccgugcugccccucgacugccugcuggccuucgucuucuucgacgccaacuggugcggguaccuccaccggcgcgaccuggagcggauccugcucacgcugggcauccgccuguccgcggagcaggccaagcagcucgugagccggguggucacccagaacaucugccaguaccgcucccugcaguacagccgccaggaggggcuggacggcggccuccccgaggaggugcuguucgggaaccuggaccuccugccgccccccggcaaguccaccaagcccggggccgccccgaccgagcacaaggcccuggugagccacaacggcucccucaucaacgucgggagccugcugcagcgggcggagcagcaggacuccggccgccucuaccuggagaacaagauccacacgcuggagcucaagcuggaggagagccacaaccgguucuccgccaccgaggugaccaacaagacccuggccgccgagaugcaggagcuccgcgugcggcuggccgaggcggaggagacggcccgcaccgccgagcggcagaagagccagcugcagcgccuccugcaggagcugcggcgccggcucaccccccugcagcuggagauccagcgcgucguggagaaggccgacagcuggguggagaaggaggagcccgcgcccuccaacuga

SEQ ID NO: 27768 - RNA, 1221 nt, Artificial Sequence
  derived and/or modified sequence opt1 from CCBE1__Homo_sapiens__NP_597716
auggugcccccgccgcccagccgcggcggggccgcccggggccagcuggggcgcucccucggcccccugcugcuccugcuggcccucgggcacaccuggaccuaccgggaggagcccgaggacggcgaccgcgagaucugcagcgaguccaagaucgccacgaccaaguaccccugccucaagagcuccggcgagcugacgaccugcuaccggaagaagugcugcaagggguacaaguucguccugggccagugcauccccgaggacuacgacgugugcgccgaggcccccugcgagcagcagugcaccgacaacuucgggcgcgugcugugcacgugcuacccgggcuaccgguacgaccgcgagcggcaccgcaagcgggagaagcccuacugccuggacaucgacgagugcgccagcuccaacgggacccucugcgcgcacaucugcaucaacacccugggcagcuaccgcugcgagugccgggagggcuacauccgcgaggacgacgggaagaccugcacccggggcgacaaguaccccaacgacaccgggcacgagaaguccgagaacauggucaaggccgggaccugcugcgccacgugcaaggaguucuaccagaugaagcagaccgugcugcagcucaagcagaagaucgcccugcugcccaacaacgcggccgaccucggcaaguacaucaccggcgacaaggugcuggccagcaacaccuaccugccgggcccgcccgggcuccccggcgggcagggcccgcccggcucccccgggcccaagggcagccccggguuccccggcaugcccgggcccccgggccagcccggcccccgcggguccaugggccccauggggccgagccccgaccugucccacaucaagcagggccggcgcgggcccgucggcccgcccggcgcccccgggcgggacggcagcaagggggagcgcggcgcccccggcccgcgggggucccccggcccgcccgggagcuucgacuuccugcuccugaugcuggcggacauccgcaacgacaucacggagcuccaggagaagguguucggccaccgcacccacuccagcgccgaggaguucccccugccccaggaguuccccagcuaccccgaggccauggaccugggguccggcgacgaccacccgcggcgcaccgagacccgggaccuccgcgcgccccgggacuucuaccccuga

SEQ ID NO: 27769 - RNA, 1119 nt, Artificial Sequence
  derived and/or modified sequence opt1 from CCBL1__Homo_sapiens__NP_001116144
auggccaagcagcugcaggcccgccggcucgacggcaucgacuacaaccccuggguggaguucgucaagcuggcgagcgagcacgacguggugaaccuggggcagggcuucccggacuucccgccgcccgacuucgccgucgaggccuuccagcacgccguguccggggacuucaugcucaaccaguacaccaagaccuucgugaucaucaucgagcccuucuucgacugcuacgagcccaugacgaugauggccggcgggcgccccgucuucgugagccugaagcccggccccauccagaacggcgagcugggguccagcuccaacuggcagcucgaccccauggagcuggcgggcaaguucaccagccggaccaaggcccuggugcucaacacccccaacaacccccuggggaaggucuucucccgcgaggagcuggagcucguggccagccugugccagcagcacgacguggucugcaucacggacgagguguaccaguggaugguguacgacggccaccagcacaucuccaucgccagccugccggggaugugggagcggacccucaccaucggcuccgcgggcaagaccuucagcgccacgggguggaaggucggcugggugcuggggcccgaccacaucaugaagcaccuccgcaccgugcaccagaacuccgucuuccacugccccacccagagccaggccgccguggccgaguccuucgagcgggagcagcugcuguuccgccagcccagcuccuacuucgugcaguucccgcaggcgaugcagcggugccgcgaccacaugauccggagccugcaguccgucggccucaagcccaucaucccccagggcagcuacuuccugaucaccgacaucagcgacuucaagcgcaagaugcccgaccugccgggggccguggacgagcccuacgaccggcgcuucgugaaguggaugaucaagaacaagggccucgucgccauccccguguccaucuucuacagcgucccccaccagaagcacuucgaccacuacauccgguucugcuucgugaaggacgaggccacgcugcaggccauggacgagaagcugcgcaaguggaagguggagcucuga

SEQ ID NO: 27770 - RNA, 882 nt, Artificial Sequence
  derived and/or modified sequence opt1 from CCDC101__Homo_sapiens__NP_612423
auggcccuggugagcgccgacucccgcaucgcggagcuccugaccgagcugcaccagcucaucaagcagacccaggaggagcggagccgcuccgagcacaaccuggucaacauccagaagacgcacgagcggaugcagaccgagaacaagaucagccccuacuaccgcaccaagcugcggggccucuacaccacggccaaggccgacgccgaggccgagugcaacauccugcgcaaggcgcuggacaagaucgccgagaucaagucccuccuggaggagcggcgcaucgccgccaagaucgcggggcuguacaacgacagcgagccgccccggaagaccaugcgccggggcgugcucaugacccugcugcagcaguccgccaugacccucccccuguggaucgggaagcccggcgacaagcccccgccccugugcggggccauccccgccagcggcgacuacguggcccgccccggcgacaaggucgcggcccgggugaaggccguggacggggacgagcaguggauccucgccgaggucguguccuacagccacgccacgaacaaguacgagguggacgacaucgacgaggagggcaaggagcgccacacccugucccggcgccgggucaucccccugccccaguggaaggcgaaccccgagaccgacccggaggcccucuuccagaaggagcagcuggugcuggcccucuacccccagaccacgugcuucuaccgcgcccugauccacgccccgccccagcggccccaggacgacuacagcgugcuguucgaggacaccuccuacgcggacggguacagcccgccccucaacgucgcccagcgcuacgugguggccugcaaggagcccaagaagaaguga

SEQ ID NO: 27771 - RNA, 1542 nt, Artificial Sequence
  derived and/or modified sequence opt1 from CCDC102B__Homo_sapiens__NP_001087198
augaaccuggacagcauccaccgccugaucgaggagacccagaucuuccagaugcagcaguccagcaucaagucccggggcgacaugguggcccccgccagcccgccccgcgacacgugcaacacgugcuucccccugcacgggcugcagucccacgcggcccacaacuucugcgcccacagcuacaacaccaacaagugggacaucugcgaggagcuccggcugcgcgagcuggaggaggucaaggcccgggccgcgcagauggagaagaccaugcgcuggugguccgacugcaccgccaacuggcgggagaaguggagcaaggugcgcgccgagcggaacuccgcccgcgaggagggccggcagcuccgcaucaagcuggagauggcgaugaaggagcugagcacccucaagaagaagcagucccugcccccgcagaaggaggcccuggaggccaacgugacccaggaccucaagcugcccggguucgucgaggagagcugcgagcacaccgaccaguuccagcuguccagccagaugcacgaguccauccgggaguaccucgugaagcgccaguucagcaccaaggaggacacgaacaacaaggagcagggcguggucaucgacucccugaagcugagcgaggagaugaagcccaaccucgacgggguggaccuguucaacaacggcggcuccgggaacggcgagaccaagaccgggcugcggcucaaggccaucaaccugccccuggagaacgaggugaccgagaucagcgcccuccagguccaccuggacgaguuccagaagauccuguggaaggagcgcgagaugcggacggcgcucgagaaggagaucgagcgccuggagagcgcccugucccucuggaaguggaaguacgaggagcugaaggagagcaagccgaagaacgugaaggaguucgacauccugcucggccagcacaacgacgagaugcaggagcuguccgggaacaucaaggaggagagcaagucccagaacagcaaggaccgggugaucugcgagcugcgcgccgagcucgagcggcugcaggccgagaacaccuccgagugggacaagcgcgagauccuggagcgcgagaagcagggccucgagcgggagaaccgccggcugaagauccaggucaaggagauggaggagcugcucgacaagaagaaccgccugagcgccaacucccagagccccgacuucaagaugucccagaucgaccugcaggagaagaaccaggagcuccugaaccugcagcacgcguacuacaagcucaaccggcaguaccaggccaacaucgccgagcugacccacgccaacaaccgcguggaccagaacgaggccgaggugaagaagcugcggcugcgcgucgaggagcucaagcagggccugaaccagaaggaggacgagcuggacgacagccucaaccagauccggaagcugcagcgcucccuggacgaggagaaggagcggaacgagaaccucgagaccgagcugcgccaccuccagaacugguga

SEQ ID NO: 27772 - RNA, 297 nt, Artificial Sequence
  derived and/or modified sequence opt1 from CCDC103__Homo_sapiens__NP_001245326
auggagcgcaacgacaucaucaacuucaaggcccuggagaaggagcuccaggccgcgcugaccgccgacgagaaguacaagcgggagaacgccgccaagcugcgcgccguggagcagcgggucgcgagcuacgaggaguuccgcggcaucgugcucgccucccaccugaagccccuggagcggaaggacaagaugggcgggaagcgcaccgugccguggaacugccacacgauccaggggcggaccuuccaggacgucgccaccgagaucagccccaacuccuggaaguccagcuga

SEQ ID NO: 27773 - RNA, 1500 nt, Artificial Sequence
  derived and/or modified sequence opt1 from CCDC105__Homo_sapiens__NP_775753
augcgcgugcuggugcccccggccgagcggagccaggacacccgcgucggcgcccccgcguggcgggaggccgcccaggccauggcccgcaccgcgcacauccucaccgaccggugcgggcaggaggccgugaccauguggcagcccaaggacuccguccuggaccccaacguggcccaccaccugggccgcgccgcguacauccagccguggcgguuccgcguggagaugaucaagggcggcgggacccucgagaagcccccgcccggggagggcgucacccuguggaaggggaagaugaagccgcccgccugguacgcccggcugccccucccccugcaccgcaaggcccgggcccugcagacgaccgagguggugcacgcgcacgcccgcggcgcccggcucaccgccgcccgccuggggcgggcgcagcaccagaucaacggccgcguccggcagcugcuccgccagcgggaggugaccgaccaccgccugagcgaggugcggaaggggcugcucaucaaccagcaguccgucaagcugcgcggcuaccgccccaagagcgagaaggugcccgacaaggccgacuccaugcugacgugggagaaggaggagcucaagagcaugaagcggaagauggagcgcgacauggagaaguccgaggugcugcugaagacccucgccagcugccgggacacccugaacuucugcuucaaggagcgccugcaggccgucgaccucaugaaccagccccuggacaaggugcuggagcaggcccggcgccacuccugggugaaccucagccgggcgcccaccccgcgcacgcagggccagaagaccccgccgcccgaccccgucgggaccuacaaccccgccugcgcccuggcccugaacgaggccaagcggcuccugguggaguccaaggacacccugguggagauggcgaagaacgaggucgacgugcgcgagcagcagcuccagaucagcgaccgggugugcgccucccuggcccagaaggccagcgagacgcuggagcucaaggagcgccugaacaugacccugggccucaugcgggggaccauccugcgcugcaccaaguacaaccaggagcuguacacgacccacggccucaucaagggcccccuguccaagguccaccuggagaccgcggagaagcucgaccggccccuggugcgcauguaccagcggcacgucgggacccagcugcccgaggccgcccgccucgcccagggcacggacaagcugcagugccacaucaccuaccuggagaagaaccuggacgagcuccuggccacccacaagaaccugagcugggggcucaacugcaagaacaucggccacgagguggacgggaacgugguccggcugcgccugcgccagcggcagccccacgugugcuacgagcaggcgcagcgccucgugaaggacugggacccccggacgcccccgccccgcuccaagagcuccgccgaccccuga

SEQ ID NO: 27774 - RNA, 2355 nt, Artificial Sequence
  derived and/or modified sequence opt1 from CCDC108__Homo_sapiens__NP_001265224
auggagaccgccaucuggcgccggagcuacaucucccugaucagcuccgagcgccccgugcacaacuggcggggcaagagcguccagaagaagcaggccgaguccaagagccagaucaagcuccacacccaguccgcgcccuucgggcugugccccaaggacaugaugcugacgcaggcccccagcuccguggugcgcagccggaacucccgcaaccacaccgucaacagcggcggguccugccucagcgccuccaccguggccauccccgccaucaacgacagcuccgcggccaugagcgccugcuccaccaucagcgcccagccggcgagcuccauggacacgcagaugcacagccccaagaagcaggagcgggugaacaagcgcgucaucuggggcaucgagguggccgaggagcugcacuggaaggggugggagcugggcaaggagaccacccggaaccucgugcugaagaaccgcucccugaagcuccagaagaugaaguaccggccgcccaagaccaaguucuucuucacggucaucccccagcccaucuuccugagccccggcaucacccugacccuccccaucguguuccgcccgcuggaggccaaggaguacauggaccagcugugguucgagaaggccgaggggauguucugcgugggccuccgggccacccugcccugccaccgccugaucugccggccgcccucccuccagcugcccaugugcgcggucggggacacgaccgaggccuucuucugccuggacaacgugggcgaccuccccaccuucuucaccugggaguucagcucccccuuccagaugcugcccgccacggggcugcucgagccgggccaggccagccagaucaaggugaccuuccagccccugaccgccgucaucuacgaggugcaggcgaccugcugguacggcgccgggucccgccagcggagcuccauccagcugcaggccguggccaagugcgcccagcuccuggucagcaucaagcacaagugccccgaggaccaggacgcggagggcuuccagaagcugcucuacuucggguccguggccgugggcugcacgagcgagcgccagauccggcugcacaaccccuccgccgucaacgccccguuccgcaucgagaucagccccgacgagcuggccgaggaccaggcguucuccugccccaccgcccacggcaucgugcuccccggggagaagaagugcgugagcgucuucuuccacccgaagacccuggacacccggacgguggacuacugcuccaucaugcccagcggcugcgccagcaagacccugcucaaggucgugggguucugccgcggccccgccgugucccugcagcacuacugcgucaacuucagcugggugaaccugggggagcgcuccgagcagccgcucuggaucgagaaccagagcgacugcaccgcgcacuuccaguucgccaucgacugccuggaguccguguucaccauccggcccgccuucggcacgcuggucggcaaggcccgcaugacccuccacugcgccuuccagcccacccaccccaucaucugcuuccggcgcguggcgugccugauccaccaccaggacccgcuguuccucgaccugauggggaccugccacagcgacuccacgaagcccgccauccugaagccccagcaccucaccugguaccggacccaccuggcccgcggccugacccuguacccgcccgacauccucgacgccaugcugaaggagaagaagcuggcccaggaccagaacggggcgcucaugauccccauccaggaccuggaggacaugcccgcgccccaguacccguacaucccgcccaugacggaguucuucuucgacggcaccagcgacaucaccaucuucccgccgcccaucuccguggagcccgucgagguggacuucggggccugccccggccccgaggcccccaaccccgugccccugugccucaugaaccacaccaagggcaagaucauggucguguggacccggcgcagcgacugccccuucugggugacgcccgaguccugcgacgugcccccgcucaagagcauggccaugcggcugcacuuccagccgccccaccccaacugccuguacaccgucgagcuggaggccuucgccaucuacaaggugugcgcccgcaacgagcgggaggagugcggggucuccgcccgcagccuguccggccucgugggguggcaggaggugaccgagggcagcuuccggcugcacccccugcgcgcgcggcucucccugggguggaccgucacgcccaugagccugagcccgcccaagcuccuggccuga

SEQ ID NO: 27775 - RNA, 2013 nt, Artificial Sequence
  derived and/or modified sequence opt1 from CCDC114__Homo_sapiens__NP_653178
auggagggcgagcgccgggccuacagcaaggaggugcaccagcgcaucaacaagcagcuggaggagauccggcgccucgaggagguccgcggggaccugcagguccagaucuccgccgcgcagaaccaggugaagcggcugcgggacagccagcgccucgagaacauggaccggcugcugaagggccgcgcccagguccaggccgagaucgaggagcuccaggagcagacccgggcccuggacaagcagauccaggagugggagacccgcaucuucacgcacuccaagaacgugcggagccccggguucauccuggaccagaaggugaagauccgccggcgcauccggauccucgagaaccagcuggaccgcgugaccugccacuucgacaaccagcuggugcggaacgccgcgcuccgcgaggagcuggaccugcuccggaucgaccgcaaccgcuaccugaacguggaccggaagcugaagaaggagauccaccaccuccaccaccuggucuccacccugauccucagcuccaccagcgccuacgccgugcgcgaggaggccaaggcgaagaugggccugcugcgggagcgcgccgagaaggaggaggcccaguccgagauggaggcccaggugcuccagcggcagauccugcaccuggagcagcuccaccacuuccugaagcugaagaacaacgaccgccagccggaccccgacguccucgagaagcgggagaagcaggccggggagguggcggagggcguguggaagacgagccaggagcgccugguccugugcuacgaggacgcccucaacaagcugucccagcugaugggcgagagcgaccccgaccuccuggugcagaaguaccuggagaucgaggagcggaacuucgccgaguucaacuucaucaacgagcagaaccucgagcuggagcacgugcaggaggagaucaaggagaugcaggaggcccuggucuccgcccgcgcgagcaaggacgaccagcaccuccugcaggagcagcagcagaaggugcugcagcagcggauggacaaggugcacuccgaggccgagcgccucgaggcccgguuccaggacguccgcgggcagcuggagaagcugaaggccgacauccagcuccuguucaccaaggcccacugcgacagcuccaugaucgacgaccugcugggcgugaagaccagcaugggggaccgggacaugggccucuuccugucccugaucgagaagcgccucguggagcugcugaccguccaggcguuccuccacgcccagagcuucacgagccuggccgacgccgcccugcucgugcuggggcagucccuggaggaccuccccaagaagauggcgccgcugcagccgcccgacacccuggaggacccgcccggcuucgaggccagcgacgacuaccccaugucccgggaggagcuccugagccaggucgagaagcugguggagcuccaggagcaggccgaggcccagcgccagaaggaccuggcggccgccgccgccaagcuggacggcacccucuccguggaccuggcgagcacccagcgggccggguccagcacgguccuggugcccacccgccacccccacgccauccccggcuccauccucagccacaagaccucccgcgaccgggggagccugggccacgugaccuucggcgggcuguccagcuccacgggccaccuccccagccacaucacccacggggaccccaacaccggccacgucaccuucggguccacgagcgccuccagcggcggccacgugaccuuccgccccgugagcgccuccagcuaccugggguccaccggcuacgucgggagcucccggggcggggagaacaccgagggcggcguggagagcgggggcacggcguccgacagcuccgggggccuggggagcucccgcgaccacgugagcuccaccggcccggccagcuccaccggccccgggagcuccaccagcaaggacagccggggcuga

SEQ ID NO: 27776 - RNA, 543 nt, Artificial Sequence
  derived and/or modified sequence opt1 from CCDC115__Homo_sapiens__NP_115733
auggccgcccuggaccuccgcgcggagcuggacagccuggugcuccagcugcugggcgaccucgaggagcuggaggggaagcggaccguccugaacgcccgcguggaggagggcuggcucucccuggccaaggcccgguacgccaugggggccaagagcgugggcccccugcaguacgccucccacauggagccgcaggucugccuccacgccagcgaggcccaggaggggcugcagaaguucaagguggugcgcgcgggcguccacgcccccgaggaggugggcccccgggaggccgggcugcgccggcgcaagggccccaccaagacgccggagcccgaguccagcgaggcgccccaggacccccucaacugguucgggauccuggugccgcacucccugcggcaggcccaggcgagcuuccgcgacggccuccagcuggccgccgacaucgccucccugcagaaccggaucgacugggggcgcagccagcuccggggccugcaggagaagcugaagcagcucgagcccggcgccgcguga

SEQ ID NO: 27777 - RNA, 1323 nt, Artificial Sequence
  derived and/or modified sequence opt1 from CCDC121__Homo_sapiens__NP_001136155
augggcagccgcgggcagggcucccacagcaagaagacccgguccaugcccgugauccugagcccgcagcgcaccggguccggcgccaccgggggccccgccgcgcgggccuacagcgucgccgaggccgugaagcaguuccgcgccggccccgcggggacgggcgccgggugcucccuccagggcugcugggccgcgccccggccguucgagcaccgcaccaacaagcugcgggagcugagcacccucgcccacugcucccgcgagcugcagacccaggugcccgacgccagcgcccacucccuggccgucacgcucagcgagcugcacuccugccgggaccugcaggacgagugccucgacagccgcuucgccgaggggccccggcgccugcugcccccguaccacucccucaucaacaacuucgugaagcccgagaagcugaccaagguggagacccggcugaaggagaagaucgucgcggagaugacggaccucaacaagcacaucaagcaggcccagacccagcgcaagcagcugcuggaggagagccgggagcuccaccgcgagaagcugcuggugcaggccgagaaccgguucuuccucgaguaccugaccaacaagaccgaggaguacacggagcagcccgagaagguguggaacuccuaccugcagaaguccggcgagaucgagcgccggcgccaggagagcgccagccgguacgccgagcagaucagcguccucaagaccgcgcugcugcagaaggagaacauccaguccagccucaagcgcaagcugcaggccaugcgcgacaucgccauccugaaggagaagcaggagaaggagauccagacccuccaggaggagaccaagaaggugcaggccgagacggccuccaagacccgggaggugcaggcgcagcugcugcaggagaagcgccuccuggagaagcagcugagcgagcccgaccggcgccuccugggcaagcggaagcgccgggagcugaacaugaaggcccaggcccucaagcuggccgccaagcgcuucaucuucgaguacuccugcgggaucaaccgggagaaccagcaguucaagaaggagcugcuccagcugaucgagcaggcgcagaagcugaccgccacccagagccaccucgagaaccgcaagcagcagcugcagcaggagcagugguaccuggagucccucauccaggcccggcagcgccugcagggcagccacaaccagugccugaaccggcaggacgucccgaagacgacccccucccugccccaggggaccaagagccgcaucaaccccaaguga

SEQ ID NO: 27778 - RNA, 822 nt, Artificial Sequence
  derived and/or modified sequence opt1 from CCDC122__Homo_sapiens__NP_659411
augagcgacaacaaggagcgcaagucccagggcuuccccaaggaggacaaccaggacaccagcucccuggccgacgccguggagaaggucgcgaagcagcagcagagccaggccuccgagaucgagaagaacaagaagguccucuucaaccugaagaacgagcugcacgagcucgagaaggagaucgccgccaucagcgccgagaccaaggagacggagcggcagaucuaccagcaggacuccgcgaucgagaacaccaagcugcacugcgacagccuggagacccagaucaagucccuccacagcgagaacgugaagcugaaguucgacaucgagaccgcccaggaggacuucgaggagcacaugaucaaguacaacgccuacuacgccaagaucaaggcgcacaagaacucccugggggagguggagagcaagugguccuucaugacggagcuccacgagaagcgcgacuucgugaagaagcugaagaccaugaaggaggagcugaugcaggaccuccagaacccgggcgggaaccggaucacccaggugcaggaggacaucaccaaccugaaggacaagaucaucacggucaaggagagcaucaucgagaagaccugcuuccuggaggaggagaagaagacccacgagaagcuccgcaaggagaucgaggugcagcacaagcgguacgacgccauccugaagcgccugcacugccaggugaacaagcuccaguccaaccggcgccaguggcaguggaacauccagcagcuggagaagaccgccgccgagcugcggaagugcaucggcaugcaggaguga

SEQ ID NO: 27779 - RNA, 3165 nt, Artificial Sequence
  derived and/or modified sequence opt1 from CCDC129__Homo_sapiens__NP_001244896
augagcgugucccugcagaacuacagccccaugauggcccagaagucccagggcagcgacaaccuccaggaggggcaggagaaguccaagcgcgagauccugaagugcaccaagagcgccugggcgccgcuggacgaguggcucccgcccgaccccgaggaggagucccagagccugaccauccccaugcuggaggacuccaagcaggagagcauccagcaguggcucgacuccggcuucuucgucagcgccaacgagaacuuccagcaggucaucgaccggaccgugucccuguacgagcaggggaugguccagaugaccgugaaggacuacaugcgcagccugcaccaguucuccgagacccccauccucagccggggcaccuccuucaacagcugcuacuccacggccagcgugccccagagcauccccgaguggcuggaguucugggagaucgacccggucgagauccugcucgaccugggguucggcgccgacgagcccgacaucugcaugcagauccccgcccgcuuccugggcugcggguccgcggcccggggcaucaacauccgcguguuccucgaggcccagaagcagcggauggacaucgagaaccccaaccuguacgggcgcuuccggcagcuggagauccucgaccacgugaccaacgccuucagcucccugcugagcgacgucuccauccucccgaaccgcgcggaggagaaggccggcggggagagcgugcagcggaccuccgugagcgccgccaaggagcaccgccggcgcaugggcaagcugcugcggcgcgccuccaagcagaacauccggcgcgacugcaaccccgaggucagcgaguccuucaaggugaaggacgagguguucguccccuucaccaagcccugggacugcggcgcggagcucgccgccacgagcaucaaccacaagcagaaccaccugucccugagcguggagcaccagucccuccaggccugcgacgaccugcugccguacccgccccacgggcuccugagcaagcaguggcccugcuccagcaugcccgccaagcaggcgccgcccuccugcgugagcgagggcagcgugaaggggcggacccagaaggagaaccuguuccagaccaacaagcucaagucccugagccaccuggccggcaagggccccgacuccuucgagauggaggaggugcagagcuucgaggaggagaccgggaacccccucgacaugacguccggcaccgugggggcccgcgucgaccgggccaacagcugccaguccgacagcuccggcuuccuggaggagccccuggagccccucccccugcagaugccgagccugcccaacucccagagccccgccgagaacgggggccgcaagccgcgcgaccagucccacagccucguguccagccaggacugccagcuggaguccgacggccccgacagcaagagccgggcguccaugagcuucuccagccaggaggccaacgcccuggagcagcgcgccuccgugagcgucauggaggaggaguuccuccuggaggccauggaggggccgcccgagcuguacauccccgacauggcgugcgccaagaccaccacgcggggcgagugcccccgcaaggacucccaccucuggcagcugcugcccaugccccacgccgaguacgaggugacccggccgaccgccaccagcaaguacgaccacccccugggguucauggucacgcacgugaccgagaugcaggacuccuucgugcgccccgagggcgcggggaagguccagagccaccacaacgagucccagcggagccccggcaacgaccacacccaggacaaguuccuccacguggacuccgaggccccgcgcgaggaggagagcuccggcuucugcccccacaccaaccacagccugcuggugcccgaguccagcucccagugcauccccaagcacagcgagaucacgccguacgccaccgaccucgcccagaccagcgagaagcugaucccccaccuccacaagcugcccggggaccccgcccaggucaagucccggagcggcacccuggggcagauccugccgggcacggaggcggagauggagaaccucccccugaacaccggguccagccgcuccgugaugacccagaugagcuccagccugguguccgccgcccagcgggccgucgcccucggcaccggcccccgcgggacgagccuggagugcaccgugugcgaccccgugaccgcgaccgagacgcggcugggcaccaaggcccgccagcucaacgacgccuccauccagaccagcgcccuguccaacaagacccugacccacgggccgcagccccucaccaagagcgucucccuggacagcggcuucuccagcaucugccccauggggacgugccacgccaucccggcgcacugcugcaucugcugccaccaccacccccacugccacggcgagcggcagucccccggccccgagccgagcgugugccgccacugccugugcagccucaccgggcaccaggaggcccaguucaugaccacgcugaaggcccugcaggacaccaccgugcgggagcucugcuccugcaccguccacgagauggaggccaugaagacgaucugccagagcuuccgcgaguaccuggaggagaucgagcagcaccugaugggccagcaggcccucuucucccgggacaugagcgaggaggagcgcgaggaggcggagcagcugcagacccugcgcgaggcccuccggcagcaggucgccgagcuggaguuccagcugggggaccgcgcccagcagauccgggagggcauccuccugcagcuggaggugcucaccgcggagccgcccgagcacuacuccaaccugcaccaguacaacuggaucgaggagagcaacggccagaccuccugcagcaagauccaccccgggauggcgccccgcacgguguucccgcccgacgacggccaggaggcccccugcuccgggggcacccagcuggccgccuucaccccgcccacccucgagaacagcacgcggaugucccccagcuccagcgccugggccaagcuggggcccacgccccuguccaacugccccgugggcgagaaggacgccgacguguuccucuga

SEQ ID NO: 27780 - RNA, 1191 nt, Artificial Sequence
  derived and/or modified sequence opt1 from CCDC130__Homo_sapiens__NP_110445
augggcgagcgcaagggggugaacaaguacuacccgcccgacuucaaccccgagaagcacggcagccugaaccgguaccacaacucccacccccuccgcgagcgggcccgcaagcugagccaggggauccugaucauccgguucgagaugcccuacaacaucuggugcgacggcugcaagaaccacaucgggaugggcguccgcuacaacgccgagaagaagaaggugggcaacuacuacaccaccccgaucuaccgguuccgcaugaagugccaccucugcgugaacuacaucgagaugcagacggaccccgcgaacugcgacuacgucaucguguccggggcccagcggaaggaggagcgcugggacauggccgacaacgagcagguccugaccaccgagcacgagaagaagcagaagcuggagaccgacgccauguuccggcucgagcacggcgaggccgaccgcagcacgcugaagaaggcgcugcccacccucucccacauccaggaggcccagagcgccuggaaggacgacuucgcccugaacuccaugcugcggcgccgguuccgcgagaagaagaaggcgauccaggaggaggaggagcgggaccaggcccuccaggccaaggccagccugaccaucccccuggugccggagaccgaggacgaccgcaagcucgccgcgcugcugaaguuccacacgcucgacuccuacgaggacaagcagaagcugaagcggaccgagaucaucagccgcuccugguuccccagcgcccccggguccgccagcuccagcaagguguccggcgugcugaagaagcucgcccagagccggcgcaccgcccuggcgaccucccccaucacggucggggaccugggcaucgugcgccggcgcagccgggacgugccggagagcccccagcacgccgccgacacccccaaguccggcgagccccgcgucccggaggaggccgcccaggaccggcccaugagccccggggacugcccgcccgagaccaccgagacgcccaagugcuccagcccccgcggccaggaggggucccggcaggacaagccccucagcccggcgggcuccagccaggaggccgccgacacccccgacacccgccaccccugcucccugggcagcucccugguggccgacuacagcgacuccgagagcgaguga

SEQ ID NO: 27781 - RNA, 351 nt, Artificial Sequence
  derived and/or modified sequence opt1 from CCDC134__Homo_sapiens__NP_001291726
auggaccugcuccaguuccuggccuuccuguucgugcuccugcugagcggcaugggggccaccggcacccuccgcacgucccuggaccccagccuggagaucuacaagaagauguucgaggucaagcggcgcgagcagcuccuggcgcugaagaaccucgcccagcugaacgacauccaccagcaguacaagauccuggacgugaugcucaaggggcuguucaaguucaucccguccaccgaccccuuccagaaggcccugcgggaggaggagaagcgccggaagaaggaggagaagcgcaaggagauccggaagggcccccgcaucagccggucccagagcgagcucuga

SEQ ID NO: 27782 - RNA, 1305 nt, Artificial Sequence
  derived and/or modified sequence opt1 from CCDC136__Homo_sapiens__NP_001188301
auggaggccggcgccggggcgggcgccggggccgccggcuggagcugccccgggccgggccccaccgugaccacgcugggcuccuacgaggccagcgaggggugcgagcgcaagaagggccagcggugggggucccucgagcgccggggcaugcaggcgauggagggggagguccugcugcccgcccucuacgaggaggaggaggaggaggaggaggaggaggaggagguggaggaggaggaggagcagguccagaagggcggcagcguggggucccugagcgugaacaagcaccgcggccugucccucaccgagaccgagcuggaggagcugcgggcccaggugcuccagcuggucgccgagcuggaggagacccgcgagcucgcggggcagcacgaggacgacagccuggagcugcagggccuccuggaggacgagcggcuggccuccgcccagcaggccgagguguucacgaagcagauccagcagcuccagggcgagcugcgcagccugcgggaggagaucucccuccuggagcacgagaaggagagcgagcugaaggagaucgagcaggagcuccaccuggcccaggcggagauccagucccugcgccaggccgccgaggacagcgccaccgagcacgaguccgacaucgccagccuccaggaggaccugugccggaugcagaacgagcuggaggacauggagcgcauccgcggggacuacgagauggagaucgcgucccuccgggccgagauggagaugaaguccagcgagcccagcgaggagcugcaggagcugcgggagcgcuaccacuuccucaacgaggaguaccgggcccugcaggagagcaacuccagccugaccggccagcucgccgaccuggaguccgagcgcacccagcgggccacggagcgcuggcugcagagccagacccucuccaugaccagcgcggagucccagaccagcgagauggacuuccuggagccggaccccgagaugcagcugcuccggcagcagcugcgcgacgccgaggagcagaugcacgggaugaagaacaagugccaggagcugugcugcgagcucgaggagcugcagcaccaccgccagguguccgaggaggagcagcggcgccugcagcgggagcucaagugcgcccagaacgagguccugcgcuuccagacgagccacuccgugacccagagcucccccacccccaacccgcccaucuucagccugccccuggugggccucgucgugaucuccgcccugcuguggugcuggugggccgagaccagcuccuga

SEQ ID NO: 27783 - RNA, 492 nt, Artificial Sequence
  derived and/or modified sequence opt1 from CCDC140__Homo_sapiens__NP_694583
augggcgacgagugcagcaaccccgaccugcucgccgagccgggguccagcccgcccugggaccacggcaaccagcgccaggaggccgcgaacgaguccaacacccgggugccccgcguccugaaggcccaccuggggcccgagaccgcccagcccacgaagcggagcaagcgcaaccgguggcgccggcaguccugccagggccccagccccgcccgcuccgggcaguuccucggcagcgccgaccugggccugcagcgcggggugcucaaguccgcggcccggaccugccugagcgagaucuccaacagcacccgggccuccccggagagcgcccaguccaccgaccccggccgcgcggcccggccccgcacgcggacccugcccaccccgcacagcuucaagaucggggaggaggccgaggagaugaagaagaagaaggagcgcaagcggcgcaaggagcggaagaaggagcgcaacuucaagaaguga

SEQ ID NO: 27784 - RNA, 4593 nt, Artificial Sequence
  derived and/or modified sequence opt1 from CCDC141__Homo_sapiens__NP_775919
augagcucccagggcagccccuccguggcccugagcaccaccacggucuccagcguggccgugcaggcgggggacuccaagaucgucaucgccgugaucaagugcggcaagugggugcagcuccagcuggccgagagccagccgaaccugcucgagaucggguccagccaggacgagaccaagaagcugcugcacgaccacgagcuccugcuggccaagcucaaggcccuggaggaccgcgucugggagcugcuccaggaggcggacaagaccgccgaggagaacaaggaccagucccagguguacgacgccauggccgagacccugggcgaggcgugggccgcccuggugagcaugcucgagcggcgcacggagcugcugcggcucaccuccgaguucuucgagaacgcccuggaguucgccaucaagaucgaccaggcggaggacuuccugcagaacacccacgaguucgagagcgccgagucccucaagagccugcugcagcuccacgagcaccacaccaaggagcugcuggagcgcucccucgcccugcugaacaagagccagcagcucacggacuucaucgagaaguucaagugcgaggggcccaacgucaaccccgagcugacccagggcgcccacuccagcugccugaagguggaccggcuccuggagcugcuccaggaccgccggcgccagcuggacaaguaccugaagcagcaguggcaggagcucagccaggugcugcagaucugccagugggaccagcaggagaaccaggugaccugcugguuccagaagaccauccggaaccugcaggagcagucccucggcagcucccugagcgacaacgaggaccgcauccacaagcaggaggagcugaucaucaaggccaaggaguggaacuccgcggucgagaagcucaagagcgaggcccugcggauccugcucuccaaggacuacguggagaaggagcaccuccagcugagccaccagaagcugucccagcuccaggaggaguucgggcagcugauggucgagcgcaacacguggcugaagaaggccaacgaguucuucaacagcgccaacaaggccuucgacgugcucggccggguggaggcguaccugaagcugcucaaguccgaggggcugagccuggccguccucgccgugcgccacgaggagcugcaccggaagaucaaggacugcaccaccgacgcccugcagaagggccagacccucaucucccagguggacagcugcuccagccaggucuccgggauccacgagaugaugggcugcaucaagcgccggguggaccaccugacggagcagugcagcgcccacaaggaguacgcgcugaagaagcagcagcucaccgccuccguggagggcuaccugcgcaaggucgagaugagcauccagaagaucagccccgugcuguccaacgccauggacgucgggagcacccgguccgagagcgagaagauccucaacaaguaccuggagcuggacauccaggccaaggagaccucccacgagcucgaggcggccgccaagacgaugauggagaagaacgaguucgugagcgacgagauggugucccugagcuccaaggcccgcuggcuggccgaggagcucaaccuguucggccagagcaucgacuaccggucccagguccugcagaccuacguggcguuccucaagagcuccgaggagguggagaugcaguuccagagccugaaggaguucuacgagaccgagaucccgcagaaggagcaggacgacgccaaggccaagcacugcuccgacagcgccgagaagcaguggcagcuguuccucaagaaguccuucaucacccaggaccuggggcuggaguuccucaaccugaucaacauggccaaggagaacgagauccuggacgucaagaacgagguguaccucaugaagaacacgauggagaaccagaaggcggagcgcgaggagcugagccugcuccgccuggccuggcagcugaaggccaccgagagcaagcccggcaagcagcagugggccgccuucaaggagcagcucaagaagaccucccacaaccugaagcugcuccaggaggcgcugaugcccgugagcgcccuggaccucggcgggucccugcaguucauccuggaccuccggcagaaguggaacgacaugaagccccaguuccagcagcugaacgacgagguccaguacaucaugaaggagagcgaggagcugaccggccgcggggccccggugaaggagaagucccagcagcucaaggaccugauccacuuccaccagaagcagaaggagcggauccaggacuacgaggacauccuguacaaggugguccaguuccaccaggugaaggaggagcucggccgccugaucaagagccgggagcuggaguucguggagcagcccaaggagcucggggacgcccacgacguccagauccaccuccgcugcucccaggagaagcaggcgcggguggaccaccuccaccgccuggcccugagccugggcguggacaucaucuccagcguccagcggccccacugcuccaacgugagcgccaagaaccugcagcagcagcuggagcugcucgaggaggacuccaugaaguggcgcgccaaggccgaggaguacggccggacgcugagccgcuccguggaguacugcgcgaugcgggacgagaucaacgagcugaaggacagcuucaaggacaucaagaagaaguucaacaaccucaaguucaacuacaccaagaagaacgagaagucccgcaaccugaaggcccugaaguaccagauccagcaggucgacauguacgccgagaagaugcaggcccucaagcggaagauggagaaggugagcaacaagaccuccgacagcuuccugaacuaccccagcgacaaggugaacguccugcucgaggugaugaaggaccugcagaagcacguggacgacuucgacaaggucgugaccgacuacaagaagaaccuggaccucacggagcacuuccaggaggugaucgaggagugccacuucugguacgaggacgccuccgcgaccgucgugcgcguggggaaguacagcaccgagugcaagaccaaggaggccgucaagauccugcaccagcaguucaacaaguucaucgccccguccgugccccagcaggaggagcggauccaggaggccacggaccuggcccagcaccucuacggccuggaggaggggcagaaguacaucgagaagaucgugaccaagcacaaggagguccuggagagcgugaccgagcucugcgagucccugaccgagcuggaggagaagcucaagcagggcgacgugcugaagaugaaccccaaccuggaggacuuccacuacgacuacaucgaccuccugaaggagcccgcgaagaacaagcagaccaucuucaacgaggagcgcaacaaggggcagguccagguggccgaccugcugggcaucaacggcacgggggaggagcggcucccgcaggaccugaaggugagcaccgacaaggagggcgggguccaggaccugcuccugcccgaggacaugcuguccggcgaggaguacgagugcgugagccccgacgacaucucccugcccccgcugcccgggagccccgagagcccccuggccccgagcgacauggagguggaggagcccgucuccagcucccucagccugcacaucuccagcuacggcgugcaggccggcaccuccagccccggggacgcgcaggagagcgugcugcccccgcccgucgccuucgccgacgccugcaacgacaagcgcgagaccuucuccagccacuucgagcgccccuaccuccaguucaaggccgagccgccccugacgucccggggcuucguggagaaguccaccgcgcugcaccgcaucuccgccgagcaccccgagagcaugauguccgaggugcacgagcgggcccuccagcagcacccccaggcccagggcgggcugcuggagacccgcgagaagaugcacgccgacaacaacuucaccaagacgcaggaccggcuccacgcgagcuccgacgccuucagcggccugcgcuuccaguccgggaccagccggggcuaccagcgccagauggucccgcgggaggagaucaaguccaccagcgccaaguccagcguggucucccuggccgaccaggcccccaacuucagccgccuccuguccaacgugaccgugauggaggggagccccgucacgcuggagguggaggugaccggcuuccccgagccgacccucaccugguacaagaaggggcagaagcugagcgcggacggccaccuccagguccugcacaaggagacgcggcacuccguguucauccccaaggugugcaaggccgacgccggccuguacgucgcccgcgcccagaacagcuccggggcgcugagcuccaacgugauccuccacgugaccggcaacugccggcugcccaucacccgcgucaacuggaucacccugugcgugguguacgucagcgugucccucauguacuggcugcugacgcaguga

SEQ ID NO: 27785 - RNA, 1338 nt, Artificial Sequence
  derived and/or modified sequence opt1 from CCDC148__Homo_sapiens__NP_001288613
augaagcgcacccuggagaugaacguguucgucacccuccagauccugguggacuucgugaagaagcagcugaagacggucuucgagcggcuccgccuggagcagcagcggaucgagaacgaccugagcgacugguccaucaagauccucgaccacagccuggaggagaagaccaacccccuguccgagcuccccaucgagcuggagagccuggagugccccuaccccgaccucaaguccagcauccuguccgaguucuacaaguucacccagaaguaccagaagaagcugcaggacuucaaccuccagcuggaggacaucuaccgcaacugccagcugagcgaggaggaccacuggaucuaccaggccauccucgaccaguaccccggcgaccuguucgggcggcgcacccuguaccucgacaugcugcagcgguacuucccgcacaagucccgccacgaccugguggagcacgagaaguacugcgaccaguaccgguucgccaucgagcagcagaacauccucaucagcaacuggaacaagaacaagaaggacuucauccagaaggcggugcugacgcugaccgaggccugcgccacccacgagauggaguccaugcucgccaaggacaagaagaagcagcaggagcugugcgccgaccugaaggcgaagguccgccaguggcgggcccaccaggaggagguggcccgccucgagauggagaucagcgcccggcgccgggagaaggaggaggagaaggagaagcuguggaagaagaaggagcugcuccagcgcgcggagaagaagaagaagaucaagaaguacugggccaagaagaagcagaaguggcaggagauggagaugcgggaccugcagcgccuggaggagcucaagaagcugaucgccgagcagucccugaaggaccgggagcgcgugaaguaccggcaggagcuccuggagcgccgccugauggagaagaaggaggucgcccuccaggaggcccacgaggacaaggagcgggcgcgccggcuggaggcccugcgcaagcaggucgccgugguggcccaguucgaccccgugcggaugaugagcgacaccauggccuccaaggcgcgcaugggcaucgagaucgaggaggaguucauccuccagaagccccuguucacgcugaacaccuacaacgagcagcagaucaucagcgacccccggcuccgcuucgagcuggcccugcgggaggccgggcugcaccgcacccucuacgccaaggagauccugccgaagaucagcccccagaagccgccccggaaggacauggaguccaccguguucaagaucuga

SEQ ID NO: 27786 - RNA, 1626 nt, Artificial Sequence
  derived and/or modified sequence opt1 from CCDC151__Homo_sapiens__NP_001289382
augcacccgcccguggcccccugcaagaagcugcgcugcccgcccacccggagcuucacccccacgcgcggccgguccaaggagggggaccgcaaggccuucuucgagagcucccaguggaacaucaagaagaaccaggagaccaucagccagcuccggaaggagaccaaggcgcuggagcugaagcuccuggaccugcucaagggcgacgagaaggucgugcaggccgugauccgcgaguggaagugggagaagcccuaccugaagaaccggaccgggcaggcccuggagcaccucgaccaccgccugcgggagaaggucaagcagcagaacgcccugcgccaccagguggugcuccggcagcgccggcuggaggagcugcagcuccagcacucccugcgccugcucgagauggccgaggcgcagaaccggcacacggaggucgccaagaccaugcgcaaccuggagaaccggcuggagaaggcccagaugaaggcccaggaggcggagcacaucaccagcguguaccuccagcugaaggccuaccugauggacgagucccucaaccuggagaaccgccuggacagcauggaggccgaggugguccggaccaagcacgagcucgaggcccugcacguggugaaccaggaggcccugaacgcgcgcgacaucgccaagaaccagcuccaguaccuggaggagacgcugguccgggagcgcaagaagcgcgagcgguacaucuccgagugcaagaagcgcgccgaggagaagaagcucgagaacgagcggauggagcgcaagacccaccgggagcaccuccugcugcagagcgacgacaccauccaggacucccugcacgccaaggaggaggagcugcgccagcgguggagcauguaccagauggaggugaucuucggcaaggugaaggacgccaccgggacggacgagacccacucccucguccgccgguuccuggcgcagggcgacaccuucgcccagcuggagacccucaagagcgagaacgagcagacgcuggugcgccugaagcaggagaagcagcagcuccagcgggagcuggaggaccugaaguacuccggcgaggccacccucgugagccagcagaagcugcaggccgaggcccaggagcgccugaagaaggaggagcggcgccacgcggaggccaaggaccagcuggagcgggcccuccgcgccaugcaggucgccaaggacucccuggagcaccuggcgagcaagcucauccacaucaccguggaggacgggcgguucgccggcaaggagcuggacccccaggccgacaacuacgugcccaaccugcucgggcuggucgaggagaagcugcucaagcugcaggcccagcugcagggccacgacgugcaggagaugcucugccacaucgcgaaccgcgaguuccuggccucccuggaggggcggcucccggaguacaacacccgcaucgcccugccccuggccacgagcaaggacaaguucuucgacgaggagagcgaggaggaggacaacgagguggucacccgcgccucccucaagauccggagccagaagcugaucgagucccacaagaagcaccgccggagccgccgguccuga

SEQ ID NO: 27787 - RNA, 294 nt, Artificial Sequence
  derived and/or modified sequence opt1 from CCDC167__Homo_sapiens__NP_612502
augaccaagaagaagcgcgagaaccugggcguggcccucgagaucgacgggcuggaggagaagcugagccagugccggcgcgaccucgaggccgucaacucccggcugcacagccgcgagcugucccccgaggcgcggcgcagccucgagaaggagaagaacucccugaugaacaaggccagcaacuacgagaaggagcugaaguuccuccggcaggagaaccgcaagaacaugcugcuguccguggccaucuucauccuccugacccugguguacgccuacuggacgauguga

SEQ ID NO: 27788 - RNA, 1509 nt, Artificial Sequence
  derived and/or modified sequence opt1 from CCDC169-SOHLH2__Homo_sapiens__NP_001185839
auggagacccugcaggagagccucaacacccugcugaagcagcucgaggaggagaagaagacgcuggagucccaggugaaguacuacgcccugaagcucgagcaggagagcaaggccuaccagaagaucaacaacgagcgccggaccuaccuggcggagaugucccagggcagcgggcugcaccaggucuccaagcgccagcaggucgaccagcucccccggaugcaggagaaccuggugaagacccugcuccugaaggaggagcuggacccgcucaaggccaagaucgacauccugcuggugggcgacgugaccgugggguaccucgccgacacgguccagaagcuguucgccaacaucgccgaggugaccaucaccaucagcgacaccaaggaggcggccgcccugcucgacgacugcaucuucaacauggugcugcugaagguccccuccagccucuccgccgaggagcuggaggcgaucaagcugauccgcuucggcaagaagaagaacacgcacagccucuucguguucaucauccccgagaacuucaaggggugcaucuccggccacggcauggacaucgcccugaccgagccccugaccauggagaagaugagcaacguggucaaguacuggaccacgugcccguccaacaccgugaagaccgagaacgccaccgggcccgaggagcucggccugccccugcagcggagcuacuccgagcaccucggguacuuccccacggaccuguucgccugcagcgagucccugcgcaacggcaacgggcucgagcugaacgccagccuguccgaguucgagaagaacaagaagaucagccuccugcacagcuccaaggagaagcugcggcgcgagcggaucaaguacugcugcgagcagcuccgcacccugcugccguacgugaagggccggaagaacgacgcggccagcguccucgaggccaccguggacuacgugaaguacauccgcgagaagaucucccccgccgucauggcccagaucaccgaggcgcugcagagcaacaugcgguucugcaagaagcagcagacgcccaucgagcugucccuccccggcaccgugauggcccagcgcgagaacagcgugauguccaccuacagcccggagcgggggcugcaguuccugaccaacacgugcuggaacggcugcuccacccccgacgccgagagcucccuggacgaggccguccgcgugcccagcuccagcgccuccgagaacgcgaucggggaccccuacaagacccacaucagcuccgccgcccucagccugaacucccugcacaccgugcgguacuacagcaaggucacgccgagcuacgacgccaccgccgugaccaaccagaacaucuccauccaccuccccagcgcgaugccgcccgucuccaagcugcugccccgccacugcaccagcggccucggccagacgugcaccacccaccccaacugccugcagcaguucugggccuacuga

SEQ ID NO: 27789 - RNA, 2148 nt, Artificial Sequence
  derived and/or modified sequence opt1 from CCDC170__Homo_sapiens__NP_079335
augagccuggacugcaccucccacaucgcccucggcgccgcgagccccgccccggaggagaccuacgaccaccuguccgaggugcccgucacgcgcgagcagcugaaccacuaccggaacguggcccagaacgcccgcagcgagcucgccgcgacccuggugaaguucgagugcgcccaguccgagcugcaggaccuccggagcaagaugcuguccaaggaggucagcugccaggagcugaaggccgagauggaguccuacaaggagaacaacgcccgcaagagcucccuccugaccagccugcgggaccgcgugcaggagcucgaggaggaguccgcggcccugagcaccuccaagauccggacggagaucaccgcccacgccgccaucaaggagaaccaggagcugaagaagaagguggucgagcucaacgagaagcugcagaagugcagcaaggagaacgaggagaacaagaagcaggucuccaagaacugccgcaagcacgaggaguuccugacccagcuccgggacugccuggaccccgacgagcgcaacgacaaggcgagcgacgaggaccugauccucaagcugcgggaccugcgcaaggagaacgaguucgugaaggggcagaucgugauccucgaggagaccaucaacgugcacgagauggaggccaaggccucccgggagacgaucaugcgccuggccagcgaggugaaccgggagcagaagaaggccgcgagcugcaccgaggagaaggagaagcugaaccaggaccuccuguccgccgucgaggccaaggaggcccuggagcgcgaggugaagaucuuccaggagcggcuccuggccggccagcaggucugggacgcgagcaagcaggaggugucccugcucaagaaguccagcagcgagcuggagaagucccugaaggccagccaggacgccgugaccaccucccagagccaguacuucuccuuccgcgagaagaucgccgcccuccugcgggggcgccugagcaugacgggcuccaccgaggacaccauccucgagaagauccgggagauggacagccgcgaggagucccgcgaccggauggugagccagcuggaggcgcagaucuccgagcuggucgagcagcucgggaaggagagcggcuuccaccagaaggcccugcagcgcgcccagaaggccgagaacaugcuggagacccuccagggccagcugacgcaccuggaggcggagcucguguccgggggcgugcugcgggacaaccugaacuucgagaagcagaaguaccugaaguuccucgaccagcugagccagaagaugaagcuggaccagauggccgccgagcucggguucgacaugcgccuggacgucgugcuggcccggaccgagcagcucgugcgccuggagagcaacgccgucaucgagaacaagaccaucgcgcacaaccugcagcggaagcucaagacccagaaggagcgccuggaguccaaggagcugcacaugagccuccugcggcagaagaucgcccagcuggaggaggagaagcaggcccgcacggcccucguggucgagcgggacaacgcccaccugaccauccgcaaccugcagaagaagguggagcggcuccagaaggagcugaacacgugccgcgaccugcacaccgagcucaaggcgaagcuggccgacaccaacgagcugaagaucaagacccucgagcagaccaaggccaucgaggaccugaacaagucccgggaccagcuggagaagaugaaggagaaggccgagaagaagcucaugagcgugaaguccgagcuggacaccacggagcacgaggccaaggagaacaaggagcgcgcgcggaacaugaucgaggucgugaccagcgagaugaagacccugaagaagucccucgaggaggccgagaagcgcgagaagcagcuggccgacuuccgggagguggucagccagaugcugggccucaacgugaccucccuggcccugcccgacuacgagaucaucaagugccucgagcgccuggugcacagccaccagcaccacuucgucacgugcgcgugccugaaggacgugaccaccgggcaggagcgccacccgcagggccaccuccagcugcugcacuga

SEQ ID NO: 27790 - RNA, 3981 nt, Artificial Sequence
  derived and/or modified sequence opt1 from CCDC171__Homo_sapiens__NP_775821
augaaccugaacaccagcuccaacaccggcgacacgcagcgccucaagaucgccagccuggacgugaagcagauccugaagaacgagaccgagcucgacaucaccgacaaccugcggaagaagcugcacugggccaagaaggagaagcucgagaucaccacgaagcacaacgcggagcuggccuccuacgagagccagaucgccaagcugcgcuccgaggucgagaagggggaggcccuccggcagagccuggaguacgaccuggccguggcgcgcaaggaggccggccucgggcggcgcgccgccgaggagcggcuggcggaggcccaccgcauccaggagaagcugugcgcccagaacuccgagcuccaggccaagaccaacgagaccgagaaggccuuccagaccagccagcagaaguggaaggaggagugccggcgcuucgagcacgaccuggaggagcgggacaacaugauccagaacugcaaccgcgaguacgaccugcucaugaaggagaagucccggcuggagaagacgcugcaggaggcgcucgagaagcaccagcgcgagaagaacgagauggagagccacauccgggagaccgcccuggaggaguuccgccugcaggaggagcagugggaggccgagcggcgcgagcuccaguucaucgugcaggagcaggacaccgccguccagaacaugcacaagaagguggagaagcuggagaccgagcacauggacugcuccgaccugcuccggcgccagacgagcgagcuggaguucuccacccagcgggaggagcgccugcgcaaggaguucgaggccaccacccuccgggugcgcaagcuggaggagaacaucgaggcggagcgggccgcccaccuggagagcaaguucaacuccgagaucauccagcuccgcauccgggaccuggagggcgcccugcaggucgagaaggccagccaggcggaggccguggccgaccucgagaucaucaagaacgaguucaaggagguggaguccgccuacgagcgcgagaagcacaacgcccaggagagcuucgcgaagcugaaccugcucgagaaggaguacuucuccaagaacaagaagcugaacgaggacaucgaggagcagaagaaggucaucaucgaccugagcaagcggcuccaguacaacgagaaguccugcagcgagcugcaggaggagcuggugauggccaagaagcaccaggccuuccucguggagacgugcgagaacaacgucaaggagcuggagagcauccuggacuccuucaccgugagcgggcaguggaccuccggcauccacaaggacaaggacaagcccccgagcuucuccgugguccucgagcgccugcggcgcacccugacggacuaccagaacaagcuggaggacgccagcaacgaggagaaggcgugcaacgagcucgacuccaccaagcagaagaucgacagccacaccaagaacaucaaggagcugcaggacaagcuggccgacgugaacaaggagcucucccaccuccacaccaagugcgccgaccgggaggcccugaucagcacgcucaagguggagcugcagaacguccugcacugcugggagaaggagaaggcccaggcggcccaguccgagagcgagcuccagaagcugucccaggccuuccacaaggacgccgaggagaagcugaccuuccuccacacccuguaccagcaccugguggccggcugcgugcucaucaagcagcccgaggggaugcuggacaaguucagcugguccgagcugugcgcgguccuccaggagaacguggacgcccugaucgccgaccugaaccgcgccaacgagaagauccggcaccucgaguacaucugcaagaacaagagcgacaccaugcgcgagcugcagcagacgcaggaggacaccuucaccaagguggccgagcagaucaaggcgcaggaguccugcuggcaccggcagaagaaggagcuggagcuccaguacagcgagcuguuccuggagguccagaagcgcgcccagaaguuccaggagaucgccgagaagaacauggagaagcucaaccacaucgagaagucccacgagcagcuggugcuggagaacagccacuucaagaagcuccugagccagacccagcgggagcagaugucccugcucgccgcgugcgcccugauggccggcgcccuguacccccucuacagccgcuccugcgcccugagcacgcagcgggacuuccugcaggagcaggucaacaccuucgagcuguucaagcuggagauccgcacccuggcgcaggcccucuccaccguggaggagaagaagcaggaggaggccaagaugaagaagaagacguucaaggggcugauccgcaucuuccggaagggcgugaucgccguccuggccgcgaaccgccucaagauccuggggcagagcugcgccucccuguucaccuggauggagagcuucaaggagggcaucggcaugcucgugugcaccggggagccccaggacaagcacaaguucccgaagcaccagaaggagcagcugcggugccugcaggcccucuccuggcugaccagcuccgaccugcucgccgccaucaucagcuccauggcggagcugcaggacgugaucggcaaggccgaccccaacagccgcaucugcgggcaccuccugaucggcgccgccaagaacuccuucgcgaagcugauggacaagaucagccuggucauggagugcaucccccuccacagcucccggagcaucaccuacguggagaaggacucccuggugcagcgccuggcccacggccuccacaaggucaacacgcuggcccugaaguacgggcuccggggccacgugcccaucaccaagagcaccgccucccugcagaagcagauccugggguucacccagcgccuccacgccgcggagguggagcggcgcagccugcggcuggaggucacggaguucaagcgcuccgugaacgagaugaagaaggagcucgacaaggcccagggccugcagaugcagcugaacgaguucaagcagagcaagcucaucacccacgagaaguucgaguccgccugcgaggagcugaacaacgcccugcuccgggaggagcaggcccagaugcugcugaacgagcaggcgcagcagcuccaggagcugaacuacaagcuggagcuccacagcuccgaggaggccgacaagaaccagacccugggggaggccgucaagagccuguccgaggccaagauggagcuccgccggaaggaccagagccugcgccagcugaaccggcaccucacccagcuggagcaggacaagcgccggcuggaggagaacauccacgacgccgaguccgcgcuccgcauggccgccaaggacaaggagugcguggccaaccacaugcgggccguggagaacacgcugcacaaggugcgcgaccagaucagccuguccuggagcgcggccucccgcaacgacuucacccugcagcucccgaagcugcaccuggagaccuucgccauggagggccucaagggcgggcccgaggucguggccugccaggcgaugaucaagagcuucauggacguguaccagcuggccagcacccggaucaugacgcuggagaaggagaugaccucccaccgcagccacaucgccgcccucaaguccgagcugcacaccgccugccugcgggagaacgcgagccuccaguccaucggcagccgcgaccacuccaaccugagcauccccucccgggcgccccugccggccgacaccacggggaucggcgacuuccucccccugaaggccgagcuggacaccaccuacaccuuccucaaggagacguucaucaacaccgucccccacgcccugaccagcucccacagcucccccgugaccaugagcgccaacgccaaccgcccgacgcagaucgggcuguga

SEQ ID NO: 27791 - RNA, 2382 nt, Artificial Sequence
  derived and/or modified sequence opt1 from CCDC175__Homo_sapiens__NP_001157871
auggcccugagccccuggaccccgggccucggggccggcgagaagcuggugcaggcggccgccgucuccaccgggcccagccuggagcucugcacgcugcccuccacccugggcagcuccguggccguggaggcccucgagcagcuguucgucguggagcagagccugcaguccgacuacuucaagugcaacgaggaggcgaagaucuuccucaaggacaucgccguggccgucaagaagcuggaggagaugcgcaaggccaccaucgaccugcucgagaucgagagcauggagcugaacaagcuguacuaccuccuggagacccugcccaacuccaucaagcgggagcucgaggagugcgugcgcgacgcgcggcgccugaaccuguucgagaucaacacgaucaagaugcggaucacccgcaccgagaacgagaucgagcuccugaagaagaagaucaccgaccugacgaaguacaacgaggcccucggggagaagcaggaggagcuggcccggaagcacgcccgcuucgugcugagccucaaccagaccauggagaagaaggccaccaccacggucuacaucaacgagaccuacaccaagaucaaccugaagcgggaggacaucgcgcugcagaagaagugcauccaggaggccgaggagcucauggagaaggagcgcgccgaguaccugauccggaagcaggagcugaccgcccagaucaacgaguucgagaacacgcgcgaggugaagcggauggagaccuaccagaagaagaaggagcucgacaagcugcagaccaagauguccaagaucaaggagaccgugacggucagcgccgcggugcuguccgaccacaaccucgagaucgcccgccugcacgagagcauccgguacugggagcaggagguguccgagcugaagaaggaccucgccauccuggaggccaagcugugcuucuucaccgacaacaaggagaagcucgacgacaucagcaacgacgagaagaacgaguuccugaacaagaucaagcagcuggucgagacccuccacgccgcgcgcauggaguacaaggaccugcgggagaagaugaagacccuggcccgccaguacaagaucgugcucuccgaggaggagaaggccuuccugcagaagcagaagauccacgacgagaaccagaagcagcugacguucaucagccagaaggaguacuuccugucccagaagcggguggacaucaagaacauggaggagggccucaucacccugcaggagcugcagcaggccaccaagaccgucuaccagcagcagaucaagauccucagcgccaaccuggagcgcgagagccagcggugcgugaucacgcaguggaagauggcgugccugcgcaagaagcacgcccgcuggaccgccaagaucaaggccgagauccaggcgaucaccgagaagauccagaacgccgaggugcggcgcaucgagcuccugaacgagaccuccuuccggcagcaggagaucagcggcuucgucgcccagaucgagaagcugacgaccgagcucaaggaggaggagaaggccuucgugaacaaggagaagaugcugaugaaggagcuguccaaguacgaggagaucuucgugaaggagacccagaucaacaaggagaaggaggaggagcucgucgaguaccugccgcagcuccagguggccgagcaggaguacaaggagaagcgccggaagcuggaggagcugagcaacaucaucaccgcgcagcgccaggaggaggaccugcucaacaaccacaucuuccuguucacgcgggacuucucccgcuacaucagcaacauggaggacgucaagcaggagcugcagcagcuccgggaccaggaguccaagaagaacaaggaccacuucgagacccugaagaaccuggagaacggguucuacaucaacgaccagaaggccgaccuccugcugcucgagaacaagaagcugaaggaguacauccuguaccucaagaacaacaucgagaaguaccgcgagggccaggaggcccugaugcacaccagcuccgaccugagccggcagcucaucgcccaggaggcccaguacaaggaccugugggcggaguuccagaccaccgugaagauccugguggacaacggggaggagacgcuccaggacaucaacaaccugaccgacaagcugcgcgagcgggacgagaagaugcagcacgucuccaccuggcuccgcggcagccuggaggggcugcggcuccugguggagcaggagucccccauggaccugcucaagaagaagaagcacauccgcacccgggugcacuuccccgucgugaagugcacggagaagaacacccugaccaaguga

SEQ ID NO: 27792 - RNA, 1590 nt, Artificial Sequence
  derived and/or modified sequence opt1 from CCDC176__Homo_sapiens__NP_079333
augcccagcaagggcaaggacaagaagaaggggaaguccaagggcaaggacaccaagaagcugaucaagaccgacgagagcguggucgaccgcgccaaggccaacgcgucccucugggaggcccggcuggaggugacggagcugagccgcaucaaguaccgggacaccucccgcauccucgccaagagcaacgaggaccugaagaagaagcagugcaagauggagaaggacaucauguccgugcugagcuaccucaagaagcaggaccaggagaaggacaacaugaucgagaagcugaagcagcagcugaacgagaccaaggagaaggcccaggaggagaaggacaagcucgagcagaaguacacccggcagaucaacgagcuggaggggcaguuccaccagaaggccaaggagaucggcaugauccacacggagcugaaggcgguccgccaguuccagaagcggaagauccagguggagcgcgagcucgacgaccugaaggagaaccugcggaacaccgagcgcauccaccaggagacccuccggcgccuggagucccgguucuucgaggagaagcaccgccuggagcaggaggccgagaagaagaucaucaugcucgccgagcgggcccaccacgaggcgaucgugcagcugaacgacgccgggcgcaacgucuucaaggagaacgacuaccugcagaaggcccucgccuaccaccugaaggagaccgacgcccugcagaagaacagccagaagcuccaggagucccacacgcugcugcuccaccagaaggagaucaacgaccugcuggugaaggagaagaucaugcagcucgugcagcagcggagccagauccagacccugcagaagaaggucgugaaccuggagaccgcgcucuccuacaugaccaaggaguucgagagcgaggugcugaagcugcagcagcacgccaugaucgagaaccaggccggccaggucgagaucgacaagcuccagcaccuccugcagaugaaggaccgcgagaugaaccgggugaagaagcuggccaagaacauccuggacgagcgcacggagguggagcgguucuuccuggacgcccuccaccaggucaagcagcagauccugaucucccgcaagcacuacaagcagaucgcgcaggccgccuucaaccugaagaugcgcgccgccugcaccggccggaccgaguacccgaagauccgcaccuucgacgggcgggagcacagcacgaacuccgugaaccaggaccuccuggaggcggagaaguggacccacaucgagggcaacguggacaucggggaccugaccugggagcagaaggagaagguccuccgccugcuguucgccaagaugaacggcugccccagccggaaguacaaccaguccagccgcccgcccgugcccgacuacguggucagcgacuccggggagaccaaggaguucggcgacgagagcaagcugcaggacaagaucuucaucacgcagcagaucgccaucuccgacagcuccggcgagguggugcuccccaccauccccaaggagccccaggagagcgacaccgggaccuucuga

SEQ ID NO: 27793 - RNA, 2604 nt, Artificial Sequence
  derived and/or modified sequence opt1 from CCDC178__Homo_sapiens__NP_001098998
augaccgagaacaagaccgugagcuccagcuccacgcgcgacgaccagaccaacaucggccugaccugccaggaggucaaggcccuccgggagaaggccuggagccgcaccaacgaggggaacgcgaugucccagagccuggugcuguacggcgccuccaaggagaacagcgagggguuccacgaguccaagaugacgaacaccgagggcgugaacaaggggaucuacuucagcuaccccugccggcgccacuccugcgccgucgugaacaucccggcccccugcgugaacaagaugaucagccacauccaggacgucgaguccaagauccaggagcaccucaagcgguucgagaccagcuucgaggaguggucccgcaccagcuccacgaaggaccugaaggaggacuggagcgugaccacccccgugaaggaggucaagcccggcgagaagcgggacgagaagugcccggagcugaagcaggagauggagacccuccuguccgaggccauccgccugaucaagagccucgagacggaccgggcggacgccgaggaggcccugaagcagcagcgcagccggaagaacaugaucaacaugaagaucgacuccuggagcguguggaagcugcaggagcucccccuggccgugcagaaggagcacgaggcguaccuguccgacgucaucgagcuccaguggcaccuggaggacaaggccaaccagcugcagcacuucgagaagcagaagaccgagcucgaggaggccaacgccaagauccaggccgacaucgacuacaugaacgagcacggcccccugcuggacagcaagcagaaccaggagcuccaggaccugaagaaccacuacaagaagaagauggaggugauggaccugcaccgcaaggugaacgaggagcucgaggaggcgcuggaggccugcgagaacgcccggcugaaggcccagcagaucaaggaggagaucgacaaggacaucuaccaggacgagaagaccaucgaggccuacaagcgcgagaucuaccagcucaacucccuguucgaccacuacagcuccagcgucaucaacgugaacaccaacaucgaggagaaggaggaggaggugacggaggcgauccgggagaccaaguccagcaagaacgagcugcacucccucagcaagaugcuggaggaccugcgccgggucuacgaccagcucaccuggaagcagaagucccacgagaaccaguaccuggaggccgugaacgacuucuacgccgccaagaagaccugggacaucgagcugagcgacguggccaaggacuucuccgcgaucagccucgccugcacgaagcugaccgaggacaacaagaagcuggagaucgacaucaacaagaucaccgucaagaccaacgaguccauccgcaagaaguccaaguacgagagcgagaucaaguaccucacgaucaugaagcugaagaacgacaagcaccugaagaacaucuacaaggaggccuaccggaucgggacccucuuccaccugaccaagcacaagaccgacgagauggaggacaagaucgccgaggugcgccggaaguucaagggccgcgaggaguuccugaagaagcucacgcagggggagguggccgcgggcaugguccugcagaagaagcuguacagcaucuacgaggugcaggcccucgagcgcaaggagcugaucaagaaccgggccaucugcgccaugagccuggcggagcugcaggagccccuccugcagcuggaggacgaggccgagcgcauccggucccucgacaaggagcacagcgucaugcugaacaacaucaucgaccagaaggaccugauccgccggaagguggggaaggugaagaagaagcuccgcaagaagggcaagaagacccuggacgcccugaucgagaccgaguccaagcggagcgccaucuucaaggaccucgaggccaccaaguccaagacgaugaucuucuacgcgaagaucaacgagcugaacgaggagcugaaggccaaggaggaggagaagaaguccuucgaccagacccucgagauccugaagaacaaguucaucaccaugcgcuucaagcgggagcacgcccagaccgucuucgaccacuacaugcaggagaagaaggacugcgaggagcgcaucuucgaggaggaccagcgguuccgcgugcugcucgccgugcggcagaagacgcugcaggacacccagaagaucaucgccgacagccuggaggagaaccuccgccuggcgcaggaguaccagcagcugcagaucaccuuccucaaggagaaggacaacuacuucaacaucuacgacaagcagcugagccuggacaccuccauccgggacaagaagcagcucugccagcugcagcgccggaugcacacccuguggcaggagcacuucaagcucgucgugcuguucagccagaugcgccuggccaacuuccagacggacucccaggagagcauccagaagauccucgccgugcaggaggaguccagcaaccugaugcagcacauccugggcuucuuccagacccucaccgacgggaccugcgagaacgacggcuga

SEQ ID NO: 27794 - RNA, 5106 nt, Artificial Sequence
  derived and/or modified sequence opt1 from CCDC180__Homo_sapiens__NP_065944
augcggggcggggagaaccggccgcccgcccgcgugcagagcagcagcgaggagcuggagcugcggcaccagucccuggacgccuuccccgggcgccggcugcccgggcgcggcauccagcccgcggccaagaugagcuccguggggaaggugacccaggugcccaacggcaaggccuaccagcagaucuuccaggccgagguccagcuggugcacagccuggccgcgacccggaagcgcgccgccgagcgguccgugacgcugaaguccggccgcauccccaugaugaagaaggucgagacccccgagggggaggugaugagcccccggcagcagaaguggaugcacagccuccccaacgacuggaucauggagaaccccgugcugcaccgcgagaaggagcgggccaagcgcgagaaggcgcgggaguccgagaacaccaucgccgcccgcgagguccggggccugauggacaccaucgugcccgagaagaucagcaccuccaccuuccagcgccaggccgagcacaagcgcaagagcuacgaguccgcccucgcgagcuuccaggaggagaucgcccagguggggaaggagauggagccccugaucgucgacaccggcgggcuguuccucaagaagcugaccgaguccgacgaggagaugaaccggcuguuccucaagguggagaacgacacgaaccuggaggacuacaccauccaggcccugcucgagcugugggacaagguggccggccggcugcuccugcgcaagcaggagaucaaggagcuggacgaggcccuccacagccuggaguucucccgcaccgacaagcugaaguccguccucaagaaguacgcggaggugaucgagaagaccagcuaccugaugcggcccgagguguaccgccugaucaacgaggaggccauggucaugaacuacgcccuccugggcaaccggaaggcccuggcccagcuguucgugaaccugauggaguccacgcugcagcaggagcucgacagccgccaccgguggcaggggcugguggacaccuggaaggcgcugaagaaggaggcccuccugcaguccuucagcgaguucauggccuccgagagcauccacacgccgcccgccgucaccaaggagcuggaggugaugcucaagacgcagaacgugcugcagcagcgccggcugaagcaccucugcaccaucugcgaccugcugcccccguccuacagcaagacccagcucaccgaguggcacuccagccugaacucccugaacaaggagcuggacacguaccacgucgacugcaugaugcgcauccggcuccuguacgagaagaccuggcaggagugccugaugcacgugcagaacugcaagaagcagcuccuggacuggaaggccuucaccgaggaggaggcggagacccuggucaaccaguucuucuuccagauggugggcgcccuccaggggaagguggaggaggaccuggagcugcucgacaagagcuucgagacgcuggccgaccagaccgaguggcaguccagccaccuguucaaguacuuccaggaggucgugcagcucugggaggcccaccaguccgagcugcuggugcaggagcucgagcuggagaagcgcauggagcagcaccggcagaagcacagccuggagucccagguccaggaggcgcaccucgaccgccugcuggaccagcuccggcagcagagcgacaaggagacccuggccuuccaccuggagaaggugaaggacuaccucaagaacaugaagucccgcuacgagugcuuccacacccugcugacgaaggaggugauggaguaccccgccaucaugcucaaggagcugaacagcuacagcuccgcccugagccaguacuucuucguccgggagaucuucgagcagaaccucgccggcgaggugaucuucaaguuccgccagcccgaggcgcacgagaagcccucccagaagcgggugaagaagcugcgcaagaagcagggcagcaaggaggacaugacccgguccgaggagagcaucuccagcgggaccuccaccgcccgcagcgucgaggagguggaggaggagaacgaccaggagauggaguccuucaucacggaggaggugcugggccagcagaagaaguccccgcuccacgccaagauggacgaguccaaggaggggagcauccagggccuggaggagaugcaggucgagcgcgaggggucccugaaccccagccucaacgaggagaacgugaagggccagggcgagaagaaggaggaguccgaggaggaggacgagaaggaggaggaggaggaggaggagaagcuggaggaggagaaggaggagaaggaggcccaggaggagcaggagagccugagcgugggggaggaggaggacaaggaggagggccucgaggagaucuacuacgaggacauggaguccuucaccaucagcuccgggaacaccuacuucgucuucgugccccuggaggaggagcacugccgcaagagccacuccaccuucagcgccauguucaucaacgacacguccagcgcgaaguucaucgagcaggucaccauccccucccgccugauccucgagaucaagaagcagcugcgggccggcuucuucgagcaccuggagaagugguucgaccagugcagccucaacacccgcgucaccguggccaccaagaucaacgagcuggacuccgagcuggagcuccaccuccaccuccaccagccgcgggcccagcagaucgagaaggacauccacaacgugcgcgccgcggagcuccugcugcaccaggagcagcucgacagccacugcgccggggucacggagacccugaagaagaagcggcugauguucugccaguuccaggaggagcagaacgugcgcuccaagaacuuccggcucaagaucuacgacauggagcacaucuuccugaacgccacccgcagccagaagcuggugacccucuccaacacgcugcaccaggagcugcucagcuacgucgacgugacccaggugucccugcggagcuuccgccaguaccuggaggagucccucggcaagcugcgguacagcaacaucgaguucaucaagcacugccgccuguucagcgagggcgggaacuucucccccaaggagaucaacagccucugcucccggcuggagaaggaggccgcgcgcaucgagcuggucgagagcgugaucaugcucaacauggagaagcuggagaacgaguaccuggaccaggccaacgacgugaucaacaaguucgaguccaaguuccacaaccucagcgucgaccugaucuucaucgagaagauccagcggcugcucaccaaccuccaggugaagaucaagugccagguggccaaguccaacagccagaccaacggccugaacuucucccuccagcagcugcagaacaagaucaagacgugccaggagagccgcggggagaagaccaccgucaccacggaggagcugcucuccuucgugcagaccuggaaggagaagcugagccagcggauccaguaccugaacugcucccucgaccgcgugagcaugaccgagcuggucuucaccaacacgauccugaaggaccaggaggaggacuccgacauccucaccagcuccgaggcccuggaggaggaggccaagcuggacguggugacccccgagagcuucacccagcucucccgggucggcaagccccugaucgaggacccggcgguggacgugauccgcaagcugcugcagcuccccaacacgaaguggcccacccaccacugcgacaaggacccgagccagaccgggcgcggcgccugggccugcggcagccggggguccagcgaggccggcgccgggggcgcggucugcagcccgcccgugcugugcagcugccccggcccguccagccccaagggguucaagcgccaccggugccagcccgagaacuccggcaagaaggccgugcccagcgccuccgccaccagcgccggguccuucacgccgcaccccaagcccaacaagauggagcgcaaguaccggguccugggcgacaagcccccgcccgcggccgaggacuucaaggggaucauccucacccugcugugggagagcuccgagaaccuccugaccguggccgaggaguucuaccgcaaggagaagcggcccgugacccgccccgacugcaugugcgacacguucgaccagugcgccgagaacaucagcaagaagauccuggaguaccagucccaggcgaacaaguaccacaacagcugccucaucgagcugcggauccagauccgccgguucgaggagcugcucccgcaggucugcuggcuggugauggagaacuucaaggagcaccacuggaagaaguucuucaccuccgucaaggagauccgcggccaguucgaggagcagcagaagcggcuggagaagcgcaaggacaagaacgcccagaagcuccaccugaaccugggccaccccgugcacuuccaggagauggagagccuccaccuguccgaggaggagcggcaggaggagcuggacagcaugauccgcaugaacaaggagaagcucgaggagugcacccggcgcaacggccagguguucaucaccaaccuggccacguucaccgagaaguuccugcuccagcuggacgaggucgugaccaucgacgacgugcaggucgcccggauggagccgcccaagcagaagcugagcaugcucauccgccgcaagcuggccggccugucccucaaggaggagagcgagaagccgcugaucgagcgggggucccgcaaguggcccggcaucaagcccaccgaggugacgauccagaacaagauccugcuccagcccaccagcuccaucagcaccaccaagaccacgcuggggcaccuggcggccguggaggcccgggacgccgucuaccucaaguaccuggccuccuucgaggaggagcugaagcgcauccaggacgacugcaccagccagaucaaggaggcgcagcgguggaaggacuccuggaagcagagccuccacaccauccagggccuguacguguga

SEQ ID NO: 27795 - RNA, 1527 nt, Artificial Sequence
  derived and/or modified sequence opt1 from CCDC181__Homo_sapiens__NP_067002
augaacgagaacaaggacaccgacagcaagaaguccgaggaguacgaggacgacuucgagaaggaccuggaguggcucaucaacgagaacgagaaguccgacgccagcaucaucgagauggccugcgagaaggaggagaacaucaaccaggaccugaaggagaacgagaccgugauggagcacacgaagcgccacagcgaccccgacaagucccugcaggacgaggucagcccgcggcgcaacgacaucaucuccgugcccggcauccagccccucgaccccaucagcgacuccgacagcgagaacuccuuccaggagagcaagcuggagucccagaaggaccuggaggaggaggaggacgaggaggugcggcgcuacaucauggagaagaucguccaggcgaacaagcuccugcagaaccaggagccggugaacgacaagcgggagcgcaagcugaaguucaaggaccagcucguggaccuggaggucccgccccuggaggacaccaccaccuucaagaacuacuucgagaacgagcggaacauguucgggaagcucagccagcugugcaucuccaacgacuucggccaggaggacgugcugcucagccugacgaacggguccugcgaggagaacaaggaccgcaccauccugguggagcgggacggcaaguucgagcuccugaaccugcaggacaucgccagccagggguuccugccgcccaucaacaacgccaacuccaccgagaacgacccccagcagcuccugccccgcagcagcaacuccagcgucuccggcaccaagaaggaggacagcacggccaagauccacgccgugacccacuccagcaccggcgagccccucgcguacaucgcccagccgccccugaaccggaagaccugccccuccagcgccgugaacuccgaccgcagcaaggggaacggcaaguccaaccaccggacgcagagcgcccacaucucccccgucaccagcaccuacugccugagcccccgccagaaggagcuccagaagcagcuggaggagaagcgggagaagcugaagcgcgaggaggagcggcgcaagaucgaggaggagaaggagaagaagcgggagaacgacaucguguucaaggcguggcuccagaagaagcgcgagcagguccuggagaugcggcgcauccagcgcgccaaggagaucgaggacaugaacucccgggagaaccgcgacccccagcaggccuuccggcuguggcucaagaagaagcacgaggagcagaugaaggagcgccagaccgaggagcugcggaagcaggaggagugccuguucuuccucaaggggacggagggccgcgagcgggccuucaagcaguggcugcgccggaagcgcauggagaagauggccgagcagcaggcggugcgggagcgcacccggcagcugcgccucgaggccaagcgguccaagcagcugcagcaccaccuguacaugagcgaggccaagcccuuccgcuucaccgaccacuacaacuga

SEQ ID NO: 27796 - RNA, 1872 nt, Artificial Sequence
  derived and/or modified sequence opt1 from CCDC185__Homo_sapiens__NP_689823
auggccggcuucagccacuucucccagccgcccuaccgcgaccugugggagccgccccggcccgggggcgagcgcgagagcacccagcggcucgggggccagcgcuccggggccgacagcaccgcgugcucccgggccggcacgcccggcgccgagagcgaggccggggccugcuggcugcacccccacugcuccuucacgccccgcccccggcgccggggcugcagcgacucccugcgcgggagccggucccucagcgacguggcgcgccggccccuggagcgcucccggaagcaccgcccccggagccgccggcuggaggacgccuggggcgagaccgggaccaagccccgccccgccuggcagccgcagacccagcucccgccccagcggccccagcccugcccccacuacccccuggcccagggcgacagcccgccgcccugccccggcggggcgggcacgccccuguccgggaccuuccgcgucgagaaggcccagggcggcgaccagugggccgugccccucgggcgccaccugggccgguggucccccagcuccgugcccagcgagcgcagcuccguccccagccagaaguucaagcggcacuccgccugcgugugcgcccagaagcgcgacagcuccgaccagguggagagccuggcgucccgggacagccagccgcucgccuccagcaaggagaugcgcagcccccacacccagguccucaaguccaagcuggaggaggugguggucuccagccaggaccagcagaucguggcccuggugcugacccggcugaagaaggcccagcgcauccgggagcuccagcagcaggccgcgaaggccugggaggagcugaagcgcuccgaccagaagguccagaugacccuggagcgggagcgccggcuccugcugcgccagagccaggagcaguggcaggagaaggagcagcggaagacccuccagucccccgagcagcgcgggcugcggcgcgacagccagcggaagaacgugccgcccggcgagucccgcuggaaggagcagcccgaggaccaggagagcccccgccaggagaagcuggagaaggcccgggcccaggccgagcaccgcaagcagugccaggugcggcgccuccgggagcaggagaagaugcugcgcaaccugcgggagcagcacagccuccagcugcagcgccggcuggucgaggcgugccgcaagcggcaccuccacgccguggaggggcagaagaaggugcaggacaccaaccuguccagccugaucaacuaccaggcccgcaagguccucauggacugccaggccaaggccgaggagcugcugcggcagcucucccuggagcagagcuuccagcgcucccaggagauccaccagggccugcggaaggagcgccagcgggagcuccgcgagaaggcgcagaaggaggaggagcagcugcagcaggcccgguggcgcgccggcgagagcgaggagcagcggaagaugcgcaagcgcauccugguggagcucgccgacgagaagauccggcaggcgcgcucccacgugcacaagacgacccgggacaagguccagcaccuccgcgagcugaaccaccuccgggagaagaaccaccacauccugaagcugaaggccgagaaggaggagaagugccacaucgaggggaucaaggaggccaucaagaagaaggagcagcgcgugcagcacaucagccagggcaaggacccgaacuuccaggaguuccagaagcugccccaggccucccggcgcgaggagcgggccccgcccaacagcucccuggaccagauggugcuggaggcgcagcugcgcgccugccagcagaaccggggguacuga

SEQ ID NO: 27797 - RNA, 1884 nt, Artificial Sequence
  derived and/or modified sequence opt1 from CCDC22__Homo_sapiens__NP_054727
auggaggaggccgaccgcauccugauccacagccuccggcaggccggcaccgcggugcccccggacguccagacccugcgcgccuucacgaccgagcuggugguggaggccgucgugcggugccuccgcgugaucaaccccgccgucggguccggccugagcccccugcucccccuggccauguccgcgcgguuccgccuggccaugagccucgcccaggccugcauggaccugggguacccgcuggagcucggcuaccagaacuuccuguaccccuccgagcccgaccugcgggaccuccugcuguuccucgcggagcgccugcccaccgacgccagcgaggacgccgaccagccggccggggacuccgccauccugcuccgggcgaucggcagccagauccgcgaccagcuggcccugcccugggugccgccccaccuccggacccccaagcugcagcaccuccagggcuccgcccugcagaagcccuuccacgccagccgccuggugguccccgagcuguccagccgcggggagccccgggaguuccaggccuccccgcuccugcugcccgugcccacccaggugccccagccggucggccggguggcgagccuccuggagcaccacgcccugcagcucugccagcagacggggcgcgaccggcccggcgacgaggacugggugcaccgcaccucccggcugccgccccaggaggacacccgcgcccagcggcagcgccugcagaagcagcucacggagcaccuccgccagagcugggggcugcugggcgcccccauccaggcccgggaccugggcgagcugcuccaggcguggggcgccggggccaagaccggggcccccaagggcucccgcuucacccacagcgagaaguucaccuuccaccuggagccccaggcccaggcgacgcaggucuccgacgugcccgccaccagccggcgcccggagcaggucaccugggccgcccaggagcaggagcuggagagccuccgggagcagcuggagggcgugaaccgcuccaucgaggagguggaggcggacaugaagacccugggggugagcuucguccaggccgaguccgagugccggcacagcaagcuguccacggccgagcgcgagcaggcccuccggcucaagagccgcgccguggagcugcugcccgacggcaccgcgaaccuggccaagcugcagcucguggucgagaacuccgcccagcgggugauccaccuggccgggcagugggagaagcaccgcgucccccugcucgccgaguaccggcaccuccgcaagcugcaggacugccgggagcuggagagcucccgccggcuggcggagauccaggagcugcaccagagcgugcgcgccgccgccgaggaggcccggcgcaaggaggagguguacaagcagcucauguccgagcuggagacccugccgcgcgacgucagccggcucgcguacacccagcgcauccuggagaucgugggcaacauccggaagcagaaggaggagaucacgaagauccuguccgacaccaaggagcuccagaaggagaucaacagccuguccgggaagcuggaccgcaccuucgccgugaccgacgagcucgucuucaaggacgccaagaaggacgacgccgugcggaaggcguacaaguaccuggccgcccugcacgagaacugcagccagcucauccagacgaucgaggacaccggcaccaucaugcgcgaggugcgggaccuggaggagcagaucgagaccgagcugggcaagaagacgcucuccaaccuggagaagauccgcgaggacuaccgggcccugcgccaggagaacgccgggcuccugggccggguccgcgaggcguga

SEQ ID NO: 27798 - RNA, 825 nt, Artificial Sequence
  derived and/or modified sequence opt1 from CCDC28A__Homo_sapiens__NP_056254
augccccgcgccgagccgcgggccacccugggcgagcaggagaaggcggggcucccccugggcgccuggcgccuguaccuccugcggcacuuccgcaagcagaccgagcugcggcgcagcgggucccgggacgugacgggcgcccuccuggucgccgccgcgguggccagcgaggccguggggucccugcgcgucgccgagggcggccccaacacccuccugcuccaggugcugcggagcuggcccuggugcaacaaggagcugaagaccauggaggagcgcaaggugaagcggcgcucccccaagagcuucuccgcgcacugcacccaggucgugaacgccaagaagaacgccaucccggugagcaaguccacgggguucagcaaccccgccucccagagcaccucccagcggcccaagcugaagcgcgucaugaaggagaagaccaagccgcagggcggggagggcaagggggcccagagcacccccauccagcacuccuuccucacggacgugagcgacgugcaggagauggagcggggccugcugucccuccugaacgacuuccacagcggcaagcugcaggcguucgggaacgagugcuccaucgagcagauggagcacguccgcggcaugcaggagaagcucgcccggcugaaccuggagcucuacggggagcuggaggagcugcccgaggacaagcgcaagaccgccagcgacagcaaccucgaccggcugcuguccgaccucgaggagcugaacagcuccauccagaagcugcaccucgccgacgcccaggacgugcccaacaccagcgcguccuga

SEQ ID NO: 27799 - RNA, 2826 nt, Artificial Sequence
  derived and/or modified sequence opt1 from CCDC39__Homo_sapiens__NP_852091
augagcuccgaguuccuggccgagcuccacugggaggacggcuucgccauccccguggcgaacgaggagaacaagcugcuggaggaccagcucagcaagcugaaggacgagcgcgccucccugcaggacgagcuccgggaguacgaggagcgcaucaacagcaugaccucccacuucaagaacgucaagcaggagcugagcaucacccagucccugugcaaggcccgggagcgcgagacggagagcgaggagcacuucaaggccaucgcccagcgggagcucgggcgcgugaaggacgagauccagcggcuggagaacgagauggcguccauccuggagaagaaguccgacaaggagaacggcaucuucaaggccacccagaagcucgacgggcugaagugccagaugaacugggaccagcaggcccuggaggccuggcucgaggagagcgcgcacaaggacagcgacgcccugacccugcagaaguacgcccagcaggacgacaacaagauccgcgcccucacccugcagcuggagcggcucacgcuggagugcaaccagaagcgcaagauccuggacaacgagcucaccgagaccaucuccgcccagcuggagcuggacaaggcggcccaggacuuccggaagauccacaacgagcgccaggagcucaucaagcagugggagaacaccaucgagcagaugcagaagcgggacggcgacaucgacaacugcgcccuggagcuggcccgcaucaagcaggagacgcgggagaaggagaaccucgugaaggagaagaucaaguuccuggagagcgagaucgggaacaacaccgaguucgagaagcgcaucuccgucgccgaccggaagcugcucaagugccgcaccgcguaccaggaccacgagaccagccggauccagcugaagggcgagcuggacucccucaaggccacggugaaccgcaccagcuccgaccuggaggcccugcggaagaacaucagcaagaucaagaaggacauccacgaggagaccgcccgccuccagaagaccaagaaccacaacgagaucauccagacgaagcugaaggagaucaccgagaagaccaugagcguggaggagaaggccaccaaccuggaggacaugcucaaggaggaggagaaggacgucaaggagguggacgugcagcugaaccugaucaagggcguccucuucaagaaggcgcaggagcugcagacggagaccaugaaggagaaggccgugcuguccgagaucgaggggacccgcagcucccucaagcaccugaaccaccagcugcagaagcuggacuucgagacccucaagcagcaggagaucauguacagccaggacuuccacauccagcaggucgagcggcgcaugucccggcugaagggcgagaucaacagcgaggagaagcaggcccuggaggccaagaucguggagcuccgcaagucccuggaggagaagaaguccacgugcgggcugcucgagacccagaucaagaagcugcacaacgaccuguacuucaucaagaaggcccacagcaagaacagcgacgagaagcagucccucaugaccaagaucaacgagcugaaccuguucaucgaccggagcgagaaggagcucgacaaggcgaagggcuucaagcaggaccugaugaucgaggacaaccugcucaagcuggaggugaagcgcacccgggagaugcugcacuccaaggccgaggaggugcucagccuggagaagcgcaagcagcagcuguacacggccauggaggagcggaccgaggagaucaagguccacaagaccaugcucgccucccagauccgcuacguggaccaggagcgggagaacaucagcaccgaguuccgcgagcggcuguccaagaucgagaagcugaagaaccgcuacgagauccucacgguggucaugcugccgcccgagggggaggaggagaagacccaggcguacuacgugaucaaggccgcccaggagaaggaggagcugcagcgggagggcgacugccucgacgccaagaucaacaaggccgagaaggagaucuacgcgcuggagaacacccuccaggugcugaacagcugcaacaacaacuacaagcaguccuucaagaaggucacccccagcagcgacgaguacgagcugaagauccagcuggaggagcagaagcgcgccguggacgagaaguaccgguacaagcagcgccagauccgggagcuccaggaggacauccaguccauggagaacacgcuggacgugaucgagcaccuggccaacaacgucaaggagaagcucagcgagaagcaggccuacuccuuccagcugagcaaggagaccgaggagcagaagcccaagcuggagcgcgugaccaagcagugcgccaagcucaccaaggagauccgccugcugaaggacaccaaggacgagacgauggaggagcaggacaucaagcuccgggagaugaagcaguuccacaaggucaucgacgagaugcugguggacaucaucgaggagaacaccgagauccgcaucauccugcagaccuacuuccagcaguccggccucgagcugccgaccgcgagcacgaaggggucccggcagagcucccgcagccccucccacaccagccuguccgcccggagcucccgcagcaccuccaccagcacgagccaguccagcaucaaggugcucgagcugaaguuccccgccuccagcucccuggucggcagccccucccggccgagcuccgccagcuccagcuccagcaacgugaaguccaagaaguccagcaaguga

SEQ ID NO: 27800 - RNA, 438 nt, Artificial Sequence
  derived and/or modified sequence opt1 from CCDC3__Homo_sapiens__NP_001269587
auggacgagaacuacaaccugcucccccacggcgugaacuuccaggacgccaucuucccggacacccaggagaaccgccggauguucagcucccuguuccaguucagcaacugcucccaggggcagcagcuggccaccuucagcuccgacugggagauccaggaggacagccgccucaugugcuccagcguccagaaggcgcuguucgaggaggaggaccacgugaagaagcugcagcagaagguggccacgcucgagaagcggaaccgccagcugcgggagcgcgucaagaaggugaagcggucccugcgccaggcccggaagaagggccgccaccucgagcuggccaaccagaagcugagcgagaagcucgccgcgggggcccugccccacaucaacgcccggggccccgugcggcccccguaccugcgcggguga

SEQ ID NO: 27801 - RNA, 3093 nt, Artificial Sequence
  derived and/or modified sequence opt1 from CCDC40__Homo_sapiens__NP_001230271
auggccgagcccggcggggccgcgggccgcagccacccggaggacggguccgccagcgagggcgagaaggaggggaacaacgagucccacauggugagcccgcccgagaaggacgacggccagaagggcgaggaggccgucggguccaccgagcaccccgaggaggugaccacgcaggccgaggccgcgaucgaggagggcgagguggagaccgagggggaggccgccgucgagggcgaggaggaggccgugagcuacggggacgcggaguccgaggaggaguacuacuacaccgagaccagcucccccgagggccagaucagcgccgccgacacgaccuaccccuacuucuccccgccccaggagcugcccggcgaggaggccuacgacagcguguccggggaggccggccuccagggguuccagcaggaggcgaccggcccgcccgagagccgggagcgccgggucaccucccccgagcccagccacggcgugcuggggcccuccgagcagaugggccaggugacgagcgggcccgccgucggccgccugaccggguccaccgaggagccccagggccaggugcucccgaugggcgugcagcaccgguuccgccugagccacgggagcgacaucgaguccagcgaccuggaggaguucgucucccaggagcccgugaucccgcccggcgugcccgacgcccacccccgggagggggaccuccccgucuuccaggaccagauccagcagcccagcaccgaggagggcgccauggccgagcgcguggaguccgaggggagcgacgaggaggcggaggacgagggcucccagcuggugguccuggacccggaccacccccucauggugcgguuccaggccgcccugaagaacuaccugaaccgccagaucgagaagcucaagcuggaccugcaggagcucguggucgccacgaagcagagccgggcccagcgccaggagcugggcgugaaccuguacgaggugcagcagcaccucguccaccuccagaagcugcuggagaagucccacgaccggcacgcgauggccagcuccgagcgccggcagaaggaggaggagcugcaggccgcccgcgcccuguacaccaagaccugcgcggccgccaacgaggagcggaagaagcucgccgcgcugcagaccgagauggagaaccuggcccuccaccuguucuacaugcagaacaucgaccaggacaugcgcgacgacauccgggugaugacgcaggucgugaagaaggccgagaccgagcgcauccgggccgagaucgagaagaagaagcaggaccuguacguggaccagcucaccacccgcgcccagcagcuggaggaggacaucgcgcuguucgaggcccaguaccucgcccaggccgaggacacgcgcauccugcggaaggccgucagcgaggcgugcaccgagaucgacgccaucuccguggagaagcgccggaucaugcagcagugggccagcucccugguggggaugaagcaccgcgacgaggcccaccgggccguccucgaggcgcugcgcggcugccagcaccaggccaagagcaccgacggggagaucgaggccuacaagaaguccaucaugaaggaggaggagaagaacgagaagcuggccagcauccucaaccggaccgagacggaggcgacccugcugcagaagcucaccacccagugccugacgaagcaggucgcccugcagucccaguucaacaccuaccgccucacccugcaggacaccgaggacgcccugagccaggaccagcucgagcagaugauccugacggaggagcugcaggccauccggcaggccauccagggcgagcuggagcuccgccggaagaccgacgcggccauccgcgagaagcugcaggagcacaugaccagcaacaagaccacgaaguacuucaaccagcugauccuccggcugcagaaggagaagaccaacaugaugacccaccuguccaagaucaacggggacaucgcccagaccacccucgacaucacgcacaccagcucccgccuggacgcccaccagaagacccugguggagcucgaccaggacgugaagaaggugaacgagcugaucaccaacagccaguccgagaucagccggcgcacgauccugaucgagcggaagcagggccucaucaacuuccugaacaagcagcuggagcgcaugguguccgagcucggcggggaggaggucggcccccuggagcuggagaucaagcggcucagcaagcugaucgacgagcacgacgggaaggccgugcaggcccaggugaccuggcugcgccuccagcaggagauggucaaggugacccaggagcaggaggagcagcuggcgucccuggacgccagcaagaaggagcuccacaucauggagcagaagaagcugcgcguggaguccaagaucgagcaggagaagaaggagcagaaggagaucgagcaccacaugaaggaccuggacaacgaccucaagaagcugaacaugcugaugaacaagaaccggugcagcuccgaggagcucgagcagaacaaccgcgucaccgagaacgaguucgugcggagccugaaggccuccgagcgcgagacgaucaagaugcaggacaagcugaaccagcucagcgaggagaaggccacccugcugaaccagcucguggaggcggagcaccagaucaugcugugggagaagaagauccagcuggccaaggagaugcgguccagcgucgacagcgagaucggccagaccgagauccgcgccaugaagggcgagauccaccggaugaagaaguacugccgcaccacgcaggacgcccaccggcacgugcacgagcagcacgggacccacgcggggaccugcaccaagaacacgggccgcgcccaggcccgggcccgcaccacccgggacgcccgcggccacgugcacgagcagcacgggacccgggcgggcacgugcaccaacaacaccggccgcgcccaggcccgggcccgcacccgggacgcccgccggcacguccacgagcaccgcacgcacaccgcgcgcgccuga

SEQ ID NO: 27802 - RNA, 927 nt, Artificial Sequence
  derived and/or modified sequence opt1 from CCDC42B__Homo_sapiens__NP_001138344
auggccgugcccugggaggaguacuuccgccuggcccuccaggagaagcugagcaccaagcugccggagcaggcggaggaccacgucccgcccgugcuccggcugcuggagaagcgccaggagcucguggacgccgaccaggcccugcaggcccagaaggaggucuuccggaccaagacggccgcgcugaagcagcgcugggagcagcucgagcagaaggagcgggagcugaagggcuccuucauccgcuucgacaaguuccugcaggacagcgaggcccggcgcaaccgggcccuccgccgggccgcggaggagcgccaccaggccgggcggcgcgagguggaggcccugcggcuguggacccagcuccaggagcugcgccgggagcacgcccgccugcagcggcgccucaagcggcuggagcccugcgcccgccugcucgagcaggcgcuggagcugcuccccggcuuccaggaggugcccgagcuggucgcccgcuucgacgggcuggccgagacccaggccgcccuccggcugcgcgagcgggagcagcuggcggagcucgaggccgcccgcgcccggcugcagcagcugcgcgacgccuggcccgacgaggugcucgcgcagggccagcggcgcgcccagcugcaggagcggcuggaggccgcccgcgagcggacccuccagugggaguccaaguggauccagauccagaacacggccgcggagaagacccugcugcucgggcgcagccggauggccgugcugaaccuguuccagcucgucugccagcaccagggccagcccccgacccuggacaucgaggacaccgagggccagcuggagcacgugaagcuguucaugcaggaccucuccgccaugcuggccgggcucggccaggcggagcccgccgcccccgccagcuga

SEQ ID NO: 27803 - RNA, 729 nt, Artificial Sequence
  derived and/or modified sequence opt1 from CCDC42__Homo_sapiens__NP_001151733
augagccugggcaucauggaggaggaggaccucgccgaguacuuccgccugcaguacggggagcggcugcuccagaugcugcagaagcugcccaacguggagggcgccuccgagagcccguccaucuggcuccuggagaagaagaaggagaccgagaucaugcaccagaccaugguccagaagaagaagauguuccagcgccggauggagacgcugaaccuccgcugggaggagcugggggugaaggaggcgcagcugaaggcccacauccagaaguccgagcaguucauccaggagaacgaccagaagcggauccgcgccaugaagaaggccaacaaggagcgggagcucaagugccagcacaugcaggagcugaccaagcgcaagcaggagaugguggcccugcggcucgagcaccagcgccugagcgcgaagcugaaggacuacuacaucuucaacaaguaccucgagaaggucguggagaacagcgaggagucccggugggcccacauccagaacaccgccgccaagaagacccugcugcucggcacgaucaagauggcgacccugaaccuguuccagaucgugagcaagcaccucaaggaggucaccgagguggcccuggaggacacccacaagcagcuggacaugauccagcaguucauccaggaccgcuccgacaucugggccgaggugaagaagaaggagcagcagcggguccgcaucuga

SEQ ID NO: 27804 - RNA, 921 nt, Artificial Sequence
  derived and/or modified sequence opt1 from CCDC50__Homo_sapiens__NP_777568
auggccgaggugagcaucgaccaguccaagcugcccggcgucaaggaggugugccgcgacuucgccgugcucgaggaccacacccuggcgcacagccugcaggagcaggagaucgagcaccaccucgccuccaacguccagcggaaccgccuggugcagcacgaccuccagguggccaagcagcugcaggaggaggaccugaaggcccaggcccagcugcagaagcgguacaaggaccucgagcagcaggacugcgagaucgcgcaggagauccaggagaagcuggccaucgaggccgagcgccggcgcauccaggagaagaaggacgaggacaucgcccggcugcuccaggagaaggagcugcaggaggagaagaagcgcaagaagcacuuccccgaguuccccgcgacccgggccuacgccgacagcuacuacuacgaggacgggggcaugaagccccgcgucaugaaggaggccguguccacgcccagccggauggcccaccgcgaccaggagugguacgacgcggagaucgcccggaagcugcaggaggaggagcuccuggccacccagguggacaugcgcgccgcccaggucgcgcaggacgaggagaucgcccggcugcucauggccgaggagaagaaggccuacaagaaggccaaggagcgcgagaaguccagccuggacaagcggaagcaggacccggaguggaagcccaagaccgcgaaggccgccaacuccaagagcaaggaguccgacgagccccaccacagcaagaacgagcgccccgcccggccgcccccgcccaucaugaccgacggggaggacgccgacuacacgcacuucaccaaccagcaguccagcacccgccacuucuccaagagcgaguccagccacaagggcuuccacuacaagcacuga

SEQ ID NO: 27805 - RNA, 987 nt, Artificial Sequence
  derived and/or modified sequence opt1 from CCDC54__Homo_sapiens__NP_115989
auguacacccugcacaccaagcgcgugaaggccgccgcgcggcagauguggacgagcaaccucuccaagguccgccagagccugaagaacguguaccacaagugcaagauccggcaccaggacuccaccggcuaccccaccgugaccagcgacgacugcaaccaggacgacgacuccuacgacgggaagaugaaccugccggucgugcuccaggacgugaagacggcccaggucgagcuguucagccagaugaccgacaucgugcacaugauccccaaggugcaggagaagaccgaccuguaccagaagcagauggagguccucgagacccgcaugaacgugaacgaggacaagcagugcacgaccaccaaggacauccuguccaugaaggaggacaucaaggcccugaagaagaaggugaccgagcucgagauccagaacagcugcuccacgauccacugccuggagauccuggagggcgagcgggggaaggagaucaccgagcuccuguacaagcugauccagcccgccacccucaagaacacccuggccagcacggacauggagaucuccagcgcggagcccgagaaggucccguccuaccccaagagcaccgaccaccuggagaagaagaccaucagcccccagaugaagacccucaagaagcgcaaccaccagaacgccucccgguccuucgagaaggccaagcccaacaucuacaucuacccggacuucagcacguggaucaagcugaccuucgugcacggcgggaaguggaccuucuuccuguccgccaccaagcucgaggaguucauccaguggcugcugagccgccccacgauccuccccgaggagccccaggugaucacccagcgguacugcccguucaccggccccauccugagccugaccacgaucugccucuccaucuucaacaacaucuacggcuucaucugcagccugaaggaggaggucacccgccuguga

SEQ ID NO: 27806 - RNA, 1653 nt, Artificial Sequence
  derived and/or modified sequence opt1 from CCDC60__Homo_sapiens__NP_848594
augaccaaggugcccgccaccaagaagcugcagagcuccccgaacagcggcgccguccgccccuucuacgcguccgagaaccuccgccaggugcccgacaagcccaugaaguccaucaaguacauggacaaggagaucaucaaccugaagaaggaccugauccggagccgguuccucauccagagcgugaagaucgggcgcggcuacuucgccauccugcgggaggagacggccaagaagaagaagcagcagcagcugcagaagcucaaggaggaggagcgcaacaaguuccagccggccgagaagaucuccgagauccacuacggggacacccugcugagcaccuacgacgacgagaagcucaagacccugggcgcccgggucacgcgccggcccuucacccccauccacuccugcaucaucagccccucccugaccgaggcgcacguggagccccucuuccgccagcugugcgcccugcacuggcuccuggaggcccugaccaucgaccacacgcaccacaccaugaagcccgugaucacgugcuggaaccccaaggaccccgggggcagcaaguccaccaucaagaagaucaacaaggacaagagcaugggccagaagugggagcacuucaucaccgccccgaagaccaagaaguucaagauccccaccaugcgggucaccaaccgcaagcccucccggcgcgggagcacgcucucccugagccgggcguccggcgggagcagcccccaguccagcaugaucuccgugaacccgggcagcgacgagccgcccuccgugaacacccaggucaccagcuccaaggacaucgaggacaacgagagcuccagcaccaagcccgacgaggagccgcuguacaugaaccuccagaagcugcuggagauggugcgcgaggacgcccggcgcacggugaccaucgagaacgggaugcagcggaaggcccccuccauccucagcguccugaagcagaacaaguccaacagcgccuacaaggagaugcagaccacccugaaguccagcgagcgcuccagcuccacgagcgccgagagccacauccagcccgugcagaagaaguccaagaaccggaccaacugcgacaucaacauccacuacaagagcggcgugugcaacaccaugcgcgcgaaguucuacuccgucgcccaggaggccggcuucugccuccaggacaagauggagauccugaugaagcgccaggaggagcgggggauccagaaguuccgcgccuucgugcuggugagcaacuuccagaaggacaucgccaagaugcggcaccacaucuccgucgugaagggcgacgcggaggagaucgccgaccacugguacuucgaccuccugagcaagcugcccgaggaccucaagaacuuccgcccggccaagaagauccuggugaagcugcagaaguucggggagaaccucgaccugcggauccgcccccacguccugcucaaggugcugcaggaccugcggaucugggagcucugcucccccgacaucgccguggccaucgaguucguccgcgagcacaucauccacaugccccaggaggacuacaucagcuggcugcagucccggaucaacaucccgaucggccccuacagcgcgcugcgcuga

SEQ ID NO: 27807 - RNA, 2055 nt, Artificial Sequence
  derived and/or modified sequence opt1 from CCDC62__Homo_sapiens__NP_958843
augaacccgcccgccgccuuccuggcgggccgccagaacaucgggagcgagguggagaucuccaccaucgagaagcagcggaaggagcuccagcugcugaucggcgagcucaaggaccgcgacaaggagcugaacgacauggucgccgugcaccagcagcagcugcucagcugggaggaggaccggcagaaggugcugacccuggaggagcgcugcuccaagcucgagggggagcugcacaagcggacggagaucauccgcagccugaccaagaaggucaaggcccucgaguccaaccagauggagugccagaccgcccugcagaagacccagcugcagcuccaggagauggcccagaaggcgacgcacagcucccugcugagcgaggaccucgaggcccggaacgagacccuguccaacacccugguggagcucagcgcccaggugggccagcugcaggcccgcgagcaggcgcugaccacgaugaucaagcucaaggacaaggacaucaucgaggccgucaaccacaucgccgacugcuccgggaaguucaagaugcuggagcacgcccugcgggacgccaagauggcggagaccugcaucgugaaggagaagcaggacuacaagcagaagcucaaggcccugaagaucgaggugaacaagcugaaggaggaccucaacgagaagaccaccgagaacaacgagcagcgcgaggagaucauccggcugaagcaggagaaguccugccugcacgacgagcuccuguucacggucgagcgcgagaagcggaaggacgagcugcucaacaucgccaagagcaagcaggagcgcaccaacagcgagcugcacaaccugcggcagaucuacgugaagcagcaguccgaccuccaguuccugaacuucaacguggagaacagccaggagcugauccagauguacgacuccaagauggaggagagcaaggcccucgacuccagccgcgacaugugccugagcgaccuggagaacaaccaccccaaggucgacaucaagcgggagaagaaccagaagucccucuucaaggaccagaaguucgaggccaugcuggugcagcagaaccgcagcgacaaguccagcugcgacgagugcaaggagaagaagcagcagaucgacaccguguucggcgagaaguccgucaucacccugagcuccaucuucacgaaggaccucguggagaagcacaaccugcccuggagccugggcgggaagacccagaucgagcccgagaacaagaucacccugugcaagauccacaccaaguccccgaagugccacggcacgggggugcagaacgagggcaagcagcccagcgagacccccacccucuccgacgagaagcaguggcacgacgucagcguguaccuggggcugaccaacugccccuccagcaagcacccggagaagcucgacguggagugccaggaccagauggagcgguccgagaucagcugcugccagaagaacgaggcgugccugggcgaguccggcaugugcgacagcaagugcugccaccccuccaacuucaucaucgaggcccccgggcacaugagcgacgucgaguggaugagcaucuucaagcccuccaagaugcagcgcaucgugcggcucaagagcggcugcacgugcuccgagagcaucugcgggacccagcacgacuccccggccagcgagcugaucgccauccaggacucccacagccugggcuccagcaaguccgcccugcgcgaggacgagaccgagagcuccagcaacaagaagaacucccccaccagccuccugaucuacaaggacgcgcccgccuucaacgagaaggccuccaucgugcugcccagccaggacgacuucagcccgacguccaagcuccagcgccugcuggccgagagccggcagauggucaccgaccucgagcuguccacccugcuccccaucagccacgagaaccugaccggcuccgccacgaacaagagcgaggugcccgaggaguccgcgcagaagaacaccuucgucagcuacuga

SEQ ID NO: 27808 - RNA, 1692 nt, Artificial Sequence
  derived and/or modified sequence opt1 from CCDC63__Homo_sapiens__XP_011536303
augagcgugcugaagaagaaccgccggaaggacuccgacacgccccaggagcccagcgagaaggccaaggagcagcaggccgaggcggagcuccgcaagcugcggcagcaguuccgcaagauggucgagucccgcaagagcuucaaguuccggaaccagcagaagaucgccucccaguacaaggagaucaagacccugaagaccgagcaggacgagaucacccuccugcugagccucaugaaguccagccggaacaugaaccgcuccgagaagaacuacauggagcugcggcugcuccugcagaccaaggaggacuacgaggcccugaucaagagccucaaggugcugcuggccgagcucgacgagaagauccugcagauggagaagaagaucgccaaccagaagcagaucuucgcgaagaugcaggaggccaacaacccccgcaagcugcagaagcagauccacauccucgagacccggcugaaccuggugacgguccacuucgacaagaugcucaccaccaacgccaagcugcgcaaggagaucgaggaccugcgguucgagaaggccgcguacgacaacguguaccagcagcuccagcacugccugcugauggagaagaagaccaugaaccucgccaucgagcaguccagccaggccuacgagcagcgcguggaggccauggcccggauggcggccaugaaggaccgccagaagaaggacacgucccaguacaaccuggagauccgggagcuggagcgccucuacgcccacgagagcaagcugaaguccuuccugcucgucaagcugaacgaccggaacgaguucgaggagcaggccaagcgcgaggaggcccugaaggcgaagaagcacgugaagaagaaccggggcgagagcuucgaguccuacgagguggcccaccuccgccugcugaagcucgccgagagcgggaaccugaaccagcugaucgaggacuuccucgccaaggaggagaagaacuucgcccgcuucaccuacgucaccgagcugaacaacgacauggagaugaugcacaagcggacccagcgcauccaggacgagaucauccugcuccggucccagcagaagcugagccacgacgacaaccacagcgugcugcgccagcucgaggacaagcugcggaagacgaccgaggaggcggacauguacgaguccaaguacggcgaggugagcaagacccuggaccugcucaagaacuccgucgagaagcuguucaagaagaucaacugcgacgccaccaagauccuggugcagcucggggagacgggcaaggugaccgacaucaaccugccccaguacuucgccaucaucgagaagaagaccaacgaccugcuccugcuggagaccuaccgccggauccucgaggucgagggggccgaggccgagaucccgccgcccuucaucaaccccuucuggggcggcagcgcgcugcugaagccgcccgagcccaucaaggugaucccgcccgugcucggggccgaccccuucuccgaccgccuggacgacgucgagcagccccuggaccacagcucccuccggcagcuggugcuggacaacuacauccucaaggagaaccgcagcaaggaggugcggggcgacucccugcccgagaaggucgacgacuuccgcagccggaagaaggugacgauguga

SEQ ID NO: 27809 - RNA, 1455 nt, Artificial Sequence
  derived and/or modified sequence opt1 from CCDC65__Homo_sapiens__NP_149115
augcccaagaaggagaagauggccaagaccccgcugagcgacgagaagcagcuccugcuguuccagcagaagcuccuggccgaggaggagauggcgaagaagaaggagcgccugcucucccaguuccugaaggacaagcuggccaaggaggagcacaacagcgcccucaaccugaacaagaucaacacccaguggcggacggugcugcgcgaggucaagacccgggagcuccacaaggacaucgagauccugucccagaccuucgagcgcgugguggacugcaaggacaacgucaucaagagccuggccaaggaccucuccgaggccgaggagcaguacgcgcacgcccugcggagccaccuccacaacguggaccagcugcuggcccugcagcgccaccggcucucccugcuggaggagagcuacaacauggagcucgaggcccugaccaaggaguucgagacggagcgcaagaccaucaucgaccagcacgagaaggagauccacuaccugcaggacaucuucauggcgauggagcagaacuacaucgacuccgaguacgagagcaagcucgaguuccaguccauguggaacgaccugaagaacaugaaccuggaggagaagcacuuccuccggcugcaccuggagaaccgcguggaggaccucuggcggaaguuccaggacguccugaagaacuacaccgacgccaccgaggaccgcaaggccgccuucgagacgcuccaggugaaggacgagaaguccagcaaggagaucgaggugcagaugaagaagauccagaagcugcaggacgccaucaccaucagcaagggcaagaucaugauccacucccgggagagcgaggacgagaaccgcuacauccggaacgacaaggagcugguccuggugcagcuccgcaagcugaaggcgcagcggacccaggcccgcgccgccucccagaagaaccuggugcggcucacccuggagagcaacgccacgcugaaggcgcuccgcaagaucgucgacaagggggagaagauccugaagcuggccgagaucugccggaaguucgagaccgaggaggagaaggugcuccccuucuacuccagcgugcugacccccaaggagcaggagggcauccagaagaacaaccuggaggagcugaccgaggagcucacgaaggucaugguggacuacaucgggauggagaacuucuggaagcgcuacaacaaggugaagcuggagcagcugagccuccagcaccgccgggcccagcugcuggacaucaacggcaagcuccgcgagaugcugaagcaguaccuggacgggaucuccgucagcgacgaggugcucucccagcugaacccccuguucaucgugaacuaccagagcaaccuccugcagccgcuguccauccggaucgcccaccccggcgacaagcagcaccccaccaccuga

SEQ ID NO: 27810 - RNA, 2745 nt, Artificial Sequence
  derived and/or modified sequence opt1 from CCDC66__Homo_sapiens__NP_001012524
augggcaacaaggccaagaucgccaagugcccccugcgcaccaagaccgggcacauccucaagagcacgcaggacacgugcaucggcuccgagaagcugcugcagaagaagccgguggggagcgagaccucccaggcgaagggcgagaagaacgggaugaccuucagcuccaccaaggaccucugcaagcagugcaucgacaaggacugccugcacauccagaaggagaucagccccgccacccccaacaugcagaagacccggaacaccgucaacacgucccuggugggcaagcagaagccccacaagaagcacaucaccgccgagaacaugaaguccagccucgugugccugacccaggaccagcugcagcagauccucaugaccgucaaccagggcaaccgcagccugucccugacggagaacgggaaggaggccaagagccaguacucccucuaccugaacagcaucuccaaccagccgaaggacgagaacaucaugggccuguucaagaagaccgagauggugagcuccgugcccgccgagaacaagagcguccucaacgagcaccaggagaccuccaagcagugcgagcagaagaucgcgaucgagaacgaguggaagcccgccgacaucuucagcacccugggggagcgggagugcgaccgcagcucccuggaggccaagaaggcccaguggcggaaggagcucgacgagcaggucgcgcugaagaagaaggagaaggaggugagcgagaaguggaacgaccccuggaagaaguccgagagcgacaagaucaucugggagaagcaccagauccuggaccagucccgcgagacggugcuccuggagcacccguucagcgccgugaagcaggagcugcagcggaaguggaucgaggagcucaacaagcagaucgaggacgaccgccagcggaagaucgaggagaagaucaucuacuccaagggcgaggagcacgaccgcugggccaugcacuucgacagccugaaguccuaccccgggagccagucccagcuguucagccaguccacccacaagcagcccgaguacuucugcgugagccccgacacccaggagcucgccgacgucuccagcgugugcaccccgacgaccggcucccagguggagcccagcgaggaggagcacaucgccaagcccaucaaggacgucgugauggcgaacuccaagaagaccaacuuccugcggagcaugaccgcccugcucgaccccgcccagaucgaggagcgcgaccggcgccggcagaagcagcuggagcaccagaaggccaucacggcccagguggaggagaagcgccggaagaagcagcuggaggaggagcagcgcaagaaggaggagcaggaggaggagcuccggcuggcgcaggagcgcgaggagaugcagaagcaguacgaggaggacauccugaagcagaagcagaaggaggagaucaugacccucaagaccaacgagcuguuccagaccaugcagcgggcccaggagcuggcccagcgccucaagcaggagcagcgcauccgggagcuggcccagaagggccacgacacgagccgccugaucaagaaccucggggucgacaccauccagauggaguacaacgccuccaacaucagcaacucccggcacgacagcgacgagaucuccggcaagaugaacaccuacaugaacagcaccacguccaagaaggacaccggggugcagaccgacgaccugaacaucggcaucuucaccaacgcggagagccacugcggcucccugauggagcgcgacaucacgaacugcagcuccccggagaucagcgccgagcucaucgggcaguucuccaccaagaagaacaagcaggagcugacccaggacaagggcgccagccuggagaaggagaacaaccggugcaacgaccagugcaaccaguucacccgcaucgagaagcagaccaagcacaugaagaaguaccccaagcggcccgacuggaacaucaacaagcccccgaagcgcuacauccccgccuccgagaaguaccccaagcagcuccagaagcagcgggaggagaagaaggugcgccggcagauggagcugcugcaccuggucgagaagaacaaccccgggcaccucagccagaaccgcggcaucuccccggagaucuuccacagcagccaccaggagacggaguccaagcugcgguggcaccuggugaagaaggaggaggagccccucaacauccacagcuucuccaaggagcgcagccccuccagccccgugccggucgugaagaaccggacccagcagacccagaacacccugcaccucccccugaagaacuccagcuacgagcgcgagaaccugaucuccgggagcaaccagacggagcuguccagcggcaucuccgagagcucccacuucauccccuacguccggaccaacgagaucuacuaccucgacccggacgcgccccugagcggccccuccacccaggacccccaguaccagaacagccaggacugcgggcagaagcgccagcuguucgacuccgacugcgugcgggacccgcuccugaaccccaacauggugaagaaccgcgaccgccagcaggccauccugaagggccucagcgagcugcggcaggggcugcuccagaagcagaaggagcuggagagcucccugcucccccuggccgagaaccaggaggagagcuucggcuccagcuucuga

SEQ ID NO: 27811 - RNA, 1815 nt, Artificial Sequence
  derived and/or modified sequence opt1 from CCDC67__Homo_sapiens__NP_857596
auggagaaccaggcccacaacaccaugggcaccagccccugcgaggccgagcugcaggagcucauggagcagaucgacaucaugguguccaacaagaagauggacugggagcgcaagaugcgggcgcuggagacgcgccuggaccuccgggaccaggagcuggccaacgcccagaccugccuggaccagaaggggcaggaggucggccuccugcgccagaagcuggacagccucgagaagugcaaccuggccaugacccagaacuacgaggggcagcugcagucccucaaggcccaguucagcaagcugaccaacaacuucgagaagcugcggcuccaccagaugaagcagaacaaggugccccgcaaggagcugccccaccugaaggaggagauccccuucgagcucuccaaccugaaccagaagcuggaggaguuccgggcgaagucccgcgagugggacaagcaggagauccucuaccagacgcaccugaucucccuggacgcccagcagaagcuccugagcgagaagugcaaccaguuccagaagcaggcccaguccuaccagacccagcugaacggcaagaagcagugccucgaggacagcuccagcgagaucccccggcugaucugcgacccggaccccaacugcgagaucaacgagcgcgacgaguucaucaucgagaagcugaaguccgccgugaacgagaucgcgcucagccggaacaagcugcaggacgagaaccagaagcugcuccaggagcugaagauguaccagcgccagugccaggccauggaggccgggcuguccgaggucaagagcgagcuccagucccgggacgaccugcugcgcaucaucgagauggagcggcuccagcugcaccgcgagcugcucaagaucggcgagugccagaacgcccagggcaacaagacccggcuggagagcuccuaccugcccagcaucaaggagcccgagcgcaagaucaaggagcuguucagcgugaugcaggaccagccgaaccacgagaaggagcucaacaagauccggucccagcugcagcaggucgaggaguaccacaacagcgagcaggagcgcaugcggaacgagaucuccgaccucaccgaggagcugcaccagaaggagaucacgaucgccaccgugaccaagaaggcggcccugcuggagaagcagcucaagauggagcuggagaucaaggagaagaugcuggccaagcagaaggugagcgacaugaaguacaaggccgugcgcaccgagaacacgcaccucaaggggaugaugggcgaccuggaccccggggaguacauguccauggacuucaccaaccgcgagcagagccggcacaccuccaucaacaagcugcaguacgagaacgagcgccuccggaacgaccuggccaagcugcacgucaacggcaagagcaccuggacgaaccagaacaccuacgaggagaccgggcgcuacgcguaccagucccagaucaagguggagcagaacgaggagcggcucagccacgacugcgagcccaaccgcuccaccaugcccccgcugccgcccagcacguuccaggccaaggagaugaccagcccccuggugagcgacgacgacgucuucccccucuccccgcccgacaugagcuuccccgccucccuggccgcccagcacuuccugcucgaggaggagaagcgggcgaaggagcuggagaagcugcucaacacccacaucgacgagcugcagcgccacaccgaguucacgcugaacaaguacagcaagcucaagcagaaccggcacaucuga

SEQ ID NO: 27812 - RNA, 1008 nt, Artificial Sequence
  derived and/or modified sequence opt1 from CCDC68__Homo_sapiens__NP_001137301
augaccaccgugacggucaccaccgagaucccgccccgcgacaagauggaggacaacagcgcccuguacgaguccaccagcgcccacaucaucgaggagacggaguacgugaagaagauccggaccacccuccagaagauccgcacccagauguucaaggacgagauccggcacgacuccacgaaccacaagcuggacgcgaagcacugcggcaaccugcagcaggggagcgacuccgagauggaccccagcugcugcucccucgaccugcugaugaagaagaucaagggcaaggaccuccagcugcuggagaugaacaaggagaacgaggugcucaagaucaagcugcaggccagccgcgaggccggggccgccgcgcugcggaacgucgcccagcgccucuucgagaacuaccagacccaguccgaggaggugcggaagaagcaggaggacagcaagcagcugcuccaggugaacaagcuggagaaggagcagaagcugaagcagcacgucgagaaccugaaccagguggccgagaagcucgaggagaagcacucccagaucaccgagcuggagaaccuggugcagcgcauggagaaggagaagcggacccuccuggagcgcaagcugagccucgagaacaagcugcugcagcucaaguccagcgccacguacggcaaguccugccaggaccugcagcgggagaucagcauccugcaggagcagaucucccaccuccaguucgucauccacagccagcaccagaaccugcgcuccgugauccaggagauggaggggcugaagaacaaccucaaggagcaggacaagcggaucgagaaccugcgcgagaaggugaacauccuggaggcgcagaacaaggagcucaagacccaggucgcccugagcagcgagacgccccggaccaagguguccaaggccgugagcaccuccgagcugaagaccgagggcgucagccccuaccucaugcugauccgccugcggaaguga

SEQ ID NO: 27813 - RNA, 1425 nt, Artificial Sequence
  derived and/or modified sequence opt1 from CCDC6__Homo_sapiens__NP_005427
auggccgacagcgccuccgagagcgacaccgacggcgccgggggcaacuccagcuccagcgcggccaugcaguccagcugcuccagcaccuccgggggcgggggcggcgggggcgggggcgggggcggcggcaagagcggcgggaucgugaucucccccuuccgccuggaggagcucacgaaccggcuggccagccugcagcaggagaacaagguccucaagaucgagcuggagaccuacaagcugaagugcaaggcccuccaggaggagaaccgcgaccugcggaaggcguccgugaccauccaggcccgcgccgagcaggaggaggaguucaucagcaacacccuguucaagaagauccaggcccuccagaaggagaaggagacgcuggcggugaacuacgagaaggaggaggaguuccugaccaacgagcucucccggaagcugaugcagcugcagcacgagaaggccgagcucgagcagcaccuggagcaggagcaggaguuccaggucaacaagcugaugaagaagaucaagaagcucgagaacgacaccaucagcaagcagcugacccuggagcagcuccgccgggagaagaucgaccuggagaacacgcuggagcaggagcaggaggcccucgugaaccgccuguggaagcggauggacaagcuggaggccgagaagcgcauccuccaggagaagcuggaccagcccguguccgccccgcccagcccccgggacaucagcauggagaucgacucccccgagaacaugaugcgccacauccgguuccugaagaacgaggucgagcgccucaagaagcagcugcgggcggcccagcugcagcacagcgagaagauggcccaguaccucgaggaggagcgccacaugcgggaggagaaccugcgccugcagcggaagcuccagcgcgagauggagcggcgcgaggcccugugccgccagcuguccgagagcgaguccagccucgagauggacgacgagcgguacuucaacgagauguccgcccaggggcugcgcccccggaccgugagcucccccauccccuacacccccagccccuccagcucccgccccaucagccccggccuguccuacgcgagccacaccgugggguucacgccgcccaccucccucacccgggccggcaugagcuacuacaacucccccgggcugcacguccagcacaugggcaccagccacgggaucacgcgccccagcccgcggcgcuccaacagccccgacaaguucaagcggcccacgcccccgcccucccccaacacccagacccccgugcagccgcccccgccgcccccgccgccgcccaugcagcccaccgugcccagcgccgccaccucccagcccacccccagccagcacuccgcccaccccagcucccagcccuga

SEQ ID NO: 27814 - RNA, 1317 nt, Artificial Sequence
  derived and/or modified sequence opt1 from CCDC78__Homo_sapiens__NP_001026907
auggagcacgccgccacgaccggcccccgcccggggccgcccagccggcgcguggagaacgucgugcugcgggcgaaggacuggcuccccggcgcccccgggggcacggccgugugggccaccucccuggaggccgaggucccgcccgaccuggcgcucaacaaggagcagcagcugcagaucagcaaggagcugguggacauccagaucaccacccaccaccuccacgagcagcacgaggccgagaucuuccagcugaaguccgagauccugcgccucgagagccgggugcuggagcuggagcuccgcggggacggcacgucccagggcugcgccguccccguggagagcgacccccggcacccccgcgccgcggcccaggagcugcggcacaaggcccaggugcccgggcacuccgacgaccaccgcuuccagguccagcccaagaacaccaugaacccggagaacgagcagcaccggcugggcagcgggcuccagggcgaggugaagugggcccuggagcaccaggaggcccgccagcaggcgcuggugacccgggucgccacccucgggcgccagcugcagggcgcccgggaggaggcccgcgccgcgggccagcggcuggccacgcaggccguggugcucugcuccugccaggggcagcugcgccaggccgaggccgagaacgcgcggcugcagcuccagcugaagaagcugaaggacgaguacguccuccgccugcagcacugcgccuggcaggccguggagcacgccgacggcgccgggcaggcgcccgccaccaccgcccugcggaccuuccucgaggccacgcuggaggacauccgcgcggcccaccgcagccgggagcagcagcuggcccgcgccgcccgguccuaccacaagcgccucguggaccugagccggcgccacgaggagcugcucgucgcguaccgggcccccggcaacccccaggccaucuucgacaucgccucccuggaccuggagccgcuccccgugccccuggugaccgacuucagccaccgcgaggaccagcacggcgggcccggcgcccugcucuccagcccgaagaagcggcccgggggcgcgucccagggcgggaccagcgagccccagggccuggacgccgccuccugggcccagauccaccagaagcugcgcgacuucagccggagcacccaguccuggaacgggagcggccacuccugcuggagcgggccccgcuggcucaaguccaacuuccugagcuaccgguccacguggaccagcaccugggccggcaccuccaccaagagcuga

SEQ ID NO: 27815 - RNA, 2853 nt, Artificial Sequence
  derived and/or modified sequence opt1 from CCDC80__Homo_sapiens__NP_955805
augaccuggcgcaugggcccccgguucaccaugcugcucgccauguggcuggugugcgggagcgagccgcacccccacgccacgauccgcggcucccacgggggccggaaggucccccuggugagccccgacuccagccgcccggcgcgguuccuccgccacaccgggcggucccgcggcaucgagcggagcacccuggaggagcccaaccugcagccccuccagcgccggcgcuccgugcccguccugcggcuggcccgcccgaccgagccgcccgcccggagcgacaucaacggcgccgccgugcgccccgagcagcggcccgcggcccgcgggagcccccgggagaugauccgcgacgagggcagcuccgcccggagccgcaugcuccgcuuccccuccgggagcuccagccccaacauccuggccuccuucgcgggcaagaaccgggugugggucaucagcgccccgcacgccuccgagggguacuaccgccugaugaugagccuccugaaggacgacguguacugcgagcuggccgagcggcacauccagcagaucguccucuuccaccaggccggcgaggagggcgggaagguccgccggaucacgagcgagggccagauccuggagcagccccuggaccccucccucauccccaagcugaugagcuuccugaagcucgagaaggggaaguucggcauggugcugcugaagaagacccuccagguggaggagcgcuacccguaccccguccggcuggaggcgauguacgaggugaucgaccagggccccauccgccggaucgagaagauccgccagaagggguucgugcagaagugcaaggccuccggcgucgagggccaggugguggccgagggcaacgacgggggcggcggggccggccggcccagccugggguccgagaagaagaaggaggacccgcgccgggcccaggugccgcccacccgcgagagccgggugaaggugcuccgcaagcuggcggccaccgcccccgcccugccccagccgcccuccacgccccgggccaccacccucccgcccgcgcccgccaccacggucacccgcagcaccucccgggccgugaccguggccgcccgccccaugacgaccaccgcguuccccaccacgcagcgccccuggacccccagcccgucccaccggccgcccaccaccacggaggucaucaccgcccgccggcccagcguguccgagaaccuguacccgcccagccgcaaggaccagcaccgggagcgcccccagaccacccggcgccccuccaaggccacgagccuggaguccuucaccaacgccccgcccaccaccaucagcgagcccuccacgcgggcggccgggcccgggcgcuuccgggacaaccgcauggaccggcgcgagcacggccaccgggaccccaacgucgugcccggcccgcccaagcccgccaaggagaagccgcccaagaagaaggcccaggacaagauccucagcaacgaguacgaggagaaguacgaccugagccgccccaccgccucccagcuggaggacgagcuccagguggggaacgucccccugaagaaggcgaaggagagcaagaagcacgagaagcuggagaagcccgagaaggagaagaagaagaagaugaagaacgagaacgccgacaagcuccugaaguccgagaagcagaugaagaaguccgagaagaaguccaagcaggagaaggagaaguccaagaagaagaagggcgggaagaccgagcaggacggcuaccagaagcccaccaacaagcacuucacgcagagcccgaagaaguccguggccgaccugcucgggagcuucgagggcaagcggcgccugcugcucaucaccgcccccaaggccgagaacaacauguacgugcagcagcgggacgaguaccuggagagcuucugcaagauggcgacccgcaagaucuccgucaucaccaucuucggccccgugaacaacagcaccaugaagaucgaccacuuccagcuggacaacgagaagcccaugcggguggucgacgacgaggaccucguggaccagcgccugaucuccgagcugcgcaaggaguacgggaugacguacaacgacuucuucauggugcugaccgacgucgaccuccgggugaagcaguacuacgaggugccgaucaccaugaaguccgucuucgaccugaucgacaccuuccagagccgcaucaaggacauggagaagcagaagaaggagggcaucgugugcaaggaggacaagaagcagagccuggagaacuuccucucccgguuccgcuggcggcgccggcugcuggugaucagcgcccccaacgacgaggacugggccuacagccagcagcucuccgcccugagcgggcaggccugcaacuucggccugcgccacaucacgauccucaagcugcugggcgucggggaggaggugggcggggugcucgagcuguuccccaucaacggcuccagcgucguggagcgggaggacgugcccgcgcaccuggucaaggacauccgcaacuacuuccagguguccccggaguacuucagcaugcuccugguggggaaggacggcaacgucaaguccugguaccccagccccaugugguccauggugaucguguacgaccugaucgacagcaugcagcuccggcgccaggagauggccauccagcagucccugggcaugcggugccccgaggacgaguacgccggguacggcuaccacagcuaccaccagggguaccaggacggcuaccaggacgacuaccgccaccacgaguccuaccaccacggguacccguacuga

SEQ ID NO: 27816 - RNA, 1242 nt, Artificial Sequence
  derived and/or modified sequence opt1 from CCDC83__Homo_sapiens__NP_001273088
auggagaacagcggcaaggccaacaagaaggacacccacgacgggcccccgaaggagaucaagcugcccaccagcgaggcccuccuggacuaccagugccagaucaaggaggacgcgguggagcaguucauguuccagaucaagacgcugcgcaagaagaaccagaaguaccacgagcggaacagccgccucaaggaggagcagaucuggcacauccggcaccuccugaaggagcucuccgaggagaaggccgagggccugcccgucgugacccgcgaggacguggaggaggccaugaaggagaaguggaaguucgagcgggaccaggagaagaaccugcgcgacaugcggaugcagaucagcaacgccgagaagcuguuccuggagaagcuguccgagaaggaguacugggaggaguacaagaacgucgggagcgagcgccacgccaagcucaucaccucccugcagaacgacaucaacaccgugaaggagaacgcggagaagaugagcgagcacuacaagaucacgcuggaggacacccggaagaagaucaucaaggagacccuccugcagcuggaccagaagaaggagugggccacccagaacgccgugaagcucaucgacaagggcuccuaccuggagaucugggagaacgacuggcugaagaaggaggucgccauccaccgcaaggagguggaggagcucaagaacgcgauccacgagcuggaggccgagaaccuggugcucaucgaccagcugagcaacugccggcuggucgaccucaagaucccccgccggcuguaccugacgcaggccgccgggcucgaggugccgcccgaggagaugucccuggagcugcccgagacccacaucgaggagaaguccgagcuccagcccaccgagguggagagccgcgaccugaugagcuccagcgacgaguccaccauccugcaccucagccacgagaacuccaucgaggaccugcaguacgucaagaucgacaaggaggagaacagcggcacggaguucggcgacaccgacaugaaguaccugcucuacgaggacgagaaggacuucaaggacuacgugaaccuggggccgcugggcgugaagcucaugagcgucgaguccaagaagaugcccauccacuuccaggagaaggagauccccgugaagcuguacaaggacgugcggagccccgagucccacaucaccuacaagaugaugaaguccuuccuguga

SEQ ID NO: 27817 - RNA, 1662 nt, Artificial Sequence
  derived and/or modified sequence opt1 from CCDC85A__Homo_sapiens__NP_001073902
augagcaaggccgccggcggggcggccgccgccgccgcggccgccgaguccugcagccccgccccggcgggcuccagcgccgccccgcccgcccccguggaggaccuguccaaggucagcgacgaggagcuccugcagugguccaaggaggagcugauccgcagccuccggcgcgccgaggcggagaagguguccgccaugcuggaccacagcaaccugauccgggaggugaaccgccggcuccagcugcaccugggggagauccgcggccucaaggacaucaaccagaagcugcaggaggacaaccaggagcugcgggaccucugcugcuuccuggacgacgaccgccagaaggggaagcgggucucccgcgaguggcagcggcugggccgcuacaccgccggcgugaugcacaaggagguggcccucuaccugcagaagcugaaggaccucgaggucaagcaggaggagguggugaaggagaacauggagcugaaggagcugugcguccuccuggacgaggagaagggggccggcugcgcggggagccggugcuccaucgacagccaggccucccugugccagcucaccgccagcacggcccccuacgugcgcgacgugggcgacggguccagcaccuccagcaccggcagcaccgacucccccgaccaccacaagcaccacgccagcuccggcagccccgagcaccuccagaagccccgguccgaggggagcccggagcacuccaagcaccgcagcgcgucccccgagcacccccagaagccccgggccugcggcacgccggaccgccccaaggcccugaaggggcccagccccgagcaccacaagccgcugugcaagggcucccccgagcagcagcggcacccccaccccggcagcuccccggagacccugcccaagcacguccugagcgggucccccgagcacuuccagaagcaccgcagcggcuccagccccgagcacgcccggcacuccgggggcagcccggagcaccuccagaagcacgcccugggcgggagccuggagcaccucccccgcgcgcgcggcaccucccccgagcaccugaagcagcacuacgggggcagccccgaccacaagcacgggggcggguccggcggcagcgggggcuccgggggcgggagccgggagggcacccugcgccggcaggcccaggaggacggcuccccgcaccaccgcaacguguacagcgggaugaacgaguccacgcucagcuacgugcggcagcuggaggcccgcguccggcagcuggaggaggagaaccgcaugcucccccaggccucccagaaccggcgccagcccccgacccggaacagcuccaacauggagaagggcugggggagccgcgcgcggcgcgugcugcagugguggcagggcugccggggcaucgggcgcugccugcccacccuccccggcuccuuccggcugagcuccggggccgacggcagcaacagcucccccaacagcgccgccuccuucagcgggcacgccaccccgucccagcagcccgagcccgugguccacagccugaaggugguguggcgcaagcucggcgacgcggccggcuccugccccgggauccggcagcaccugagcggcaaccaguacaaggggccgauguga

SEQ ID NO: 27818 - RNA, 1083 nt, Artificial Sequence
  derived and/or modified sequence opt1 from CCDC86__Homo_sapiens__NP_077003
auggacacgccccugcgccggagccgccggcucggcgggcugcgcccggagucccccgagagccugaccuccgugagccggacccgccgggcccucgucgaguucgaguccaaccccgaggagacccgcgagcccggcagcccgcccuccgugcagcgggccgggcugggcagccccgagcggcccccgaagaccucccccgggagcccccgccugcagcagggcgcgggccucgaguccccgcaggggcagcccgagcccggcgccgccagcccccagcgccagcaggaccugcaccuggagagcccccagcggcagccggaguacucccccgagagcccccgcugccagcccaagccguccgaggaggcccccaagugcucccaggaccagggggugcucgccagcgagcuggcgcagaacaaggaggagcugacccccggcgcgccccagcaccagcucccgcccguccccgggucccccgagccguaccccggccagcaggcccccggcccggagcccagccagccccugcuggagcucacgccccgggccccggggagcccccgcggccagcacgagcccuccaagcccccgcccgccggggagaccgugaccggcggcuucggggccaagaagcggaagggcagcuccagccaggcccccgccuccaagaagcugaacaaggaggagcugcccgugaucccgaaggggaagcccaagagcggccgcgucuggaaggaccgguccaagaagcgcuucagccagaugcuccaggacaagccccugcggaccuccuggcagcgcaagaugaaggagcgccaggagcggaagcuggccaaggacuucgcgcgccaccucgaggaggagaaggagcggcgccggcaggagaagaagcagcgccgggccgagaaccugaagcgccggcuggagaacgagcgcaaggccgagguggugcaggucauccggaaccccgccaagcucaagcgcgccaagaagaagcagcugcggagcaucgagaagcgcgacacgcuggcgcuccugcagaagcagccgccccagcagcccgccgccaagaucuga

SEQ ID NO: 27819 - RNA, 5613 nt, Artificial Sequence
  derived and/or modified sequence opt1 from CCDC88A__Homo_sapiens__NP_001129069
auggagaacgagaucuucacgccccugcuggagcaguucaugaccagcccgcuggugacgugggucaagaccuucggcccccuggccgccgggaacggcaccaaccucgacgaguacguggcccugguggacggggucuuccugaaccaggugaugcuccagaucaaccccaagcuggagagccagcgcgugaacaagaaggucaacaacgacgccagccugcggaugcacaaccucagcauccuggugcgccagaucaaguucuacuaccaggagacccugcagcagcucaucaugaugagccugcccaacgugcugaucaucggcaagaaccccuucagcgagcaggggaccgaggaggucaagaagcuccugcugcuccugcugggcugcgccgugcagugccagaagaaggaggaguucaucgagcggauccagggccucgacuucgacaccaaggccgccguggcggcccacauccaggaggucacccacaaccaggagaacguguucgaccugcaguggauggaggugaccgacaugagccaggaggacaucgagccccugcucaagaacauggcccugcaccugaagcgccucaucgacgagcgggacgagcacuccgagaccaucaucgagcugagcgaggagcgcgacgggcugcacuuccucccccacgccuccagcuccgcgcagagccccugcggcucccccgggaugaagcggaccgagagccgccagcaccuguccgucgagcuggccgacgccaaggccaagauccggcgccuccggcaggagcuggaggagaagaccgagcagcugcucgacugcaagcaggagcuggagcagauggagaucgagcugaagcgccuccagcaggagaacaugaaccugcugagcgacgcccgguccgcgcgcauguaccgggacgagcucgacgcccugcgcgagaaggccgugcggguggacaagcuggagagcgaggucucccgcuacaaggagcggcuccacgacaucgaguucuacaaggcccgcguggaggagcugaaggaggacaaccaggugcugcucgagaccaagacgaugcuggaggaccagcuggagggcacccgggcccgcagcgacaagcugcacgagcucgagaaggagaaccugcagcugaaggcgaagcuccacgacauggagauggagcgcgacauggaccggaagaagaucgaggagcugauggaggagaacaugacccuggagauggcccagaagcagagcauggacgagucccuccaccuggggugggagcuggagcagaucagccgcaccuccgagcucagcgaggcgccccagaagucccugggccacgaggucaacgagcugacgagcucccggcuccugaagcuggagauggagaaccagagccucaccaagaccguggaggagcugcgcaccacgguggacuccgucgagggcaacgccagcaagauccugaagauggagaaggagaaccagcggcucuccaagaagguggagauccuggagaacgagaucguccaggagaagcagagccugcagaacugccagaaccucuccaaggaccugaugaaggagaaggcccagcuggagaagaccaucgagacccuccgcgagaacagcgagcggcagaucaagauccuggagcaggagaacgagcaccugaaccagaccguguccagccuccgccagcggucccagaucagcgcggaggcccgcgugaaggacaucgagaaggagaacaagauccugcacgaguccaucaaggagacgagcagcaagcuguccaagaucgaguucgagaagcggcagaucaagaaggagcucgagcacuacaaggagaagggggagcgcgccgaggagcuggagaacgagcugcaccaccucgagaaggagaacgagcugcugcagaagaagaucaccaaccucaagaucacgugcgagaagaucgaggcccuggagcaggagaacagcgagcuggagcgggagaaccgcaagcucaagaagacccuggacuccuucaagaaccugacguuccagcucgagagccuggagaaggagaacucccagcuggacgaggagaaccucgagcugcggcgcaacgucgagagccugaagugcgccuccaugaagauggcgcagcuccagcuggagaacaaggagcuggagagcgagaaggagcagcucaagaagggccuggagcugcucaaggccuccuucaagaagaccgagcggcuggaggugagcuaccaggggcuggacaucgagaaccagcgccuccagaagacccuggagaacuccaacaagaagauccagcagcuggagagcgagcuccaggaccuggagauggagaaccagacccugcagaagaaccucgaggagcugaagaucuccagcaagcggcuggagcagcucgagaaggagaacaagucccuggagcaggagacgagccagcuggagaaggacaagaagcagcucgagaaggagaacaagcgccugcgccagcaggccgagaucaaggacaccacccuggaggagaacaacgugaagaucggcaaccucgagaaggagaacaagacccuguccaaggagaucggcaucuacaaggagagcugcguccggcugaaggagcucgagaaggagaacaaggagcuggugaagcgcgccacgaucgacaucaagacccuggugacccuccgggaggaccuggucagcgagaagcugaagacccagcagaugaacaacgaccucgagaagcugacccacgagcuggagaagaucgggcucaacaaggagcgccugcugcacgacgagcaguccacggacgaccgguacaagcuccuggagagcaagcuggaguccacccucaagaagucccuggagaucaaggaggagaagaucgcggcccuggaggcccgccucgaggagagcaccaacuacaaccagcagcugcggcaggagcugaagaccgugaagaagaacuacgaggcccugaagcagcgccaggacgaggagcggauggugcagagcagcccgcccaucagcggcgaggacaacaagugggagcgcgagucccaggagacgacccgggagcuccugaaggucaaggaccgccugaucgagguggagcggaacaacgccacccuccaggcggagaagcaggcccugaagacccagcugaagcagcucgagacgcagaacaacaaccugcaggcccagauccuggcccuccagcgccagaccgugagccugcaggagcagaacaccacccugcagacgcagaacgccaagcuccaggucgagaacuccacccugaacagccaguccaccagccugaugaaccagaacgcgcagcuccugauccagcaguccagccuggagaacgagaacgaguccgugaucaaggagcgggaggaccucaagagccuguacgacucccugaucaaggaccacgagaagcucgagcugcugcacgagcgccaggccagcgaguacgagagccucaucuccaagcacgggacccugaaguccgcccacaagaaccuggagguggagcaccgggaccucgaggaccgcuacaaccagcugcugaagcagaagggccagcucgaggaccuggagaagaugcugaaggucgagcaggagaagaugcuccuggagaacaagaaccacgagacgguggccgccgaguacaagaagcugugcggggagaacgaccggcucaaccacaccuacucccagcugcugaaggagaccgaggugcuccagaccgaccacaagaaccucaagagccugcucaacaacuccaagcuggagcagacgcgccuggaggcggaguucagcaagcucaaggagcaguaccagcagcuggacaucaccuccaccaagcugaacaaccagugcgagcuccugagccagcugaagggcaaccucgaggaggagaaccggcaccuccuggaccagauccagacccugaugcugcagaaccgcacgcugcucgagcagaacauggaguccaaggaccuguuccacgucgagcagcgccaguacaucgacaagcugaacgagcuccggcgccagaaggagaagcuggaggagaagaucauggaccaguacaaguucuacgaccccuccccgccccggcgccggggcaacuggaucacccugaagaugcgcaagcucaucaaguccaagaaggacaucaaccgggagcgccagaagucccugacccugacccccacgcgguccgacagcuccgagggguuccuccagcugccgcaccaggacagccaggacuccagcuccgugggcagcaacagccuggaggacgggcagacccucggcaccaagaaguccagcaugguggcccugaagcgccugcccuuccuccggaaccgccccaaggacaaggacaagaugaaggccugcuaccggcgcuccaugagcaugaacgaccugguccaguccauggugcuggccgggcaguggaccggcagcacggagaaccucgaggugcccgacgacaucuccaccggcaagcggcgcaaggagcugggggcgauggccuucagcaccaccgccaucaacuucuccacggucaacagcuccgccggcuuccggagcaagcagcuggugaacaacaaggacaccaccuccuucgaggacaucagcccgcaggggguguccgacgacagcuccaccggcagccgcguccacgccucccggcccgcgagccucgacagcgggcgcaccuccacgagcaacuccaacaacaacgccagccugcacgaggugaaggccggcgccgugaacaaccagucccgcccccagagccacuccagcggcgaguucucccugcuccacgaccacgaggccuggagcuccagcggguccagccccauccaguaccugaagcggcagacccgcuccagcccgguccugcagcacaagaucuccgagacccucgagagccggcaccacaagaucaagaccggcucccccgggagcgagguggugacgcugcagcaguuccuggaggagagcaacaagcucaccuccguccagaucaagagcuccagccaggagaaccugcuggacgaggugaugaagucccucagcguguccagcgacuuccugggcaaggacaagcccgucuccugcggccuggcgcgcagcguguccgggaagacccccggcgacuucuacgaccggcgcaccacgaagccggaguuccuccggcccgggccccgcaagaccgaggacaccuacuucaucagcuccgccggcaagccgacccccgggacgcagggcaagaucaagcuggugaaggagagcucccugagccggcaguccaaggacagcaaccccuacgccacccucccccgcgccuccagcgucaucagcaccgccgagggcaccacgcggcgcaccuccauccacgacuuccugaccaaggacagccggcugccgaucuccguggacuccccgcccgcggccgccgacuccaacaccacggccgcgagcaacguggacaagguccaggagucccgcaacagcaagucccggagccgcgagcagcaguccagcuga

SEQ ID NO: 27820 - RNA, 6087 nt, Artificial Sequence
  derived and/or modified sequence opt1 from CCDC88C__Homo_sapiens__NP_001073883
auggacgugaccgucuccgagcugcucgagcuguuccugcagagcccccuggugaccugggugaagaccuucggccccuucggguccggcucccaggacaaccugaccauguacauggaccuggucgacgggaucuuccucaaccagaucaugcugcagaucgacccccgccccaccaaccagcgcaucaacaagcacgugaacaacgacgugaaccugcgcauccagaaccucaccauccugguccggaacaucaagacguacuaccaggaggugcugcagcagcucaucgugaugaaccugcccaacguccugaugaucggccgcgacccccucagcgggaaguccauggaggagaucaagaaggugcugcugcucgugcugggcugcgccguccagugcgagcggaaggaggaguucaucgagcgcaucaagcagcuggacaucgagacccaggccggcaucguggcccacauccaggaggugacccacaaccaggagaacgucuucgaccuccaguggcuggagcugcccgacguggcccccgaggagcucgaggcccugagccgguccauggugcugcaccuccgccggcugaucgaccagcgcgacgagugcaccgagcugaucgucgaccucacgcaggagcgggacuaccugcaggcccagcacccgcccagccccaucaaguccagcuccgccgacagcacccccucccccaccagcucccugagcuccgaggacaagcagcaccucgccguggagcuggccgacaccaaggcccgccugcggcgcgugcggcaggagcucgaggacaagacggagcagcuggucgacacccgccacgagguggaccagcuggugcucgagcugcagaaggucaagcaggagaacauccagcuggccgccgacgcccggagcgcccgcgccuaccgggacgagcucgacucccugcgcgagaaggccaaccggguggagcgccuggagcucgagcugacccgcugcaaggagaagcugcacgacgucgacuucuacaaggcccggauggaggagcuccgcgaggacaacaucauccugaucgagaccaaggccaugcuggaggagcagcugacggccgcccgggcccgcggggacaaggugcacgagcucgagaaggagaaccugcagcugaaguccaagcuccacgaccuggagcuggaccgggacaccgacaagaagcgcaucgaggagcuccuggaggagaacauggugcuggagaucgcgcagaagcagagcaugaacgaguccgcccaccucggcugggagcuggagcagcugagcaagaacgccgaccucuccgacgccagccggaaguccuucgucuucgagcugaacgagugcgccagcucccgcauccugaagcucgagaaggagaaccagagccugcaguccaccauccaggggcugcgggacgcgagccucgugcuggaggaguccggccugaagugcggggagcucgagaaggagaaccaccagcugagcaagaagaucgagaagcugcagacccagcucgagcgcgagaagcaguccaaccaggaccuggagacgcugagcgaggagcucauccgggagaaggagcagcugcaguccgacauggagacccugaaggccgacaaggcccgccagaucaaggaccucgagcaggagaaggaccaccugaaccgggccauguggagccugcgcgagcggucccaggugagcuccgaggcccgcaugaaggacgucgagaaggagaacaaggcgcuccaccagaccgugaccgaggccaacggcaagcugagccagcuggaguucgagaagcggcagcuccaccgcgaccuggagcaggccaaggagaagggcgagcgggccgagaagcuggagcgcgagcuccagcgccugcaggaggagaacgggcggcuggcgcgcaaggugacgagccucgagaccgccaccgagaaggucgaggcccuggagcacgagucccagggccugcagcucgagaaccggacccugcgcaagagccuggacacgcuccagaacgugucccugcagcuggaggggcucgagcgggacaacaagcagcuggacgccgagaaccuggagcuccgccggcugguggagaccaugcgcuucaccagcaccaagcuggcccagauggagcgggagaaccagcagcucgagcgcgagaaggaggagcugcggaagaacgucgaccugcucaaggcgcugggcaagaaguccgagcgccuggagcucagcuaccaguccgugagcgccgagaaccugcggcugcagcagucccucgagagcuccagccacaagacgcagacccuggaguccgagcugggcgagcucgaggccgagcgccaggcccugcggcgcgaccuggaggcccuccggcuggcgaacgcccagcuggagggggccgagaaggaccgcaaggcccucgagcaggagguggcccagcuggagaaggacaagaagcugcucgagaaggaggcgaagcggcuguggcagcaggucgagcugaaggacgccgugcucgacgacagcaccgccaagcuguccgccguggagaaggagagccgcgcgcuggacaaggagcucgcccggugccgcgacgccgccggcaagcugaaggagcuggagaaggacaaccgcgaccucaccaagcaggucacggugcacgcccggacccugaccacccugcgcgaggaccucgugcuggagaagcugaagucccagcagcucagcagcgagcuggacaagcugucccaggagcuggagaaggucgggcucaaccgggagcugcugcuccaggaggacgacagcggcuccgacaccaaguacaagauccuggaggggcgcaacgagagcgcgcugaagacgacccucgccaugaaggaggagaagaucgugcugcuggaggcccagauggaggagaaggccucccucaaccggcagcuggagagcgagcugcagaugcucaagaaggagugcgagacccugcgccagaaccagggcgagggccagcaccuccagaacuccuucaagcaccccgccgggaagaccgcggccagccaccagggcaaggaggccugggggcccggccacaaggaggccacgauggagcuccugcgggugaaggaccgcgccaucgagcuggagcggaacaacgcggcccuccaggccgagaagcagcugcugaaggagcagcuccagcaccuggagacccagaacgucaccuucuccagccagauccugacccuccagaagcaguccgccuuccugcaggagcacaacacgacccugcagacccagaccgcgaagcuccagguggagaacagcacgcuguccagccaguccgccgcccugaccgcccaguacacccuccugcagaaccaccacaccgccaaggagacggagaacgagagccugcagcgccagcaggagcagcucaccgcggccuacgaggcccugcugcaggaccacgagcaccucgggacccugcacgagcggcaguccgccgaguacgaggcccugauccgccagcacagcugccucaagacccugcaccggaaccuggagcucgagcacaaggagcugggcgagcgccacggcgacaugcugaagcggaaggcggagcucgaggagcgcgagaaggugcugacgaccgagcgggaggcccugcagcaggagcagcgcaccaacgcccucgccaugggggagaaccagcggcugcgcggcgagcuggaccgcgucaacuuccuccaccaccagcugaagggggaguacgaggagcugcacgcccacaccaaggagcucaagacgucccugaacaacgcgcagcuggagcucaaccgguggcaggcccgcuucgacgagcugaaggagcagcaccagaccauggacaucagccugaccaagcucgacaaccacugcgagcugcugagccggcucaagggcaaccuggaggaggagaaccaccaccuccugucccagauccagcugcugagccagcagaaccagaugcuccuggagcagaacauggagaacaaggagcaguaccacgaggagcagaagcaguacaucgacaagcugaacgcccuccgccggcacaaggagaagcuggaggagaagaucauggaccaguacaaguucuacgacccgccgcccaagaagaagaaccacuggaucggggccaaggcccuggugaagcucaucaagcccaagaaggagggcucccgcgagcggcugaaguccaccguggacagcccgcccuggcagcuggagagcuccgaccccgcgagccccgccgccucccagccccuccgcagccaggccgagaaccccgacacgcccgcgcugggcuccaacugcgccgaggagcgggacgcccacaacgggagcgucggcaaggggcccggcgaccugaagcccaagcgcggcagcccccaccgggggagccucgaccgcaccgacgccuccaccgaccuggccaugcggagcuggcccuccgagcugggcagccggaccugcuccacgagcgcgaccaccaccgcccccagcaacuccacgcccaucgcccggcaccccgggcgcaccaagggcuacaacagcgacgacaaccucugcgagcccucccuggaguucgaggugcccaaccaccggcaguacgugagccgccccuccagccuggaguccagccggaacaccuccagcaacuccagcccccucaaccugaagggguccagcgagcagcugcacggccgcuccgagagcuucuccagcgaggaccucauccccucccgggaccuggccacccugccccgcgaggccagcacccccggccgcaacgcgcucgggcggcacgaguacccgcugccccgcaacggcccccugccccaggagggggcccagaagcggggcacggccccgcccuacgucggggugcgccccugcagcgccucccccagcuccgagauggugacccucgaggaguuccuggaggagagcaaccgguccagcccgacccacgacacccccuccugccgcgacgaccugcucagcgacuacuuccggaaggccuccgacccgcccgcgaucggcggccagccggggccgcccgccaagaaggagggcgccaagaugcccacgaacuucgucgccccgaccgugaagauggcggcccccaccagcgaggggcgcccccugaagccgggccaguacgugaagcccaacuuccggcugaccgaggccgaggcgccgcccuccgucgccccgcgccaggcgcagccgccccagagccugucccucgggcggccccgccaggccccggugccgcccgccagccacgcccccgccucccggagcgcgucccugagccgcgccuucucccuggccagcgccgaccuccugcgggccagcggcccggaggcgugcaagcaggagagcccccagaagcugggcgcccccgaggcccucgggggccgcgagacggggagccacacccugcagucccccgccccgcccagcucccacagccuggcgcgggagcgcacgccccucgugggcaaggccggguccagcugccagggccccggcccgcggucccgcccccuggacacccgccgguucagccuggcgccgcccaaggaggagcgccucgccccgcugcaccaguccgccacggcgcccgccaucgccaccgccggggccggcgcggccgccgccgggagcggcuccaacagccagcugcuccacuucucccccgccgcggcccccgccgcccggaccaagccgaaggcgccgccccgcagcggcgaggucgcgaccaucacgccggugcgggccgggcugucccugagcgagggcgacggggugcccggccaggggugcuccgagggccuccccgccaagagccccggccgcagcccggaccuggcgccccaccuggggcgggcgcucgaggacugcucccgcggcagcgucuccaagagcucccccgccagccccgagcccgggggcgacccccagaccgugugguacgaguacgggugcguguga

SEQ ID NO: 27821 - RNA, 1617 nt, Artificial Sequence
  derived and/or modified sequence opt1 from CCDC8__Homo_sapiens__NP_114429
augcugcagaucggcgaggacguggacuaccuccugaucccccgcgagguccggcuggccgggggcguguggcgcgugaucagcaagccggccaccaaggaggcggaguuccgggagcgccucacccaguuccuggaggaggaggggcggacgcuggaggacgucgcccgcaucauggagaaguccacgccccacccgccccagccgcccaagaagcccaaggagccccgggugcgccggcgcgugcagcagauggucaccccgccgccccggcucguggugggcaccuacgacagcuccaacgccagcgacuccgaguucagcgacuucgagaccucccgcgacaagagccggcaggggccccgccggggcaagaagguccgcaagaugcccguguccuaccugggcagcaaguuccugggguccgaccucgagagcgaggacgacgaggagcugguggaggccuuccugcggcgccaggagaagcagcccuccgccccgcccgcgcggcgccgggucaaccuccccgugcccauguucgaggacaaccugggcccccagcugagcaaggccgaccgcuggcgcgaguacgugucccaggucagcugggggaagcucaagcggcgcgugaagggcugggcgccccgggccgggcccggcgugggcgaggcccgccuggccuccaccgccgucgagagcgccgggguguccagcgcccccgagggcaccagccccggggaccggcugggcaacgcgggcgacgugugcgucccccaggccuccccgcgccgguggcgccccaagaucaacugggccagcuuccggcgccggcgcaaggagcagaccgcccccacggggcagggcgccgacaucgaggcggaccagggcggggaggccgccgacucccagcgggaggaggccaucgccgaccagcgcgagggggcggccggcaaccagcgggccggcgcccccgccgaccagggggcggaggccgccgacaaccagcgcgaggaggccgcggacaaccagcgggccggcgccccggccgaggagggggccgaggcggccgacaaccagcgcgaggaggccgccgacaaccagcgggccgaggcgcccgccgaccagcgcagccagggcaccgacaaccaccgcgaggaggccgccgacaaccagcgggccgaggcgcccgccgaccagggguccgaggugaccgacaaccagcgcgaggaggccgugcacgaccagcgggagcgcgccccggcgguccagggcgccgacaaccagcgggcccaggcccgcgccggccagcgggcggaggccgcccacaaccagcgcgccggggcccccggcauccaggaggcggaggugagcgccgcccaggggaccacgggcaccgcccccggggcccgggcgcgcaagcaggucaagaccgugcgguuccagacccccggccgcuucuccugguucugcaagcggcgccgggccuucuggcacacgccgcgccuccccacccugcccaagcgggugccccgcgccggcgaggcccggaaccugcgcguccuccgggcggaggcccgcgccgaggccgagcagggggagcaggaggaccagcuguga

SEQ ID NO: 27822 - RNA, 1326 nt, Artificial Sequence
  derived and/or modified sequence opt1 from CCDC91__Homo_sapiens__NP_060788
auggacgacgacgacuucggcggguucgaggccgccgagaccuucgacggcgggagcggcgagacccagacgaccucccccgcgaucccgugggccgccuuccccgccgugagcgggguccaccugucccccagcucccccgagaucgugcucgaccgcgaccacagcuccagcaucggcugccuguccagcgacgccaucaucuccagcccggagaacacccacgcggccaacuccaucgugagccagaccauccccaaggcccagauccagcaguccacgcacacccaccuggacaucagccucuucccccugggccugaccgacgagaaguccaacgggaccaucgcccucgucgacgacagcgaggaccccggcgcgaacguguccaacauccagcugcagcagaagaucagcagccuggagaucaagcucaagguguccgaggaggagaagcagcggaucaagcaggacgucgagagccugauggagaagcacaacgugcuggagaagggguuccucaaggagaaggagcaggaggccaucuccuuccaggaccgcuacaaggagcugcaggagaagcacaagcaggagcuggaggacaugcggaaggccggccacgaggcccucagcaucaucguggacgaguacaaggcccugcugcaguccagcgucaagcagcaggucgaggcgaucgagaagcaguacaucuccgccaucgagaagcaggcccacaagugcgaggagcuccugaacgcccagcaccagcgccugcucgagaugcuggacacggagaaggagcugcucaaggagaagaucaaggaggcccugauccagcagagccaggagcagaaggagauccuggagaagugccucgaggaggagcggcagcgcaacaaggaggcgcugguguccgccgccaagcuggagaaggaggccgugaaggacgccgugcucaagguggucgaggaggagcggaagaaccuggagaaggcgcacgccgaggagcgcgagcuguggaagaccgagcacgccaaggaccaggagaaggugagccaggagauccagaaggccauccaggagcagcggaagaucucccaggagaccgugaaggccgcgaucaucgaggagcagaagcgcagcgagaaggccgucgaggaggccgugaagcggacccgcgacgagcucaucgaguacaucaaggagcagaagcggcuggaccaggugauccgccagcggucccugagcucccucgagcuguuccugagcugcgcccagaagcagcucuccgcgcugaucgccacggagccggucgacaucgaguga

SEQ ID NO: 27823 - RNA, 972 nt, Artificial Sequence
  derived and/or modified sequence opt1 from CCDC94__Homo_sapiens__NP_060544
augagcgagcgcaaggugcugaacaaguacuacccgcccgacuucgaccccuccaagauccccaagcucaagcugcccaaggaccggcaguacgucgugcgccugauggccccguucaacaugcggugcaagaccugcggcgaguacaucuacaaggggaagaaguucaacgcccgcaaggagaccgugcagaacgaggucuaccucggccugcccaucuuccgguucuacaucaagugcacccgcugccuggcggagaucaccuucaagaccgaccccgagaacaccgacuacacgauggagcacggggccacccggaacuuccaggccgagaagcuccuggaggaggaggagaagcgcgugcagaaggagcgggaggacgaggagcugaacaaccccaugaaggugcucgagaaccgcaccaaggacagcaagcuggagauggagguccuggagaaccuccaggagcugaaggaccugaaccagcggcaggcccacguggacuucgaggccaugcuccgccagcaccggcuguccgaggaggagcgccggcgccagcagcaggaggaggacgagcaggagaccgcggcccugcucgaggaggcccggaagcgccggcugcuggaggacagcgacuccgaggacgaggccgcgccgagcccccuccagcccgcccugcgccccaacccgacggccauccuggacgaggcccccaagcccaagcggaagguggaggucugggagcaguccgugggcagccucgggucccggcccccgcugagccgccugguggucgugaagaaggccaaggcggaccccgacugcuccaacggccagccccaggccgcccccaccccgggcgcgccccagaaccgcaaggaggccaaccccacgccccucaccccgggggccagcucccugagccagcugggcgccuaccucgacuccgacgacagcaacggguccaacuga

SEQ ID NO: 27824 - RNA, 1032 nt, Artificial Sequence
  derived and/or modified sequence opt1 from CCDC97__Homo_sapiens__NP_443080
auggaggccguggccaccgcgaccgccgccaaggagcccgacaagggcugcaucgagccggggcccggccacuggggcgagcugagccgcacgcccguccccuccaagccgcaggacaagguggaggccgccgaggcgacccccguggcccucgacagcgacaccuccggggccgagaacgccgcggucagcgccaugcugcacgccguggccgccucccggcugcccgugugcagccagcagcagggggagcccgaccucaccgagcacgagaaggucgcgauccuggcccagcuguaccacgagaagccgcucguguuccuggagcgcuuccggacgggccugcgcgaggagcaccucgccugcuucggccacgugcgcggggaccaccgggccgacuucuacugcgccgaggucgcgcggcagggcaccgcccgcccccggacccugcgcacccggcugcgcaaccggcgcuacgccgcccuccgggagcugauccagggcggggaguacuucuccgacgagcagaugcgcuuccgggcgccccugcucuacgagcaguacaucgggcaguaccugacgcaggaggagcugagcgcccgcacccccacccaccagccgcccaagcccggcucccccggccggccggccugcccccucagcaaccugcugcuccaguccuacgaggagcgcgagcugcagcagcggcugcuccagcagcaggaggaggaggaggccugccuggaggaggaggaggaggaggaggacagcgacgaggaggaccagcgcuccgggaaggacagcgaggccugggugcccgacuccgaggagcgccugauccuccgggaggaguucaccagccgcaugcaccagcgguuccuggacggcaaggacggggacuucgacuacuccacgguggacgacaaccccgacuucgacaaccuggacaucgucgcccgcgacgaggaggagcgguacuucgacgaggaggagccggaggacgcgcccagccccgagcucgacggcgacuga

SEQ ID NO: 27825 - RNA, 2508 nt, Artificial Sequence
  derived and/or modified sequence opt1 from CCHCR1__Homo_sapiens__NP_001099033
auguggccccacagcgccggcgcccgcccgugggcguccacccugaccgggaaggacccccgggugauggccugcuggugccucgacggccugcccagcgggcuggccgagcccuggcgcgagcucuggcgguggcgcucccggccgcugcacugcgucccgcccuucagcccccuggcccgcuccagccgggaccaccgcaaccuccggcgccggggcaacaucgacggguggcgccagaaccuggagcccuccaacaacguggagauguucccgcccagcggccaccaggacguguccgagcggcgccuggacacgcagcggccccaggucaccaugugggagcgcgacgugagcuccgaccggcaggagcccggccgccgggggcgcagcuggggccucgaggggucccaggcccugagccagcaggcggaggugaucguccggcagcugcaggagcuccgccgccuggaggaggaggugcggcugcuccgcgagaccucccugcagcagaagaugcggcuggaggcccaggccauggagcucgaggcccuggcgcgcgccgagaaggccggccgggccgaggccgaggggcugcgcgcggcccucgccggcgccgaggugguccggaagaaccuggaggagggcagccagcgcgagcuggaggaggugcagcggcuccaccaggagcagcuguccagccugacccaggcccacgaggaggcgcucuccagccugacgagcaaggccgaggggcuggagaagucccucagcucccuggagacccgccgggccggcgaggccaaggagcuggccgaggcgcagcgcgaggccgagcuccugcggaagcagcugagcaagacccaggaggaccucgaggcccaggugacccuggucgagaaccugcgcaaguacgugggggagcagguccccuccgaggugcacagccagacgugggagcucgagcggcagaagcugcuggagaccaugcagcaccuccaggaggaccgcgacucccugcacgccaccgccgagcugcuccaggugcgggugcagagccugacccacauccuggcgcuccaggaggaggagcugacgcgcaagguccagcccuccgacagccuggagcccgaguucacccggaagugccagucccugcucaaccgcuggcgcgagaagguguucgcccugauggugcagcugaaggcccaggagcucgagcacagcgacuccgucaagcagcugaagggccagguggccagccugcaggagaaggugaccucccagagccaggagcaggcgauccuccagcggucccugcaggacaaggccgccgaggucgagguggagcgcaugggcgccaaggggcugcagcucgagcugagccgggcccaggaggcgcgccggcgcuggcagcagcagaccgccuccgccgaggagcagcugcggcucgucgugaacgccgugagcagcucccagaucuggcuggagacgaccauggccaaggucgagggcgcggccgcccagcugccgagccucaacaaccgccuguccuacgccgugcggaaggugcacaccauccgcgggcugaucgcccggaagcucgcgcuggcccagcugcgccaggagagcugcccccugcccccgcccgucaccgacgugucccucgagcugcagcagcuccgggaggagcgcaaccggcuggacgccgagcugcagcucagcgcccgccugauccagcaggaggugggccgggcgcgcgagcagggggaggccgagcggcagcagcuguccaaggucgcccagcagcucgagcaggagcugcagcagacgcaggagagccuggccucccucggccugcagcuggagguggcccgccagggccagcaggagagcaccgaggaggcggccucccuccggcaggagcugacccagcagcaggagcuguacgggcaggcccuccaggagaagguggccgaggucgagacccgccugcgcgagcagcugagcgacacggagcggcgccucaacgaggcccggcgcgagcacgcgaaggccguggugucccugcggcagauccagcgccgggccgcccaggagaaggagcgcagccaggagcugcggcgccuccaggaggaggcccggaaggaggagggccagcgccuggcgcggcgccugcaggagcucgagcgggacaagaaccugaugcuggccacccuccagcaggaggggcugcugucccgcuacaagcagcagcggcuccugaccguccugcccagccuccuggacaagaagaaguccguggugagcagcccccggcccccggagugcuccgccagcgcccccgucgcggccgccgugcccacccgcgaguccaucaagggcagccuguccgugcuccuggacgaccugcaggaccucagcgaggccaucuccaaggaggaggccgucugccagggggacaaccuggaccgcugcagcuccagcaacccccagauguccagcuga

SEQ ID NO: 27826 - RNA, 1287 nt, Artificial Sequence
  derived and/or modified sequence opt1 from CCKAR__Homo_sapiens__NP_000721
auggacguggucgacagccugcucgugaacggcuccaacaucaccccgcccugcgagcuggggcuggagaacgagacccucuucugccuggaccagccccgccccagcaaggaguggcagcccgccgugcagauccugcucuacucccugaucuuccugcucagcguccugggcaacacgcuggugaucaccgugcucauccggaacaagcgcaugcggaccgucaccaacaucuuccugcugucccucgccgugagcgaccugaugcugugccucuucugcaugcccuucaaccugauccccaaccugcucaaggacuucaucuucggguccgcggugugcaagacgaccaccuacuucaugggcaccagcgucuccgugagcacguucaaccugguggccaucucccuggagcgcuacggggccaucugcaagccccuccagagccgggucuggcagaccaagucccacgcccugaaggugaucgccgcgaccuggugccugagcuucaccaucaugacgcccuacccgaucuacuccaaccucgugcccuucaccaagaacaacaaccagaccgccaacaugugccgcuuccugcugcccaacgacgucaugcagcagagcuggcacaccuuccuccugcugauccucuuccugauccccggcaucgugaugaugguggccuacggccugaucucccucgagcuguaccaggggaucaaguucgaggccagccagaagaaguccgcgaaggagcggaagccgagcacgaccagcuccggcaaguacgaggacagcgacgggugcuaccugcagaagacccgcccgccccggaagcucgagcugcgccagcuguccaccggcagcuccagccgggccaaccgcauccgguccaacagcuccgccgccaaccucauggccaagaagcgcgucauccggaugcugaucgugaucgugguccuguucuuccucugcuggaugcccaucuucagcgcgaacgccuggcgcgccuacgacacggccuccgccgagcggcgccugagcgggacccccaucuccuucauccugcuccugagcuacaccuccagcugcgugaaccccaucaucuacugcuucaugaacaagcgguuccgccugggcuucauggcgaccuuccccugcugccccaacccgggcccgcccggggcccggggcgaggugggggaggaggaggagggcggcacgaccggggccucccugagccgcuucuccuacagccacaugagcgccuccgucccgccccaguga

SEQ ID NO: 27827 - RNA, 1344 nt, Artificial Sequence
  derived and/or modified sequence opt1 from CCKBR__Homo_sapiens__NP_795344
auggagcugcucaagcugaaccgcagcgugcagggcaccgggcccggcccgggggccucccugugccggcccggcgcgccccuccugaacagcuccagcgucgggaaccuguccugcgagcccccgcgcauccggggcgccggcacccgcgagcucgagcuggccauccggaucacgcuguacgccgugaucuuccucaugagcgucgggggcaacaugcugaucaucguggugcuggggcucucccgccggcugcgcaccgugaccaacgccuuccugcucagccuggccgucuccgaccugcuccuggcgguggccugcaugcccuucacccugcuccccaaccugaugggcacguucaucuucgggaccgugaucugcaaggccgucagcuaccugaugggcguguccgugagcgucuccacccucagccugguggccaucgcgcuggagcgguacuccgccaucugccgcccccuccaggcccggguguggcagacccgcagccacgccgcccgggucaucguggcgacguggcugcuguccggccuccugauggugccguaccccgucuacaccguggugcagcccgucgggccccgcgugcugcagugcgugcaccgguggccgagcgcccgcguccggcagaccugguccgugcuccugcugcuccugcuguucuucauccccggcgucgugauggccguggccuacgggcucaucagccgcgagcuguaccugggccuccgguucgacggcgacagcgacuccgacagccagucccgcguccggaaccagggcgggcugcccggggccgugcaccagaacggccgcugccgccccgagaccggggcggugggcgaggacagcgacggcugcuacguccagcugccgcggucccgccccgcccucgagcugacggcccugaccgcccccgggcccggcagcgggucccggccgacccaggccaagcuccuggcgaagaagcgcguggugcggaugcugcuggucaucguggugcuguucuuccugugcuggcugcccgucuacagcgccaacaccuggcgcgccuucgacggccccggggcccaccgggcccucuccggcgcgcccaucagcuucauccaccuccuguccuacgccagcgccugcgugaacccgcucguguacugcuucaugcaccgccgguuccgccaggccugccuggagacgugcgcgcggugcugcccccgcccgccccgggcccgcccccgggcccugcccgacgaggacccgcccacccccuccaucgccagccucucccgccugagcuacaccaccaucuccacgcugggccccggguga

SEQ ID NO: 27828 - RNA, 348 nt, Artificial Sequence
  derived and/or modified sequence opt1 from CCK__Homo_sapiens__NP_000720
augaacagcggcgugugccugugcguccucauggccgugcuggccgcgggggcccugacccagcccgugccgcccgccgaccccgccggcuccgggcuccagcgcgccgaggaggcgccccggcgccagcugcgggucagccagcgcaccgacggcgagucccgggcccaccugggggcccuccuggcccgcuacauccagcaggcgcggaaggccccgagcggccgcauguccaucgugaagaaccugcagaaccucgaccccagccaccggaucuccgaccgcgacuacaugggcuggauggacuucgggcggcgcagcgccgaggaguacgaguaccccuccuga

SEQ ID NO: 27829 - RNA, 294 nt, Artificial Sequence
  derived and/or modified sequence opt1 from CCL11__Homo_sapiens__NP_002977
augaaggugagcgccgcccugcucuggcugcugcucaucgcggccgccuucagcccccagggccuggccgggccggccagcguccccacgaccugcugcuucaaccuggcgaaccgcaagaucccccuccagcggcuggaguccuaccgccggaucaccagcggcaagugcccccagaaggccgugaucuucaagaccaagcuggccaaggacaucugcgccgacccgaagaagaagugggugcaggacuccaugaaguaccucgaccagaagucccccacccccaagcccuga

SEQ ID NO: 27830 - RNA, 297 nt, Artificial Sequence
  derived and/or modified sequence opt1 from CCL13__Homo_sapiens__NP_005399
augaaggugagcgccguccugcucugccugcugcucaugaccgccgcguucaacccccagggccuggcccagccggacgcccugaacgugcccuccacgugcugcuucaccuucagcuccaagaagaucagccuccagcgccugaaguccuacgugaucaccaccagccggugcccccagaaggccgucaucuuccgcaccaagcuggggaaggagaucugcgccgaccccaaggagaagugggugcagaacuacaugaagcaccucggccggaaggcgcacacgcugaagaccuga

SEQ ID NO: 27831 - RNA, 330 nt, Artificial Sequence
  derived and/or modified sequence opt1 from CCL14__Homo_sapiens__NP_116738
augaagaucagcguggccgccauccccuucuuccugcucaucaccaucgcgcugggcaccaagacggaguccagcucccagaccgggggcaagccgaaggucgugaagauccagcugaagcucgucgggggccccuaccaccccagcgagugcugcuucaccuacaccacguacaagaucccccgccagcggaucauggacuacuacgagaccaacucccagugcagcaagccggggaucguguucaucaccaagcgcggccacuccgugugcaccaaccccagcgacaagugggugcaggacuacaucaaggacaugaaggagaacuga

SEQ ID NO: 27832 - RNA, 342 nt, Artificial Sequence
  derived and/or modified sequence opt1 from CCL15__Homo_sapiens__NP_116741
augaaggugagcgucgccgcccuguccugccucaugcugguggcggugcugggcagccaggcccaguucaccaacgacgccgagaccgagcucaugauguccaagcugccccuggagaacccggucgugcucaacagcuuccacuucgccgccgacugcugcacguccuacaucagccaguccauccccugcagccugaugaaguccuacuucgagaccagcuccgagugcagcaagcccggggugaucuuccugaccaagaagggccgccaggucugcgcgaagcccuccgggccgggcgugcaggacugcaugaagaagcucaagcccuacagcaucuga

SEQ ID NO: 27833 - RNA, 363 nt, Artificial Sequence
  derived and/or modified sequence opt1 from CCL16__Homo_sapiens__XP_005258077
augaaggugagcgaggccgcccugucccuccugguccugauccucaucaucaccagcgcgucccgcagccagcccaaggugccggagugggugaacacccccuccacgugcugccugaaguacuacgagaagguccugccccggcgccucguggugggcuaccggaaggcccugaacugccaccuccccgccaucaucuucgucaccaagcgcaaccgggaggugugcaccaacccgaacgacgacugggugcaggaguacaucaaggaccccaaccugccccugcugcccacccgcaaccucagcacggucaagaucaucaccgccaagaacgggcagccgcagcugcugaacucccaguga

SEQ ID NO: 27834 - RNA, 285 nt, Artificial Sequence
  derived and/or modified sequence opt1 from CCL17__Homo_sapiens__NP_002978
auggcgccccugaagaugcucgcccuggugacccugcuccugggcgccagccugcagcacauccacgccgcccgcgggaccaacgucggccgggagugcugccucgaguacuucaagggggccaucccgcugcgcaagcugaagacgugguaccagaccuccgaggacugcagccgggacgccaucguguucgugaccguccagggccgcgcgaucugcuccgaccccaacaacaagcgggugaagaacgccgugaaguaccuccagagccuggagcgcuccuga

SEQ ID NO: 27835 - RNA, 270 nt, Artificial Sequence
  derived and/or modified sequence opt1 from CCL18__Homo_sapiens__NP_002979
augaagggccuggccgccgcgcuccuggugcuggucugcaccauggcccucugcagcugcgcccagguggggaccaacaaggagcugugcugccugguguacacguccuggcagaucccccagaaguucaucgucgacuacagcgagaccuccccgcagugccccaagcccggcgugauccuccugaccaagcgcgggcggcagaucugcgccgaccccaacaagaagugggugcagaaguacaucagcgaccugaagcucaacgccuga

SEQ ID NO: 27836 - RNA, 297 nt, Artificial Sequence
  derived and/or modified sequence opt1 from CCL19__Homo_sapiens__NP_006265
auggcccugcuccuggcccugagccuccuggugcuguggaccucccccgcgccgacccucagcggcacgaacgacgccgaggacugcugccuguccgucacccagaagcccauccccggguacaucgugcgcaacuuccacuaccugcucaucaaggacggcugccgggugcccgccgucguguucaccacccugcgcgggcggcagcugugcgccccgcccgaccagcccuggguggagcgcaucauccagcggcuccagcgcacgagcgccaagaugaagcggcgcuccagcuga

SEQ ID NO: 27837 - RNA, 291 nt, Artificial Sequence
  derived and/or modified sequence opt1 from CCL1__Homo_sapiens__NP_002972
augcagaucaucaccaccgcccuggugugccuccugcuggccggcauguggcccgaggacgucgacagcaaguccaugcaggucccguucagccgcugcugcuucuccuucgcggagcaggagaucccccuccgggccauccugugcuaccgcaacacgagcuccaucugcagcaacgaggggcugaucuucaagcucaagcggggcaaggaggccugcgcccuggacaccguggggugggugcagcgccaccggaagaugcugcgccacugccccuccaagcggaaguga

SEQ ID NO: 27838 - RNA, 288 nt, Artificial Sequence
  derived and/or modified sequence opt1 from CCL20__Homo_sapiens__NP_001123518
augugcugcaccaagagccugcuccuggccgcccugauguccgugcuccugcugcaccucugcggcgagagcgaggcguccaacuucgacugcugccugggguacaccgaccgcauccugcaccccaaguucaucgucggcuucacgcggcagcucgccaacgaggggugcgacaucaacgccaucaucuuccacaccaagaagaagcugagcgugugcgccaacccgaagcagaccugggugaaguacaucguccgccugcucuccaagaaggugaagaacauguga

SEQ ID NO: 27839 - RNA, 405 nt, Artificial Sequence
  derived and/or modified sequence opt1 from CCL21__Homo_sapiens__NP_002980
auggcccagagccuggcccucucccugcugauccucgugcuggcguucggcaucccccgcacccaggggagcgacggcggggcccaggacugcugccugaaguacucccagcggaagaucccggccaaggucgugcgcagcuaccggaagcaggagcccucccucggcugcagcauccccgccauccuguuccugccccgcaagcggucccaggccgagcucugcgcggacccgaaggagcugugggugcagcagcugaugcagcaccucgacaagacccccagcccccagaagcccgcccaggggugccgcaaggaccggggcgccuccaagacgggcaagaaggggaagggcagcaaggggugcaagcgcaccgagcggucccagaccccgaagggccccuga

SEQ ID NO: 27840 - RNA, 282 nt, Artificial Sequence
  derived and/or modified sequence opt1 from CCL22__Homo_sapiens__NP_002981
auggaccgccugcagaccgcccuccuggugguccuggugcuccuggccguggcgcugcaggccaccgaggccggccccuacggggccaacauggaggacagcgucugcugccgggacuacgugcgcuaccggcucccgcugcgcguggucaagcacuucuacuggacguccgacagcugcccccggcccggcguggugcugcucaccuuccgcgacaaggagaucugcgccgacccccgggucccgugggugaagaugauccugaacaagcugucccaguga

SEQ ID NO: 27841 - RNA, 414 nt, Artificial Sequence
  derived and/or modified sequence opt1 from CCL23__Homo_sapiens__NP_005055
augaaggugagcgucgccgcccuguccugccucaugcuggugaccgcgcugggcagccaggcccgcgugaccaaggacgccgagacggaguucaugauguccaagcucccccuggagaacccgguccugcucgacaugcuguggcggcgcaagaucgggccccagaugacccugagccacgccgccggcuuccacgcgaccuccgccgacugcugcaucagcuacacgccccgguccauccccugcagccuccuggaguccuacuucgagaccaacagcgagugcuccaagccgggggugaucuuccugaccaagaagggccgccgguucugcgccaaccccagcgacaagcagguccaggugugcaugcgcaugcucaagcuggacacccggaucaagacccgcaagaacuga

SEQ ID NO: 27842 - RNA, 360 nt, Artificial Sequence
  derived and/or modified sequence opt1 from CCL24__Homo_sapiens__XP_011514762
auggccggccugaugaccaucgugaccagccuccuguuccugggggucugcgcccaccacaucauccccacgggcuccguggugaucccgagccccugcugcauguucuucgucuccaagcgcauccccgagaaccggguggugagcuaccagcucuccagccgcuccaccugccugaaggcgggggucaucuucaccaccaagaagggccagcaguucugcggggaccccaagcaggagugggugcagcgguacaugaagaaccuggacgccaagcagaagaaggccagcccgcgcgcccgggccguggcggucaagggccccgugcagcgcuaccccggcaaccagacgaccugcuga

SEQ ID NO: 27843 - RNA, 450 nt, Artificial Sequence
  derived and/or modified sequence opt1 from CCL25__Homo_sapiens__NP_001188288
augaaccuguggcuccuggccugccugguggccggcuuccucggggcgugggcccccgccguccacacccagggcguguucgaggacugcugccuggccuaccacuacccgaucgggugggccgugcugcgccgggcguggaccuaccgcauccaggaggucagcggcuccugcaaccuccccgccgccaucuucuaccugcccaagcggcaccgcaaggugugcgggaaccccaagagccgggaggugcagcgcgccaugaagcugcucgacgcgcggaacaaggucuucgccaagcugcaccacaacacgcagaccuuccagggcccgcacgccgugaagaagcuguccagcggcaacuccaagcucagcuccagcaaguucuccaaccccaucagcuccagcaagcgcaacgugucccugcugaucagcgccaacuccgggcucuga

SEQ ID NO: 27844 - RNA, 285 nt, Artificial Sequence
  derived and/or modified sequence opt1 from CCL26__Homo_sapiens__NP_006063
augaugggccugagccucgccuccgccgugcugcuggcgagccuccugucccugcaccucgggaccgccacccgcggcagcgacaucuccaagacgugcugcuuccaguacagccacaagccccugccguggaccuggguccgguccuacgaguucaccagcaacuccugcagccagcgcgccgugaucuucaccacgaagcgggggaagaaggugugcacccacccccgcaagaaguggguccagaaguacaucucccugcucaagacccccaagcagcuguga

SEQ ID NO: 27845 - RNA, 339 nt, Artificial Sequence
  derived and/or modified sequence opt1 from CCL27__Homo_sapiens__NP_006655
augaaggggcccccgaccuucugcagccugcuccugcugucccuccugcugagccccgaccccaccgccgccuuccuccugcccccguccacggcgugcugcacccagcuguaccgcaagccccucagcgacaagcugcugcggaaggugauccaggucgagcuccaggaggccgacggcgacugccaccuccaggccuucgugcugcaccuggcccagcgcuccaucugcauccacccccagaaccccagccugucccagugguucgagcaccaggagcggaagcugcacggcacccucccgaagcugaacuucgggaugcugcgcaagaugggcuga

SEQ ID NO: 27846 - RNA, 384 nt, Artificial Sequence
  derived and/or modified sequence opt1 from CCL28__Homo_sapiens__NP_001288802
augcagcagcgcggccuggccaucguggcccucgcggucugcgccgcccugcacgccagcgaggccauccugcccaucgcguccagcugcugcaccgaggugucccaccacaucagccggcgccuccuggagcgggugaacaugugccgcauccagcgggccgacggggacugcgaccuggccgccgucauccuccacgugaagcgccggcgcaucugcguguccccgcacaaccacaccgucaagcaguggaugaaggugcaggcggccaagaagaacggcaaggggaacgugugccaccggaagaagcaccacggcaagcgcaacagcaaccgggcccaccaggggaagcacgagacguacggccacaagacccccuacuga

SEQ ID NO: 27847 - RNA, 300 nt, Artificial Sequence
  derived and/or modified sequence opt1 from CCL2__Homo_sapiens__NP_002973
augaaggugagcgccgcccugcucugccugcugcucaucgcggccaccuucaucccccagggccuggcccagccggacgccaucaacgcccccgugaccugcugcuacaacuucacgaaccgcaagaucuccguccagcggcuggcgagcuaccgccggaucaccuccagcaagugccccaaggaggccgugaucuucaagaccaucgucgccaaggagaucugcgccgaccccaagcagaagugggugcaggacuccauggaccaccucgacaagcagacccagacgccgaagaccuga

SEQ ID NO: 27848 - RNA, 279 nt, Artificial Sequence
  derived and/or modified sequence opt1 from CCL3__Homo_sapiens__NP_002974
augcaggucagcaccgccgcccuggcggugcuccugugcaccauggcccugugcaaccaguucuccgccagccucgccgccgacacgcccaccgcgugcugcuucuccuacaccagccgccagaucccgcagaacuucaucgccgacuacuucgagaccuccagccagugcuccaagcccggcgugaucuuccugacgaagcggagccgccaggugugcgccgaccccuccgaggaguggguccagaaguacgugagcgaccuggagcucuccgccuga

SEQ ID NO: 27849 - RNA, 282 nt, Artificial Sequence
  derived and/or modified sequence opt1 from CCL3L3__Homo_sapiens__NP_001001437
augcaggucagcaccgccgcccuggcggugcuccugugcaccauggcccugugcaaccaggugcucuccgcgccccuggccgccgacacgccgaccgccugcugcuucagcuacaccucccgccagaucccccagaacuucaucgccgacuacuucgagaccagcucccagugcagcaagcccuccgugaucuuccugacgaagcggggccgccaggucugcgccgaccccagcgaggagugggugcagaaguacguguccgaccucgagcugagcgccuga

SEQ ID NO: 27850 - RNA, 279 nt, Artificial Sequence
  derived and/or modified sequence opt1 from CCL4__Homo_sapiens__NP_002975
augaagcugugcgugaccguccucagccugcugaugcucguggccgccuucugcucccccgcgcugagcgccccgaugggcuccgacccgcccaccgccugcugcuucagcuacacggcccgcaagcugccccggaacuucguggucgacuacuacgagaccuccagccucugcucccagcccgccgugguguuccagaccaagcgcagcaagcaggucugcgcggaccccuccgagagcugggugcaggaguacguguacgaccuggagcugaacuga

SEQ ID NO: 27851 - RNA, 279 nt, Artificial Sequence
  derived and/or modified sequence opt1 from CCL4L1__Homo_sapiens__NP_996890
augaagcugugcgugaccguccucagccugcuggugcucguggccgccuucugcucccuggcgcugagcgcccccaugggcuccgacccgcccaccgccugcugcuucagcuacacggcccgcaagcucccccggaacuucgucguggacuacuacgagaccuccagccugugcucccagcccgccguggucuuccagaccaagcgcgggaagcaggucugcgcggacccgagcgaguccugggugcaggaguacguguacgaccuggagcucaacuga

SEQ ID NO: 27852 - RNA, 264 nt, Artificial Sequence
  derived and/or modified sequence opt1 from CCL4L2__Homo_sapiens__NP_001278397
augaagcugugcgugaccguccucagccugcuggugcucguggccgccuucugcucccuggcgcugagcgcccccaugggcuccgacccgcccaccgccugcugcuucagcuacacggcccgcaagcucccccggaacuucgucguggacuacuacgagaccuccagccugugcucccagcccgccguggucgggaagcaggucugcgcggacccgagcgaguccugggugcaggaguacguguacgaccuggagcucaacuga

SEQ ID NO: 27853 - RNA, 465 nt, Artificial Sequence
  derived and/or modified sequence opt1 from CCL5__Homo_sapiens__NP_001265665
augaagguguccgccgccgcgcuggccgucauccucaucgccaccgcccugugcgcccccgcguccgccagccccuacuccagcgacaccacgcccugcugcuucgccuacaucgcccgcccccugccccgggcgcacaucaaggaguacuucuacaccuccggcaagugcagcaacccggccguggugcaccgcucccggaugcccaagcgcgaggggcagcaggucuggcaggacuuccucuacgacagccggcugaacaagggcaagcugugccaccccaaggagcccccguccgugugccagccccgcgaggagauggggagcggcgugcaccagcuguucggggacgagcucggcuggcggguccuggagcccgagcucacccagaucugccuguuccugcucgcccuggugcuggccugggaggccagcccccacuacccgaccccgcccgcgcccuga

SEQ ID NO: 27854 - RNA, 300 nt, Artificial Sequence
  derived and/or modified sequence opt1 from CCL7__Homo_sapiens__NP_006264
augaaggccagcgccgcgcugcucugccugcugcucaccgccgccgccuucagcccccagggccuggcccagccgguggggaucaacaccuccacgaccugcugcuaccgcuucaucaacaagaagauccccaagcagcggcuggaguccuaccgccggaccaccagcucccacugcccccgcgaggcggucaucuucaagacgaagcucgacaaggagaucugcgccgaccccacccagaagugggugcaggacuucaugaagcaccuggacaagaagacccagaccccgaagcuguga

SEQ ID NO: 27855 - RNA, 300 nt, Artificial Sequence
  derived and/or modified sequence opt1 from CCL8__Homo_sapiens__NP_005614
augaaggugagcgccgcccugcucugccugcugcucauggcggccaccuucagcccccagggccuggcccagccggacuccgucuccauccccaucacgugcugcuucaacgugaucaaccgcaagauccccauccagcggcuggagagcuacacccgcaucaccaacauccagugccccaaggaggccgugaucuucaagaccaagcgggggaaggaggucugcgccgacccgaaggagcgcugggugcgggacuccaugaagcaccucgaccagaucuuccagaaccugaagcccuga

SEQ ID NO: 27856 - RNA, 1398 nt, Artificial Sequence
  derived and/or modified sequence opt1 from CCM2__Homo_sapiens__NP_001025006
augcacagcuccugccgccagcggcgcaaccagaaccugagcaaggagaucccccagaccgaguuccacaccggcuacuccauggagaacgagccggggaucgugagccccuucaagcgggucuuccucaagggcgagaagucccgcgacaagaaggcccacgagaaggugacggagcggcgcccccugcacaccgugguccugagccuccccgagcggguggagccggaccgccugcuguccgacuacaucgagaaggaggugaaguaccucgggcagcugaccagcauccccggcuaccugaaccccuccagccggaccgagauccuccacuucaucgacaacgccaagcgcgcgcaccagcugcccgggcaccugacgcaggagcacgacgccguccucucccugagcgccuacaacgugaagcuggccuggcgggacggcgaggacaucauccuccgcgugccgauccacgacaucgccgcggucuccuacgugcgggacgacgccgcccaccuggugguccugaagaccgcccaggaccccggcaucagccccucccagagccucugcgcggaguccagccgcgggcuguccgccggcagccugagcgaguccgccguggggcccguggaggccugcugccucgucauccuggccgcggagagcaagguggccgccgaggagcugugcugccuccugggccagguguuccaggucguguacaccgaguccaccaucgacuuccuggaccgggccaucuucgacggggccagcacgccgacccaccaccucucccugcacagcgacgacuccagcaccaagguggacaucaaggagaccuacgaggucgaggcguccacguucugcuuccccgagagcguggacgugggcggcgccagcccccacuccaagaccaucuccgagagcgagcuguccgccagcgccaccgagcuccugcaggacuacaugcugacccuccgcacgaagcuguccagccaggagauccagcaguucgccgcgcugcuccacgaguaccggaacggggccuccauccacgaguucugcaucaaccugcgccagcuguacggcgacagccggaaguuccuccugcuggggcuccgccccuucaucccggagaaggacagccagcacuucgagaacuuccuggagaccaucggcgucaaggacggccgggggaucaucaccgacuccuucggccgccaccgccgggcccugagcaccacguccagcuccaccaccaacgggaaccgcgccaccggcagcuccgacgaccggagcgcccccuccgagggggacgagugggaccgcaugaucagcgacaucuccagcgacaucgaggcgcucggcugcuccauggaccaggacagcgccuga

SEQ ID NO: 27857 - RNA, 1395 nt, Artificial Sequence
  derived and/or modified sequence opt1 from CCNA1__Homo_sapiens__NP_001104515
auggagaccggcuuccccgccaucauguaccccgggagcuucaucggcggguggggcgaggaguaccuguccugggaggggcccggccuccccgacuucguguuccagcagcccgucgagagcgaggccaugcacugcuccaaccccaagagcggcguggugcuggcgaccgucgcccgcgggcccgacgccugccagauccugacgcgggcgccccucggccaggacccgccgcagcgcaccgugcuggggcugcucaccgccaacggccaguaccggcggaccugcgggcagggcaucacgcgcauccgcugcuacuccggcagcgagaacgccuucccgcccgccgggaagaaggcccugcccgacugcggcgugcaggagccgcccaagcagggguucgacaucuacauggacgagcuggagcagggcgaccgggacuccugcagcguccgcgagggcauggccuucgaggacguguacgagguggacaccgggacccucaaguccgaccugcacuuccugcucgacuucaacaccgucagccccaugcugguggacuccagccugcucucccagagcgaggacaucuccagccugggcacggacgugaucaacgucaccgaguacgcggaggagaucuaccaguaccugcgggaggccgagauccgccaccggcccaaggcccacuacaugaagaagcagcccgacaucaccgaggggaugcgcaccauccucguggacuggcugguggaggucggcgaggaguacaagcugcgggccgagacgcucuaccuggccgugaacuuccuggaccgcuuccucuccugcaugagcgugcugcgggggaagcugcagcucgucggcaccgcggccaugcugcuggccuccaaguacgaggagaucuacccgcccgagguggacgaguucguguacaucaccgacgacaccuacacgaagcgccagcuccugaagauggagcaccuccugcugaagguccuggccuucgaccucaccgugcccaccaccaaccaguuccugcugcaguaccuccggcgccagggcgugugcguccggacggagaaccuggccaaguacguggcggagcugagccuccuggaggccgaccccuuccugaaguaccuccccagccugaucgccgccgccgcguucugccuggccaacuacaccgucaacaagcacuucuggcccgagacccucgccgccuucaccggguacucccugagcgagaucgugcccugccuguccgagcugcacaaggccuaccucgacaucccgcaccgcccccagcaggcgauccgggagaaguacaaggccagcaaguaccugugcgugucccugauggagccgcccgccguccuccugcugcaguga

SEQ ID NO: 27858 - RNA, 1299 nt, Artificial Sequence
  derived and/or modified sequence opt1 from CCNA2__Homo_sapiens__NP_001228
augcugggcaacagcgcccccgggccggccacccgcgaggccggcuccgcccuccuggcccugcagcagaccgcccuccaggaggaccaggagaacaucaaccccgagaaggccgcgcccgugcagcagccccggacgcgcgccgcccuggccguccucaagagcgggaacccgcggggccuggcgcagcagcagcgccccaagacccggcgcguggcgccccugaaggaccugcccgugaacgacgagcacgucaccgugccgcccuggaaggccaacuccaagcagcccgccuucaccauccacguggacgaggccgagaaggaggcccagaagaagcccgccgagagccagaagaucgagcgggaggacgcccucgccuucaacuccgccaucagccugccggggccccgcaagccccuggucccccucgacuacccgauggacggcuccuucgagagcccccacacgauggacauguccaucgugcuggaggacgagaagcccgugagcgucaacgaggugcccgacuaccacgaggacauccacaccuaccugcgggagauggaggugaagugcaagccgaaggucggcuacaugaagaagcagcccgacaucaccaacuccaugcgcgcgauccucguggacuggcugguggaggucggggaggaguacaagcugcagaacgagacccuccaccuggccgugaacuacaucgaccgguuccugagcuccaugagcgugcuccgcggcaagcugcagcuggucgggacggccgccaugcuccuggccuccaaguucgaggagaucuacccgcccgagguggcggaguucguguacaucaccgacgacaccuacaccaagaagcagguccugcggauggagcaccucgugcugaaggugcugacguucgaccucgccgcccccaccgucaaccaguuccugacccaguacuuccugcaccagcagcccgccaacugcaagguggagagccucgccauguuccugggcgagcugucccucaucgacgcggaccccuaccugaaguaccugcccagcgucaucgccggggccgccuuccaccucgcgcuguacaccgugacgggccaguccuggccggagagccugauccgcaagaccggcuacacccucgagagccugaagcccugccugauggaccuccaccagaccuaccugaaggcgccccagcacgcccagcaguccauccgggagaaguacaagaacagcaaguaccacggggugucccugcucaacccgcccgagacgcugaaccuguga

SEQ ID NO: 27859 - RNA, 1302 nt, Artificial Sequence
  derived and/or modified sequence opt1 from CCNB1__Homo_sapiens__NP_114172
auggcccugcgcgugacccggaacagcaagaucaacgccgagaacaaggcgaagaucaacauggccggcgccaagcgcguccccaccgccccggccgcgacguccaagcccgggcuccggccccgcaccgcccugggcgacaucgggaacaaggugagcgagcagcugcaggccaagaugcccaugaagaaggaggccaagccguccgcgaccggcaaggugaucgacaagaagcuccccaagccccuggagaagguccccaugcuggugccggugcccgucagcgagcccgugcccgagccggagcccgagcccgagcccgagccggugaaggaggagaagcucucccccgagcccauccuggucgacaccgccagccccuccccgauggagacgagcgggugcgcccccgccgaggaggaccugugccaggccuucuccgacgugauccucgcggugaacgacgucgacgccgaggacggcgccgaccccaaccugugcagcgaguacgugaaggacaucuacgccuaccugcggcagcucgaggaggagcaggccgugcgccccaaguaccugcugggccgggaggucaccgggaacaugcgcgcgauccucaucgacuggcugguccaggugcagaugaaguuccggcugcuccaggagaccauguacaugaccguguccaucaucgaccgcuucaugcagaacaacugcgugccgaagaagaugcugcagcuggugggcgucacggccauguucaucgccagcaaguacgaggagauguacccgcccgagaucggggacuucgccuucgugaccgacaacaccuacaccaagcaccagauccggcagauggagaugaagauccuccgcgcccugaacuucggccuggggcggccccucccccugcacuuccugcgccgggcguccaagaucggcgagguggacgucgagcagcacacgcucgccaaguaccugauggagcugaccaugcucgacuacgacauggugcacuucccgcccagccagaucgccgccggcgccuucugccuggcgcugaagauccucgacaacggggaguggacccccacccugcagcacuaccuguccuacacggaggagagccuccugcccgucaugcagcaccuggccaagaacguggugauggucaaccagggccucaccaagcacaugaccgugaagaacaaguacgccaccuccaagcacgccaagaucagcacgcugccccagcugaacuccgcgcucgugcaggaccuggccaaggccgucgccaagguguga

SEQ ID NO: 27860 - RNA, 1197 nt, Artificial Sequence
  derived and/or modified sequence opt1 from CCNB2__Homo_sapiens__NP_004692
auggcccugcuccgccggcccaccgugagcuccgaccuggagaacaucgacaccggcgucaacagcaaggugaagucccacgugacgauccgccggaccguccuggaggagaucgggaaccgcgugaccacccgggccgcccagguggcgaagaaggcccagaacacgaaggucccggugcagcccaccaagaccaccaacgugaacaagcagcucaagcccacggccagcgucaagcccgugcagauggagaagcuggccccgaagggccccucccccacccccgaggacgugagcaugaaggaggagaaccugugccaggcguucuccgacgcccuccugugcaagaucgaggacaucgacaacgaggacugggagaacccgcagcugugcagcgacuacgucaaggacaucuaccaguaccuccgccagcuggaggugcugcaguccaucaacccccacuuccucgacgggcgggacaucaacggccgcaugcgggccauccugguggacuggcugguccaggugcacagcaaguuccgccuccugcaggagacccuguacaugugcguggggaucauggaccgguuccuccagguccagcccgugucccgcaagaagcugcagcuggugggcaucaccgcccuccugcuggcgagcaaguacgaggagauguucucccccaacaucgaggacuucgucuacaucacggacaacgccuacaccagcucccagauccgggagauggagacccucauccugaaggagcugaaguucgagcucggccgcccgcugccccugcacuuccuccggcgcgccagcaaggccggggagguggacguggagcagcacacccuggccaaguaccugauggagcucacgcugaucgacuacgacaugguccacuaccaccccuccaagguggcggccgccgccagcugccugucccagaagguccucggccaggggaaguggaaccugaagcagcaguacuacaccggcuacaccgagaacgaggugcuggaggugaugcagcacauggccaagaacgucgugaaggugaacgagaaccucaccaaguucaucgcgaucaagaacaaguacgccagcagcaagcugcugaagaucuccaugaucccccagcucaacagcaaggccgucaaggaccuggccuccccgcugaucgggcggagcuga

SEQ ID NO: 27861 - RNA, 876 nt, Artificial Sequence
  derived and/or modified sequence opt1 from CCNB3__Homo_sapiens__NP_391990
augcugcucccccugccgccccagagcuccaagcccgugcccaagaagucccagagcagcaagaucgucccgucccaccacgaccccagcgagaagaccggcgagaacugccagaccaagaucucccccagcucccugcaggagagccccuccagccuccagggggcccugaagaagcgcuccgccuucgaggaccugacgaacgugagcuucgagaugacccacgagacccucuaccuggcggugaagcuggucgaccucuaccugaugaaggccgugugcaagaaggacaagcugcagcuccugggcgccaccgccuucaugaucgccgcgaaguucgaggagcacaacuccccgcggguggacgacuucgucuacaucugcgacgacaacuaccagcgcagcgaggugcuguccauggagaucaacauccucaacgugcugaagugcgacaucaacauccccaucgccuaccacuuccugcggcgcuacgcccggugcauccacacgaacaugaagacccucacccugagccgcuacaucugcgagaugacccugcaggaguaccacuacguccaggagaaggccuccaagcucgcggccgccagccugcugcucgcccuguacaugaagaagcugggguacugggugcccuuccucgagcacuacagcggcuacuccaucagcgagcugcacccccuggugcggcagcucaacaagcugcugacguucuccagcuacgacucccucaaggccgucuacuacaaguacagccacccgguguucuucgagguggcgaagauccccgcccuggacaugcugaagcucgaggagauccugaacugcgacugcgaggcccaggggcugguccucuga

SEQ ID NO: 27862 - RNA, 597 nt, Artificial Sequence
  derived and/or modified sequence opt1 from CCNC__Homo_sapiens__NP_001013417
auggccccgaccugcguguuccuggccagcaaggucgaggaguucggcgugguguccaacacccgccucaucgcggccgccacgagcguccugaagacccgguucuccuacgccuuccccaaggaguuccccuaccgcaugaaccacauccuggagugcgaguucuaccuccuggagcugauggacugcugccucaucguguaccaccccuaccggccccugcugcaguacgugcaggacauggggcaggaggacaugcuccugccgcuggccuggcgcaucgucaacgacaccuaccggaccgaccucugccugcuguacccgcccuucaugaucgcgcucgccugccugcacguggccugcgugguccagcagaaggacgcccgccagugguucgcggagcugagcguggacauggagaagauccucgagaucauccgggugauccugaagcuguacgagcaguggaagaacuucgacgagcgcaaggagauggccacgauccucuccaagaugcccaagcccaagcccccgcccaacagcgagggcgagcaggggcccaacggcucccagaacagcuccuacagccaguccuga

SEQ ID NO: 27863 - RNA, 888 nt, Artificial Sequence
  derived and/or modified sequence opt1 from CCND1__Homo_sapiens__NP_444284
auggagcaccagcugcucugcugcgagguggagaccauccgccgggccuaccccgacgccaaccugcugaacgaccgcguccuccgggcgaugcugaaggccgaggagaccugcgccccgagcguguccuacuucaagugcgugcagaaggagguccugcccagcaugcgcaagaucguggccacguggaugcucgaggugugcgaggagcagaagugcgaggaggaggucuucccccuggccaugaacuaccuggaccgguuccucucccuggagcccgugaagaagucccgccugcagcuccugggcgcgaccugcauguucguggccagcaagaugaaggagaccaucccgcugaccgccgagaagcucugcaucuacacggacaacagcauccggcccgaggagcugcugcagauggagcuccugcuggucaacaagcucaaguggaaccuggccgcgaugacgccccacgacuucaucgagcacuuccuguccaagaugcccgaggccgaggagaacaagcagaucauccgcaagcacgcccagaccuucguggcccucugcgccaccgacgugaaguucaucagcaacccgcccuccauggucgcggccgggagcgugguggccgccguccagggccugaaccugcggucccccaacaacuuccucagcuacuaccgccugacccgguuccugucccgcgugaucaagugcgaccccgacugccuccgggccugccaggagcagaucgaggcgcugcuggagagcucccuccgccaggcccagcagaacauggacccgaaggccgccgaggaggaggaggaggaggaggaggagguggaccuggccugcacccccaccgacguccgggacguggacaucuga

SEQ ID NO: 27864 - RNA, 870 nt, Artificial Sequence
  derived and/or modified sequence opt1 from CCND2__Homo_sapiens__NP_001750
auggagcugcucugccacgagguggaccccguccgccgggccgugcgcgaccggaaccugcugcgcgacgaccgggugcuccagaaccugcugaccaucgaggagcgcuaccucccccagugcagcuacuucaagugcguccagaaggacauccagcccuacaugcggcgcaugguggccaccuggaugcuggaggugugcgaggagcagaagugcgaggaggaggucuucccccuggcgaugaacuaccucgaccgguuccuggccggcgugcccacgccgaagucccaccuccagcugcugggggccgugugcauguuccuggccagcaagcucaaggagaccagcccccugaccgccgagaagcugugcaucuacaccgacaacuccaucaagccccaggagcuccuggagugggagcuggucgugcucggcaagcugaaguggaaccuggcggccgugacgccccacgacuucaucgagcacauccuccgcaagcugccgcagcagcgggagaagcugucccucauccgcaagcacgcccagaccuucaucgcccugugcgcgaccgacuucaaguucgccauguacccgcccagcaugaucgccaccggguccgucggcgccgccaucugcgggcugcagcaggacgaggaggugagcucccucacgugcgacgcgcugaccgagcugcucgccaagaucaccaacaccgacguggacugccugaaggccugccaggagcagaucgaggccguccugcucaacagccugcagcaguaccggcaggaccagcgcgacggcuccaagagcgaggacgagcuggaccaggccuccacgcccaccgacgugcgggacaucgaccucuga

SEQ ID NO: 27865 - RNA, 636 nt, Artificial Sequence
  derived and/or modified sequence opt1 from CCND3__Homo_sapiens__NP_001129489
augaacuaccuggaccgcuaccucagcugcgugcccacccggaaggcccagcugcagcugcucggcgccgucugcaugcugcuggccuccaagcuccgcgagaccacgccgcugaccaucgagaagcugugcaucuacaccgaccacgccgugagcccccggcagcuccgcgacugggaggugcugguccuggggaagcucaagugggaccuggccgccgugaucgcccacgacuuccuggcguucauccuccaccggcugucccugccccgcgaccggcaggcccucgugaagaagcacgcccagaccuuccuggcccugugcgcgacggacuacaccuucgccauguacccgcccagcaugaucgccaccggcuccaucggggccgccguccagggccucggggcgugcagcauguccggcgacgagcugaccgagcugcucgccggcaucacggggaccgagguggacugccugcgcgccugccaggagcagaucgaggccgcccugcgggagagccuccgcgaggcgucccagaccagcuccagccccgcccccaaggcgccccggggcuccagcucccaggggccgagccagaccuccacgcccaccgacgugaccgccauccaccuguga

SEQ ID NO: 27866 - RNA, 1083 nt, Artificial Sequence
  derived and/or modified sequence opt1 from CCNDBP1__Homo_sapiens__NP_036274
auggccagcgccaccgcgcccgccgccgccgugccgacccuggccagcccccucgagcagcugcgccaccuggcggaggagcuccggcugcugcucccccgcguccgggugggcgaggcccaggagacgaccgaggaguucaaccgcgagauguucuggcggcgccugaacgaggccgccgugaccgucucccgggaggcgaccacgcugaccaucguguucucccagcucccccugccgagcccccaggagacccagaaguucugcgagcagguccacgccgccaucaaggccuucaucgccguguacuaccugcuccccaaggaccaggggaucacccugcgcaagcuggugcggggcgcgacgcucgacaucguggacgggauggcccagcugauggagguccuguccgugacccccacccagagcccggagaacaacgaccucaucuccuacaacagcgugugggucgccugccagcagaugccccagaucccccgcgacaacaaggccgccgcgcugcugaugcucaccaagaacguggacuucgugaaggacgcccacgaggagauggagcaggccgucgaggagugcgaccccuacuccggccugcugaacgacacggaggagaacaacagcgacaaccacaaccacgaggacgacgugcucggguucccguccaaccaggaccuguacuggagcgaggacgaccaggagcugaucauccccugccucgcccuggugcgggccuccaaggcgugccugaagaagauccgcaugcucgucgccgagaacggcaagaaggaccagguggcccagcuggacgacaucguggacaucagcgacgagaucucccccagcgucgacgaccuggcccucuccaucuacccgcccaugugccaccugaccgugcggaucaacagcgccaagcugguguccguccucaagaaggcgcuggagaucaccaaggccagccacgugacgccccagcccgaggacagcuggaucccccugcucaucaacgccaucgaccacugcaugaaccgcaucaaggagcugacccaguccgagcuggagcucuga

SEQ ID NO: 27867 - RNA, 1233 nt, Artificial Sequence
  derived and/or modified sequence opt1 from CCNE1__Homo_sapiens__NP_001229
augccccgcgagcggcgcgagcgggacgccaaggagcgcgacaccaugaaggaggacggcggggccgaguucagcgcgcggucccgcaagcggaaggccaacgugaccgucuuccugcaggaccccgacgaggagauggccaagaucgaccgcacggcccgggaccagugcggcagccagcccugggacaacaacgccgugugcgcggaccccugcucccucauccccaccccggacaaggaggacgacgaccgcguguaccccaacagcacgugcaagccccggaucaucgcccccucccgcgggagcccgcugcccguccuguccugggccaaccgggaggagguguggaagaucaugcucaacaaggagaagaccuaccugcgcgaccagcacuuccuggagcagcacccccuccugcagcccaagaugcgggccauccugcucgacuggcugauggaggugugcgaggucuacaagcugcaccgcgagaccuucuaccucgcgcaggacuucuucgaccgguacauggccacccaggagaacguggugaagacccugcugcagcucaucggcaucagcucccuguucaucgccgccaagcuggaggagaucuacccgcccaagcuccaccaguucgccuacgucaccgacggggcgugcagcggcgacgagauccugacgauggagcugaugaucaugaaggcccucaaguggcgccugagcccccugaccaucguguccuggcucaacguguacaugcaggucgccuaccugaacgaccugcacgaggugcuccugccccaguacccgcagcagaucuucauccagaucgccgagcugcucgaccugugcgugcuggacgucgacugccucgaguuccccuacggcauccuggccgcguccgcccuguaccacuucagcuccagcgagcucaugcagaagguguccggguaccaguggugcgacaucgagaacugcgugaaguggaugguccccuucgccauggugauccgggagaccggcagcuccaagcugaagcacuuccgcgggguggccgacgaggacgcccacaacauccagacccaccgggacagccuggaccuccuggacaaggcgcgcgccaagaaggccaugcugagcgagcagaaccgcgccagcccccucccguccggccugcugacgccgccccaguccgggaagaagcagagcuccggccccgagauggccuga

SEQ ID NO: 27868 - RNA, 1215 nt, Artificial Sequence
  derived and/or modified sequence opt1 from CCNE2__Homo_sapiens__NP_477097
augagccgccgguccagccgccugcaggccaagcagcagccccagcccucccagaccgagagcccccaggaggcccagaucauccaggcgaagaagcggaagaccacgcaggacgugaagaagcgccgggaggaggucaccaagaagcaccaguacgagauccgcaacugcuggccgcccgugcucuccggcgggaucagccccugcaucaucaucgagacgccccacaaggagaucggcaccuccgacuucagccgguucaccaacuaccgcuucaagaaccuguucaucaaccccagcccccugccggaccucuccugggggugcuccaaggagguguggcugaacaugcugaagaaggagagccgguacguccacgacaagcacuucgaggugcuccacuccgaccuggagccccagaugcgcagcauccugcucgacuggcugcuggaggugugcgaggucuacacccuccaccgggagaccuucuaccuggcccaggacuucuucgaccgcuucaugcugacccagaaggacaucaacaagaacaugcuccagcugaucggcaucacgucccuguucaucgccagcaagcucgaggagaucuacgcccccaagcugcaggaguucgccuacgugaccgacggggcgugcuccgaggaggacauccugcggauggagcucaucauccugaaggcccugaagugggagcucugccccgugaccaucaucagcuggcugaaccuguuccuccaggucgacgcccugaaggacgccccgaaggugcugcucccccaguacucccaggagaccuucauccagaucgcgcagcugcuggaccucugcauccuggccaucgacagccuggaguuccaguaccgcauccucacggccgccgcccugugccacuucaccagcaucgagguggucaagaaggcguccggccuggagugggacagcaucuccgagugcguggacuggauggugcccuucgucaacguggucaagagcaccucccccgugaagcucaagaccuucaagaagaucccgauggaggaccggcacaacauccagacgcacaccaacuaccuggccaugcuggaggaggugaacuacaucaacaccuuccgcaagggcgggcagcucagccccgugugcaacggcgggaucaugaccccgcccaaguccacggagaagccgcccggcaagcacuga

SEQ ID NO: 27869 - RNA, 2361 nt, Artificial Sequence
  derived and/or modified sequence opt1 from CCNF__Homo_sapiens__NP_001752
augggcagcgggggcgugguccacugccgcugcgccaagugcuucugcuaccccaccaagcggcgcauccggcgccggccccgcaaccugaccauccucucccugcccgaggacgugcuguuccacauccucaaguggcugagcguggaggacauccuggccguccgggcggugcacucccagcucaaggaccugguggacaaccacgccagcgucugggccugcgccuccuuccaggagcuguggcccagccccgggaaccucaagcuguucgagcgcgccgcggagaagggcaacuucgaggccgccgugaagcuggggaucgccuaccucuacaacgagggccuguccgugagcgacgaggcgcgggccgaggucaacggccugaaggccucccgcuucuucagccucgccgagcggcugaacgugggggccgcgccguucaucuggcuguucauccgcccgcccugguccgugagcggcuccugcugcaaggccgucgugcacgagagccuccgggccgagugccagcugcagcgcacgcacaaggccuccauccugcacugccucgggcgggugcugagccuguucgaggacgaggagaagcagcagcaggcccacgaccucuucgaggaggcggcccaccagggcugccugaccuccagcuaccugcucugggaguccgaccgccggaccgacgucagcgaccccgggcgcugccugcacagcuuccggaagcugcgcgacuacgccgccaagggcugcugggaggcccagcucucccuggcgaaggccugcgccaacgccaaccagcugggccucgaggugcgggccagcuccgagaucgugugccagcuguuccaggcgagccaggccgucuccaagcagcaggucuucagcgugcagaaggggcugaacgacaccaugcgcuacauccucaucgacuggcugguggagguggccacgaugaaggacuucaccucccugugccuccaccugaccguggagugcgucgaccgcuaccugcggcgccggcucgugccccgcuaccggcugcagcugcucggcaucgccugcauggucaucugcacccgcuucaucagcaaggagauccugacgauccgggaggcgguguggcugaccgacaacaccuacaaguacgaggaccucgugcgcaugaugggggagaucgucuccgcccuggagggcaagauccgggugcccaccguggucgacuacaaggaggugcugcugacgcucgugcccgucgagcugcgcacccagcaccugugcagcuuccucugcgagcugucccugcuccacaccagccuguccgccuacgcccccgcccggcuggcggccgccgcccuccugcuggcccgccucacccacggccagacgcagccguggaccacccagcugugggaccugaccggguucagcuacgaggaccucauccccugcgugcugucccugcacaagaagugcuuccacgacgacgcgcccaaggacuaccgccaggugagccucacggccgucaagcagcgguucgaggacaagcgguacggcgagaucucccaggaggaggugcugagcuacucccagcugugcgccgcccucggggugacccaggacagccccgacccgcccaccuuccugagcaccggcgagauccacgccuuccuguccagccccuccgggcgccggacgaagcgcaagcgggagaacagccuccaggaggaccgcggcuccuucgucaccacccccaccgcggagcugagcucccaggaggagacgcugcucggcagcuuccuggacuggucccuggacugcugcagcggguacgagggcgaccaggaguccgagggggagaaggagggcgacgugaccgccccgagcgggauccucgacgugaccgucguguaccugaaccccgagcagcacugcugccaggaguccagcgacgaggaggccugccccgaggacaagggcccccaggacccgcaggcccuggcgcucgacacccagauccccgccacgcccggccccaagccgcuggugcgcaccucccgggagcccgggaaggacgucaccaccagcggcuacuccagcgugagcacggccucccccaccagcuccguggacgggggccugggggcccucccgcagcccaccagcguccugucccuggacagcgacucccacacccagcccugccaccaccaggcccgcaagagcugccuccagugccggcccccguccccgcccgagagcuccgugccccagcagcaggucaagcgcaucaaccugugcauccacagcgaggaggaggacaugaaccugggccucgugcggcuguga

SEQ ID NO: 27870 - RNA, 888 nt, Artificial Sequence
  derived and/or modified sequence opt1 from CCNG1__Homo_sapiens__NP_954854
augaucgaggugcugaccaccacggacagccagaagcugcugcaccagcugaacgcccuccuggagcaggagucccgcugccagcccaaggucugcggccugcggcucaucgagagcgcccacgacaacgggcugcgcaugaccgcgcggcugcgcgacuucgaggugaaggaccuccugucccugacccaguucuucggcuucgacaccgagacguucagccucgccgugaaccugcuggaccgguuccucuccaagaugaagguccagccgaagcaccuggggugcgugggccugagcugcuucuaccucgccgugaaguccaucgaggaggagcgcaacgucccccuggccaccgaccugauccggaucagccaguaccgcuucaccguguccgaccucaugcggauggagaagaucgugcuggagaaggucugcuggaaggugaaggccaccacggcguuccaguuccugcagcucuacuacagccugcugcaggagaaccucccccuggagcgccggaacuccaucaacuucgagcgccuggaggcccagcucaaggccugccacugccggaucaucuucagcaaggccaagcccuccgugcuggcgcugagcaucaucgcccucgagauccaggcccagaagugcgucgagcugaccgaggggaucgagugccugcagaagcacuccaagaucaacggccgcgaccucaccuucuggcaggagcuggugagcaagugccugaccgaguacuccagcaacaagugcuccaagccgaacgugcagaagcucaaguggaucgucagcggccggacggcccgccagcugaagcacagcuacuaccggaucacccaccuccccaccauccccgagauggugcccuga

SEQ ID NO: 27871 - RNA, 1035 nt, Artificial Sequence
  derived and/or modified sequence opt1 from CCNG2__Homo_sapiens__XP_011530701
augaaggaccugggcgccgagcaccucgccgggcacgagggcgugcagcugcuggggcuccugaacgucuaccuggagcaggaggagcgcuuccagccccgggagaagggccucagccugaucgaggcgaccccggagaacgacaacacccugugccccgggcuccgcaacgccaagguggaggaccugcggucccuggccaacuucuucggcagcugcacggagaccuucgugcucgccgucaacauccuggaccgcuuccuggcccucaugaaggugaagcccaagcaccuguccugcaucggcgugugcagcuuccugcucgcggcccggaucgucgaggaggacugcaacauccccuccacccacgacgugauccgcaucagccagugcaagugcaccgccuccgacaucaagcggauggagaagaucaucagcgagaagcugcacuacgagcuggaggccacgaccgcgcucaacuuccugcaccuguaccacaccaucauccucugccacaccuccgagcgcaaggagauccugagccuggacaagcucgaggcccagcugaaggccugcaacugccggcugaucuucuccaaggccaagccgagcgugcucgcccugugccugcucaaccuggaggucgagacgcugaaguccguggagcuccuggagauccugcuccuggugaagaagcacagcaagaucaacgacaccgaguucuucuacuggcgcgagcuggucuccaagugccucgcggaguacagcucccccgagugcugcaagcccgaccugaagaagcugguguggaucgugagccggcgcaccgcccagaaccuccacaacuccuacuacagcguccccgagcugccgaccauccccgagggcgggugcuucgacgagagcgaguccgaggacagcugcgaggacauguccugcggggaggagagccuguccagcuccccgcccagcgaccaggagugcacguucuucuucaacuucaagguggcccagacccucugcuuccccuccuga

SEQ ID NO: 27872 - RNA, 813 nt, Artificial Sequence
  derived and/or modified sequence opt1 from CCNH__Homo_sapiens__NP_001186118
augacccugugcaaguacuacgagaagcgccuccuggaguucugcagcguguucaagcccgccaugccccgguccgucgugggcaccgccugcauguacuucaagcgcuucuaccugaacaacagcgugauggaguaccacccccggaucaucaugcucacgugcgcguuccuggccugcaaggucgacgaguucaacguguccagcccccaguucguggggaaccugcgcgagagcccccucggccaggagaaggcccuggagcagauccuggaguacgagcuccugcugauccagcagcucaacuuccaccugaucguccacaacccguaccggcccuucgagggguuccugaucgaccucaagacccgcuaccccauccuggagaaccccgagauccugcggaagaccgccgacgacuuccucaaccgcaucgcccugaccgacgcguaccugcucuacacgccgagccagaucgcccugaccgccauccuguccagcgccucccgggcgggcaucaccauggagagcuaccucuccgagagccugaugcugaaggagaaccggaccugccucucccagcugcuggacaucaugaaguccaugcgcaaccucgugaagaaguacgagccgccccgcuccgaggagguggccguccugaagcagaagcuggagcggugccacagcgccgagcucgcccugaacgugaucacgaagaagcgcaagggguacgaggacgacgacuacguguccaagaaguccaagcacgaggaggaggaguggaccgacgacgaccuggucgagagccucuga

SEQ ID NO: 27873 - RNA, 1134 nt, Artificial Sequence
  derived and/or modified sequence opt1 from CCNI__Homo_sapiens__NP_006826
augaaguuccccggcccgcuggagaaccagcgccucagcuuccugcuggagaaggccaucacccgggaggcccagauguggaaggugaacguccgcaagaugcccuccaaccagaacgugagccccucccagcgggacgaggugauccaguggcucgcgaagcugaaguaccaguucaaccuguaccccgagaccuucgcccucgccagcucccugcuggaccgcuuccucgccacggucaaggcccacccgaaguaccugagcugcaucgcgaucuccugcuucuuccuggccgccaagaccguggaggaggacgagcggauccccgugcucaagguccuggcccgcgacagcuucugcgggugcuccagcuccgagauccugcggauggagcgcaucauccucgacaagcugaacugggaccugcacaccgcgacgccccucgacuuccugcacaucuuccacgccaucgccgugagcacccggccccagcugcuguucucccugccgaagcugagccccucccagcaccucgccgugcugaccaagcagcugcuccacugcauggccugcaaccagcugcugcaguuccgcggcagcaugcucgcgcuggccauggucucccuggagauggagaagcucauccccgacuggcugagccugaccaucgagcuccugcagaaggcccagauggacuccagccagcugauccacugccgggagcucguggcccaccaccugagcacccugcaguccagccucccccugaacuccguguacgucuaccgcccgcugaagcacacgcucgugaccugcgacaaggggguguuccggcugcaccccagcuccguccccggccccgacuucagcaaggacaacuccaagccggaggugcccgugcgcgggaccgccgcguucuaccaccaccuccccgccgccagcggcugcaagcagaccuccacgaagcggaaggucgaggagauggagguggacgacuucuacgacggcaucaagcgccucuacaacgaggacaacgugagcgagaacgucggguccgugugcggcaccgaccugagccggcaggaggggcacgccucccccugcccgccccugcagcccgugagcgucauguga

SEQ ID NO: 27874 - RNA, 1152 nt, Artificial Sequence
  derived and/or modified sequence opt1 from CCNJ__Homo_sapiens__NP_001127847
auggagcuggagggccagugguggcgcgggcagcucgccgccgacauccaccaggcgcugcgguacaaggagcugaagcuccccagcuacaagggccaguccccgcagcugagccugcgccgguacuucgccgaccucaucgccaucguguccaaccgcuucacccugugccccagcgcccggcaccuggccgucuaccuccuggaccuguucauggaccgcuacgacaucuccauccagcagcuccaccugguggcgcugagcugccuccugcuggccuccaaguucgaggagaaggaggacagcgugcccaagcucgagcagcugaacucccuggggugcaugaccaacaugaaccucguccugacgaagcagaaccugcuccacauggagcugcugcuccuggagaccuuccaguggaaccugugccuccccaccgccgcccacuucaucgaguacuaccugagcgaggcggugcacgagaccgaccugcacgacggcuggccgaugaucugccucgagaagacgaagcuguacauggccaaguacgccgacuacuuccuggaggugucccuccaggacuacgccuuccugaacuacgcccccagccuggucgcggccgccugcguggccuccagccggaucauccuccgccugucccccaccuggcccacccggcugcaccgccucaccgccuacagcugggacuuccuggugcagugcaucgagcggcugcucaucgcgcacgacaacgacgucaaggaggccaacaagcagcgcgggcaggccggcccgcaguccgcccagcugagcguguuccagacggccucccagcccagccggcccgugcacuuccagcagccccaguaccugcaccagacccaccagaccagccuccaguaccgccacccgaccuccgagcagcccagcugccagcagaucgucuccacgacccacaccagcuccuacacccugcagacgugccccgcgggcuuccagaccagcgugcaggggcugggccacaugcagaccggggugggcaugucccuggccauccccgucgaggugaagccgugccucagcguguccuacaaccggagcuaccagaucaacgagcacuaccccugcaucacccccugcuucgagcgcuga

SEQ ID NO: 27875 - RNA, 1308 nt, Artificial Sequence
  derived and/or modified sequence opt1 from CCNJL__Homo_sapiens__NP_078841
augauggacgagcccuggugggagggccgcguggccagcgacguccacugcacccugcgggagaaggagcucaagcugccgaccuuccgcgcccacagcccccugcucaagucccggcgcuucuucguggacauccugacgcugcucuccagccacugccagcugugccccgcggcccggcaccuggccguguaccuccuggaccacuucauggaccgcuacaacgucaccaccuccaagcagcuguacaccguggccgugagcugccuccugcuggccaacggggucucccuccugagcccccggcugaagugcuccggcaugaucagcgcgcacugcaaccuccaccucccgggguccagcaacucccccgccagcgcgccccacccgccgcccacgccgccccagguggccgagaccaccggcaaguucgaggaccgcgaggaccacgugcccaagcuggagcagaucaacuccacccggauccugagcucccagaacuucacgcugaccaagaaggagcugcucagcaccgagcugcugcuccuggaggccuucuccuggaaccugugccuccccacccccgcccacuuccuggacuacuaccugcucgccagcgucagccagaaggaccaccacugccacacguggcccacgaccugcccccgcaagaccaaggagugccugaaggaguacgcccacuacuuccuggaggugacccuccaggaccacaucuucuacaaguuccagcccuccguggucgccgcggccugcgugggggccagccggaucugccugcagcugucccccuacuggacccgcgaccuccagcggaucagcuccuacagccuggagcaccuguccacgugcaucgagauccuccugguggucuacgacaacgugcugaaggacgccguggccgucaagagccaggcgcucgccauggugcccggcaccccgcccacccccacccaggugcuguuccagcccccggccuaccccgcccugggccagcccgccaccacccucgcgcaguuccagacgcccguccaggaccugugccuggccuaccgcgacucccugcaggcccaccggagcgggucccuccugagcggcuccaccgggagcucccugcacaccccguaccagccccuccagccccuggacaugugcccggugcccgugcccgccagccuguccaugcacauggccaucgcggccgagccccgccacugccucgccaccacguacggcagcuccuacuucagcgggagccacauguucccgaccggcugcuucgaccgguga

SEQ ID NO: 27876 - RNA, 1743 nt, Artificial Sequence
  derived and/or modified sequence opt1 from CCNK__Homo_sapiens__XP_011535577
augaaggagaacaaggagaacagcucccccagcgugaccuccgccaaccuggaccacaccaagccgugcugguacugggacaagaaggaccucgcccacacgcccagccagcuggagggccuggaccccgcgaccgaggcccgcuaccggcgcgagggggcccgguucaucuucgacgucggcacccgccucgggcugcacuacgacacccuggccacgggcaucaucuacuuccaccgguucuacauguuccacuccuucaagcaguucccccgcuacgugaccggggccugcugccucuuccuggcgggcaagguggaggagaccccgaagaagugcaaggacaucaucaagaccgcccggagccugcucaacgacguccaguucggccaguucggggacgaccccaaggaggaggugauggugcuggagcgcauccugcuccagacgaucaaguucgaccugcaggucgagcaccccuaccaguuccugcucaaguacgccaagcagcugaagggcgacaagaacaagauccagaagcuggugcagauggccuggaccuucgugaacgacucccucugcaccacccugagccugcagugggagcccgagaucaucgcggucgccgugauguaccucgccgggcggcugugcaaguucgagauccaggaguggacguccaagccgauguaccgccgguggugggagcaguucgugcaggacguccccguggacgugcuggaggacaucugccaccagauccucgaccuguacagccagggcaagcagcagaugccccaccacaccccccaccagcugcagcagccgcccucccuccagcccaccccccaggucccgcaggugcagcagagccagcccucccagagcuccgagcccagccagccccagcagaaggacccgcagcagcccgcccagcagcagcagcccgcccagcagcccaagaagccguccccccagcccagcuccccccgccaggugaagcgggcggucguggugagcccgaaggaggagaacaaggccgccgagccccccccgcccaagauccccaagaucgagaccacgcaccccccgcugccccccgcccaccccccgcccgaccgcaagcccccccuggccgcggcccucggggaggccgagccgcccggccccgucgacgccaccgaccugcccaaggugcagaucccgccccccgcccaccccgcgccggugcaccagccccccccccugccgcaccggccccccccgcccccccccagcuccuacaugaccggcaugagcaccacguccagcuacauguccggggagggcuaccagagccuccaguccaugaugaagaccgaggggccgagcuacggcgcccugccccccgccuacggccccccggcccaccugcccuaccacccccacgucuaccccccgaaccccccccccccgcccgugccccccccgcccgccuccuucccccccccggcgauccccccccccaccccgggguacccccccccgccccccaccuacaaccccaacuucccgcccccccccccgcgccucccccccacgcacgccguccccccgcaccccccccccggccuggggcugccgcccgccagcuacccccccccggccgugccccccggcgggcagcccccggugcccccccccaucccgccccccggcaugccgcccgucggcgggcucggccgggcggccuggaugcgcuga

SEQ ID NO: 27877 - RNA, 1581 nt, Artificial Sequence
  derived and/or modified sequence opt1 from CCNL1__Homo_sapiens__NP_064703
auggccagcggcccccacuccaccgccaccgcggccgccgccgccagcuccgcggccccgagcgccgggggcuccagcuccgggacgaccaccaccacgaccaccaccacgggcgggauccugaucggcgaccgccucuacagcgaggugucccugaccaucgaccacagccugauccccgaggagcggcucucccccacccccagcaugcaggacggccuggaccugccguccgagaccgaccuccgcauccuggggugcgagcugauccaggccgcgggcauccuccugcggcugccccaggucgccauggccacggggcagguccucuuccaccgcuucuucuacagcaaguccuucgugaagcacagcuucgagaucguggccauggccugcaucaaccuggcguccaagaucgaggaggcgccccggcgcauccgggacgugaucaacguguuccaccaccuccgccagcugcggggcaagcgcacccccagcccgcugauccuggaccagaacuacaucaacaccaagaaccaggucaucaaggccgagcggcgcgugcucaaggagcugggguucugcgugcacgucaagcacccccacaagaucaucgugauguaccuccaggugcuggagugcgagcggaaccagacccugguccagacggccuggaacuacaugaacgacucccugcgcaccaacguguucgugcgguuccagcccgagaccaucgccugcgccugcaucuaccucgccgcccgcgcccugcagaucccccugccgacccggccccacugguuccuccuguucggcacgaccgaggaggagauccaggagaucugcaucgagacccugcgccucuacacccggaagaagcccaacuacgagcugcuggagaaggaggucgagaagcgcaagguggcccuccaggaggcgaagcugaaggccaagggccugaaccccgacgggacgccggcccucagcacccugggcggguucagccccgccuccaagcccagcagcccccgggaggugaaggccgaggagaaguccccgaucuccaucaacgucaagaccgugaagaaggagcccgaggaccgccagcaggcgagcaagucccccuacaacggcgugcgcaaggacagcaagcggucccgcaacagccgguccgccagccgcucccggagccgcacccggucccgcagccggucccacacgccccgccggcacuacaacaaccgccggagccgcuccggcaccuacagcagccggucccgcagccggucccgcagccacuccgagagcccgcggcgccaccacaaccacgggagcccccaccugaaggccaagcacacccgcgacgaccucaagagcuccaaccggcacggccacaagcgcaagaagucccggucccgcagccaguccaagagccgggaccacuccgacgccgcgaagaagcaccgccacgagcgggggcaccaccgcgaccggcgcgagcggagccgcuccuucgagcggagccacaagagcaagcaccacggcgggucccgcagcggccacggccggcaccgccgguga

SEQ ID NO: 27878 - RNA, 1170 nt, Artificial Sequence
  derived and/or modified sequence opt1 from CCNL2__Homo_sapiens__XP_011540521
augggccagcuggccgccgcgcucaugagcccccgccgggggcugccgcugggcgccgagucccccagcgcccgcugcucccacgccagcaaccuccacccccggggguucucccuguuccagguggacagcuucaaggaggccgcggcccgcuccgccgagaagggccccgccgcgagcgcccuggaggaggaggaggaggagccgaagcggauggccugccuccccgccgccacccccgcgcugugcuccgccagcuccuucgagaacuacaugaacgacagccugcgcaccgacgucuucgugcgguuccagcccgaguccaucgccugcgccugcaucuaccucgccgcgcgcacgcuggagaucccgcugcccaaccggccccacugguuccuccuguucggggccaccgaggaggagauccaggagaucugccugaagauccuccagcuguacgcccgcaagaagguggaccugacccaccucgagggcgaggucgagaagcggaagcacgccaucgaggaggccaaggcgcaggcccgcggccugcugcccgggggcacccaggugcucgacgggacgagcggcuucuccccggcccccaagcugguggagagccccaaggaggggaagggcuccaagcccagcccgcuguccgucaagaacaccaagcggcgccucgagggcgccaagaaggccaaggcggacagccccgugaacgggcugcccaagggccgggagagccgcucccggagccgcucccgggagcagagcuacucccgcagccccucccggagcgccuccccgaagcgccgcaagagcgacuccgggagcaccuccggcggcagcaagucccagagccggucccgcagccgguccgacagcccgccccgccaggcgccccggagcgcccccuacaagggguccgagauccgcggcagccggaaguccaaggacugcaaguacccccagaagccccacaagagccgcucccggagcuccagccgcucccggagccgcucccgggagcgcgccgacaaccccgggaaguacaagaagaagucccacuacuaccgggaccagcgccgggagcgcagccggagcuacgagcgcaccggccgccgguacgagcgcgaccacccggggcacucccggcaccgccgguga

SEQ ID NO: 27879 - RNA, 1053 nt, Artificial Sequence
  derived and/or modified sequence opt1 from CCNO__Homo_sapiens__NP_066970
auggugacccccugcccgaccagccccuccagccccgccgcccgcgcgggccggcgcgacaacgaccagaaccugcgggcccccgucaagaagucccgccggccgcgccuccggcgcaagcagccccugcacccccugaaccccugcccgcuccccggggacagcggcaucugcgaccuguucgagucccccagcuccgggagcgacggcgccgagucccccagcgccgcccgcgggggcuccccgcugcccggccccgcgcagcccguggcccagcucgaccugcagacguuccgggacuacgggcagagcugcuacgccuuccggaaggcccaggagucccacuuccacccgcgcgaggcgcuggcccggcagccccaggugaccgccgagagccgcugcaagcuccuguccuggcugauccccguccaccggcaguucggccucagcuucgagucccugugccugaccgugaacacccucgaccgcuuccugacgaccacccccguggccgccgacugcuuccagcugcucggggucaccagccugcugaucgcgugcaagcaggucgaggugcacccgccccgggugaagcagcuccuggcccugugcugcggcgccuucucccgccagcagcucugcaaccuggagugcaucgugcugcacaagcuccacuucacgcugggggcccccaccaucagcuucuuccuggagcacuucacccacgcccggguggaggcgggccaggccgaggccagcgaggcccucgaggcccaggcgcuggcccgcggcgucgccgagcugucccucgccgacuacgccuucaccagcuacucccccagccugcuggcgaucugcugccucgcccuggccgaccggaugcugcgcgugucccgcccgguggaccuccggcugggggaccaccccgaggccgcgcuggaggacugcaugggcaagcuccagcugcuggucgccaucaacagcacgucccucacccacaugcugcccgugcagaucugcgagaagugcagccugcccccguccagcaaguga

SEQ ID NO: 27880 - RNA, 2181 nt, Artificial Sequence
  derived and/or modified sequence opt1 from CCNT1__Homo_sapiens__NP_001231
auggagggcgagcgcaagaacaacaacaagcgcugguacuucacccgcgagcagcuggagaacagccccucccggcgcuucgggguggaccccgacaaggagcucagcuaccggcagcaggccgccaaccugcugcaggacaugggccagcgccucaacgucucccagcugaccaucaacacggcgaucguguacaugcaccgguucuacaugauccagagcuucacccaguuccccgggaacuccguggcccccgccgcccuguuccucgccgcgaaggucgaggagcagcccaagaagcuggagcacgugaucaagguggcccacacgugccugcacccccaggagagccuccccgacacccgcuccgaggccuaccugcagcagguccaggaccuggugauccucgagagcaucauccugcagacccugggcuucgagcucaccaucgaccacccccacacccacguggucaagugcacccagcuggugcgggccuccaaggaccuggcgcagacgagcuacuucauggccaccaacucccuccaccugaccaccuucagccugcaguacacgcccccgguggucgccugcgugugcauccaccucgccugcaagugguccaacugggagauccccgugagcaccgacgggaagcacuggugggaguacgucgacgccaccgugacccuggagcugcucgacgagcugacgcacgaguuccugcagauccucgagaagacccccaaccgccugaagcggaucuggaacuggcgcgcgugcgaggccgccaagaagaccaaggccgacgaccggggcaccgacgagaagacguccgagcagaccauccugaacaugaucagccaguccagcuccgacaccaccaucgccggccucaugagcaugagcacguccaccaccagcgcggugcccucccugccggucagcgaggaguccagcuccaaccugaccagcguggagaugcuccccgggaagcgcuggcuguccagccagcccuccuucaagcuggagcccacgcagggccaccggaccagcgagaaccucgcccugaccgggguggaccacucccugccgcaggacggcagcaacgccuucaucucccagaagcagaacagcaaguccguccccagcgccaaggugucccucaaggaguaccgcgccaagcacgcggaggagcuggccgcccagaagcggcagcuggagaacauggaggccaacgucaagagccaguacgccuacgcggcccagaaccuccugagccaccacgacucccacagcuccgugauccugaagaugcccaucgaggggagcgagaaccccgagcgcccguuccucgagaaggccgacaagaccgcccugaagaugcggauccccguggcgggcggcgacaaggccgccuccagcaagcccgaggagaucaagaugcgcaucaagguccacgccgccgcggacaagcacaacuccguggaggacagcgugacgaagucccgggagcacaaggagaagcacaagacccaccccagcaaccaccaccaccaccacaaccaccacucccacaagcacagccacucccagcugccggucgggaccggcaacaagcgccccggggaccccaagcacagcucccagaccagcaaccucgcccacaagacguacucccugagcagcuccuucagcuccagcuccagcacccgcaagcggggccccuccgaggagaccggcggggccguguucgaccacccggccaagaucgccaagagcaccaaguccagcucccugaacuucagcuuccccucccugcccaccaugggccagaugccggggcacagcuccgacacgagcggccucuccuucagccagcccuccugcaagacccgcgugccccacagcaagcuggacaaggggcccaccggcgcgaacggccacaacaccacgcagaccaucgacuaccaggacaccgucaacaugcugcacagccuccuguccgcccagggggugcagccgacccagcccacggccuucgaguucgugcggcccuacagcgacuaccugaacccccgcuccggcgggaucagcucccggagcggcaacaccgacaagccgcggcccccgccccuccccuccgagcccccgccgccccugccgccccugcccaaguga

SEQ ID NO: 27881 - RNA, 951 nt, Artificial Sequence
  derived and/or modified sequence opt1 from CCNY__Homo_sapiens__NP_001269781
augggcaacaccaccagcugcugcguguccagcucccccaagcugcgccggaacgcccacagccgccucgaguccuaccggccggacacggaccugagccgcgaggacaccgggugcaaccugcagcacaucuccgaccgggagaacaucgacguccgcgagaagcgcaagagccucuucaucaaccaccacccgcccggccagaucgcccggaaguacuccagcugcuccaccaucuuccuggacgacagcaccgugucccagcccaaccugaaguacacgaucaagugcguggcgcucgccaucuacuaccacaucaagaaccgggaccccgacgggcgcaugcugcuggacaucuucgacgagaaccuccacccccugagcaaguccgaggucccgcccgacuacgacaagcacaaccccgagcagaagcagaucuaccgguucgugcgcacccuguucagcgccgcccagcucaccgccgagugcgcgaucgugacccuggucuaccuggagcggcuccugacguacgccgagaucgacaucugccccgccaacuggaagcgcaucgugcugggcgccauccuccuggcguccaaggugugggacgaccaggccgucuggaacguggacuacugccagauccugaaggacaucaccguggaggacaugaacgagcucgagcggcaguuccuggagcugcuccaguucaacaucaacguccccagcuccguguacgccaaguacuacuucgaccugcgcagccuggccgaggccaacaaccucagcuucccccuggagccgcugucccgggagcgcgcgcacaagcucgaggccaucagccggcugugcgaggacaaguacaaggaccugcgccgguccgcccgcaagcgcagcgccuccgccgacaaccucacccugccccgguggagccccgcgaucaucuccuga

SEQ ID NO: 27882 - RNA, 2976 nt, Artificial Sequence
  derived and/or modified sequence opt1 from CCP110__Homo_sapiens__NP_055526
auggaggaguacgagaaguucugcgagaagucccuggcccgcauccaggaggccucccucagcaccgaguccuuccugcccgcgcagagcgaguccaucagccugauccgguuccacggcguggccauccucuccccgcugcugaacaucgagaagcgcaaggagaugcagcaggagaagcagaaggcccucgacgucgaggcccggaagcaggucaaccgcaagaaggcccugcugacccgggugcaggagauccucgacaacguccaggugcgcaaggcgcccaacgccagcgacuucgaccagugggagauggagacgguguacuccaacagcgaggugcggaaccugaacgugcccgccaccuuccccaacuccuucccgagccacaccgagcacuccaccgccgcgaagcuggacaagaucgccgggauccucccccuggacaacgaggaccagugcaagacggacggcaucgaccuggcccgcgacagcgagggguucaacucccccaagcagugcgacagcuccaacaucagccacguggagaacgaggccuuccccaagaccuccagcgccaccccgcaggagacccucaucagcgacggccccuucuccgucaacgagcagcaggaccugccccugcucgcggaggugauccccgacccguacgugaugagccugcagaaccugaugaagaaguccaaggaguacaucgagcgggagcagagccgccggucccuccgcgggagcaugaaccggaucgucaacgagucccaccuggacaaggagcacgacgccguggagguggccgacugcgucaaggagaagggccagcugacgggcaagcacugcgugagcgugauccccgacaagcccucccucaacaagagcaacguccugcugcagggggccuccacccaggccagcuccaugagcaugcccgugcucgcguccuucagcaagguggacaucccgauccgcaccggccaccccaccguccuggaguccaacagcgacuucaaggugauccccacguucgugaccgagaacaacgucaucaagucccugaccgggagcuacgccaagcuccccagcccggagcccuccaugagccccaagaugcaccggcgccggucccgcaccagcuccgccugccacauccugaucaacaaccccaucaacgccugcgagcugagcccgaagggcaaggagcaggccauggaccucaucauccaggacacggacgagaacaccaacgugcccgagaucaugcccaagcugcccaccgaccuggcgggggucugcuccagcaagguguacgugggcaagaacaccuccgaggucaaggaggacguggugcucggcaagagcaaccaggucugccaguccagcgggaaccaccuggagaacaaggugacgcacggccuggugaccgucgaggggcagcucaccuccgacgagcggggcgcccacaucaugaacagcacgugcgccgccaugccgaagcugcacgagcccuacgccuccagccagugcaucgcgucccccaacuucggcaccgugagcgggcugaagccggccagcaugcucgagaagaacugcucccugcagaccgagcugaacaagagcuacgacgugaagaaccccagcccccuccugaugcagaaccagaacacccgccagcagauggacacccccauggucagcugcggcaacgagcaguuccuggacaacuccuucgagaaggugaagcggcgccucgaccuggacaucgacgggcugcagaaggagaacugcccguacgugaucacgagcggcaucaccgagcaggagcgccagcaccuccccgagaagcgguaccccaagggguccggcuucgucaacaagaacaagaugcugggcaccagcuccaaggagagcgaggagcugcugaaguccaagaugcucgccuucgaggagaugcgcaagcggcuggaggagcagcacgcccagcagcugagccuccugaucgcggagcaggagcgcgagcaggagcggcugcagaaggagaucgaggagcaggagaagaugcucaaggagaagaaggccaugaccgccgaggccuccgagcuggacaucaacaacgccguggagcuggaguggcgcaagaucagcgacuccagccuccuggagacgaugcugucccaggcggacagccuccacaccuccaacagcaacagcuccggguucaccaacagcgccaugcaguacuccuucgugagcgccaacgaggcccccuucuaccuguggggcuccagcaccuccgggcugacgaagcucagcgucacccggccguucggccgcgccaagacccgguggucccagguguucagccuggagauccaggcgaaguucaacaagaucaccgccguggccaagggguuccugacccgccggcucaugcagacggacaagcugaagcagcugcgccagaccgucaaggacaccauggaguucauccgguccuuccagagcgaggcgccccucaagcgcggcaucguguccgcccaggacgccagccugcaggagcgggugcuggcccagcuccgcgccgcccuguacggcauccacgacaucuucuucgucauggacgcggccgagcggauguccauccugcaccacgaccgcgaggugcggaaggagaagaugcuccgccagauggacaagaugaaguccccgcgcguggcccugagcgccgccacccagaagucccuggaccggaagaaguacaugaaggcggccgagauggggaugcccaacaagaaguuccucgucaagcagaaccccagcgagacgcgcgugcugcagcccaaccagggccagaacgcccccgugcaccggcugcucagccgccaggggagcaucugccggaagaaccccaagaaggccgccaagugcugcgacaaccugcgccggcagcacucccugggcuga

SEQ ID NO: 27883 - RNA, 1089 nt, Artificial Sequence
  derived and/or modified sequence opt1 from CCR10__Homo_sapiens__NP_057686
augggcaccgaggccaccgagcaggucagcugggggcacuacuccggcgacgaggaggacgccuacagcgcggagccccugccggagcucugcuacaaggccgacgugcaggccuucucccgcgccuuccagcccagcgugucccugacgguggccgcgcuggggcucgccggcaacgggcugguccuggccacccaccucgccgcgcggcgcgccgcccggagccccaccuccgcccaccuccugcagcucgcccuggcggaccugcuccuggcccugacccuccccuucgccgccgccggcgcgcugcagggcuggagccugggguccgccacgugccgcaccaucagcggccucuacuccgccagcuuccacgccggguuccuguuccuggccugcaucuccgcggaccgguacguggccaucgcccgcgcccucccggccggcccccggcccagcacccccgggcgcgcgcaccugguguccgucaucguguggcugcucagccugcugcucgcccugccggcccugcuguucucccaggacggccagcgggagggccagcgccggugccgccugaucuuccccgaggggcugacccagacggugaagggcgccagcgcggucgcccagguggcccucggguucgcccugccccugggcgugauggucgccugcuacgcgcuccugggccggacccugcucgccgcccgcgggcccgagcggcgccgggcccugcgcgugguggucgcccugguggcggccuucgugguccuccagcugccguacucccuggcccuccugcuggacaccgccgaccuccuggccgcgcgggagcgcagcugccccgccagcaagcggaaggacguggcccugcuggugaccuccggccucgcccuggcgcgcugcgggcugaaccccguccucuacgccuuccugggccugcgcuuccggcaggaccuccgccggcugcugcgcgggggcagcugccccuccggcccgcagccccggcgcgggugcccccggcgcccccggcucagcuccugcagcgccccgacggagacccacucccugagcugggacaacuga

SEQ ID NO: 27884 - RNA, 1068 nt, Artificial Sequence
  derived and/or modified sequence opt1 from CCR1__Homo_sapiens__NP_001286
auggagacccccaacaccacggaggacuacgacaccaccaccgaguucgacuacggcgacgccacgccgugccagaaggugaacgagcgcgccuucggggcgcagcugcucccgccccuguacagccuggucuucgugaucggccucguggggaacauccuggucgugcuggugcucguccaguacaagcggcugaagaacaugaccuccaucuaccugcucaaccuggccaucagcgaccuccucuuccuguucacccugcccuucuggaucgacuacaagcucaaggacgacuggguguucggcgacgccaugugcaagauccuguccggguucuacuacaccggccuguacagcgagaucuucuucaucauccuccugacgaucgaccgcuaccuggccaucgugcacgccgucuucgcgcuccgggcccgcaccgugaccuucggcgugaucaccuccaucaucaucugggcccuggccauccuggcgagcaugcccgggcucuacuucuccaagacgcagugggaguucacccaccacacgugcagccugcacuucccccacgagucccugcgggaguggaagcuguuccaggcccugaagcugaaccucuucggccugguccugccccuccuggugaugaucaucugcuacaccgggaucaucaagauccugcuccgccggcccaacgagaagaaguccaaggccgugcgccugaucuucgucaucaugaucaucuucuuccuguucuggaccccguacaaccucaccauccugaucagcguguuccaggacuuccuguucacccacgagugcgagcagagccggcaccucgaccuggccgugcaggucaccgaggugaucgccuacacgcacugcugcgugaaccccgucaucuacgcguucgugggcgagcgcuuccggaaguaccugcgccagcuguuccaccggcgcguggccguccaccucgugaaguggcugcccuuccucuccgucgaccggcuggagcgcgugagcuccaccagccccuccaccggggagcacgagcugagcgccggcuucuga

SEQ ID NO: 27885 - RNA, 1125 nt, Artificial Sequence
  derived and/or modified sequence opt1 from CCR2__Homo_sapiens__NP_001116513
augcugagcaccucccgcagccgguucauccgcaacaccaacgaguccggcgaggaggugacgaccuucuucgacuacgacuacggggcccccugccacaaguucgacgucaagcagaucggcgcccagcuccugccgccccuguacagccucguguucaucuucggguucgugggcaacaugcuggucgugcugauccucaucaacugcaagaagcugaagugccugaccgacaucuaccuccugaaccuggccaucuccgaccuccuguuccugaucacccucccccugugggcccacagcgccgccaacgaguggguguucgggaacgccaugugcaagcuguucacgggccucuaccacaucggcuacuucgggggcaucuucuucaucauccugcugaccaucgaccgguaccucgcgaucguccacgccguguucgcccugaaggcccgcaccgugaccuucggggucgugacguccgugaucaccuggcuggucgcgguguucgccagcgugcccggcaucaucuucaccaagugccagaaggaggacuccgucuacgugugcgggccguacuucccccggggcuggaacaacuuccacaccaucaugcgcaacauccucggccuggugcugccccuccugaucauggucaucugcuacagcgggauccugaagacgcuccugcggugccgcaacgagaagaagcggcaccgcgccgugcgggugaucuucaccaucaugaucgucuacuuccuguucuggacccccuacaacaucgugauccuccugaacaccuuccaggaguucuucggccuguccaacugcgagagcacgucccagcucgaccaggccacccaggugaccgagacccuggggaugacgcacugcugcaucaacccgaucaucuacgccuucgucggcgagaaguuccgcagccuguuccacaucgcgcucggcugccggaucgcgccccugcagaagcccgugugcgggggccccgggguccgcccgggcaagaacgugaaggugaccacccaggggcugcucgacggccggggcaaggggaaguccaucggccgcgcccccgaggccagccugcaggacaaggagggggccuga

SEQ ID NO: 27886 - RNA, 1122 nt, Artificial Sequence
  derived and/or modified sequence opt1 from CCR3__Homo_sapiens__NP_001158152
augcccuucggcauccgcaugcugcuccgggcccacaagccggggcgcagcgagaugaccaccucccuggacacgguggagaccuucggcaccaccagcuacuacgacgacgucgggcugcucugcgagaaggccgacacgcgggcgcugauggcccaguucgugccgccccuguacucccucguguucaccgucggccugcuggggaacgugguggucgugaugauccucaucaaguaccgccggcugcgcaucaugaccaacaucuaccugcucaaccuggccaucagcgaccugcuguuccuggugacccugcccuucuggauccacuacguccggggccacaacuggguguucggccacgggaugugcaagcuccuguccggcuucuaccacacggggcuguacagcgagaucuucuucaucauccuccugaccaucgaccgcuaccuggccaucgugcacgccgucuucgcgcuccgggcccgcaccgugaccuucggcgugaucacguccaucgucaccugggggcuggccgugcuggccgcgcuccccgaguucaucuucuacgagaccgaggagcuguucgaggagacccugugcagcgcccucuaccccgaggacacgguguacuccuggcggcacuuccacacccugcgcaugaccaucuucugccugguccucccccugcuggugauggccaucugcuacaccggcaucaucaagacgcuccugcggugccccagcaagaagaaguacaaggccauccgccugaucuucgugaucauggccgucuucuucaucuucuggaccccguacaacguggcgauccuccuguccagcuaccaguccauccuguucggcaacgacugcgagcggagcaagcaccucgaccuggugaugcuggucaccgaggugaucgccuacucccacugcugcaugaaccccgucaucuacgccuucgugggggagcgcuuccggaaguaccuccgccacuucuuccaccggcaccuccugaugcaccucggccgcuacauccccuuccugcccagcgagaagcuggagcggaccuccagcguguccccgagcacggccgagcccgagcugagcaucgucuucuga

SEQ ID NO: 27887 - RNA, 1083 nt, Artificial Sequence
  derived and/or modified sequence opt1 from CCR4__Homo_sapiens__NP_005499
augaaccccaccgacaucgccgacaccacgcuggacgagagcaucuacuccaacuacuaccucuacgagagcaucccgaagcccugcaccaaggagggcaucaaggccuucggggagcuguuccugccgccccucuacucccugguguucgucuucggccugcucgggaacagcguggugguccuggugcuguucaaguacaagcgccuccgguccaugaccgacguguaccugcugaaccucgcgaucagcgaccugcuguucgucuucucccuccccuucuggggcuacuacgccgccgaccaguggguguucgggcugggccugugcaagaugaucagcuggauguaccucgugggcuucuacuccgggaucuucuucgucaugcugaugagcaucgaccgcuaccuggccaucgugcacgccguguucucccuccgggcgcgcacccugacguacggcgucaucaccagccuggccaccugguccguggccguguucgccagccuccccggguuccuguucuccacgugcuacaccgagcggaaccacaccuacugcaagaccaaguacagccugaacuccaccacguggaagguccucagcucccuggagaucaacauccugggccucgugaucccccuggggaucaugcuguucugcuacagcaugaucauccgcacccuccagcacugcaagaacgagaagaagaacaaggcggugaagaugaucuucgccgucguggugcuguuccugggcuucuggacccccuacaacaucguccucuuccuggagacccugguggagcucgaggugcugcaggacugcacguucgagcgguaccuggacuacgccauccaggccaccgagacccucgccuucguccacugcugccugaacccgaucaucuacuucuuccugggcgagaaguuccgcaaguacauccuccagcuguucaagaccugccgggggcuguucgugcucugccaguacugcggccugcugcagaucuacagcgcggacacgcccuccagcuccuacacccagagcaccauggaccacgaccugcacgacgcccucuga

SEQ ID NO: 27888 - RNA, 1059 nt, Artificial Sequence
  derived and/or modified sequence opt1 from CCR5__Homo_sapiens__NP_000570
auggacuaccaggugagcucccccaucuacgacaucaacuacuacaccagcgagccgugccagaagaucaacgucaagcagaucgccgcccgccugcucccgccccuguacucccugguguucaucuucggcuucguggggaacaugcucgucauccugauccugaucaacugcaagcggcucaagagcaugaccgacaucuaccugcugaaccucgcgaucuccgaccuguucuuccugcucacggugcccuucugggcccacuacgccgccgcccagugggacuucggcaacaccaugugccagcugcugaccgggcucuacuucaucggcuucuucagcgggaucuucuucaucauccugcugaccaucgaccgcuaccucgcggugguccacgccguguucgcccugaaggcccggacggugaccuucggcgucgugaccuccgugaucaccugggucguggcgguguucgccagccugcccggcaucaucuucacgcgcucccagaaggaggggcuccacuacacgugcagcucccacuuccccuacagccaguaccaguucuggaagaacuuccagacccugaagaucgucauccugggccucgugcugccccugcucgugauggucaucugcuacuccgggauccugaagacccugcuccggugccgcaacgagaagaagcggcaccgcgccgugcggcugaucuucaccaucaugaucguguacuuccuguucugggcccccuacaacaucguccuccugcugaacaccuuccaggaguucuucggccucaacaacugcagcuccagcaaccgccuggaccaggccaugcaggucaccgagacccuggggaugacgcacugcugcaucaacccgaucaucuacgcguucgugggcgagaaguuccggaacuaccuccugguguucuuccagaagcacaucgccaagcgcuucugcaagugcugcuccaucuuccagcaggaggcccccgagcgggccagcuccguguacacccgcagcaccggcgagcaggagaucagcgucgggcuguga

SEQ ID NO: 27889 - RNA, 1125 nt, Artificial Sequence
  derived and/or modified sequence opt1 from CCR6__Homo_sapiens__NP_004358
augagcggcgaguccaugaacuucagcgacguguucgacuccagcgaggacuacuucgucuccgugaacaccagcuacuacuccguggacagcgagaugcugcucugcucccugcaggagguccgccaguucagccggcuguucgugcccaucgccuacucccucaucugcguguucgggcugcugggcaacauccucgucgugaucaccuucgccuucuacaagaaggcgcgcagcaugacggacguguaccugcugaacauggccaucgccgacauccucuucguccugacccugccguucugggccgugucccacgccaccggggcguggguguucagcaacgcgaccugcaagcuccugaagggcaucuacgccaucaacuucaacugcgggaugcugcuccugacgugcaucuccauggaccgguacaucgccaucguccaggccaccaagagcuuccgccugcggucccgcacccucccccggagcaagaucaucugccuggugguguggggccuguccgucaucaucagcagcuccaccuucguguucaaccagaaguacaacacgcagggcagcgacgugugcgagcccaaguaccagaccgucuccgagcccauccgcuggaagcuccugaugcuggggcucgagcugcuguucggcuucuucaucccgcucauguucaugaucuucugcuacaccuucaucgugaagacccuggugcaggcccagaacagcaagcggcacaaggccauccgcgucaucaucgccguggugcuggucuuccucgccugccagaucccccacaacauggugcugcuggucacggcggccaaccucgggaagaugaaccgguccugccagagcgagaagcugaucggcuacaccaagaccgugaccgaggugcuggccuuccuccacugcugccugaaccccguccuguacgccuucaucgggcagaaguuccgcaacuacuuccucaagauccugaaggaccuguggugcgugcggcgcaaguacaaguccagcggcuucuccugcgccggccgguacagcgagaacaucucccgccagacgagcgagaccgcggacaacgacaacgccuccagcuucaccauguga

SEQ ID NO: 27890 - RNA, 1137 nt, Artificial Sequence
  derived and/or modified sequence opt1 from CCR7__Homo_sapiens__NP_001829
auggaccugggcaagcccaugaaguccgugcucgucguggcccugcuggugaucuuccaggucugccucugccaggacgaggugaccgacgacuacaucggggacaacaccacgguggacuacacccuguucgagagccugugcagcaagaaggacguccgcaacuucaaggccugguuccucccgaucauguacuccaucaucugcuucgugggccugcuggggaacggccucgugguccugaccuacaucuacuucaagcggcugaagaccaugacggacaccuaccuccugaaccuggcgguggccgacauccucuuccugcugacccuccccuucugggccuacagcgccgccaaguccuggguguucgggguccacuucugcaagcugaucuucgcgaucuacaagaugagcuucuucuccggcaugcugcuccugcugugcaucagcaucgaccgcuacguggccaucgugcaggccgucuccgcccaccggcaccgcgcgcgggugcuccugaucagcaagcuguccugcgugggcaucuggauccucgccaccguccugagcauccccgagcugcucuacuccgaccugcagcgcagcuccagcgagcaggccaugcggugcucccugaucacggagcacguggaggccuucaucaccauccagguggcccagauggucaucggguuccucgugccccugcuggcgaugagcuucugcuaccucgugaucauccgcacccugcugcaggcccggaacuucgagcgcaacaaggccaucaaggucaucaucgccguggucgugguguucaucgucuuccagcucccguacaacggcguggugcuggcccagaccgucgcgaacuucaacaucacguccagcacgugcgagcugagcaagcagcucaacaucgccuacgacgugaccuacucccuggccugcgugcggugcugcgucaaccccuuccuguacgccuucaucggggugaaguuccgcaacgaccucuucaagcuguucaaggaccugggcugccucagccaggagcagcugcggcagugguccagcugccgccacauccggcgcuccagcauguccguggaggccgagaccaccaccaccuucagccccuga

SEQ ID NO: 27891 - RNA, 1068 nt, Artificial Sequence
  derived and/or modified sequence opt1 from CCR8__Homo_sapiens__NP_005192
auggacuacacccuggaccucagcgugaccacggucaccgacuacuacuaccccgacaucuucuccagcccgugcgacgccgagcugauccagaccaacggcaagcugcuccuggccguguucuacugccugcuguucguguucucccugcuggggaacagccucgucauccuggugcugguggucugcaagaagcuccgcuccaucaccgacguguaccugcugaaccucgcgcugagcgaccuccucuucguguucuccuuccccuuccagacguacuaccugcuggaccagugggucuucggcaccgugaugugcaagguggucagcggguucuacuacaucggcuucuacuccagcauguucuucaucacccucauguccguggaccgguaccuggccgugguccacgccguguacgcccugaaggugcgcaccauccggauggggacgacccucugccuggccgucuggcugaccgcgaucauggccaccaucccccuccugguguucuaccagguggccagcgaggacggcguccugcagugcuacuccuucuacaaccagcagacgcucaaguggaagaucuucaccaacuucaagaugaacauccugggccugcucauccccuucaccaucuucauguucugcuacaucaagauccugcaccagcugaagcgcugccagaaccacaacaagaccaaggccauccggcucgugcugaucguggucaucgcgagccuccuguucugggugccguucaacgucgugcuguuccugacgucccuccacagcaugcacauccuggacgggugcuccaucagccagcagcugaccuacgccacccacgugaccgagaucaucuccuucacgcacugcugcgucaaccccgugaucuacgccuucgugggcgagaaguucaagaagcaccucagcgagaucuuccagaaguccugcagccagaucuucaacuaccuggggcgccagaugccccgggagagcugcgagaaguccagcuccugccagcagcacagcucccgcagcuccagcgucgacuacauccuguga

SEQ ID NO: 27892 - RNA, 1074 nt, Artificial Sequence
  derived and/or modified sequence opt1 from CCR9__Homo_sapiens__NP_001243298
auggccgacgacuacggcagcgaguccaccagcuccauggaggacuacgugaacuucaacuucaccgacuucuacugcgagaagaacaacguccgccaguucgccagccacuuccugcccccgcucuacuggcugguguucaucgugggggcgcugggcaacucccucgucauccugguguacugguacugcacgcgggugaagaccaugaccgacauguuccugcucaaccuggccaucgccgaccugcuguuccuggucacccugcccuucugggccaucgccgcggccgaccaguggaaguuccagacguucaugugcaagguggugaacagcauguacaagaugaacuucuacuccugcguccuccugaucaugugcaucagcguggaccgcuacaucgccaucgcccaggcgaugcgggcccacaccuggcgcgagaagcggcugcucuacuccaagauggugugcuucaccaucuggguccuggccgccgcccugugcauccccgagauccucuacagccagaucaaggaggaguccgggaucgcgaucugcaccaugguguaccccagcgacgaguccacgaagcucaagagcgccgugcugacccucaaggucauccugggcuucuuccugccguucguggugauggccugcugcuacaccaucaucauccacacccucauccaggccaagaaguccagcaagcacaaggcccugaaggucacgaucaccgugcugaccguguucguccucucccaguuccccuacaacugcauccugcuggugcagaccaucgacgcguacgccauguucaucagcaacugcgccguguccacgaacaucgacaucugcuuccaggucacccagaccaucgccuucuuccacagcugccucaaccccgugcuguacgucuucgugggggagcgcuuccggcgcgaccuggugaagacccucaagaaccugggcugcaucagccaggcccagugggucuccuucacgcggcgcgagggcagccugaagcucuccagcaugcugcuggagaccaccuccggggcgcucagccuguga

SEQ ID NO: 27893 - RNA, 1071 nt, Artificial Sequence
  derived and/or modified sequence opt1 from CCRL2__Homo_sapiens__NP_001124382
augaucuacacccgcuuccugaagggcagccugaagauggccaacuacacccuggcccccgaggacgaguacgacgugcugaucgagggggagcucgaguccgacgaggcggagcagugcgacaaguacgacgcccaggcccugagcgcccagcuggucccgucccucugcagcgccguguucgugaucggcguccuggacaaccugcucguggugcugauccuggucaaguacaaggggcucaagcggguggagaacaucuaccugcugaaccucgcgguguccaaccugugcuuccugcucacgcugcccuucugggcccacgccggcggggaccccaugugcaagauccugaucggccucuacuucgucggccuguacagcgagaccuucuucaacugccugcucaccgugcagcgcuaccugguguuccugcacaaggggaacuucuucuccgcccggcgccggguccccugcggcaucaucaccagcgugcucgcgugggugacggccauccuggccacccugccggaguucgucguguacaagccccagauggaggaccagaaguacaagugcgccuucucccgcacccccuuccuccccgccgacgagaccuucuggaagcacuuccugacgcugaagaugaacaucagcgugcucguccugccgcuguucaucuucaccuuccucuacgugcagaugcggaagacccugcgcuuccgggagcagcgcuacucccuguucaagcucguguucgcgaucauggucguguuccugcugaugugggcccccuacaacaucgccuucuuccucagcaccuucaaggagcacuucucccugagcgacugcaaguccagcuacaaccuggacaaguccgugcacaucacgaagcucaucgccaccacccacugcugcaucaacccccugcuguacgccuuccucgacgggaccuucagcaaguaccugugccggugcuuccaccuccgcuccaacacgccccugcagccgcggggccagagcgcgcaggggaccagccgcgaggagcccgaccacuccaccgaggucuga

SEQ ID NO: 27894 - RNA, 1296 nt, Artificial Sequence
  derived and/or modified sequence opt1 from CCRN4L__Homo_sapiens__NP_036250
auguuccacagcccccgccggcugugcuccgcccuccugcagcgcgacgccccgggccugcggcgccuccccgcgcccgggcugcggcgcccccugagcccgcccgccgccgugccccggcccgccuccccgcgccuccuggccgcggccagcgccgccuccggcgcggcccggagcugcucccgcaccgucugcagcauggggaccggcacgucccggcuguacagcgcccucgccaagacccugaacuccagcgccgcgucccagcaccccgaguaccuggugagccccgaccccgagcaccucgagccgaucgaccccaaggagcugcuggaggagugccgcgccgugcuccacacccggccgccccgcuuccagcgggacuucgucgaccugcgcaccgacugccccuccacgcacccgcccauccgggugaugcaguggaacauccuggcccaggcccucggggagggcaaggacaacuucgugcagugccccgucgaggcccugaagugggaggagcgcaagugccugauccucgaggagauccuggcguaccagcccgacauccugugccuccaggagguggaccacuacuucgacaccuuccagccccugcugagccggcucggcuaccaggggaccuucuuccccaagcccugguccccgugccuggacguggagcacaacaacggccccgacgggugcgcccuguucuuccuccagaaccgcuucaagcuggucaacagcgccaacauccggcugaccgccaugacgcucaagaccaaccagguggccaucgcgcagacccuggagugcaaggaguccggccgccaguucugcaucgccgugacccaccugaaggcccgcacggggugggagcgguuccgcagcgcccagggcugcgaccuccugcagaaccugcagaacaucacccagggcgccaagaucccccucaucgucugcggggacuucaacgcggagcccaccgaggagguguacaagcacuucgccagcuccagccugaaccugaacuccgccuacaagcuccugagcgccgacggccaguccgagccgcccuacaccacguggaagauccggaccagcggggagugccgccacacccuggacuacaucugguacuccaagcacgcgcucaacgugcggagcgcccuggaccugcucaccgaggagcagaucggccccaaccgccugccguccuucaacuaccccagcgaccaccugucccuggucugcgacuucagcuucacggaggaguccgacggccucagcuga

SEQ ID NO: 27895 - RNA, 2703 nt, Artificial Sequence
  derived and/or modified sequence opt1 from CCSER1__Homo_sapiens__NP_001138537
augggcgacagcgggucccgccggagcacccuggugucccgccuccccaucuuccggcgcagcaucaaccggcgccacgacucccugcccagcucccccagcuccagcaacaccgucggcgugcacuccagcucccccagcuccacgaacagcuccagcggguccaccggcaagcggcgcagcaucuuccggacccccagcaucuccuuccaccacaagaaggggagcgagccgaagcaggagcccaccaaccagaaccuguccaucagcaacggcgcccagcccggccacuccaacaugcagaagcucagccuggaggagcacaucaagacgcgcgggcggcacuccgugggcuucagcuccagccgcaacaagaagaucacccggucccugaccgaggacuucgagcgcgagaaggagcacagcaccaacaagaacgucuucaucaacugccucuccagcgggaaguccgagggcgacgacagcggguucacggaggaccagacccggcgcuccgugaagcagagcacccggaagcugcugcccaaguccuucagcagccacuacaaguucuccaagccggugcuccagagccaguccaucagccugguccagcaguccgaguucagccuggaggugacccaguaccaggagcgcgagcccgugcucguccgggccucccccagcugcuccguggacgugacggagcgcgcgggcagcucccugcagagcccccugcucuccgccgaccugaccaccgcccagaccccgagcgaguuccuggcccucacggaggacuccgucagcgagauggacgccuucuccaagagcggcagcauggcgucccacugcgacaacuucgggcacaacgacagcaccucccagaugagccugaacuccgccgccgugaccaagaccacgaccgagcugaccggcaccgugcccugcgccaucaugagccccgggaaguaccggcucgagggccagugcuccacggagagcaacucccugcccgagaccagcgcggccaaccagaaggagguccugcuccagaucgccgagcugccggccaccuccgugagccacuccgagagcaaccugcccgccgacuccgagcgcgaggagaacaucggccuccagaacggggagaccaugcugggcacgaacagcccccgcaagcugggguucuacgagcagcacaaggcgaucgccgagcacgugaagggcauccaccccaucuccgacagcaagaucaucccgaccuccggggaccaccacaucuucaacaagaccagccacggcuacgaggccaaccccgccaagguccucgccagcucccugagccccuuccgggagggccgcuucaucgagcggcgccugcgguccagcuccgaggggaccgcgggcagcucccgcaugauccucaagcccaaggacgggaacaucgaggaggugaacagccugcggaagcagcgcgccggcuccagcuccagcaagaugaacucccuggacgugcucaacaaccuggggagcugcgagcuggacgaggacgaccucaugcuggaccuggaguuccucgaggagcagucccugcacccgagcgucugccgggaggacuccuaccacagcgugguguccugcgccgccgucgugcugacgcccauggagcccaugaucgagaugaagaagcgcgaggagcccgaguucccggagcccagcaagcagaaccucagccugaagcugaccaaggacgucgaccaggaggcccggugcucccacaucagccgcaugcccaacuccccgagcgcggacuggccccuccagggcguggaggagaacggcgggaucgacucccugcccuuccggcugaugcugcaggacugcaccgccgugaagacccuccugcugaagaugaagcgcguccuccaggagagcgccgacaugucccccgccagcuccacgaccagccugccggugagcccccugaccgaggagcccgugcccuucaaggacaucaugaaggacgagugcuccaugcucaagcugcagcugaaggagaaggacgagcucaucucccagcugcaggaggagcugggcaagguccggcaccuccagaaggccuucgcgagccgcguggacaaguccacccagaccgagcugcugugcuacgacgggcucaaccugaagcggcuggagacggugcagggcgggcgcgaggccaccuaccggaaccgcaucgucagccagaaccucuccacccgcgaccggaaggccauccacaccccgacggaggaccgcuuccgguacagcgccgcggaccagaccucccccuacaagaacaagaccugccagcugcccagccugugccucagcaacuuccugaaggacaaggagcuggccgaggugaucaagcacucccgcggcaccuacgagacgcucaccagcgacgugacccagaaccugcgggccaccgucggccaguccagccugaagcccacggccaagaccgaggggcucuccaccuuccuggagaagccgaaggaccagguggccaccgcgcgccagcacagcacguucaccggccgguucgggcagccgccccgcggccccaucucccugcacauguacagccggaagaacguguuccuccaccacaaccugcacuccaccgagcugcagacccucggccagcaggacggguga

SEQ ID NO: 27896 - RNA, 825 nt, Artificial Sequence
  derived and/or modified sequence opt1 from CCS__Homo_sapiens__NP_005116
auggccagcgacuccggcaaccaggggacccugugcacccucgaguucgccgugcagaugacgugccagagcugcgucgacgcggugcgcaagucccugcagggcguggccgggguccaggacguggaggugcaccuggaggaccagaugguccucgugcacaccacccugcccagccaggaggugcaggcccugcucgagggcaccgggcggcaggccguccugaagggcaugggcuccgggcagcugcagaaccucggcgccgcgguggccauccucgggggcccggggacggugcagggcgucgugcgcuuccugcagcucacccccgagcggugccugaucgagggcaccaucgacgggcuggagcccggccuccacgggcugcacgugcaccaguacggcgaccugaccaacaacugcaacagcugcggcaaccacuucaaccccgacggggccucccacggcgggccgcaggacagcgaccgccaccggggcgaccucgggaacguccgcgccgacgcggacggccgggccaucuuccgcauggaggacgagcagcugaaggugugggacgugaucggccggucccugaucaucgacgagggggaggacgaccucggccgcgggggccacccccugagcaagaucacggggaacuccggcgagcggcuggccugcggcaucaucgcccgcagcgccgggcuguuccagaaccccaagcagaucugcuccugcgacggccugaccaucugggaggagcgggggcgccccaucgcgggcaaggggcggaaggagagcgcccagccgcccgcccaccuguga

SEQ ID NO: 27897 - RNA, 1608 nt, Artificial Sequence
  derived and/or modified sequence opt1 from CCT2__Homo_sapiens__NP_006422
auggccagccugucccucgcccccgugaacaucuucaaggcgggcgccgacgaggagcgcgccgagaccgcccggcugaccagcuucaucggggccaucgcgaucggcgaccuggucaaguccacgcucgggccgaagggcauggacaagauccugcugagcuccgggcgcgacgccagccucauggugaccaacgacggcgccaccauccugaagaacaucggcguggacaaccccgccgcgaagguccugguggacaugucccgggugcaggacgacgaggucggggacggcaccacgagcgugaccgugcucgccgccgagcugcugcgcgaggccgagucccucaucgccaagaagauccacccccagaccaucaucgcgggguggcgggaggccaccaaggccgcccgcgaggcccugcugagcuccgcggucgaccacggcagcgacgaggugaaguuccggcaggaccucaugaacaucgccgggacgacccuguccagcaagcugcucacccaccacaaggaccacuucaccaagcuggccguggaggccguccugcgccucaagggcuccggcaaccuggaggccauccacaucaucaagaagcucgggggcagccuggcggacuccuaccuggacgagggguuccugcucgacaagaagaucggcgugaaccagcccaagcggaucgagaacgccaagauccugaucgccaacacgggcauggacaccgacaagaucaagaucuucgggagccgcgugcgggucgacuccaccgccaagguggccgagaucgagcacgcggagaaggagaagaugaaggagaagguggagcgcauccugaagcacggcaucaacugcuucaucaaccggcagcucaucuacaacuacccggagcagcuguucggggccgccggcgucauggccaucgagcacgcggacuucgccgggguggagcgccuggcccucgugaccggcggcgagaucgccagcacguucgaccaccccgagcuggucaagcuggggagcugcaagcucaucgaggaggugaugaucggcgaggacaagcugauccacuucuccgggguggcccugggcgaggcgugcaccaucguccuccgcggggccacccagcagauccuggacgaggccgagcggagccugcacgacgcccucugcgugcuggcccagaccgucaaggacucccggacgguguacggcggcgggugcagcgagaugcugauggcgcacgccgugacccagcucgccaaccgcacccccggcaaggaggccgucgccauggaguccuacgcgaaggcccugcggaugcugcccaccaucaucgccgacaacgccggguacgacagcgcggaccucguggcccagcugcgcgccgcccacuccgagggcaacacgaccgccgggcuggacaugcgggagggcaccaucggcgacauggcgauccuggggaucaccgagagcuuccaggugaagcgccagguccuccuguccgccgccgaggccgccgaggugauccugcgcguggacaacaucaucaaggcggccccgcggaagcgcguccccgaccaccaccccugcuga

SEQ ID NO: 27898 - RNA, 1524 nt, Artificial Sequence
  derived and/or modified sequence opt1 from CCT3__Homo_sapiens__NP_001008800
augaugggccaccgccccgugcugguccucagccagaacaccaagcgggaguccgggcgcaaggugcagagcggcaacaucaacgccgccaagauccaggugcagcacccggcggccaaguccaugaucgagaucagccggacccaggacgaggaggucggggacggcacgaccuccgugaucauccuggccggggagaugcugagcguggccgagcacuuccucgagcagcagaugcaccccaccgucgugaucuccgccuaccgcaaggcgcuggacgacaugaucagcacccugaagaagaucuccauccccguggacaucagcgacuccgacaugaugcucaacaucaucaacagcuccaucacgaccaaggccaucagccggugguccagccuggccugcaacaucgcccuggacgcggucaagauggugcaguucgaggagaacggccgcaaggagaucgacaucaagaaguacgcccggguggagaagauccccggcgggaucaucgaggacuccugcguccuccgcggcgugaugaucaacaaggacgugacccacccgcggaugcgccgguacaucaagaacccccgcaucguccugcuggacagcucccucgaguacaagaagggggagagccagaccgacaucgagaucacgcgggaggaggacuucacccgcauccugcagauggaggaggaguacauccagcagcugugcgaggacaucauccagcucaagcccgacguggugaucaccgagaagggcaucagcgaccuggcccagcacuaccugaugcgggccaacaucaccgccauccgccggguccgcaagacggacaacaaccggaucgcgcgcgccugcggggcccggaucgugucccgccccgaggagcuccgcgaggacgacgugggcaccggcgccgggcugcuggagaucaagaagaucggcgacgaguacuucaccuucaucaccgacugcaaggacccgaaggccugcacgauccuccugcgcggggcgagcaaggagauccuguccgaggucgagcggaaccuccaggacgccaugcaggucugccggaacgugcugcuggacccccagcucgugcccggcggcggggccagcgagauggccguggcccacgcgcugaccgagaaguccaaggccaugaccggcgucgagcaguggcccuaccgcgccguggcccaggcccuggaggugaucccgcggacccucauccagaacugcggggcgagcacgauccgccugcugaccucccuccgggccaagcacacccaggagaacugcgagaccuggggcgucaacggggagacgggcacccugguggacaugaaggagcugggcaucugggagccccucgccgugaagcugcagaccuacaagaccgccgucgagacggcggugcugcuccugcgcaucgacgacaucgugagcgggcacaagaagaagggcgacgaccagucccggcagggcggggcccccgacgccgggcaggaguga

SEQ ID NO: 27899 - RNA, 1530 nt, Artificial Sequence
  derived and/or modified sequence opt1 from CCT4__Homo_sapiens__NP_001243650
augcccgagaacguggccccgcgcagcggcgccaccgcgggggccgccggcgggcggggcaagggggccuaccaggaccgcgacaagcccgcccagauccgguucuccaacaucagcgcggccaaggccgucgccgacgcgauccgcaccucccugggccccaagggcauggacaagaugcucguggagcugagcaaggcccaggacaucgaggccggggacggcacgaccuccguggucaucaucgccgggagccugcucgacuccugcaccaagcugcugcagaagggcauccaccccaccaucaucagcgaguccuuccagaaggcccucgagaaggggaucgagauccugacggacaugagccggccgguggagcuguccgaccgcgagacccuccugaacagcgcgaccaccucccugaacagcaagguggucucccaguacagcucccuccugagccccauguccgugaacgccgugaugaaggucaucgaccccgccacggccaccagcguggaccugcgggacaucaagaucgugaagaagcucggcggcaccaucgacgacugcgagcuggucgaggggcuggugcucacccagaaggugagcaacuccggcaucacgcgcgucgagaaggccaagaucgggcugauccaguucugccugagcgcgcccaagaccgacauggacaaccagaucgugguguccgacuacgcccagauggaccggguccuccgcgaggagcgggccuacauccugaaccuggugaagcagaucaagaagaccggcugcaacgugcuccugauccagaaguccauccugcgcgacgcccucagcgaccuggcccugcacuuccucaacaagaugaagaucauggucaucaaggacaucgagcgggaggacaucgaguucaucugcaagaccaucggcacgaagccgguggcgcacaucgaccaguucaccgccgacaugcuggggagcgccgagcuggccgaggaggugaaccucaacggcuccgggaagcugcugaagaucaccggcugcgccagccccgggaagaccgucacgaucgugguccgcggcuccaacaagcucgugaucgaggaggcggagcggagcauccacgacgcccugugcgugauccgcugccuggucaagaagcgggcccucaucgccggcgggggcgcgcccgagaucgagcuggcccugcgccucaccgaguacucccggacccugagcgggauggaguccuacugcgugcgcgccuucgccgacgccauggaggugauccccagcacccuggcggagaacgccggccucaacccgaucuccacggucaccgagcugcggaaccgccacgcccagggggagaagaccgccggcaucaacgugcgcaagggcgggaucagcaacauccuggaggagcucgugguccagccccugcugguguccgugagcgcccugacccucgcgacggagaccguccgguccauccugaagaucgacgacguggugaacacccgcuga

SEQ ID NO: 27900 - RNA, 1626 nt, Artificial Sequence
  derived and/or modified sequence opt1 from CCT5__Homo_sapiens__NP_036205
auggccagcaugggcacccuggccuucgacgaguacgggcgccccuuccucaucaucaaggaccaggaccggaagucccgccugaugggccuggaggcgcucaagagccacaucauggccgccaaggccguggccaacaccaugcggacgucccuggggccgaacggccuggacaagaugauggucgacaaggacggggacgugaccgugaccaacgacggcgcgaccauccucagcaugauggacgucgaccaccagaucgccaagcugaugguggagcuguccaagagccaggacgacgagaucggcgacgggacgaccggcguggucgugcucgccggggcccugcuggaggaggcggagcagcuccuggaccgcggcauccaccccauccggaucgccgacggguacgagcaggccgcccgcguggccaucgagcaccuggacaagaucuccgacagcguccucguggacaucaaggacaccgagccccugauccagaccgcgaagacgacccugggcuccaagguggucaacagcugccaccggcagauggccgagaucgccgugaacgccgugcucaccgucgccgacauggagcgccgggacguggacuucgagcugaucaagguggagggcaaggucgggggccgccuggaggacaccaagcucaucaagggggugaucguggacaaggacuucucccacccccagaugccgaagaaggucgaggacgcgaagaucgccauccugacgugccccuucgagccgcccaagcccaagaccaagcacaagcuggacgugaccagcguggaggacuacaaggcccuccagaaguacgagaaggagaaguucgaggagaugauccagcagaucaaggagaccggcgccaaccuggccaucugccaguggggcuucgacgacgaggcgaaccaccuccugcugcagaacaaccugcccgccguccggugggucgggggccccgagaucgagcucaucgccaucgccaccgggggccgcaucgugccccgguucuccgagcugacggccgagaagcugggguucgcgggccucgugcaggagaucagcuucggcaccaccaaggacaagaugcuggugaucgagcagugcaagaacucccgcgccgucacgaucuucauccgcgggggcaacaagaugaucaucgaggaggccaagcggagccugcacgacgcccucugcgugauccggaaccugauccgcgacaaccggguggucuacgggggcggggcggccgagaucuccugcgcccuggccgugagccaggaggccgacaagugcccgacccucgagcaguacgcgaugcgcgccuucgccgacgcccuggaggugauccccauggcccuguccgagaacagcggcaugaaccccauccagaccaugaccgagguccgggcgcgccaggugaaggagaugaaccccgcccucggcaucgacugccugcacaaggggacgaacgacaugaagcagcagcacgugaucgagacccugaucggcaagaagcagcagaucagccucgccacccagaugguccgcaugauccugaagaucgacgacauccggaagccgggggaguccgaggaguga

SEQ ID NO: 27901 - RNA, 1461 nt, Artificial Sequence
  derived and/or modified sequence opt1 from CCT6A__Homo_sapiens__NP_001009186
auggccgccgugaagacccugaaccccaaggcggaggucgcccgcgcccaggccgcccucgcggugaacaucagcgccgcccggggccugcaggacgugcugcgcaccaaccucgggccgaagggcacgaugaagaugcuggucuccggggccggcgacaucaagcugaccaaggacgggaacgugcuccugcacgagaugggccugcacccccggaucaucaccgagggcuucgaggcggccaaggagaaggcccuccaguuccuggaggaggugaaggucagccgcgagauggaccgggagacccugaucgacguggcccgcacgucccuccggaccaaggugcacgccgagcuggcggacguccugaccgaggccgugguggacagcauccucgccaucaagaagcaggacgagcccaucgaccuguucaugaucgagaucauggagaugaagcacaaguccgagaccgacacgagccugauccgcgggcucguccuggaccacggcgcccggcaccccgacaugaagaagcgcguggaggacgccuacauccugaccugcaacgugucccucgaguacgagaagaccgaggucaacagcggguucuucuacaaguccgcggaggagcgggagaagcuggugaaggccgagcgcaaguucaucgaggaccgggugaagaagaucaucgagcugaagcgcaaggucugcggcgacagcgacaagggguucguggugaucaaccagaagggcaucgacccguucucccucgacgcccugagcaaggagggcaucgucgcccugcggcgcgccaagcggcgcaacauggagcggcucacccuggcgugcgggggcguggcccugaacuccuucgacgaccucagccccgacugccuggggcacgccggccugguguacgaguacacgcucggcgaggagaaguucaccuucaucgagaagugcaacaacccccgcuccgucacccugcugaucaaggggcccaacaagcacacccucacgcagaucaaggacgccgugcgggacggccugcgcgccgucaagaacgcgaucgacgacgggugcguggugccgggcgccggggccgucgagguggccauggcggaggcccugaucaagcacaagcccagcgugaagggccgcgcccagcucggcguccaggccuucgccgacgcgcugcugaucauccccaaggugcucgcccagaacuccggguucgaccugcaggagacccuggugaagauccaggccgagcacagcgaguccggccagcucgucgggguggaccugaacaccggcgagcccaugguggccgccgaggucggggugugggacaacuacugcgugaagaagcagcugcuccacagcugcaccgucaucgcgacgaacauccugcugguggacgagaucaugcgggccggcaugagcucccugaagggcuga

SEQ ID NO: 27902 - RNA, 1482 nt, Artificial Sequence
  derived and/or modified sequence opt1 from CCT6B__Homo_sapiens__NP_001180458
auggccgccaucaaggcggugaacagcaaggccgaggucgcccgcgcccgggccgcgcuggccgugaacaucugcgccgcccgcggccuccaggacgugcugcggaccaaccuggggcccaagggcaccaugaagaugcucgucuccggggcgggcgacaucaagcugacgaaggacgggaacgugcugcucgacgagaugcagauccagcacccgaccgccagccugaucgccaagguggccaccgcccaggacgacgucaccggcgacggcacgaccuccaacgugcugaucaucggggagcuccugaagcaggcggaccuguacaucagcgagggccuccacccccgcaucaucgccgagggguucgaggccgccaagaucaaggcccuggaggugcuggaggaggucaaggugaccaaggagaugaagcggaagauccuccuggacguggcgcgcaccucccugcagacgaagguccacgccgagcucgccgacgugcugaccgagguggucguggacagcgugcuggccguccggcgccccggcuaccccaucgaccucuucaugguggagaucauggagaugaagcacaagcuggggaccgacaccaaggaggugaacuccggcuucuucuacaagacggccgaggagaaggagaagcuggucaaggcggagcggaaguucaucgaggaccgcgugcagaagaucaucgaccucaaggacaaggugugcgcccagagcaacaagggcuucgucgugaucaaccagaaggggaucgacccguucucccuggacagccuggccaagcacggcaucgucgcccuccggcgcgccaagcggcgcaacauggagcggcugucccuggcgugcgggggcauggccgugaacagcuucgaggaccucaccguggacugccugggccacgccgggcuggucuacgaguacacccucggcgaggagaaguucaccuucaucgaggagugcgugaaccccugcuccgugacgcugcuggucaaggggcccaacaagcacacccucacccaggugaaggacgccauccgcgacggccugcgggcgaucaagaacgccaucgaggacgggugcauggugcccggcgccggcgccaucgaggucgccauggcggaggcccuggugaccuacaagaacagcaucaaggggcgcgcccggcucggcgugcaggccuucgccgacgcgcugcugaucaucccgaagguccucgcccagaacgccggguacgacccccaggagacgcuggugaaggugcaggccgagcacgucgaguccaagcagcuggugggcguggaccucaacaccggggagcccauggucgccgcggacgccggcgugugggacaacuacugcgugaagaagcagcugcugcacagcugcaccgucaucgccaccaacauccuccugguggacgagaucaugcgcgccggcauguccagccugaaguga

SEQ ID NO: 27903 - RNA, 1020 nt, Artificial Sequence
  derived and/or modified sequence opt1 from CCT7__Homo_sapiens__NP_001009570
augauggacagccagcugguggccggcgucgccuucaagaagaccuucuccuacgcgggguucgagaugcagcccaagaaguaccacaacccgaagaucgcccuccugaacguggagcuggagcucaaggccgagaaggacaacgccgagauccgcgugcacaccgucgaggacuaccaggccaucguggacgcggaguggaacauccuguacgacaagcuggagaagauccaccacagcggcgccaaggugguccucuccaagcugcccaucggggacguggccacgcaguacuucgccgaccgggacauguucugcgcgggccgcgugcccgaggaggaccugaagcggaccaugauggccugcgggggcagcauccagaccuccgucaacgcccucagcgccgacgugcugggccgcugccagguguucgaggagacccagaucgggggcgagcgguacaacuucuucacggggugccccaaggccaagaccugcaccuucauccugcgcggcggggcggagcaguucauggaggagaccgagcggucccuccacgacgccaucaugaucguccgccgggccaucaagaacgacagcgugguggccggcggcggggccaucgagauggagcuguccaaguaccugcgcgacuacagccggacgaucccgggcaagcagcagcuccugaucggggcguacgccaaggcccuggagaucaucccccgccagcucugcgacaacgccggcuucgacgccaccaacauccugaacaagcugcgggcgcgccacgcccagggcgggaccugguacggcgucgacaucaacaacgaggacaucgccgacaacuucgaggccuucgugugggagcccgccauggugcggaucaacgcgcucaccgccgccuccgaggccgcgugccugaucgucagcguggacgagacgaucaagaacccccgcuccaccguggacgccccgaccgccgccgggcggggccgcgggcggggccgcccccacuga

SEQ ID NO: 27904 - RNA, 4287 nt, Artificial Sequence
  derived and/or modified sequence opt1 from CD109__Homo_sapiens__NP_001153059
augcagggcccgccgcugcucaccgccgcccaccuccugugcgugugcaccgcggcccuggccgucgcccccgggccccgcuuccuggugacggcccccggcaucauccggcccgggggcaacgugaccaucggggucgagcugcucgagcacugccccagccaggugaccgugaaggcggagcugcugaagaccgccuccaaccucacggucagcgugcuggaggccgagggcguguucgagaagggcuccuucaagacccugacccuccccagccugccccugaacuccgccgacgagaucuacgagcuccgcgucaccgggcggacgcaggacgagauccuguucagcaacuccacccgccugagcuucgagaccaagcggaucuccguguucauccagaccgacaaggcgcucuacaagccgaagcaggaggugaaguuccgcaucgucacgcuguucagcgacuucaagcccuacaagaccucccugaacauccucaucaaggaccccaagagcaaccugauccagcaguggcugucccagcagagcgaccucggcgugaucuccaagaccuuccagcugagcucccaccccauccugggggacuggagcauccaggugcaggucaacgaccagaccuacuaccaguccuuccaggugagcgaguacgugcucccgaaguucgaggucacgcugcagacgccccuguacugcagcaugaacuccaagcaccucaacggcaccaucaccgccaaguacaccuacgggaagcccgugaagggcgacgugacccugaccuuccugccccucagcuucuggggcaagaagaagaacaucaccaagacguucaagaucaacggguccgccaacuucagcuucaacgacgaggagaugaagaacgucauggacuccagcaacggccuguccgaguaccuggaccucagcuccccggggcccguggagauccugaccaccgugaccgagagcgucacgggcaucucccggaacgugagcaccaacgucuucuucaagcagcacgacuacaucaucgaguucuucgacuacaccaccgugcugaagcccucccucaacuucacggccaccgugaaggucacccgcgccgacggcaaccagcugacccuggaggagcggcgcaacaacguggugaucacggucacccagcggaacuacaccgaguacuggagcggguccaacagcggcaaccagaagauggaggcggugcagaagaucaacuacaccgugccccaguccgggaccuucaagaucgaguucccgauccucgaggacagcuccgagcugcagcugaaggccuacuuccucggcagcaagagcuccauggccguccacagccuguucaagucccccagcaagacguacauccagcugaagacccgcgacgagaacaucaagguggggucccccuucgagcucguggucagcggcaacaagcggcugaaggagcuguccuacaugguggugagccgcggccagcuggucgccguggggaagcagaacuccaccauguucagccucacccccgagaacuccuggacgccgaaggccugcgugaucgucuacuacaucgaggacgacggcgagaucaucagcgacgugcugaagauccccgugcagcuggucuucaagaacaagaucaagcucuacugguccaaggugaaggcggagcccagcgagaaggugucccugcggaucagcgucacccagcccgacuccaucguggggaucguggccgucgacaagagcgugaaccugaugaacgccagcaacgacaucaccauggagaacgugguccacgagcucgagcuguacaacaccggcuacuaccuggggauguucaugaacuccuucgccguguuccaggagugcggccucugggugcugacggacgccaaccugaccaaggacuacaucgacggcgucuacgacaacgcggaguacgccgagcgcuucauggaggagaacgaggggcacaucguggacauccacgacuucagccucggcuccagcccgcacgugcggaagcacuuccccgagaccuggaucuggcuggacaccaacaugggguaccgcaucuaccaggaguucgaggucacggugcccgacuccaucaccagcuggguggccaccggcuucgucaucuccgaggaccuggggcucggccugaccacgaccccgguggagcugcaggccuuccagcccuucuucaucuuccucaaccugcccuacagcgugauccggggcgaggaguucgcccuggagaucaccaucuucaacuaccucaaggacgcgaccgaggucaaggugaucaucgagaaguccgacaaguucgacauccugaugacgagcaacgagaucaacgccaccgggcaccagcagacccugcucgugcccuccgaggacggcgccaccguccuguucccgauccgccccacgcaccugggggagauccccaucaccgugaccgcccucagccccaccgcguccgacgccgugacgcagaugauccuggucaaggccgagggcaucgagaaguccuacagccagagcauccugcucgaccugaccgacaaccggcugcaguccacccucaagacccugagcuucuccuucccgcccaacacggugaccggcagcgagcgcgugcagaucaccgccaucggggacguccugggccccagcaucaacgggcucgccucccugauccgcaugcccuacggcugcggggagcagaacaugaucaacuucgcgccgaacaucuacauccuggacuaccucaccaagaagaagcagcugacggacaaccugaaggagaaggcccucagcuucaugcggcagggcuaccagcgcgagcugcuguaccagcgggaggacggcuccuucagcgccuucgggaacuacgaccccuccggcagcaccuggcucuccgccuucgugcugcgcugcuuccuggaggccgaccccuacaucgacaucgaccagaacguccuccaccggaccuacaccuggcugaaggggcaccagaaguccaacggcgaguucugggaccccgggcgcgugauccacagcgagcugcagggcggcaacaagagcccggugacccucacggcguacaucgucaccucccugcugggguaccggaaguaccagcccaacaucgacgugcaggagagcauccacuuccucgaguccgaguucagccgcggcaucuccgacaacuacacccuggcccugaucaccuacgcccucagcuccguggggagccccaaggccaaggaggcccugaacaugcugacguggcgggcggagcaggagggcgggaugcaguucugggucuccagcgagagcaagcucuccgacagcuggcagccccgcucccuggacaucgagguggccgccuacgcccugcucagccacuuccugcaguuccagaccuccgagggcaucccgaucaugcgguggcugagccgccagcggaacucccucggcggguucgcgagcacccaggacaccacgguggcccugaaggcccuguccgaguucgccgcccucaugaacaccgagcgcaccaacauccaggucaccgugacgggccccagcucccccagcccccuggcggugguccagccgaccgccgugaacaucuccgccaacggguucggcuucgccaucugccagcugaacguggucuacaacgugaaggccagcggguccagccggcgccggcgcuccauccagaaccaggaggcguucgaccucgacguggccgucaaggagaacaaggacgaccugaaccacguggaccugaacgugugcaccagcuucuccggccccggccggagcgggauggcccucauggaggucaaccugcugagcggcuucauggugcccuccgaggccaucagccucuccgagaccgugaagaaggucgaguacgaccacgggaagcugaaccuguaccucgacagcgugaacgagacgcaguucugcgugaacaucccggccguccgcaacuucaagguguccaacacccaggacgcgagcguguccaucgucgacuacuacgagccccgccggcaggccgugcgcagcuacaacuccgaggugaagcugagcuccugcgaccugugcagcgacguccagggcugccggcccugcgaggacggcgccuccgggagccaccaccacuccagcgugaucuucaucuucugcuucaagcuccuguacuucauggagcuguggcucuga

SEQ ID NO: 27905 - RNA, 1128 nt, Artificial Sequence
  derived and/or modified sequence opt1 from CD14__Homo_sapiens__NP_001167576
auggagcgcgccagcugccugcuccugcugcuccugccccuggugcacgucuccgccaccaccccggagcccugcgagcucgacgacgaggacuuccggugcgugugcaacuucagcgagccccagcccgacugguccgaggcguuccagugcgugagcgccgucgagguggagauccacgccggcgggcugaaccuggagccguuccucaagcgcguggacgccgacgccgacccccggcaguacgcggacacggucaaggcccugcgcgugcggcgccugaccgugggcgccgcccagguccccgcgcagcuccuggugggggcccugcgggugcucgccuacucccgccugaaggagcugacccucgaggaccugaagaucaccggcacgaugcccccgcugccccucgaggccaccgggcuggcccugagcucccuccggcugcgcaacgucagcugggcgaccggccgguccuggcuggccgagcuccagcaguggcugaagcccggccugaaggugcucagcaucgcccaggcccacucccccgccuucagcugcgagcagguccgcgcguucccggcccugaccucccuggaccucagcgacaaccccgggcugggcgagcgggggcugauggccgcccucugcccccacaaguuccccgccauccagaaccuggcgcugcgcaacacgggcauggagaccccgaccggggugugcgccgcccucgccgccgcgggcgugcagccccacucccuggaccugagccacaacucccuccgggccaccgugaaccccagcgcgccccgcugcaugugguccagcgcccugaacagccugaaccucuccuucgccggccuggagcaggucccgaaggggcugcccgccaagcuccgggugcuggaccugagcugcaaccgccugaaccgggcgccccagcccgacgagcucccggagguggacaaccugacgcuggacggcaaccccuuccucguccccgggaccgcccugccccacgagggcuccaugaacagcggcguggugccggccugcgcccgcuccacccugagcgucgggguguccggcacccucguccugcugcagggggcccggggcuucgccuga

SEQ ID NO: 27906 - RNA, 762 nt, Artificial Sequence
  derived and/or modified sequence opt1 from CD151__Homo_sapiens__NP_001034579
augggcgaguucaacgagaagaagacgaccugcgggaccgugugccugaaguaccuccuguucaccuacaacugcugcuucuggcuggccggccucgccgucauggcgguggggaucuggacccuggcccucaagagcgacuacaucucccugcuggccagcggcaccuaccuggccaccgccuacauccucguggucgcggggaccguggugauggucaccggcgugcugggcugcugcgccaccuucaaggagcgccggaaccugcuccgccuguacuucauccugcuccugaucaucuuccugcucgagaucaucgccgggauccuggccuacgcguacuaccagcagcugaacacggagcucaaggagaaccugaaggacaccaugaccaagcgguaccaccagcccggccacgaggccgugaccuccgccgucgaccagcugcagcaggaguuccacugcugcgggagcaacaacucccaggacuggcgcgacagcgaguggauccggucccaggaggccggcgggcgcguggugccggacagcugcugcaagacggucguggcccucugcggccagcgggaccacgcguccaacaucuacaagguggagggcgggugcaucaccaagcuggagaccuucauccaggagcaccuccgcgucaucggcgccguggggaucggcaucgccugcgugcaggucuucggcaugaucuucacgugcugccuguaccggagccugaagcuggagcacuacuga

SEQ ID NO: 27907 - RNA, 3471 nt, Artificial Sequence
  derived and/or modified sequence opt1 from CD163__Homo_sapiens__NP_004235
augagcaagcugcgcauggugcuccuggaggacuccggcagcgccgacuuccggcgccacuucgucaaccugucccccuucaccaucaccguggugcuccugcugagcgccugcuucgucacguccagccucgggggcaccgacaaggagcugcggcugguggacggggagaacaagugcuccggccgcguggaggucaaggugcaggaggagugggggaccgugugcaacaacggcuggagcauggaggcggucuccgugaucugcaaccagcucggcugcccgaccgccaucaaggcccccgggugggccaacagcuccgccggcagcgggcggaucuggauggaccacguguccugccgcggcaacgagagcgcgcugugggacugcaagcacgacggguggggcaagcacuccaacugcacgcaccagcaggacgccggcgugaccugcagcgacggguccaaccuggagaugcggcucacccgcggcgggaacaugugcagcggccggaucgagaucaaguuccagggccgcugggggaccgugugcgacgacaacuucaacaucgaccacgccuccgugaucugccggcagcuggagugcggcagcgccgucagcuucuccgggagcuccaacuucggcgaggggagcggccccaucugguucgacgaccugaucugcaacggcaacgaguccgcgcucuggaacugcaagcaccagggguggggcaagcacaacugcgaccacgccgaggacgccggggugaucugcagcaagggcgccgaccugucccugcgccucguggacggggucacggagugcagcggccggcuggaggugcgcuuccagggcgagugggggaccaucugcgacgacggcugggacuccuacgacgccgcgguggccugcaagcagcuggggugccccaccgccgucaccgccaucggccgggugaacgccagcaagggguucggccacaucuggcucgacuccgugagcugccagggccacgagccggcgaucuggcagugcaagcaccacgagugggggaagcacuacugcaaccacaacgaggacgccggcgucacgugcuccgacgggagcgaccuggagcugcgccuccggggcggcgggucccgcugcgccggcaccguggaggucgagauccagcggcugcuggggaaggugugcgaccgcggcugggggcucaaggaggccgacguggucugccggcagcugggcugcggcagcgcccugaagaccuccuaccagguguacagcaagauccaggcgaccaacacguggcuguuccuguccagcugcaacgggaacgagaccagccugugggacugcaagaacuggcaguggggcgggcugaccugcgaccacuacgaggaggccaagaucacgugcuccgcccaccgcgagccccgccucgugggcggggacauccccugcagcggccgggucgaggugaagcacggcgacaccuggggguccaucugcgacagcgacuucucccuggaggccgccagcgugcucugccgcgagcugcagugcggcaccgucguguccauccucgggggcgcgcacuucggggagggcaacggccagaucugggccgaggaguuccagugcgaggggcacgagagccaccucucccugugccccguggccccgcggcccgaggggaccugcagccacucccgcgacgucgggguggugugcagccgguacaccgagauccgccuggucaacggcaagacgcccugcgaggggcggguggagcucaagacccugggcgccuggggcucccugugcaacagccacugggacaucgaggacgcgcacgugcucugccagcagcugaagugcggggucgcccuguccacccccggcggggcccgcuucggcaagggcaacgggcagaucuggcggcacauguuccacugcaccggcacggagcagcacaugggggacugcccggugaccgcccucggcgccagccugugccccuccgagcaggucgcgagcgucaucugcagcgggaaccagucccagacccugagcuccugcaacagcuccagccugggccccacccgccccacgaucccggaggaguccgccguggccugcaucgagagcggccagcuccggcuggugaacgggggcgggcgcugcgccggccgggucgagaucuaccacgagggguccuggggcaccaucugcgacgacagcugggaccuguccgacgcccacguggugugccgccagcucggcugcggggaggcgaucaacgccaccggcagcgcccacuucggggagggcaccgggcccaucuggcuggacgagaugaagugcaacggcaaggagucccggaucuggcagugccacagccacggcugggggcagcagaacugccgccacaaggaggacgccggcgucaucugcuccgaguucaugagccugcggcucacguccgaggccagccgcgaggcgugcgccgggcggcuggagguguucuacaacggcgccuggggcaccguggggaaguccagcaugagcgagaccaccgucggcguggugugccgccagcuggggugcgccgacaagggcaagaucaaccccgcgucccucgacaaggccaugagcauccccaugugggucgacaacgugcagugcccgaaggggcccgacacccuguggcagugccccuccagccccugggagaagcgccuggccuccccgagcgaggagacguggaucacgugcgacaacaagauccggcuccaggagggccccaccuccugcagcggccgcguggagaucuggcacgggggcuccugggggaccgucugcgacgacagcugggaccuggacgacgcccagguggugugccagcagcugggcugcgggcccgcccucaaggcguucaaggaggccgaguucggccagggcaccgggcccaucuggcugaacgaggucaagugcaagggcaacgaguccagccugugggacugcccggcccggcgcugggggcacuccgagugcggccacaaggaggacgccgccgugaacugcaccgacaucagcgugcagaagacgccccagaaggcgaccaccgggcgguccagccgccaguccagcuucaucgccgucggcauccucggcguggugcugcuggccaucuucgucgcccucuucuuccugaccaagaagcggcgccagcggcagcgccuggccguguccagccggggcgagaaccucgugcaccagauccaguaccgcgagaugaacagcugccugaacgcggacgaccuggaccucaugaacuccagcgagaacucccacgagagcgccgacuucuccgccgccgagcugaucagcgucuccaaguuccugcccaucagcggcauggagaaggaggcgauccucucccacaccgagaaggagaacgggaaccuguga

SEQ ID NO: 27908 - RNA, 4362 nt, Artificial Sequence
  derived and/or modified sequence opt1 from CD163L1__Homo_sapiens__NP_777601
augaugcugccccagaacagcuggcacaucgacuucggccgcugcugcugccaccagaaccucuucuccgccguggugaccugcauccugcugcucaacagcugcuuccugaucuccagcuucaacgggaccgaccuggagcuccggcuggugaacggcgacgggccgugcuccggcacgguggaggucaaguuccaggggcaguggggcaccgugugcgacgacggcuggaacaccaccgccagcacgguggucugcaagcagcuggggugccccuucuccuucgcgauguuccgcuucggccaggccgugacccggcacgggaagaucuggcucgacgacgugagcugcuacggcaacgaguccgcccugugggagugccagcaccgcgagugggggagccacaacugcuaccacggcgaggacgucggcgugaacugcuacggggaggccaaccugggccuccggcugguggacgggaacaacuccugcagcggccgcgucgaggugaaguuccaggagcgguggggcaccaucugcgacgacggguggaaccugaacaccgccgcgguggucugccgccagcucggcugccccuccagcuucaucuccagcgggguggugaacucccccgccguccugcggccgaucuggcuggacgacauccucugccagggcaacgagcuggcccuguggaacugccgccaccggggguggggcaaccacgacugcagccacaacgaggacgugacgcugaccugcuacgacuccagcgaccuggagcugcgccucgugggcgggaccaaccggugcaugggccgcgucgagcugaagauccaggggcgguggggcaccgugugccaccacaaguggaacaacgccgcggccgacguggucugcaagcagcuggggugcggcacggcccuccacuucgccggccugccccaccuccagagcggguccgacguggucuggcucgacggcgugagcugcuccgggaacgagagcuuccugugggacugccgccacuccggcaccgugaacuucgacugccugcaccagaacgacgucagcgugaucugcuccgacggggccgaccucgagcugcggcuggcggacggcagcaacaacugcuccggccgcguggagguccggauccacgagcagugguggaccaucugcgaccagaacuggaagaacgagcaggcccucguggugugcaagcagcuggggugccccuucagcgucuucggcucccgccgggccaagcccagcaacgaggcccgcgacaucuggaucaacuccaucagcugcaccgggaacgaguccgcccugugggacugcacguacgacggcaaggcgaagcggaccugcuuccgccgcagcgacgccggcgugaucugcuccgacaaggccgaccucgaccugcggcuggugggggcccacagcccgugcuacggccgccucgaggucaaguaccagggggaguggggcaccgugugccacgaccggugguccacccgcaacgccgcgguggucugcaagcagcuggggugcggcaagcccaugcacguguucggcaugacguacuucaaggaggccagcgggcccaucuggcuggacgacgugagcugcaucggcaacgaguccaacaucugggacugcgagcacagcggguggggcaagcacaacugcguccaccgggaggacgugaucgugaccugcuccggggacgccaccuggggccuccgccuggucggcgggagcaaccggugcuccggccgccuggagguguacuuccaggggcgguggggcaccgugugcgacgacggguggaacagcaaggccgccgcggucgugugcucccagcucgacugccccagcuccaucaucggcaugggccuggggaacgccagcacgggcuacgggaagaucuggcuggacgacguguccugcgacggcgacgagagcgaccugugguccugccgcaacagcggguggggcaacaacgacugcucccacagcgaggacgucggcgugaucugcuccgacgccagcgacauggagcuccggcuggucgggggcagcucccgcugcgccgggaaggucgaggugaacgugcagggcgcggucggcauccugugcgccaacggguggggcaugaacaucgccgagguggugugccggcagcucgagugcgggagcgccauccgcgucucccgggagccgcacuucaccgagcgcacccugcacauccugaugagcaacuccggcugcaccgggggcgaggccagccucugggacugcauccggugggaguggaagcagacggcgugccaccugaacauggaggccucccugaucugcagcgcccaccgccagccccgccucgugggcgccgacaugcccugcuccgggcggguggaggucaagcacgccgacaccuggcgcagcgugugcgacuccgacuucagccugcacgcggccaacgugcugugccgggagcucaacugcggcgacgccaucucccugagcgucggggaccacuucggcaaggggaacggccugaccugggccgagaaguuccagugcgagggcuccgagacccaccucgcccugugccccaucgugcagcacccggaggacacgugcauccacagccgcgaggugggggucgugugcucccgguacaccgacgugcgccuggucaacggcaagagccagugcgacggccagguggagaucaacgugcucgggcacugggggucccugugcgacacccacugggaccccgaggacgcgcggguccugugccgccagcucagcugcggcaccgcccugagcacgaccggcgggaaguacaucggcgagcgguccgugcgcgucugggggcaccgguuccacugccugggcaacgagagccuccuggacaacugccagaugaccgugcugggcgccccgcccugcauccacgggaacaccguguccgucaucugcaccggcagccucacgcagccccuguuccccugccuggccaacguguccgaccccuaccucagcgcggugcccgagggguccgcccugaucugccuggaggacaagcgccuccggcuggucgacggcgacagccgcugcgccgggcggguggagaucuaccacgacggcuucuggggcaccaucugcgacgacgggugggaccuguccgacgcccacguggucugccagaagcucggcugcgggguggccuucaacgcgaccgugagcgcccacuucggcgagggguccggcccgaucuggcuggacgaccugaacugcaccggcauggagagccaccucuggcagugccccucccgcggguggggccagcacgacugccggcacaaggaggacgccggggucaucugcagcgaguucacggcccugcgccuguacuccgagaccgagaccgagagcugcgccggccggcucgagguguucuacaacgggaccuggggcuccgugggccgccggaacaucacgaccgcgaucgccgggaucgucugccgccagcugggcugcggggagaacggcguggugagccuggcgccccucuccaagaccgggagcggcuucaugugggucgacgacauccagugccccaagacccacaucagcaucuggcagugccuguccgccccgugggagcgccggaucagcucccccgccgaggagacguggaucacgugcgaggaccgcauccgggugcgcggcggggacaccgagugcagcggccggguggagaucuggcacgccggguccuggggcaccgucugcgacgacagcugggaccuggccgaggccgagguggugugccagcagcucggcugcggguccgcccuggcggcccugcgcgacgccagcuucggccaggggaccggcaccaucuggcucgacgacaugcggugcaaggggaacgaguccuuccugugggacugccacgccaagcccuggggccagagcgacugcggccacaaggaggacgccgggguccgcugcuccggccagagccugaagucccucaacgcgagcuccgggcaccuggcccugauccucagcuccaucuucggccugcugcuccuggugcuguucauccucuuccugaccuggugccgggugcagaagcagaagcaccucccgcugcgcgucagcacccggcgccgggggucccuggaggagaaccuguuccacgagauggagacgugccucaagcgcgaggacccccacggcacccggaccagcgacgacacccccaaccacggcugcgaggacgccagcgacacgucccugcugggggugcuccccgccagcgaggccaccaaguga

SEQ ID NO: 27909 - RNA, 555 nt, Artificial Sequence
  derived and/or modified sequence opt1 from CD164__Homo_sapiens__NP_001135873
augagccgccugucccggagccuccugugggccgcgaccugccugggcgugcucugcguccuguccgccgacaagaacaccacgcagcaccccaacgugaccacccuggccccgaucagcaacgugaccuccgcccccgucacgagccucccccuggugaccacccccgccccggagaccugcgaggggcgcaacuccugcgugagcugcuucaacgucuccguggugaacacgaccugcuucuggaucgagugcaaggacgagagcuacugcucccacaacagcaccgucuccgacugccaggugggcaacaccacggacuucugcagcgccaagcccaccgugcagcccucccccagcaccaccuccaagacggucaccaccagcgggaccacgaacaacaccgugaccccgaccucccagcccgugcgcaagagcacguucgacgcggccagcuucaucggcgggaucguccuggugcucggcgugcaggccgucaucuucuuccuguacaaguucugcaaguccaaggagcggaacuaccacacccuguga

SEQ ID NO: 27910 - RNA, 1314 nt, Artificial Sequence
  derived and/or modified sequence opt1 from CD177__Homo_sapiens__NP_065139
augagcgccgugcugcuccuggcccugcucggcuucauccugccccugccggggguccaggcgcuccugugccaguucggcaccgugcagcacguguggaaggucuccgaccugccccgccaguggacccccaagaacacgagcugcgacuccgggcucggcugccaggacacccugaugcugaucgagagcgggccccaggugucccucgugcugagcaagggcugcaccgaggccaaggaccaggagccgcgggucaccgagcaccgcaugggccccgggcugucccucaucagcuacacguucgugugccggcaggaggacuucugcaacaaccuggugaacucccugccccucugggcgccccagccgcccgccgaccccggcagccugcgcugccccgucugccuguccauggaggggugccucgagggcaccaccgaggagaucugcccgaaggggaccacgcacugcuacgacggccugcugcggcuccgcggcgggggcaucuucagcaaccugcgggugcaggggugcaugccccagcccgugugcaaccugcucaacggcacccaggagaucggccccgucgggaugaccgagaacugcgacaugaaggacuuccugaccugccaccgcggcacgaccaucaugacccacgggaaccuggcccaggagccgaccgacuggacgaccuccaacaccgagaugugcgaggugggccaggugugccaggagacccuccugcugcucgacgucgggcugacgagcacccuggugggcaccaagggcugcuccaccgugggggcccagaacagccagaagacgaccauccacuccgccccgcccggcguccucguggccagcuacacccacuucugcuccagcgaccugugcaacagcgccuccagcuccagcgugcugcucaacucccugccgccccaggcggcccccguccccggggaccggcagugcccgaccugcgugcagccccugggcacgugcagcuccgggagcccccgcaugaccugcccccggggcgccacccacugcuacgacggcuacauccaccucuccgggggcgggcugagcaccaagauguccauccagggcugcguggcccagcccagcuccuuccugcucaaccacacgcgccagaucgggaucuucagcgcccgggagaagcgcgacguccagccgcccgcgucccagcacgagggcggcggggccgagggccuggagagccugaccuggggcguggggcucgcccuggcccccgcccugugguggggcgucgugugccccuccugcuga

SEQ ID NO: 27911 - RNA, 1986 nt, Artificial Sequence
  derived and/or modified sequence opt1 from CD180__Homo_sapiens__NP_005573
auggccuucgacgugagcugcuucuucugggucgugcuguucuccgccggcugcaaggugaucaccagcugggaccagaugugcaucgagaaggaggcgaacaagaccuacaacugcgagaaccucgggcuguccgagauccccgacacccugcccaacaccaccgaguuccucgaguucagcuucaacuuccugcccaccauccacaaccgcacguucucccggcugaugaaccucaccuuccuggaccugacccgcugccagaucaacuggauccacgaggacaccuuccagagccaccaccagcucuccacgcugguccugaccggcaacccccucaucuucauggccgagaccagccugaacgggcccaagucccugaagcaccucuuccugauccagaccggcaucagcaaccuggaguucaucccggugcacaaccucgagaaccuggagucccuguaccucgggagcaaccacaucuccagcaucaaguuccccaaggacuuccccgcccggaaccugaaggugcuggacuuccagaacaacgccauccacuacaucucccgcgaggacaugcggagccucgagcaggccaucaaccugucccugaacuucaacggcaacaacgucaagggcaucgagcucggggcguucgacagcacgaucuuccagucccugaacuucggcgggacccccaaccugagcgugaucuucaacggccuccagaacagcaccacccagucccuguggcuggggacguucgaggacaucgacgacgaggacaucagcuccgccaugcucaagggccugugcgagaugagcguggagucccugaaccuccaggagcaccgcuucagcgacaucuccagcaccaccuuccagugcuucacccagcugcaggagcuggaccucacggccacccaccugaagggccugccguccgggaugaagggccucaaccugcugaagaagcucguccugagcgugaaccacuucgaccagcugugccagaucuccgccgcgaacuuccccagccucacccaccuguacauccgggggaacgugaagaagcugcaccugggcgucggcugccucgagaagcuggggaaccugcagacccucgaccugucccacaacgacaucgaggccagcgacugcugcucccugcagcucaagaaccugagccaccuccagacgcugaaccugucccacaacgagccccugggccuccagagccaggccuucaaggagugcccccagcuggagcugcucgaccuggccuucacccgccugcacaucaacgccccgcagucccccuuccagaaccuccacuuccuccaggugcugaaccugaccuacugcuuccuggacaccagcaaccagcaccuccuggcggggcugcccgugcugcggcaccucaaccugaagggcaaccacuuccaggacgggacgaucaccaagaccaaccugcuccagaccgucggcagccuggaggugcugauccucuccagcugcggccugcuguccaucgaccagcaggccuuccacagccucgggaagaugucccacguggaccugagccacaacucccugacgugcgacagcaucgacucccucagccaccugaagggcaucuaccugaaccucgccgccaacuccaucaacaucaucagcccccgccugcugccgauccucucccagcagagcaccaucaaccugucccacaacccccuggacugcacgugcagcaacauccacuuccucaccugguacaaggagaaccugcacaagcuggagggguccgaggagacgaccugcgccaacccgcccagccuccggggcgucaagcugagcgacgugaagcuguccugcgggaucaccgcgaucggcaucuucuuccucaucguguuccugcugcuccuggccauccuccuguucuucgccgucaaguaccugcugcgcuggaaguaccagcacaucuga

SEQ ID NO: 27912 - RNA, 1674 nt, Artificial Sequence
  derived and/or modified sequence opt1 from CD19__Homo_sapiens__NP_001171569
augcccccgccccgccugcucuucuuccugcuguuccucacccccauggaggugcggcccgaggagccgcuggucgugaagguggaggagggcgacaacgccguccugcagugccucaaggggaccagcgacggccccacgcagcagcugaccuggucccgcgagagcccccugaagcccuuccucaagcugucccuggggcucccgggccuggggauccacaugcggccccuggccaucuggcucuucaucuucaacgugagccagcagaugggcggcuucuaccugugccagcccgggcccccguccgagaaggcguggcagcccggcuggaccgugaacgucgaggggagcggcgagcuguuccgcuggaacguguccgaccucgggggccugggcugcgggcugaagaaccggagcuccgagggccccagcucccccagcgggaagcucauguccccgaagcuguacgugugggccaaggaccgccccgagaucugggagggcgagccccccugccugccgccccgggacagccucaaccagucccugagccaggaccugaccauggcccccggcuccacgcucuggcugagcugcgggguccccccggacuccgugagccgcggcccccugagcuggacccacgugcaccccaaggggcccaagucccuccugagccuggagcucaaggacgaccggccggcccgcgacaugugggucauggagaccggccugcugcucccccgggccaccgcgcaggacgccgggaaguacuacugccaccgcggcaaccugacgauguccuuccaccuggagaucaccgcccggcccgugcucuggcacuggcugcugcgcaccggcggguggaaggugagcgccgucacccucgcguaccugaucuucugccugugcucccucgugggcauccugcaccugcagcgggcccucgugcugcgccggaagcgcaagcggaugacggacccgacccgccgguucuucaaggucacccccccccccgggagcggcccgcagaaccaguacgggaacgugcugucccugcccacccccacgagcggccucggccgcgcccagcgcugggccgccgggcugggcgggaccgcgcccuccuacggcaacccgagcuccgacgugcaggccgacggggcccugggcagccgguccccccccggcgucgggcccgaggaggaggagggcgagggguacgaggagccggacagcgaggaggacuccgaguucuacgagaacgacagcaaccucggccaggaccagcugucccaggacggcagcggguacgagaaccccgaggacgagccccugggccccgaggacgaggacuccuucagcaacgccgagagcuacgagaacgaggacgaggagcucacccagccgguggcccgcaccauggacuuccuguccccccacgggagcgcgugggaccccucccgggaggccacgagccuggccggcucccagagcuacgaggacaugcgcgggauccucuacgccgccccccagcugcgguccauccgcggccagccgggccccaaccacgaggaggacgcggacagcuacgagaacauggacaaccccgacgggcccgacccggccuggggcgggggcgggcggaugggcaccugguccacccgcuga

SEQ ID NO: 27913 - RNA, 984 nt, Artificial Sequence
  derived and/or modified sequence opt1 from CD1A__Homo_sapiens__NP_001754
augcuguuccuccugcugccccuccuggccgugcugccgggcgacgggaacgccgacggccucaaggagccccugagcuuccacgucaccuggaucgcguccuucuacaaccacagcuggaagcagaaccugguguccggguggcucagcgaccugcagacccacacgugggacuccaacagcuccaccaucguguuccugugccccuggagccgcggcaacuucuccaacgaggaguggaaggagcucgagacccuguuccggauccgcaccauccggagcuucgaggggauccgccgguacgcccacgagcugcaguucgaguaccccuucgagauccaggucacgggcggcugcgagcuccacuccgggaaggugagcggcuccuuccugcagcuggccuaccaggggagcgacuucguguccuuccagaacaacagcuggcucccguaccccgucgccggcaacauggccaagcacuucugcaaggugcugaaccagaaccagcacgagaacgacaucacccacaaccugcucuccgacacgugcccccgcuucauccuggggcugcucgacgcgggcaaggcccaccuccagcgccaggugaagcccgaggccuggcugagccacggcccgucccccgggcccggccaccuccagcuggucugccacgugagcggguucuaccccaagccggugugggucauguggaugcggggcgagcaggagcagcagggcacccagcgcggggacauccugcccagcgccgacggcaccugguaccugcgggcgacccuggagguggccgccggggaggccgccgaccuguccugccgggugaagcacagcucccucgagggccaggacaucguccuguacugggagcaccacagcuccgugggguucaucauccuggcggugaucgucccccuccugcugcucaucggccuggcccugugguuccgcaagcggugcuucugcuga

SEQ ID NO: 27914 - RNA, 1002 nt, Artificial Sequence
  derived and/or modified sequence opt1 from CD1B__Homo_sapiens__NP_001755
augcugcuccugcccuuccagcugcucgccgugcuguucccgggcgggaacagcgagcacgccuuccagggccccaccuccuuccacgucauccagaccagcuccuucacgaacagcaccugggcgcagacccagggguccggcuggcuggacgaccuccagauccacgggugggacagcgacuccggcaccgccaucuuccugaagcccuggagcaagggcaacuucuccgacaaggagguggccgagcuggaggagaucuuccgcguguacaucuucggguucgcccgggagguccaggacuucgccggcgacuuccagaugaaguaccccuucgagauccaggggaucgcgggcugcgagcuccacagcgggggcgccaucguguccuuccugcgcggcgcccucgggggccuggacuuccugagcgugaagaacgccuccugcgucccgagccccgagggcgggucccgggcgcagaaguucugcgcccugaucauccaguaccagggcaucauggagacggugcgcauccuccuguacgagaccugcccccgguaccugcucggggugcugaacgccggcaaggccgaccugcagcgccaggucaagcccgaggccuggcucagcuccgggccgagccccggccccgggcggcugcagcuggugugccacguguccggcuucuaccccaagccggucugggugauguggaugcgcggcgagcaggagcagcaggggacccagcucggcgacauccugcccaacgcgaacuggaccugguaccugcgggccacgcucgacguggccgacggggaggccgccggccugagcugccgcgucaagcacagcucccuggaggggcaggacaucauccucuacuggcggaaccccaccagcaucggcuccaucgugcuggcgaucaucgugcccagccugcuccugcugcucugccuggcccugugguacaugcgccggcgcuccuaccagaacaucccguga

SEQ ID NO: 27915 - RNA, 1002 nt, Artificial Sequence
  derived and/or modified sequence opt1 from CD1C__Homo_sapiens__NP_001756
augcuguuccuccaguuccugcugcucgcccugcugcuccccggcggggacaacgccgacgcgagccaggagcacguguccuuccacgucauccagaucuucagcuucgugaaccaguccugggcccgcggccaggggagcggcuggcuggacgagcugcagacccacgggugggacuccgagagcggcaccaucaucuuccuccacaacugguccaagggcaacuucagcaacgaggagcuguccgaccuggagcuccuguuccgguucuaccuguucgggcucacgcgcgagauccaggaccacgccagccaggacuacuccaaguacccguucgaggugcaggucaaggccggcugcgagcugcacagcgggaagucccccgagggcuucuuccagguggccuucaacgggcuggaccuccugagcuuccagaacaccaccugggugcccucccccggcugcggcagccuggcgcaguccgucugccaccuccugaaccaccaguacgagggggugaccgagacgguguacaaccugauccggagcacgugcccgcgcuuccuccugggccugcucgacgccgggaagauguacguccaccgccaggugcggcccgaggccuggcuguccagccggcccagccugggcuccggccagcuccugcuggugugccacgccagcggguucuaccccaagccggucugggugaccuggaugcgcaacgagcaggagcagcucggcaccaagcacggggacauccugcccaacgcggacggcaccugguaccuccaggugauccuggaggucgccuccgaggagcccgccgggcugagcugccgggugcgccacuccagccugggcggccaggacaucauccucuacugggggcaccacuucuccaugaacuggaucgcccugguggucaucgugccccuggugauccucaucguccuggugcugugguucaagaagcacugcagcuaccaggacauccucuga

SEQ ID NO: 27916 - RNA, 1008 nt, Artificial Sequence
  derived and/or modified sequence opt1 from CD1D__Homo_sapiens__NP_001757
augggcugccuccuguuccugcugcucugggcccugcugcaggccugggggagcgcggaggugccccagcgccucuucccgcugcggugccugcagaucuccagcuucgccaacuccagcuggacccgcaccgacggccucgccuggcugggggagcugcagacgcacuccuggagcaacgacuccgacaccguccggagccucaagcccuggucccagggcaccuucagcgaccagcagugggagacccugcagcacaucuuccgcguguaccgguccagcuucacgcgcgacgugaaggaguucgccaagaugcugcggcucuccuacccccuggagcugcaggucagcgccgggugcgaggugcaccccggcaacgcguccaacaacuucuuccacguggccuuccagggcaaggacauccucagcuuccaggggaccuccugggagccgacccaggaggcgccccugugggucaaccuggccauccaggugcucaaccaggacaaguggacccgcgagacggugcaguggcugcugaacgggaccugcccccaguucgucagcgggcuccuggaguccggcaagagcgagcugaagaagcaggucaagcccaaggccuggcucagccgggggccgucccccggccccggccgccugcugcucgugugccacgugagcggguucuaccccaagccggugugggugaaguggaugcggggcgagcaggagcagcaggggacccagcccggcgacauccugcccaacgccgacgagaccugguaccugcgcgccacgcucgacgucguggccggcgaggccgcggggcuguccugccgggugaagcacagcucccuggagggccaggacaucguccucuacuggggcggcagcuacaccuccauggggcugaucgcccuggccgugcucgccugccugcuguuccuccugaucgugggcuucaccagccgcuucaagcggcagaccuccuaccagggcguccuguga

SEQ ID NO: 27917 - RNA, 1131 nt, Artificial Sequence
  derived and/or modified sequence opt1 from CD1E__Homo_sapiens__NP_001036048
augcugcuccuguuccuccuguucgagggccugugcugccccggggagaacaccgccgccccgcaggcgcugcagagcuaccaccucgccgccgaggagcagcuguccuuccgcaugcugcagaccagcuccuucgccaaccacagcugggcccacuccgagggcagcggguggcucggcgaccugcagacgcacgggugggacaccgugcugggcaccauccgguuccucaagcccuggucccacggcaacuucagcaagcaggagcugaagaaccugcagucccucuuccagcuguacuuccacagcuucauccagaucguccaggcguccgccgggcaguuccagcuggaguaccccuucgagauccagauccucgccggcugccgcaugaacgcgccccagaucuuccugaacauggccuaccaggggagcgacuuccuguccuuccagggcaucagcugggagccgucccccggggccggcauccgggcccagaacaucugcaaggugcucaaccgcuaccuggacaucaaggagauccugcagagccuccugggccacacgugcccccgguuccuggccgggcucauggaggccggcgaguccgagcugaagcgcaaggugaagcccgaggcguggcugagcugcgggccgucccccggccccggccggcuccagcuggucugccacgugagcggguucuaccccaagccggugugggucauguggaugcgcggcgagcaggagcagcgggggacccagcgcggcgacgugcugcccaacgccgacgagaccugguaccuccgggccacccuggacguggccgccggggaggcggccggccugagcugccgcgucaagcacuccagccucggcgggcacgaccugaucauccacuggggcggguacuccaucuuccugauccucaucugccugaccgugaucgugacgcuggucauccucgugguggucgacagccggcugaagaagcagucccccguguuccugaugggcgccaacacccaggacaccaagaacagccgccaccaguucugccucgcccagguguccuggaucaagaaccggguccugaagaaguggaagacccgccugaaccagcucugguga

SEQ ID NO: 27918 - RNA, 885 nt, Artificial Sequence
  derived and/or modified sequence opt1 from CD200__Homo_sapiens__NP_001004196
auggagcgccugacccucacccggacgaucggcgggccccugcugaccgccacccuccugggcaagaccacgaucaacgacuaccaggugauccgcaugccguucagccaccuguccaccuacagccucgucugggugauggccgcggugguccugugcaccgcccagguccagguggugacccaggacgagcgggagcagcuguacacgcccgccucccucaagugcagccugcagaacgcccaggaggcccugaucgugaccuggcagaagaagaaggcggugucccccgagaacauggucaccuucagcgagaaccacgggguggugauccagcccgccuacaaggacaagaucaacaucacccagcucggccugcagaacuccacgaucaccuucuggaacaucacccuggaggacgaggggugcuacaugugccucuucaacaccuucggcuucggcaagaucagcgggacggccugccugaccgucuacgugcagccgaucgugucccugcacuacaaguucagcgaggaccaccucaacaucacgugcuccgccaccgcgcgccccgcccccauggucuucuggaaggugccccggagcggcaucgagaacuccaccgugacccugagccacccgaacgggaccaccuccgucacgagcauccugcacaucaaggaccccaagaaccaggugggcaaggaggugaucugccagguccuccaccuggggaccgugaccgacuucaagcagaccgugaacaagggcuacugguucuccgucccccugcuccugagcaucgugucccuggucauccuccuggugcugaucagcauccuccuguacuggaagcgccaccggaaccaggaccgcgagcccuga

SEQ ID NO: 27919 - RNA, 1047 nt, Artificial Sequence
  derived and/or modified sequence opt1 from CD200R1__Homo_sapiens__NP_620161
augcugugccccuggcgcaccgccaaccucggccugcugcucauccugaccaucuuccugguggccgaggcggagggggccgcccagccgaacaacagccucaugcugcagacguccaaggagaaccacgcccuggccagcuccagccucugcauggacgagaagcagaucacccagaacuacuccaagguccuggcggaggugaacaccagcuggcccgugaagauggccaccaacgccguccugugcugcccgcccaucgcccuccggaaccugaucaucaucacgugggagaucauccugcgcggccagcccuccugcaccaaggcguacaagaaggagaccaacgagaccaaggagacgaacugcaccgacgagcggaucaccugggugagccgccccgaccagaacuccgaccuccagauccggaccguggccaucacgcacgacggguacuaccgcugcaucauggucacccccgacggcaacuuccaccggggguaccaccuccaggugcuggugacccccgaggucacccuguuccagaaccgcaaccggacggccgugugcaaggccguggccggcaagccggcggcccacaucagcuggauccccgagggcgacugcgccaccaagcaggaguacugguccaacgggaccgucaccgucaagagcacgugccacugggaggugcacaacguguccaccgugaccugccacgugagccaccugaccggcaacaagucccuguacaucgagcuccugcccguccccggggccaagaaguccgccaagcuguacaucccguacaucauccucacgaucaucauccugaccaucgugggcuucaucuggcugcucaaggugaacgggugccgcaaguacaagcugaacaagaccgagagcacccccgucguggaggaggacgagaugcagcccuacgcgagcuacacggagaagaacaacccccuguacgacaccaccaacaaggugaaggccuccgaggcccuccagagcgaggucgacaccgaccugcacacgcuguga

SEQ ID NO: 27920 - RNA, 987 nt, Artificial Sequence
  derived and/or modified sequence opt1 from CD207__Homo_sapiens__NP_056532
augaccguggagaaggaggcccccgacgcccacuucaccgucgacaagcagaacaucagccuguggccgcgcgagcccccgcccaaguccggccccagccucgugcccgggaagacgcccaccgugcgggcggcccugaucugccugacccucguccugguggccuccgugcugcuccaggccguccuguacccccgcuucaugggcaccaucagcgacgugaagacgaacgugcagcugcucaaggggcgggucgacaacaucuccacccuggacagcgagaucaagaagaacuccgacggcauggaggccgcgggggugcagauccagauggugaacgagagccugggcuacguccgcucccaguuccucaagcugaagaccagcguggagaaggccaacgcccagauccagauccugacccgguccugggaggaggugagcacgcucaacgcccagaucccggagcugaaguccgaccuggagaaggcgagcgcccucaacaccaagauccgcgcccugcagggcucccuggagaacaugagcaagcuccugaagcggcagaacgacauccugcaggucgugucccagggguggaaguacuucaagggcaacuucuacuacuucagccucauccccaagaccugguacuccgccgagcaguucugcgugagccgcaacagccaccugaccuccgucacgagcgaguccgagcaggaguuccuguacaagaccgccgggggccucaucuacuggaucgggcugaccaaggcgggcauggagggcgacuggagcuggguggacgacacccccuucaacaaggugcaguccguccgguucuggauccccggggagccgaacaacgccggcaacaacgagcacugcgggaacaucaaggcccccagccugcaggccuggaacgacgcccccugcgacaagacguuccucuucaucugcaagcgccccuacgugccguccgagcccuga

SEQ ID NO: 27921 - RNA, 807 nt, Artificial Sequence
  derived and/or modified sequence opt1 from CD209__Homo_sapiens__NP_001138365
augagcgacuccaaggagccccgccugcagcagcucggccugcuggugagcaagguccccuccagcaucucccaggagcagagccggcaggacgccaucuaccagaaccucacccagcugaaggccgcggugggggagcuguccgagaaguccaagcuccaggagaucuaccaggagcugacccagcugaaggccgccgugggcgagcuccccgagaaguccaagcugcaggagaucuaccaggagcugacgcgccucaaggccgccgucggggagcugcccgagaaguccaagcugcaggagaucuaccaggagcucaccuggcugaaggcggccguggagcggcugugccaccccugcccgugggaguggaccuucuuccagggcaacugcuacuucaugagcaacagccagcgcaacuggcacgacuccaucaccgccugcaaggaggugggggcccagcucgucgugaucaagagcgcggaggagcagaacuuccugcagcugcaguccagccgguccaaccgcuucacguggaugggccucagcgaccugaaccaggagggcaccuggcaguggguggacgggagcccccugcuccccagcuucaagcaguacuggaaccggggcgagcccaacaacgucggggaggaggacugcgccgaguucagcggcaacggguggaacgacgacaagugcaaccuggccaaguucuggaucugcaagaaguccgccgccagcugcucccgcgacgaggagcaguuccugagcccggcgcccgccacccccaacccgccgcccgccuga

SEQ ID NO: 27922 - RNA, 1011 nt, Artificial Sequence
  derived and/or modified sequence opt1 from CD226__Homo_sapiens__NP_001290547
auggacuaccccacccugcuccuggcccugcuccacguguaccgcgcccugugcgaggagguccuguggcacaccagcgugccguucgcggagaacaugucccucgagugcguguaccccagcaugggcauccugacgcaggucgagugguucaagaucgggacccagcaggacuccaucgccaucuucagccccacccacggcauggugauccggaagcccuacgccgagcgcguguacuuccugaacuccaccauggccagcaacaacaugacccucuucuuccggaacgccuccgaggacgacgucggguacuacagcugcucccuguacacguacccgcagggcaccuggcagaaggugauccaggugguccagagcgacuccuucgaggcggccgugcccagcaacucccacaucgugagcgagcccgggaagaacgucacccugacgugccagccccagaugaccuggccggugcaggccgugcgcugggagaagauccagccccggcagaucgaccuccugaccuacugcaaccugguccacggccgcaacuucaccuccaaguucccccggcagaucgugagcaacugcucccacggccgcuggagcgugaucgucauccccgacgugacgguguccgacagcgggcucuaccggugcuaccugcaggccagcgcgggcgagaacgagaccuucgucaugcgccugaccguggccgaggggaagaccgacaaccaguacacccucuucguggccggcgggacgguccugcugcuccuguucgugaucuccaucaccaccaucaucgucaucuuccugaaccggcgccggcgccgggagcgccgggaccucuucacggagagcugggacacccagaaggccccgaacaacuaccgcucccccaucagcaccucccagcccaccaaccagagcauggacgacacgcgggaggacaucuacgugaacuaccccaccuucucccgccggccgaagacccgcguguga

SEQ ID NO: 27923 - RNA, 2280 nt, Artificial Sequence
  derived and/or modified sequence opt1 from CD22__Homo_sapiens__NP_001172028
augcaccuccucggccccuggcugcugcuccuggugcuggaguaccucgccuucagcgacuccagcaagugggucuucgagcacccggagacccuguacgccugggagggggcgugcguguggauccccugcaccuaccgcgcccuggacggcgaccucgaguccuucauccuguuccacaaccccgaguacaacaagaacacgagcaaguucgacgggacccggcuguacgaguccaccaaggacggcaaggugcccagcgagcagaagcgcguccaguuccucggggacaagaacaagaacugcacccuguccauccacccggugcaccugaacgacagcggccagcucggccugcggauggaguccaagacggagaaguggauggagcgcauccaccugaacgugagcgagcggcccuucccgccccacauccagcucccgcccgagauccaggagucccaggaggucacccugaccugccugcucaacuucagcugcuacggguaccccauccagcugcaguggcugcucgagggcgugcccaugcgccaggccgccgugaccuccacgagccugaccaucaaguccgucuucacccggagcgagcugaaguucuccccgcaguggagccaccacgggaagaucgugaccugccagcuccaggacgccgacggcaaguuccuguccaacgacacggugcagcugaacgucaagcacacccccaagcucgagaucaaggugacccccagcgacgcgaucgugcgcgagggggacagcgucaccaugacgugcgagguguccagcuccaaccccgaguacaccaccgugagcuggcugaaggacggcaccucccugaagaagcagaacacguucacccucaaccugcgggaggucaccaaggaccagagcggcaaguacugcugccagguguccaacgacguggggcccggccgcagcgaggaggucuuccuccaggugcaguacccgcccaagaaggugaccacggucauccagaaccccaugcccauccgggagggggacaccgugacccuguccugcaacuacaacagcuccaaccccagcgucacccgcuacgaguggaagccccacggcgccugggaggagcccucccugggcgugcugaagauccagaacguggggugggacaacacgaccaucgccugcgccgcgugcaacagcuggugcuccugggccagcccggucgcccucaacgugcaguacgcgccccgggacgugcgcguccggaagaucaagccccuguccgagauccacagcggcaacuccgugagccugcagugcgacuucagcuccagccaccccaaggaggugcaguucuucugggagaagaacgggcgccuccugggcaaggagucccagcugaacuucgacagcaucuccccggaggacgccgggagcuacuccugcugggucaacaacagcaucggccagaccgccuccaaggccuggacccucgaggugcuguacgcgccccggcgccugcgggugagcaugucccccggcgaccaggucauggagggcaagagcgccacgcugaccugcgaguccgacgccaacccgcccgugagccacuacaccugguucgacuggaacaaccagucccugcccuaccacagccagaagcugcgccuggagcccgugaagguccagcacuccggggccuacuggugccaggggaccaacagcgugggcaaggggcggagcccgcucuccacgcugaccguguacuacagccccgagaccaucggccgccgcgucgccgugggccugggguccugccucgccauccugauccuggccaucugcggccucaagcugcagcggcgcuggaagcggacccagagccagcaggggcugcaggagaacuccagcggccaguccuucuucgugcgcaacaagaagguccggcgcgcgccccucagcgaggggccccacucccugggcugcuacaacccgaugauggaggacggcaucagcuacaccacgcugcgguuccccgagaugaacaucccccgcaccggggacgccgaguccagcgagaugcagcggcccccgcccgacugcgacgacaccgugaccuacuccgcccuccacaagcgccaggugggcgacuacgagaacgucauccccgacuuccccgaggacgaggggauccacuacagcgagcugauccaguucggcgugggcgagcggccgcaggcccaggagaacguggacuacgucauccugaagcacuga

SEQ ID NO: 27924 - RNA, 1113 nt, Artificial Sequence
  derived and/or modified sequence opt1 from CD244__Homo_sapiens__NP_001160135
augcugggccagguggucacccucauccugcugcuccugcugaagguguaccaggggaagggcugccaggggagcgccgaccacguggucuccaucagcggcgugccccuccagcugcagccgaacuccauccagaccaagguggacagcaucgccuggaagaagcugcuccccucccagaacggguuccaccacauccugaagugggagaacggcagccugcccuccaacacgagcaacgaccgcuucuccuucaucgucaagaaccucagccugcugaucaaggcggcccagcagcaggacuccggccucuacugccuggaggugaccagcaucuccgggaaggugcagaccgccaccuuccaggucuucguguucgagagccugcuccccgacaagguggagaagccgcggcugcagggccaggggaagauccuggaccgcggccggugccaggucgcccucuccugccuggugagccgcgacgggaacguguccuacgccugguaccggggcagcaagcugauccagacggcgggcaaccucaccuaccuggacgaggaggucgacaucaacgggacccacaccuacacgugcaacguguccaaccccgugagcugggagagccacacccugaaccucacccaggacugccagaacgcccaccaggaguuccgcuucuggcccuuccuggucaucaucgugauccuguccgcccucuuccugggcacccuggccugcuucugcguguggcggcgcaagcggaaggagaagcagagcgagacgucccccaaggaguuccucaccaucuacgaggacgucaaggaccugaagacccgccggaaccacgagcaggagcagaccuuccccgggggcggcagcacgaucuacuccaugauccagagccaguccagcgcgccgaccucccaggagcccgccuacacccuguacagccucauccagcccucccgcaagagcgggucccggaagcgcaaccacagcccguccuucaacagcaccaucuacgaggugaucggcaagucccagcccaaggcccagaaccccgcccggcugagccgcaaggagcuggagaacuucgacguguacuccuga

SEQ ID NO: 27925 - RNA, 492 nt, Artificial Sequence
  derived and/or modified sequence opt1 from CD247__Homo_sapiens__NP_000725
augaaguggaaggcccuguucaccgccgcgauccuccaggcccagcugcccaucaccgaggcccagagcuucggccugcucgaccccaagcugugcuaccugcucgacgggauccuguucaucuacggcgugauccugacggcccucuuccugcgcgucaaguucucccggagcgccgacgcgcccgccuaccagcaggggcagaaccagcuguacaacgagcucaaccugggccgccgggaggaguacgacgugcuggacaagcgccgggggcgcgaccccgagaugggcggcaagccccggcgcaagaacccgcaggaggggcucuacaacgagcugcagaaggacaagauggccgaggccuacuccgagaucggcaugaagggggagcggcgccggggcaaggggcacgacggccuguaccagggccucagcaccgcgaccaaggacaccuacgacgcccugcacaugcaggcccugccgccccgcuga

SEQ ID NO: 27926 - RNA, 2274 nt, Artificial Sequence
  derived and/or modified sequence opt1 from CD248__Homo_sapiens__NP_065137
augcugcuccgccugcugcucgccugggccgcggccggccccacccuggggcaggacccgugggccgccgagccccgggccgcgugcggccccagcuccugcuacgcccuguucccccgccggcgcaccuuccucgaggccuggcgggccugccgcgagcucgggggcgaccuggcgacgccgcggacccccgaggaggcccagcgcguggacagccuggucggggccggccccgccucccggcugcuguggaucggccuccagcgccaggcccggcagugccagcugcagcgcccccugcggggguucaccuggaccacgggcgaccaggacaccgcguucaccaacugggcccagccggccagcgggggccccugccccgcccagcgcugcguggcccucgaggcguccggggagcaccgguggcuggagggcagcugcacccuggccguggacggcuaccucugccaguucggguucgagggcgccugccccgcccugcaggacgaggccgggcaggcgggcccggccgucuacacgacccccuuccaccugguguccaccgaguucgaguggcuccccuucggcagcguggccgccguccagugccaggccgggcgcggcgcgucccugcugugcgugaagcagcccgagggcggggugggguggagccgggccggcccgcucugccugggcaccgggugcucccccgacaacggcgggugcgagcacgagugcgucgaggagguggacggccacgugagcugccgcugcacggagggguuccggcuggccgccgacggccgcuccugcgaggaccccugcgcgcaggcccccugcgagcagcagugcgagccgggcgggccccagggcuacagcugccacugccggcucggguuccgccccgccgaggacgacccccaccgcugcgucgacaccgacgagugccagaucgccggcgugugccagcagaugugcgugaacuacgucgggggcuucgagugcuacugcuccgagggccacgagcuggaggccgacgggaucagcugcuccccggcgggcgccaugggggcccaggccagccaggaccugggcgacgagcuccuggacgacggcgaggacgaggaggacgaggacgaggccuggaaggcguucaacgggggcuggaccgagaugcccgggauccuguggauggagcccacccagcccccggacuucgcccucgccuaccggcccuccuuccccgaggaccgcgagccgcagauccccuaccccgagcccacguggccgccgccccugagcgcgccccgggugcccuaccacagcuccgugcugagcgucacccgccccgugguggucuccgccacccaccccacccuccccagcgcccaccagccgcccgugauccccgccacgcaccccgcccugucccgggaccaccagaucccggugaucgccgcgaacuaccccgaccugcccagcgccuaccagcccggcauccucuccgucagccacuccgcccagccgcccgcccaccagccgcccaugaucagcaccaaguaccccgagcuguuccccgcccaccagucccccauguucccggacacccgcguggcggggacccagacgaccacccaccuccccggcaucccgcccaaccacgcgccccuggucaccacgcugggcgcccagcugccgccccaggcccccgacgcccucgugcugcggacccaggccacccagcugcccaucauccccaccgcccagcccagccucacgaccaccucccgcagccccguguccccggcccaccagaucagcguccccgccgccacccagcccgcggcccugcccacgcugcugccgucccagagccccaccaaccagaccucccccaucagccccacccacccgcacagcaaggcgccccagaucccccgggaggacgggcccuccccgaagcucgcccuguggcugcccagccccgcccccaccgccgccccgacggcccucggcgaggccgggcuggcggagcacucccagcgcgacgaccgguggcugcucguggcccugcuggugccgaccugcgucuuccucguggugcugcuggcccucggcaucgucuacugcacccgcugcgggccccacgcccccaacaagcggaucaccgacugcuaccgcugggugauccacgccggcagcaagucccccacggagcccaugcccccgcggggcagccugaccggggugcagaccugccgcaccuccgucuga

SEQ ID NO: 27927 - RNA, 411 nt, Artificial Sequence
  derived and/or modified sequence opt1 from CD24__Homo_sapiens__XP_011533677
augcgcacccgggacgcccccgugagcucccugcgccucgccgacacccggcgcagccagaacaaggcgcgggccuccggccgcgcccggccgcgcgggcgggcccgccggagccugcgcacgcggaccccgcccgcccgcuccgcggaccagcccggccggguccgcgcccggcgccggcccgggcccgugggccaggggcuggccggcagcccccgcuccccgcccugccuccggccgcccggcgccagcgggucccccagcacccagcaccccgcgcgccgcgccgcccaccggcgccggggccacgggcaguccaacggcgggcaggcccgcgccggcgcggccgccgccggcaccgcccccacgcacgcggugcggugcgcccccgagcccagcuccauccuguga

SEQ ID NO: 27928 - RNA, 531 nt, Artificial Sequence
  derived and/or modified sequence opt1 from CD274__Homo_sapiens__NP_001254635
augcgcaucuucgccguguucaucuucaugaccuacuggcaccuccugaacgcccccuacaacaagaucaaccagcggauccuggucguggaccccgugaccagcgagcacgagcugacgugccaggcggagggcuaccccaaggccgaggucaucuggaccuccagcgaccaccaggugcucuccgggaagaccaccacgaccaacagcaagcgcgaggagaagcuguucaacgugaccuccacccugcggaucaacacgaccaccaacgagaucuucuacugcaccuuccgccggcucgaccccgaggagaaccacacggccgagcuggucauccccgagcugccgcucgcccacccgcccaacgagcgcacccaccuggugauccugggcgccauccuccugugccuggggguggcgcucaccuucaucuuccggcugcgcaagggccggaugauggacgucaagaagugcgggauccaggacaccaacagcaagaagcaguccgacacgcaccuggaggagaccuga

SEQ ID NO: 27929 - RNA, 951 nt, Artificial Sequence
  derived and/or modified sequence opt1 from CD276__Homo_sapiens__NP_079516
augcugcgccggcgcggcagccccgggaugggcgugcacgucggggccgcccucggcgcgcugugguucugccugaccggggcccucgagguccaggugcccgaggaccccgugguggcccuggugggcaccgacgccacgcugugcugcuccuucagccccgagcccggcuucucccucgcccagcugaaccugaucuggcagcucaccgacaccaagcagcugguccacagcuucgcggaggggcaggaccagggcuccgccuacgccaaccggaccgcccuguucccggaccuccuggcgcaggggaacgccagccugcgccuccagcgggugcgcguggccgacgagggcuccuucacgugcuucgucagcauccgggacuucggguccgccgccgugagccuccagguggcggcccccuacuccaagcccagcaugacccuggagcccaacaaggaccugcgcccgggcgacaccgucaccaucacgugcuccagcuaccggggcuaccccgaggccgagguguucuggcaggacgggcagggcgugccccugaccgggaacgucaccaccucccagauggccaacgagcagggccuguucgacgugcacagcgugcuccgcgucgugcugggcgccaacgggacguacuccugccuggugcggaaccccguccuccagcaggacgcgcacggcagcgugaccaucaccgggcagccgaugaccuucccgcccgaggcccugugggugacggucggccuguccgugugccucaucgcccugcuggucgcccucgccuucgugugcuggcgcaagaucaagcagagcugcgaggaggagaacgcgggggccgaggaccaggacggcgagggcgaggggagcaagaccgcccugcagccccugaagcacuccgacagcaaggaggacgacggccaggagaucgccuga

SEQ ID NO: 27930 - RNA, 783 nt, Artificial Sequence
  derived and/or modified sequence opt1 from CD27__Homo_sapiens__NP_001233
auggcccgcccccacccgugguggcugugcgugcucggcacccuggucgggcugagcgccacccccgcgcccaaguccugccccgagcggcacuacugggcccagggcaagcucugcugccagaugugcgagccggggacguuccuggugaaggacugcgaccagcaccgcaaggccgcccagugcgaccccugcauccccggcgugagcuucucccccgaccaccacacccggccgcacugcgagagcugccgccacugcaacuccgggcugcucguccggaacugcaccaucaccgccaacgcggagugcgccugccgcaacggcuggcagugccgggacaaggagugcacggagugcgacccccugcccaaccccagccugaccgcccgcuccagccaggcccucuccccgcacccccagcccacccaccuccccuacgugagcgagaugcuggaggcgcggaccgccggccacaugcagacgcuggccgacuuccgccagcugccggcccggacccuguccacccacuggccgccccagcgcagccucugcuccagcgacuucauccggauccuggugaucuucuccgggauguuccuggucuucacccucgccggcgcgcuguuccugcaccagcgccggaaguaccgcagcaacaagggggagucccccguggagcccgccgagcccugccgguacagcugcccccgcgaggaggagggcuccacgauccccauccaggaggacuaccggaagccggagcccgccugcagccccuga

SEQ ID NO: 27931 - RNA, 306 nt, Artificial Sequence
  derived and/or modified sequence opt1 from CD28__Homo_sapiens__NP_001230007
augcugcgccuccugcuggcccucaaccuguuccccagcauccaggugaccggcaagcaccugugccccagcccccucuuccccgggcccuccaagccguucuggguccuggugguggucggcggggugcuggccugcuacucccuccuggugaccgucgcguucaucaucuucugggugcggagcaagcgcucccggcugcuccacagcgacuacaugaacaugacgccccgccggcccggccccacccgcaagcacuaccagccguacgccccgccccgggacuucgccgccuaccgcuccuga

SEQ ID NO: 27932 - RNA, 1920 nt, Artificial Sequence
  derived and/or modified sequence opt1 from CD2AP__Homo_sapiens__NP_036252
augguggacuacaucgucgaguacgacuacgacgccgugcacgacgacgagcugaccauccgcgugggcgagaucauccggaacgucaagaagcuccaggaggagggguggcuggagggcgagcugaacgggcgccggggcauguuccccgacaacuucgugaaggagaucaagcgcgagaccgaguucaaggacgacagccucccgaucaagcgggagcgccacgggaacguggccucccugguccagcggaucagcacguacggccugcccgcgggcgggauccagccccacccccagaccaagaacaucaagaagaagaccaagaagcgccagugcaagguccucuucgaguacaucccgcagaacgaggacgagcuggagcugaaggugggcgacaucaucgacaucaacgaggaggucgaggagggguggugguccggcacccucaacaacaagcuggggcuguuccccagcaacuucgugaaggagcucgaggugacggacgacggcgagacccacgaggcccaggacgacuccgagaccguccuggccggccccaccagccccaucccgucccuggggaacgugagcgagacggccuccggcagcgugacccagcccaagaagauccgggggaucggcuucggcgacaucuucaaggagggguccgugaagcuccgcacccggaccagcuccagcgagacggaggagaagaagcccgagaagccccugauccugcagucccucggcccgaagacccagagcguggagaucaccaagaccgacacggaggggaagaucaaggccaaggaguacugccgcacccuguucgcguacgagggcaccaacgaggacgagcugaccuucaaggagggggagaucauccaccucaucuccaaggagacgggcgaggccggcugguggcgcggggagcugaacggcaaggaggggguguuccccgacaacuucgccguccagaucaacgagcuggacaaggacuuccccaagcccaagaagccgcccccgcccgccaaggcgcccgcccccaagcccgagcucaucgccgccgagaagaaguacuucagccugaagcccgaggagaaggacgagaaguccacccuggagcagaagccgagcaagcccgccgcgccccaggugcccccgaagaagcccacgcccccgaccaaggccagcaaccuccugcgguccagcggcaccguguaccccaagcggcccgagaagcccgucccgcccccgccgcccaucgccaagaucaacggggagguguccagcaucuccagcaaguucgagaccgagcccguguccaagcugaagcucgacagcgagcagcugccccugcgccccaaguccgucgacuucgacagccucaccgugcggaccuccaaggagacggacgucgugaacuucgacgacaucgccagcuccgagaaccugcugcaccucaccgccaaccgccccaagaugcccggccggcgccugcccggccgguucaacgggggccacagccccacccacuccccggagaagauccugaagcuccccaaggaggaggacagcgcgaaccugaagcccuccgagcugaagaaggacacgugcuacagccccaagccguccguguaccucagcacccccagcuccgccagcaaggccaacaccaccgccuuccugacgccccuggagaucaaggccaaggucgagaccgacgacgugaagaagaacucccucgacgagcugcgcgcgcagaucaucgagcugcucugcaucguggaggcccugaagaaggaccacgggaaggagcuggagaagcugcgcaaggaccucgaggaggagaagaccaugcggagcaaccuggagauggagaucgagaagcugaagaaggccguccucuccagcuga

SEQ ID NO: 27933 - RNA, 561 nt, Artificial Sequence
  derived and/or modified sequence opt1 from CD300A__Homo_sapiens__NP_001243770
auguggcugcccugggcccuccugcugcucugggugccggccagcaccuccaugacccccgcgagcaucacggccgccaagaccuccaccaucaccacggccuucccgcccgucagcuccaccacccuguucgccgugggcgcgacccacagcgccuccauccaggaggagacggaggagguggucaacagccagcugccccuccugcugucccuccuggcccugcuccugcugcuccuggugggggccagccugcucgcguggcgcauguuccagaaguggaucaaggccggcgaccacuccgagcugagccagaaccccaagcaggccgccacccaguccgagcugcacuacgccaaccucgagcugcugauguggccccuccaggagaagcccgcgccgccccgggagguggaggucgaguacagcaccguggccagcccccgcgaggagcugcacuacgccuccguggucuucgacuccaacaccaaccggaucgccgcccagcgcccccgggaggaggagccggacagcgacuacuccgugauccgcaagacguga

SEQ ID NO: 27934 - RNA, 675 nt, Artificial Sequence
  derived and/or modified sequence opt1 from CD300C__Homo_sapiens__NP_006669
augaccgcccgcgccugggcgagcuggcgguccagcgcccugcuccugcugcucgugcccggcuacuucccgcugucccaccccaugaccgucgccgggcccgugggcgggagccuguccgugcagugccgcuacgagaaggagcaccggacgcucaacaaguucuggugccggcccccgcagauccugcgcugcgacaagaucgucgagaccaagggcagcgccgggaagcgcaacggccggguguccauccgcgacagccccgccaaccuguccuucaccgugacccucgagaaccugacggaggaggacgcgggcaccuacuggugcggggucgacacccccuggcugcgggacuuccacgaccccaucguggagguggaggucagcguguucccggccggcaccacgaccgccuccagcccccaguccagcauggggaccuccggcccgcccaccaagcuccccgugcacacguggcccagcgucacccgcaaggacucccccgagcccagcccgcaccccgggucccuguucagcaacgugcgguuccugcuccuggugcugcucgagcugccccugcuccugagcaugcugggcgccguccucugggugaaccgcccccagcgguccagccgcucccggcagaacuggccgaagggcgagaaccaguga

SEQ ID NO: 27935 - RNA, 585 nt, Artificial Sequence
  derived and/or modified sequence opt1 from CD300LF__Homo_sapiens__NP_001276011
auguggcugccccagcucgaccugaugcgcgugaucagcgccaagucccagggcuacagcaucgucacccagaucaccgggccgacgaccgugaacggccuggagcgggggucccucaccgugcagugcgucuaccgcagcggcugggagaccuaccugaagugguggugccgcggggccaucuggcgggacugcaagauccuggugaagacguccggcagcgagcaggaggugaagcgggaccgcgucuccaucaaggacaaccagaagaaccggaccuucaccgugaccauggaggaccucaugaagacggacgcggacaccuacuggugcggcaucgagaagaccgggaacgaccugggcgugaccguccaggugacgaucgaccccgcccccgugacccaggaggagaccagcuccagccccacccugacggggcaccaccucgacaacuccagccgcgacgucccgcgggccggcaccgccgcccccgggggccgcccccugcugugccggcccgacccggcggccggccgcaaccuccccgccaagggguaccacgaggccuuccugugccccggcuga

SEQ ID NO: 27936 - RNA, 525 nt, Artificial Sequence
  derived and/or modified sequence opt1 from CD302__Homo_sapiens__NP_001185692
augcugcgcgccgcccuccccgcgcugcugcucccgcugcugggccucgccgccgccgccguggcggacugccccagcuccaccuggauccaguuccaggacagcugcuacaucuuccugcaggaggccaucaaggucgaguccaucgaggacgugcggaaccagugcaccgaccacggggccgacaugaucagcauccacaacgaggaggagaacgccuucauccuggacacgcucaagaagcaguggaagggccccgacgacauccugcuggggauguucuacgacaccgacgugcccuacaagcgcaaguaccucuccgacaaccacauccugaucagcgcgcuggucaucgccuccaccgugauccucaccgugcugggcgccaucaucugguuccuguacaagaagcacagcgacucccgguucacgaccgucuucagcaccgccccgcagucccccuacaacgaggacugcgugcucguggucggggaggagaacgaguaccccgugcaguucgacuga

SEQ ID NO: 27937 - RNA, 723 nt, Artificial Sequence
  derived and/or modified sequence opt1 from CD320__Homo_sapiens__NP_001159367
augagcggcggguggauggcccaggugggcgccuggcgcaccggggcgcugggccucgcccugcugcuccugcuggggcucggccugggccuggaggccgccgccagcccccucagcaccccgacguccgcgcaggccgccgggaucgagcccugcacccagaagggccagugcccgcccccgcccgggcugcccugccccugcaccggcgucagcgacugcuccgggggcaccgacaagaagcugcggaacugcucccgccucgccugccuggcgggcgagcugcggugcacgcucuccgacgacugcaucccccugaccuggcgcugcgacgggcaccccgacugccccgacagcuccgacgagcugggcugcgggaccaacgagauccuccccgagggcgacgccaccacgaugggcccgcccgugacccuggagagcgugaccucccugcggaacgccaccacgauggggccgcccgucacccucgagagcgugcccuccgugggcaacgccaccagcuccagcgccggggaccaguccggcagccccaccgcguacggggucaucgccgccgccgccgugcuguccgcgagccuggugacggccacccuccugcugcucagcuggcugcgcgcccaggagcggcugcgcccccucggccugcuggucgccaugaaggagucccuccugcugagcgagcagaagaccucccuccccuga

SEQ ID NO: 27938 - RNA, 714 nt, Artificial Sequence
  derived and/or modified sequence opt1 from CD33__Homo_sapiens__NP_001076087
augccccugcuccugcugcucccgcugcugugggccgaccucacccaccgccccaagauccugauccccggcacccuggagcccgggcacagcaagaaccucacgugcuccgugagcugggccugcgagcagggcaccccgcccaucuucuccuggcugagcgcggcccccaccucccuggggccccggaccacgcacagcuccguccucaucaucaccccgcgcccccaggaccacggcaccaaccugaccugccaggugaaguucgccggggccggcgugacgaccgagcggaccauccagcugaacgucaccuacgugccccagaaccccacgaccggcaucuucccgggggacggcagcgggaagcaggagacccgcgccggcgugguccacggggcgaucggcggcgccggggugaccgcccuccuggcccugugccucugccugaucuucuucaucgugaagacgcaccggcgcaaggcggcccggaccgccgucggccgcaacgacacccaccccaccacgggguccgccagccccaagcaccagaagaaguccaagcugcacggccccaccgagaccagcuccugcagcggcgccgcgccgaccguggagauggacgaggagcuccacuacgccucccugaacuuccacgggaugaaccccagcaaggacacguccaccgaguacagcgaggugcggacccaguga

SEQ ID NO: 27939 - RNA, 1158 nt, Artificial Sequence
  derived and/or modified sequence opt1 from CD34__Homo_sapiens__NP_001020280
augcuggugcgccggggcgcccgcgccgggccccggaugccgcgcggcuggaccgcgcucugccugcugagccuccugcccuccggguucaugagccuggacaacaacggcaccgccacgcccgagcuccccacccaggggaccuucuccaacgucagcaccaacguguccuaccaggagacgaccaccccgagcacccugggcuccacgagccugcaccccgugucccagcacggcaacgaggccaccaccaacaucaccgagacgaccgucaaguucaccagcaccuccgugaucacgagcguguacgggaacaccaacuccagcguccagucccagaccagcgugaucuccaccguguucacgacccccgccaacgucagcacccccgagaccacgcucaagccgucccugagccccggcaacgugagcgaccuguccaccaccagcaccucccucgccacgagccccaccaagcccuacaccuccagcuccccgauccugagcgacaucaaggcggagaucaagugcuccgggauccgggaggugaagcugacccagggcaucugccucgagcagaacaagacgagcuccugcgccgaguucaagaaggaccgcggggagggccuggcccggguccugugcggcgaggagcaggccgacgcggacgccggggcccaggugugcagccuccugcuggcccaguccgaggugcgcccccagugccuccugcugguccucgccaaccggaccgagaucagcuccaagcugcagcugaugaagaagcaccagagcgaccucaagaagcugggcauccuggacuucaccgagcaggacguggcgucccaccagagcuacucccagaagacccucaucgcccuggugacgagcggggcccugcucgccguccugggcaucaccggcuacuuccugaugaaccgccggagcuggucccccaccggggagcgccucggcgaggaccccuacuacaccgagaacgggggcgggcagggcuacagcuccggcccggggaccagccccgaggcccagggcaaggcguccgugaaccgcggggcccaggagaacggcacggggcaggccaccagccggaacggccacuccgcccggcagcacguggucgccgacaccgagcuguga

SEQ ID NO: 27940 - RNA, 1419 nt, Artificial Sequence
  derived and/or modified sequence opt1 from CD36__Homo_sapiens__NP_001001547
augggcugcgaccgcaacugcgggcugaucgccggcgccgugaucggggcgguccucgccguguucggcgggauccugaugcccgugggcgaccugcucauccagaagaccaucaagaagcaggucgugcuggaggagggcaccaucgccuucaagaacugggugaagacggggaccgaggucuaccggcaguucuggaucuucgacgugcagaacccgcaggaggugaugaugaacagcuccaacauccaggucaagcagcgcggccccuacaccuaccgggugcgcuuccuggccaaggagaacgugacccaggacgccgaggacaacacggucagcuuccuccagcccaacggggcgaucuucgagcccucccugagcgugggcaccgaggccgacaacuucaccgugcugaaccucgccgucgccgcggccucccacaucuaccagaaccaguucgugcagaugauccugaacagccugaucaacaaguccaagagcuccauguuccaggugcggacccuccgcgagcugcuguggggguaccgggacccguuccucagccugguccccuaccccgugacgaccaccgugggccuguucuaccccuacaacaacaccgccgacggcgucuacaagguguucaacgggaaggacaacaucuccaagguggccaucaucgacacguacaagggcaagcgcaaccucagcuacugggagucccacugcgacaugaucaacgggaccgacgccgcgagcuucccgcccuucgucgagaagucccaggugcugcaguucuucagcuccgacaucugccggagcaucuacgccgucuucgaguccgacgugaaccugaagggcauccccguguaccgcuucguccuccccagcaaggccuucgccagcccgguggagaaccccgacaacuacugcuucugcaccgagaagaucaucuccaagaacugcaccagcuacggcgugcuggacaucuccaagugcaaggaggggcggcccgucuacaucagccugccccacuuccucuacgccuccccggacgugagcgagcccaucgacggccugaaccccaacgaggaggagcaccgcacguaccuggacaucgagcccaucaccggguucacccuccaguucgcgaagcggcuccaggugaaccugcuggucaagccguccgagaagauccaggugcugaagaaccugaagcgcaacuacaucgugcccauccucuggcugaacgagaccggcacgaucggggacgagaaggccaacauguuccggagccaggucaccggcaagaucaaccugcucggccugaucgagaugauccugcucuccguggggguggucauguucguggccuucaugaucagcuacugcgccugccgcuccaagaccaucaaguga

SEQ ID NO: 27941 - RNA, 846 nt, Artificial Sequence
  derived and/or modified sequence opt1 from CD37__Homo_sapiens__NP_001765
augagcgcccaggaguccugccugagccucaucaaguacuuccuguucguguucaaccuguucuucuucguccucggcucccugaucuucugcuucgggaucuggauccugaucgacaagaccagcuucguguccuucgugggccucgccuucgucccccugcagaucuggagcaaggugcuggcgaucuccgggaucuucaccaugggcaucgcccuccuggggugcgugggcgcccugaaggagcuccgcugccugcugggccucuacuucgggaugcugcugcuccuguucgccacgcagaucacccugggcauccucaucagcacccagcgggcccagcuggagcgcucccugcgggacgucguggagaagaccauccagaaguacgggacgaacccggaggagaccgcggccgaggagagcugggacuacgugcaguuccagcuccgcugcugcggcuggcacuacccccaggacugguuccagguccugauccugcgggggaacggcuccgaggcccaccgcgugcccugcagcugcuacaaccucuccgccaccaacgacagcaccauccuggacaaggugauccugccccagcucucccggcugggccaccuggcgcgcagccggcacuccgccgacaucugcgccgucccggccgagagccacaucuaccgcgaggggugcgcccagggccuccagaaguggcugcacaacaaccugaucuccaucguggggaucugccucggcgugggccugcuggagcucggguucaugacgcugagcaucuuccugugccggaaccucgaccacgucuacaaccgccuggcgcgguaccgcuga

SEQ ID NO: 27942 - RNA, 903 nt, Artificial Sequence
  derived and/or modified sequence opt1 from CD38__Homo_sapiens__NP_001766
auggccaacugcgaguucagccccguguccggcgacaagccgugcugccgccugagccggcgcgcccagcucugccugggggucuccauccuggugcucauccugguggucgugcuggcgguggucgugccccgguggcgccagcaguggagcggccccgggaccaccaagcgguuccccgagacggugcucgcccgcugcgucaaguacaccgagauccacccggagaugcggcacguggacugccaguccgugugggacgccuucaagggcgccuucaucagcaagcaccccugcaacaucaccgaggaggacuaccagccccugaugaagcuggggacccagacgguccccugcaacaagauccuccuguggucccgcaucaaggaccuggcccaccaguucacccaggugcagcgggacauguucacccucgaggacacccugcugggcuaccucgcggacgaccugacguggugcggcgaguucaacaccagcaagaucaacuaccaguccugcccggacuggcgcaaggacugcagcaacaaccccguguccgucuucuggaagaccgugagccggcgcuucgccgaggccgccugcgacgugguccacgugaugcugaacgggucccggagcaagaucuucgacaagaacuccaccuucggcagcguggagguccacaaccuccagcccgagaaggugcagacgcuggaggcgugggugauccacgggggccgcgaggacucccgggaccugugccaggaccccaccaucaaggagcucgagagcaucaucuccaagcgcaacauccaguucagcugcaagaacaucuaccggccggacaaguuccugcagugcgucaagaaccccgaggacagcuccugcaccagcgagaucuga

SEQ ID NO: 27943 - RNA, 516 nt, Artificial Sequence
  derived and/or modified sequence opt1 from CD3D__Homo_sapiens__NP_000723
auggagcacagcaccuuccuguccggccucgugcuggccacccugcucagccaggucucccccuucaagaucccgaucgaggagcuggaggaccgcguguucgugaacugcaacacgagcaucaccugggucgaggggaccgugggcacccugcucuccgacaucacgcggcuggaccuggggaagcgcauccucgacccccggggcaucuaccgcugcaacgggaccgacaucuacaaggacaaggagagcaccgugcagguccacuaccggaugugccaguccugcguggagcuggaccccgccaccguggcgggcaucaucgucacggacgugaucgccacccugcuccuggcccugggcguguucugcuucgccgggcacgagaccggccgccucagcggggccgcggacacccaggcccugcugcggaacgaccaggucuaccagccccuccgcgaccgggacgacgcccaguacucccaccugggcgggaacugggcccgcaacaaguga

SEQ ID NO: 27944 - RNA, 1533 nt, Artificial Sequence
  derived and/or modified sequence opt1 from CD3EAP__Homo_sapiens__NP_036231
auggaggagccccaggccggcgacgccgcgcgcuucagcugcccgcccaacuucaccgccaagccgcccgccuccgagagcccccgguucucccuggaggcccucaccgggcccgacacggagcuguggcugauccaggcccccgcggacuucgcccccgagugcuucaacggccgccacgugccgcucagcgggucccagaucgucaagggcaagcuggccgggaagcggcaccgcuaccgggugcugagcuccugcccccaggccggcgaggcgacccuccuggcccccagcaccgaggccggcgggggccugaccugcgccuccgcgccccaggggacgcuccgcauccuggagggcccgcagcagagccuguccgggagcccccuccagcccauccccgccuccccgccgccccagaucccgcccggccugcggccccgcuucugcgccuucggcgggaacccgcccgugaccggcccccggagcgcccuggcccccaaccuccugaccuccgggaagaagaagaaggagaugcaggucaccgaggcccccgugacgcaggaggcggugaacggccacggcgcccuggaggucgacauggcccucgggagccccgagauggacgugcgcaagaagaagaagaagaagaaccagcagcugaaggagcccgaggccgccggccccguggggaccgagcccaccgucgagacccuggagccgcucggcgugcuguuccccuccacgaccaagaagcggaagaagcccaaggggaaggagaccuucgagcccgaggacaagaccgugaagcaggagcagaucaacacggagccgcuggaggacaccguccucagccccaccaagaagcgcaagcggcagaagggcaccgagggcauggagcccgaggagggggugacgguggagucccagccccaggucaagguggagccgcuggaggaggcgaucccccugccgcccaccaagaagcgcaagaaggagaagggccagauggccaugauggagcccgggaccgaggccauggagcccguggagcccgagaugaagccccucgagagcccgggcgggaccauggcgccccagcagcccgagggcgccaagccccaggcccaggccgcccuggccgcgccgaagaagaagacgaagaaggagaagcagcaggacgccaccgucgagcccgagaccgagguggugggccccgagcugcccgacgaccucgagccgcaggccgcccccaccagcacgaagaagaagaagaagaagaaggagcgggggcacaccgucaccgagcccauccagccgcuggagcccgagcugcccggcgaggggcagcccgaggcccgcgcgaccccgggcuccacgaagaagcggaagaagcagagccaggagucccgcaugcccgagaccgugccccaggaggagaugcccgggccgccccucaacagcgaguccggcgaggaggcccccaccggccgggacaagaagcgcaagcagcagcagcagcagcccguguga

SEQ ID NO: 27945 - RNA, 624 nt, Artificial Sequence
  derived and/or modified sequence opt1 from CD3E__Homo_sapiens__NP_000724
augcagagcggcacccacuggcgcgugcuggggcucugccugcuguccgucggcgugugggggcaggacggcaacgaggagaugggcgggaucacccagacgcccuacaaggugagcaucuccggcaccaccgucauccugaccugcccccaguaccccgggagcgagauccucuggcagcacaacgacaagaacaucggcggggacgaggacgacaagaacaucggcuccgacgaggaccaccugagccucaaggaguucuccgagcuggagcagagcggguacuacgugugcuacccccggggcuccaagcccgaggacgccaacuucuaccuguaccuccgcgcccgggugugcgagaacugcauggagauggacgucaugagcguggcgacgaucgugaucgucgacaucugcaucaccggcgggcugcugcuccugguguacuacugguccaagaaccgcaaggccaaggccaagccggugacccggggcgccggggccggcggccgccagcgggggcagaacaaggagcgcccgccgcccguccccaaccccgacuacgagcccauccggaagggccagcgcgaccuguacagcgggcucaaccagcggcgcaucuga

SEQ ID NO: 27946 - RNA, 549 nt, Artificial Sequence
  derived and/or modified sequence opt1 from CD3G__Homo_sapiens__NP_000064
auggagcagggcaaggggcuggccgugcucauccuggccaucauccugcuccagggcacccuggcgcagagcaucaaggggaaccaccuggucaagguguacgacuaccaggaggacggcuccgugcuccugaccugcgacgccgaggccaagaacaucacgugguucaaggacgggaagaugaucggcuuccugaccgaggacaagaagaaguggaaccucggcagcaacgccaaggacccccgcgggauguaccagugcaagggcucccagaacaagagcaagccgcugcaggucuacuaccggaugugccagaacugcaucgagcugaacgccgcgaccaucuccggguuccucuucgccgagaucgugagcaucuucgugcuggccgucggcguguacuucaucgccgggcaggacggcgugcgccagucccgggcgagcgacaagcagacccugcuccccaacgaccagcuguaccagccccugaaggaccgcgaggacgaccaguacucccaccuccagggcaaccagcugcggcgcaacuga

SEQ ID NO: 27947 - RNA, 834 nt, Artificial Sequence
  derived and/or modified sequence opt1 from CD40__Homo_sapiens__NP_001241
auggugcgccugccccuccagugcguccuguggggcugccugcucaccgccgugcacccggagccgcccaccgccugccgggagaagcaguaccugaucaacagccagugcugcucccugugccagcccgggcagaagcucgugagcgacugcacggaguucaccgagaccgagugccugcccugcggcgaguccgaguuccuggacaccuggaaccgcgagacgcacugccaccagcacaaguacugcgaccccaaccucgggcugcggguccagcagaagggcaccagcgagaccgacaccaucugcacgugcgaggagggguggcacugcaccuccgaggcgugcgagagcugcgugcugcaccgcuccugcagccccggcuucggcgugaagcagaucgccaccggggucuccgacaccaucugcgagcccugcccggugggcuucuucagcaacguguccagcgccuucgagaagugccaccccuggacguccugcgagaccaaggaccucgucgugcagcaggccgggaccaacaagaccgacguggucugcggcccccaggaccggcugcgcgcccugguggugauccccaucaucuucgggauccucuucgcgauccugcugguccucguguucaucaagaagguggccaagaagccgacgaacaaggcgccccaccccaagcaggagccccaggagaucaacuucccggacgaccugcccggcagcaacaccgccgcccccguccaggagacccugcacggcugccagcccgugacccaggaggacgggaaggagucccggaucagcgugcaggagcgccaguga

SEQ ID NO: 27948 - RNA, 786 nt, Artificial Sequence
  derived and/or modified sequence opt1 from CD40LG__Homo_sapiens__NP_000065
augaucgagaccuacaaccagaccagcccccgcuccgccgccacgggccugccgaucagcaugaagaucuucauguaccuccugaccguguuccugaucacccagaugaucggguccgcgcuguucgccgucuaccugcaccggcgccuggacaagaucgaggacgagcggaaccuccacgaggacuucguguucaugaagaccauccagcgcugcaacacgggcgagcggagccugucccugcucaacugcgaggagaucaagagccaguucgagggguucgugaaggacaucaugcugaacaaggaggagaccaagaaggagaacuccuucgagaugcagaagggcgaccagaacccccagaucgccgcccacgucaucagcgaggccuccagcaagaccaccuccgugcugcagugggcggagaagggguacuacacgaugagcaacaaccucgugacccuggagaacggcaagcagcugaccgucaagcgccagggccucuacuacaucuacgcccaggugaccuucugcuccaaccgggaggccagcucccaggcccccuucaucgcgagccugugccugaagucccccgggcgcuucgagcggauccuccugcgcgccgccaacacgcacagcuccgccaagccgugcggccagcagagcauccaccucgggggcguguucgagcuccagcccggggccagcgucuucgugaacgugaccgaccccucccaggucagccacggcaccggcuucaccuccuucgggcugcugaagcucuga

SEQ ID NO: 27949 - RNA, 2229 nt, Artificial Sequence
  derived and/or modified sequence opt1 from CD44__Homo_sapiens__NP_000601
auggacaaguucugguggcacgccgccuggggccugugccucgugccccugagccuggcgcagaucgaccucaacaucacgugccgcuucgccggggucuuccacguggagaagaacggccgguacuccaucagccgcaccgaggccgccgaccugugcaaggccuucaacuccacccugccgaccauggcgcagauggagaaggcccucagcaucggguucgagaccugccgguacggcuucaucgaggggcacguggucaucccccgcauccaccccaacuccaucugcgccgccaacaacaccggcguguacauccugacgagcaacaccucccaguacgacaccuacugcuucaacgcgagcgcgcccccggaggaggacugcaccuccgugacggaccugcccaacgccuucgacggccccaucaccaucaccaucgucaaccgggacgggacccgcuacgugcagaagggcgaguaccggacgaaccccgaggacaucuacccgagcaaccccaccgacgacgacguguccagcggguccagcuccgagcgcagcuccaccagcggcggguacaucuucuacaccuucuccacgguccaccccauccccgacgaggacagcccguggaucaccgacagcaccgaccggauccccgccaccacgcucauguccaccagcgccaccgccaccgagacggccaccaagcgccaggagaccugggacugguucuccuggcuguuccugcccagcgaguccaagaaccaccuccacaccacgacccagauggccggcaccagcuccaacaccaucagcgccggcugggagcccaacgaggagaacgaggacgagcgggaccgccaccuguccuucagcggguccggcaucgacgacgacgaggacuucaucagcuccacgaucagcaccaccccgcgggccuucgaccacaccaagcagaaccaggacuggacgcaguggaaccccucccacagcaaccccgaggugcugcuccagaccaccacccgcaugaccgacguggaccggaacgggacgaccgcguacgagggcaacuggaaccccgaggcccacccgccccugauccaccacgagcaccacgaggaggaggagacgccccacuccaccagcaccauccaggccacccccuccagcaccaccgaggagacggccacccagaaggagcagugguucggcaaccgcuggcacgagggguaccggcagaccccgaaggaggacagccacuccaccacgggcaccgccgcggccagcgcccacaccucccaccccaugcaggggcgcaccacgcccagccccgaggacuccagcuggaccgacuucuucaacccgaucucccaccccaugggccgggggcaccaggccggccgccggauggacauggacagcucccacagcaucacccugcagcccaccgccaacccgaacacgggccucgucgaggaccuggaccgcaccgggccccuguccaugaccacccagcagagcaacucccagagcuucuccacgagccacgagggccucgaggaggacaaggaccaccccaccaccuccacccugacgagcagcaaccgcaacgacgugaccgggggccggcgcgaccccaaccacuccgaggggagcaccacccugcucgagggcuacacgucccacuacccgcacaccaaggagagccggaccuucauccccgugaccuccgcgaagacgggcagcuucggggucaccgccgugaccgugggcgacuccaacagcaacgucaaccgcucccugagcggggaccaggacaccuuccaccccuccggcgggagccacaccacgcacggcuccgagagcgacggccacucccacgggagccaggagggcggggccaacaccaccuccggccccauccggaccccgcagauccccgaguggcugaucauccucgccagccugcuggcgcucgcccugauccuggccgugugcaucgccgugaacucccgccggcgcugcggccagaagaagaagcucgucaucaacagcgggaacggcgccguggaggaccggaagcccagcgggcugaacggcgaggcguccaagagccaggagauggugcaccuggucaacaaggaguccagcgagacgcccgaccaguucaugaccgccgacgagacccgcaaccuccagaacguggacaugaagaucggggucuga

SEQ ID NO: 27950 - RNA, 1179 nt, Artificial Sequence
  derived and/or modified sequence opt1 from CD46__Homo_sapiens__NP_002380
auggagcccccgggccgccgggagugccccuuccccagcuggcgcuuccccgggcugcuccuggccgccauggugcugcuccuguacuccuucagcgacgcgugcgaggagccgcccaccuucgaggccauggagcugaucggcaagcccaagcccuacuacgagaucggggagcgggucgacuacaagugcaagaagggcuacuucuacaucccgccccucgccacccacacgaucugcgaccgcaaccacaccuggcugcccguguccgacgacgccugcuaccgggagaccugccccuacauccgcgacccgcugaacgggcaggccgugcccgcgaacggcaccuacgaguucggcuaccagaugcacuucaucugcaacgagggguacuaccucaucggcgaggagauccuguacugcgagcugaaggggagcgucgccaucugguccggcaagccgcccaucugcgagaaggugcucugcacgcccccgcccaagaucaagaacgggaagcacaccuucagcgagguggaggucuucgaguaccuggacgccgugaccuacuccugcgaccccgcccccggccccgaccccuucagccugaucggcgaguccaccaucuacugcggggacaacagcguguggucccgggcggcccccgagugcaaggucgugaagugccgcuucccgguggucgagaacggcaagcagaucagcggguucggcaagaaguucuacuacaaggccacggugauguucgagugcgacaagggcuucuaccucgacggguccgacaccaucgugugcgacagcaacuccaccugggacccgcccguccccaagugccugaaggugcugccgcccagcuccaccaagccgcccgcccucagccacuccgugagcacgagcuccaccaccaagagccccgccuccagcgcguccggcccccggcccaccuacaagccgcccgucagcaacuaccccggguaccccaagcccgaggagggcauccuggacucccuggacgugugggugaucgccgucaucgugaucgccaucguggucgggguggccgucaucugcguggugcccuaccgcuaccuccagcggcgcaagaagaagggcacguaccugaccgacgagacccaccgggaggucaaguucaccagccuguga

SEQ ID NO: 27951 - RNA, 972 nt, Artificial Sequence
  derived and/or modified sequence opt1 from CD47__Homo_sapiens__NP_001768
auguggccccugguggccgcccuccugcugggcagcgcgugcugcggguccgcccagcuccuguucaacaagaccaagagcgucgaguucaccuucugcaacgacacgguggugaucccgugcuucgucaccaacauggaggcccagaacaccaccgagguguacgugaaguggaaguucaagggccgcgacaucuacacguucgacggggcccugaacaaguccaccguccccaccgacuucagcuccgccaagaucgaggugagccagcuccugaagggcgacgcgucccugaagauggacaagagcgacgccgugucccacaccgggaacuacacgugcgaggucaccgagcucacccgggagggcgagaccaucaucgagcugaaguaccgcguggugagcugguucucccccaacgagaacauccugaucgucaucuuccccaucuucgccauccuccuguucuggggccaguucgggaucaagacgcugaaguaccggagcggcgggauggacgagaagaccaucgcccuccugguggcgggccuggugaucaccgucaucgugaucgugggggccauccucuucgucccgggcgaguacucccugaagaacgccaccggccuggggcucaucgugacgagcaccggcauccugauccugcuccacuacuacguguucuccaccgccaucgggcugaccagcuucgucaucgccauccuggugauccaggugaucgcguacauccucgccgucgugggccugucccugugcaucgccgccugcauccccaugcacggcccccuccugaucagcgggcuguccauccucgcccuggcgcagcugcucggccuggucuacaugaaguucguggccagcaaccagaagacgauccagcccccgcgcaaggccguggaggagccccugaacgccuucaaggagagcaaggggaugaugaacgacgaguga

SEQ ID NO: 27952 - RNA, 732 nt, Artificial Sequence
  derived and/or modified sequence opt1 from CD48__Homo_sapiens__NP_001769
augugcagccgcggcugggacuccugccuggcccucgagcugcugcuccugccccugagccuccuggugaccuccauccaggggcaccugguccacaugaccguggugagcggcuccaacgucacgcucaacaucagcgagucccugcccgagaacuacaagcagcugaccugguucuacaccuucgaccagaagaucguggagugggacagccggaaguccaaguacuucgagagcaaguucaaggggcgcgugcggcucgacccccaguccggcgcccuguacaucagcaagguccagaaggaggacaacuccaccuacaucaugcgcgugcugaagaagacggggaacgagcaggaguggaagaucaagcuccaggugcuggaccccguccccaagccggugaucaagaucgagaagaucgaggacauggacgacaacugcuaccugaagcucagcugcgugauccccggcgaguccgucaacuacaccugguacggcgacaagcggcccuuccccaaggagcugcagaacagcgugcuggagaccacccucaugccgcacaacuacucccgcugcuacacgugccaggugagcaacuccgucagcagcaagaacgggaccgugugccuguccccgcccugcacccuggcgcggagcuucggcguggaguggaucgccuccuggcucgucgugaccgugcccacgauccuggggcugcuccugaccuga

SEQ ID NO: 27953 - RNA, 1377 nt, Artificial Sequence
  derived and/or modified sequence opt1 from CD4__Homo_sapiens__NP_000607
augaaccgcggcgugcccuuccggcaccuccuccugguccugcagcucgcccugcugccggccgcgacccaggggaagaagguggugcucggcaagaagggggacaccgucgagcugacgugcaccgccagccagaagaaguccauccaguuccacuggaagaacagcaaccagaucaagauccugggcaaccagggguccuuccucaccaagggccccagcaagcugaacgaccgcgccgacucccggcgcagccugugggaccagggcaacuucccccucaucaucaagaaccugaagaucgaggacuccgacaccuacaucugcgagguggaggaccagaaggaggaggugcagcugcucgucuucgggcugacggccaacagcgacacccaccuccugcagggccagucccugacccugacccucgagagcccgcccggguccagccccuccgugcagugccggagcccccgcggcaagaacauccagggcgggaagacgcuguccgugagccagcuggagcuccaggacuccggcaccuggaccugcaccguccugcagaaccagaagaagguggaguucaagaucgacaucgugguccuggccuuccagaaggcgagcuccaucguguacaagaaggagggggagcaggucgaguucagcuucccccucgccuucacgguggagaagcugaccggcagcggggagcugugguggcaggccgagcgggccuccagcuccaagagcuggaucaccuucgaccucaagaacaaggagguguccgugaagcgcgucacccaggacccgaagcugcagaugggcaagaagcugccccuccaccugacgcugccccaggcgcucccccaguacgccggcagcgggaaccugacccuggcccucgaggccaagaccggcaagcugcaccaggaggugaaccugguggucaugcgggccacccagcuccagaagaaccugacgugcgaggugugggggccgaccucccccaagcugaugcucagccugaagcuggagaacaaggaggcgaagguguccaagcgcgagaaggccgucugggugcucaaccccgaggccggcauguggcagugccugcugagcgacuccgggcagguccugcucgagagcaacaucaaggugcugcccaccugguccaccccggugcagcccauggcccugaucguccucggcggcguggccgggcugcugcuguucaucggccuggggaucuucuucugcgugcggugccgccaccggcgccggcaggcggagcgcaugagccagaucaagcggcugcucuccgagaagaagacgugccagugcccccaccgcuuccagaagaccugcagccccaucuga

SEQ ID NO: 27954 - RNA, 1146 nt, Artificial Sequence
  derived and/or modified sequence opt1 from CD55__Homo_sapiens__NP_000565
augaccguggcccgccccagcgucccggccgcgcugccccuccugggcgagcugccccggcuccugcugcucgugcugcugugccuccccgccguguggggcgacugcgggcugccgcccgacguccccaacgcccagcccgcccuggaggggcgcaccuccuucccggaggacacggugaucaccuacaagugcgaggagagcuucgugaagauccccggcgagaaggacuccgucaucugccucaaggggagccagugguccgacaucgaggaguucugcaaccggagcugcgaggugcccacccgccugaacuccgccagccugaagcagcccuacaucacccagaacuacuucccggugggcacggucguggaguacgagugccggcccggcuaccgccgggagcccucccucagccccaagcugaccugccugcagaaccucaagugguccaccgcgguggaguucugcaagaagaaguccugcccgaaccccggggagauccgcaacggccagaucgacguccccgggggcauccuguucggggccaccaucagcuucagcugcaacacgggcuacaagcuguucggcuccaccagcuccuucugccucaucagcggguccagcgugcaguggagcgacccccugccggagugccgggagaucuacugccccgccccgccccagaucgacaacggcaucauccagggggagcgcgaccacuacggcuaccggcaguccgugaccuacgccugcaacaagggcuucaccaugaucggggagcacagcaucuacugcacggucaacaacgacgagggcgagugguccgggcccccgcccgagugccgcggcaagagccugaccuccaaggugccgcccaccgugcagaagcccaccacggucaacgugcccaccaccgaggugagccccaccucccagaagacgaccaccaagaccacgacccccaacgcgcaggccacccggagcacccccgucucccgcacgaccaagcacuuccacgagaccacccccaacaaggggagcggcacgaccuccggcaccacccggcuccugagcgggcacacgugcuucacccugaccggccuccuggggacccuggugaccaugggccuccugacguga

SEQ ID NO: 27955 - RNA, 387 nt, Artificial Sequence
  derived and/or modified sequence opt1 from CD59__Homo_sapiens__NP_001120695
augggcauccagggcgggagcgugcuguucgggcuccugcugguccucgccguguucugccacuccggccacagccugcagugcuacaacugccccaacccgaccgccgacugcaagaccgcggugaacugcuccagcgacuucgacgccugccugaucacgaaggccgggcuccaggucuacaacaagugcuggaaguucgagcacugcaacuucaacgacgugaccacccgccugcgggagaacgagcugaccuacuacugcugcaagaaggaccucugcaacuucaacgagcagcuggagaacggcggcacgucccugagcgagaagaccgugcuccugcuggucacccccuuccucgccgccgcguggucccugcaccccuga

SEQ ID NO: 27956 - RNA, 1488 nt, Artificial Sequence
  derived and/or modified sequence opt1 from CD5__Homo_sapiens__NP_055022
augcccaugggcagccugcagccgcucgccacccuguaccugcucgggaugcugguggccuccugccugggccgccucagcugguacgaccccgacuuccaggcgcggcugacccgcuccaacagcaagugccaggggcagcuggaggucuaccucaaggacggcuggcacauggugugcucccagagcugggggcgguccagcaagcagugggaggaccccucccaggccagcaaggugugccagcgccugaacugcggcgucccccugucccucggcccguuccuggugacguacaccccgcagagcuccaucaucugcuacgggcagcugggcagcuucuccaacugcagccacucccggaacgacaugugccacagccucgggcugaccugccuggagccccagaagaccacgccgcccaccacccgcccgccgcccaccacgacccccgagcccaccgccccgccccggcuccagcugguggcccaguccggcgggcagcacugcgccggcgucguggaguucuacagcggcagccucgggggcaccaucuccuacgaggcgcaggacaagacgcaggaccuggagaacuuccugugcaacaaccugcagugcgggagcuuccucaagcaccuccccgagaccgaggccggccgcgcccaggaccccggcgagccccgggagcaccagccccugcccauccaguggaagauccagaacuccagcugcaccucccuggagcacugcuuccgcaagaucaagccccagaaguccgggcgggugcuggcccugcucugcagcggcuuccagcccaagguccagagccgccuggucgggggcuccagcaucugcgaggggaccguggaggugcggcagggcgcgcagugggccgcccugugcgacuccagcuccgcccgcagcucccuccggugggaggaggugugccgcgagcagcagugcggcagcgugaacuccuaccggguccuggacgccggggaccccacgagccgcggccuguucugcccccaccagaagcucucccagugccacgagcugugggagcggaacagcuacugcaagaagguguucgugaccugccaggaccccaaccccgcggggcuggccgccggcaccgucgccagcaucauccucgcccuggugcugcucgugguccugcugguggugugcgggccccucgcguacaagaagcuggucaagaaguuccgccagaagaagcagcggcaguggaucggcccgaccggcaugaaccagaacauguccuuccaccgcaaccacacggccaccgugcgcagccacgccgagaaccccaccgccucccacgucgacaacgaguacagccagcccccgcggaacucccaccugagcgccuaccccgcgcucgagggggcccugcaccgcuccagcaugcagcccgacaacuccagcgacuccgacuacgaccugcacggcgcccagcggcuguga

SEQ ID NO: 27957 - RNA, 1044 nt, Artificial Sequence
  derived and/or modified sequence opt1 from CD5L__Homo_sapiens__NP_005885
auggcccuccuguucagccugauccuggccaucugcacccgccccggcuuccucgcguccccgagcggggugcggcuggucggcgggcugcaccgcugcgagggccggguggagguggagcagaaggggcaguggggcaccgucugcgacgacggcugggacaucaaggacguggccgugcucugccgcgagcuggggugcggcgccgccuccgggacgcccagcggcauccuguacgagccgcccgccgagaaggagcagaagguccucauccaguccgugagcugcaccgggaccgaggacacccuggcgcagugcgagcaggaggagguguacgacugcucccacgacgaggacgccggcgccagcugcgagaaccccgaguccagcuucucccccguccccgagggcgugcggcuggccgacgggcccggccacugcaaggggcgcguggaggucaagcaccagaaccagugguacacggugugccagaccggcuggagccuccgggcggccaagguggucugccgccagcugggcugcgggcgggccgugcugacccagaagcgcugcaacaagcacgccuacggccggaagccgaucuggcucucccagaugagcugcuccgggcgcgaggccacccugcaggacugccccagcggccccugggggaagaacacgugcaaccacgacgaggacaccuggguggagugcgaggaccccuucgaccugcggcucgucggcggcgacaaccugugcuccgggcgccuggaggugcuccacaagggcgugugggggagcgucugcgacgacaacuggggcgagaaggaggaccagguggugugcaagcagcuggggugcggcaagucccugagcccgagcuuccgggaccgcaagugcuacggccccggggucggccggaucuggcucgacaacgugcgcugcuccggggaggagcagagccuggagcagugccagcaccgguucuggggcuuccacgacugcacccaccaggaggacgucgcggugaucugcuccggguga

SEQ ID NO: 27958 - RNA, 648 nt, Artificial Sequence
  derived and/or modified sequence opt1 from CD63__Homo_sapiens__NP_001244321
auggccguggagggcgggaugaagugcgucaaguuccugcucuacgugcugcugcucgccuucugcggcgcgacccccgggagccugcugccgguggucaucaucgccgugggcguguuccucuuccuggucgccuucguggggugcugcggcgccugcaaggagaacuacugccugaugaucaccuucgccaucuuccucucccugaucaugcugguggaggucgcggccgccaucgccggcuacguguuccgcgacaaggugaugagcgaguucaacaacaacuuccggcagcagauggagaacuaccccaagaacaaccacacggcguccauccucgaccgcaugcaggccgacuucaagugcugcggggccgccaacuacaccgacugggagaagauccccagcauguccaagaaccggguccccgacagcugcugcaucaacgugaccgugggcugcgggaucaacuucaacgagaaggccauccacaaggagggcugcgucgagaagaucgggggcuggcugcgcaagaacgugcugguggucgcggccgccgcccucggcaucgccuucguggaggugcuggggaucgucuucgcgugcugccuggugaaguccauccggagcggcuacgaggugauguga

SEQ ID NO: 27959 - RNA, 984 nt, Artificial Sequence
  derived and/or modified sequence opt1 from CD68__Homo_sapiens__NP_001035148
augcgccuggccgugcuguucagcggcgcccugcuggggcuccuggcggaguccaccggcaccacgagccaccggaccaccaagucccacaagaccacgacccaccgcaccaccacgaccgggaccaccagccacggccccacgaccgccacccacaacccgaccacgaccucccacgggaacgucaccgugcaccccaccagcaacuccacggccaccagccagggccccuccaccgccacccacagccccgccacgaccucccacggcaacgcgaccgugcacccgaccagcaacuccacggccaccagccccggguucaccuccagcgcccaccccgagcccccgccgcccucccccagccccucccccaccagcaaggagacgaucggcgacuacaccuggaccaacgggagccagcccugcguccaccuccaggcccagauccagauccgggugauguacaccacgcagggcgggggcgaggcguggggcaucuccgugcucaaccccaacaagaccaagguccaggggagcugcgagggcgcccacccgcaccuccugcuguccuuccccuacgggcaccugagcuucggcuucaugcaggaccugcagcagaaggugguguaccucuccuacauggccgucgaguacaacgugagcuucccccacgccgcccaguggaccuucuccgcgcagaacgccagccugcgcgaccugcaggcgccccucggccaguccuucagcugcuccaacagcuccaucauccugagcccggccgugcaccuggaccuccugucccugcggcuccaggccgcccagcugccccacaccggggucuucggccagagcuucuccugccccagcgaccgcuccauccugcucccccugaucaucgggcugauccuccugggccugcucgcccuggugcugaucgccuucugcaucauccggcgccggccgagcgccuaccaggcccucuga

SEQ ID NO: 27960 - RNA, 600 nt, Artificial Sequence
  derived and/or modified sequence opt1 from CD69__Homo_sapiens__NP_001772
augagcuccgagaacugcuucguggccgagaacagcucccugcaccccgagagcggccaggagaacgacgccaccuccccgcacuucagcacccgccacgagggguccuuccagguccccgugcucugcgcggugaugaacgucguguucaucacgauccugaucaucgcccugaucgcccucagcgugggccaguacaacugccccgggcaguacaccuucuccaugcccagcgacucccacgucagcuccugcagcgaggacugggugggcuaccagcggaagugcuacuucaucuccaccgugaagcgcagcuggaccuccgcccagaacgccugcagcgagcacggggcgacgcuggccgucaucgacuccgagaaggacaugaacuuccugaagcgguacgccggccgcgaggagcacugggugggccucaagaaggagccggggcaccccuggaaguggagcaacggcaaggaguucaacaacugguucaacgugaccgggagcgacaagugcgucuuccugaagaacaccgagguguccagcauggagugcgagaagaaccuguacuggaucugcaacaagcccuacaaguga

SEQ ID NO: 27961 - RNA, 1806 nt, Artificial Sequence
  derived and/or modified sequence opt1 from CD6__Homo_sapiens__NP_001241679
auguggcuguucuucggcaucaccgggcuccugaccgccgcccugagcggccaccccucccccgcgccgcccgaccagcucaacacgagcuccgccgagagcgagcugugggagcccggggagcgccugccggugcggcucaccaacggcuccagcuccugcagcgggaccgucgaggugcgccuggaggccuccugggagcccgccugcggcgcccugugggacagccgggcggccgaggccgugugccgcgcccucggcugcgggggcgcggaggccgccucccagcuggccccgcccacccccgagcugcccccgccgcccgccgcggggaacacgagcgucgccgccaacgccacccucgccggcgcgcccgcccugcugugcuccggggccgaguggcggcucugcgaggugguggagcacgccugccgcagcgacggccggcgcgcccgggugaccugcgcggagaaccgcgcccugcggcuggucgacggcgggggcgccugcgccgggcgcguggagaugcucgagcacggcgaguggggcuccgucugcgacgacaccugggaccuggaggacgcccacguggugugccggcagcuggggugcggcugggcgguccaggcccuccccgggcugcacuucacgcccggccgcgggcccauccaccgggaccaggugaacugcagcggcgccgaggccuaccugugggacugccccggccuccccgggcagcacuacugcggccacaaggaggacgcgggggccgugugcuccgagcaccagagcuggcgccugaccggcggggccgaccggugcgagggccaggucgaggugcacuuccgcggcguguggaacaccgucugcgacuccgagugguaccccagcgaggccaaggugcugugccagagccucgggugcggcaccgccguggagcggccgaaggggcugccccacucccugagcggccgcauguacuacuccugcaacggggaggagcucacgcugagcaacugcuccuggcgguucaacaacagcaaccugugcucccagagccucgcggcccgcguccugugcuccgccagccgcucccugcacaaccucagcacccccgaggugcccgccuccgugcagaccgucaccaucgagagcuccgugacggucaagaucgagaacaaggagagccgggagcugaugcugcucaucccguccaucgugcugggcauccugcuccugggcagccugaucuucaucgccuucauccuccugcgcaucaaggggaaguacguguucaugcugcccauccagguccaggcgcccccgcccgaggacuccgacagcggcagcgacuccgacuacgagcacuacgacuucagcgcccagccgcccguggcccucaccaccuucuacaacucccagcggcaccgcgugaccgacgaggagguccagcagagccgguuccagaugccgccccuggaggaggggcuggaggagcugcacgccucccacauccccacggccaaccccggccacugcaucaccgacccgcccagccucggcccccaguaccacccccgcuccaacagcgaguccagcaccuccagcggggaggacuacugcaacucccccaagagcaagcugccgcccuggaacccccagguguucuccagcgagcgguccagcuuccuggagcagccgcccaaccucgagcuggcgggcacccagcccgccuucagcgggucccccagcccccagcccgacuccacggacaacgacgacuacgacgacaucagcgccgccuga

SEQ ID NO: 27962 - RNA, 1080 nt, Artificial Sequence
  derived and/or modified sequence opt1 from CD72__Homo_sapiens__NP_001773
auggccgaggccaucaccuacgcggaccugcgcuucgugaaggcgccccucaagaaguccaucagcagccggcugggccaggacccgggggccgacgacgacggcgagaucaccuacgagaacguccaggugcccgccgugcuggggguccccuccagccucgccuccagcgugcugggcgacaaggccgccgugaaguccgagcagcccacggccagcuggcgcgccgucaccuccccggcgguggggcggauccugcccugccgcacgaccugccuccgguaccugcugcucggccugcugcugaccugccuccugcucggcgugaccgccaucugccuggggguccgcuaccuccaggugagccagcagcugcagcagaccaaccgggugcuggaggucaccaacuccagccugcgccagcagcuccggcugaagaucacgcagcugggccaguccgccgaggaccuccaggggagccgccgggagcuggcccagucccaggaggcccuccagguggagcagcgcgcgcaccaggccgccgagggccagcugcaggccugccaggccgaccggcagaagaccaaggagacccugcagagcgaggagcagcagcgccgggcgcuggagcagaagcucuccaacauggagaaccgccugaagcccuucuucacgugcgggagcgccgacacgugcugccccuccggcuggaucaugcaccagaaguccugcuucuacaucagccugaccagcaagaacuggcaggagagccagaagcagugcgagacccucuccagcaagcuggccaccuucuccgagaucuacccgcagagccacuccuacuacuuccugaacagccuccugcccaacggcggguccggcaacagcuacuggaccgggcuguccagcaacaaggacuggaagcucaccgacgacacccagcggacccgcacguacgcccaguccagcaagugcaacaaggugcacaagaccugguccugguggacccuggagagcgaguccugccggagcucccugcccuacaucugcgagaugaccgccuuccgcuuccccgacuga

SEQ ID NO: 27963 - RNA, 483 nt, Artificial Sequence
  derived and/or modified sequence opt1 from CD74__Homo_sapiens__NP_001020329
augcaccgccggcgcagccgguccugccgcgaggaccagaagcccgugauggacgaccagcgggaccugaucagcaacaacgagcagcucccgaugcugggccgccggcccggggcccccgaguccaagugcagccgcggcgcccuguacaccggguucuccauccucgucacccugcugcucgcgggccaggccacgaccgccuacuuccuguaccagcagcaggggcggcuggacaagcucaccgugaccagccagaaccugcagcuggagaaccuccgcaugaagcugcccaagccgcccaagcccguguccaagaugcggauggccacgccccugcucaugcaggcccugccgaugggcgcgcugccccagggccccaugcagaacgccaccaaguacgggaacaugaccgaggaccacgucaugcaccuccugcagagccacuggaacuggcgcacccggcugcucggcuggguguga

SEQ ID NO: 27964 - RNA, 681 nt, Artificial Sequence
  derived and/or modified sequence opt1 from CD79A__Homo_sapiens__NP_001774
augcccggcgggccgggcgugcugcaggcccuccccgccaccaucuuccugcuguuccuccugagcgcggucuaccuggggcccggcugccaggcccucuggaugcacaaggugcccgccucccugauggugagccugggggaggacgcccacuuccagugcccgcacaacuccagcaacaacgccaacgucaccugguggcgcgugcuccacggcaacuacacguggccgcccgaguuccugggccccggggaggaccccaacggcacccugaucauccagaacgugaacaagucccacgggggcaucuacgucugccgggugcaggaggggaacgagagcuaccagcaguccugcggcaccuaccuccgcgugcggcagcccccgccccgccccuuccuggacaugggcgaggggaccaagaaccggaucaucacggcggagggcaucauccugcuguucugcgccgucgugcccgggacccugcuccucuuccgcaagcgguggcagaacgagaagcugggccuggacgccggcgacgaguacgaggacgagaaccucuacgaggggcugaaccuggacgacugcagcauguacgaggacaucucccgcggccuccaggggaccuaccaggacgugggcagccugaacaucggggacguccagcuggagaagcccuga

SEQ ID NO: 27965 - RNA, 690 nt, Artificial Sequence
  derived and/or modified sequence opt1 from CD79B__Homo_sapiens__NP_000617
auggcccgccuggcccucagccccgugccgucccacuggauggucgcgcugcugcuccugcugagcgccgagcccgugcccgccgcccgguccgaggaccgcuaccggaaccccaagggcagcgccugcucccgcaucuggcagagcccgcgguucaucgcgcgcaagcggggguucaccgugaagaugcacugcuacaugaacuccgccagcggcaacgucuccuggcucuggaagcaggagauggacgagaacccccagcagcugaagcuggagaaggggcgcauggaggagagccagaacgagucccucgccacccugacgauccagggcauccgguucgaggacaacgggaucuacuucugccagcagaagugcaacaacaccagcgagguguaccagggcugcggcaccgagcugcgcgugaugggguucuccacccucgcccagcugaagcagcggaacacgcugaaggacggcaucaucaugauccagacccuccugaucauccuguucaucaucguccccaucuuccuccugcuggacaaggacgacagcaaggcggggauggaggaggaccacaccuacgagggccucgacaucgaccagaccgccacguacgaggacaucgugacccugcgcaccggggaggugaagugguccgucggcgagcaccccggccaggaguga

SEQ ID NO: 27966 - RNA, 723 nt, Artificial Sequence
  derived and/or modified sequence opt1 from CD7__Homo_sapiens__NP_006128
auggccgggcccccgcgccugcuccugcugccccuccugcuggcccucgcgcggggccugcccggcgcccuggccgcccaggaggugcagcagagcccccacugcaccaccgucccggugggggccuccgugaacaucacgugcagcaccuccggcgggcuccgcggcaucuaccugcggcagcugggcccccagccccaggacaucaucuacuacgaggacggggucgugcccaccaccgaccgccgguuccgcggccggaucgacuucagcgggucccaggacaaccucacgaucaccaugcaccgccugcagcugagcgacaccggcaccuacacgugccaggcgaucaccgaggugaacgucuacggguccggcacccucgugcuggugaccgaggagcagagccagggcuggcaccggugcuccgacgccccgccccgcgccagcgcccugcccgcgcccccgacgggguccgcccuccccgacccccagaccgccagcgcccugcccgacccgcccgccgcguccgcccugcccgccgcccucgccgucaucagcuuccugcugggccucgggcugggcguggcgugcgugcuggcccggacccagaucaagaagcucugcuccuggcgcgacaagaacagcgccgccugcgucguguacgaggacaugucccacagccggugcaacacccuguccagccccaaccaguaccaguga

SEQ ID NO: 27967 - RNA, 867 nt, Artificial Sequence
  derived and/or modified sequence opt1 from CD80__Homo_sapiens__NP_005182
augggccacacccgccggcaggggaccagccccuccaagugcccguaccugaacuucuuccagcuccuggugcuggccggccucagccacuucugcuccggggucauccacgugacgaaggaggugaaggaggucgccacccugagcugcggccacaacguguccguggaggagcuggcccagacccgcaucuacuggcagaaggagaagaagaugguccucaccaugaugagcggggacaugaacaucuggcccgaguacaagaaccggacgaucuucgacaucaccaacaaccuguccaucgugauccuggcccuccgccccagcgacgagggcaccuacgagugcgugguccugaaguacgagaaggacgccuucaagcgggagcaccuggccgaggugacccucuccgugaaggccgacuuccccacgccgagcaucuccgacuucgagauccccaccagcaacauccgccggaucaucugcuccaccagcggcggguuccccgagccccaccuguccuggcuggagaacggcgaggagcucaacgcgaucaacaccacggucagccaggacccggagaccgagcuguacgccguguccagcaagcuggacuucaacaugaccaccaaccacuccuucaugugccucaucaaguacgggcaccuccgcgugaaccagacguucaacuggaacaccaccaagcaggagcacuuccccgacaaccugcugcccagcugggccaucacccugaucagcgucaacggcaucuucgugaucugcugccugacguacugcuucgcgccccggugccgcgagcggcgccggaacgagcgccuccggcgcgaguccgugcggccggucuga

SEQ ID NO: 27968 - RNA, 711 nt, Artificial Sequence
  derived and/or modified sequence opt1 from CD81__Homo_sapiens__NP_004347
augggcguggaggggugcaccaagugcaucaaguaccuccuguucgucuucaacuucguguucuggcuggccggcggggugauccugggcgucgcccucuggcugcgccacgacccccagaccacgaaccugcucuaccuggagcugggggacaagccggcgcccaacaccuucuacgugggcaucuacauccucaucgccgugggcgccgucaugauguucgugggguuccugggcugcuacggggccauccaggagagccagugccugcucggcaccuucuucacgugccuggugauccuguucgccugcgaggucgcggccgggaucuggggcuucgugaacaaggaccagaucgccaaggacgugaagcaguucuacgaccaggcccuccagcaggcggucguggacgacgacgccaacaacgccaaggccguggucaagaccuuccacgagacccuggacugcugcggcuccagcacccugaccgcccucacgaccuccgugcugaagaacaaccugugccccagcggguccaacaucaucagcaaccucuucaaggaggacugccaccagaagaucgacgaccuguucuccggcaagcuguaccucaucgggaucgcggccaucguggucgccgugaucaugaucuucgagaugauccugagcauggugcugugcugcggcauccggaacuccagcgucuacuga

SEQ ID NO: 27969 - RNA, 729 nt, Artificial Sequence
  derived and/or modified sequence opt1 from CD82__Homo_sapiens__NP_001020015
augggcagcgccugcaucaaggugaccaaguacuuccuguuccucuucaaccugaucuucuucauccugggggccgucauccucggcuucgggguguggauccuggcggacaaguccagcuucaucuccgugcugcagaccagcuccagcucccuccgcaugggcgccuacgucuucaucggggugggcgccgugacgaugcugaugggcuuccuggggugcaucggcgccgucaacgaggugcggugccuccuggggcugcucaagcaggagaugggcgggaucgugaccgagcugauccgcgacuacaacagcucccgggaggacagccugcaggacgccugggacuacguccaggcccaggugaagugcugcggcuggguguccuucuacaacuggaccgacaacgcggagcucaugaaccgccccgaggucaccuacccgugcagcugcgaggugaagggcgaggaggacaacucccugagcgugcggaagggguucugcgaggcccccggcaaccgcacgcaguccgggaaccaccccgaggacuggcccgucuaccaggagggcugcauggagaaggugcaggccuggcugcaggagaaccucggcaucauccugggggugggcgucgggguggcgaucaucgagcugcucggcauggugcugagcaucugccugugccggcacguccacuccgaggacuacagcaaggugccgaaguacuga

SEQ ID NO: 27970 - RNA, 618 nt, Artificial Sequence
  derived and/or modified sequence opt1 from CD83__Homo_sapiens__NP_004224
augagccgcggccugcagcuccugcugcucuccugcgccuacagccuggcccccgcgaccccggaggugaaggucgccugcuccgaggacguggaccugcccugcaccgcccccugggacccccaggugccguacaccgucagcugggugaagcuccuggagggcggggaggagcggauggagacgccccaggaggaccaccuccgcgggcagcacuaccaccagaagggccagaacggguccuucgacgcccccaacgagcggcccuacagccugaagauccgcaacaccaccuccugcaacagcggcaccuaccggugcacccugcaggacccggacggccagcgcaaccuguccgggaaggugauccuccgggucaccggcugccccgcccagcgcaaggaggagaccuucaagaaguaccgggcggagaucgugcugcugcucgcccuggugaucuucuaccugacgcucaucaucuucacgugcaaguucgcccgccugcagagcaucuuccccgacuucuccaaggccgggauggagcgggcguuccugcccgucaccagcccgaacaagcaccucggccuggugacgccccacaagaccgagcugguguga

SEQ ID NO: 27971 - RNA, 1038 nt, Artificial Sequence
  derived and/or modified sequence opt1 from CD84__Homo_sapiens__NP_001171808
auggcccagcaccaccuguggauccuccugcugugccuccagaccuggcccgaggccgcgggcaaggacagcgagaucuucaccgugaacgggauccugggcgaguccgucacguucccggugaacauccaggagccccgccaggugaagaucaucgccuggaccagcaagaccuccgucgccuacgugacccccggggacagcgagacggcccccguggucaccgugacccaccggaacuacuacgagcgcauccacgcccugggcccgaacuacaaccucgugaucuccgaccugcggauggaggacgcgggggacuacaaggccgacaucaacacccaggccgaccccuacacgaccaccaagcgcuacaaccugcagaucuaccggcgccucggcaagcccaagaucacccagagccugauggccuccgucaacagcacgugcaacgugacccugaccugcuccguggagaaggaggagaagaacgucaccuacaacuggagcccccucggcgaggaggggaacgugcugcagaucuuccagacgccggaggaccaggagcugaccuacacgugcaccgcgcagaaccccguguccaacaacagcgacuccaucagcgcccggcagcucugcgccgacaucgccaugggcuuccgcacccaccacaccgggcugcuguccguccucgccauguucuuccugcuggugcucauccugagcuccguguuccuguuccgccucuucaagcggcggcagggccgcaucuuccccgaggggagcugccugaacaccuucaccaagaaccccuacgcggccuccaagaagacgaucuacaccuacaucauggccagccggaacacccagccggccgagagccgcaucuacgacgagauccugcaguccaagguccuccccagcaaggaggagcccgugaacaccguguacuccgagguccaguucgccgacaagaugggcaaggcgagcacgcaggacuccaagcccccgggcaccagcuccuacgagaucgugaucuga

SEQ ID NO: 27972 - RNA, 654 nt, Artificial Sequence
  derived and/or modified sequence opt1 from CD86__Homo_sapiens__NP_001193853
auggacccccagugcaccaugggccugagcaacauccucuucgugauggccuuccugcuguccgccaacuucagccagccggagaucguccccaucuccaacaucaccgagaacguguacaucaaccugaccugcagcuccauccacggguaccccgagcccaagaagaugagcgugcuccugcgcaccaagaacuccaccaucgaguacgacggcaucaugcagaagucccaggacaacgucaccgagcucuacgacgugagcaucagccuguccgugagcuucccggacgucacguccaacaugaccaucuucugcauccuggagaccgacaagacccggcuccugagcucccccuucagcaucgagcuggaggacccccagcccccgcccgaccacauccccuggaucacggcggugcuccccaccgugaucaucugcgucaugguguucugccugauccuguggaaguggaagaagaagaagcgcccgcggaacuccuacaagugcgggaccaacaccauggagcgcgaggagagcgagcagacgaagaagcgggagaagauccacauccccgagcgcuccgacgaggcccagcggguguucaagagcagcaagaccuccagcugcgacaaguccgacacgugcuucuga

SEQ ID NO: 27973 - RNA, 708 nt, Artificial Sequence
  derived and/or modified sequence opt1 from CD8A__Homo_sapiens__NP_001759
auggcccugcccgugaccgcccuccugcugccgcucgcgcugcugcuccacgccgcccgccccagccaguuccgggucagcccccuggaccgcaccuggaaccugggcgagacgguggagcucaagugccaggugcugcugagcaaccccaccuccgggugcagcuggcuguuccagccgcggggcgccgccgcgucccccaccuuccuccuguaccucagccagaacaagcccaaggccgccgaggggcuggacacccagcgcuucuccggcaagcggcugggggacacguucguccucacccugagcgacuuccgccgggagaacgagggcuacuacuucugcuccgcccugagcaacuccaucauguacuucagccacuucgugcccguguuccucccggcgaagcccaccaccacgcccgcgccccgcccgcccacccccgcccccaccaucgccucccagccgcugagccugcggcccgaggccugccgccccgccgccggcggggccguccacacccggggccucgacuucgccugcgacaucuacaucugggcgccccuggccgggacgugcggcgugcugcuccugucccuggugaucacccucuacugcaaccaccgcaaccggcgccgggucugcaagugcccgcgccccguggugaaguccggggacaagcccucccugagcgcccgguacgucuga

SEQ ID NO: 27974 - RNA, 597 nt, Artificial Sequence
  derived and/or modified sequence opt1 from CD8B__Homo_sapiens__NP_001171571
augcgcccccggcuguggcuccugcuggccgcccagcucaccgugcugcacggcaacagcguccugcagcagaccccggcguacaucaaggugcagacgaacaagauggugaugcucuccugcgaggccaagaucagccuguccaacaugcgcaucuacuggcugcggcagcgccaggcccccagcuccgacagccaccacgaguuccucgcccugugggacuccgccaaggggaccauccacggcgaggaggucgagcaggagaagaucgcgguguuccgggacgccagccgcuucauccugaaccucaccuccgugaagcccgaggacagcgggaucuacuucugcaugaucgucggcucccccgagcugaccuucgggaagggcacgcagcugagcgugguggacuuccucccgaccaccgcccagcccaccaagaaguccacgcugaagaagcgggucugccgccugccccggcccgagacccagaagggccucaaggggaagguguaccaggagccgcugagccccaacgccugcauggacaccaccgcgauccugcagccccaccgcuccugccucacgcacggcagcuga

SEQ ID NO: 27975 - RNA, 1959 nt, Artificial Sequence
  derived and/or modified sequence opt1 from CD93__Homo_sapiens__NP_036204
auggccaccagcaugggccugcuccugcugcuccugcugcuccugacccagcccggggccggcacgggggcggacaccgaggccguggucugcgugggcaccgccugcuacaccgcccacuccgggaagcugagcgccgcggaggcccagaaccacugcaaccagaacggcggcaaccucgccacggugaaguccaaggaggaggcccagcacguccagcgcgugcuggcgcagcugcuccggcgcgaggccgcccugaccgcccggaugagcaaguucuggaucgggcugcagcgcgagaagggcaagugccucgacccgucccugccccugaagggguucagcugggugggcgggggcgaggacacccccuacuccaacuggcacaaggagcuccggaacagcugcaucuccaagcgcugcgucagccugcugcucgaccugucccagccccugcucccgagccggcugcccaagugguccgagggccccugcgggagccccggcuccccggggagcaacaucgagggcuucgugugcaaguucuccuucaagggcaugugccgcccccuggcccucgggggccccggccaggugaccuacacgacccccuuccagaccaccagcuccagccuggaggcggucccguucgccagcgccgccaacguggccugcggggagggggacaaggacgagacgcagucccacuacuuccugugcaaggagaaggcgcccgacguguucgacuggggcagcuccggcccccucugcgucagccccaaguacgggugcaacuucaacaacggcgggugccaccaggacugcuucgagggcggggacggcuccuuccugugcggcugccggccgggguuccgccugcucgacgaccuggugaccugcgccagccggaaccccugcuccagcucccccugccgcggcggggcgaccugcgugcugggcccccacgggaagaacuacacgugccggugcccgcagggcuaccagcucgacagcucccagcuggacugcgucgacguggacgagugccaggacagccccugcgcccaggagugcgugaacacccccggcggguuccgcugcgagugcugggucggcuacgagcccgggggcccgggcgagggggccugccaggacguggacgagugcgcccugggccggucccccugcgcccaggggugcaccaacaccgacggcagcuuccacugcuccugcgaggagggguacgugcucgccggcgaggacggcacccagugccaggacgucgacgagugcguggggcccggcgggccccugugcgacagccugugcuucaacacgcagggcuccuuccacugcgggugccucccgggcugggugcuggcccccaacggcgucagcugcaccauggggcccgugucccugggcccgcccagcgggccgcccgacgaggaggacaagggcgagaaggaggggagcaccgucccccgcgccgcgaccgccucccccacgcggggccccgagggcacccccaaggccaccccgaccacgagccgccccucccucagcuccgacgcccccaucaccagcgcgccccugaagaugcuggccccguccgggagccccggcguguggcgggagcccuccauccaccacgccaccgccgccagcgggccccaggagccggcgggcggggacuccagcguggccacccagaacaacgacggcacggacggccagaagcuccugcuguucuacauccuggggaccgucguggccauccuccugcugcucgcccuggcccugggccuccugguguaccgcaagcggcgcgcgaagcgcgaggagaagaaggagaagaagccccagaacgccgccgacuccuacagcuggguccccgagcgggccgagucccgcgccauggagaaccaguacagccccaccccggggaccgacugcuga

SEQ ID NO: 27976 - RNA, 1710 nt, Artificial Sequence
  derived and/or modified sequence opt1 from CD96__Homo_sapiens__NP_005807
auggagaagaaguggaaguacugcgccguguacuacaucauccagauccacuucgucaagggcgugugggagaagaccgugaacaccgaggagaacgucuacgccacccuggggagcgacgugaaccugaccugccagacccagaccgugggcuucuucguccagaugcagugguccaaggugacgaacaagaucgaccugaucgcgguguaccacccccaguacggguucuacugcgccuacggccgcccgugcgagagccuggucaccuucaccgagacccccgagaacggguccaaguggacgcuccaccuccgcaacaugagcugcuccgugagcggccgcuacgagugcaugcuggugcucuaccccgagggcauccagaccaagaucuacaaccugcugauccagacccacgucaccgccgacgaguggaacuccaaccacacgaucgagaucgagaucaaccagacccucgagauccccugcuuccagaacagcuccagcaagaucuccagcgaguucaccuacgccugguccguggaggacaacgggacccaggagacgcugaucagccagaaccaccugaucuccaacagcacccuccugaaggaccgggugaagcugggcaccgacuaccgccuccaccuguccccgguccagaucuucgacgacgggcggaaguucagcugccacauccgcgugggccccaacaagauccugcgguccagcaccacggugaaggucuucgccaagcccgagauccccgugaucguggagaacaacagcaccgacguccucguggagcgccgguucacgugccugcugaagaacguguucccgaaggcgaacaucaccugguucaucgacggguccuuccuccacgacgagaaggagggcaucuacaucaccaacgaggagcgcaagggcaaggacggguuccuggagcucaagagcguccugacccgggugcacuccaacaagcccgcccagagcgacaaccugaccaucuggugcauggcccugucccccguccccggcaacaagguguggaacaucagcuccgagaagaucaccuuccuccuggggagcgagaucuccagcacggacccgccccuguccgugaccgagagcacccucgacacccagcccucccccgccagcuccgucagcccggcgcgcuaccccgccacguccagcgugacccugguggacgucuccgcccugcggcccaacaccacgccccagccgagcaacagcuccaugaccacccgcggcuucaacuaccccuggaccagcuccggcaccgacaccaagaaguccgugagccggauccccagcgagacguacuccagcucccccagcggggccggcuccacccuccacgacaacguguucaccagcaccgcccgcgcguucuccgaggucccgacgaccgccaacgggagcaccaagaccaaccacgugcacaucacgggcaucguggucaacaagcccaaggacgggauguccuggcccgugaucguggccgcccugcuguucugcugcaugauccucuucggccugggcguccggaaguggugccaguaccagaaggagaucauggagcggcccccgcccuucaagcccccgcccccgcccaucaaguacacgugcauccaggagcccaacgagagcgaccugcccuaccacgagauggagacccucuga

SEQ ID NO: 27977 - RNA, 510 nt, Artificial Sequence
  derived and/or modified sequence opt1 from CD99__Homo_sapiens__NP_001116370
auggcccgcggcgccgcgcuggcccuccugcuguucgggcuccugggcgugcuggucgccgcccccgacgggggcuucgaccucagcgacgcccugccgggggacgacuucgaccugggcgacgcggugguggacggcgagaacgacgacccccggccgcccaacccgcccaagcccaugcccaaccccaaccccaaccaccccuccagcuccgggagcuucuccgacgccgaccucgccgacggcgucagcgggggcgaggggaagggcggcuccgacgggggcgggagccaccgcaaggagggcgaggaggccgacgcgcccggcgugaucccggggaucgugggcgccgucgugguggccgucgccggggccaucuccagcuucaucgcguaccagaagaagaagcugugcuucaaggagaacgccgagcagggcgagguggacauggagucccaccggaacgccaacgccgagcccgccgugcagcgcacccugcucgagaaguga

SEQ ID NO: 27978 - RNA, 687 nt, Artificial Sequence
  derived and/or modified sequence opt1 from CD9__Homo_sapiens__NP_001760
augcccgugaagggcgggaccaagugcaucaaguaccuccuguucggcuucaacuucaucuucuggcuggccgggaucgccguccuggcgaucggccucuggcugcgcuucgacagccagaccaaguccaucuucgagcaggagacgaacaacaacaacagcuccuucuacaccgggguguacauccugaucggcgccggcgcccucaugaugcuggugggguuccugggcugcugcggggccguccaggagagccagugcaugcucggccuguucuucggguuccugcucgugaucuucgccaucgagaucgcggccgccaucuggggcuacucccacaaggacgaggugaucaaggagguccaggaguucuacaaggacaccuacaacaagcugaagaccaaggacgagccgcagcgggagacgcugaaggccauccacuacgcgcucaacugcugcggccuggccgggggcguggagcaguucaucagcgacaucugccccaagaaggacgugcuggagaccuucaccgucaaguccugccccgacgccaucaaggagguguucgacaacaaguuccacaucaucggggccgugggcaucggcaucgccgucgugaugaucuucgggaugaucuucagcaugauccucugcugcgcgauccgccggaaccgcgagaugguguga

SEQ ID NO: 27979 - RNA, 1476 nt, Artificial Sequence
  derived and/or modified sequence opt1 from CDADC1__Homo_sapiens__NP_001180407
augaaggaggccggccagaugcagaaccuggagagcgcccgcgcggggcgguccgugagcacccagaccggcuccaugacggggcagaucccccgccucagcaaggucaaccuguucacccugcucucccuguggauggagcuguucccggccgaggcccagcggcagaagucccagaagaacgaggagggcaagcacgggccccucggcgacaacgaggagcgcacccgggugagcaccgacaagcgccaggugaagcggacgggccuggucguggugaagaacaugaagaucgucgggcugcacugcagcuccgaggaccuccacgccggccagaucgcccugaucaagcacgggagccgccugaagaacugcgaccucuacuucucccggaagcccugcagcgcgugccugaagaugaucgugaacgccggcgugaaccgcaucuccuacuggcccgccgacccggagaucagccugcucaccgaggccuccagcuccgaggacgcgaagcuggacgccaaggccgucgagcggcucaagagcaacucccgcgcccacgugugcgugcugcugcagccccuggucugcuacauggugcaguucguggaggagaccagcuacaagugcgacuucauccagaagaucaccaagacgcuccccgacgccaacaccgacuucuacuacgagugcaagcaggagcggaucaaggaguacgagaugcuguuccuggucagcaacgaggagaugcacaagcagauccucaugaccaucgggcuggagaaccugugcgagaaccccuacuucuccaaccuccgccagaacaugaaggaccugauccugcuccuggcgaccguggccagcuccgugccgaacuucaagcacuucggcuucuaccggagcaaccccgagcagaucaacgagauccacaaccagucccugccccaggagaucgcccgccacugcaugguccaggcccggcuccuggccuaccgcacggaggaccacaagaccggcgugggggcggugaucugggccgagggcaagagccgguccugcgacgggaccggcgccauguacuucgucggcugcggguacaacgccuuccccgugggcagcgaguacgccgacuucccgcacauggacgacaagcagaaggaccgcgagauccggaaguuccgcuacaucauccacgcggagcagaacgcccugaccuuccgcugccaggagaucaagcccgaggagcgguccaugaucuucgugacgaagugccccugcgacgagugcgucccccucaucaagggggccggcaucaagcagaucuacgccggggacguggacgucggcaagaagaaggccgacaucagcuacaugcgcuucggcgagcuggaggggguguccaaguucaccuggcagcugaacccgagcggcgcguacgggcucgagcagaacgagcccgagcggcgcgaguccuga

SEQ ID NO: 27980 - RNA, 3684 nt, Artificial Sequence
  derived and/or modified sequence opt1 from CDAN1__Homo_sapiens__NP_612486
auggccgccgugcuggagagccuccugcgcgaggaggucuccguggcggccgugguccgguggaucgcccgcagcacccagggcuccgaggacaacgccggggaggccgcggcccugagcucccuccgggcccugcgcaaggaguucgugcccuuccugcucaacuuccugcgggagcagagcucccgcgugcugccgcagggcccccccacccccgccaagacgccgggggcgagcgccgcccuccccggccggcccgggggccccccgcgcggcucccggggggcccgcagccagcuguucccccccaccgaggcccaguccaccgcggccgaggccccccuggcccggcgcggcgggcggcgccggggcccggggcccgcccgcgagcggggcggccgcgggcucgaggagggcgucagcggggagucccugcccggcgcgggcgggcggcgccugcggggcagcgggucccccagccgcccgucccucacccugagcgacccccccaaccuguccaaccucgaggaguuccccccggugggcagcgugccccccgggcccacgggcaccaagccgagccgccggaucaaccccacccccgucuccgaggagcgcagccuguccaagcccaagaccugcuucacgagcccgcccaucuccugcgugcccagcucccagccgagcgcccuggacaccucccccuggggccucgggcugccccccggcugccggagccugcaggaggagcgcgagaugcuccggaaggagcgcuccaagcagcugcagcagagcccgacccccaccugccccacgcccgagcugggguccccgcuccccagccggaccggcucccugaccgacgagcccgccgaccccgcccgcgugagcucccggcagcgccuggagcucgucgcccugguguacagcuccugcaucgcggagaaccuggugccgaaccucuuccuggagcuguucuucgucuuccagcuccugaccgcccggcgcauggugacggccaaggacagcgaccccgagcugagccccgccgugcucgacucccuggagagcccccuguuccaguccauccacgacugcgucuucuucgccgugcaggugcucgagugccacuuccagguccugagcaaccuggacaaggggacccucaagcugcuggcggagaacgagcggcuccugugcuucuccccggcccugcagggccgccugcgggccgccuacgagggcagcguggcgaaggugucccucgucaugccccccagcacccaggccguguccuuccagcccgagaccgacaaccgcgccaacuucagcuccgaccgggccuuccacacguucaagaagcagcgcgacgucuucuacgaggugcugcgggagugggaggaccaccacgaggagccggggugggacuucgagaagggccuggggagccgcauccgcgccaugaugggccagcucuccgcggccugcagccacucccacuucgugcggcuguuccagaagcagcugcuccagaugugccagagccccgggggcgccggcgggaccguccugggcgaggcccccgacgugcuguccaugcucggggccgacaagcugggccgccuguggcggcuccaggagcgccugauggcgccccagagcagcggcgggccgugcccccccccgaccuuccccggcugccagggguucuuccgggacuucauccuguccgccagcuccuuccaguucaaccagcaccucauggacagccugucccugaagauccaggagcucaacggccuggcccugccccagcacgagcccaacgacgaggacggggagagcgacguggacuggcagggcgagcgcaagcaguucgccgucgugcuccugucccugcggcuccuggccaaguuccugggcuucguggcguuccucccguaccgcgggcccgagccccccccgaccggcgagcugcaggacagcauccuggcccuccggucccaggucccccccgugcuggacgugcgcacgcugcuccagcgggggcugcaggcccgccgggccguccugaccgugcccuggcucguggaguuccugagcuucgcggaccacgucgugccgcugcucgaguacuaccgcgacaucuucacccugcugcuccggcugcaccgcucccuggugcucagccaggaguccgagggcaagaugugcuuccugaacaagcugcuccugcuggccguccucggguggcuguuccagauccccaccgugcccgaggaccuguucuuccucgaggagggccccagcuacgccuucgagguggacacggucgccccggagcacggccuggacaacgcccccgugguggaccagcagcugcucuacaccugcugccccuacaucggggagcugcggaagcugcucgcguccugggucagcggcuccagcgggcgcuccggcggguucaugcggaagaucacccccaccacgaccaccagccugggcgcccagccgagccagaccucccagggccugcaggcccagcucgcccaggccuucuuccacaaccagccccccagccugcgccggacgguggaguucguggcggagcgcaucggguccaacugcgucaagcacaucaaggccacccugguggccgaccucgugcgccaggccgagagccugcugcaggagcagcucgucacccagggcgaggaggggggcgaccccgcccagcugcuggagauccucugcucccagcugugcccgcacggggcgcaggcccuggcccucggccgggaguucugccagcgcaagagccccggcgccgugcgggcgcugcugcccgaggagacccccgccgccgugcucuccagcgccgagaacaucgccgucgggcuggcgaccgagaaggccugcgccuggcuguccgccaacaucacggcccucauccgccgggaggugaaggcggccgugagccgcacccugcgggcccagggcccggagcccgccgcccgcggggagcggcgcggcugcucccgggcgugcgagcaccacgccccccugccgagccaccucaucuccgagaucaaggacguccugagccuggccgugggcccccgcgaccccgacgagggggugucccccgagcaccucgagcagcugcugggccagcucgggcagacccugcggugccgccaguuccugugcccgcccgccgagcagcaccucgccaagugcagcgucgagcuggcgucccugcugguggccgaccagauccccauccucggccccccggcccaguaccggcuggagcgcgggcaggcccggcgccugcuccacaugcugcugagccucuggaaggaggacuuccagggccccgugccccugcagcugcuccuguccccccggaacgucggccugcucgcggacacccgcccgcgcgagugggaccugcugcucuuccugcugcgggagcucguggagaaggggcugaugggccgcauggagaucgaggccugccuggggagccuccaccaggcccaguggcccggcgacuucgccgaggagcuggccacgcugagcaaccucuuccuggcggagccccaccugcccgagccgcagcuccgggccugcgagcuggugcagcccaaccgcgggaccguccuggcccaguccuga

SEQ ID NO: 27981 - RNA, 1011 nt, Artificial Sequence
  derived and/or modified sequence opt1 from CDC123__Homo_sapiens__NP_006014
augaagaaggagcacgugcugcacugccaguucagcgccugguaccccuucuuccgcggcgucaccaucaaguccgugauccucccgcugccccagaacgugaaggacuaccugcucgacgacgggacccuggucgugagcggccgggacgacccgcccacgcacucccagcccgacagcgacgacgaggccgaggagauccagugguccgacgacgagaacaccgcgacccugaccgcccccgaguuccccgaguucgccacgaaggugcaggaggccaucaacagccucgggggcuccgucuuccccaagcugaacuggagcgccccgcgcgacgcguacuggaucgccaugaacuccagccugaagugcaagacccucuccgacaucuuccugcuguucaagagcuccgacuucaucacccgggacuucacccagcccuucauccacugcacggacgacagccccgaccccugcaucgaguacgagcucgugcugcgcaaguggugcgagcugaucccgggggccgaguuccggugcuucgugaaggagaacaagcucaucggcaucucccagcgcgacuacacccaguacuacgaccacaucagcaagcagaaggaggagauccggcgcugcauccaggacuucuucaagaagcacauccaguacaaguuccuggacgaggacuucgucuucgacaucuaccgggacucccgcggcaagguguggcugaucgacuucaaccccuucggggaggugaccgacagccuccuguucaccugggaggagcugaucuccgagaacaaccucaacggcgacuucagcgaggucgacgcccaggagcaggacagccccgcguuccggugcacgaacuccgaggugaccgugcagcccagcccguaccuguccuaccgccugcccaaggacuucgucgaccucagcaccggggaggacgcccacaagcugaucgacuuccugaagcucaagcggaaccagcaggaggacgacuga

SEQ ID NO: 27982 - RNA, 1836 nt, Artificial Sequence
  derived and/or modified sequence opt1 from CDC14A__Homo_sapiens__XP_011540643
auggacuucccccugggccagugccgccucgugugcagcucccuguacauguggcuggccaagcgggaggacggggccgcgauccucaacaugccgagccccuccuucuacgccgacuucggcccccugaaccuggccauggucuaccgcuacugcugcaagcucaacaagaagcucaagagcuacucccugagccggaagaagaucgugcacuacacgugcuucgaccagcgcaagcgggccaacgccgcguuccugaucggggccuacgccgugaucuaccugaagaagacccccgaggaggccuaccgcgcgcugcucuccggcagcaacccgcccuaccugcccuuccgggacgccuccuucgggaacugcaccuacaaccugaccauccucgacugccugcagggcauccgcaagggccugcagcacggguucuucgacuucgagaccuucgacgucgacgaguacgagcacuacgagcggguggagaacggcgacuucaacuggaucgugcccgggaaguuccucgccuucagcggcccgcaccccaaguccaagaucgagaacggguacccccugcacgcccccgaggccuacuucccguacuucaagaagcacaacgucaccgcgguggugcgccugaacaagaagaucuacgaggccaagcgguucacggacgccggcuucgagcacuacgaccucuucuucaucgacggcagcacccccuccgacaacaucguccgccgguuccugaacaucugcgagaacaccgagggggccaucgccgugcacugcaaggcgggccuggggcgcaccggcacgcucaucgccugcuacgugaugaagcacuaccgguucacccacgccgagaucaucgccuggauccgcaucugccggcccggcagcaucaucgggccccagcagcacuuccuggaggagaagcaggccucccuguggguccagggcgacaucuuccgcagcaagcucaagaaccggccguccagcgagggguccaucaacaagauccugagcggccuggacgacaugagcaucgggggcaaccucuccaagacccagaacauggagcgcuucggcgaggacaaccuggaggacgacgacguggagaugaagaacgggaucacccagggcgacaagcugcgggcgcucaagagccagcgccagccccgcacgucccccagcugcgccuuccgguccgacgacaccaaggggcacccccgcgccgugagccagccguuccggcuguccagcucccugcagggcagcgccgucacccucaagaccuccaagauggcccugagccccuccgcgacggccaagcgcaucaaccggaccagccuguccagcggggccaccgugcgcuccuucagcaucaacucccggcucgccagcagccugggcaaccugaacgcggccaccgacgaccccgagaacaagaagacguccagcuccagcaaggccggcuucaccgccucccccuucaccaaccuccugaacgggagcucccagccgaccacgcgcaacuaccccgagcugaacaacaaccaguacaaccggagcuccaacagcaacggcgggaaccucaacuccccgcccggcccccacagcgccaagaccgaggagcacaccaccauccugcgccccuccuacacggggcugagcuccagcuccgcgcgguuccucagccgcagcauccccguguccgcccagaccccgccgcccggcccccagaaccccgagugcaacuucugcgcccugcccagccagccccggcugcccccgaagaaguucaacuccgccaaggaggccuucuga

SEQ ID NO: 27983 - RNA, 1386 nt, Artificial Sequence
  derived and/or modified sequence opt1 from CDC14B__Homo_sapiens__NP_001070649
augagccgcgagggcgccggggccgcgcugguggccgaggucaucaaggaccggcucugcuucgccauccuguacucccgccccaagagcgccuccaacgugcacuacuucagcaucgacaacgagcuggaguacgagaacuucuacgccgacuucggcccgcucaaccuggcgaugguguaccgguacugcugcaagaucaacaagaagcugaaguccaucaccaugcuccgcaagaagaucguccacuucaccgggagcgaccagcggaagcaggccaacgccgccuuccuggugggcugcuacauggugaucuaccuggggcgcacgcccgaggaggcguaccggauccucaucuucggcgagaccuccuacauccccuuccgcgacgccgccuacggcagcugcaacuucuacaucacccugcuggacugcuuccacgccgucaagaaggccaugcaguacggguuccucaacuucaacuccuucaaccuggacgaguacgagcacuacgagaaggcggagaacggcgaccugaacuggaucauccccgaccgguucaucgccuucugcgggccgcacagccgcgcccggcucgaguccggcuaccaccagcacagccccgagaccuacauccaguacuucaagaaccacaacgugacgaccaucauccgccugaacaagcggauguacgacgccaagcgcuucaccgacgccggguucgaccaccacgaccuguucuucgcggacggcuccacccccacggacgccaucgugaaggaguuccucgacaucugcgagaacgccgagggcgccaucgccguccacugcaaggcggggcugggccggaccgggacccugaucgccugcuacaucaugaagcacuaccgcaugaccgccgccgagacgaucgccugggugcggaucugccgccccggcagcgugaucggcccgcagcagcaguuccucgucaugaagcagaccaaccuguggcuggagggggacuacuuccggcagaagcucaagggccaggagaacgggcagcaccgcgcggccuucuccaagcugcugagcggcguggacgacaucuccaucaacgggguggagaaccaggaccagcaggagcccgagcccuacagcgacgacgacgagaucaacggcgucacccagggcgaccggcuccgcgcccugaagucccgccggcagagcaagaccaacgccaucccccugacggugauccuccagagcuccgugcagagcugcaagaccuccgagccgaacaucagcggguccgcgggcaucaccaagcgcaccacgcggagcgccucccgcaagagcuccgucaagagccuguccaucagccggaccaagaccgugcugcgcuga

SEQ ID NO: 27984 - RNA, 1863 nt, Artificial Sequence
  derived and/or modified sequence opt1 from CDC16__Homo_sapiens__NP_003894
augaaccuggagcgccuccggaagcgcgugcggcaguaccuggaccagcagcaguaccagagcgcccuguucugggccgacaaggucgcgucccucagccgcgaggagccccaggacaucuacuggcuggcccagugccuguaccucaccgcccaguaccaccgggccgcccacgcgcugcgcucccggaagcuggacaagcucuacgaggccugccgcuaccuggccgcccggugccacuacgcggccaaggagcaccagcaggcccuggacgugcucgacauggaggagccgaucaacaagcgccuguucgagaaguaccugaaggacgagagcggcuucaaggaccccuccagcgacugggagaugucccagagcuccaucaagagcuccaucugccuccugcgggggaagaucuacgacgcccuggacaaccgcacccucgccacguacagcuacaaggaggcgcugaagcuggacguguacugcuucgaggccuucgaccuccugaccucccaccacaugcugaccgcccaggaggagaaggagcuccuggagagccugccccucuccaagcugugcaacgaggagcaggagcugcuccgguuccuguucgagaacaagcugaagaaguacaacaagcccagcgagaccgucaucccggaguccguggacggccuccaggagaaccuggacguggucgugagccuggccgagcgccacuacuacaacugcgacuucaagaugugcuacaagcucacguccguggucauggagaaggaccccuuccacgccagcugccugcccgugcacaucgggacccugguggagcucaacaaggcgaacgagcuguucuaccugagccacaagcucgucgaccuguaccccuccaacccggugagcugguucgccgugggcugcuacuaccugauggucgggcacaagaacgagcacgcccggcgcuaccucuccaaggccaccacccuggagaagacguacggccccgccuggaucgcguacggccacagcuucgccguggaguccgagcacgaccaggccauggccgccuacuucaccgcggcccagcugaugaaggggugccaccuccccaugcuguacaucggccuggaguacgggcugaccaacaacagcaagcucgccgagcgguucuucucccaggcccugagcaucgcgcccgaggacccguucgugaugcacgaggucggcgugguggccuuccagaacggggaguggaagaccgccgagaagugguuccuggacgcccucgagaagaucaaggccaucggcaacgaggucacgguggacaagugggagccccugcugaacaaccucggccacgugugccgcaagcugaagaaguacgcggaggcccuggacuaccaccggcaggcccucguccugaucccccagaacgccuccaccuacagcgccaucggguacauccacucccugaugggcaacuucgagaacgcgguggacuacuuccacaccgcccucgggcugcgccgggacgacaccuucagcgucacgaugcugggccacugcaucgagauguacaucggcgacuccgaggccuacaucggggccgacaucaaggacaagcucaagugcuacgacuucgacgugcacaccaugaagacccugaagaacaucaucagcccgcccugggacuuccgcgaguucgagguggagaagcagaccgccgaggagacgggccugacgccccucgagaccucccgcaagacccccgacagccggcccucccuggaggagaccuucgagaucgagaugaacgagagcgacaugaugcuggagaccuccaugagcgaccacagcaccuga

SEQ ID NO: 27985 - RNA, 1434 nt, Artificial Sequence
  derived and/or modified sequence opt1 from CDC20B__Homo_sapiens__NP_001139206
auggaguggaagcuggagcgcaccgcgccccggcgcgugcggaccgaggaggagaugcucugggagagcaucaugcgcguccuguccaaggaccugaagcagaagcggagccaggacuccgccaacgugcucgacagcgugaacgccacguacuccgacuucaagagcaacuucgccaagcgccuguccgccgaggucccgguggccagcucccccaucaccacccgguggcagcagagccagacccgcgcccuguccagcgacuccuucggcgaggagcagagcacgaccuaccuccccgaggcguccgggagcgugcugaagacgcccccggagaaggagacccugacccucggcucccggaaggagcagcugaagacccccagcaaggggaucuccgagaccagcaacagcgcccugcacuucugcaaggcgccccacgccauggaccgcgacuggaaggaguccgucgccagcaagggccagaagugccucaagcagcuguucgugacccagaacgugguccagcaggccaacgggaagaugcagcugugcgagcaguccgagugcguguggaagggcugcaaggacggcgugcgggacgagagcuuccaccucaaguccagcggggacaucaacgacuccauccugcagcccgaggucaagauccacaucacgggccugcgcaacgacuacuaccucaacauccuggacuggagcuuccagaaccugguggccaucgcccucggguccgccguguacaucuggaacggcgagaaccacaacgggaucgagaacaucgaccugagccugaccugcaacuacaucuccagcgucuccuggaucaaggaggggaccugccucgcggugggcaccagcgagggcgaggugcagcugugggacgucgugacgaagaagcggcugcgcaacaugcucggccaccuguccguggucggggcccugagcuggaaccacuucauccucuccagcggcucccggcugggccgcguguaccaccacgacgugcgggucgcccagcaccacguggggacccugcgccacaagcaggccgucugcgcccucaaguggagcccggacggccggcugcugagcuccgggugcagcgacggccuccugaccaucuggccccacgaccccggggcguccgcccagggccagccccugaaggugaucacccagagcacggccgugaagaucugcucccucaucuggcugccgaagaccaaggagaucgccaccggccaggggacccccaagaacgacgucacgguguggaccugccccaccgugagccgcuccggcggguucuucggccaccgggggcgcguccugcaccucagccugucccccgaccagacccgcguguucagcgccgcggccgacggcacggccuccguguggaacugcuacuga

SEQ ID NO: 27986 - RNA, 1794 nt, Artificial Sequence
  derived and/or modified sequence opt1 from CDC23__Homo_sapiens__NP_004652
auggccgccagcaccuccauggugcccgucgcggugaccgccgccguggccccgguccugagcaucaacuccgacuucagcgaccuccgcgagaucaagaagcagcugcugcucaucgccggccugacgcgggagcgcgggcugcuccacuccagcaagugguccgcggagcuggccuucagccugcccgcccucccccuggccgagcugcagcccccgccgcccaucaccgaggaggacgcgcaggacauggacgccuacacccucgccaaggccuacuucgacgugaaggaguacgaccgggccgcgcacuuccugcacggcugcaacuccaagaaggccuacuuccuguacauguacagccgcuaccucuccggggagaagaagaaggacgacgagaccguggacagccugggcccccuggagaaggggcaggucaagaacgaggcccuccgggagcugcgcguggagcuguccaagaagcaccaggcccgggagcucgacggcuucggccuguaccuguacggggugguccuccgcaagcuggaccuggugaaggaggccaucgacguguucgucgaggcgacgcacgugcucccccugcacuggggcgccuggcuggagcucugcaaccugaucaccgacaaggagaugcugaaguuccucagccugcccgacaccuggaugaaggaguucuuccuggcccacaucuacaccgagcuccagcugaucgaggaggcccugcagaaguaccagaaccucaucgacgugggguucuccaagagcuccuacaucgucagccagaucgccguggcguaccacaacauccgggacaucgacaaggcccuguccaucuucaacgagcugcgcaagcaggaccccuaccggaucgagaacauggacacguucagcaaccuccuguacgugcgcagcaugaaguccgagcugagcuaccucgcccacaaccugugcgagaucgacaaguaccgggucgagaccugcugcgugaucggcaacuacuacucccugcgcagccagcacgagaaggccgcccucuacuuccagcgggcgcugaagcugaacccccgcuaccugggggccuggacccucaugggccacgaguacauggagaugaagaacaccuccgccgccauccaggcguaccggcacgccaucgaggugaacaagcgcgacuaccgggccugguacggccuggggcagacguacgagauccugaagaugccguucuacugccucuacuacuaccgccgggcccaccagcugcgccccaacgacagccgcaugcuggucgcccucggcgagugcuacgagaagcugaaccagcugguggaggcgaagaagugcuacuggcgggccuacgccgugggggacgucgagaagauggcccucgugaagcuggccaagcugcacgagcagcucaccgaguccgagcaggcggcccagugcuacaucaaguacauccaggacaucuacagcugcggcgagaucgucgagcaccuggaggaguccaccgccuuccgcuaccuggcccaguacuacuucaagugcaagcucugggacgaggccagcacgugcgcgcagaagugcugcgccuucaacgacacccgggaggagggcaaggcccugcugcgccagauccuccagcugcggaaccagggggagacccccaccaccgaggugcccgccccguucuuccugcccgcgucccucagcgccaacaacacgcccacccgccgggugagcccccugaaccuguccuccgucaccccguga

SEQ ID NO: 27987 - RNA, 1575 nt, Artificial Sequence
  derived and/or modified sequence opt1 from CDC25A__Homo_sapiens__NP_001780
auggagcugggccccgagccgccccaccgccggcgccuccuguucgccugcagcccgccgcccgccucccagcccguggucaaggcgcuguucggggccagcgccgccggcgggcucucccccgugaccaaccugaccgugacgauggaccagcugcagggccucgggagcgacuacgagcagccccuggaggucaagaacaacuccaaccugcagcggaugggcagcuccgagagcaccgacuccggcuucugccucgacagccccgggccccuggacuccaaggagaaccuggagaaccccaugcgccggauccacagccucccccagaagcugcugggcugcuccccggcccucaagcgcagccacuccgacagccuggaccacgacaucuuccagcugaucgaccccgacgagaacaaggagaacgaggcguucgaguucaagaagcccgugcggcccgugucccgcgggugccuccacagccacggccugcaggaggggaaggaccuguucacccagcggcagaacuccgccccggcccgcaugcucagcagcaacgagcgggacuccagcgagcccggcaacuucaucccccuguucacgccccaguccccggucaccgccacccugagcgacgaggacgacggcuucguggaccuccuggacggggagaaccugaagaacgaggaggagacccccuccugcauggcgagccucuggaccgcgccccuggugaugcgcacgaccaaccuggacaaccggugcaagcuguucgacucccccagccucugcuccagcuccacccgcagcguccugaagcggccggagcgcucccaggaggagagcccgcccggcuccaccaagcggcgcaagagcauguccggggccagccccaaggaguccacgaaccccgagaaggcccacgagacccuccaccagagccugagccuggccuccagccccaagggcaccaucgagaacauccucgacaacgacccccgggaccugaucggcgacuucuccaagggguaccuguuccacaccguggccggcaagcaccaggaccucaaguacaucagcccggagaucauggccuccgugcugaacgggaaguucgccaaccugaucaaggaguucgucaucaucgacugccgcuaccccuacgaguacgagggcgggcacaucaagggcgccgugaaccuccacauggaggaggagguggaggacuuccugcugaagaagcccaucguccccacggacggcaagcgggugaucguggucuuccacugcgaguucagcuccgagcgcgggccgcgcaugugccgguacgugcgcgagcgggaccgccucggcaacgaguaccccaagcugcacuaccccgagcuguacgugcucaagggcggguacaaggaguucuucaugaagugccagagcuacugcgagcccccguccuaccggcccaugcaccacgaggacuucaaggaggaccugaagaaguuccgcaccaagagccggaccugggccggggagaaguccaagcgcgagauguacagccggcugaagaagcuguga

SEQ ID NO: 27988 - RNA, 1551 nt, Artificial Sequence
  derived and/or modified sequence opt1 from CDC25B__Homo_sapiens__NP_001274445
augcacagcgagacccccaagucccaggugggcacccuccuguuccgcagccggucccgccugacgcaccugagccucucccggcgcgccagcgaguccagccuguccagcgaguccagcgaguccagcgacgccgggcugugcauggacuccccgagccccauggacccccacauggcggagcagaccuucgagcaggccauccaggccgccucccggaucauccgcaacgagcaguucgccauccggcgcuuccagagcaugcccguccggcuccugggccacuccccggugcugcgcaacaucaccaacagccaggcgcccgacgggcggcgcaagagcgaggccggcuccggggccgccagcuccagcggcgaggacaaggagaacgacggcuucguguucaagaugcccuggaagcccacccacccguccagcacgcacgcgcucgccgagugggccucccggcgcgaggccuucgcccagcggcccagcuccgcgcccgaccugaugugccugagccccgaccgcaagauggaggucgaggagcucuccccgcuggcccuggggcgguucagccucacccccgccgagggcgacaccgaggaggacgacggguucguggacauccuggaguccgaccugaaggacgacgacgccgugccgcccggcauggagagccucaucuccgcgccccuggucaagacccuggagaaggaggaggagaaggaccucgugauguacagcaagugccagcgccuguuccggucccccagcaugcccugcuccgugauccgccccauccugaagcggcucgagcgcccgcaggaccgcgacacgcccguccagaacaagcggcgccggagcgugaccccgcccgaggagcagcaggaggccgaggagcccaaggcccgcgugcugcggagcaagucccugugccacgacgagaucgagaaccuccuggacagcgaccaccgcgagcugaucggggacuacuccaaggccuuccuccugcagaccgucgacggcaagcaccaggaccugaaguacaucagccccgagaccaugguggcccuccugacgggcaaguucuccaacaucguggacaaguucgucaucguggacugccgguaccccuacgaguacgagggcgggcacaucaagaccgccgugaaccugccccucgagcgcgacgcggagagcuuccugcugaaguccccgaucgcccccugcagccucgacaagcgggucauccugaucuuccacugcgaguucuccagcgagcgcgggccccggaugugccgcuucauccgggagcgcgaccgggccgugaacgacuacccgucccuguacuaccccgagauguacauccucaagggcggcuacaaggaguucuucccccagcaccccaacuucugcgagccgcaggacuaccgccccaugaaccacgaggccuucaaggacgagcugaagaccuuccggcugaagacccgcagcugggccggggagcggucccgccgcgagcucugcagccggcugcaggaccaguga

SEQ ID NO: 27989 - RNA, 1422 nt, Artificial Sequence
  derived and/or modified sequence opt1 from CDC25C__Homo_sapiens__NP_001274511
augagcaccgagcuguucuccagcacccgcgaggagggcuccagcggguccggccccagcuuccgguccaaccagcgcaagaugcucaaccugcugcucgagcgggacacgagcuucaccgugugcccggacgucccccgcacccccguggggaaguuccugggcgacuccgccaaccugagcauccucuccgggggcacccccaagcggugccuggaccugagcaaccucuccagcggcgagaucacggccacccagcugaccaccuccgcggaccuggacgagacggggcaccucgacagcuccggccugcaggaggugcaccuggccgggaugaaccacgaccagcaccucaugaagugcagcccggcccagcugcugugcuccacccccaacggccucgaccgcgggcaccggaagcgcgacgccaugugcagcagcuccgccaacaaggagaacgacaacggcaaccuggucgacagcgagaugaaguaccugggcucccccaucaccaccgugcccaagcucgacaagaacccgaaccugggggaggaccaggcggaggagaucagcgacgagcugauggaguucucccucaaggaccaggaggccaaggugagccgguccggccuguaccgcagccccuccaugcccgagaaccugaaccggccccgccucaagcaggucgagaaguucaaggacaacacgaucccggacaaggugaagaagaaguacuucagcgggcagggcaagcugcggaagggccugugccucaagaagaccgugucccugugcgacaucaccaucacccagaugcuggaggaggacagcaaccaggggcaccucaucggcgacuucuccaaggucugcgcccugcccacggugagcgggaagcaccaggaccugaaguacgugaaccccgagaccgucgccgcgcuccuguccggcaaguuccaggggcugaucgagaaguucuacgugaucgacugccgcuaccccuacgaguaccucggcggccacauccagggggcccugaaccuguacagccaggaggagcuguucaacuucuuccucaagaagccgaucgugccccuggacacccagaagcggaucaucaucgucuuccacugcgaguucuccagcgagcgcggcccccggaugugccgcugccuccgggaggaggaccgcucccugaaccaguaccccgcccuguacuacccggagcucuacauccugaagggcggguaccgggacuucuuccccgaguacauggagcugugcgagccccagagcuacugccccaugcaccaccaggaccacaagaccgagcugcuccgcugccgcagccaguccaaggugcaggagggggagcggcagcugcgcgagcagaucgcccugcucgugaaggacaugagcccguga

SEQ ID NO: 27990 - RNA, 2493 nt, Artificial Sequence
  derived and/or modified sequence opt1 from CDC27__Homo_sapiens__NP_001107563
augaccgugcugcaggagcccguccaggccgccaucuggcaggcgcucaaccacuacgccuaccgcgacgccguguuccuggccgagcggcuguacgccgaggugcacagcgaggaggcccucuuccugcuggcgaccugcuacuaccgcuccggcaaggccuacaaggccuaccggcuccugaaggggcacagcugcacgaccccgcagugcaaguaccugcucgcgaagugcugcgucgaccuguccaagcuggccgagggcgagcagauccucagcgggggcguguucaacaagcagaagucccacgacgacaucgugaccgaguucggggacagcgccugcuucacccugucccugcucggccacgucuacugcaagacggaccgccuggccaagggcagcgagugcuaccagaagucccugagccucaaccccuuccuguggucccccuucgagagccugugcgagaucggggagaagcccgacccggaccagaccuucaaguucaccucccuccagaacuucagcaacugccugcccaacuccugcaccacccaggugcccaaccacagccugucccaccggcagcccgagaccgugcucaccgagaccccgcaggacacgaucgagcugaaccgccugaaccucgagagcuccaacagcaaguacagccugaacaccgacuccagcgucuccuacaucgacagcgccgugaucucccccgacaccgugccccugggcaccgggacgagcauccucuccaagcagguccagaacaagcccaagaccggccggagccugcucgggggcccggcggcccugagcccccugacgcccuccuucggcauccugccccucgagaccccgucccccggggacggcagcuaccugcagaacuacacgaacaccccgcccgugaucgacgugcccuccaccggggcgcccagcaagaagaccuuccgcguccugcaguccguggcccggaucggccagacgggcaccaagagcguguucucccagagcgggaacucccgcgaggucacccccauccucgcccagacccagagcagcggcccccagacguccaccacgccccaggugcugagcccgaccaucaccuccccgcccaacgcccugccccggcgcagcucccgccucuucaccagcgacuccagcaccaccaaggagaacuccaagaagcugaagaugaaguucccgcccaagauccccaaccggaagaccaagagcaagacgaacaagggcgggaucacccagcccaacaucaacgacucccuggagaucaccaagcucgacagcuccaucaucagcgaggggaagaucuccaccaucacgccccagauccaggccuucaaccugcagaaggccgccgccgagggccugaugagccuccugcgggagaugggcaagggguaccuggcgcugugcuccuacaacugcaaggaggccaucaacauccucagccaccuccccagccaccacuacaacaccggcugggugcugugccagaucgggcgcgccuacuucgagcuguccgaguacaugcaggccgagcggaucuucagcgagguccgccggaucgagaacuaccgcguggagggcauggagaucuacuccaccacccuguggcaccuccagaaggacguggcccugagcguccuguccaaggaccugacggacauggacaagaacagcccggaggcguggugcgccgccgggaacugcuucucccuccagcgggagcacgacaucgccaucaaguucuuccagcgcgcgauccagguggaccccaacuacgccuacgccuacacccugcugggccacgaguucguccucaccgaggagcuggacaaggcccuggccugcuuccgcaacgcgauccgggugaacccccgccacuacaacgccugguacggccucgggaugaucuacuacaagcaggagaaguucagccuggccgagaugcacuuccagaaggcccuggacaucaacccccaguccagcgugcuccugugccacaucggcgucgugcagcacgcccugaagaaguccgagaaggcgcucgacacccugaacaaggccaucgugaucgacccgaagaacccccugugcaaguuccaccgggccagcguccucuucgccaacgagaaguacaaguccgcccugcaggagcuggaggagcucaagcagaucgugcccaaggagagccugguguacuuccugaucgggaaggucuacaagaagcucggccagacgcaccuggcgcugaugaacuucuccugggccauggaccucgaccccaagggggccaacaaccagaucaaggaggccaucgacaagcgcuaccugccggacgacgaggagcccaucacccaggaggagcagaucaugggcaccgacgagagccaggaguccagcaugaccgacgcggacgacacgcagcugcacgccgccgaguccgacgaguucuga

SEQ ID NO: 27991 - RNA, 711 nt, Artificial Sequence
  derived and/or modified sequence opt1 from CDC34__Homo_sapiens__NP_004350
auggcccgcccccuggugccgagcucccagaaggcccuccugcuggagcucaagggccugcaggaggagcccgucgagggguuccgggugacccugguggacgagggcgaccucuacaacugggaggucgcgaucuucgggccgcccaacaccuacuacgagggcggguacuucaaggcccgccugaaguuccccaucgacuaccccuacagcccgcccgccuuccgguuccugacgaagauguggcaccccaacaucuacgagaccggcgacgugugcaucuccauccuccacccgcccguggacgacccccagagcggcgagcugcccuccgagcgcuggaaccccacccagaacguccggaccauccugcucagcgugaucucccugcugaacgagcccaacacguucagccccgccaacguggacgccuccgucauguaccgcaaguggaaggagagcaaggggaaggaccgggaguacaccgacaucauccgcaagcagguccucggcaccaagguggacgcggagcgggacggggugaaggugccgaccacgcuggccgaguacugcgugaagaccaaggcccccgcccccgacgagggcuccgaccuguucuacgacgacuacuacgaggacggggaggucgaggaggaggcggacagcugcuucggcgacgacgaggacgacuccggcaccgaggagagcuga

SEQ ID NO: 27992 - RNA, 1137 nt, Artificial Sequence
  derived and/or modified sequence opt1 from CDC37__Homo_sapiens__NP_008996
augguggacuacagcgucugggaccacaucgagguguccgacgacgaggacgagacccaccccaacaucgacaccgccagccuguuccgcuggcggcaccaggcccgcguggagcggauggagcaguuccagaaggagaaggaggagcucgaccgcggcugccgggagugcaagcgcaaggucgcggagugccagcggaagcugaaggagcuggagguggccgagggcgggaaggccgagcucgagcgccugcaggccgaggcccagcagcugcggaaggaggagcgcuccugggagcagaagcucgaggagaugcggaagaaggagaaguccaugccguggaacguggacacgcugagcaaggacggguucagcaaguccauggucaacaccaagcccgagaagaccgaggaggacagcgaggaggugcgcgagcagaagcacaagaccuucguggagaaguacgagaagcagaucaagcacuucggcaugcugcggcgcugggacgacucccagaaguaccucagcgacaacguccaccuggugugcgaggagacggcgaacuaccuggugaucuggugcaucgaccucgaggucgaggagaagugcgcccugauggagcaggucgcccaccagaccaucgugaugcaguucauccuggagcucgccaagucccugaagguggacccccgggcgugcuuccgccaguucuucaccaagaucaagaccgccgaccggcaguacauggagggguucaacgacgagcuggaggccuucaaggagcgcgugcggggccgcgccaagcuccggaucgagaaggccaugaaggaguacgaggaggaggagcgcaagaagcgccugggccccgggggccuggacccgguggaggucuacgagagccuccccgaggagcugcagaagugcuucgacgugaaggacgugcagaugcugcaggacgcgaucuccaagauggaccccacggacgccaaguaccacaugcagcggugcaucgacagcgggcucuggguccccaacuccaaggccagcgaggccaaggagggcgaggaggccgggccgggcgacccccugcuggaggcggugcccaagaccggcgacgagaaggacguguccgucuga

SEQ ID NO: 27993 - RNA, 1014 nt, Artificial Sequence
  derived and/or modified sequence opt1 from CDC37L1__Homo_sapiens__NP_060383
auggagcagcccuggccgccgcccggccccuggagccugccccgcgccgagggggaggccgaggaggaguccgacuucgacguguuccccagcagcccccggugcccccagcucccgggcgggggcgcgcagauguacucccacgggaucgagcuggccugccagaagcagaaggaguucgucaaguccagcguggccugcaaguggaaccuggccgaggcccagcagaagcucggcucccuggcgcugcacaacagcgagucccucgaccaggagcacgccaaggcccagaccgccgugagcgagcugcgccagcgggaggaggaguggcgccagaaggaggaggcgcugguccagcgggagaagaugugccucugguccaccgacgccaucagcaaggacguguucaacaaguccuucaucaaccaggacaagcgcaaggacacggaggacgaggacaagagcgaguccuucaugcagaaguacgagcagaagauccggcacuucggcaugcugagccgcugggacgacucccagcgguuccugagcgaccaccccuaccucgugugcgaggagaccgccaaguaccugauccuguggugcuuccaccucgaggccgagaagaagggggcccugauggagcagaucgcgcaccaggccgucgugaugcaguucaucauggagauggccaagaacugcaacguggacccccgcggcugcuuccggcuguucuuccagaaggccaaggccgaggaggagggguacuucgaggcguucaagaacgagcucgaggccuucaagucccgcguccggcuguacagccagagccaguccuuccagcccaugaccgugcagaaccacgugccgcacagcggcgucggguccaucggccugcucgagagccugccccagaaccccgacuaccugcaguacuccaucagcaccgcccucugcucccugaacagcguggugcacaaggaggacgacgagcccaagaugauggacacggucuga

SEQ ID NO: 27994 - RNA, 5160 nt, Artificial Sequence
  derived and/or modified sequence opt1 from CDC42BPA__Homo_sapiens__NP_003598
auguccggcgaggugcgccugcggcagcucgagcaguucauccuggacgggcccgcgcagaccaacggccagugcuucuccgucgagacccugcucgacauccugaucugccuguacgacgagugcaacaacagcccccuccgccgggagaagaacauccuggaguaccuggagugggccaagcccuucaccuccaaggugaagcagaugcgccuccaccgggaggacuucgagauccugaaggugaucgggcgcggcgcguucggggaggucgccguggugaagcugaagaacgccgacaaggucuucgccaugaagauccucaacaagugggagaugcugaagcgggccgagaccgcgugcuuccgcgaggagcgggacgugcuggugaacggcgacaacaaguggaucaccacccuccacuacgccuuccaggacgacaacaaccuguaccuggucauggacuacuacgugggcggggaccuccugacgcugcucagcaaguucgaggaccgccugcccgaggacauggcccgguucuaccuggccgagauggugaucgcgaucgacuccguccaccagcuccacuacgugcaccgcgacaucaagcccgacaacauccugauggacaugaacggccacauccggcuggccgacuucgggagcugccucaagcugauggaggacggcaccgugcaguccagcgucgccguggggacccccgacuacaucucccccgagauccugcaggccauggaggacggcaagggccgcuacgggcccgagugcgacugguggagccucggcgugugcauguacgagaugcuguacggggagacccccuucuacgccgagucccuggucgagacguacggcaagaucaugaaccacaaggagcgguuccaguucccggcccaggugaccgacgugagcgagaacgccaaggaccucauccgccggcugaucugcucccgcgagcaccggcugggccagaacgggaucgaggacuucaagaagcaccccuucuucagcggcaucgacugggacaacauccgcaacugcgaggcccccuacauccccgaggucuccagcccgaccgacaccuccaacuucgacguggacgacgacugccucaagaacagcgagacgaugccgccgcccacccacaccgccuucuccgggcaccaccuccccuucgugggcuucaccuacacgagcagcugcguccuguccgaccggagcugccugcgcgugaccgccgggcccaccucccuggaccuggacgucaacgugcagcgcacccucgacaacaaccuggcgacggaggccuacgagcggcgcaucaagcggcuggagcaggagaagcucgagcugagccgcaagcugcaggaguccacccagaccgugcaggcccuccaguacagcaccgucgacggcccccugacggccuccaaggaccuggagaucaagaaccugaaggaggagaucgagaagcuccggaagcaggucaccgagagcucccaccuggagcagcagcuggaggaggccaacgcggugcgccaggagcucgacgacgccuuccggcagaucaaggccuacgagaagcagaucaagacccugcagcaggagcgcgaggaccugaacaaggagcucguccaggccagcgagcggcugaagaaccaguccaaggagcugaaggacgcccacugccagcgcaagcucgcgaugcaggaguucauggagaucaacgagcggcugaccgagcugcacacgcagaagcagaagcucgcccgccacgugcgggacaaggaggaggagguggaccuggucaugcagaagguggagagccugcgccaggagcuccggcgcaccgagcgggccaagaaggagcuggaggugcacaccgaggcccuggcggccgaggccuccaaggaccgcaagcuccgggagcagagcgagcacuacuccaagcagcuggagaacgagcuggagggccucaagcagaagcagaucagcuacucccccggggucugcagcaucgagcaccagcaggagaucaccaagcugaagacggaccuggagaagaaguccaucuucuacgaggaggagcucagcaagcgcgagggcauccacgccaacgagaucaagaaccugaagaaggagcugcacgacagcgaggggcagcagcucgcccugaacaaggagaucaugauccugaaggacaagcucgagaagacccgccgggagucccagagcgagcgcgaggaguucgaguccgaguucaagcagcaguacgagcgggagaaggugcugcugaccgaggagaacaagaagcucaccagcgagcuggacaagcugacgacccucuacgagaaccuguccauccacaaccagcagcuggaggaggaggugaaggaccucgcggacaagaaggagagcgucgcccacugggaggcccagaucaccgagaucauccaguggguguccgacgagaaggacgcccgcggcuaccugcaggcccuggcgagcaagaugaccgaggagcucgaggcccugcggaacuccagccuggggacccgcgccacggacaugccguggaagaugcggcgcuucgccaagcucgacauguccgcccggcuggagcugcagagcgcgcucgacgccgagauccgcgccaagcaggccauccaggaggagcugaacaaggugaaggcguccaacaucaucaccgagugcaagcugaaggacagcgagaagaagaaccucgagcugcuguccgagaucgagcagcucaucaaggacaccgaggagcugcggagcgagaagggcaucgagcaccaggacucccagcacagcuuccuggccuuccucaacacccccacggacgcccuggaccaguucgagaccgucgacagcacgccccuguccgugcacacccccacgcuccgcaagaagggcugcccggggagcaccggcuucccgcccaagcggaagacccaccaguucuucgugaaguccuucaccacgcccaccaagugccaccagugcaccagccugauggucgggcugauccgccagggcugcuccugcgaggugugcggguucagcugccacaucacgugcgugaacaaggccccgacgaccugccccgugccgcccgagcagaccaagggcccccucggcaucgacccccagaaggggaucggcaccgccuacgaggggcacgugcggauccccaagcccgcgggcgugaagaagggcuggcagcgcgcccuggccaucgucugcgacuucaagcuguuccucuacgacaucgccgaggggaaggccucccagcccagcguggugaucucccaggucaucgacaugcgggacgaggaguucagcguguccagcgugcuggcguccgacgucauccacgccagccgcaaggacauccccugcaucuuccgggugacggccucccagcugagcgccuccaacaacaagugcagcauccucaugcuggccgacaccgagaacgagaagaacaagugggugggcguccuguccgagcuccacaagauccugaagaagaacaaguuccgcgaccggagcguguacgugcccaaggaggcguacgacagcacccugccgcucaucaagaccacgcaggccgccgccaucaucgaccacgagcgcaucgcgcuggggaacgaggagggccuguucgucgugcacgugaccaaggacgagaucauccgcgucggggacaacaagaagauccaccagaucgagcucauccccaacgaccagcugguggccgugaucuccggccggaaccgccacguccggcuguuccccaugagcgcccucgacggccgcgagaccgacuucuacaagcuguccgagaccaaggggugccagacggugaccagcggcaaggugcggcacggggcccugaccugccucugcgucgccaugaagcgccaggugcugugcuacgagcuguuccaguccaagacccggcaccgcaaguucaaggagauccaggugcccuacaacguccaguggauggcgaucuucagcgagcagcucugcgugggcuuccaguccggguuccugcgguacccgcugaacggcgagggcaaccccuacagcaugcuccacuccaacgaccacacgcugagcuucaucgcccaccagcccauggacgccaucugcgccgucgagaucuccagcaaggaguaccugcucugcuucaacuccaucgggaucuacaccgacugccagggccgccggagccgccagcaggagcugauguggcccgccaacccguccagcugcugcuacaacgcgcccuaccuguccguguacagcgagaacgccguggacaucuucgacgucaacuccauggaguggauccagacccugccccucaagaaggugcggccccugaacaacgaggggagccugaaccuccugggccuggagaccauccgccucaucuacuucaagaacaagauggccgagggggacgagcugguggucccggagacgagcgacaacucccggaagcagauggugcgcaacaucaacaacaagcggcgcuacagcuuccgggugcccgaggaggagcgcaugcagcagcgccgggagaugcugcgcgaccccgagaugcggaacaagcucaucuccaaccccaccaacuucaaccacaucgcccacaugggcccgggcgacgggauccagauccugaaggaccugcccaugaacccccgcccgcaggagagccggaccgucuucuccggcagcguguccauccccagcaucaccaagucccgccccgagcccgggcggagcauguccgccagcuccggccucagcgcgcgcuccagcgcccagaacggguccgcccugaagcgggaguucagcggcggcuccuacagcgccaagcgccagccgaugcccagccccuccgaggggagccuguccagcggcgggauggaccagggcuccgacgcccccgcgcgggacuucgacggcgaggacagcgacuccccgcgccacagcaccgccuccaacagcuccaaccucagcagcccgcccagccccgccuccccgcggaagaccaagagccugucccuggagagcaccgaccgcggguccugggaccccuga

SEQ ID NO: 27995 - RNA, 5136 nt, Artificial Sequence
  derived and/or modified sequence opt1 from CDC42BPB__Homo_sapiens__NP_006026
augagcgccaaggugcgccugaagaagcucgagcagcugcugcucgacggccccuggcggaacgaguccgcccugagcgucgagacccugcucgacgugcuggugugccuguacaccgagugcucccacagcgcgcuccgccgggacaaguacgucgccgaguuccuggagugggccaagccguucacgcagcuggugaaggagaugcagcuccaccgcgaggacuucgagaucaucaaggugaucgggcggggcgccuucggggaggucgccguggugaagaugaagaacaccgagcgcaucuacgcgaugaagauccugaacaagugggagaugcugaagcgggccgagaccgccugcuuccgcgaggagcgggacguccucgugaacggcgacugccaguggaucaccgcccugcacuacgcguuccaggacgagaaccaccuguaccucgugauggacuacuacgucgggggcgaccugcugacgcuccuguccaaguucgaggacaagcugcccgaggacauggcccgcuucuacaucggcgagauggugcucgccaucgacagcauccaccagcugcacuacgugcaccgggacaucaagcccgacaacguccugcucgacgugaacgggcacauccgccuggccgacuucggcuccugccugaagaugaacgacgacgggaccgugcagagcuccgucgccgugggcacccccgacuacaucagcccggagauccuccaggcgauggaggacgggaugggcaaguacggccccgagugcgacugguggucccugggggugugcauguacgagaugcuguacggcgagacccccuucuacgccgagagccucgucgagacguacgggaagaucaugaaccacgaggagcgguuccaguuccccucccacgugaccgacgugagcgaggaggccaaggaccugauccagcgccugaucugcucccgggagcgccggcucggccagaacggcaucgaggacuucaagaagcacgccuucuucgaggggcugaacugggagaacauccgcaaccuggaggccccguacauccccgacgucagcucccccagcgacaccuccaacuucgacguggacgacgacguccuccggaacaccgagauccugcccccgggcagccacacgggguucagcggccugcaccuccccuucaucggguucaccuucaccaccgaguccugcuucagcgaccgcggcucccugaagagcaucaugcaguccaacacgcugaccaaggacgaggacgugcagcgggaccucgagcacagccugcagauggaggcguacgagcgccgcauccggcgccuggagcaggagaagcucgagcugucccggaagcugcaggagagcacccagaccgugcagucccugcacggcagcucccgcgcccucagcaacuccaaccgggacaaggagaucaagaagcugaacgaggagaucgagcgccugaagaacaagaucgccgacagcaaccggcucgagcgccagcuggaggacacggucgcccugcggcaggagcgcgaggacuccacccagcggcuccgcgggcuggagaagcagcaccggguggugcgccaggagaaggaggagcugcacaagcagcucgucgaggccagcgagcggcugaagucccaggcgaaggagcugaaggacgcccaccagcagcgcaagcucgcccugcaggaguucagcgagcugaacgagcggauggccgagcuccgcgcccagaagcagaaggugucccggcagcugcgcgacaaggaggaggagauggagguggcgacccagaaggucgacgccaugcgccaggagaugcggcgcgccgagaagcugcggaaggagcucgaggcccagcuggacgacgcgguggccgaggccagcaaggagcgcaagcugcgggagcacagcgagaacuucugcaagcagauggaguccgagcucgaggcccugaaggugaagcagggcgggcgcggcgccggggcgacccuggagcaccagcaggagaucagcaagaucaaguccgagcucgagaagaagguccuguucuacgaggaggagcuggugcggcgcgaggccagccacgugcucgaggucaagaacgugaagaaggaggugcacgacuccgagagccaccagcuggcccugcagaaggagauccucaugcugaaggacaagcuggagaaguccaagcgggagcgccacaacgagauggaggaggccgucggcacgaucaaggacaaguacgagcgggagcgcgccaugcucuucgacgagaacaagaagcugaccgcggagaacgagaagcugugcagcuucguggacaagcucaccgcccagaaccggcagcuggaggacgagcugcaggaccucgccgccaagaaggaguccguggcccacugggaggcgcagaucgccgagaucauccagugggucagcgacgagaaggacgcccgcggcuaccugcaggcccuggcguccaagaugaccgaggagcucgaggcccugcggagcuccagccuggggucccgcacgcucgacccccuguggaaggugcggcgcagccagaagcuggacauguccgcccggcucgagcugcagagcgcccuggaggccgagauccgcgcgaagcagcucgugcaggaggagcugcggaaggucaaggacgccaaccugacccucgagagcaagcugaaggacuccgaggccaagaaccgcgagcugcucgaggagauggagauccugaagaagaagauggaggagaaguuccgcgccgacaccggccugaagcuccccgacuuccaggacagcaucuucgaguacuucaacaccgccccgcuggcgcacgaccugacguuccggaccuccagcgccuccgagcaggagacccaggcccccaagcccgaggccagccccuccaugagcguggccgcguccgagcagcaggaggacauggcccgcccgccccagcggcccagcgccgugccccucccgaccacgcaggcccuggcgcuggccgggcccaagcccaaggcccaccaguucuccaucaagagcuucuccagccccacccagugcucccacugcaccagccucauggucggccugauccgccagggguacgccugcgaggugugcuccuucgccugccacgugagcugcaaggacggcgcgccgcaggucugccccauccccccggagcaguccaagcggccccugggcguggacgugcagcgcgggaucggcaccgccuacaaggggcacgucaaggugcccaagcccaccggcgugaagaagggcuggcagcgggccuacgccgucgugugcgacugcaagcucuuccuguacgaccugccggaggggaagagcacgcagcccggcgugaucgccagccagguccucgaccugcgcgacgacgaguucuccgugagcuccgugcuggcgagcgacgucauccacgccacccggcgcgacauccccugcaucuuccgggugaccgccucccuccugggggcccccagcaagaccuccagccugcucauccugacggagaacgagaacgagaagcgcaagugggugggcauccuggaggggcuccaguccauccugcacaagaaccggcugcgcaaccaggucgugcacgugccgcucgaggccuacgacagcucccugccccugaucaaggcgauccucaccgccgccaucgucgacgccgaccggaucgccgugggccuggaggagggccuguacgugaucgaggucacccgcgacgugaucguccgggcggccgacugcaagaaggugcaccagaucgagcucgccccccgcgagaagaucgugauccugcugugcgggcggaaccaccacguccaccucuaccccuggagcucccuggacggcgccgaggggagcuucgacaucaagcugccggagaccaagggcugccagcugauggcgacggccacccucaagcgcaacuccgggaccugccuguucguggccgugaagcgccugauccucugcuacgagauccagcggaccaagcccuuccaccgcaaguucaacgagaucgucgcccccggcagcgugcagugccuggccgugcugcgggaccgccucugcgucggcuaccccuccggguucugccugcugagcauccagggcgacgggcagccgcucaaccuggugaaccccaacgaccccucccuggcguuccucagccagcagagcuucgacgcccugugcgccguggagcuggaguccgaggaguaccuccugugcuucagccacaugggccuguacgucgacccccaggggcggcgcgcccgggcccaggagcucauguggccggcggcccccguggccugcuccugcagccccacgcacgugaccgucuacuccgaguacggcguggacguguucgacguccgcaccauggagugggugcagaccaucggccugcggcgcauccggccccugaacagcgaggggacgcucaaccugcugaacugcgagccgccccgccucaucuacuucaaguccaaguucagcggcgccgugcugaacguccccgacaccuccgacaacagcaagaagcagaugcugcggacccgcuccaagcggcgcuucguguucaaggugccggaggaggagcggcuccagcagcgccgggagaugcugcgcgaccccgagcugcggagcaagaugaucuccaaccccaccaacuucaaccacgucgcccacauggggcccggcgacgggaugcaggugcucauggaccugccgcugagcgcggugccccccucccaggaggagcgccccggcccggcccccacgaaccucgcccgccagccccccagccggaacaagccguacaucuccuggcccagcuccggcgggagcgagcccagcgucaccgugccccugcgcuccaugagcgacccggaccaggacuucgacaaggagcccgacuccgacagcaccaagcacuccacccccagcaacuccagcaaccccuccggcccgcccagccccaacuccccccaccggagccagcugccgcucgaggggcuggagcagcccgccugcgacacguga

SEQ ID NO: 27996 - RNA, 4656 nt, Artificial Sequence
  derived and/or modified sequence opt1 from CDC42BPG__Homo_sapiens__NP_059995
auggagcgccggcugcgcgcccucgagcagcuggcccggggcgaggcggggggcugccccgggcuggacggccuccuggaccugcuccuggcccugcaccacgagcucagcuccgggccgcugcgccgggagcgcagcguggcccaguuccuguccugggccagccccuucgucuccaaggugaaggagcuccggcugcagcgcgacgacuucgagauccugaaggugaucggccggggcgccuucggggaggucaccguggugcgccagcgggacaccggccagaucuucgcgaugaagaugcuccacaagugggagaugcugaagcgcgccgagacggccugcuuccgggaggagcgcgacguccuggugaagggggacagccggugggugaccacccuccacuacgccuuccaggacgaggaguaccuguaccuggucauggacuacuacgcgggcggggaccuccugacccugcucucccgcuucgaggaccggcugccccccgagcuggcccaguucuaccucgccgagauggugcuggccauccacagccugcaccagcucggcuacgugcaccgcgacgucaagccggacaacgugcugcuggacgugaacggccacauccggcucgccgacuucggguccugccugcgccugaacacgaacggcauggucgacagcuccguggcgguggggacccccgacuacaucagccccgagauccuccaggccauggaggagggcaagggccacuacgggccccagugcgacugguggucccugggcgucugcgccuacgagcugcucuucggggagaccccguucuacgccgagagccugguggagaccuacggcaagaucaugaaccacgaggaccaccugcaguucccccccgacgugcccgacgucccggccuccgcgcaggaccucauccggcagcugcugugccgccaggaggagcgccucgggcggggcggccuggacgacuuccgcaaccaccccuucuucgaggggguggacugggagcggcuggccagcuccacggcccccuacauccccgagcuccgcggcccgauggacaccagcaacuucgacguggacgacgacacccugaaccaccccgggacccugccccccccgucccacggcgccuucagcgggcaccaccugcccuucgucggcuucacguacaccagcggcucccacagccccgaguccagcuccgaggccugggcggcccucgagcggaagcugcagugccuggagcaggagaagguggagcucagccgcaagcaccaggaggcccugcacgcccccaccgaccaccgggagcuggagcagcuccgcaaggagguccagacccugcgggaccgccugccggagaugcuccgggacaaggccucccugagccagacggacgggccccccgcgggcucccccgggcaggacagcgaccugcgccaggagcucgaccggcugcaccgcgagcuggccgagggccgggccgggcuccaggcccaggagcaggagcugugccgcgcgcagggccagcaggaggagcugcuccagcggcugcaggaggcccaggagcgcgaggccgccaccgccucccagacccgggcgcugagcucccagcucgaggaggcccgcgccgcccagcgcgagcuggaggcccaggugagcucccugagccggcaggugacccagcuccagggccagugggagcagcgccuggaggaguccagccaggcgaagacgauccacaccgccuccgagaccaacgggaugggcccgcccgaggggggcccccaggaggcccagcugcggaaggaggucgccgcccuccgcgagcagcuggagcaggcgcacagccaccggccgagcggcaaggaggaggcccugugccagcuccaggaggagaaccgccggcugucccgcgagcaggagcggcuggaggccgagcucgcccaggagcaggagagcaagcagcgccuggagggggagcggcgcgagaccgaguccaacugggaggcgcagcuggccgacauccucagcugggugaacgacgagaaggugucccggggcuaccugcaggcccuggccacgaagauggccgaggagcucgagagccugcgcaacgucgggacccagacccugcccgcgcggccccucgaccaccaguggaaggcccgccggcugcagaagauggaggccuccgcccgccuggagcuccagagcgcccuggaggcggagauccgggccaagcagggccugcaggagcgccucacccaggugcaggaggcccagcugcaggccgagcggcgccugcaggaggccgagaagcagucccaggcgcuccagcaggagcuggccaugcugcgcgaggagcuccgggcccgcgggcccguggacacgaagccgagcaacucccugauccccuuccugagcuuccgguccagcgagaaggacuccgccaaggaccccggcaucagcggcgaggcgacccgccacgggggcgagcccgaccuccggccggaggggcgccggucccugcgcaugggcgccgucuucccccgggcccccaccgccaacaccgccagcacggaggggcugcccgcgaagccgggcagccacacccuccgcccccgguccuuccccagccccaccaagugccugcgcugcaccucccugaugcucggccuggggcggcagggccuggggugcgacgccugcggcuacuucugccacacgaccugcgccccgcaggccccccccugccccgugccgcccgaccuccugcgcaccgcccugggggugcaccccgagaccggcaccggcacggcguacgagggguuccucagcgucccccggccguccggcgugcgccggggguggcagcgcguguucgccgcccugagcgacucccggcugcuccuguucgacgcccccgaccugcgccucagccccccguccggcgcccugcugcagguccucgaccugcgcgacccccaguucagcgcgacccccgugcuggccuccgacgugauccacgcccagagccgggaccucccccgcaucuuccgggucaccaccucccagcuggccgugccgcccacgaccugcaccgugcugcuccuggccgagagcgagggggagcgcgagcgguggcugcagguccucggcgagcugcagcgccugcuccuggacgcgcggccccgcccccggccgguguacacccugaaggaggccuacgacaacggccucccccugcugccccacacgcugugcgccgccauccucgaccaggaccgccuggcgcuggggaccgaggagggccucuucgugauccaccugcgguccaacgacaucuuccaggucggggagugccgccgggugcagcagcugacccucagccccuccgccggccugcuggugguccucugcggccgcgggccgagcgugcggcuguucgcccuggccgagcucgagaacaucgagguggccggcgcgaagauccccgagucccgcgggugccagguccuggccgccggcagcauccugcaggcccggacccccgugcucugcguggccgucaagcgccaggugcugugcuaccagcuggggcccggcccgggccccuggcagcggcgcauccgggagcuccaggcgcccgccacggugcagagccuggggcugcucggcgaccgccugugcgucggggccgccggcggguucgcccuguacccccuccugaacgaggcggccccgcuggcccucggcgccggccuggugcccgaggagcugccccccucccgcgggggccucggggaggcgcugggcgccguggagcugagccucuccgaguuccugcugcucuucaccaccgccgggaucuacgucgacggcgccggccggaagagccgcgggcacgagcugcuguggccggccgcgcccaugggcuggggguacgccgcccccuaccucaccguguucuccgagaacagcaucgacguguucgacguccggcgcgccgagugggugcagacggugccccugaagaagguccggccgcugaaccccgagggcucccucuuccuguacggcaccgagaaggugcgccugaccuaccuccggaaccagcuggccgagaaggacgaguucgacauccccgaccugaccgacaacagccgccggcagcucuuccgcacgaaguccaagcggcgcuucuucuuccgggugagcgaggagcagcagaagcagcagcgccgggagaugcugaaggacccguucguccgcuccaagcugaucagcccccccaccaacuucaaccaccucgugcacguggggcccgcgaacggccggccgggggcccgcgacaagucccccgcccccgaggagaagggccgggucgcccgcgggagcggcccccagcgcccgcacuccuucagcgaggcccugcggcgccccgcguccaugggcagcgaggggcugggcggggacgccgaccccaugaagcggaagcccuggaccucccucagcagcgaguccgugagcugcccgcagggcucccugagccccgccaccucccugaugcaggucagcgagcgcccccggucccucccccugagcccggagcuggaguccagccccuga

SEQ ID NO: 27997 - RNA, 1176 nt, Artificial Sequence
  derived and/or modified sequence opt1 from CDC42EP1__Homo_sapiens__NP_689449
augcccggcccgcagggcgggcgcggggccgccaccaugagccugggcaagcucucccccguggggugggucagcuccagccagggcaagcggcgccugaccgcggacaugaucucccacccccugggcgacuuccggcacacgaugcacguggggcgcggcggggacguguucggcgacaccagcuuccucuccaaccacgggggcagcuccggcagcacccaccggagcccccgcuccuuccuggccaagaagcugcagcucguccggcgcgugggggccccgccccggcgcauggccuccccgcccgcccccagccccgcgccgcccgccaucucccccaucaucaagaacgccaucagccugccccagcugaaccaggccgcguacgacucccucguggucggcaagcugagcuucgacuccagccccaccagcuccacggacgggcacagcuccuacggccuggacagcggcuucugcaccaucucccggcucccccgcagcgagaagccgcacgaccgggaccgcgacggguccuuccccagcgagcccggccugcggcgcuccgacagccugcucuccuuccggcuggaccuggaccucgggcccagccugcuguccgagcuccugggcgugaugagccugccggaggcccccgccgccgagacccccgcccccgcggccaacccgcccgcccccaccgccaaccccacggggccggccgcgaacccgcccgccaccaccgccaacccgcccgcccccgccgcgaaccccuccgcccccgccgccacccccacgggccccgccgcgaacccgcccgcccccgccgccagcuccacgccccacggccacugccccaacggggugaccgcgggccucgggccggucgccgaggucaagagcucccccgugggcgggggcccccgcggccccgccgggccggcccugggccggcacuggggcgccgggugggacgggggccaccacuaccccgagauggacgcgcgccaggagcggguggaggugcugccccaggcccgcgccagcugggagagccucgacgaggaguggcgcgcgccccaggccggcucccggaccccggugcccagcaccguccaggccaacaccuucgaguucgccgacgccgaggaggacgacgaggugaagguguga

SEQ ID NO: 27998 - RNA, 765 nt, Artificial Sequence
  derived and/or modified sequence opt1 from CDC42EP3__Homo_sapiens__NP_006440
augcccgccaagaccccgaucuaccugaaggccgcgaacaacaagaagggcaagaaguucaagcuccgcgacauccugagccccgacaugaucuccccgccccugggggacuuccggcacaccauccacaucggcaaggaggggcagcacgacguguucggcgacaucagcuuccuccaggggaacuacgagcugcugcccggcaaccaggagaaggcccaccucggccaguuccccgggcacaacgaguucuuccgcgccaacuccacgagcgacuccgucuucaccgagacccccagccccgugcugaagaacgccaucucccugccgaccaucggcgggagccaggcccucaugcugccccugcucucccccgugacguucaacagcaagcaggaguccuucggccccgcgaagcugccgcggcugagcugcgagcccgucauggaggagaaggcccaggagaaguccagccuccuggagaacgggaccgugcaccagggcgacaccuccuggggcagcuccgggagcgccucccagagcagccagggccgcgacucccacagcuccagccuguccgagcaguaccccgacuggcccgccgaggacauguucgaccacccgacccccugcgagcucaucaaggggaagaccaagagcgaggagucccugagcgaccugacgggcucccuccugagccugcagcucgaccugggccccucccugcucgacgaggugcugaacgucauggacaagaacaaguga

SEQ ID NO: 27999 - RNA, 255 nt, Artificial Sequence
  derived and/or modified sequence opt1 from CDC42SE2__Homo_sapiens__NP_001033791
augagcgaguucuggcugugcuucaacugcugcaucgccgagcagccccagccgaagcgccggcgccggaucgaccgcuccaugaucggcgagcccaccaacuucgugcacaccgcccacgucgggagcggcgaccucuucuccgggaugaacagcguguccagcauccagaaccagaugcaguccaagggcggguacggcggcgggaugcccgcgaacgugcagaugcagcuggucgacacgaaggccggcuga

SEQ ID NO: 28000 - RNA, 1797 nt, Artificial Sequence
  derived and/or modified sequence opt1 from CDC45__Homo_sapiens__XP_005261342
auguucgugagcgacuuccgcaaggaguucuacgaggucgugcagucccagcgggugcugcuguucgucgccagcgacguggacgcccugugcgcgugcaagauccugcaggcccucuuccagugcgaccacgugcaguacacccugguccccguguccggcuggcaggagcuggagaccgccuuccucgagcacaaggagcaguuccacuacuucauccugaucaacugcggggccaacguggaccugcucgacauccugcagccggacgaggacacgaucuucuucgucugcgacacccaccgccccgugaacguggucaacguguacaacgacacccagaucaagcugcucaucaagcaggacgacgaccuggaggugcccgccuacgaggacaucuuccgggacgaggaggaggacgaggagcacagcggcaacgacuccgacgggagcgagcccuccgagaagcgcacccggcuggaggaggagaucgucgagcagacgaugcgccggcgccagcggcgcgagugggaggcgcggagcggcuccgggagcgagccgguggccgccgcccucgagaaguccagccgccuguucgcgggccccauguccgaccggaccgcgccccgcagcccccggcgcgacauccuguucgacuacgagcaguacgaguaccacggcaccuccagcgccauggugauguucgagcucgccuggaugcuguccaaggaccugaacgacaugcucuggugggccaucgucgggcugaccgaccagugggugcaggacaagaucacgcagaugaaguacgugaccgacgucggcgugcugcagcggcacgugagccgccacaaccaccggaacgaggacgaggagaacacccucuccgucgacugcacccgcaucagcuucgaguacgaccugcggcuggugcucuaccagcacuggagccugcacgacucccugugcaacacgagcuacaccgccgcccgcuucaagcucugguccguccacgggcagaagcgccugcaggaguuccuggccgacaugggccucccgcugaagcaggucaagcagaaguuccaggccauggacaucagccugaaggagaaccuccgggagaugaucgaggaguccgccaacaaguucgggaugaaggacaugcgcgugcagaccuucagcauccacuucggcuucaagcacaaguuccuggcguccgacgugguguucgccaccaugagccugauggagucccccgagaaggacggcagcgggacggaccacuucauccaggcccucgacucccugagccgguccaaccuggacaagcucuaccacggccuggagcuggccaagaagcagcuccgcgccacccagcagaccaucgcgagcugccugugcaccaaccuggugaucucccaggggcccuuccucuacugcagccugauggagggcacgcccgacgucaugcuguucucccggccggccagccugucccuccugagcaagcaccuccucaagagcuucgugugcuccaccaagaaccgccggugcaagcugcugccccucgugauggccgcgccccugagcauggagcacggcaccgucaccgugguggggaucccgcccgagacggacuccagcgaccgcaagaacuucuucggccgggccuucgagaaggccgccgaguccaccagcucccgcaugcugcacaaccacuucgaccucagcgucaucgagcugaaggccgaggaccgguccaaguuccuggacgcccucaucagccugcuguccuga

SEQ ID NO: 28001 - RNA, 2409 nt, Artificial Sequence
  derived and/or modified sequence opt1 from CDC5L__Homo_sapiens__NP_001244
augccccgcaucaugaucaagggcgggguguggcggaacaccgaggacgagauccugaaggccgccgucaugaaguacggcaagaaccaguggagccgcaucgcgucccuccugcaccgcaagagcgccaagcagugcaaggcccggugguacgaguggcuggacccguccaucaagaagaccgaguggagccgggaggaggaggagaagcuccugcaccuggccaagcucaugcccacgcaguggcgcaccaucgcccccaucaucgggcggaccgcggcccagugccuggagcacuacgaguuccugcucgacaaggccgcccagcgcgacaacgaggaggagaccacggacgacccccggaagcugaagccgggcgagaucgaccccaaccccgagaccaagcccgcgcgcccggaccccaucgacauggacgaggacgagcuggagaugcucuccgaggcccgggcccgccuggccaacacccaggggaagaaggccaagcggaaggcgcgcgagaagcagcuggaggaggcccggcgccucgccgcccugcagaagcggcgcgagcugcgggccgcgggcaucgagauccagaagaagcgcaagcggaagcgcggcguggacuacaacgccgagauccccuucgagaagaagcccgcccucggguucuacgacaccagcgaggagaacuaccaggcccuggacgccgacuuccgcaagcugcggcagcaggaccucgacggcgagcugcgcuccgagaaggaggggcgggaccgcaagaaggacaagcagcaccugaagcggaagaaggagagcgaccucccguccgcgauccugcagacgagcggcguguccgaguucaccaagaagcgcagcaagcugguccuccccgcgccccagaucuccgacgccgagcugcaggagguggugaaggucgggcaggccagcgagaucgcccggcagaccgccgaggaguccggcaucaccaacagcgccuccagcacgcugcucuccgaguacaacgugaccaacaacagcguggcccugcgcacgccccggaccccggccagccaggaccgcauccugcaggaggcgcagaaccucauggcccugaccaacgucgacaccccgcugaagggcgggcucaacaccccgcugcacgaguccgacuucagcggcgugacgccccagcgccaggugguccagacccccaacaccgugcuguccacccccuuccggacccccagcaacggggccgagggccucacgccccgguccggcaccacccccaagcccgugaucaacagcacccccgggcgcacgccccugcgggacaagcugaacaucaacccggaggacggcauggccgacuacuccgaccccagcuacgucaagcagauggagcgcgagucccgggagcaccuccgccuggggcugcucggccugcccgccccgaagaacgacuucgagaucgugcugcccgagaacgcggagaaggagcucgaggagcgggagaucgacgacaccuacaucgaggacgccgccgacguggacgcccgcaagcaggccauccgcgacgcggagcgggucaaggagaugaagcgcaugcacaaggccgugcagaaggaccugccccggcccagcgaggugaacgagaccauccugcgcccgcugaacgucgagccgccccucaccgaccugcagaaguccgaggagcugaucaagaaggagaugaucacgaugcuccacuacgaccugcugcaccaccccuacgagcccagcgggaacaagaagggcaagaccgugggcuucgggaccaacaacuccgagcacaucaccuaccucgagcacaaccccuacgagaaguucagcaaggaggagcugaagaaggcccaggacgugcugguccaggagauggagguggucaagcagggcaugucccacggggagcucagcuccgaggccuacaaccaggugugggaggagugcuacagccaggugcuguaccugcccggccagucccgguacacgcgcgccaaccucgcgagcaagaaggaccggaucgagagccuggagaagcgccuggagaucaaccgggggcacaugaccaccgaggccaagcgcgccgccaagauggagaagaagaugaagauccuccugggcggcuaccagucccgggcgauggggcugaugaagcagcucaacgaccugugggaccagaucgagcaggcccaccuggagcuccgcaccuucgaggagcugaagaagcacgaggacagcgccaucccccggcgccuggagugccucaaggaggacguccagcggcagcaggagcgcgagaaggagcugcagcaccgguacgccgaccugcuccuggagaaggagacccugaaguccaaguucuga

SEQ ID NO: 28002 - RNA, 1683 nt, Artificial Sequence
  derived and/or modified sequence opt1 from CDC6__Homo_sapiens__NP_001245
augccccagacccgcagccaggcccaggccaccaucuccuucccgaagcggaagcugagccgcgcgcucaacaaggccaagaacuccagcgacgccaagcuggagcccacgaacgugcagaccgugaccugcagcccccgggugaaggcccugccccucuccccgcgcaagcggcugggcgacgacaaccugugcaacacgccccaccucccgcccugcuccccgcccaagcaggggaagaaggagaacggcccgccccacagccacacccugaaggggcgccggcugguguucgacaaccagcucaccaucaagucccccagcaagcgcgagcuggccaagguccaccagaacaagauccuguccagcgugcggaagucccaggagaucaccaccaacagcgagcagcgcugcccccucaagaaggaguccgcgugcgugcggcuguucaagcaggagggcacgugcuaccagcaggccaagcugguccucaacaccgccgugcccgaccgccugcccgcccgggagcgcgagauggacgugauccggaacuuccugcgcgagcacaucugcgggaagaaggcgggcagccucuaccuguccggcgccccggggaccggcaagaccgccugccugagccggauccuccaggaccugaagaaggagcugaagggguucaagacgaucaugcucaacugcaugucccugcgcaccgcccaggccgucuuccccgcgaucgcccaggagaucugccaggaggaggugagccggcccgccggcaaggacaugaugcgcaagcuggagaagcacaugaccgccgagaaggggcccaugaucgugcucguccuggacgagauggaccagcuggacagcaagggccaggacgugcucuacacccuguucgaguggccguggcuguccaacagccaccucgugcugaucggcaucgccaacacgcuggaccucaccgaccggauccugccccgccugcaggcgcgcgagaagugcaagccccagcuccugaacuucccgcccuacacccggaaccagaucgucaccauccugcaggaccgccucaaccaggugucccgggaccaggugcuggacaacgccgccguccaguucugcgcccgcaaggugagcgccguguccggggacguccggaaggcgcuggacgugugccgccgggccaucgagaucguggagagcgacgucaagucccagacgauccucaagccccugagcgagugcaagucccccagcgagccccugauccccaagcgcgugggccucauccacaucucccaggucaucagcgagguggacgggaaccggaugacccugucccaggagggcgcccaggacagcuucccccugcagcagaagauccuggugugcucccucaugcugcugauccgccagcucaagaucaaggaggucacccugggcaagcuguacgaggccuacagcaaggugugccggaagcagcaggucgccgcggucgaccaguccgagugccucagccuguccgggcugcucgaggcccgcggcauccuggggcugaagcggaacaaggagacccgccucacgaagguguucuucaagaucgaggagaaggagaucgagcacgcccugaaggacaaggcccugaucggcaacauccucgcgaccgggcugcccuga

SEQ ID NO: 28003 - RNA, 1596 nt, Artificial Sequence
  derived and/or modified sequence opt1 from CDC73__Homo_sapiens__NP_078805
auggccgacgugcugagcguccuccgccaguacaacauccagaagaaggagaucguggugaagggcgacgaggucaucuucggggaguucuccuggcccaagaacgugaagaccaacuacguggucuggggcaccgggaaggagggccagccgcgggaguacuacacgcuggacagcauccuguuccuccugaacaacgugcaccugucccaccccguguacguccgccgggccgcgaccgagaacauccccguggugcgccggcccgaccgcaaggaccuccugggguaccugaacggcgaggccagcaccuccgccagcaucgaccgguccgccccgcucgagaucggccugcagcgcagcacccaggucaagcgggccgcggacgaggugcuggccgaggccaagaagccccgcaucgaggacgaggagugcgugcggcucgacaaggagcgccuggccgcgcggcuggaggggcacaaggagggcaucguccagacggagcagauccgcucccucagcgaggccauguccguggagaagaucgccgccaucaaggccaagaucauggcgaagaagcggagcaccaucaagaccgaccuggacgacgacaucaccgcccugaagcagcgcuccuucguggacgccgaggucgacgugacgcgggacaucgugagccgcgagcgggucuggcgcacccggaccaccauccuccaguccacggggaagaacuucagcaagaacaucuucgccauccugcaguccgugaaggcccgcgaggagggccgcgcgcccgagcagcggcccgccccgaacgccgcccccguggaccccacccugcgcaccaagcagcccaucccggccgcguacaaccgguacgaccaggagcgcuucaaggggaaggaggagaccgagggcuucaagaucgacacgaugggcaccuaccacgggaugacccucaagagcgucaccgagggcgccuccgcccggaagacgcagacccccgccgcccagcccgugccccgcccggucagccaggcgcggcccccgcccaaccagaagaaggggagccgcacccccaucaucaucauccccgccgccaccacgucccugaucaccaugcugaacgccaaggaccuccugcaggaccugaaguucgugcccagcgacgagaagaagaagcagggcugccagcgggagaacgagacccucauccagcgccggaaggaccagaugcagcccggcgggaccgcgaucuccgugacggucccguaccgcgugguggaccagccccugaagcugaugccccaggacugggaccgggucguggccguguucguccagggccccgccuggcaguucaagggguggccguggcuccugcccgacggcagccccguggacaucuucgccaagaucaaggccuuccaccugaaguacgacgaggugcgccucgacccgaacguccagaagugggacgugaccgugcuggagcuguccuaccacaagcggcaccucgaccgccccgucuuccugcgguucugggagacccuggaccgcuacauggugaagcacaagagccaccuccgguucuga

SEQ ID NO: 28004 - RNA, 1725 nt, Artificial Sequence
  derived and/or modified sequence opt1 from CDC7__Homo_sapiens__XP_011540528
auggaggccagccugggcauccagauggacgagcccauggccuucuccccgcagcgcgaccgguuccaggcggaggggagccucaagaagaacgagcagaacuucaagcuggccggcgugaagaaggacaucgagaagcuguacgaggccgucccccagcucuccaacguguucaagaucgaggacaagaucggggagggcaccuucagcuccguguaccuggccaccgcccagcugcaggucgggcccgaggagaagaucgcgcucaagcaccugauccccacgagccacccgauccgcaucgccgccgagcugcagugccucaccguggccggcggccaggacaacgugaugggggucaaguacugcuuccggaagaacgaccacguggugaucgcgaugcccuaccuggagcacgaguccuuccuggacauccucaacagccuguccuuccaggagguccgcgaguacaugcugaaccucuucaaggcccugaagcggauccaccaguucggcaucgugcaccgcgacgugaagcccagcaacuuccuguacaaccggcgccucaagaaguacgcccuggucgacuucgggcuggcccagggcacccacgacaccaagaucgagcuccugaaguucgugcaguccgaggcccagcaggagcggugcagccagaacaagucccacaucaucacggggaacaagaucccccugagcggcccggugcccaaggagcucgaccagcaguccaccaccaaggcgagcgucaagcgccccuacaccaacgcccagauccagaucaagcagggcaaggacgggaaggagggcuccguggggcugagcgugcagcgguccgucuucggcgagcgcaacuucaacauccacagcagcaucucccacgagagccccgccgugaagcugaugaagcaguccaagacgguggacguccucagccggaagcuggccaccaagaagaaggccaucuccaccaaggugaugaacagcgcggugaugcgcaagaccgccuccagcugcccggccucccugacgugcgacugcuacgccaccgacaaggucugcagcaucugccucucccggcgccagcaggucgcgccccgggccggcacccccggguuccgcgcccccgaggugcugaccaagugcccgaaccagacgaccgccaucgacauguggagcgccggcgugaucuuccugucccuccugagcgggcgguaccccuucuacaaggccuccgacgaccugaccgcgcucgcccagaucaugaccauccgcggcagccgggagacgauccaggccgccaagaccuucgggaaguccauccugugcagcaaggaggugcccgcgcaggaccugcgcaagcucugcgagcgccugcggggcauggacuccagcacccccaagcugaccagcgacauccagggccacgccucccaccagccggccaucagcgagaagacggaccacaaggccuccugccucguccagaccccgcccgggcaguacagcggcaacuccuucaagaagggggacagcaacuccugcgagcacugcuucgacgaguacaacaccaaccuggagggcuggaacgaggugcccgacgaggccuacgaccugcucgacaagcugcuggaccucaaccccgcgagccgcaucaccgccgaggaggcccugcugcaccccuucuucaaggacaugucccuguga

SEQ ID NO: 28005 - RNA, 3072 nt, Artificial Sequence
  derived and/or modified sequence opt1 from CDCA2__Homo_sapiens__NP_689775
auggacgccaacagcaaggacaagcccccggagaccaaggaguccgccaugaacaacgcgggcaacgccagcuucauccuggggaccggcaagaucgugacgccccagaagcacgccgagcucccgcccaaccccugcacccccgacaccuucaagagcccccugaacuucagcaccgucacgguggagcagcuggggaucacccccgaguccuucgugcgcaacagcgccggcaaguccagcuccuaccucaagaagugccggcgccggagcgccgucggggcgcgcggcuccccggagaccaaccaccugauccgguucaucgcccgccagcagaacaucaagaacgcccgcaagagcccccuggcccaggacucccccagccagggcucccccgcgcucuaccggaacgugaacacccugcgggagcgcaucagcgccuuccaguccgccuuccacagcaucaaggagaacgagaagaugacggggugccuggaguucuccgaggccggcaaggagagcgagaugaccgaccucacccggaaggaggggcugagcgccugccagcaguccggcuucccggcggugcugagcuccaagcgccggcgcaucagcuaccagcgggacuccgacgagaaccucaccgacgccgaggggaaggucaucggccugcagaucuucaacaucgacacggaccgcgccugcgccguggagaccagcguggaccuguccgagaucagcuccaagcucggcagcacccaguccggguuccuggucgaggagagccugccccucuccgagcugaccgagacgagcaacgcccugaagguggcggacugcguggucggcaagggguccagcgacgccgugucccccgacaccuucaccgccgaggugagcuccgacgccguccccgacgugcggagcccggccacccccgcgugccgccgggaccuccccacgcccaagaccuucgugcugcgcagcguccugaagaagccguccgugaagaugugccucgagagccugcaggagcacugcaacaaccuguacgacgacgacggcacccaccccucccucaucagcaaccugcccaacugcugcaaggagaaggaggccgaggacgaggagaacuucgaggcccccgccuuccugaacaugcggaagcgcaagcgcgugaccuucggcgaggaccucuccccggaggucuucgacgagagccugcccgccaacacgccccugcggaagggcgggacccccgugugcaagaaggacuucuccgggcucagcucccugcugcucgagcagagcccggugcccgagccccugccgcagcccgacuucgacgacaagggcgagaaccuggagaacaucgagccccuccaggucuccuucgcggugcugagcucccccaacaagagcuccaucagcgagacccuguccgggaccgacacguucagcagcuccaacaaccacgagaagaucagcuccccgaaggucggccgcaucacccggaccagcaaccgccggaaccagcucguguccguggucgaggagagcgugugcaaccugcugaacaccgaggugcagcccugcaaggagaagaagaucaaccgccggaagucccaggagacgaagugcaccaagcgcgcccuccccaagaagucccagguccugaaguccugccggaagaagaagggcaaggggaagaaguccgugcagaagucccuguacggcgagcgcgacaucgccagcaagaagccccuccugagcccgauccccgagcugcccgaggugcccgagaugaccccgagcauccccuccauccggcgccuggggagcggcuacuucuccagcaacgggaagcucgaggaggucaagacccccaagaaccccgugaagcggaaggaccugcugcgccacgacccggaccuccacaugcaccagggcuacgacaaguacgacguguccgaguucugcagcuacaucaagagcuccagcucccugggcaacgccacgagcgacgaggaccccaacaccaacaucaugaacaucaacgagaacaagaacauccccaaggcgaagaacaaguccgagagcgagaacgagcccaaggccgggaccgacuccccggucagcugcgccuccgugaccgaggagcggguggccagcgacucccccaagcccgcccugacccuccagcagggccaggaguucagcgccgggggccagaacgcggagaaccugugccaguucuucaagaucucccccgaccugaacaucaagugcgagcgcaaggacgacuuccucggggccgccgagggcaagcugcagugcaaccggcugaugccgaacagccagaaggacugccacugccucggcgacguccugaucgagaacacgaaggaguccaagagccaguccgaggaccuggggcgcaagcccauggagagcuccagcguggugagcugccgggaccgcaaggaccgccggcgcuccaugugcuacagcgacggccggucccuccaccuggagaagaacgggaaccacacccccagcuccagcgucggcuccagcguggagaucucccuggagaacagcgagcuguucaaggaccucuccgacgccaucgagcagaccuuccagcgccggaacagcgagaccaaggugcgccgguccacgcgccugcagaaggaccucgagaacgagggccuggucuggaucagccugccgcuccccuccaccagccagaaggcgaagcggcgcaccaucugcaccuucgacuccagcggguucgaguccaugagccccaucaaggagacggugagcucccggcagaagccccagauggccccgcccgugagcgaccccgagaacucccagggccccgccgccgggagcuccgacgagccgggcaagcgccgcaagagcuucugcaucuccacccuggccaacaccaaggcgaccagccaguucaagggguaccggcggcgcuccagccugaacggcaagggcgaguccagccucacggcccuggagcggaucgagcacaacggggagcgcaagcaguga

SEQ ID NO: 28006 - RNA, 807 nt, Artificial Sequence
  derived and/or modified sequence opt1 from CDCA3__Homo_sapiens__NP_112589
augggcagcgccaaguccgugcccgucaccccggcccgcccgccgccccacaacaagcaccuggcgcggguggccgacccccgcagccccuccgccgggauccuccggacccccauccagguggagagcagcccccagcccggccugcccgccggggagcagcuggagggccucaagcacgcccaggacuccgacccccgcucccccacgcuggggaucgcgcggaccccgaugaagaccagcuccggcgacccgcccagcccccuggucaagcagcucuccgagguguucgagaccgaggacagcaaguccaaccugccgcccgagcccgugcugccgcccgaggcgccccucagcuccgagcuggaccugccccucggcacgcagcugagcgucgaggagcagaugccgcccuggaaccagaccgaguuccccuccaagcaggucuucagcaaggaggaggcccgccagcccaccgagacccccguggccucccagagcagcgacaagcccucccgggaccccgagacgccccgcagcuccgggagcaugcggaaccgcuggaagccgaacuccagcaaggugcugggccggagcccccucaccauccugcaggacgacaacucccccgggacccugacccuccgccagggcaagcggcccuccccgcugagcgagaacguguccgagcugaaggagggggccauccucggcacgggccgccugcugaagaccgggggccgggccugggagcaggggcaggaccacgacaaggagaaccagcacuucccccucguggagagcuga

SEQ ID NO: 28007 - RNA, 759 nt, Artificial Sequence
  derived and/or modified sequence opt1 from CDCA5__Homo_sapiens__NP_542399
augagcggccgccggacccgcuccgggggcgccgcccagcggagcgggccccgcgcgcccucccccaccaagccccugcggcgcagccagcggaaguccggcagcgagcuccccuccauccugccggagaucuggcccaagacgcccagcgccgccgccgugcgcaagcccaucguccugaagcggaucguggcccacgcgguggaggucccggccgugcagagcccccgccggagcccccgcaucuccuucuuccucgagaaggagaacgagcccccggggcgggagcugaccaaggaggaccuguucaagacccacuccgugcccgccacccccacguccacccccgucccgaaccccgaggccgagagcuccagcaaggagggcgagcucgacgcgcgcgaccuggagauguccaagaaggugcggcgcagcuacucccggcuggagacccucggcagcgccagcaccuccacgcccgggcgccggagcugcuucggcuucgaggggcugcugggcgccgaggaccucuccggggugagccccgucgugugcuccaagcugaccgaggugccgcgcgucugcgccaagcccugggcccccgacaugacccugcccggcaucagcccgccgcccgagaagcagaagcggaagaagaagaagaugcccgagauccucaagaccgagcuggacgagugggcggccgccaugaacgccgaguucgaggccgcggagcaguucgaccugcucguggaguga

SEQ ID NO: 28008 - RNA, 1353 nt, Artificial Sequence
  derived and/or modified sequence opt1 from CDCA7__Homo_sapiens__NP_114148
auggacgcccgccgggugccccagaaggaccugcgcgucaagaagaaccugaagaaguuccgguacgugaagcugaucagcauggagaccuccagcuccagcgacgacuccugcgacagcuucgccuccgacaacuucgcgaacaccaagccgaaguuccgcagcgacaucuccgaggagcuggccaacguguucuacgaggacagcgacaacgaguccuucugcggcuucagcgaguccgagguccaggacgugcucgaccacugcggguuccugcagaagccccggcccgacgugacgaacgagcuggccggcaucuuccacgccgacagcgacgacgaguccuucugcggguucagcgaguccgagauccaggacggcaugcgccuccagagcguccgggaggggugccgcacccggucccagugccgccacagcggcccccugcggguggccaugaaguucccggcgcgcagcacccggggcgccaccaacaagaaggccgagucccgccagcccagcgagaacuccgugacggacagcaacuccgacagcgaggacgaguccgggaugaacuuccuggagaagcgggcccucaacaucaagcagaacaaggcgaugcuggccaagcugaugagcgagcucgaguccuuccccggcagcuuccgcgggcggcacccccugccgggcuccgacagccagucccgccggccccgccggcgcaccuuccccggggucgccagccgccggaaccccgagcgccgggcccgcccgcugacccggucccgcagccggauccucggcucccuggacgcccugcccauggaggaggaggaggaggaggacaaguacaugcucgugcgcaagcggaagaccguggacggcuacaugaacgaggacgaccugccccgcagccggcgcucccggagcagcgucacgcugccccacaucauccgcccgguggaggagaucaccgaggaggagcucgagaacgugugcuccaacagccgggagaagaucuacaaccgcucccuggggagcacgugccaccagugccggcagaagaccaucgacaccaagaccaacugccgcaaccccgacugcuggggcguccgggggcaguucugcggccccugccugcgcaaccgcuacggcgaggaggugcgggacgcgcuccuggaccccaacuggcacugcccgcccugccgcgggaucugcaacugcuccuucugccggcagcgcgacggccggugcgccaccggggugcuggucuaccucgccaaguaccacggcuucgggaacgugcacgccuaccucaagagccugaagcaggaguucgagaugcaggccuga

SEQ ID NO: 28009 - RNA, 1263 nt, Artificial Sequence
  derived and/or modified sequence opt1 from CDCA7L__Homo_sapiens__NP_001120842
auggagacccugagcuccgaggagagcugcgacuccuucgacagccucgaguccggcaagcagcaggacgugcgcuuccacagcaaguacuucaccgaggagcugcggcgcaucuucaucgaggacacggacuccgagaccgaggacuucgccggguucacccagagcgaccugaacggcaagaccaaccccgaggucauggugguggaguccgaccucagcgacgacgggaaggccucccuggucagcgaggaggaggaggacgaggaggaggacaaggcgacgccgcggcgcucccggagccgccgguccagcaucggccugcgcguggccuuccaguuccccaccaagaagcucgccaacaagcccgacaagaacuccagcuccgagcagcuguucagcagcgcccggcugcagaacgagaagaagaccauccucgagcgcaagaaggacugccgccaggugauccagcgcgaggacuccaccagcgaguccgaggacgacagccgggacgagucccaggagagcuccgacgcccugcugaagcgcacgaugaacaucaaggagaacaaggcgaugcucgcccagcugcuggccgagcucaacagcaugcccgacuucuucccgguccggacccccaccuccgccagccgcaagaagaccgugcggcgcgcguucuccgaggggcagaucacgcggcgcaugaaccccacccggagcgcccggcccccggagaaguucgcccuggagaacuucaccguguccgccgccaaguucgcggaggaguucuacagcuuccgccggcgcaagaccaucggcggcaagugccgggaguaccgccggcgccaccggaucuccagcuuccgccccgucgaggacaucacggaggaggaccuggagaacguggccaucaccgugcgggacaagaucuacgacaagguccucgggaacacgugccaccagugccgccagaagaccaucgacaccaagaccgugugccggaaccagggcugcugcggggugcgcggccaguucugcgggcccugccugcggaaccgcuacggcgaggacguccgguccgcccugcucgaccccgacugggugugcccgcccugccgcggcaucugcaacugcagcuacugccggaagcgcgacgggcggugcgccaccggcauccugauccaccuggccaaguucuacggguacgacaacgugaaggaguaccucgagucccugcagaaggagcuggucgaggacaacuga

SEQ ID NO: 28010 - RNA, 2511 nt, Artificial Sequence
  derived and/or modified sequence opt1 from CDCP1__Homo_sapiens__NP_073753
auggccggccugaacugcggggugagcaucgcccuccugggcguccugcuccugggggcggcccgccugccccggggcgccgaggccuucgagaucgcccucccgcgcgaguccaacaucaccgugcugaucaagcuggggacccccacgcuccuggcgaagcccugcuacaucgugaucagcaagcggcacaucaccaugcuguccaucaagagcggcgagcgcaucgucuucaccuucuccugccagagccccgagaaccacuucgugaucgagauccagaagaacaucgacugcauguccggcccgugccccuucggggaggugcagcuccagcccagcaccucccugcugcccacgcucaaccggaccuucaucugggacgucaaggcccacaagagcaucggccuggagcugcaguucuccaucccgcgccuccggcagaucgggcccggcgagagcugccccgacggggugacccacuccaucagcggccgcaucgacgccaccgugguccggaucggcacguucugcuccaacgggaccgugagccgcaucaagaugcaggagggcgugaagauggcccugcaccuccccugguuccacccgcggaacgucuccggguucagcaucgcgaaccgcuccagcaucaagcggcugugcaucaucgagagcguguucgagggcgagggcuccgccacccugaugagcgccaacuaccccgagggguuccccgaggacgagcugaugaccuggcaguucgugguccccgcccaccuccgcgccuccgugagcuuccugaacuucaaccuguccaacugcgagcggaaggaggagcgcguggaguacuacaucccgggcagcacgaccaaccccgaggucuucaagcucgaggacaagcagcccgggaacauggcgggcaacuucaaccugucccugcaggggugcgaccaggacgcccagagccccggcauccuccggcugcaguuccaggugcuggugcagcacccgcagaacgaguccaacaagaucuacgucguggaccucagcaacgagcgcgccaugucccugaccaucgagccccggcccgugaagcagagccgcaaguucguccccggcugcuucgugugccuggagucccggaccugcagcuccaaccucacgcugaccagcggguccaagcacaagaucagcuuccugugcgacgaccucacccgccuguggaugaacgucgagaagaccaucuccugcacggaccaccgcuacugccagcgcaagagcuacagccuccaggugccguccgacauccugcaccuccccguggagcugcacgacuucagcuggaagcugcugguccccaaggaccggcugucccucgugcuggugcccgcccagaagcugcagcagcacacccacgagaagccgugcaacaccagcuucuccuaccuggucgccagcgcgauccccucccaggaccucuacuucggcagcuucugccccgggggcuccaucaagcagauccaggugaagcagaacaucagcgugacccugcggacguucgccccguccuuccagcaggaggccagccgccaggggcugaccgucuccuucauccccuacuucaaggaggagggcguguucaccgugacccccgacaccaagagcaaggucuaccuccggacgcccaacugggaccgcggccugccgucccugaccagcguguccuggaacaucagcgugccccgggaccaggucgccugccucaccuucuucaaggagcgcagcgggguggugugccagacgggccgggccuucaugaucauccaggagcagcgcacccgggcggaggagaucuucucccuggacgaggacguccugcccaagcccagcuuccaccaccacuccuucugggugaacaucagcaacugcuccccgaccagcgggaagcagcucgaccugcuguucuccgugacccucacgccccgcaccgucgaccugaccgugauccugaucgccgccgugggcgggggcguccuccugcugagcgcccucggccugaucaucugcugcgugaagaagaagaagaagaagaccaacaaggggcccgccgugggcaucuacaacgacaacaucaacaccgagaugccccggcagccgaagaaguuccagaaggggcgcaaggacaacgacucccacgucuacgcggugaucgaggacacgaugguguacggccaccuccugcaggacagcuccggcagcuuccugcagcccgaggucgacaccuaccggcccuuccaggggaccaugggcgugugcccgcccuccccgcccaccaucugcagccgcgcccccacggccaagcuggccaccgaggagcccccgccccgguccccgcccgagagcgaguccgagcccuacaccuucagccaccccaacaacggggacguguccagcaaggacaccgacaucccccuccugaacacgcaggagcccauggagcccgcggaguga

SEQ ID NO: 28011 - RNA, 2367 nt, Artificial Sequence
  derived and/or modified sequence opt1 from CDH10__Homo_sapiens__NP_006718
augaccauccaccaguuccugcuccuguuccuguucugggugugccucccccacuucugcagccccgagaucauguuccgccggacccccgucccccagcagcgcauccuguccagccgggugccccgcuccgacggcaagauccugcaccggcagaagcgcggguggauguggaaccaguucuuccuccuggaggaguacacgggcagcgacuaccaguacguggggaagcugcacuccgaccaggacaagggcgacgggagccucaaguacauccuguccggcgacggcgccgggacccuguucaucaucgacgagaagaccggcgacauccacgccacccggcgcaucgaccgggaggagaaggcguucuacacgcuccgcgcccaggccaucaaccggcgcacccugcggccggucgagcccgagagcgaguucgugaucaagauccacgacaucaacgacaacgagcccaccuuccccgaggagaucuacaccgccuccgugccggagaugagcgucguggggacguccgugguccaggugaccgccaccgacgcggacgaccccagcuacggcaacuccgcccgcgugaucuacagcauccugcaggggcagcccuacuucuccgucgagcccgagaccggcaucauccggacggcccucccgaacaugaaccgcgagaaccgggagcaguaccagguggugauccaggccaaggacaugggcgggcagaugggcgggcugagcggcaccaccaccgucaacaucacgcugaccgacgugaacgacaacccgccccgcuucccccagaacaccauccaccuccgggugcuggaguccagccccgucggcaccgcgaucggguccgugaaggccacggacgccgacaccggcaagaacgccgagguggaguaccgcaucaucgacggggacggcaccgacauguucgacaucgucaccgagaaggacacgcaggaggggaucaucaccgugaagaagccccuggacuacgagagccggcgccucuacacccugaagguggaggccgagaacacccacgucgacccccgcuucuacuaccugggccccuucaaggacacgaccaucgugaagaucagcaucgaggacgucgacgagccgcccguguucucccggagcuccuaccucuucgaggugcacgaggacaucgaggucggcaccaucaucgggaccgugauggcgcgcgaccccgacagcaucuccagccccauccgguucucccuggaccgccacacggaccuggaccggaucuucaacauccacagcggcaacgggucccucuacaccagcaagccgcuggaccgcgagcugucccaguggcacaaccucaccgugaucgccgccgagaucaacaaccccaaggagaccacgcgggucgccguguucgugcgcauccuggacgucaacgacaacgcgccccaguucgccguguucuacgacaccuucgugugcgagaacgcccggcccggccagcugauccagaccaucagcgccgucgacaaggacgacccgcucgggggccagaaguucuucuucucccuggccgccgugaaccccaacuucaccgugcaggacaacgaggacaacaccgcgcgcauccugacgcggaagaacggcuucaaccgccacgagaucagcaccuaccuccugcccgucgugaucuccgacaacgacuacccgauccagagcuccaccgggacccugacgauccgggugugcgccugcgacagccagggcaacaugcaguccugcagcgccgaggcccuccugcugcccgccgggcucagcaccggcgcgcugaucgccauccugcucugcaucaucauccugcuggucaucgugguccucuucgccgcccugaagcgccagcggaagaaggagccccugauccuguccaaggaggacauccgcgacaacaucgugagcuacaacgacgagggcgggggcgaggaggacacccaggcguucgacaucgggacccuccggaaccccgccgccaucgaggagaagaagcugcgccgggacaucaucccggagacgcuguucaucccccgccgcacccccaccgcccccgacaacaccgacgugcgggacuucaucaacgagcgccucaaggagcacgaccuggacccgacggccccgcccuacgacucccuggcgaccuacgccuacgagggcaacgacagcaucgccgagucccucagcucccuggagagcgggaccaccgagggcgaccagaacuacgacuaccugcgggaguggggcccccgcuucaacaagcucgccgagauguacgggggcggggaguccgacaaggacagcuga

SEQ ID NO: 28012 - RNA, 2391 nt, Artificial Sequence
  derived and/or modified sequence opt1 from CDH11__Homo_sapiens__NP_001788
augaaggagaacuacugccugcaggccgcccucgugugccugggcaugcugugccacagccacgcguucgcccccgagcgccgggggcaccuccgccccuccuuccacggccaccacgagaaggggaaggagggccagguccugcagcggagcaagcgcggguggguguggaaccaguucuucgugaucgaggaguacaccggccccgaccccguccuggugggccggcuccacuccgacaucgacagcggggacggcaacaucaaguacauccuguccggggagggcgccgggaccaucuucgugaucgacgacaagagcggcaacauccacgccacgaagacccuggaccgcgaggagcgggcccaguacacccucauggcgcaggccgucgaccgcgacaccaaccggccccuggagccgcccuccgaguucaucgugaaggugcaggacaucaacgacaacccgcccgaguuccugcacgagacguaccacgccaacguccccgagcgcagcaacgugggcaccuccgugauccaggucaccgccagcgacgcggacgaccccaccuacgggaacuccgccaagcucguguacagcauccuggagggccagcccuacuucuccguggaggcccagacggggaucauccggaccgcccugcccaacauggaccgcgaggccaaggaggaguaccacgucgugauccaggcgaaggacaugggcggccacaugggcgggcucagcgggaccaccaaggugacgaucacccugaccgacgucaacgacaacccgcccaaguucccccaguccguguaccagaugagcguguccgaggccgccguccccggcgaggagguggggcgggugaaggccaaggacccggacaucggcgagaacggccuggucaccuacaacaucguggacggggacggcauggagagcuucgagaucacgaccgacuacgagacccaggagggggucaucaagcucaagaagcccguggacuucgagaccaagcgcgccuacucccugaagguggaggcggccaacguccacaucgaccccaaguucaucagcaacggccccuucaaggacacggugaccgugaagaucagcgucgaggacgccgacgagccgcccauguuccuggcccccuccuacauccacgaggugcaggagaacgccgcggccgggaccguggucggccgggugcacgccaaggaccccgacgccgccaacagcccgauccgcuacuccaucgaccggcacaccgaccucgaccgcuucuucacgaucaaccccgaggacggcuucaucaagaccaccaagccccuggaccgggaggagaccgcguggcugaacaucacgguguucgccgccgagauccacaaccgccaccaggaggccaagguccccguggcgauccgggugcucgacgucaacgacaacgccccgaaguucgccgcccccuacgagggguucaucugcgagagcgaccagaccaagccccuguccaaccagccgaucgugaccaucagcgccgacgacaaggacgacaccgcgaacggcccccgcuucaucuucucccugccgcccgagaucauccacaaccccaacuucacggugcgcgacaaccgggacaacaccgccggggucuacgcccgccggggcggguucagccgccagaagcaggaccucuaccugcugcccaucgugaucuccgacggcggcaucccgcccaugagcuccaccaacacccucacgaucaaggugugcgggugcgacgucaacggcgcccugcugagcugcaacgccgaggcguacauccucaacgccgggcuguccaccggcgcccugaucgccauccucgccugcaucgugauccugcuggugaucgucguccucuucgugacccugcggcgccagaagaaggagccccugaucguguucgaggaggaggacgugcgggagaacaucaucaccuacgacgacgagggcgggggcgaggaggacaccgaggcguucgacaucgccacgcuccagaaccccgacgggaucaacggcuucaucccccgcaaggacaucaagcccgaguaccaguacaugccgcggcccgggcugcgccccgcccccaacagcguggacgucgacgacuucaucaacacccggauccaggaggccgacaacgacccgaccgcgccgcccuacgacuccauccagaucuacggcuacgagggccgcgggagcguggccggcucccugagcucccucgagagcgccaccacggacagcgaccuggacuacgacuaccugcagaacugggggccccgguucaagaagcucgccgaccuguacggcuccaaggacaccuucgacgacgacagcuga

SEQ ID NO: 28013 - RNA, 2283 nt, Artificial Sequence
  derived and/or modified sequence opt1 from CDH13__Homo_sapiens__NP_001207417
augaagaccccgcccggcgccagcucccgcaccaagugcagccgggagcugcgcuccuucugcgccuucagcugcccccgggcgaagcagcccacgugcaccgccugguucccccagcaggagcacccguccgagaacgggccccagaugcccggccgcgacccgcccgccgccagcaccaugcagguccuccugcugaccuccgccgaggaccucgacugcacgcccggguuccagcagaagguguuccacaucaaccagcccgcggaguucaucgaggaccagagcauccugaaccugaccuucuccgacugcaagggcaacgacaagcuccgguacgaggugagcucccccuacuucaaggugaacagcgacgggggccuggucgcccugcgcaacaucaccgccgugggcaagacccucuucgugcacgcccggacgccgcacgcggaggacauggccgagcuggucaucgucgggggcaaggacauccaggggucccugcaggacaucuucaaguucgcccgcaccagccccgugccccggcagaagcgcuccaucguggugagccccauccucaucccggagaaccagcggcagcccuucccccgcgacgugggcaaggucguggacuccgaccggcccgagcgcagcaaguuccggcugaccgggaagggcguggaccaggagccgaagggcaucuuccgcaucaacgagaacaccggguccgucagcgugacgcggacccuggaccgcgaggugaucgccgucuaccagcuguucguggagaccaccgacgugaacggcaagacgcucgaggggcccgucccccuggaggugaucgugaucgaccagaacgacaaccggcccaucuuccgcgagggcccguacaucggccacgucauggaggggagccccaccggcaccaccgugaugcggaugacggccuucgacgcggacgaccccgccaccgacaacgcccuccugcgcuacaacauccgccagcagacccccgacaagccgucccccaacauguucuacaucgaccccgagaagggggacaucgucaccguggugagcccggcccugcucgaccgggagacgcuggagaaccccaaguacgagcugaucaucgaggcccaggacauggcgggccucgacgucgggcugaccggcaccgccaccgccacgaucaugaucgacgacaagaacgaccacucccccaaguucaccaagaaggaguuccaggccaccguggaggagggcgccgugggggucaucgugaaccugaccguggaggacaaggacgaccccacgaccggcgcguggcgcgccgccuacaccaucaucaacgggaacccgggccagagcuucgagauccacaccaacccccagacgaacgaggggaugcucuccgucgugaagccccuggacuacgagaucagcgccuuccacacccugcucaucaagguggagaacgaggacccccuggucccggacguguccuacggccccagcuccaccgccaccgugcacaucaccguccuggacgugaacgagggccccguguucuaccccgacccgaugauggucacgcggcaggaggaccucagcgugggguccgugcugcugaccgucaacgcgaccgaccccgacagccuccagcaccagaccauccgcuacuccguguacaaggaccccgccggcuggcugaacaucaaccccaucaacgggacgguggacaccaccgccguccuggaccgggagagcccguucguggacaacuccguguacaccgcccucuuccuggcgaucgacagcggcaacccgcccgccacggggaccggcacccugcucaucacccuggaggacgucaacgacaacgcccccuucaucuaccccacgguggccgaggugugcgacgacgccaagaaccuguccgucgugauccucggcgcgagcgacaaggaccugcaccccaacaccgaccccuucaaguucgagauccacaagcaggccgugcccgacaaggucuggaagaucuccaagaucaacaacacccacgcccuggugagccuccugcagaaccugaacaaggccaacuacaaccugccgaucauggugaccgacagcgggaagccgcccaugacgaacaucaccgaccuccgcguccaggugugcuccugccggaacagcaagguggacugcaacgccgcgggcgcccugcgcuucucccugcccagcguccuccugcugucccucuucagccuggccugccuguga

SEQ ID NO: 28014 - RNA, 2445 nt, Artificial Sequence
  derived and/or modified sequence opt1 from CDH15__Homo_sapiens__NP_004924
auggacgccgccuuccugcucgugcugggccugcucgcgcagagccugugccugucccucgggguccccggcuggcgccggccgaccacccuguaccccuggcgccgggcccccgcccugagccgcgugcggcgcgccugggugaucccgcccaucuccgucagcgagaaccacaagcggcuccccuacccccuggugcagaucaaguccgacaagcagcagcuggggagcgugaucuacuccauccagggccccggggucgacgaggagccgcgcggcguguucagcaucgacaaguucacgggcaagguguuccucaacgccaugcuggaccgggagaagaccgaccgcuuccggcugcgcgcguucgcccucgaccucgggggcuccacccuggaggaccccaccgaccuggagaucgucgugguggaccagaacgacaaccggcccgccuuccugcaggaggccuucacggggcgcguccuggagggcgcggugcccgggaccuacgugacccgggccgaggccaccgacgccgacgacccggagacggacaacgccgcgcuccgcuucagcauccugcagcagggcucccccgagcuguucagcaucgacgagcucaccggcgagauccggaccguccagguggggcuggaccgcgagguggucgccguguacaaccugacccuccagguggccgacauguccggcgacgggcugacggccaccgccagcgcgaucaucacccuggacgacaucaacgacaacgcccccgaguucacccgggacgaguucuucauggaggccaucgaggccgucuccggcguggacgugggccgccucgaggucgaggaccgggaccugcccgggagcccgaacuggguggcccgcuucacgauccuggagggcgaccccgacgggcaguucaccauccgcaccgaccccaagaccaacgagggcguccucuccaucgugaaggcgcuggacuacgagagcugcgagcacuacgagcugaagguguccguccagaacgaggcgccccuccaggccgccgcccugcgggccgagcgcgggcaggccaaggugcgggugcacguccaggacacgaacgagccgcccguguuccaggagaacccccugcgcaccagccucgccgagggcgcgcccccgggcacccugguggccaccuucagcgcccgggaccccgacacggagcagcugcagcgccucuccuacagcaaggacuacgaccccgaggacuggcugcaggucgacgccgccaccgggcggauccagacccagcacgugcugucccccgccagcccguuccucaagggcgggugguaccgcgcgaucgugcuggcccaggacgacgccucccagccccggaccgccacgggcacccugagcaucgagauccucgaggucaacgaccacgcccccgugcuggcgccgcccccgcccgggucccugugcagcgagccccaccagggccccggccugcuccugggggccaccgacgaggaccugccgccccacggcgcccccuuccacuuccagcucagcccccgccugcccgagcuggggcggaacuggucccucucccaggugaacgucagccacgcccgccugcggccccgccaccaggugccggagggccugcaccggcucucccugcugcuccgcgacagcgggcagccgccccagcagcgggagcagccccugaacgugaccgucugccgcugcggcaaggacggcgugugccugcccggggccgcggcccuccuggccggcgggacgggccugucccucggcgcccuggugaucguccuggcgagcgcccuccugcugcucgugcuggugcugcucgucgcccugcgggcccgcuucuggaagcagucccgcgggaagggccugcuccacgggccccaggacgaccugcgggacaacgugcugaacuacgacgagcagggcgggggcgaggaggaccaggacgccuacgacaucagccagcuccgccaccccaccgcgcugucccugccccucggcccgccgccccugcggcgcgacgcgccccaggggcggcugcacccccagccgccccgcgugcuccccaccagcccccuggacaucgccgacuucaucaacgacggccuggaggccgccgacagcgaccccuccgugcccccguacgacaccgcccucaucuacgacuacgagggggacggcagcgucgccgggacgcuguccagcauccuguccagccagggcgacgaggaccaggacuacgacuaccuccgggacuggggcccccgcuucgcccggcuggccgacauguacgggcaccccugcggccuggaguacggggcccgcugggaccaccaggcgcgggagggccucucccccggggcccugcugccgcgccaccggggccgcaccgccuga

SEQ ID NO: 28015 - RNA, 2424 nt, Artificial Sequence
  derived and/or modified sequence opt1 from CDH16__Homo_sapiens__NP_001191673
auggugcccgccuggcuguggcuccugugcgucagcgugccgcaggcccugcccaaggcgcagcccgccgagcucuccguggagguccccgagaacuacggcgggaacuucccgcuguaccugaccaagcucccccugccccgcgagggcgccgaggggcagaucgugcugagcggcgacuccgggaaggccaccgagggccccuucgccauggacccggacagcggcuuccuccuggugacgcgggcgcuggaccgcgaggagcaggccgaguaccagcuccaggucacccuggagaugcaggacgggcacgugcuguggggcccccagcccgugcucguccacgugaaggacgagaacgaccaggugccccacuucucccaggccaucuaccgggcccgccugagccgggggacccgcccgggcauccccuuccuguuccucgaggcguccgaccgggacgagcccgggaccgccaacagcgaccugcgcuuccacauccugucccaggcccccgcccagccgagccccgacauguuccagcucgagccccggcugggcgcccuggcgcucucccccaagggcagcacgucccuggaccacgcccuggagcgcaccuaccagcuccugguccaggugaaggacaugggggaccaggccagcggccaccaggccaccgccaccguggaggucuccaucaucgagagcacgugggugucccuggagccgauccaccucgcggagaaccugaaggugcuguacccccaccacauggcccagguccacuggagcgggggcgacgugcacuaccaccucgagucccacccgcccggccccuucgaggugaacgccgaggggaaccuguacgucacccgggagcuggaccgcgaggcccaggccgaguaccuccuccaggugcgggcgcagaacagccacggcgaggacuacgccgcgccccuggagcugcacgugcuggucauggacgagaacgacaacgugcccaucugcccgccccgcgaccccaccgucagcauccccgagcuguccccgcccgggaccgaggugacgcggcucagcgccgaggacgccgacgcccccggcucccccaacagccacguggucuaccagcugcuguccccggagcccgaggacgggguggagggccgcgccuuccagguggaccccaccagcggcuccgucacccucggggugcugccccugcgggccggccagaacauccuccugcuggugcuggccauggaccucgcgggggccgagggcggguucagcuccacgugcgaggucgagguggccgugaccgacaucaacgaccacgccccggaguucaucaccagccagaucggccccaucucccugcccgaggacgucgagcccggcacccugguggccaugcucaccgcgaucgacgccgaccuggagccggccuuccgccugauggacuucgccaucgagcgcggggacacggagggcaccuucgggcucgacugggagcccgacagcggccacgugcggcugcggcugugcaagaaccucuccuacgaggccgcgcccagccacgaggucgugguggucgugcaguccguggccaagcuggucgggcccggcccgggccccggggccaccgccaccgugacggugcuggucgagcgcgugaugcccccgcccaagcucgaccaggagagcuacgaggccuccgugcccaucagcgcgcccgccggcuccuuccugcugaccauccagcccagcgacccgaucagccgcacccuccgguucucccuggucaacgacagcgagggguggcugugcaucgagaaguucuccggcgaggugcacaccgcccagagccuccagggcgcccagcccggggacacguacaccgugcuggucgaggcgcaggacaccgcccugacccucgcccccgugccgucccaguaccugugcacgccccgccaggaccacggccugaucgugagcgggcccuccaaggaccccgaccucgccagcggccacgggccguacuccuucacccugggccccaaccccaccguccagcgggacuggcgccugcagacccucaacggcagccacgccuaccugacgcuggcgcuccacuggguggagccccgggagcacaucaucccgguggucgugucccacaacgcccagauguggcagcugcuggugcgcgucaucgugugccggugcaacguggaggggcagugcaugcgcaaggucggccggaugaaggggaugcccaccaagcucagcgccgugggcauccugguggggacccuggucgccaucggcaucuuccucauccugaucuucacccacuggaccaugucccgcaagaaggaccccgaccagcccgccgacagcgugccgcugaaggcgacgguguga

SEQ ID NO: 28016 - RNA, 2499 nt, Artificial Sequence
  derived and/or modified sequence opt1 from CDH17__Homo_sapiens__NP_001138135
augauccugcaggcccaccuccacagccugugccugcucaugcuguaccuggccaccggcuacgggcaggagggcaaguucuccgggccccucaagccgaugaccuucagcaucuacgagggccaggagcccucccagaucaucuuccaguucaaggcgaacccgcccgccgugacguucgagcugaccggggagaccgacaacaucuucgucaucgagcgcgagggccugcucuacuacaaccgggcccuggaccgcgagacccggagcacgcacaaccuccagguggccgcccuggacgcgaacggcaucaucguggaggggcccguccccaucaccaucaaggugaaggacaucaacgacaaccgccccaccuuccugcaguccaaguacgagggcagcgugcggcagaacucccgccccgggaagccguuccuguacgucaacgccaccgaccucgacgaccccgccacgcccaacggccagcuguacuaccagaucgugauccagcugcccaugaucaacaacgugauguacuuccagaucaacaacaagaccggggccaucagccucacccgggagggcucccaggagcugaacccggcgaagaaccccagcuacaaccuggucaucuccgugaaggacaugggcgggcagagcgagaacuccuucagcgacaccacguccguggacaucaucgucaccgagaacaucuggaaggcccccaagcccguggagaugguggagaacagcaccgacccgcaccccaucaagaucacccagguccgcuggaacgaccccggcgcccaguacucccucguggacaaggagaagcugccccgguucccguucagcaucgaccaggagggggacaucuacgugacgcagccccuggaccgcgaggagaaggacgccuacgucuucuacgccguggcgaaggacgaguacggcaagccccucuccuacccccuggagauccacgugaaggucaaggacaucaacgacaacccgccgaccugccccagccccgugaccguguucgagguccaggagaacgagcggcugggcaacagcaucgggacccucacggcccacgaccgcgacgaggagaacaccgccaacuccuuccugaacuaccggaucguggagcagacccccaagcugcccauggacggccucuuccugauccagaccuacgccgggaugcugcagcucgccaagcagagccugaagaagcaggacacgccccaguacaaccugaccaucgaggucuccgacaaggacuucaagacccucugcuucgugcagaucaacgugaucgacaucaacgaccagaucccgaucuucgagaaguccgacuacggcaaccugacccuggcggaggacacgaacaucgggagcaccauccucaccauccaggccaccgacgccgacgagcccuucacgggcagcuccaagauccuguaccacaucaucaagggcgacagcgaggggcgccugggcgucgacaccgacccccacaccaacaccggguacgugaucaucaagaagccccucgacuucgagacggccgccguguccaacaucgucuucaaggcggagaacccggagccccugguguucggcgugaaguacaacgccagcuccuucgccaaguucacccugaucgucaccgacgugaacgaggcgccccaguucagccagcacguguuccaggccaaggucuccgaggacguggccaucgggaccaaggugggcaacgucaccgccaaggaccccgagggccucgacaucagcuacucccugcgcggggacacgcgcggcuggcugaagaucgaccacgugaccggggagaucuucagcguggccccgcucgaccgggaggccggcucccccuaccgcguccaggugguggcgaccgaggucgggggcagcucccugagcagcguguccgaguuccaccugauccugauggacgugaacgacaacccgccccggcucgccaaggacuacaccggccuguucuucugccacccccugagcgcccccgggucccucaucuucgaggccacggacgacgaccagcaccuguuccgcggcccccacuucaccuucagccugggguccggcagccuccagaacgacugggaggucuccaagaucaacggcacccacgcccggcugagcacccgccacacggaguucgaggagcgcgaguacguggugcugauccggaucaacgacgggggccggcccccgcucgaggggaucgucucccugcccgugaccuucugcagcugcguggagggcuccugcuuccggcccgcggggcaccagaccggcauccccaccgucggcauggccguggggauccugcucacgacccugcuggugaucggcaucauccucgccgucguguucauccgcaucaagaaggacaaggggaaggacaacguggagagcgcccaggccuccgaggucaagccgcugcggagcuga

SEQ ID NO: 28017 - RNA, 1725 nt, Artificial Sequence
  derived and/or modified sequence opt1 from CDH18__Homo_sapiens__NP_001161139
augaagaucaccagcaccuccugcaucugccccgugcuggucugccucugcuucgugcagcgcugcuacggcacggcccaccacagcuccaucaaggugaugcggaaccagaccaagcacaucgagggggagaccgagguccaccaccgcccgaagcggggcuggguguggaaccaguucuucgugcuggaggagcacauggggcccgacccccaguacgucggcaagcugcacagcaacuccgacaagggggacggcagcgugaaguacauccucaccggcgagggggccggcacgaucuucaucaucgacgacaccaccggggacauccacuccaccaagagccuggaccgcgagcagaagacgcacuacgugcugcacgcgcaggccaucgaccggcgcaccaacaagccccucgagccggaguccgaguucaucaucaagguccaggacaucaacgacaacgcccccaaguucaccgacggccccuacaucgugaccgugcccgagaugagcgacauggggacguccguccuccaggugaccgccaccgacgccgacgacccgaccuacggcaacagcgcgcggguggucuacuccauccugcagggccagcccuacuucagcguggaccccaagacgggggugauccgcaccgcccugcacaacauggaccgggaggcccgcgagcacuacuccgucgugauccaggccaaggacauggcgggccaggucgggggccugagcggcuccaccaccgugaacaucacgcugaccgacgugaacgacaacccgccccgguucccccagaagcacuaccagcucuacgugcccgagagcgcccaggucggguccgccgugggcaagaucaaggccaacgacgccgacaccgggagcaacgcggacaugaccuacagcaucaucaacggcgacgggaugggcaucuucuccaucagcacggacaaggagacccgcgagggcauccugucccugaagaagccccucaacuacgagaagaagaaguccuacacccugaacaucgagggggccaacacccaccuggacuuccgguucagccaccucggcccguucaaggacgccacgaugcugaagaucaucgucggggacguggacgagccgccccuguucagcaugcccuccuaccucauggagguguacgagaacgccaagaucggcaccgucguggggaccgugcuggcccaggaccccgacagcaccaacucccugguccgcuacuucaucaacuacaacguggaggacgaccgguucuucaacaucgacgcgaacacgggcaccauccgcaccaccaaggugcucgaccgggaggagacgcccugguacaacaucaccgucaccgccagcgagaucgacaaccccgaccugcugucccacgugaccgugggcauccgcguccucgacgugaacgacaacccgcccgagcuggcccgggaguacgacaucaucgugugcgagaacagcaagcccgggcaggucauccacaccaucuccgccacggacaaggacgacuucgccaacggcccccgcuucaacuucuuccuggacgagcggcuccccgugaacccgaacuucacccugaaggacaacgaggcggccgcccccagccccuccggguucgugcacgcccgcgagaugggcgucugcgggccggccaugcagaagcccagcugcccccgccugguguga

SEQ ID NO: 28018 - RNA, 1473 nt, Artificial Sequence
  derived and/or modified sequence opt1 from CDH19__Homo_sapiens__NP_001257957
augaacugcuaccugcuccugcgcuucaugcugggcaucccccuccuguggccgugccugggggccaccgagaacagccagaccaagaaggugaagcagcccguccggucccaccuccgcgugaagcggggcuggguguggaaccaguucuucguccccgaggagaugaacacgaccagccaccacaucgggcagcugcgcuccgaccuggacaacggcaacaacagcuuccaguacaagcuccugggggccggcgcgggcuccaccuucaucaucgacgagcggaccggggacaucuacgccauccagaagcuggaccgcgaggagcggagccucuacauccugcgcgcccaggugaucgacaucgccacgggccgggccguggagcccgaguccgaguucgucaucaaggugagcgacaucaacgacaacgagccgaaguuccuggacgagcccuacgaggcgaucgugcccgagaugucccccgaggggacccucgucauccaggugaccgccagcgacgccgacgacccguccagcggcaacaacgcccgccugcuguacucccuccugcaggggcagcccuacuucagcguggagcccaccacgggcgucauccggaucuccagcaagauggaccgcgagcugcaggacgaguacugggugaucauccaggcgaaggacaugaucggccagcccggggcccucuccggcaccaccagcgugcugaucaagcuguccgacgucaacgacaacaagccgaucuucaaggagagccucuaccggcugaccgugagcgaguccgcccccacggggaccagcaucggcaccaucauggccuacgacaacgacaucggcgagaacgccgagauggacuacuccaucgaggaggacgacagccagaccuucgacaucaucacgaaccacgagacccaggaggggaucgugauccugaagaagaaggucgacuucgagcaccagaaccacuacggcauccgcgcgaaggugaagaaccaccacgugcccgagcagcucaugaaguaccacaccgaggccuccaccacguucaucaagauccaggucgaggacguggacgagcccccgcuguuccugcuccccuacuacguguucgaggucuucgaggagacgccccaggggagcuucgugggcgucguguccgccaccgaccccgacaaccgcaagagcccgauccgguacuccaucacccggagcaagguguucaacaucaacgacaacgggaccaucaccaccuccaacagccuggaccgcgagaucuccgccugguacaaccugagcaucaccgccacggagaaguacaacaucgagcagaucuccagcaucccccucuacguccaggugcugaacaucaacgaccacgcgcccgaguucucccaguacuacgagaccuacgugugcgagaacgccggcagcggccaggggcuguucuucuga

SEQ ID NO: 28019 - RNA, 2649 nt, Artificial Sequence
  derived and/or modified sequence opt1 from CDH1__Homo_sapiens__NP_004351
augggccccuggagccgcucccugagcgcccuccugcugcuccuccagguguccagcuggcugugccaggagccggagcccugccaccccggguucgacgccgaguccuacaccuucaccgucccccggcgccaccuggagcggggccgcgugcuggggcgggugaacuucgaggacugcacgggccgccagcggaccgccuacuucagccuggacacccgcuucaaggucgggaccgacggcgugaucacggugaagcggccgcuccgcuuccacaacccccagauccacuuccuggucuacgccugggacuccaccuaccggaaguucagcaccaaggugacccugaacacggugggccaccaccaccgcccgcccccgcaccaggccuccgucagcgggauccaggccgagcuccugaccuuccccaacuccagccccggccugcggcgccagaagcgggacugggugaucccgcccaucuccugccccgagaacgagaaggggcccuuccccaagaaccucgugcagaucaagagcaacaaggacaaggagggcaaggucuucuacuccaucaccgggcagggcgccgacaccccgcccgugggcguguucaucaucgagcgcgagacgggguggcugaaggucaccgagccccuggaccgggagcgcaucgcgaccuacacccucuucagccacgccguguccagcaacggcaacgccguggaggaccccauggagauccugaucacggucaccgaccagaacgacaacaagccggaguucacccaggagguguucaagggguccgugauggagggcgcccugcccggcaccagcgucauggaggugacggcgaccgacgccgacgacgacgugaacaccuacaacgccgccaucgccuacaccauccucagccaggaccccgagcugcccgacaagaacauguucacgaucaaccggaacaccggggucaucuccguggucaccaccggccuggaccgcgagagcuucccgacguacacccucguggugcaggcggccgaccugcagggggagggccuguccaccaccgccacggccgucaucaccgugaccgacaccaacgacaacccgcccaucuucaaccccacgaccuacaagggccaggugcccgagaacgaggccaacgucgugaucaccacccucaaggugaccgacgcggacgcccccaacacgcccgccugggaggccgucuacaccauccugaacgacgacgggggccaguucguggugaccaccaacccggucaacaacgacgggauccugaagacggccaagggccucgacuucgaggcgaagcagcaguacauccugcacguggccgugaccaacgucgugcccuucgaggugagccugaccaccuccacggccaccgucaccguggacgugcucgacgucaacgaggcccccaucuucgugcccccggagaagcggguggaggucagcgaggacuucggggugggccaggagaucaccuccuacacggcccaggagcccgacaccuucauggagcagaagaucaccuaccgcaucuggcgcgacaccgcgaacuggcuggagaucaaccccgacacgggggccaucagcacccgggccgagcuggaccgcgaggacuucgagcacgugaagaacuccaccuacaccgcccucaucaucgcgacggacaacggcagccccgucgccaccggcaccgggacccugcugcucauccuguccgacgugaacgacaacgccccgauccccgagccccggacgaucuucuucugcgagcgcaaccccaagccccaggugaucaacaucaucgacgccgaccugccgcccaacaccagccccuucaccgccgagcucacccacggcgcguccgccaacuggacgauccaguacaacgaccccacccaggagagcaucauccugaagcccaagauggcccuggaggucggggacuacaagaucaaccucaagcugauggacaaccagaacaaggaccaggugaccacccuggagguguccgucugcgacugcgagggcgccgccggggugugccggaaggcgcagcccguggaggccggccuccagauccccgccauccugggcauccucgggggcauccuggcccugcugauccugauccuccugcugcuccuguuccugcgccggcgcgccgucgugaaggagccgcuccugccgcccgaggacgacacgcgggacaacguguacuacuacgacgaggagggcgggggcgaggaggaccaggacuucgaccugagccagcuccaccgcgggcuggacgcgcggcccgaggucacccgcaacgacguggcccccacccugauguccgugccccgguaccucccccgcccggccaaccccgacgagaucggcaacuucaucgacgagaaccugaaggccgcggacaccgaccccacggcgcccccguacgacagccugcucgucuucgacuacgagggguccggcagcgaggccgccagccuguccagccugaacuccagcgaguccgacaaggaccaggacuacgacuaccucaacgagugggggaaccgguucaagaagcuggccgacauguacggcggcggggaggacgacuga

SEQ ID NO: 28020 - RNA, 2406 nt, Artificial Sequence
  derived and/or modified sequence opt1 from CDH20__Homo_sapiens__XP_005266739
auguggaccagcggccgcauguccaacgccaagaacuggcuggggcucggcaugagccuguacuucugggggcugauggaccucaccacgaccgugcuguccgacacccccaccccgcagggcgagcuggaggcccuccugagcgacaagccccagucccaccagcggacgaagcgcagcugggucuggaaccaguucuucgugcuggaggaguacaccgggaccgacccccucuacgugggcaagcugcacuccgacauggaccggggcgacgggagcaucaaguacauccuguccggcgagggggccggcaucgucuucaccaucgacgacacgaccggggacauccacgccauccagcgccucgaccgggaggagcgcgcccaguacacccugcgggcccaggcccuggaccgccggaccggccgccccauggagccggagagcgaguucaucaucaagauccaggacaucaacgacaacgagcccaaguuccucgacggccccuacguggcgacggugcccgagauguccccggucgggaccagcgugauccaggugaccgccaccgacgccgacgaccccacguacggcaacuccgcccgggucguguacagcauccugcaggggcagcccuacuucuccguggacagcaagaccggcgucauccgcaccgcgcugaugaacauggaccgggaggccaaggaguacuacgaggugaucauccaggccaaggacaugggcgggcagcucggcgggcuggccggcaccacgaccgugaacaucacccuguccgacgucaacgacaacccgccccgcuucccccagaagcacuaccagaugagcgugcucgaguccgcccccaucagcagcaccguggggcgggucuucgcgaaggaccuggacgagggcaucaacgccgagaugaaguacacgaucguggacggcgacggggccgacgccuucgacaucuccaccgaccccaacuuccaggugggcaucaucaccgucaagaagccgcugagcuucgaguccaagaaguccuacacccucaagguggagggggccaacccccaccuggagaugcgcuuccugaaccucggccccuuccaggacacgaccaccgugcacaucagcgucgaggacguggacgagcccccggucuucgagcccggguucuacuucguggaggugcccgaggacgucgcgaucggcaccacgauccagaucaucagcgccaaggaccccgacgugaccaacaacuccauccgguacagcaucgaccgcuccagcgacccgggccgguucuucuacguggacaucaccaccggggcccugaugacggcccgcccccuggaccgggaggaguucuccuggcacaacaucaccguccucgccauggagaugaacaaccccagccaggugggcuccgugcccgucaccaucaaggugcuggacgugaacgacaacgcgccggaguucccccgcuucuacgaggccuucgucugcgagaacgccaaggccgggcagcugauccagaccgugagcgccguggaccaggacgacccccgcaacggccagcacuucuacuacucccucgcgccggaggccgccaacaaccccaacuucaccauccgggacaaccaggacaacacggcccgcauccugacccggcgcagcggguuccggcagcaggagcaguccgucuuccaccuccccauccugaucgcggacagcggccagcccgugcuguccagcaccggcacccugacgauccaggugugcagcugcgacgacgacgggcacgucauguccugcagcccggaggccuacaugcuccccgugucccugagccgcggcgcccugaucgccauccucgccugcaucuucgugcugcugguccucgugcugcugauccucuccaugcggcgccaccggaagcagcccuacaucaucgacgacgaggagaacauccacgagaacaucgugcgcuacgacgacgagggcgggggcgaggaggacaccgaggcguucgacaucgccgccauguggaacccccgggaggcccaggccggggcggccccgaagacccgccaggacaugcugcccgagaucgagagccugucccgguacgucccccagaccugcgccgugaacagcacggugcacuccuacguccuggccaagcucuacgaggccgacauggaccugugggcgcccccguucgacagccugcagaccuacauguucgagggcgacggguccguggccggcagccucuccagccugcaguccgccaccagcgacuccgagcagagcuucgacuuccugaccgacugggggccccgcuuccggaagcucgccgagcuguacggcgcgagcgagggccccgcgccccugugguga

SEQ ID NO: 28021 - RNA, 2487 nt, Artificial Sequence
  derived and/or modified sequence opt1 from CDH22__Homo_sapiens__XP_011527296
augcgcccccggccggagggccgcgggcugcgggccggcguggcccucagccccgcgcugcugcuccugcugcuccugccccccccgcccacccugcucgggcgccugugggccgccggcacccccucccccagcgccccgggggcccggcaggacggcgcgcugggcgccgggcgcgucaagcggggcuggguguggaaccaguucuucguggucgaggaguacacggggaccgagccccucuacgugggcaagauccacuccgacagcgacgagggggacggcgccaucaaguacaccaucuccggcgagggggccggcaccaucuuccugaucgacgagcugacgggggacauccacgcgauggagcgccucgaccgggagcagaagaccuucuacacccugcgcgcccaggcccgggaccgcgccaccaaccggcugcucgagcccgagagcgaguucaucaucaaggugcaggacaucaacgacuccgagccccgcuuccugcacggcccguacaucggcagcgucgccgagcugucccccacggggaccagcgugaugcaggugauggcguccgacgccgacgaccccaccuacggcagcuccgcccggcucgucuacagcgugcuggacggggagcaccacuucaccguggaccccaagacgggcgucauccgcaccgccgugccggaccuggaccgggagucccaggagcgcuacgagguggucauccaggccaccgacauggcggggcagcucggcggccugagcggguccaccacggugaccaucguggucaccgacgugaacgacaaccccccccgguucccccagaagauguaccaguucagcauccaggaguccgccccgaucggcaccgccguggggcgcgucaaggccgaggacagcgacgugggcgagaacacggacaugaccuaccaccugaaggacgagagcuccagcgggggcgacguguucaaggucaccaccgacuccgacacgcaggaggccaucaucgugguccagaagcggcucgacuucgagagccagcccgugcacaccgugauccuggaggcgcugaacaaguucgucgacccccgcuucgccgaccucggcaccuuccgcgaccaggccaucgugcggguggccgucaccgacguggacgagcccccggaguuccgcccccccuccgggcugcuggaggugcaggaggacgcccaggucggcagccucguggggguggucacggcgcgggaccccgacgccgccaaccgcccggugcgguacgccaucgaccgcgaguccgaccuggaccagaucuucgacaucgacgcggacaccggcgccaucgugaccgggaagggccuggaccgggagaccgccggcuggcacaacaucacgguccucgccauggaggccgacaaccacgcgcagcugagccgcgccucccugcggauccgcauccucgacgugaacgacaacccccccgagcuggccaccccguacgaggccgccgugugcgaggacgcgaagcccgggcagcugauccagaccaucagcgucguggaccgggacgagccccagggcgggcaccgcuucuacuuccggcucgugcccgaggccccguccaacccccacuucagccugcuggacauccaggacaacaccgccgccguccacacgcagcacgugggcuucaaccgccaggagcaggacguguucuuccuccccauccuggucguggacuccggccccccgacccugagcuccaccgggacccucaccauccggaucugcggcugcgacagcuccgggacgauccagagcugcaacaccaccgccuucgugauggcggccucccugagccccggcgcccugaucgcccugcucgucugcgugcugauccuggugguccucgugcugcugauccucacccugcgccggcaccacaagagccaccuguccagcgacgaggacgaggacaugcgcgacaacgugaucaaguacaacgacgaggggggcggcgagcaggacacggaggcguacgacauguccgcccuccggagccuguacgacuucggggagcugaagggcggggacggcgggggcuccgccggcgggggcgccgggggcgggagcggcggcggggccggcucccccccccaggcgcaccucccgagcgagcgccacucccugccccaggggccccccagcccggagcccgacuucuccgucuuccgcgacuucaucagccggaagguggcccuggccgacggcgaccucuccgugccccccuacgacgccuuccagaccuacgccuucgagggggcggacagcccggccgccucccugagcucccugcacagcggcagcuccggcagcgagcaggacuucgccuaccucuccagcugggggccccgcuuccggccccuggccgcgcuguacgccggccaccgcggggacgacgaggcccaggccuccuga

SEQ ID NO: 28022 - RNA, 4146 nt, Artificial Sequence
  derived and/or modified sequence opt1 from CDH23__Homo_sapiens__NP_001165401
augggccgccacguggccaccagcugccacgucgccuggcugcucgugcugaucuccgggugcuggggccaggugaaccggcugcccuucuucaccaaccacuucuucgacacguaccuccugaucagcgaggacaccccggucggguccagcgugacccagcugcucgcgcaggacauggacaacgacccccugguguucggcgucuccggggaggaggccagccgcuucuucgccguggagcccgacaccggcguggucuggcugcggcagccccucgaccgcgagacgaaguccgaguucaccguggaguucagcguguccgaccaccagggcgucaucacccggaaggugaacauccaggugggggacgucaacgacaacgccccgaccuuccacaaccagcccuacagcgugcgcauccccgagaacacgcccgugggcaccccgaucuucaucgucaacgccaccgaccccgaccugggggcgggcggguccgugcuguacagcuuccagccgcccucccaguucuucgccaucgacagcgcccggggcaucgugaccgucauccgcgagcucgacuacgagacgacccaggccuaccagcugaccgugaacgcgaccgaccaggacaagacgcggccccuguccacccucgccaaccuggccaucaucaucaccgacgugcaggacauggaccccaucuucaucaaccugcccuacagcaccaacaucuacgagcacuccccgcccggcacgaccguccgcaucaucaccgccaucgaccaggacaaggggcggccccgcggcaucggguacaccaucgugagcggcaacacgaacuccaucuucgcccucgacuacaucagcggcguccugacccugaacgggcuccuggaccgggagaacccccuguacagccacggcuucauccucaccgugaaggggaccgagcugaacgacgaccgcacgcccuccgacgcgaccgugaccaccacguucaacauccuggucaucgacaucaacgacaacgccccggaguucaacagcuccgaguacagcguggccaucaccgagcucgcccaggugggcuucgcccugccccuguucauccaggucguggacaaggacgagaaccucgggcugaacuccauguucgagguguaccuggucggcaacaacagccaccacuucaucaucucccccaccagcgugcagggcaaggcggacauccggauccgcguggccaucccccucgacuacgagaccgucgaccgguacgacuucgaccuguucgccaacgaguccgugccggaccacgugggguacgccaaggucaagaucacgcugaucaacgagaacgacaaccgccccaucuucagccagccccucuacaacaucucccuguacgagaacgugaccgugggcaccagcguccugaccgugcucgccaccgacaacgacgcggggacguucggcgagguguccuacuucuucagcgacgaccccgaccgguucucccuggacaaggacaccgggcugaucaugcucaucgcccgccuggacuacgagcugauccagcgguucacccucaccaucaucgcccgcgacggcggcggggaggagacgaccggccgcguccggaucaacgugcuggacgugaacgacaacgucccgaccuuccagaaggacgccuacgugggggcccugcgcgagaacgagcccagcgugacccagcucguccggcugcgcgcgacggacgaggacuccccgcccaacaaccagaucaccuacagcaucguguccgccagcgccuucggcagcuacuucgacaucucccuguacgagggguacggcgugaucagcgucucccggccccuggacuacgagcagaucagcaacggccucaucuaccugaccgugauggccauggacgcggggaacccgccccugaacuccaccgugcccgucacgaucgagguguucgacgagaacgacaacccgcccaccuucagcaagcccgccuacuucguguccgucguggagaacaucauggccggcgccaccguccucuuccugaacgccaccgaccuggaccgcagccgggaguacgggcaggaguccaucaucuacagccucgagggcuccacgcaguuccgcaucaacgcgcggagcggcgagaucaccaccaccucccugcuggaccgcgagaccaagagcgaguacauccucaucgugcgggccguggacgggggcguggggcacaaccagaagacgggcaucgccaccgucaacaucacccugcuggacaucaacgacaaccaccccacguggaaggacgcccccuacuacaucaaccucguggagaugaccccgcccgacuccgacgugaccaccgucguggccguggaccccgaccugggggagaacggcacgcuggucuacagcauccagccgcccaacaaguucuacucccucaacagcaccaccggcaagauccgcaccacgcacgcgaugcuggaccgggagaaccccgacccccacgaggccgagcugaugcgcaagaucguggugagcgucaccgacugcgggcggccgccccucaaggccaccuccagcgccaccguguucgucaaccugcuggaccucaacgacaacgaccccacguuccagaaccugcccuucguggccgaggugcuggagggcauccccgcgggggucuccaucuaccaggugguggccaucgaccucgacgagggccugaacgggcuggucagcuaccgcaugcccgugggcaugccccggauggacuuccucaucaacuccagcuccggcguggucgugaccaccaccgagcuggaccgcgagcggaucgccgaguaccagcugcgcguggucgccagcgacgcggggaccccgacgaaguccagcaccuccacccucaccauccacgugcuggacgugaacgacgagacgcccaccuucuuccccgccgucuacaacgugagcguguccgaggacgucccgcgcgaguuccgggugguguggcugaacugcaccgacaacgacgucggccucaacgccgagcugagcuacuucaucaccgggggcaacguggacgggaaguucuccgugggcuaccgcgacgccgucgugcggacgguggucggccuggaccgcgagaccaccgccgcguacaugcucauccuggaggccaucgacaacgggcccgugggcaagcggcacaccgggacggccaccguguucgucaccgugcuggacgugaacgacaaccgccccaucuuccuccagagcuccuacgaggccagcguccccgaggacaucccggagggccacuccauccugcagcugaaggccaccgacgcggacgagggggaguucggccgggugugguaccgcauccuccacggcaaccacgggaacaacuuccggauccacgugagcaacggccugcugaugcgcgggccccggccccucgaccgcgagcggaacagcucccacguccugaucguggaggccuacaaccacgaccugggccccaugcgcagcuccgugcgggucaucguguacguggaggacaucaacgacgaggccccggucuucacgcagcagcaguacagccgccucggccugcgggagaccgccgggaucggcaccuccgugaucgugguccaggccaccgaccgcgacagcggggacggcgggcuggugaacuaccggauccucuccggcgcggagggcaaguucgagaucgacgagagcacggggcugaucaucaccgugaacuaccuggacuacgagaccaagaccuccuacaugaugaacgucagcgccacggaccaggccccgcccuucaaccagggcuucugcuccguguacaucacccuccugaacgagcuggacgaggccgugcaguucagcaacgcguccuacgaggccgccauccucgagaaccuggcccuggggaccgagaucguccgcgugcaggccuacagcaucgacaaccucaaccagaucaccuaccgguucaacgcguacacguccacccaggccaaggcccuguucaagaucgacgccaucaccguccgcggcugggggcagggcgcccccuuccugcccaucuga

SEQ ID NO: 28023 - RNA, 498 nt, Artificial Sequence
  derived and/or modified sequence opt1 from CDH26__Homo_sapiens__NP_068582
augaagccccugaucuggaccuggagcgacguggagggccagcgcccggcccuccugaucugcaccgccgcggccgggcccacgcagggcgucaaggaccuggaggaggugccgcccuccgccgccagccaguccgcccaggcgcggugcgcccucgggagcuggggcuacgggaagcccuucgagccccgcuccgugaagaacauccacagcacccccgccuaccccgacgccaccaugcaccggcagcugcuggcgccggucgagggccgcauggccgagacccucaaccagaagcugcacguggccaacgugcuggaggacgaccccggcuaccucccccacgucuacuccgaggagggggagugcggcggggcccccagccuguccagccuggccucccucgagcaggagcugcagccggaccugcucgacagccugggcuccaaggcgacgcccuucgaggagaucuacagcgaguccggggugcccagcuga

SEQ ID NO: 28024 - RNA, 2721 nt, Artificial Sequence
  derived and/or modified sequence opt1 from CDH2__Homo_sapiens__NP_001783
augugccgcaucgccggcgcccugcggacccuccugccccugcucgcggcccugcugcaggccagcguggaggccuccggggagaucgcccucugcaagaccggcuucccggaggacgucuacagcgcggugcuguccaaggacgugcacgaggggcagccccugcucaacgucaaguucagcaacugcaacggcaagcgcaaggugcaguacgaguccagcgagcccgccgacuucaagguggacgaggacgggauggucuacgccgugcgguccuucccccugagcuccgagcacgccaaguuccugaucuacgcgcaggacaaggagacgcaggagaaguggcaggucgccgugaagcucagccugaagccgacccugaccgaggaguccgugaaggagagcgccgagguggaggagaucgucuucccccgccaguucuccaagcacagcggccaccuccagcggcagaagcgcgacugggugaucccgcccaucaaccugccggagaacucccggggccccuucccccaggagcuggugcgcauccggagcgaccgcgacaagaaccucucccugcgguacagcgucaccgggcccggcgccgaccagccgcccacggggaucuucaucaucaaccccaucuccggccagcugagcgugaccaagccccucgaccgcgagcagaucgcccgguuccaccuccgcgcgcacgccguggacaucaacgggaaccaggucgagaacccgaucgacaucgugaucaacgugaucgacaugaacgacaaccggcccgaguuccugcaccaggucuggaacggcaccgugcccgagggcagcaagcccgggaccuacgugaugacggucaccgccaucgacgccgacgacccgaacgcccugaacggcaugcugcgcuaccggaucgugucccaggcgcccagcacccccucccccaacauguucaccaucaacaacgagacgggggacaucaucaccgucgccgccggccuggaccgcgagaaggugcagcaguacacccucaucauccaggccaccgacauggagggcaacccgacguacgggcugagcaacaccgccaccgcggugaucaccgucacggacgugaacgacaacccgcccgaguucaccgccaugaccuucuacggcgaggugcccgagaaccgggucgacaucaucguggccaaccugaccgugacggacaaggaccagccccacacccccgccuggaacgccgucuaccgcaucuccgggggcgaccccaccgggcgguucgcgauccagaccgacccgaacagcaacgacggccucgugacgguggucaagcccaucgacuucgagaccaaccgcauguucgugcugaccguggccgccgagaaccaggucccccuggccaagggcauccagcacccgccccaguccaccgcgacggugagcgugaccgucaucgacgugaacgagaaccccuacuucgcccccaaccccaagaucauccgccaggaggaggggcuccacgccggcaccaugcugaccacguucaccgcccaggacccggaccgguacaugcagcagaacauccgcuacaccaagcuguccgaccccgccaacuggcucaagaucgaccccgugaacgggcagaucaccaccaucgcgguccuggaccgggagagccccaacgugaagaacaacaucuacaacgccacguuccuggccuccgacaacggcaucccgcccaugagcgggaccggcacccuccagaucuaccugcuggacaucaacgacaacgcgccccaggugcucccccaggaggccgagaccugcgagacgccggaccccaacuccaucaacaucaccgcccuggacuacgacaucgaccccaacgccggccccuucgccuucgaccugccgcucagccccgucaccaucaagcgcaacuggaccaucacgcggcugaacggggacuucgcccagcugaaccucaagaucaaguuccuggaggccggcaucuacgaggugcccaucaucaucaccgacuccgggaacccgcccaagagcaacaucuccauccugcgcgugaaggucugccagugcgacagcaacggcgacugcaccgacguggaccggaucgugggggcgggccugggcaccggggccaucaucgccauccuccugugcaucaucauccugcucauccugguccugauguucgugguguggaugaagcgccgggacaaggagcgccaggccaagcagcuccugaucgaccccgaggacgacguccgggacaacauccugaaguacgacgaggagggcgggggcgaggaggaccaggacuacgaccucucccagcugcagcagcccgacacgguggagcccgacgcgaucaagcccgugggcauccgccggauggacgagcgccccauccacgccgagccccaguacccgguccggagcgccgcgccccaccccggggacaucggcgacuucaucaacgaggggcugaaggccgccgacaacgaccccaccgccccgcccuacgacagccuccugguguucgacuacgagggcuccgggagcaccgccggcucccugagcucccucaacagcuccagcuccggcggggagcaggacuacgacuaccugaacgacuggggcccccgcuucaagaagcuggccgacauguacgggggcggggacgacuga

SEQ ID NO: 28025 - RNA, 2490 nt, Artificial Sequence
  derived and/or modified sequence opt1 from CDH3__Homo_sapiens__NP_001784
augggccugccccgcgggccgcucgccagccugcugcuccuccaggugugcuggcugcagugcgccgcguccgagcccugccgggccgucuuccgcgaggccgaggugacccucgaggccggcggggccgagcaggagcccggccaggcgcuggggaagguguucaugggcugccccggccaggagccggcccuguucagcaccgacaacgacgacuucacgguccggaacggggagaccgugcaggagcgccggucccucaaggagcgcaacccccugaagaucuuccccagcaagcggauccugcgccggcacaagcgcgacuggguggucgcccccaucuccgugccggagaacggcaaggggcccuucccccagcggcucaaccagcucaagagcaacaaggaccgcgacaccaagaucuucuacuccaucaccggccccggggccgacagcccgcccgagggcguguucgcggucgagaaggagacgggcuggcugcugcugaacaagccccuggaccgggaggagaucgccaaguacgagcuguucgggcacgccguguccgagaacggcgccagcguggaggaccccaugaacaucuccaucaucgucaccgaccagaacgaccacaagccgaaguucacccaggacaccuuccgcgggagcgugcuggagggcgugcugcccggcacguccgucaugcaggucaccgccaccgacgaggacgacgcgaucuacaccuacaacggggugguggccuacagcauccacucccaggagcccaaggacccccacgaccucauguucacgauccaccggagcaccggcaccaucuccgugaucagcuccgggcuggaccgcgagaaggugccggaguacacccugacgauccaggccaccgacauggacggcgacgggagcaccaccacggccgucgccgugguggagauccucgacgcgaacgacaacgcccccauguucgacccccagaaguacgaggcccacguccccgagaacgccgugggccacgagguccagcggcugaccgugaccgaccuggacgccccgaacagccccgcguggcgcgccaccuaccucaucaugggcggggacgacggcgaccacuucacgaucaccacccaccccgaguccaaccaggggauccugaccacgcggaagggccuggacuucgaggccaagaaccagcacacccucuacguggaggucaccaacgaggcccccuucgugcugaagcugccgaccagcacggccaccaucgugguccacguggaggacgugaacgaggcgcccgucuucgugcccccguccaagguggucgaggugcaggaggggauccccaccggcgagcccgugugcgucuacaccgccgaggaccccgacaaggagaaccagaagaucagcuaccgcauccuccgggacccggccggcuggcuggccauggaccccgacuccggccaggugacggcgguggggacccuggaccgcgaggacgagcaguucguccgcaacaacaucuacgaggugauggugcucgccauggacaacgggagcccgcccaccaccggcaccgggacgcugcugcucacccugaucgacgucaacgaccacggccccgugcccgagccccggcagaucaccaucugcaaccagucccccgugcgccagguccugaacaucaccgacaaggaccucagcccgcacacgucccccuuccaggcccagcugaccgacgacagcgacaucuacuggaccgccgaggugaacgaggagggcgacaccgugguccugucccucaagaaguuccugaagcaggacacguacgacgugcaccugagccucuccgaccacgggaacaaggagcagcugaccgugauccgggccaccgucugcgacugccacggccacguggagaccugccccgggcccuggaagggcggcuucauccugccggugcugggggcgguccucgcccugcuguuccuccugcuggugcuccugcugcucgugcgcaagaagcggaagaucaaggagccccugcugcuccccgaggacgacacgcgcgacaacgucuucuacuacggcgaggagggcggcggggaggaggaccaggacuacgacaucacccagcugcaccgggggcuggaggcccgccccgagguggugcuccggaacgacgucgccccgaccaucauccccacccccauguaccgcccccggccggccaaccccgacgagaucggcaacuucaucaucgagaaccugaaggcggccaacacggaccccaccgccccgcccuacgacacccugcucguguucgacuacgaggggagcggcuccgacgccgccagccuguccagccugaccuccagcgcgagcgaccaggaccaggacuacgacuaccucaacgagugggggucccgcuucaagaagcuggccgacauguacggcgggggcgaggacgacuga

SEQ ID NO: 28026 - RNA, 2640 nt, Artificial Sequence
  derived and/or modified sequence opt1 from CDH4__Homo_sapiens__NP_001239267
augaacggcagcugcgacuucauccuguccgccagcuuccuccccugcuucaaggaggugaaguucuccagcugcgucgggaccaagggcacccaguacgagacgaacuccauggacuucaaggugggggccgacggcaccguguucgcgacccgcgagcugcaggucccgagcgagcaggucgccuucaccgugacggccugggacucccagaccgccgagaagugggacgccguggugcggcugcucguggcgcagaccagcagcccccacuccgggcacaagccccagaagggcaagaaggucguggcccuggaccccuccccgccgcccaaggacacccugcuccccuggccccagcaccagaacgccaacggccugcgccggcgcaagcgggacugggugaucccgcccaucaacguccccgagaacagccgcgggcccuucccccagcagcuggugcggauccgcuccgacaaggacaacgacauccccauccgguacagcaucacgggcgugggggccgaccagcccccgauggaggucuucuccaucgacagcauguccggccgcauguacgugacccggcccauggaccgcgaggagcacgcgagcuaccaccuccgggcccacgccguggacaugaacgggaacaaggucgagaaccccaucgaccuguacaucuacgugaucgacaugaacgacaaccgccccgaguucaucaaccagguguacaacggcuccgucgacgagggcagcaagccggggaccuacgugaugaccgugacggccaacgacgccgacgacagcaccaccgcgaacggcaugguccgguaccgcaucgugacccagacgccccagucccccagccagaacauguucaccaucaacuccgagaccggggacaucgucaccguggccgccggccuggaccgggagaaggugcagcaguacacggucaucgugcaggccaccgacauggagggcaaccucaacuacgggcugagcaacaccgccaccgcgaucaucacggugaccgacgucaacgacaacccgcccgaguucaccgccuccaccuucgccggcgaggugcccgagaaccgcguggagacggucguggccaaccugaccgugauggaccgggaccagccccacagccccaacuggaacgccgucuaccgcaucaucuccggggacccgagcggccacuucuccgugcggaccgaccccgugaccaacgaggggauggucacgguggugaaggcggucgacuacgagcucaaccgcgccuucaugcugaccgugauggugagcaaccaggcgccccuggccuccggcauccagaugagcuuccaguccaccgccggcgucaccaucagcaucauggacaucaacgaggccccguacuuccccuccaaccacaagcucauccgccuggaggagggggugccgcccggcacggugcugaccaccuucagcgccgucgaccccgaccgguucaugcagcaggccgugcgcuacuccaagcucagcgaccccgccuccuggcugcacaucaacgcgaccaacgggcagaucaccacggccgccgugcuggaccgggagagccucuacaccaagaacaacgucuacgaggccaccuuccuggccgcggacaacggcaucccgcccgccagcgggaccggcacgcugcagaucuaccucaucgacaucaacgacaacgcccccgagcugcugcccaaggaggcccagaucugcgagaagcccaaccucaacgccaucaacaucaccgcggccgacgccgacguggaccccaacaucggcccguacguguucgagcugcccuucguccccgccgccgugcgcaagaacuggaccaucacccggcugaacggggacuacgcgcagcucucccugcgcauccuguaccucgaggccggcauguacgacgugcccaucaucgucacggacagcgggaacccgccccuguccaacaccagcaucaucaaggugaaggugugccccugcgacgacaacggcgacugcaccaccaucggggccgucgccgcggccggccugggcacgggggccaucguggccauccucaucugcauccugauccugcucaccauggugcugcuguucgucauguggaugaagcggcgcgagaaggagcggcacaccaagcagcuccugaucgaccccgaggacgacgugcgcgacaacauccugaaguacgacgaggagggcgggggcgaggaggaccaggacuacgaccucucccagcugcagcagccggaggccaugggccacgugcccagcaaggcgcccgggguccggcgcguggacgagcggcccgugggcgccgagccgcaguaccccauccgccccauggucccgcaccccggggacaucggcgacuucaucaacgaggggcugcgggccgccgacaacgaccccaccgcgcccccguacgacucccugcucguguucgacuacgagggcagcggcuccacggccgggagcguguccagccugaacuccagcuccagcggcgaccaggacuacgacuaccugaacgacugggggccccgcuucaagaagcucgccgacauguacggcgggggcgaggaggacuga

SEQ ID NO: 28027 - RNA, 2355 nt, Artificial Sequence
  derived and/or modified sequence opt1 from CDH5__Homo_sapiens__NP_001786
augcagcgccugaugaugcuccuggccaccagcggcgccugccuggggcuccuggcgguggccgccgucgccgccgcgggcgccaaccccgcccagcgggacacccacucccugcucccgacgcaccgccggcagaagcgcgacuggaucuggaaccagaugcacaucgacgaggagaagaacaccagccugccccaccacguggggaagaucaaguccagcgugucccggaagaacgccaaguaccugcucaagggcgaguacgucgggaagguguuccgcguggacgcggagaccggcgacgucuucgccaucgagcggcuggaccgcgagaacaucagcgaguaccaccugaccgccgugaucguggacaaggacacgggcgagaaccucgagacccccuccagcuucaccaucaagguccacgacgugaacgacaacuggcccguguucacccaccggcuguucaacgccuccgucccggagagcuccgccguggggacgagcgugaucuccgucaccgcgguggacgccgacgaccccaccgugggcgaccacgccagcgucauguaccagauccugaaggggaaggaguacuucgccaucgacaacuccggccgcaucaucaccaucaccaagagccucgaccgggagaagcaggcccgcuacgagaucgugguggaggcgcgggacgcccaggggcugcgcggcgacuccggcaccgccaccguccuggugacccuccaggacaucaacgacaacuuccccuucuucacgcagaccaaguacaccuucgugguccccgaggacacccggguggggacgagcgucggcucccuguucguggaggacccggacgagccccagaaccgcaugaccaaguacagcauccugcgcggggacuaccaggacgccuucaccaucgagaccaaccccgcccacaacgagggcaucaucaagcccaugaagccgcucgacuacgaguacauccagcaguacagcuucaucguggaggcgacggaccccaccaucgaccugcgguacauguccccgcccgccggcaaccgggcccaggucaucaucaacaucaccgacguggacgagccgcccaucuuccagcagcccuucuaccacuuccagcugaaggagaaccagaagaagccccucaucgggaccgugcuggccauggaccccgacgccgcgcgccacagcaucggcuacuccauccggcgcacgagcgacaaggggcaguucuuccgcgucaccaagaagggcgacaucuacaacgagaaggagcuggaccgggagguguaccccugguacaaccucaccguggaggccaaggagcuggacuccaccgggacgcccaccggcaaggagagcaucguccaggugcacaucgaggugcuggacgagaacgacaacgcccccgaguucgccaagccguaccagcccaaggucugcgagaacgcggugcacggccagcucgugcugcagaucuccgccaucgacaaggacaucacgccccgcaacgucaaguucaaguucauccugaacaccgagaacaacuucacgcucaccgacaaccacgacaacaccgccaacaucaccgugaaguacgggcaguucgaccgggagcacaccaaggugcacuuccugcccgucgugaucagcgacaacggcaugccgucccgcacggggaccagcacccugaccguggccgucugcaagugcaacgagcagggcgaguucacguucugcgaggacauggccgcccagguggggguguccauccaggcggucguggccauccuccugugcauccugaccaucaccgugaucacccuccugaucuuccugcggcgccggcuccgcaagcaggcccgggcccacggcaagagcguccccgagauccacgagcagcuggugacguacgacgaggagggcgggggcgagauggacaccaccuccuacgacgugagcguccugaacuccgugcgccgcgggggcgcgaagcccccgcggcccgcccucgacgcccggcccagccuguacgcccaggugcagaagcccccgcgccacgcccccggggcgcacggcggccccggggagauggccgccaugaucgaggucaagaaggacgaggccgaccacgacggcgacgggcccccguacgacacccugcacaucuacggcuacgagggcuccgagagcaucgcggagucccucagcagccuggggacggacuccagcgacuccgacguggacuacgacuuccugaacgacuggggcccccgguucaagaugcuggccgagcucuacgggagcgacccccgcgaggagcugcuguacuga

SEQ ID NO: 28028 - RNA, 2373 nt, Artificial Sequence
  derived and/or modified sequence opt1 from CDH6__Homo_sapiens__XP_011512223
augcgcaccuaccgguacuuccugcuccuguucugggugggccagcccuacccgacccugagcacgccccucuccaagcgcaccagcggguuccccgccaagaagcgggcccuggagcuguccggcaacagcaagaacgagcucaaccgcuccaagcggagcuggauguggaaccaguucuuccugcuggaggaguacaccggguccgacuaccaguacgucggcaagcuccacagcgaccaggaccgcggggacggcucccugaaguacauccugagcggcgacggggcgggcgaccucuucaucaucaacgagaacaccggggacauccaggccacgaagcggcuggaccgcgaggagaagcccguguacauccugcgggcccaggccaucaaccgccggaccggccgcccgguggagcccgaguccgaguucaucaucaagauccacgacaucaacgacaacgagcccaucuucaccaaggaggucuacaccgccacggugcccgagaugagcgacguggggaccuucgucguccaggugaccgcgaccgacgccgacgacccgacguacggcaacuccgccaaggugguguacagcauccuccagggccagcccuacuucuccguggagagcgagaccgggaucaucaagaccgcccugcugaacauggaccgggagaaccgcgagcaguaccaggucgugauccaggcgaaggacaugggcgggcagaugggcggccucuccgggaccacgaccgugaacaucacccugaccgacgucaacgacaacccgccccgguucccccagagcacguaccaguucaagacccccgaguccagcccgcccggcacccccaucgggcgcaucaaggccagcgacgccgacgugggcgagaacgccgagaucgaguacuccaucaccgacggggagggccuggacauguucgacgugaucacggaccaggagacccaggagggcaucaucaccgucaagaagcuccuggacuucgagaagaagaagguguacacccugaagguggaggccagcaaccccuacgucgagccccgguuccucuaccuggggcccuucaaggacuccgcgacggugcgcaucguggucgaggacguggacgagccgcccgucuucagcaagcuggccuacauccuccagauccgggaggacgcccagaucaacaccaccaucggcuccgugaccgcccaggaccccgacgccgcgcgcaaccccgugaaguacagcgucgaccggcacacggacauggaccgcaucuucaacaucgacuccgggaacggcagcaucuucaccuccaagcugcuggaccgcgagacccuccuguggcacaacaucaccgugaucgccacggagaucaacaacccgaagcagagcucccgggugccccuguacaucaagguccucgacgugaacgacaacgcccccgaguucgccgaguucuacgagaccuucgugugcgagaaggccaaggcggaccagcugauccagacccugcacgccgucgacaaggacgaccccuacagcgggcaccaguucuccuucagccucgccccggaggccgccuccggcagcaacuucaccauccaggacaacaaggacaacaccgcgggcauccugacgcgcaagaacggguacaaccggcacgagauguccaccuaccugcuccccguggugaucagcgacaacgacuaccccguccaguccagcaccggcaccgugacggugcgcgucugcgccugcgaccaccacgggaacaugcagagcugccacgccgaggcccugauccacccgaccggccuguccaccggggcgcucguggccauccugcugugcaucgugauccuccuggucaccguggugcuguucgccgcccuccggcgccagcggaagaaggagccccugaucaucagcaaggaggacauccgcgacaacaucgucuccuacaacgacgagggcggcggggaggaggacacgcaggccuucgacaucggcacccugcggaaccccgaggcgaucgaggacaacaagcugcgccgggacaucgugcccgaggcccucuuccugccgcgccggacccccaccgcccgcgacaacacggacgugcgggacuucaucaaccagcgccugaaggagaacgacaccgaccccaccgcgcccccguacgacagccucgccaccuacgccuacgaggggacgggcuccgucgccgacagccuguccagccuggaguccgugaccaccgacgccgaccaggacuacgacuaccucagcgacuggggcccccgguucaagaagcuggccgacauguacgggggcguggacuccgacaaggacagcuga

SEQ ID NO: 28029 - RNA, 2358 nt, Artificial Sequence
  derived and/or modified sequence opt1 from CDH7__Homo_sapiens__NP_387450
augaagcugggcaagguggaguucugccacuuccuccagcugaucgcccuguuccucugcuucagcgggaugucccaggccgagcugagccgcucccggagcaagcccuacuuccaguccggccgcagccggaccaagcgcuccugggucuggaaccaguucuucgugcuggaggaguacauggggagcgacccccucuacgugggcaagcugcacuccgacgucgacaagggggacggcagcaucaaguacauccuguccggcgagggggcgagcuccaucuucaucaucgacgagaacaccggcgacauccacgccacgaagcggcucgaccgcgaggagcaggccuacuacacccugcgggcccaggcccuggaccgccucaccaacaagcccguggagcccgagagcgaguucgugaucaagauccaggacaucaacgacaacgagcccaaguuccuggacgggccguacaccgcgggcguccccgagaugucccccguggggacgagcgugguccaggugaccgccaccgacgccgacgaccccaccuacggcaacuccgcccggguggucuacagcauccugcagggccagccguacuucuccguggagcccaagacgggggugaucaagaccgcgcuccccaacauggaccgcgaggccaaggaccaguaccugcuggucauccaggccaaggacauggugggccagaacgggggccucagcggcaccaccagcgugacggucacccugaccgacgugaacgacaacccgccccgguucccccgccgguccuaccaguacaacgugcccgagagccugcccgucgccuccgugguggcccgcaucaaggcggccgacgccgacaucggggccaacgccgagauggaguacaagaucgucgacggcgacgggcucggcaucuucaagaucagcguggacaaggagacccaggaggggaucaucacgauccagaaggagcuggacuucgaggcgaagaccuccuacacccugcggaucgaggccgccaacaaggacgccgacccgcgcuuccucagccugggccccuucuccgacaccacgaccgucaagaucaucguggaggacguggacgagccgcccgucuucagcagcccccuguaccccauggagguguccgaggccacccaggugggcaacaucaucgggaccgucgcggcccacgaccccgacuccagcaacucccccgugcgguacagcaucgaccgcaacacggaccucgagcgguacuucaacaucgacgccaacuccggcgugaucaccaccgccaagagccuggaccgcgagaccaacgccauccacaacaucacgguccuggcgauggagucccagaacccgagccagguggggcggggcuacguggccaucaccauccucgacaucaacgacaacgcccccgaguucgccauggacuacgagaccaccgucugcgagaacgcgcagcccggccaggugauccagaagaucuccgccguggacaaggacgagcccagcaacgggcaccaguucuacuucagccugacgaccgacgccaccaacaaccacaacuucucccugaaggacaacaaggacaacaccgccagcauccucacgcgccgcaacggcuuccggcgccaggagcaguccgucuacuaccugccgaucuucaucguggacagcgggucccccagccuguccagcaccaacacccucaccauccgggugugcgacugcgacgccgacggcgucgcgcagaccugcaacgccgaggccuacgugcugcccgccgggcuguccacgggcgcccucaucgcgauccuggccugcgugcugacccuccugguccugauccuccugaucgugaccaugcgccggcgcaagaaggagccgcugaucuucgacgaggagcgggacauccgcgagaacaucgugcgguacgacgacgagggcgggggcgaggaggacaccgaggccuucgacauggccgcccuccgcaaccugaacgucauccgggacacgaagacccgccgggacgugacccccgagauccaguuccugagccgccccgcguucaaguccauccccgacaacgugaucuuccgggaguucaucugggagcgccugaaggaggccgacgucgacccgggggccccgcccuacgacagccuccagaccuacgccuucgagggcaacggguccguggcggagagccuguccagccuggacuccaucagcagcaacuccgaccagaacuacgacuaccucagcgacuggggcccccgguucaagcgccuggccgacauguacggcacggggcaggagucccuguacagcuga

SEQ ID NO: 28030 - RNA, 2400 nt, Artificial Sequence
  derived and/or modified sequence opt1 from CDH8__Homo_sapiens__NP_001787
augcccgagcgccuggccgagaugcuccuggaccuguggacgccccucaucauccuguggaucacccugccgcccugcaucuacauggcccccaugaaccagagccaggugcucauguccggcagcccccuggagcugaacucccucggggaggagcagcggauccugaaccgcagcaagcggggcugggucuggaaccagauguucgugcuggaggaguucuccgggcccgagcccauccucgugggccgccugcacaccgaccuggaccccgggagcaagaagaucaaguacauccucuccggcgacggcgcggggaccaucuuccagaucaacgacgucaccggcgacauccacgccaucaagcggcuggaccgcgaggagaaggccgaguacacccugacggcccaggccguggacugggagaccagcaagccgcucgagccgcccuccgaguucaucaucaaggugcaggacaucaacgacaacgcgcccgaguuccugaacgggcccuaccacgccaccguccccgagaugagcauccugggcaccuccgugacgaacgugaccgccaccgacgccgacgaccccgucuacgggaacagcgcgaagcucguguacuccauccuggagggccagcccuacuucagcaucgagccggagaccgccaucaucaagacggcccugcccaacauggaccgggaggccaaggaggaguaccucguggucauccaggccaaggacaugggcgggcacuccggcgggcugagcggcaccaccacccugacggugacccucaccgacgugaacgacaacccgcccaaguucgcgcagucccuguaccacuucagcguccccgaggacguggugcugggcaccgccaucgggcgcgucaaggccaacgaccaggacaucggcgagaacgcccaguccagcuacgacaucaucgacggggacggcacggcccucuucgagaucaccagcgacgcgcaggcccaggacgggaucauccggcugcgcaagccccuggacuucgagaccaagaaguccuacacccucaagguggaggccgccaacgugcacaucgacccccgguucagcggccgcggccccuucaaggacacggccaccgucaagaucgugguggaggacgcggacgagccgcccgucuucuccagccccaccuaccugcuggaggugcacgagaacgccgcccucaacuccgucaucggccaggugaccgcccgggaccccgacaucacgagcuccccgauccgcuucagcaucgaccggcacaccgaccuggagcgccaguucaacaucaacgccgacgacgggaagaucacccuggcgacgccccucgaccgggagcuguccguguggcacaacaucaccaucaucgccaccgagauccgcaaccacagccagaucucccggguccccguggccaucaaggugcuggacgucaacgacaacgccccggaguucgcgagcgaguacgaggccuuccucugcgagaacgggaagcccggccaggugauccagaccguguccgccauggacaaggacgaccccaagaacgggcacuacuuccuguacagccugcuccccgagauggucaacaacccgaacuucaccaucaagaagaacgaggacaacucccugagcauccuggccaagcacaacggcuucaaccgccagaagcaggagguguaccuccugcccaucaucaucuccgacagcggcaacccgccccuguccagcacgagcacccugaccauccgggugugcgggugcuccaacgacggcgucgugcagagcugcaacguggaggccuacguccuccccaucgggcuguccaugggcgcgcugaucgccauccucgccugcaucauccugcugcucgugaucgugguccuguucgugacccugcgccgccacaagaacgagccccucaucaucaaggacgacgaggacgugcgggagaacaucauccgcuacgacgacgagggcgggggcgaggaggacaccgaggccuucgacaucgccacgcugcagaaccccgacgggaucaacggcuuccugccccggaaggacaucaagccggaccuccaguucaugccccgccaggggcuggcgcccguccccaacggcguggacguggacgaguucaucaacguccggcugcacgaggccgacaacgacccgaccgccccgcccuacgacagcauccagaucuacggcuacgaggggcgcggcuccguggccgggagccucuccagccuggaguccaccaccagcgacuccgaccagaacuucgacuaccugagcgacuggggcccccgguucaagcgccucggggagcuguacuccgugggcgagagcgacaaggagacguga

SEQ ID NO: 28031 - RNA, 2370 nt, Artificial Sequence
  derived and/or modified sequence opt1 from CDH9__Homo_sapiens__XP_011512224
augcgcaccuaccacuacaucccccuguucaucuggaccuacauguuccacacgguggacaccauccuccugcaggagaagcccaacagcuaccuguccagcaagaagaucgccggccucaccaaggacgacgggaagaugcugcggcgcaccaagcggggcuggauguggaaccaguucuuccugcucgaggaguacacggggaccgacacccaguacgucggcaagcugcacaccgaccaggacaagggggacggcaaccugaaguacauccucacgggcgacggggccggcucccuguucgugaucgacgagaacaccggggacauccacgcggccaagaagcuggaccgcgaggagaagucccucuacauccugcgggccaaggccaucgaccgcaagaccggccgccagguggagcccgagagcgaguucaucaucaagauccacgacaucaacgacaacgagcccaaguucaccaaggaccuguacacggccagcguccccgagauguccggggugggcaccagcgugauccaggucaccgcgaccgacgccgacgacgccaacuacggcaacuccgccaaggugguguacagcauccuccaggggcagccguacuucuccgucgaccccgagagcggcaucaucaagacggcgcugcccgacaugucccgggagaaccgggagcaguaccagguggugauccaggccaaggacaugggcgggcagaugggcgggcugagcggcaccaccaccgucaacaucacgcucaccgacgugaacaacaacccgccccgcuucccccaguccaccuaccaguucaacagccccgaguccgugccccuggggacccaccugggccggaucaaggccaacgacccggacgucggggagaacgccgagauggaguacagcaucgccgagggcgacggcgcggacauguucgacgugaucacggacaaggacacccaggaggggaucaucaccgugaagcagaaccucgacuucgagaaccagaugcuguacacccugcgcgucgacgccuccaacacgcaccccgacccccgguuccuccaccugggccccuucaaggacaccgccguggugaagaucagcgucgaggacaucgacgagccgcccguguucaccaaggugagcuaccugaucgaggucgacgaggacgugaaggagggguccaucaucggccaggucaccgccuacgaccccgacgcccgcaacaaccucaucaaguacagcguggaccggcacacggacauggaccgcaucuucgggauccacuccgagaacggcagcaucuucacccugaaggcgcuggaccgggaguccagccccuggcacaacaucaccgugaccgccacggagaucaacaacccgaagcaguccagccacauccccgucuucauccgcauccucgacaucaacgaccacgcccccgaguucgccauguacuacgagaccuucgugugcgagaacgccaagcccggccagcugauccagaccguguccgucauggacaaggacgacccgccccgggggcacaaguucuucuucgagcccgugcccgaguucacccugaacccgaacuucaccaucguggacaacaaggacaacacggcgggcaucaugacccgcaaggacggguacagccggaacaagauguccaccuaccuccugcccauccugaucuucgacaacgacuaccccauccagagcuccaccggcacgcucaccauccgcgucugcgccugcgacaaccaggggaacaugcagagcugcaccgccgaggcccugauccuguccgccggccucagcaccggcgcgcugguggccauccugcucugcgugcugauccugcucauccuggucgugcuguucgccgcccucaagcgccagcggaagaaggagccgcugaucaucuccaaggacgacgugcgcgacaacaucgucacguacaacgacgagggcggcggggaggaggacacccaggcguucgacaucgggacccugcggaaccccgaggcccgcgaggacagcaagcugcggcgcgacgugaugcccgagaccaucuuccagauccggcgcacggugccccucugggagaacaucgacguccaggacuucauccaccggcgccugaaggagaacgacgccgacccguccgccccgcccuacgacagccuggccaccuacgcguacgagggcaacgacagcaucgccgacucccucagcucccuggagagccugaccgccgacugcaaccaggacuacgacuaccucuccgacugggggccccgguucaagaagcuggccgacauguacggcggggacgacagcgaccgcgacuga

SEQ ID NO: 28032 - RNA, 2238 nt, Artificial Sequence
  derived and/or modified sequence opt1 from CDHR1__Homo_sapiens__NP_001165442
augcgccggugccgcugggccgcccuggcgcucggccugcugcggcucugccuggcccaggccaacuucgcgccccacuucuucgacaacggggugggcagcaccaacgggaacauggcccuguucucccucccggaggacacccccgucggcagccacguguacacgcugaacgggaccgaccccgagggcgaccccaucuccuaccacaucagcuucgacccguccacccgcagcguguucuccgucgaccccaccuucggcaacaucacgcugguggaggagcucgaccgggagcgcgaggacgagaucgaggcgaucaucagcaucuccgacgggcugaaccugguggccgagaaggucgugauccucgugaccgacgccaacgacgaggcgccccgguucauccaggagcccuacgucgcccuggugccggaggacauccccgccggcagcaucaucuucaaggugcacgccgucgaccgcgacaccggguccggcgggagcgugaccuacuuccugcagaaccuccacucccccuucgccguggaccggcacagcggcguccugcgccugcaggccggcgcgacgcucgacuacgagcggucccgcacccacuacaucaccgugguggccaaggacgggggcgggcggcugcacggcgccgacgucguguucagcgccaccacgaccgugaccgucaacguggaggacgugcaggacauggcccccgucuucgugggcaccccguacuacggguacgucuacgaggacacgcugcccggcuccgaggugcucaagguggucgcgauggacggggaccgcggcaagcccaaccggauccuguacagccuggugaacgggaacgacggcgccuucgagaucaacgagaccuccggcgccaucagcaucacccagagccccgcccagcuccagcgcgagguguacgagcugcacguccaggugaccgagauguccccggccgggagccccgcggcccaggccacggugcccgucaccauccggaucguggaccugaacaaccacccgcccaccuucuacggcgaguccgggccccagaaccgcuucgagcucagcaugaacgagcacccgccccagggcgagauccugcgggggcugaagaucaccgugaacgacuccgaccagggcgccaacgccaaguucaaccuccagcuggucggcccccgcgggaucuuccggguggugccccagacgguccugaacgaggcccaggugaccaucaucguggagaacagcgccgccaucgacuucgagaaguccaagguccucaccuucaagcugcuggccguggaggugaacacccccgagaaguucagcuccacggcggacgucgugauccagcuccuggacaccaacgacaacgugcccaaguucgacagccuguacuacgucgcccgcaucccggagaacgcccccggcggguccagcgugguggccgucaccgccguggaccccgacaccggcccguggggcgaggugaaguacuccacguacgggaccggcgcggaccucuuccugauccaccccagcaccgggcugaucuacacccagcccugggccucccucgacgccgaggccacggcccgcuacaacuucuacgucaaggcggaggacauggagggcaaguacagcguggccgagguguucaucacccugcuggacgucaacgaccacccgccccaguucgggaaguccgugcagaagaagaccauggugcucggcacccccgucaagaucgaggccaucgacgaggacgccgaggagcccaacaaccugguggacuacagcaucacccacgccgagcccgcgaacguguucgacaucaacucccacacgggcgagaucuggcugaagaacagcauccggagccucgacgcccugcacaacaucaccccggggcgcgacugccuguggucccuggagguccaggccaaggaccggggcagccccuccuucagcaccaccgcccuccugaagaucgacaucacggacgcggaggugcgccggcugcgcuacaugaagaacuccaacuuccccgggaccaccaagagcgugcggaagcccaaguucaagccgaagaagccccacuccagccagggccucuuccugcacccccacugcgagaucgcccuguucaaccucuccaacgucaaccuguacagccgcguguuccagggggccgcccaggccuccuga

SEQ ID NO: 28033 - RNA, 3933 nt, Artificial Sequence
  derived and/or modified sequence opt1 from CDHR2__Homo_sapiens__NP_001165447
auggcccagcuguggcucagcugcuuccugcugcccgcccucguggucuccguggcggccaacguggccccgaaguuccuggccaacaugaccagcgucauccugcccgaggaccuccccgugggcgcccaggcguucuggcugguggccgaggaccaggacaacgacccccugaccuacgggauguccggcccgaacgccuacuucuucgccgucacgcccaagaccggggaggugaagcucgcgagcgcccuggacuacgagacccuguacaccuucaaggugacgaucuccgucagcgaccccuacauccaggugcagcgcgagaugcucgugaucgucgaggaccggaacgacaacgcccccguguuccagaacaccgccuucuccaccagcaucaacgagacccugccggugggcuccgucguguucagcgugcuggccgucgacaaggacaugggguccgcgggcauggugguguacagcaucgagaaggucauccccuccacgggcgacagcgagcaccucuuccgcauccuggccaacggguccaucgugcugaacggcagccucuccuacaacaacaagagcgccuucuaccagcuggagcugaaggccugcgaccucgggggcauguaccacaacaccuucaccauccagugcucccugcccguguuccugagcaucagcgucguggaccagcccgaccucgacccgcaguucguccgggaguucuacuccgccagcguggcggaggacgccgccaaggggaccuccgugcugacggucgaggccguggacggcgacaagggcaucaacgaccccgugaucuacagcaucuccuacagcacccgccccgggugguucgacaucggcgccgacggggucauccgggugaacggcucccuggaccgcgagcagcuccuggaggcggacgaggaggugcagcugcaggucaccgccaccgagacgcaccucaacaucuacggccaggaggccaaggugagcaucugggugaccguccgggugauggacgugaacgaccacaagcccgaguucuacaacugcucccugccggccugcaccuucacccccgaggaggcccaggucaacuucacgggguacguggacgagcacgcgagcccccgcauccccaucgacgaccugaccaugguggucuacgacccggacaagggcuccaacgggaccuuccuccugagccugggcgggcccgacgccgaggccuucuccgugagccccgagcgggccgugggcuccgcgagcguccaggugcucgugcgcgucuccgcccugguggacuacgagcggcagaccgccauggccgugcaggucguggccacggacagcgugucccagaacuucagcgucgcgauggugaccauccaccuccgcgacaucaacgaccaccggcccaccuucccgcagagccuguacgugcugaccguccccgagcacuccgccacgggcagcguggugaccgacuccauccacgccaccgaccccgacaccggggccuggggccagaucacguacagccugcuccccgggaacggcgccgaccuguuccaggucgacccgguguccgggaccgugaccguccgcaacggcgagcugcucgaccgggagagccaggcgguguacuaccugacccugcaggccacggacggcgggaaccucuccagcuccaccacccugcagauccaccuccuggacaucaacgacaacgcccccguggucagcggcuccuacaacaucuucgugcaggaggaggaggggaacgugagcgucaccauccaggcccacgacaacgacgagcccggcaccaacaacucccgccugcuguucaaccugcucccggggcccuacagccacaacuucucccuggaccccgacacgggccugcuccggaaccugggcccccuggaccgcgaggccaucgacccggcgcucgaggggcggaucgugcugaccgugcuggucagcgacugcggcgagcccgugcucgggaccaaggugaacgucaccaucacgguggaggacaucaacgacaaccugcccaucuucaaccaguccagcuacaacuucaccgucaaggaggaggaccccggcgugcuggugggcgucgugaaggccugggacgccgaccagaccgaggccaacaaccgcaucagcuucucccucagcggguccggcgcgaacuacuucaugauccgggggcuggugcugggcgccgggugggccgagggcuaccuccgccugccgcccgacgucagccuggacuacgagacccagcccguguucaaccucacgguguccgccgagaaccccgacccgcagggcggggagaccaucgucgacgugugcgugaacgucaaggacgugaacgacaacccgcccacccuggacguggccagccugcgcggcauccgggucgcggagaacgggucccagcacggccagguggccguggucguggccagcgacguggacaccuccgcccagcucgagauccagcuggucaacauccugugcacgaaggccgggguggacgugggcagccucugcuggggcugguucuccgucgcggccaacgggagcguguacaucaaccaguccaaggccaucgacuacgaggccugcgaccuggugacccuggucgugcgcgccugcgaccucgcgaccgaccccggcuuccaggccuacagcaacaacgggucccugcugaucaccaucgaggacgugaacgacaacgcccccuacuuccuccccgagaacaagacguucgucaucauccccgagcuggugcugcccaaccgggagguggccagcguccgcgcgcgggacgacgacuccggcaacaacggggugauccucuucagcauccugcgcguggacuucaucuccaaggacggcgccaccaucccguuccagggcgucuucagcaucuucaccagcuccgaggccgacguguucgccgggagcauccagcccgugaccucccuggacagcacgcuccagggcaccuaccaggucaccgugcaggcccgggaccgccccucccuggggcccuuccuggaggcgaccacgacccucaaccuguucaccguggaccagagcuaccggucccgccugcaguucagcaccccgaaggaggaggucggcgccaaccggcaggccaucaacgccgcccucacgcaggcgacccgcaccaccguguacaucguggacauccaggacaucgacuccgccgcccgggcccgcccccacagcuaccuggacgccuacuucgucuuccccaacggguccgcgcugacgcucgacgagcugagcgugaugauccggaacgaccaggacucccugacccagcuccugcagcugggccucgugguccugggcagccaggagucccaggagagcgaccuguccaagcagcucaucagcgugaucaucgggcugggcguggcccugcuccugguccuggugaucaugaccauggccuucgucugcgugcgcaaguccuacaaccggaagcuccaggccaugaaggccgcgaaggaggcccgcaagaccgccgccggggugaugccgagcgcgcccgccauccccggcacgaacauguacaacaccgagcgggccaaccccaugcugaaccugccgaacaaggaccucggccuggaguaccugagccccuccaacgaccucgacagcgucuccgugaacagccuggacgacaacuccguggacgucgacaagaacagccaggagaucaaggagcaccgcccgccccacaccccgcccgagcccgaccccgagccccuguccguggugcuccuggggcgccaggccggcgccagcgggcagcuggagggccccuccuacaccaacgcggggcucgacaccacggaccuguga

SEQ ID NO: 28034 - RNA, 2658 nt, Artificial Sequence
  derived and/or modified sequence opt1 from CDHR3__Homo_sapiens__NP_689963
augcaggaggccaucauccugcucgcccugcugggcgcgaugagcgggggcgaggcccuccaccugauccugcuccccgccaccgggaacguggccgagaacuccccgcccggcaccagcguccacaaguucuccgugaagcugagcgccucccugagccccgugauccccggguucccgcagaucgucaacuccaacccccucacggaggcguuccgcgugaacuggcugagcggcaccuacuucgagguggucaccaccggcauggagcagcuggacuucgagacggggcccaacaucuucgaccuccagaucuacgugaaggacgaggugggcgucaccgaccuccaggugcugaccgugcaggucaccgacgugaacgagcccccgcaguuccaggggaaccucgccgagggccugcaccuguacaucguggagcgggccaaccccggguucaucuaccaggucgaggccuucgaccccgaggacacgucccgcaacaucccccucagcuacuuccugaucuccccgcccaagagcuuccggauguccgcgaacggcacccuguucagcaccaccgagcucgacuucgaggccggccaccgcuccuuccaccugaucguggaggugcgggacagcgggggccugaaggccuccacggagcuccaggucaacaucgugaaccugaacgacgaggugccccgcuucaccagccccacccgggucuacaccgugcuggaggagcucuccccggggacgaucguggccaacaucaccgccgaggaccccgacgacgagggcuuccccagccaccuccuguacagcaucaccaccgucuccaaguacuucaugaucaaccagcugacgggcaccauccagguggcgcagcgcaucgaccgggacgccggggagcugcgccagaaccccaccaucagccuggagguccucgugaaggaccggccguacggcgggcaggagaaccgcauccagaucaccuucaucguggaggacgucaacgacaaccccgccacgugccagaaguucaccuucuccaucauggugcccgagcggaccgccaagggcacccugcugcucgaccugaacaaguucugcuucgacgacgacagcgaggcccccaacaaccgcuucaacuucacgaugccguccggggugggcagcggcucccgguuccugcaggaccccgcggggagcggcaagaucguccucaucggggaccuggacuacgagaaccccuccaaccuggccgccggcaacaaguacaccgugaucauccaggugcaggacgucgcgcccccguacuacaagaacaacguguacguguacauccucaccagccccgagaacgaguucccccugaucuucgaccgcccguccuacgucuucgacgugagcgagcggcgccccgcccggacccgcguggggcagguccgggccacggacaaggaccugccccaguccagccuccuguacuccaucagcaccggcggcgccucccugcaguaccccaacguguucuggaucaacccgaagaccggggagcuccagcuggugaccaaggucgacugcgagacgacccccaucuacauccugcgcauccaggccaccaacaacgaggacaccagcuccgugaccgugacggucaacauccuggaggagaacgacgagaagcccaucugcacccccaacagcuacuuccucgcccugccgguggaccugaaggugggcaccaacauccagaacuucaagcugaccugcacggaccuggacagcagcccccgcuccuuccgguacuccaucgggcccggcaacgucaacaaccacuucaccuucagccccaacgccggguccaacgugacccgccugcuccugaccagccgguucgacuacgcgggcggcuucgacaagaucugggacuacaagcugcucguguacgucacggacgacaaccugauguccgaccgcaagaaggccgaggcccugguggagaccgggaccgugacccucagcaucaaggucaucccgcaccccacgaccaucaucaccaccacgccccggccccgcgugaccuaccaggugcugcggaagaacgucuacuccccgagcgccugguacgugcccuucgugaucacccugggcuccauccuccugcuggggcuccuggucuaccugguggugcuccuggcgaaggccauccaccgccacugccccugcaagaccggcaagaacaaggagccccugacgaagaagggcgagaccaagaccgccgagcgggacgucgugguggagaccauccagaugaacacgaucuucgacggggaggccaucgacccggucaccggcgagaccuacgaguucaacagcaagaccggggcccgcaaguggaaggacccccucacgcagaugcccaaguggaaggaguccagccaccagggcgcggcgccccggcgcgugaccgccggggagggcaugggcucccugcggagcgccaacugggaggaggacgagcuguccgggaaggccugggccgaggacgccggccucgggagccgcaacgagggcgggaagcugggcaacccgaagaaccggaaccccgccuucaugaaccgcgccuaccccaagccgcaccccggcaaguga

SEQ ID NO: 28035 - RNA, 2520 nt, Artificial Sequence
  derived and/or modified sequence opt1 from CDHR5__Homo_sapiens__NP_001165439
augggcagcugggcccugcucuggcccccgcugcuguucaccgggcuccuggugcgcccgcccggcaccauggcccaggcgcaguacugcuccgucaacaaggacaucuucgagguggaggagaacacgaacgugaccgagccccuggucgacauccacgugcccgaggggcaggaggugacccucggcgcccugagcacccccuucgccuuccggauccaggggaaccagcuguuccucaacgucacgcccgacuacgaggagaagucccugcuggaggcccagcuccugugccagagcggcggcacccuggugacccagcuccgcguguucgucuccgugcuggacgugaacgacaacgcccccgaguucccguucaagaccaaggagauccgggucgaggaggacacgaaggugaacagcaccgugauccccgagacccagcugcaggcggaggaccgcgacaaggacgacauccucuucuacacccugcaggagaugacggccggggccuccgacuacuucagccuggucuccgugaaccggcccgcccuccgccuggaccggccccuggacuucuacgagcgcccgaacaugaccuucuggcuccuggugcgggacacccccggcgagaacgucgagcccagccacaccgcgacggccacccuggugcucaacgugguccccgccgaccugcgcccgcccugguuccugcccugcaccuucuccgacggguacgugugcauccaggcccaguaccacggcgccgugcccaccgggcacauccucccgagcccccugguccugcggcccggccccaucuacgcggaggacggcgaccgcgggaucaaccagccgaucaucuacuccaucuuccggggcaacgugaacgggacguucaucauccaccccgacagcggcaaccucaccgucgcccgcuccgugcccagccccaugaccuuccugcugcucgugaagggccagcaggccgaccuggcccgguacuccgucacccaggugacgguggaggccgucgcggccgccgggagcccgccccgcuucccccagcggcuguaccgcggcaccguggcccgcggggccggcgcggggguggucgugaaggacgccgccgccccgucccagccccuccgcauccaggcccaggaccccgaguucagcgaccugaacagcgcgaucaccuaccggaucaccaaccacucccacuuccgcauggagggcgaggugguccugacgaccaccacccucgcccaggccggcgccuucuacgcggagguggaggcccacaacacggugaccagcgggaccgccaccacggucaucgagauccagguguccgagcaggagcccccgagcaccgaggccggcgggaccaccggccccuggaccuccacgaccagcgaggugccccggcccccggagcccucccaggggcccagcaccaccuccagcggcggcgggacgggcccccacccgcccuccgggaccacccugcggccgcccaccagcuccacgcccggcgggccgcccggcgccgagaacagcaccucccaccagcccgcgacccccggcggggacaccgcccagacgcccaagcccggcaccagccagcccaugccgcccggggucggcaccuccaccagccaccagcccgccacgccguccggcgggaccgcccagacccccgagcccggcaccagccagcccaugccgcccagcauggggacguccaccagccaccagcccgccacccccggcgggggcaccgcgcagacgccggaggccggcaccucccagcccaugccgcccgggaugggcaccagcaccucccaccagcccacgacccccgggggcgggaccgcccagacccccgagcccggcacgagccagccgaugccccuguccaagagcacccccuccagcggcgggggccccuccgaggacaagcgcuucagcgugguggacauggccgcccucgggggcguccugggggcgcugcuccugcuggcccugcucggccuggccgugcuggugcacaagcacuacggcccgcggcucaagugcugcuccgggaaggcccccgagccccagccccagggcuucgacaaccaggcguuccugccggaccacaaggccaacugggcccccguccccagccccacccacgacccgaagcccgccgaggcccccaugccggcggagcccgccccgcccgggcccgccucccccggcggggcccccgagcccccggccgcggcccgcgccggcggcagccccaccgccgugcgguccauccugacgaaggagcgccggcccgagggcggguacaaggccgugugguucggggaggacaucggcaccgaggcggacgucguggugcucaacgcccccacccuggacgucgacggcgccagcgacagcggguccggcgacgagggggagggcgccgggcgcggcggcgggccguacgacgcgcccggcggggacgacagcuacaucuga

SEQ ID NO: 28036 - RNA, 642 nt, Artificial Sequence
  derived and/or modified sequence opt1 from CDIPT__Homo_sapiens__NP_006310
augcccgacgagaacaucuuccuguucgugccgaaccucaucggcuacgcccgcaucgucuucgccaucaucagcuucuacuucaugcccugcugcccccugaccgcguccagcuucuaccugcucuccgggcugcuggacgccuucgacggccacgccgcccgggcccucaaccaggggacccgcuucggcgcgaugcuggacaugcugacggaccggugcagcaccaugugccuccuggugaaccuggcccuccuguaccccggggccacccuguucuuccagaucuccaugagccucgacguggccucccacuggcugcaccuccacagcuccgucgugcgcggcagcgagucccacaagaugaucgaccugagcggcaacccggugcugcggaucuacuacaccucccgccccgcgcuguucacgcucugcgccgggaacgagcuguucuacugccugcucuaccuguuccacuucagcgagggcccccuggucggguccgugggccucuuccggauggggcugugggugaccgcccccaucgcccugcucaagagccugaucuccgucauccaccugaucaccgccgcgcgcaacauggccgcccucgacgccgccgaccgggcgaagaagaaguga

SEQ ID NO: 28037 - RNA, 819 nt, Artificial Sequence
  derived and/or modified sequence opt1 from CDK10__Homo_sapiens__NP_443713
auggacaaggagaaggacggcauccccaucagcucccugcgcgagaucacccuccugcugcggcuccgccacccgaacaucguggagcugaaggaggucgugguggggaaccaccuggagagcaucuuccucgucaugggcuacugcgagcaggaccuggccucccugcucgagaacaugcccacccccuucagcgaggcccaggugaagugcaucgugcugcagguccugcgggggcuccaguaccugcaccgcaacuucaucauccaccgggaccugaagguguccaaccuccugaugacggacaagggcugcgugaagaccgcggacuucgggcuggcccgcgccuacggcguccccgugaagccgaugacccccaagguggucacccucugguaccgggcccccgagcugcugcucggcacgaccacccagaccacgagcaucgacaugugggccguggggugcauccuggcggagcugcucgcccaccgcccccugcugccgggcaccuccgagauccaccagaucgaccucaucgugcagcugcuggggacccccagcgagaacaucuggcccggcuucuccaagcucccccuggucgggcaguacagccugcggaagcagccguacaacaaccucaagcacaaguuccccuggcuguccgaggccggccugcgccuccugcacuuccuguucauguacgaccccaagaagcgggccaccgcgggcgacugccucgagagcuccuacuucaaggagaagccccugcgccugccgaucagcggggugugcgagggcugccgggagcccggguga

SEQ ID NO: 28038 - RNA, 2388 nt, Artificial Sequence
  derived and/or modified sequence opt1 from CDK11B__Homo_sapiens__NP_001778
augggcgacgagaaggacagcuggaaggugaagacccuggacgagauccuccaggagaagaagcgccggaaggagcaggaggagaaggccgagaucaagcgccugaagaacuccgacgaccgggacagcaagcgcgacucccuggaggagggggagcuccgggaccaccgcauggagaucaccauccggaacagccccuaccgccgggaggacuccauggaggaccgcggcgaggaggacgacagccuggccaucaagccgccccagcagaugucccggaaggagaaggcgcaccaccgcaaggacgagaagcggaaggagaagcgccggcaccgcagccacuccgccgagggcgggaagcacgcccgggucaaggagaaggagcgcgagcacgagcggcgcaagcggcaccgcgaggagcaggacaaggcccgccgggagugggagcgccagaagcggcgcgagauggcccgggagcacagccgccgggagcgcgaccggcuggagcagcucgagcgcaagcgggagcgcgagcggaagaugcgcgagcagcagaaggagcagcgggagcagaaggagcgcgagcggcgcgcggaggagcggcgcaaggagcgcgaggcccggcgcgagguguccgcccaccaccggacgaugcgcgaggacuacagcgacaaggugaaggccucccacuggagccgguccccgccccggccgccccgcgagcgcuucgagcugggggacggccggaagcccggcgaggcgcgccccgcccccgcccagaagcccgcccagcugaaggaggagaagauggaggagcgggaccuccugagcgaccugcaggacaucuccgacagcgagcgcaagaccuccagcgccgagagcuccagcgcggaguccgggagcggcuccgaggaggaggaggaggaggaggaggaggaggaggaggaggggagcaccuccgaggagagcgaggaggaggaggaggaggaggaggaggaggaggaggagaccggcuccaacagcgaggaggccuccgagcagagcgccgaggaggucuccgaggaggagaugagcgaggacgaggagcgggagaacgagaaccaccuccugguggugcccgagucccgcuucgaccgggacagcggggaguccgaggaggccgaggaggaggucggcgagggcacgccccagagcuccgcccugaccgagggggacuacgugccggacagccccgcgcucagccccaucgagcugaagcaggagcugcccaaguaccucccggcccugcagggcugccgcuccguggaggaguuccagugccugaaccggaucgaggaggggaccuacggcgucguguaccgcgccaaggacaagaagaccgacgagaucguggcccucaagcggcugaagauggagaaggagaaggagggcuuccccaucacgagccugcgcgagaucaacaccauccucaaggcccagcaccccaacaucgucaccgugcgggagaucguggucggguccaacauggacaagaucuacaucgugaugaacuacguggagcacgaccucaagagccugauggagaccaugaagcagcccuuccugccgggcgaggucaagacgcugaugauccagcugcuccgcggggugaagcaccuccacgacaacuggauccugcaccgcgaccugaagaccuccaaccugcugcucagccacgcgggcauccugaaggugggggacuucggccuggcccgggaguacggcagcccccucaaggccuacacccccgucguggugacccugugguaccgcgcccccgagcugcuccugggggccaaggaguacuccacggcggucgacaugugguccgugggcugcaucuucggggagcugcucacccagaagccgcuguuccccggcaagagcgagaucgaccagaucaacaaggucuucaaggaccuggggacccccuccgagaagaucuggcccggcuacagcgagcucccggccgugaagaagaugaccuucuccgagcaccccuacaacaaccugcggaagcgcuucggcgcccugcugagcgaccagggguucgaccucaugaacaaguuccugacguacuuccccggccggcgcaucuccgccgaggacgggcugaagcacgaguacuuccgggagaccccgcuccccaucgaccccagcauguuccccaccuggccggcgaaguccgagcagcagcgcgugaagcggggcaccagcccccgcccgcccgagggcgggcugggcuacagccagcugggggacgacgaccucaaggagacgggcuuccaccugaccaccaccaaccagggggccuccgccgccggccccggcuucagccugaaguucuga

SEQ ID NO: 28039 - RNA, 4446 nt, Artificial Sequence
  derived and/or modified sequence opt1 from CDK12__Homo_sapiens__NP_055898
augcccaacagcgagcgccacggcgggaagaaggacggcuccgggggcgccagcgggacccugcagccguccagcggcggcggguccagcaacucccgggagcgccaccggcucgugagcaagcacaagcgccacaaguccaagcacagcaaggacaugggccuggucacccccgaggccgcgucccuggggacggugaucaagccccucguggaguacgacgacaucagcuccgacagcgacaccuucuccgacgacauggccuucaagcuggaccggcgcgagaacgacgagcggcgcggcagcgaccgguccgaccgccugcacaagcaccggcaccaccagcaccgccggagccgcgaccuccugaaggccaagcagaccgagaaggagaagucccaggaggucagcagcaaguccgggagcaugaaggaccggaucuccggcagcuccaagcgcagcaacgaggagaccgacgacuacggcaaggcccagguggccaaguccagcuccaaggagagccgguccagcaagcugcacaaggagaagacgcgcaaggagcgggagcucaaguccgggcacaaggaccgcagcaagucccaccggaagcgcgagacccccaagagcuacaagaccguggacuccccgaagcgccggagccgcuccccccaccggaaguggagcgacagcuccaagcaggacgacagccccuccggcgcgagcuacgggcaggacuacgaccugucccccagccgcucccacaccagcuccaacuacgacagcuacaagaaguccccgggcagcacgucccggcgccagagcgucuccccccccuacaaggagcccagcgccuaccaguccagcacccggagcccgucccccuacagccgccggcagcgcuccgugagccccuacucccggcgccggagcuccagcuacgagcgcuccggcagcuacuccgggcggagccccuccccguacggccgccggcgcagcuccagccccuuccuguccaagcggagccucucccgcagcccccugcccagccgcaaguccaugaagagccggucccgcagcccggccuacucccggcacagcuccagccacuccaagaagaagcgcagcuccagccggucccgccacagcuccaucagccccgugcggcugccccucaacuccagccugggggccgagcugucccgcaagaagaaggagcgggcggccgccgccgccgcggccaagauggacggcaaggagagcaaggggagccccgucuuccucccgcgcaaggagaacuccagcguggaggccaaggacuccggccuggagagcaagaagcugccccgguccgugaagcucgagaagagcgcccccgacaccgagcuggucaacgugacccaccugaacacggaggugaagaacuccagcgacaccggcaaggucaagcucgacgagaacuccgagaagcaccuggugaaggaccugaaggcccaggggacccgcgacagcaagcccaucgcgcucaaggaggagaucgugaccccgaaggagacggagaccuccgagaaggagaccccccccccgcugcccaccaucgccagcccccccccgccccugcccacgaccacccccccgccccagacccccccccucccgccccugccccccaucccggcccugccccagcagcccccccucccgcccucccagcccgccuucagccagguccccgccuccagcacguccacccugccgcccagcacccacuccaagaccagcgcggugagcucccaggccaacagccagcccccggugcaggucuccgugaagacgcaggugagcgucaccgccgccaucccccaccugaagaccuccacccuccccccccugccgcugcccccccuccugcccggcgacgacgacauggacagcccgaaggagacgcugcccuccaagcccgugaagaaggagaaggagcagcggacccgccaccuccugaccgaccugccccucccgcccgagcugcccgggggcgaccugagccccccggacucccccgagcccaaggccaucacccccccgcagcagcccuacaagaagcggcccaagaucugcugcccccgcuacggggagcggcgccagacggagagcgacuggggcaagcggugcgucgacaaguucgacaucaucggcaucaucggggagggcaccuacgggcagguguacaaggcgaaggacaaggacaccggcgagcucguggcccugaagaagguccgccuggacaacgagaaggagggguucccgaucaccgccauccgggagaucaagauccugcgccagcucauccaccgcuccguggugaacaugaaggagaucgucaccgacaagcaggacgcccuggacuucaagaaggacaagggcgcguucuaccugguguucgaguacauggaccacgaccucaugggccugcuggagagcgggcucgugcacuucuccgaggaccacaucaagagcuucaugaagcagcugauggagggccuggaguacugccacaagaagaacuuccuccaccgggacaucaagugcuccaacauccugcugaacaacagcgggcagaucaagcucgccgacuucggccuggcccgccuguacaacuccgaggagagccggcccuacacgaacaaggucaucacccucugguaccgcccccccgagcugcugcucggcgaggagcgguacaccccggccaucgacgugugguccugcgggugcauccugggcgagcuguucaccaagaagcccaucuuccaggccaaccucgagcuggcgcagcuggagcucaucagccgccugugcgggagccccugcccggccguguggcccgacgucaucaagcugcccuacuucaacacgaugaagcccaagaagcaguaccggcgccggcuccgcgaggaguucuccuucaucccgagcgccgcccuggaccugcucgaccacaugcugacccuggaccccuccaagcggugcaccgccgagcagacccuccagagcgacuuccugaaggacguggagcuguccaagauggcgccccccgaccucccgcacuggcaggacugccacgagcuguggagcaagaagcgccggcgccagcggcaguccggcguggucguggaggagcccccccccagcaagacgucccgcaaggagaccaccagcgggaccuccacggagccggugaagaacagcucccccgcccccccccagccggcccccggcaaggucgagagcggcgccggggacgccaucggccuggcggacaucacccagcagcucaaccaguccgagcuggccgugcugcucaaccugcugcagagccagaccgaccucuccaucccccagauggcccagcugcugaacauccacagcaaccccgagaugcagcagcagcucgaggcccugaaccaguccaucagcgcgcugaccgaggccacgagccagcagcaggacuccgagaccauggccccggaggagagccucaaggaggcccccuccgcccccgugauccugcccagcgcggagcagaccacccuggaggccuccagcacgccggccgacaugcagaacauccucgccguccugcugucccagcucaugaagacccaggagcccgccgggagccuggaggagaacaacuccgacaagaacagcggcccccaggggccccggcgcaccccgaccaugccccaggaggaggcggccgagaagcggcccccggagccccccggccccccgcccccccccccgccccccccccugguggagggcgaccucuccagcgccccgcaggagcugaaccccgccgugacggccgcgcugcuccagcugcugucccagcccgaggccgagcccccggggcaccucccccacgagcaccaggcccugcgccccauggaguacagcacccgcccccggccgaaccgcaccuacggcaacaccgacgggcccgagacgggcuucuccgccaucgacaccgacgagcggaacagcgggcccgcgcugaccgagucccucguccagacccuggugaagaaccgcacguucagcggcagccugucccaccucggcgagagcuccagcuaccaggggaccggcuccgugcaguuccccggggaccaggaccugcgguucgcccgcgucccgcuggcccuccaccccguggugggccagcccuuccugaaggccgaggggagcuccaacagcgucgugcacgccgagaccaagcugcagaacuacggcgagcucggcccggggaccacgggcgcguccagcuccggggccggccugcacuggggcgggcccacccagagcuccgccuacggcaagcuguaccgggggcccacccgcgugcccccgcggggcgggcgcggccggggcguccccuacuga

SEQ ID NO: 28040 - RNA, 4539 nt, Artificial Sequence
  derived and/or modified sequence opt1 from CDK13__Homo_sapiens__NP_003709
augcccagcuccagcgacaccgcccugggcgggggcgggggccucuccugggccgagaagaagcuggaggagcgccggaagcgccggcgcuuccugagcccccagcagccgccccuccugcugccccuccugcagccccagcugcuccagccgccgcccccgcccccgccccuccuguuccucgccgcccccgggaccgccgccgccgcggccgccgccgcggccgccuccagcuccugcuucagccccgggccgccccucgaggugaagcggcuggcccgcggcaagcggcgcgccgggggccggcagaagcgccggcgcgggccgcgggcgggccaggaggccgagaagcgccggguguucucccucccccagccccagcaggacgggggcggcggggccagcuccggcgggggcgugacgccccugguggaguacgaggacgucagcucccagagcgagcagggccugcuccucgggggcgccuccgccgcgaccgccgccaccgccgccgggggcaccgggggcagcggcgggucccccgcgagcuccagcggcacccagcgccggggcgagggcagcgagcgccggccccgccgggaccgccgcuccagcuccgggcggagcaaggagcgccaccgggagcaccgccggcgcgacggccagcggggcggguccgaggccagcaagucccgcagccggcacucccacagcggcgaggagcgcgccgagguggccaaguccgggagcuccagcuccagcggcgggcggcgcaaguccgccagcgcgaccuccagcagcuccagcucccggaaggaccgcgacagcaaggcccaccggucccgcaccaagagcuccaaggagccgcccagcgccuacaaggagccgcccaaggccuaccgggaggacaagaccgagcccaaggcguaccgccggcgccgcucccugagcccccugggcggccgggacgacucccccgugagccaccgcgccucccagagccugcggucccgcaagagccccucccccgccgggggcgggagcagccccuacucccggcgccugccccggagccccucccccuacagccgccggcgcucccccagcuacucccggcacagcuccuacgagcgcggcggcgacgucagccccucccccuacagcuccagcuccuggcggcgcagccggucccccuacagccccgugcuccgccgguccggcaagagccgcagccggucccccuacagcucccgccacagccggucccgcagccgccaccggcugucccgcagccggucccgccacagcuccaucagccccuccacgcugacccucaagagcucccuggccgccgagcugaacaagaacaagaaggcgcgggccgccgaggccgcccgcgcggccgaggccgccaaggccgcggaggccaccaaggccgccgaggcggccgccaaggccgccaaggcgagcaacaccuccacgcccaccaagggcaacaccgagaccagcgccuccgccagccagacgaaccacgugaaggacgucaagaagaucaagaucgagcacgcccccagccccuccagcgggggcacccucaagaacgacaaggccaagaccaagccgccccuccaggugaccaagguggagaacaaccugaucgucgacaaggcgacgaagaaggccgugaucguggggaaggaguccaagagcgccgccaccaaggaggaguccgucagccucaaggagaagaccaagccccugacccccuccaucggcgccaaggagaaggagcagcacguggcgcuggugacgagcacccugccgccccugccccugccgcccaugcuccccgaggacaaggaggccgacucccugcggggcaacaucagcgucaaggccgugaagaaggagguggagaagaagcugcgcugccuccuggccgaccugccccugccgcccgagcugcccggcggggacgaccuguccaagagccccgaggagaagaagaccgcgacccagcuccacuccaagcggcgccccaagaucugcgggccccgguacggggagacgaaggagaaggacaucgacugggggaagcgcugcgucgacaaguucgacaucaucggcaucaucggcgaggggaccuacggccagguguacaaggcccgggacaaggacaccggggagaugguggcccugaagaagguccgccuggacaacgagaaggagggcuucccgaucaccgccauccgggagaucaagauccugcgccagcucacgcaccagagcaucaucaacaugaaggagaucgugaccgacaaggaggacgcccuggacuucaagaaggacaagggggcguucuaccuggucuucgaguacauggaccacgaccucaugggccugcuggaguccggccucgugcacuucaacgagaaccacaucaagagcuucaugcggcagcugauggaggggcuggacuacugccacaagaagaacuuccuccaccgcgacaucaagugcuccaacauccugcugaacaaccggggccagaucaagcucgccgacuucgggcuggcccgccuguacagcuccgaggagagccgccccuacaccaacaaggugaucacccucugguaccggccgcccgagcugcugcucggcgaggagcgcuacacgcccgccaucgacgucuggagcugcgggugcauccugggcgagcuguucaccaagaagcccaucuuccaggccaaccaggagcucgcgcagcuggagcugaucucccggaucugcggcagccccugccccgccguguggccggacgugaucaagcuccccuacuucaacaccaugaagcccaagaagcaguaccgccggaagcugcgcgaggaguucgucuucauccccgccgccgcccuggaccucuucgacuacaugcuggcgcuggacccguccaagcggugcaccgccgagcaggcccuccagugcgaguuccugcgcgacguggagcccagcaagaugccgccgcccgaccugccccucuggcaggacugccacgagcugugguccaagaagcggcgccggcagaagcagauggggaugaccgacgacgugagcacgaucaaggcgccccgcaaggaccugucccucggccuggacgacagccggaccaacacgccccaggggguccugcccuccagccagcucaagucccagggcagcuccaacguggcccccgugaagaccggccccgggcagcaccugaaccacagcgagcuggcgauccuccugaaccugcuccaguccaagacgagcgucaacauggccgacuucguccaggugcugaacaucaaggucaacuccgagacccagcagcagcugaacaagaucaaccuccccgccggcauccuggccaccggggagaagcagaccgacccgagcacgccccagcaggaguccagcaagccccugggcgggauccagccgagcucccagaccauccagcccaagguggagaccgacgcggcccaggccgccgugcagagcgccuucgcgguccuccugacccagcugaucaaggcccagcaguccaagcagaaggacgugcuccuggaggagcgcgagaacggcagcggccacgaggccucccugcagcuccggcccccgcccgagcccagcacgcccguguccgggcaggacgaccugauccagcaccaggacaugcgcauccuggagcucacccccgagcccgaccggccccgcauccugccgcccgaccagcggccgcccgagccgcccgagccgccgcccgucaccgaggaggaccuggacuaccgcaccgagaaccagcacgugcccacgaccagcuccagccucaccgacccgcacgccggcgugaaggccgcgcugcugcagcuccuggcccagcaccagccccaggacgaccccaagcgggagggcggcaucgacuaccaggccggggacaccuacgucuccacgagcgacuacaaggacaacuucggcuccagcuccuucagcuccgcccccuacgugagcaacgacggccugggguccagcagcgccccgccccucgagcgccgcuccuucaucggcaacagcgacauccagucccuggacaacuacagcaccgcguccagccacuccggcgggccgccccagccgagcgccuucuccgagagcuuccccuccagcguggccggguacggggacaucuaccugaacgccggccccaugcuguucuccggggacaaggaccaccgguucgaguacagccacggcccgaucgcgguccuggccaacuccagcgaccccuccaccgggcccgagagcacccacccccugccggccaagaugcacaacuacaacuacggcggcaaccuccaggagaaccccagcgggcccucccugaugcacggccagacguggaccagccccgcccaggggccgggcuacucccagggguaccgcggccacaucagcaccuccaccggccgggggcgcggccgggggcugcccuacuga

SEQ ID NO: 28041 - RNA, 1410 nt, Artificial Sequence
  derived and/or modified sequence opt1 from CDK14__Homo_sapiens__NP_001274064
augugcgaccugaucgagccccagccggccgagaagaucgggaagaugaagaagcuccgccggacccugagcgaguccuucagccgcaucgcccugaagaaggacgacaccacguucgacgagaucugcgugaccaagauguccacccggaacugccaggggauggacagcgucaucaagccccucgacaccauccccgaggacaagaaggugcgcgugcagcggacgcaguccaccuucgaccccuucgagaagccggcgaaccaggucaagcgcgugcacagcgagaacaacgccugcaucaacuucaagaccuccagcaccggcaaggagucccccaaggugcggcgccacagcucccccagcucccccacgagcccgaaguucgggaaggccgacuccuacgagaagcuggagaagcugggcgaggggagcuacgccaccgucuacaagggcaaguccaaggugaacggcaagcucguggcccugaaggucauccggcugcaggaggaggaggggacccccuucaccgcgauccgcgaggccagccuccugaagggccugaagcacgccaacaucgugcuccugcacgacaucauccacacgaaggagacccugacccucguguucgaguacguccacaccgaccugugccaguacauggacaagcaccccgggggccugcaccccgacaacgugaagcuguuccucuuccagcugcuccgggggcuguccuacauccaccagcgcuacauccugcaccgggaccucaagccgcagaaccugcugaucagcgacacgggcgagcucaagcuggccgacuucggccuggcgcgcgccaagagcgugcccucccacaccuacagcaacgaggucgugacccucugguaccggccgcccgacgugcugcugggguccaccgaguacagcacgugccucgacauguggggcgucgggugcaucuucguggagaugauccagggcguggccgccuuccccggcaugaaggacauccaggaccagcuggagcgcaucuuccugguccucgggacccccaacgaggacaccuggcccggcgugcacucccugccccacuucaagccggagcgguucacccuguacagcuccaagaaccuccgccaggccuggaacaagcugagcuacgugaaccacgcggaggaccuggccuccaagcuccugcagugcagccccaagaaccggcuguccgcccaggccgcccucagccacgaguacuucuccgaccugccgccccgccugugggagcucacggacaugagcuccaucuucaccguccccaacgugcggcugcagcccgaggcgggggagagcaugcgcgccuucggcaagaacaacuccuacggcaagagccuguccaacagcaagcacuga

SEQ ID NO: 28042 - RNA, 1290 nt, Artificial Sequence
  derived and/or modified sequence opt1 from CDK15__Homo_sapiens__NP_001248364
augggccaggagcugugcgccaagaccgugcagcccgggugcagcugcuaccacugcuccgagggcggggaggcccacagcugccgccggucccagccggagaccaccgaggcggccuucaagcucaccgaccugaaggaggccagcugcuccaugaccagcuuccacccccgcggccugcaggccgcccgggcgcagaaguucaaguccaagcgcccccggagcaacuccgacugcuuccaggaggaggaccuccgccagggguuccaguggcgcaagagccugcccuucggcgccgccuccagcuaccugaaccucgagaagcugggcgagggguccuacgccaccgucuacaagggcaucagccggaucaacgggcagcugguggcgcucaaggugaucuccaugaacgccgaggagggcgucccguucacggccauccgggaggccagccugcugaaggggcucaagcacgccaacaucgugcugcugcacgacaucauccacaccaaggagacccucaccuucguguucgaguacaugcacacggaccuggcgcaguacaugucccagcaccccggcggccugcacccccacaacguccgccucuucauguuccagcugcugcgggggcucgccuacauccaccaccagcacgugcugcaccgcgaccugaagccccagaaccuccugaucagccaccugggcgagcucaagcuggccgacuucgggcuggcccgggccaaguccaucccgagccagaccuacagcuccgagguggucacccucugguaccgcccgcccgacgcgcugcugggcgccaccgaguacagcuccgagcucgacaucuggggcgccgggugcaucuucaucgagauguuccagggccagccccuguuccccggggugagcaacauccuggagcagcucgagaagaucugggaggugcugggcguccccacggaggacaccuggcccgggguguccaagcugcccaacuacaacccggagugguucccccuccccacgccccggagccugcacguggucuggaaccgccugggccgggugccggaggccgaggaccucgccucccagaugcugaagggcuucccccgcgaccgggugagcgcgcaggaggcccugguccacgacuacuucuccgcccuccccagccagcuguaccagcugcccgacguguccggggugcgccucaagccggagaugugcgaccugcuggccagcuaccagaagggccaccaccccgcccaguucuccaagugcugguga

SEQ ID NO: 28043 - RNA, 1713 nt, Artificial Sequence
  derived and/or modified sequence opt1 from CDK16__Homo_sapiens__NP_001163931
augccccuguacggccgcgcccgggaccacgugacccacccgagcauccucgggacccgccccggccggcccauggccgggcccaucacggcggccgucccggagaagaucugcaacggcgccuucugcuccugcagcggggccuucccccuggaccccaacaaccccucccugggcccgcuccccagcaucucccaccugaaccugcgcacccagaucgccauggaccggaugaagaagaucaagcgccagcucagcaugacccugcggggcgggcgcggcaucgacaagaccaacggggcgcccgagcagaucggccuggacgaguccgggggcggcgggggcagcgaccccggggaggccccgacgcgggccgcccccggcgagcuccgcuccgcgcggggcccccugagcuccgcccccgagaucgugcacgaggaccugaagauggggagcgacggcgaguccgaccaggccagcgccaccuccagcgacgaggugcaguccccgguccgcgugcggaugcgcaaccacccgccccggaagaucagcaccgaggacaucaacaagcgccucucccugcccgccgacauccggcugccggagggguaccucgagaagcugacccugaacagccccaucuucgacaagccccucagccgccggcugcgccgggugucccugagcgagaucggcuucgggaagcucgagacguacaucaagcuggacaagcugggcgagggcaccuacgcgaccgucuacaaggggaaguccaagcucaccgacaaccugguggcccugaaggagauccgccucgagcacgaggagggcgcccccugcacggccauccgcgaggugagccugcugaaggaccucaagcacgccaacaucgucacccugcacgacaucauccacaccgagaagucccugacccucguguucgaguaccuggacaaggaccugaagcaguaccucgacgacugcgggaacaucaucaacaugcacaacgugaagcuguuccuguuccagcuccugcggggccuggcguacugccaccgccagaagguccuccaccgggaccugaagccgcagaaccugcucaucaacgagcgcggggagcugaagcuggccgacuucggccucgcccgggccaagagcauccccacgaagaccuacuccaacgagguggugacccugugguaccgcccgcccgacauccugcugggcagcaccgacuacuccacgcagaucgacauguggggcgucgggugcaucuucuacgagauggccaccgggcggccccucuuccccggcagcaccguggaggagcagcugcacuucaucuuccgcauccuggggacccccacggaggagaccuggcccggcauccucuccaacgaggaguucaagaccuacaacuaccccaaguaccgggcggaggcccugcugagccacgcgccccgccucgacuccgacggcgccgaccugcugaccaagcuccugcaguucgaggggcggaaccgcaucagcgccgaggacgccaugaagcaccccuucuuccugucccucggcgagcggauccacaagcugccggacacgaccagcaucuucgcccugaaggagauccagcuccagaaggaggccucccugcgcagcuccagcaugcccgacagcgggcggcccgccuuccgcguggucgacaccgaguucuga

SEQ ID NO: 28044 - RNA, 1572 nt, Artificial Sequence
  derived and/or modified sequence opt1 from CDK17__Homo_sapiens__NP_002586
augaagaaguucaagcgccggcugagccucacccugcgcggcucccagaccaucgacgagagccuguccgagcucgccgagcagaugacgaucgaggagaacagcuccaaggacaacgagcccaucgugaagaacgggcggccgcccaccagccacuccaugcacagcuuccugcaccaguacaccggcuccuucaagaagccgccccugcgccggccccacagcgucaucgggggcucccucgggagcuucauggccaugccccgcaacggcucccggcuggacaucgugcacgagaaccugaagaugggcagcgacggggaguccgaccaggcgagcggcaccuccagcgacgaggugcagucccccacgggggucugccuccgcaaccggauccaccgccggaucagcauggaggaccugaacaagcgccugagccuccccgccgacauccggaucccggacggcuaccuggagaagcugcagaucaacuccccgcccuucgaccagcccaugagccgccggucccgccgggccagccucuccgagaucggguucggcaagauggagaccuacaucaagcuggagaagcugggcgaggggaccuacgccaccguguacaagggccgcagcaagcucacggagaaccugguggcccugaaggagauccggcucgagcacgaggagggggcgcccugcaccgccauccgcgaggucucccugcugaaggaccucaagcacgccaacaucgugacccugcacgacaucgugcacaccgacaagagccugacgcucgucuucgaguaccuggacaaggaccugaagcaguacauggacgacugcggcaacaucauguccaugcacaacgugaagcuguuccucuaccagauccugcggggccucgccuacugccaccgccgcaaggugcugcaccgggaccugaagccccagaaccuccugaucaacgagaagggggagcugaagcucgcggacuucggccuggcccgcgccaagagcguccccaccaagaccuacuccaacgagguggugacccugugguaccggcccccggacguccuccuggggagcuccgaguacagcacgcagaucgacauguggggcguggggugcaucuucuucgagauggccuccggccgcccccuguuccccggcagcaccguggaggacgagcuccaccugaucuuccggcugcucgggacccccucccaggagaccuggccgggcaucagcuccaacgaggaguucaagaacuacaacuuccccaaguacaagccccagccccugaucaaccacgccccgcgccuggacagcgaggggaucgagcugaucacgaaguuccuccaguacgagagcaagaagcgggucuccgcggaggaggccaugaagcacguguacuuccgcagccugggcccccggauccacgcccugcccgaguccgugagcaucuucucccucaaggagauccagcugcagaaggaccccggguuccgcaacagcuccuacccggagaccggccacggcaagaaccggcgccagagcaugcuguucuga

SEQ ID NO: 28045 - RNA, 1425 nt, Artificial Sequence
  derived and/or modified sequence opt1 from CDK18__Homo_sapiens__NP_002587
augaucaugaacaagaugaagaacuucaagcgccgguucagccuguccgugccccgcaccgagaccaucgaggagagccucgccgaguucacggagcaguucaaccagcugcacaaccggcgcaacgagaaccugcagcucggcccgcuggggcgggacccgccccaggagugcuccaccuucagccccaccgacuccggcgaggagcccgggcagcugagccccggcguccaguuccagcgccggcagaaccagcgccgguucuccauggaggacgugagcaagcgccucucccugcccauggacauccggcugccccaggaguuccuccagaagcugcagauggagagcccggaccugcccaagccccucucccgcaugagccggcgcgccucccugagcgacaucggguucggcaagcuggagaccuacgugaagcucgacaagcugggcgaggggacguacgcgaccgucuucaagggccgguccaagcugaccgagaaccucguggcccugaaggagauccgccuggagcacgaggagggggcccccugcaccgccauccgggaggugagccuccugaagaaccugaagcacgccaacaucgucacgcuccacgaccugauccacaccgaccgcucccugacccucguguucgaguaccuggacagcgaccugaagcaguaccucgaccacugcggcaaccugauguccaugcacaacgugaagaucuucauguuccagcugcuccgggggcuggcguacugccaccaccgcaagauccugcaccgggaccucaagccgcagaaccugcugaucaacgagcgcggcgagcucaagcuggccgacuucggccuggcccgcgccaagagcguccccaccaagacguacagcaacgagguggugacccucugguaccggccgcccgacguccugcugggguccaccgaguacagcacccccaucgacauguggggcguggggugcauccacuacgagauggcgacgggccgcccccucuuccccggcuccaccgugaaggaggagcugcaccugaucuuccggcuccuggggacccccaccgaggagacguggccgggcgucaccgccuucagcgaguuccgcaccuacuccuuccccugcuaccugccccagccccugaucaaccacgccccgcggcucgacaccgacgggauccaccuccugagcucccugcugcuguacgagagcaagucccgcaugagcgccgaggccgcgcucucccacagcuacuuccggucccugggcgagcgcgugcaccagcuggaggacacggccagcaucuucucccucaaggagauccagcugcagaaggaccccggguaccggggccuggccuuccagcagcccggccgcgggaagaaccggcgccagagcaucuucuga

SEQ ID NO: 28046 - RNA, 1329 nt, Artificial Sequence
  derived and/or modified sequence opt1 from CDK19__Homo_sapiens__NP_001287892
augagcgccugccgcgagaucgcccugcuccgggagcugaagcaccccaacgugaucgcgcugcagaaggucuuccucucccacagcgaccgcaagguguggcugcuguucgacuacgccgagcacgaccucuggcacaucaucaaguuccaccgggccuccaaggccaacaagaagcccaugcagcugccccgcagcauggugaagucccugcucuaccagauccuggacggcauccacuaccugcacgccaacuggguccuccaccgggaccugaagcccgcgaacauccuggugaugggggagggccccgagcgcgggcgggugaagaucgccgacaugggcuucgcccgccucuucaacagcccgcugaagccccuggccgaccucgaccccgucguggugaccuucugguaccgggcgcccgagcugcugcucggggcccgccacuacaccaaggccaucgacaucugggccaucggcugcaucuucgccgagcugcugacguccgagccgaucuuccacugccggcaggaggacaucaagaccagcaaccccuuccaccacgaccagcucgaccgcaucuucuccgucaugggcuuccccgcggacaaggacugggaggacauccggaagaugcccgaguacccgacccugcagaaggacuuccgccggaccacguacgccaacagcucccugaucaaguacauggagaagcacaaggugaagcccgacagcaagguguuccuccugcugcagaagcuccugaccauggaccccaccaagcgcaucaccuccgagcaggcccugcaggaccccuacuuccaggaggacccgcuccccacgcuggacgucuucgccgggugccagauccccuaccccaagcgggaguuccugaacgaggacgacccggaggagaagggcgacaagaaccagcagcagcagcagaaccagcaccagcagcccaccgccccgccccagcaggcggccgccccgccccaggccccgccgccccagcagaacagcacccagaccaacgggacggccggcggggcgggcgccggcgucgggggcaccggggccggccuccagcacucccaggacagcucccugaaccaggugccgcccaacaagaagccccgccugggccccagcggggccaacuccggcgggcccgugaugcccagcgacuaccagcacagcuccagccggcucaacuaccaguccagcgugcagggcuccagccagucccagagcacccugggguacuccagcuccagccagcaguccagccaguaccaccccucccaccaggcccaccgcuacuga

SEQ ID NO: 28047 - RNA, 723 nt, Artificial Sequence
  derived and/or modified sequence opt1 from CDK1__Homo_sapiens__NP_203698
auggaggacuacaccaagaucgagaagaucggcgaggggaccuacggcguggucuacaaggggcgccacaagacgaccggccaggugguggccaugaagaagauccggcuggagagcgaggaggaggggguccccuccaccgccauccgcgagaucagccuccugaaggagcugcggcacccgaacaucgugucccuccaggacgugcugaugcaggacagccgccuguaccucaucuucgaguuccuguccauggaccugaagaaguaccucgacagcaucccgcccggccaguacauggacuccagccuggucaagguggugacccugugguaccggucccccgagguccuccugggcagcgcgcgcuacuccacgcccguggacaucuggagcaucgggaccaucuucgccgagcuggccaccaagaagccccucuuccacggcgacuccgagaucgaccagcuguuccggaucuuccgcgcccuggggacccccaacaacgagguguggcccgaggucgagagccuccaggacuacaagaacacguucccgaaguggaagcccggcucccuggccagccacgugaagaaccuggacgagaacgggcucgaccugcuguccaagaugcucaucuacgaccccgcgaagcggaucagcggcaagauggcccugaaccaccccuacuucaacgaccuggacaaccagaucaagaagauguga

SEQ ID NO: 28048 - RNA, 1041 nt, Artificial Sequence
  derived and/or modified sequence opt1 from CDK20__Homo_sapiens__NP_001034892
auggaccaguacugcauccugggccgcaucggggagggcgcccacgggaucguguucaaggccaagcacgucgagaccggcgagaucguggcgcucaagaagguggcccugcggcgccuggaggacggguuccccaaccaggcccuccgggagaucaaggcccugcaggagauggaggacaaccaguacgucgugcagcugaaggccguguucccgcacggcggcggguucguccucgcguucgaguucaugcugagcgaccuggccgagguggugcgccacgcccagcggccccucgcccaggcgcaggucaaguccuaccugcagaugcugcucaagggcguggccuucugccacgccaacaacaucgugcaccgcgaccugaagcccgccaaccugcucaucagcgccuccgggcagcugaagaucgcggacuucggccuggcccgggucuucagccccgacgggucccgccucuacacccaccagguggccacgcggugguaccgcgccccggagcugcuguacggcgcccggcaguacgaccagggcguggaccucuggagcgucgggugcaucaugggcgagcugcugaacgggagcccccucuuccccggcaagaacgacaucgagcagcugugcuacgugcugcgcauccucggcacccccaacccccagguguggcccgagcugaccgagcugcccgacuacaacaagaucuccuucaaggagcagguccccaugccgcucgaggaggugcugcccgacgugagcccccaggcgcuggaccuccuggggcaguuccugcucuacccgccgcaccagcggaucgccgccuccaaggcccugcugcaccaguacuucuucaccgcgccccuccccgcccaccccuccgagcugccgaucccccagcgccugggcgggcccgcccccaaggcccacccgggcccgccccacauccacgacuuccacgucgaccggccccucgaggagagccugcugaaccccgagcucauccgccccuucauccuggagggguga

SEQ ID NO: 28049 - RNA, 348 nt, Artificial Sequence
  derived and/or modified sequence opt1 from CDK2AP1__Homo_sapiens__NP_004633
augagcuacaagcccaaccuggccgcccacaugccggcggccgcccucaacgccgccggcuccgugcacagccccuccaccagcauggcgaccuccagccaguaccgccagcugcuguccgacuacgggccgcccagccucggcuacacgcaggggaccggcaacucccaggucccccagagcaaguacgccgagcugcuggccaucaucgaggagcucgggaaggagauccggcccaccuacgccggcuccaagagcgcgauggagcgccugaagcggggcaucauccacgcccgcgggcuggugcgggagugccucgccgagaccgagcgcaacgcccgguccuga

SEQ ID NO: 28050 - RNA, 381 nt, Artificial Sequence
  derived and/or modified sequence opt1 from CDK2AP2__Homo_sapiens__NP_005842
augagcuacaagcccaucgccccggcccccuccagcacccccggcuccagcacccccgggccgggcacgcccgugcccaccggguccguccccagcccguccggcagcgugcccggggcgggcgcccccuuccgcccccuguucaacgacuucggcccgcccuccaugggguacgugcaggccaugaagccgcccggcgcccaggggagccaguccaccuacaccgaccuccugagcgucaucgaggagaugggcaaggagauccggcccacguacgccggguccaagagcgcgauggagcgccugaagcggggcaucauccacgcccgcgcccucgugcgggagugccuggccgagaccgagcgcaacgcgcggaccuga

SEQ ID NO: 28051 - RNA, 897 nt, Artificial Sequence
  derived and/or modified sequence opt1 from CDK2__Homo_sapiens__NP_001789
auggagaacuuccagaagguggagaagaucggcgaggggaccuacggcgucguguacaaggcccgcaacaagcugaccggggagguggucgcccucaagaagauccggcuggacacggagaccgagggcgugcccagcaccgcgauccgcgagaucucccugcucaaggagcugaaccacccgaacaucgugaagcugcucgacgucauccacaccgagaacaagcuguaccugguguucgaguuccuccaccaggaccugaagaaguucauggacgccagcgcccugacggggaucccccucccccugaucaaguccuaccuguuccagcuccugcagggccuggccuucugccacagccaccgggugcuccaccgcgaccugaagccccagaaccugcucaucaacaccgagggcgccaucaagcuggcggacuucgggcuggcccgggccuucggcgucccggugcgcaccuacacccacgagguggucacgcucugguaccgggcccccgagauccugcuggggugcaaguacuacuccaccgcgguggacaucuggagccucggcugcaucuucgccgagauggugacccgccgggcccuguuccccggggacuccgagaucgaccagcuguuccgcaucuuccggacccucggcacgcccgacgaggucguguggccgggcgugaccagcaugcccgacuacaagcccuccuuccccaagugggcccgccaggacuucagcaaggucgugccgccccuggacgaggacgggcggucccugcucagccagaugcugcacuacgaccccaacaagcgcaucuccgccaaggcggcccuggcccaccccuucuuccaggacgugaccaagccggucccccaccuccggcuguga

SEQ ID NO: 28052 - RNA, 918 nt, Artificial Sequence
  derived and/or modified sequence opt1 from CDK3__Homo_sapiens__NP_001249
auggacauguuccagaagguggagaagaucggcgaggggaccuacggcgucguguacaaggccaagaaccgcgagaccgggcagcugguggcccucaagaagauccggcuggaccuggagauggagggcguccccagcacggcgauccgcgagaucucccuccugaaggagcugaagcacccgaacaucgugcggcuccuggacgugguccacaacgagcgcaagcuguaccucguguucgaguuccugagccaggaccugaagaaguacauggacuccacccccgggagcgagcucccccugcaccugaucaaguccuaccucuuccagcugcugcagggcgugagcuucugccacucccaccgggucauccaccgcgaccucaagccccagaaccugcugaucaacgagcucggcgccaucaagcuggccgacuucgggcuggcccgggccuucggcgugccgcuccgcaccuacacccacgagguggucacgcugugguaccgggcgcccgagauccugcucgggagcaaguucuacaccaccgccguggacaucugguccaucggcugcaucuucgccgagauggugacccgcaaggcccuguuccccggggacagcgagaucgaccagcuguuccggaucuuccgcaugcucggcacgcccuccgaggacaccuggccgggcgucacccagcugcccgacuacaaggggagcuuccccaaguggacccggaagggccuggaggagaucgugcccaaccucgagccggaggggcgcgaccugcugaugcagcuccugcaguacgaccccucccagcggaucacggcgaagaccgcccuggcccaccccuacuucagcucccccgagccgagccccgccgcccgccaguacgugcuccagcgguuccgccacuga

SEQ ID NO: 28053 - RNA, 912 nt, Artificial Sequence
  derived and/or modified sequence opt1 from CDK4__Homo_sapiens__NP_000066
auggccaccagccgcuacgagcccguggccgagaucggcgucggggcguacggcaccguguacaaggcccgggacccgcacuccgggcacuucguggcccucaagagcguccgcgugcccaacggcgggggcggcgggggcgggcugcccaucuccacggugcgggaggucgcccugcugcgccggcucgaggccuucgagcaccccaacguggugcgccugauggacgucugcgcgaccagccggaccgaccgcgagaucaaggugacccugguguucgagcacgucgaccaggaccuccggacguaccuggacaaggccccgccgcccggccugcccgccgagaccaucaaggaccucaugcgccaguuccugcgggggcuggacuuccuccacgccaacugcaucgugcaccgcgaccugaagccggagaacauccuggugaccuccggcggcaccgucaagcucgcggacuucgggcuggcccggaucuacagcuaccagauggcccugacgcccgugguggucacccucugguaccgcgcccccgaggugcugcugcaguccaccuacgccacccccguggacauguggagcgucggcugcaucuucgcggagauguuccggcgcaagccccucuucugcgggaacuccgaggccgaccagcugggcaagaucuucgaccugaucggccucccgcccgaggacgacuggccccgggacgugagccugccccgcggggccuucccgccccggggcccccgccccgugcaguccgucgugcccgagauggaggagagcggggcccagcugcuccuggagaugcugacguucaacccccacaagcggaucuccgccuuccgcgcgcuccagcacagcuaccugcacaaggacgagggcaaccccgaguga

SEQ ID NO: 28054 - RNA, 783 nt, Artificial Sequence
  derived and/or modified sequence opt1 from CDK5__Homo_sapiens__NP_001157882
augcagaaguacgagaagcuggagaagaucggcgaggggaccuacggcaccguguucaaggccaagaaccgcgagacgcacgagaucgucgcccucaagcgggugcgccuggacgacgacgacgagggggugcccagcuccgcgcugcgggagaucugccuccugaaggagcugaagcacaagaacaucguccgccuccacgacgugcugcacagcgacaagaagcugacccucguguucgaguucugcgaccaggaccugaagaaguacuucgacuccugcaacggcgaccuggacccggagaucgucaagaacggggagcucaagcuggccgacuucggccuggcccgggccuucggcauccccgugcgcugcuacagcgccgagguggucacccucugguaccggccgcccgacgugcuguucggggcgaagcuguacuccaccagcaucgacaugugguccgccggcugcaucuucgccgagcucgccaacgcggggcgcccccuguuccccggcaacgacguggacgaccagcugaagcggaucuuccgccuccuggggacgcccaccgaggagcaguggcccagcaugaccaagcugccggacuacaagcccuaccccauguaccccgccaccacgucccucgucaacguggugccgaagcugaacgccaccggccgggaccugcuccagaaccugcugaagugcaaccccguccagcgcaucagcgccgaggaggcccuccagcaccccuacuucuccgacuucugcccgcccuga

SEQ ID NO: 28055 - RNA, 924 nt, Artificial Sequence
  derived and/or modified sequence opt1 from CDK5R1__Homo_sapiens__XP_011523740
augggcaccgugcugagccucucccccagcuaccgcaaggccacccuguucgaggacggggccgcgacggucggccacuacaccgccgugcagaacuccaagaacgccaaggacaagaaccugaagcggcacagcaucaucuccgugcucccguggaagcgcaucgucgccgugagcgccaagaagaagaacuccaagaaggugcagcccaacagcuccuaccagaacaacaucacccaccugaacaacgagaaccugaagaagucccucagcugcgcgaaccugagcaccuucgcccagcccccgcccgcccagccgcccgccccgcccgcgucccagcugagcgggucccagacgggcgggagcuccagcgucaagaaggcgccccaccccgccgugaccuccgccggcacccccaagcgggugaucguccaggccagcaccagcgagcuccugcgcugccugggcgaguuccucugccggcgcugcuaccggcugaagcaccugucccccacggaccccgugcucuggcugcgcagcguggaccggucccugcuccugcagggguggcaggaccagggcuucaucacccccgccaacgucguguuccuguacaugcucugccgcgacgugaucagcuccgaggucgggagcgaccacgagcugcaggccgugcugcugaccugccucuaccuguccuacagcuacaugggcaacgagaucuccuacccccucaagccguuccugguggagagcugcaaggaggccuucugggaccggugccuguccgucaucaaccucaugagcuccaagaugcugcagaucaacgccgacccccacuacuucacccagguguucagcgaccugaagaacgaguccgggcaggaggacaagaagcgccuccugcugggccucgaccgguga

SEQ ID NO: 28056 - RNA, 1104 nt, Artificial Sequence
  derived and/or modified sequence opt1 from CDK5R2__Homo_sapiens__NP_003927
augggcaccgugcugagccucucccccgccagcuccgccaaggggcgccggcccggcgggcugcccgaggagaagaagaaggcgccgcccgccggcgacgaggcccucgggggcuacggcgccccgcccgucgggaagggcgggaagggcgagagccgccugaagcggcccuccgugcugaucagcgcccugaccuggaagcgccucguggcggccuccgccaagaagaagaaggggagcaagaaggucacgcccaagccggccuccaccggccccgacccccuggugcagcagcggaaccgcgagaaccugcuccggaagggccgcgacccgcccgacgggggcgggaccgcgaagccccuggccgugcccguccccaccgugcccgccgccgccgcgacgugcgagccgcccagcggcggcuccgccgccgcccagcccccggggagcggcgggggcaagcccccgcccccgcccccgcccgcgccccagguggccccgcccguccccgggggcagcccccggcgcgugaucgugcaggccuccaccggcgagcugcuccggugccugggggacuucgucugccgccggugcuaccgccugaaggagcucucccccggcgagcugguggggugguuccggggcguggaccgcagccugcuccugcagggguggcaggaccaggccuucaucacccccgccaaccuggucuucguguaccuccugugccgggagucccugcgcggcgacgagcucgccagcgcggccgagcugcaggccgccuuccugaccugccucuaccuggccuacuccuacaugggcaacgagaucagcuacccccugaagcccuuccucguggagcccgacaaggagcgguucuggcagcgcugccugcggcugauccagcgccucagcccccagaugcugcgccugaacgcggacccccacuucuucacgcaggucuuccaggaccucaagaacgagggggaggccgccgccuccggcgggggcccgcccagcgggggcgcgcccgccgccuccagcgccgcccgggacuccugcgcggccggcaccaagcacuggaccaugaaccuggaccgcuga

SEQ ID NO: 28057 - RNA, 1761 nt, Artificial Sequence
  derived and/or modified sequence opt1 from CDK5RAP1__Homo_sapiens__NP_001265096
augcacccccugcagugcgugcuccagguccagcgcagccugggcugggggccgcuggccuccgugagcuggcucucccugcggaugugccgcgcccacagcucccugagcuccaccaugugccccagccccgagcggcaggaggacggcgcgcgcaaggacuucuccagccggcucgccgccgggcccaccuuccagcacuuccugaaguccgccagcgccccgcaggagaagcuguccagcgagguggaggacccgccgcccuaccucaugauggacgagcugcugggccgccagcggaaggucuaccucgagacguacgggugccagaugaacgugaacgacaccgagaucgcgugguccauccugcagaaguccggcuaccugcgcaccagcaaccuccaggaggccgacgugauccugcuggugaccugcagcauccgggagaaggccgagcagacgaucuggaaccgccuccaccagcugaaggcccugaagacccggcgcccccggucccgcgucccccuccggaucggcauccuggggugcauggcggagcgccugaaggaggagauccucaaccgggagaagaugguggacauccuggccggccccgacgccuaccgcgaccugccccggcuccuggccgucgccgagagcgggcagcaggcggccaacgugcugcucagccuggacgagaccuacgccgacgugaugcccguccagaccuccgccagcgccacguccgcguucgugagcaucaugcgcggcugcgacaacaugugcuccuacugcaucgugcccuucacccgggggcgcgagcgcagccggcccaucgccuccauccuggaggaggucaagaagcucagcgagcagggccugaaggaggugacccugcucggccagaacgugaacuccuuccgcgacaacagcgagguccaguucaacuccgccgugcccaccaaccugagccggggguucacgaccaacuacaagaccaagcagggcgggcugcgcuucgcccaccuccuggaccaggugucccgggucgacccggagaugcgcauccgguucaccagcccccaccccaaggacuuccccgacgaggugcugcagcucauccacgagcgcgacaacaucugcaagcagauccaccucccggcccaguccggcagcucccgggugcuggaggcgaugcgccggggcuacagccgcgaggccuacgucgagcuggugcaccacauccgggaguccauccccggggucagccugagcuccgacuucaucgccggcuucugcggggagacggaggaggaccacgugcagaccgugagccugcuccgcgagguccaguacaacaugggcuuccuguucgccuacuccaugcggcagacccgcgccuaccaccggcugaaggacgacgugcccgaggaggugaagcugcgccggcucgaggagcugaucaccaucuuccgcgaggaggcgacgaaggccaaccagaccagcgucgggugcacccagcuggugcucguggagggccuguccaagcgcagcgccaccgaccugugcggccggaacgacgggaaccucaaggucaucuuccccgacgccgagauggaggacgugaacaacccgggccugcgcgugcgggcgcagcccggggacuacguccuggugaagaucacguccgccagcucccagacccuccgcggccacgugcugugccggaccacccugcgcgacagcuccgccuacugcuga

SEQ ID NO: 28058 - RNA, 5445 nt, Artificial Sequence
  derived and/or modified sequence opt1 from CDK5RAP2__Homo_sapiens__NP_001011649
augauggaccuggugcucgaggaggacgugaccgugcccggcacccugagcgggugcuccggccuggugccgagcguccccgacgaccucgacgggaucaaccccaacgccggccuggggaacggccugcuccccaacguguccgaggagacggugagccccacccgcgcccggaacaugaaggacuucgagaaccagaucaccgagcugaagaaggagaacuucaaccugaagcuccgcaucuacuuccuggaggagcggaugcagcaggaguuccacggccccaccgagcacaucuacaagacgaacaucgagcugaaggucgagguggagucccucaagcgcgagcugcaggagcgggagcagcugcucaucaaggccagcaaggccguggagucccuggccgaggccgggggcagcgagauccagcgcgucaaggaggacgcccggaagaaggugcagcaggucgaggaccugcucaccaagcgcauccugcugcucgagaaggacgucaccgcggcccaggccgagcuggagaaggccuucgcggggaccgagacggagaaggcccugcggcuccgccuggaguccaagcugagcgagaugaagaagaugcacgagggcgaccucgccauggcccuggugcuggacgagaaggaccggcucaucgaggagcugaagcugucccucaagagcaaggaggcccugauccagugccugaaggaggagaagucccagauggcgugccccgacgagaacgugagcuccggggagcuccgcggccugugcgccgcgccccgggaggagaaggagcgcgagaccgaggccgcccagauggagcaccagaaggagcggaacagcuucgaggagcgcauccaggcgcuggaggaggaccuccgggagaaggagcgcgagaucgccaccgagaagaagaacucccugaagcgggacaaggccauccagggccugaccauggcccucaagagcaaggagaagaaggucgaggagcugaacuccgagaucgagaagcugagcgccgcguucgccaaggcccgcgaggcccuccagaaggcccagacgcaggaguuccaggggagcgaggacuacgagaccgcgcuguccggcaaggaggcccugagcgccgcccuccggucccagaaccugaccaagagcaccgagaaccaccgccugcgccgguccaucaagaagaucacgcaggagcugagcgaccuccagcaggagcgcgagcggcuggagaaggaccuggaggaggcgcaccgcgagaaguccaagggggacugcaccauccgggaccuccgcaacgagguggagaagcugcggaacgaggugaacgagcgcgagaaggccauggagaaccgguacaagagccugcucuccgagagcaacaagaagcugcacaaccaggagcaggucaucaagcaccugaccgaguccaccaaccagaaggacgugcuccugcagaaguucaacgagaaggaccuggaggugauccagcagaacugcuaccucauggccgccgaggaccuggagcugcgcagcgagggccucaucacggagaagugcuccagccagcagccgcccggcuccaagaccaucuucagcaaggagaagaagcaguccagcgacuacgaggagcugauccagguccugaagaaggagcaggacaucuacacccaccucgugaagucccugcaggagagcgacagcaucaacaaccugcaggccgagcucaacaagaucuucgcgcugcggaagcagcuggagcaggacgugcucuccuaccagaaccugcgcaagacccuggaggagcagaucagcgagauccggcgccgggaggaggaguccuucagccucuacuccgaccagacgagcuaccuguccaucugccuggaggagaacaaccgcuuccaggucgagcacuucagccaggaggagcucaagaagaagguguccgaccugauccagcuggucaaggagcucuacaccgacaaccagcaccugaagaagaccaucuucgaccugagcugcaugggguuccagggcaacggguuccccgaccggcucgccuccaccgagcagacggagcugcuggccagcaaggaggacgaggacaccaucaagaucggcgaggacgacgagaucaacuuccucuccgaccagcaccuccagcagagcaacgagaucaugaaggaccuguccaagggcgggugcaagaacggcuaccuccgccacaccgagagcaagaucuccgacugcgacggggcccacgcccccggcugccuggaggagggggcguucaucaaccugcucgcgccccuguucaacgagaaggccacccugcuccuggagagccggcccgaccugcucaagguggugcgcgagcugcugcucggccagcuguuccugacggagcaggaggucagcggggagcaccucgacggcaagaccgagaagacccccaagcagaagggcgagcuggugcacuucgugcagaccaacuccuucagcaagccccacgacgagcugaagcucuccugcgaggcccagcuggucaaggccggggaggugccgaaggugggccugaaggacgccagcguccagacgguggccaccgagggggaccuccugcgcuucaagcacgaggccacccgggaggccugggaggagaagcccaucaacaccgcgcuguccgccgagcaccgccccgagaaccuccacggcgugcccggguggcaggccgcccugcugagccucccgggcaucaccaaccgggaggccaagaagucccgccugcccauccugaucaagcccagccggucccucggcaacauguaccgccugcccgcgacgcaggaggucgugacccagcugcagagccagauccucgagcugcagggggagcugaaggaguucaagaccugcaacaagcagcuccaccagaagcugauccuggccgaggccgugauggagggccggccgacccccgacaagacgcuccugaacgcccagccgcccgucggggccgcguaccaggacuccccgggcgagcagaagggcaucaagaccaccagcuccguguggcgcgacaaggagauggacagcgaccagcagcgguccuacgagaucgacagcgagaucugcccgcccgacgaccuggccucccucccgagcugcaaggagaaccccgaggacgugcugucccccaccagcgucgccacguaccugagcuccaagagccagcccuccgccaaggugagcgugauggggaccgaccaguccgagagcaucaacaccuccaacgagaccgaguaccucaagcagaagauccacgaccuggagacggagcuggagggcuaccagaacuucaucuuccagcuccagaagcacagccagugcuccgaggccaucaucaccguccugugcgggaccgagggcgcgcaggacgggcugagcaagccgaagaacggcuccgacggcgaggagaugaccuucagcucccuccaccaggugcgcuacgugaagcacgucaagauccuggggccccuggcccccgagaugaucgacagccgggugcuggagaaccucaagcagcagcuggaggagcaggaguacaagcugcagaaggagcagaaccucaacaugcagcuguucuccgagauccacaaccugcagaacaaguuccgcgaccucagcccgccccgguacgacucccuggugcagagccaggcccgcgagcugucccuccagcggcagcagaucaaggacggccacgggaucugcgucaucagccgccagcacaugaacacgaugaucaaggccuucgaggagcugcugcaggcgagcgacguggacuacugcguggccgagggcuuccaggagcagcucaaccagugcgccgagcugcuggagaagcucgagaagcuguuccugaacgggaaguccgucggcguggagaugaacacccagaacgagcucauggagcggaucgaggaggacaaccugaccuaccagcaccuccugcccgagagccccgagcccuccgccagccacgcccuguccgacuacgagaccagcgagaaguccuucuucagccgcgaccagaagcaggacaacgagacggagaagaccuccgugauggucaacagcuucucccaggaccugcugauggagcacauccaggagauccggacccugcgcaagcggcuggaggagagcaucaagaccaacgagaagcuccgcaagcagcuggagcgccagggcuccgaguucgugcaggggagcacguccaucuucgcgagcggcuccgagcugcacagcucccucaccagcgagauccacuuccugcggaagcagaaccaggcccugaacgccaugcucaucaaggggagccgcgacaagcagaaggagaacgacaagcugcgggagucccugagccgcaagaccgugucccucgagcaccuccagcgggaguacgccagcgucaaggaggagaacgagcgccugcagaaggagggcuccgagaaggagcggcacaaccagcagcucauccaggaggugcgcugcagcgggcaggagcugucccgggugcaggaggaggucaagcugcgccagcagcuccugagccagaacgacaagcugcuccagucccugcggguggagcugaaggccuacgagaagcucgacgaggagcaccgccggcugcgcgacggcgacaaguaccccauggagagcgacaacuccuucgaccuguucgacagcucccaggcggugacccccaagagcgucuccgagacgccgccccugagcggcaacgacaccgacucccugagcugcgacuccgggagcagcgccaccuccaccccgugcgugagccggcuggugacgggccaccaccucugggccuccaagaacgggcgccacguccugggccugaucgaggacuacgaggcccuccugaagcagaucagccaggggcagcggcugcucgccgagauggacauccagacccaggaggcgcccuccagcaccucccaggagcugggcaccaagggcccccaccccgccccgcugagcaaguucguguccagcguguccacggccaagcucacccuggaggaggccuaccgccggcugaagcuccuguggcgcgucagccugcccgaggacgggcagugcccccuccacugcgagcagaucggcgagaugaaggccgaggugaccaagcugcacaagaagcuguucgagcaggagaagaagcuccagaacaccaugaagcugcugcagcucuccaagcgccaggagaaggugaucuucgaccagcuggucgugacccacaagauccugcggaaggcgcgcgggaaccucgagcugcggcccggcggcgcccacccggggacgugcagccccucccgccccggcagcuga

SEQ ID NO: 28059 - RNA, 1521 nt, Artificial Sequence
  derived and/or modified sequence opt1 from CDK5RAP3__Homo_sapiens__NP_788276
auggaggaccaccagcacgugcccaucgacauccagaccagcaagcugcucgacuggcuggucgaccgccggcacugcucccugaaguggcagagccucgugcugaccauccgcgagaagaucaacgccgccauccaggacaugccggaguccgaggagaucgcgcagcugcucagcggcuccuacauccacuacuuccacugccugcggauccuggaccuccugaaggggacggaggccagcaccaagaacaucuucggccgcuacuccagccagcggaugaaggacuggcaggagaucaucgcccuguacgagaaggacaacaccuaccucguggagcuguccagccugcucguccgcaacgugaacuacgagauccccucccugaagaagcagaucgccaagugccagcagcugcagcaggaguacagccggaaggaggaggagugccaggccggggcggccgagaugcgcgagcaguucuaccacuccugcaagcaguacggcaucaccggggagaacgugcggggcgagcuccuggcccuggucaaggaccuccccagccagcuggccgagaucggcgcggccgcccagcagucccugggggaggccaucgacguguaccaggccagcgugggcuucgucugcgagucccccacggagcagguccucccgaugcugcgcuucgugcagaagcgggggaacagcaccguguacgaguggcgcaccggcaccgagcccuccgugguggagcggccccaccuggaggagcuccccgagcaggucgcggaggacgccaucgacuggggcgacuucgggguggaggccgugagcgagggcacggacagcgggaucuccgccgaggccgcgggcaucgacugggggaucuucccggagagcgacuccaaggaccccggcggcgacgggaucgacuggggcgacgacgccgucgcccugcagaucaccgugcuggaggccgggacccaggcccccgagggcguggcgcgcgggcccgacgcccucacccugcuggaguacacggagacccggaaccaguuccucgacgagcugauggagcuggagaucuuccucgcccagcgcgccgucgagcugagcgaggaggccgacgugcuguccgugagccaguuccagcucgcgccggccauccugcagggccagaccaaggagaagauggucaccaugguguccguccuggaggaccucaucggcaagcugacgagccugcagcuccagcaccuguucaugauccuggccagcccccgguacguggaccgcgugaccgaguuccuccagcagaagcugaagcagucccagcugcuggcccucaagaaggagcugaugguccagaagcagcaggaggcgcuggaggagcaggccgcccucgagcccaagcuggaccugcuccuggagaagaccaaggagcugcagaagcucaucgaggccgacaucuccaagcgguacagcgggcgccccgugaaccugaugggcaccucccuguga

SEQ ID NO: 28060 - RNA, 981 nt, Artificial Sequence
  derived and/or modified sequence opt1 from CDK6__Homo_sapiens__XP_006715898
auggagaaggacggccugugccgcgccgaccagcaguacgagugcguggccgagaucggggagggcgcguacgggaaggucuucaaggcccgggaccucaagaacggcgggcgcuucguggcccugaagcgggugcgcguccagaccggcgaggagggcaugccccugagcaccauccgggagguggccgugcuccgccaccuggagacguucgagcaccccaacgucgugcggcuguucgacgugugcaccgucucccgcaccgaccgggagaccaagcucacgcugguguucgagcacguggaccaggaccugaccaccuaccucgacaagguccccgagcccggggugcccaccgagacgaucaaggacaugauguuccagcugcugcgcggccucgacuuccugcacagccaccgggugguccaccgcgaccugaagccgcagaacauccucgugaccuccagcgggcagaucaagcuggccgacuucggccuggcgcggaucuacuccuuccagauggcccucaccagcguggucgugacccugugguaccgcgcccccgaggugcugcuccaguccagcuacgccacgcccgucgaccugugguccguggggugcaucuucgcggagauguuccggcgcaagccccuguuccggggcagcuccgacguggaccagcucggcaagauccuggacgucaucgggcugccgggcgaggaggacuggccccgcgacguggcccucccccggcaggccuuccacagcaaguccgcccagcccaucgagaaguucgucaccgacaucgacgagcuggggaaggaccugcuccugaagugccugaccuucaacccggccaagcgcaucagcgcguacuccgcccucagccaccccuacuuccaggaccuggagcggugcaaggagaaccuggacucccaccucccgcccagccagaacaccuccgagcugaacacggccuga

SEQ ID NO: 28061 - RNA, 1041 nt, Artificial Sequence
  derived and/or modified sequence opt1 from CDK7__Homo_sapiens__NP_001790
auggcccuggacgucaagagccgcgccaagcgguacgagaagcucgacuuccugggcgaggggcaguucgcgaccguguacaaggcccgcgacaagaacaccaaccagaucguggccaucaagaagaucaagcugggccaccgguccgaggccaaggacgggaucaaccgcacggcccuccgggagaucaagcugcugcaggagcucagccaccccaacaucaucggccugcuggacgcguucgggcacaaguccaacaucagccucguguucgacuucauggagaccgaccuggaggucaucaucaaggacaacucccuggugcucaccccgagccacaucaaggccuacaugcugaugacccugcagggccucgaguaccugcaccagcacuggauccugcaccgcgaccucaagcccaacaaccugcugcucgacgagaacggcgugcugaagcuggccgacuucgggcucgccaaguccuucggcagccccaaccgggcguacacgcaccaggucgugacccgcugguaccgggcccccgagcugcuguucggggcccgcauguacggcgugggggucgacaugugggccgugggcugcauccucgccgagcugcugcuccgggugccguuccugcccggcgacuccgaccuggaccagcucacccgcaucuucgagacccuggggacgcccaccgaggagcaguggcccgacaugugcagccugccggacuacgucaccuucaaguccuuccccggcaucccccuccaccacaucuucagcgcggccggggacgaccugcuggaccucauccagggccuguuccuguucaaccccugcgcccggaucaccgccacgcaggcccucaagaugaaguacuucuccaaccgcccgggccccacccccgggugccagcugccccggccgaacugccccguggagacccugaaggagcagagcaaccccgcgcucgccaucaagcgcaagcggaccgaggcccuggagcagggcgggcugcccaagaagcucaucuucuga

SEQ ID NO: 28062 - RNA, 1395 nt, Artificial Sequence
  derived and/or modified sequence opt1 from CDK8__Homo_sapiens__NP_001251
auggacuacgacuucaaggugaagcugagcuccgagcgcgagcgggucgaggaccucuucgaguacgagggcugcaagguggggcgcggcaccuacgggcacguguacaaggccaagcggaaggacggcaaggacgacaaggacuacgcccugaagcagaucgaggggaccggcaucagcauguccgcgugccgcgagaucgcccugcuccgggagcugaagcaccccaacgucaucagccugcagaagguguuccucucccacgccgaccgcaagguguggcugcuguucgacuacgccgagcacgaccucuggcacaucaucaaguuccaccgggccagcaaggcgaacaagaagccgguccagcugccccgcggcauggugaagucccugcucuaccagauccuggacgggauccacuaccugcacgccaacugggugcuccaccgggaccugaagcccgccaacauccuggucaugggcgaggggcccgagcgcggccgggugaagaucgccgacaugggguucgcgcgccucuucaacagcccgcugaagccccuggccgaccucgaccccguggucgugacguucugguaccgggcccccgagcugcugcucggcgcccgccacuacaccaaggccaucgacaucugggcgaucggcugcaucuucgccgagcugcugaccuccgagccgaucuuccacugccggcaggaggacaucaagaccagcaaccccuaccaccacgaccagcucgaccgcaucuucaacgugaugggguuccccgccgacaaggacugggaggacaucaagaagaugcccgagcacuccacgcugaugaaggacuuccggcgcaacaccuacaccaacugcagccugaucaaguacauggagaagcacaaggucaagccggacuccaaggccuuccaccuccugcagaagcugcucaccauggaccccaucaagcggaucacgagcgagcaggccaugcaggaccccuacuuccuggaggacccccugccgaccuccgacguguucgcgggcugccagauccccuaccccaagcgcgaguuccucaccgaggaggagcccgacgacaagggggacaagaagaaccagcagcagcagcagggcaacaaccacaccaacggcacggggcacccgggcaaccaggacagcucccacacccaggggccgccccugaagaaggugcgggucgugccgcccaccaccacgagcggcgggcugaucaugaccuccgacuaccagcgcagcaacccccacgccgccuaccccaaccccggccccagcaccucccagccccagagcuccaugggcuacagcgccaccucccagcagcccccgcaguacagccaccagacgcaccgcuacuga

SEQ ID NO: 28063 - RNA, 1119 nt, Artificial Sequence
  derived and/or modified sequence opt1 from CDK9__Homo_sapiens__NP_001252
auggccaagcaguacgacagcguggagugccccuucugcgacgaggucuccaaguacgagaagcuggccaagaucggccaggggaccuucggcgagguguucaaggcgcgccaccggaagaccgggcagaagguggcccucaagaagguccugauggagaacgagaaggagggcuucccgaucacggcccugcgcgagaucaagauccuccagcugcugaagcacgagaacguggugaaccucaucgagaucugccggaccaaggccagccccuacaaccgcugcaagggguccaucuaccuggucuucgacuucugcgagcacgaccuggccggccuccugagcaacgugcuggugaaguucacccucuccgagaucaagcgggucaugcagaugcugcugaacggccucuacuacauccaccgcaacaagauccugcaccgggacaugaaggcggccaacgugcugaucacccgcgacggggugcucaagcuggccgacuucggccuggcccgggcguucagccucgccaagaacucccagcccaaccgcuacacgaaccgggucgugacccugugguaccggcccccggagcugcuccugggggagcgcgacuacggcccgcccaucgaccuguggggcgccgggugcaucauggccgagauguggacccgcagccccaucaugcagggcaacaccgagcagcaccagcucgcccugaucucccagcugugcgggagcaucacgcccgagguguggcccaacgucgacaacuacgagcucuacgagaagcuggagcuggugaagggccagaagcggaaggugaaggaccgccucaaggcguacguccgggaccccuacgcccuggaccugaucgacaagcuccuggugcuggaccccgcccagcgcaucgacuccgacgacgcccucaaccacgacuucuucuggagcgacccgaugcccuccgaccugaaggggaugcugagcacccaccucaccuccauguucgaguaccuggccccgccccggcgcaagggcagccagaucacccagcaguccacgaaccagagccggaaccccgcgaccaccaaccagaccgaguucgagcgcguguucuga

SEQ ID NO: 28064 - RNA, 1740 nt, Artificial Sequence
  derived and/or modified sequence opt1 from CDKAL1__Homo_sapiens__NP_060244
augcccagcgccuccugcgacacccugcucgacgacaucgaggacaucgugagccaggaggacuccaagccgcaggaccgccacuucguccggaaggacguggugcccaagguccgccggcgcaacacccagaaguaccugcaggaggaggagaacagcccgcccuccgacagcacgauccccggcauccagaagaucuggauccggaccugggggugcucccacaacaacagcgacggcgaguacauggccgggcagcuggcggccuacggcuacaagaucaccgagaacgccuccgacgccgaccucuggcugcugaacagcugcaccgugaagaaccccgccgaggaccacuuccgcaacuccaucaagaaggcgcaggaggagaacaagaagaucgugcucgccgggugcgucccccaggcccagccccggcaggacuaccugaagggccugagcaucaucggcgugcagcagaucgaccgcguggucgaggugguggaggagacgaucaaggggcacuccguccggcuccugggccagaagaaggacaacgggcgccggcugggcggggcccgccucgaccugccgaagauccggaagaacccccugaucgagaucaucagcaucaacaccggcugccucaacgcgugcaccuacugcaagaccaagcacgcccgcggcaaccuggccuccuaccccaucgacgagcugguggaccgggccaagcagagcuuccaggagggggugugcgagaucuggcucacguccgaggacaccggcgccuacgggcgcgacaucggcaccaaccugcccacccugcucuggaagcuggucgaggugaucccggagggcgcgaugcugcggcucgggaugacgaacccgcccuacauccuggagcaccuggaggagauggccaagauccucaaccacccccgcguguacgccuuccugcacauccccguccagagcgccuccgacagcgugcugauggagaugaagcgggaguacugcguggccgacuucaagcgcgucguggacuuccucaaggagaaggugcccggcaucaccaucgcgaccgacaucaucugcggguuccccggcgagaccgaccaggacuuccaggagacggucaagcugguggaggaguacaaguuccccagccuguucaucaaccaguucuacccgcggcccgggacccccgccgccaagauggagcagguccccgcccaggugaagaagcagcgcaccaaggaccucucccgcguguuccacagcuacuccccguacgaccacaagaucggcgagcggcagcagguccuggugaccgaggagagcuucgacuccaaguucuacguggcccacaaccaguucuacgagcagguccuggugcccaagaaccccgcguucaugggcaagaugguggaggucgacaucuacgagagcgggaagcacuucaugaagggccagcccguguccgacgccaagguguacacgccgagcaucuccaagccccucgccaagggggaggucagcggccugaccaaggacuuccgcaacgggcugggcaaccagcucuccagcggcucccacaccagcgccgccucccagugcgacagcgcguccagccggauggugcugcccaugccgcgccugcaccaggacugcgcccuccggauguccguggggcuggcccugcucggccugcuguucgccuucuucgucaagguguacaacuga

SEQ ID NO: 28065 - RNA, 1077 nt, Artificial Sequence
  derived and/or modified sequence opt1 from CDKL1__Homo_sapiens__NP_004187
augauggagaaguacgagaagaucggcaagaucggggagggcagcuacggggugguguucaagugccgcaaccgggacaccggccagaucguggccaucaagaaguuccuggaguccgaggacgaccccgugaucaagaagaucgcccuccgcgagauccggaugcugaagcagcugaagcacccgaaccucgucaaccugcuggagguguuccgccggaagcgccggcuccaccugguguucgaguacugcgaccacaccguccugcacgagcucgaccgcuaccagcgcggggugcccgagcaccuggucaagagcaucacguggcagacccugcaggcggugaacuucugccacaagcacaacugcauccaccgggacgugaagcccgagaacauccucaucaccaagcacuccgugaucaagcugugcgacuucggcuucgcccggcugcucaccggccccagcgacuacuacacggacuacgucgccacccgcugguaccgguccccggagcugcuggugggggacacccaguacggcccgcccguggacgucugggccaucgggugcguguucgccgagcuccugagcggcgugccccuguggcccgggaaguccgacgucgaccagcucuaccugauccgcaagacccugggcgaccucaucccccggcaccagcaggucuucagcacgaaccaguacuucuccggcgugaagauccccgaccccgaggacauggagccgcuggagcugaaguuccccaacaucagcuaccccgcgcucgggcugcugaagggcugccuccacauggaccccacccagcgccugaccugcgagcagcugcuccaccacccguacuucgagaacauccgggagaucgaggaccuggccaaggagcacaacaagcccacccgcaagacgcugcggaagucccgcaagcaccacugcuucaccgagaccagcaagcuccaguaccugccccagcugaccggguccagcauccuccccgcccuggacaacaagaaguacuacugcgacacgaagaagcugaacuaccgguucccgaacaucuga

SEQ ID NO: 28066 - RNA, 1482 nt, Artificial Sequence
  derived and/or modified sequence opt1 from CDKL2__Homo_sapiens__NP_003939
auggagaaguacgagaaccugggccucgugggggagggcagcuacgggauggucaugaagugccgcaacaaggacaccggccggaucguggccaucaagaaguuccuggaguccgacgacgacaagauggugaagaagaucgccaugcgcgagaucaagcugcucaagcagcugcggcacgagaaccuggucaaccuccuggaggugugcaagaagaagaagcgcugguaccugguguucgaguucgucgaccacaccauccucgacgaccuggagcuguuccccaacgggcucgacuaccagguggugcagaaguaccuguuccagaucaucaacggcaucggcuucugccacagccacaacaucauccaccgggacaucaagccggagaacauccuggucucccagagcgggguggugaagcucugcgacuucggcuucgcgcgcacgcuggccgcccccggggaggucuacaccgacuacguggccacccggugguaccgcgcccccgagcugcucgugggcgacgucaaguacgggaaggcgguggacgugugggccaucggcugccuggucaccgagauguucaugggcgagccccuguucccgggggacuccgacaucgaccagcucuaccacaucaugaugugccugggcaaccugaucccccggcaccaggagcuguucaacaagaaccccguguucgccggggugcgccuccccgagaucaaggagcgggagccgcuggagcgccgguaccccaagcucagcgaggucgugaucgaccuggccaagaagugccugcacaucgaccccgacaagcgccccuucugcgcggagcuccugcaccacgacuucuuccagauggacggcuucgccgagcgguucucccaggagcugcagcucaaggugcagaaggacgcccgcaacgucagccuguccaagaagucccagaaccggaagaaggagaaggagaaggacgacagccugguggaggagcgcaagacgcucgucgugcaggacaccaacgccgacccgaagaucaaggacuacaagcuguucaagaucaagggcagcaagaucgacggggagaaggccgagaagggcaaccgggcguccaacgccagcugccugcacgacucccgcaccagccacaacaagaucgugcccuccaccagccucaaggacugcuccaacgucagcguggaccacacgcggaaccccagcguggccaucccgccccugacccacaaccuguccgccgucgcccccagcaucaacuccgggaugggcaccgagaccauccccauccagggguaccgcguggacgagaagacgaagaagugcagcauccccuucgugaagccgaaccgccacucccccagcggcaucuacaacaucaacgucaccacccucguguccggcccgccccugagcgacgacuccggggcggaccugccccagauggagcaccagcacuga

SEQ ID NO: 28067 - RNA, 1779 nt, Artificial Sequence
  derived and/or modified sequence opt1 from CDKL3__Homo_sapiens__NP_001107047
auggagauguacgagacccugggcaaggugggggagggcagcuacgggaccgucaugaagugcaagcacaagaacacgggccagaucguggccaucaagaucuucuacgagcgccccgagcaguccgugaacaagaucgccaugcgggagaucaaguuccucaagcaguuccaccacgagaaccuggucaaccugaucgagguguuccgccagaagaagaagauccaccucguguucgaguucaucgaccacaccguccuggacgagcugcagcacuacugccacgggcucgagagcaagcggcugcgcaaguaccuguuccagauccuccgggcgaucgacuaccugcacuccaacaacaucauccaccgcgacaucaagccggagaacauccuggugagccaguccggcaucaccaagcucugcgacuucggcuucgcccggacccuggccgcccccggggacaucuacacggacuacguggccacccgcugguaccgggcgcccgagcugguccucaaggacaccagcuacggcaagcccguggacaucugggcccuggggugcaugaucaucgagauggccaccggcaacccguaccugcccuccagcuccgaccucgaccugcugcacaagaucgugcucaaggucgggaaccugagcccccaccuccagaacaucuucuccaagagccccaucuucgccggcguggugcugccgcagguccagcaccccaagaacgcgcgcaagaaguaccccaagcugaacggccugcucgccgacaucgugcacgccugccugcagaucgaccccgccgaccggaucuccagcuccgaccugcuccaccacgaguacuucacgcgcgacggguucaucgagaaguucaugccggagcugaaggccaagcugcuccaggaggcgaaggugaacagccugaucaagcccaaggaguccagcaaggagaacgagcugcggaaggacgagcgcaagaccgucuacaccaacacccuccuguccagcagcgugcugggcaaggagaucgagaaggagaagaagcccaaggagaucaaggugcgggucaucaaggugaagggcgggcgcggcgacaucuccgagcccaagaagaaggaguacgagggcgggcucgggcagcaggacgccaacgagaacgugcacccgaugagccccgacacgaagcuggucaccaucgagccgcccaaccccaucaaccccuccaccaacugcaacggccugaaggagaacccccacugcgggggcagcgugaccaugcccccgaucaaccucacgaacuccaaccugauggccgccaaccugagcuccaaccucuuccaccccagcguccggcugaccgagcgcgccaagaagcggcgcaccuccagccaguccaucggccaggugaugcccaacagccggcaggaggaccccgggccgauccagucccagauggagaagggcaucuucaacgagcgcaccgggcacagcgaccagauggcgaacgagaacaagcgcaagcugaacuucucccggagcgaccgcaaggaguuccacuuccccgagcuccccgugacgauccaguccaaggacaccaagggcauggaggucaagcagaucaagaugcugaagcgggagagcaagaagaccgaguccagcaagaucccgacccugcugaacguggaccagaaccaggagaagcaggagggcggggacggccacugcgaggggaagaaccucaagcgcaaccgguucuucuucugguga

SEQ ID NO: 28068 - RNA, 948 nt, Artificial Sequence
  derived and/or modified sequence opt1 from CDKL4__Homo_sapiens__NP_001009565
auggagaaguacgagaagcuggccaagaccggcgaggggagcuacggcgugguguucaagugccgcaacaagaccuccggccaggugguggccgucaagaaguucguggagagcgaggacgaccccguggucaagaagaucgcgcuccgggagauccgcaugcugaagcagcugaagcacccgaaccucgugaaccugaucgagguguuccggcgcaagcggaagaugcaccuggucuucgaguacugcgaccacacgcuccugaacgagcuggagcgcaaccccaacgggguggccgacggggugaucaaguccguccucuggcagacccugcaggcccugaacuucugccacauccacaacugcauccaccgggacaucaagcccgagaacauccucaucaccaagcagggcaucaucaagaucugcgacuucggcuucgcccagauccugauccccggggacgccuacaccgacuacguggcgacgcgcugguaccgggccccggagcugcucgugggcgacacccaguacgggagcuccgucgacaucugggccaucggcugcguguucgccgagcugcugaccgggcagccccucuggcccggcaagagcgacguggaccagcuguaccugaucauccgcacccucggcaagcugaucccccggcaccaguccaucuucaagagcaacggguucuuccacggcaucuccaucccggagcccgaggacauggagacgcuggaggagaaguucagcgacguccaccccguggcgcucaacuucaugaaggggugccugaagaugaaccccgacgaccgccugaccugcucccagcuccuggagagcuccuacuucgacagcuuccaggaggcccagaucaagcggaaggcccgcaacgagggccggaaccgccggcgccagcagguccugccgcucaaguccuga

SEQ ID NO: 28069 - RNA, 3093 nt, Artificial Sequence
  derived and/or modified sequence opt1 from CDKL5__Homo_sapiens__NP_001032420
augaagauccccaacaucggcaacgugaugaacaaguucgagauccugggggucgugggcgagggggccuacggcgugguccucaagugccgccacaaggagacccacgagaucguggccaucaagaaguucaaggacagcgaggagaacgaggaggugaaggagaccacgcugcgggagcugaagaugcuccgcacccugaagcaggagaacaucgucgagcugaaggaggcguuccggcgccgggggaagcucuaccugguguucgaguacguggagaagaacaugcuggagcuccuggaggagaugccgaacggcgucccgcccgagaaggugaaguccuacaucuaccagcugaucaaggccauccacuggugccacaagaacgacaucgugcaccgcgacaucaagcccgagaaccuccugaucagccacaacgacguccugaagcucugcgacuucggcuucgcccggaaccuguccgaggggaacaacgccaacuacaccgaguacguggccacccgcugguaccggagccccgagcugcuccugggcgcgcccuacgggaaguccguggacauguggagcgucggcugcauccugggggagcucuccgacggccagccccuguuccccggcgagagcgagaucgaccagcuguucacgauccagaaggugcucgggccgcugcccuccgagcagaugaagcuguucuacagcaacccccgcuuccacggccuccgguuccccgccgugaaccacccgcagucccuggagcgccgguaccuggggauccucaacagcguccugcuggaccucaugaagaaccugcugaagcucgaccccgccgaccgcuaccugaccgagcagugccugaaccaccccaccuuccagacccagcggcuccuggaccgcucccccagccgguccgccaagcgcaagccguaccacguggagagcuccacgcugagcaaccggaaccaggcgggcaaguccaccgcccuccagagccaccaccgcagcaacuccaaggacauccagaaccugagcgugggccugccccgggccgacgaggggcuccccgccaacgaguccuuccugaacggcaaccuggccggggcgagccucagcccccugcacaccaagaccuaccaggccagcucccagccgggcagcacguccaaggaccugaccaacaacaacaucccccaccuccugagccccaaggaggccaaguccaagaccgaguucgacuucaacaucgaccccaagccgagcgaggggcccggcaccaaguaccugaaguccaacagccgcucccagcagaaccgccacagcuucauggaguccagccaguccaaggccggcacgcugcagcccaacgagaagcagagccggcacagcuacaucgacaccaucccccaguccagccgcuccccgagcuaccggaccaaggccaagucccacggggcgcucagcgacuccaagagcgucuccaaccugagcgaggcccgcgcccagaucgccgagcccuccaccagccgguacuuccccuccagcugccuggaccucaacuccccgacgagccccacccccacccgccacuccgacacccggacgcugcugagccccagcggccgcaacaaccggaacgaggggacccucgacucccgccggaccaccacgcgccacagcaagaccauggaggagcugaagcugccggagcacauggacuccagccacucccacagccucuccgcgccccacgagagcuucuccuacggccugggguacaccagccccuucuccagccagcagcggccccaccgccacuccauguacgugacccgggacaaggugcgcgccaagggccuggacggcagccucuccaucgggcagggcauggccgcccgggccaacagccugcagcugcucuccccgcagcccggggagcagcugccgcccgagaugacggucgcccgcagcuccgugaaggagaccagccgggagggcaccagcuccuuccacacccgccagaaguccgagggcggggucuaccacgacccccacuccgacgacggcacggcgcccaaggagaaccgccaccuguacaacgaccccgugccccggcgcguggggagcuucuaccgggucccgagcccccgccccgacaacuccuuccacgagaacaacguguccacccgggugagcucccuccccagcgaguccagcuccggcaccaaccacagcaagcgccagccggccuucgaccccuggaagucccccgagaacaucagccacuccgagcagcugaaggagaaggagaagcagggguucuuccggagcaugaagaagaagaagaagaagucccagaccguccccaacagcgacagcccggaccugcucacccugcagaaguccauccacagcgccuccacgcccagcucccgccccaaggaguggcggccggagaagaucagcgaccugcagacccagucccagccccucaagagccugcgcaagcugcuccaccuguccagcgccuccaaccaccccgcgagcuccgacccccgguuccagccgcugaccgcccagcagaccaagaacagcuucuccgagauccgcauccacccccucagccaggccuccggcggcagcuccaacauccggcaggagcccgcccccaaggggcgcccggcccugcagcugcccgacggcgggugcgacggccggcgccagcggcaccacagcgggccccaggaccgccgguucaugcuccgcacgaccgagcagcagggcgaguacuucugcugcggcgaccccaagaagccgcacacccccugcgugcccaaccgggcgcugcaccgccccaucagcuccccggcccccuaccccgugcugcagguccgcgggaccagcaugugccccacgcuccaggugcggggcaccgacgccuucuccugcccgacccagcagagcggguucuccuucuucgugcgccacgucaugcgggaggcccugauccaccgcgcccaggugaaccaggcggcccugcucaccuaccacgagaacgccgcccugacgggcaaguga

SEQ ID NO: 28070 - RNA, 495 nt, Artificial Sequence
  derived and/or modified sequence opt1 from CDKN1A__Homo_sapiens__NP_000380
augagcgagcccgccggcgacgugcgccagaacccgugcggguccaaggccugccggcgccuguucggccccgucgacagcgagcagcucucccgggacugcgacgcgcugauggccgggugcauccaggaggcccgcgagcgguggaacuucgacuucgugaccgagacgccccuggagggcgacuucgccugggagcgcgugcgggggcucggccugcccaagcuguaccucccgaccggcccccgccgggggcgcgacgagcugggcgggggccggcgccccgggaccagccccgcccugcuccagggcaccgcggaggaggaccacgucgaccugucccugagcugcacccucgugccgcgguccggcgagcaggccgaggggagccccggcgggcccggcgacucccagggccgcaagcggcgccagacgagcaugaccgacuucuaccacuccaagcggcgccugaucuucagcaagcggaagcccuga

SEQ ID NO: 28071 - RNA, 597 nt, Artificial Sequence
  derived and/or modified sequence opt1 from CDKN1B__Homo_sapiens__NP_004055
augagcaacgugcgcgucuccaacggcagccccucccuggagcggauggacgcccgccaggccgagcacccgaagcccagcgcgugccggaaccucuucgggcccguggaccacgaggagcugacccgcgaccuggagaagcacugccgggacauggaggaggccucccagcgcaaguggaacuucgacuuccagaaccacaagccccucgagggcaaguacgaguggcaggagguggagaaggggagccugccggaguucuacuaccggccgccccgcccgcccaagggcgccugcaagguccccgcccaggagucccaggacgugagcgggucccggcccgccgcgccccugaucggcgcccccgccaacagcgaggacacccaccucguggaccccaagacggaccccuccgacagccagaccggccuggccgagcagugcgcggggauccgcaagcggcccgccaccgacgacuccagcacccagaacaagcgcgccaaccggacggaggagaacgucuccgacggcagcccgaacgccggguccguggagcagacccccaagaagcccggccugcgccggcgccagaccuga

SEQ ID NO: 28072 - RNA, 951 nt, Artificial Sequence
  derived and/or modified sequence opt1 from CDKN1C__Homo_sapiens__NP_000067
augagcgacgccucccugcgcagcaccuccaccauggagcggcucguggcccgcggcaccuuccccguccuggugcggaccagcgcgugccgcucccuguucgggccgguggaccacgaggagcucagccgggagcugcaggcccgccuggccgagcucaacgccgaggaccagaaccggugggacuacgacuuccagcaggacaugccccugcgcggccccgggcggcugcaguggaccgaggucgacuccgacagcgugcccgccuucuaccgcgagaccgugcaggucggccggugccgccuccugcuggcgccgcggcccguggccguggccgucgccguguccccgccccucgagcccgcggccgagagccuggacgggcuggaggaggcccccgagcagcuccccuccgugcccgucccggcccccgccagcacgcccccgcccgugcccgugcuggcgcccgcccccgccccggcccccgcccccgucgcggcccccguggccgccccgguggccgucgcggugcuggcccccgcccccgcccccgccccggcgcccgcccccgccccggcccccguggcggcccccgcccccgccccggcccccgcgcccgcccccgccccggcccccgcccccgcgcccgacgccgccccgcaggaguccgccgagcagggcgccaaccagggccagcgcgggcaggagccccucgcggaccagcugcacagcggcaucuccgggcggcccgccgccggcaccgccgcggccagcgccaacggggccgccaucaagaagcuguccggcccccucaucagcgacuucuucgcgaagcgcaagcgguccgccccggagaaguccagcggcgacguccccgcccccugccccagcccgagcgccgcccccggggugggcuccguggagcagacgccccgcaagcggcugcgcuga

SEQ ID NO: 28073 - RNA, 471 nt, Artificial Sequence
  derived and/or modified sequence opt1 from CDKN2A__Homo_sapiens__NP_000068
auggagcccgccgccggcagcuccauggagccgagcgcggacuggcuggccaccgccgccgcccgcgggcggguggaggagguccgcgcgcuccuggaggccggcgcccugcccaacgcccccaacuccuacgggcggcgccccauccaggugaugaugaugggcagcgcgcggguggccgagcuccugcugcuccacggggccgagccgaacugcgccgaccccgccacccugacgcgccccguccacgacgcggcccgggagggcuuccuggacacccucguggugcugcaccgcgccggcgcccggcuggacguccgcgacgccugggggcggcuccccguggaccuggcggaggagcugggccaccgcgacguggcccgguaccuccgcgccgccgccgggggcacccggggguccaaccacgcgcgcaucgacgccgccgagggcccgagcgacauccccgacuga

SEQ ID NO: 28074 - RNA, 1743 nt, Artificial Sequence
  derived and/or modified sequence opt1 from CDKN2AIP__Homo_sapiens__NP_060102
auggcccaggaggugagcgaguaccugucccagaacccccgcgucgccgcguggguggaggcccuccggugcgacggcgagaccgacaagcacuggcgccaccggcgcgacuuccugcugcggaacgccggggaccucgccccggccggcggggcggccagcgccuccaccgacgaggccgcggacgccgagagcggcacgcgcaaccggcagcugcagcagcugaucuccuucagcauggccugggccaaccacguguuccucgggugccgcuacccccagaaggucauggacaagauccuguccauggccgagggcaucaaggugaccgacgcgcccaccuacaccacgcgggacgagcugguggccaaggucaagaagcgcggcaucagcuccagcaacgaggggguggaggagcccuccaagaagcgggugaucgagggcaagaacagcuccgccgucgagcaggaccacgccaagaccagcgccaagaccgagcgcgcguccgcccagcaggagaacagcuccacgugcaucgggagcgccaucaaguccgagagcggcaacagcgcccgguccagcgggaucuccagccagaacuccagcaccuccgacggcgaccgcagcguguccagccaguccagcuccagcguguccagccaggucaccaccgccggcuccgggaaggcgagcgaggccgaggccccggacaagcacggcuccgccagcuucgugagccuccugaaguccagcgugaacucccacaugacccagagcacggacucccggcagcagagcgggucccccaagaaguccgcccuggagggcagcagcgcguccgccagccaguccagcuccgagaucgaggucccccuccugggcagcuccgggagcagcgagguggagcugccccuccuguccagcaagccguccagcgagaccgccuccagcggccugaccuccaagaccagcuccgaggccagcguguccagcuccgucgcgaagaacagcuccagcuccgggacgagccuccugacccccaaguccagcagcuccaccaacaccagccugcucacguccaagagcaccucccagguggccgccagccugcuggccuccaagagcuccagccagaccuccggcagccucguguccaagagcaccucccuggccagcgucucccagcuggcgagcaaguccagcagccagacguccaccagccagcuccccuccaagagcaccucccagagcuccgagagcuccgugaaguucagcugcaagcugaccaacgaggacgugaagcagaagcagcccuucuucaaccgccuguacaagacggucgccuggaagcucguggccgucgggggcuucuccccgaacgugaaccacggcgagcugcugaacgccgccaucgaggcgcucaaggccacccuggacguguucuucgucccccugaaggagcucgccgaccugccccagaacaagagcucccaggagagcaucgugugcgagcugcggugcaaguccguguaccucgggaccggcugcggcaagagcaaggagaacgccaaggccgucgcgucccgcgaggcccugaagcuguuccucaagaagaaggugguggucaagaucugcaagcggaaguaccgcgggagcgagaucgaggaccuggugcugcucgacgaggagucccggcccgugaaccugccgcccgcccugaagcacccccaggagcuccuguga

SEQ ID NO: 28075 - RNA, 417 nt, Artificial Sequence
  derived and/or modified sequence opt1 from CDKN2B__Homo_sapiens__NP_004927
augcgcgaggagaacaagggcaugcccagcgggggcggguccgacgagggccuggccagcgccgcggcccgggggcucguggagaagguccgccagcugcuggaggccggcgccgacccgaacggcgugaaccgguucgggcgccgggccauccaggugaugaugaugggcuccgcgcgcgucgccgagcuccugcugcuccacggggccgagcccaacugcgccgaccccgcgacccugacccggcccgugcacgacgccgcccgcgagggcuuccuggacacgcucgugguccugcaccgggccggggcccgccuggacgugcgggacgcguggggccgccucccgguggaccuggccgaggagcggggccaccgcgacgucgccggguaccugcggaccgccaccggcgacuga

SEQ ID NO: 28076 - RNA, 507 nt, Artificial Sequence
  derived and/or modified sequence opt1 from CDKN2C__Homo_sapiens__NP_001253
auggccgagcccuggggcaacgagcuggccagcgcggccgcccgcggggaccucgagcagcugaccucccugcuccagaacaacgugaacgucaacgcccagaacggcuucgggcggaccgcccuccaggugaugaagcugggcaacccggagaucgcgcgccggcugcugcugcgcggggccaaccccgaccucaaggaccggacgggcuucgccgugauccacgacgccgcgcgcgccggcuuccuggacacccugcagacccuccuggaguuccaggccgacgucaacaucgaggacaacgaggggaaccugccccuccaccuggccgccaaggagggccaccuccgggugguggaguuccuggucaagcacaccgcgagcaacguggggcaccgcaaccacaagggcgacacggccugcgaccuggcccggcuguacgggcgcaacgagguggucucccucaugcaggccaacggcgccggcggggcgaccaaccugcaguga

SEQ ID NO: 28077 - RNA, 501 nt, Artificial Sequence
  derived and/or modified sequence opt1 from CDKN2D__Homo_sapiens__NP_001791
augcugcucgaggaggugcgcgccggcgaccggcugagcggggccgccgcccgcggcgacguccaggaggugcggcgccugcuccaccgggagcuggugcaccccgacgcccugaaccgcuucgggaagaccgcccuccaggucaugauguucggcuccaccgccaucgcgcuggagcugcucaagcagggggccagcccgaacgugcaggacacguccggcaccagccccgugcacgacgccgcccggaccggcuuccuggacacccugaagguccucguggagcacggggcggacgugaacguccccgacggcacgggggcccugcccauccaccuggccgugcaggagggccacaccgccguggucuccuuccucgccgcggagagcgaccugcaccgccgggacgcccgcgggcugaccccgcucgagcuggcccugcagcggggcgcccaggaccucguggacauccugcagggccacaugguggcgccccuguga

SEQ ID NO: 28078 - RNA, 519 nt, Artificial Sequence
  derived and/or modified sequence opt1 from CDKN3__Homo_sapiens__NP_001124323
augaagcccccgagcuccauccagaccagcugcaaguucaaggacgugcgccggaacguccagaaggacaccgaggagcugaaguccugcggcauccaggacaucuucguguucugcacgcgcggggagcucagcaaguaccgggugcccaaccugcuggaccucuaccagcagugcggcaucaucacccaccaccaccccaucgccgacgggggcacccccgacaucgccuccugcugcgagaucauggaggagcugaccacgugccugaagaacuaccgcaagacccucauccacugcuacgggggccugggccggagcugccuggucgcggccugccuccugcuguaccucuccgacaccaucagcccggagcaggccaucgacucccugcgcgaccugcgggggagcggcgccauccagaccaucaagcaguacaacuaccuccacgaguuccgcgacaagcuggccgcgcaccuguccagccgggacucccagagccgcuccgugagccgguga

SEQ ID NO: 28079 - RNA, 564 nt, Artificial Sequence
  derived and/or modified sequence opt1 from CDNF__Homo_sapiens__NP_001025125
auguggugcgccagccccguggccgucguggcguucugcgccgggcugcucgugucccacccgguccugacccaggggcaggaggccggcgggcgccccggcgccgacugcgaggugugcaaggaguuccugaaccgguucuacaagagccucaucgaccgcggggugaacuucucccuggacaccaucgagaaggagcugaucagcuucugccucgacacgaagggcaaggagaaccggcugugcuacuaccugggcgccaccaaggacgcggccaccaagauccucuccgaggucacccgccccaugagcgugcacaugcccgccaugaagaucugcgagaagcugaagaagcuggacucccagaucugcgagcucaaguacgagaagacgcuggaccuggccagcguggaccuccggaagaugcgcgucgcggagcugaagcagauccugcacuccuggggcgaggagugccgggccugcgccgagaagaccgacuacgugaaccucauccaggagcuggccccgaaguacgccgcgacccaccccaagaccgagcuguga

SEQ ID NO: 28080 - RNA, 603 nt, Artificial Sequence
  derived and/or modified sequence opt1 from CDO1__Homo_sapiens__NP_001792
auggagcagaccgaggugcugaagccccgcacccucgccgaccugauccggauccugcaccagcuguucgccggcgacgaggucaacguggaggaggugcaggcgaucauggaggccuacgagagcgacccgacggagugggccauguacgccaaguucgaccaguaccgcuacacccggaaccucgucgaccaggggaacggcaaguucaaccugaugauccucugcuggggcgaggggcacggguccagcauccacgaccacaccaacucccacugcuuccugaagaugcugcagggcaaccucaaggagacccuguucgccuggcccgacaagaaguccaacgagauggugaagaaguccgagcgcgugcugcgggagaaccagugcgcguacaucaacgacagcaucggccuccaccgcgucgagaacaucucccacacggagcccgccgugagccugcaccuguacagcccgcccuucgacacgugccacgccuucgaccagcggaccgggcacaagaacaaggugaccaugaccuuccacagcaaguucggcauccgcacccccaacgccaccuccgggagccucgagaacaacuga

SEQ ID NO: 28081 - RNA, 3864 nt, Artificial Sequence
  derived and/or modified sequence opt1 from CDON__Homo_sapiens__XP_011541167
augcaccccgaccugggcccgcucugcacccugcuguacgugacccucacgauccugugcagcuccgucagcuccgaccuggcccccuacuucaccagcgagccccucuccgccgugcagaagcucgggggccccgugguccugcacugcagcgcgcagccggugaccacccgcaucuccuggcugcacaacgggaagacgcuggacggcaaccuggagcacgugaagauccaccaggggacccucaccauccugagccugaacuccagccuccugggcuacuaccagugccuggccaacaacuccaucggcgccaucgucagcgggcccgccaccguguccguggccguccucggcgacuucgggagcuccacgaagcacgugaucaccgcggaggagaaguccgccggcuucaucgggugccgggugcccgaguccaaccccaaggccgagguccgcuacaagauccggggcaaguggcuggagcacagcaccgagaacuaccugauccucccguccggcaaccugcagauccugaacgugagccucgaggacaaggggagcuacaagugcgccgcguacaaccccgugacccaccagcugaaggucgagcccaucggccgcaagcugcucgugucccggcccagcuccgacgacgugcacauccugcacccgacgcacagccaggcccuggccguccucucccgcagccccgugacccuggagugcguggucuccggggugcccgcgccccagguguacuggcugaaggacggccaggacaucgccccgggcagcaacuggcggcgccucuacucccaccuggccaccgacagcgucgaccccgccgacuccgggaacuacagcugcauggccggcaacaaguccggggacgugaaguacgucaccuacauggugaacgugcuggagcacgccagcaucuccaagggccuccaggaccagaucgucagccugggggccacggugcacuucacgugcgacgugcacggcaaccccgcgcccaacugcaccugguuccacaacgcccagccgauccaccccuccgcccggcaccugaccgccggcaacgggcucaagaucagcggcgucacgguggaggacguggggauguaccagugcgucgccgacaacggcaucggguucaugcacuccaccggccgccuggagaucgagaacgacggcggguucaagcccgugaucaucaccgcgcccgugagcgccaaggucgccgacggcgacuucgugacccugagcugcaacgccuccgggcucccggugcccgucauccggugguacgacagccacggccugaucaccagccaccccagccaggugcugcgcuccaagagccggaagucccagcucagccgccccgaggggcugaaccuggagccgguguacuucguccucucccaggccggcgcgagcucccugcacauccaggccgugacccaggagcacgccggcaaguacaucugcgaggccgcgaacgagcacgggaccacccaggccgaggccagccugauggugguccccuucgagacgaacaccaaggccgagaccgugacccugcccgacgccgcgcagaacgacgaccgguccaagcgcgacggcagcgagacggggcuccuguccagcuucccggugaagguccaccccuccgccguggagagcgcccccgagaagaacgccagcggcaucuccgugcccgacgccccgaucauccugagcccgccccagacccacacccccgacaccuacaaccucgucuggcgggcgggcaaggacgggggccugcccaucaacgccuacuucgugaaguaccgcaagcuggacgacggggugggcaugcucggguccuggcacacgguccgggugcccggcagcgagaacgagcugcaccuggccgagcucgagcccuccagccuguacgaggugcugauggucgcccgcuccgccgcgggcgaggggcagcccgccaugcucaccuuccggaccagcaaggagaagaccgccuccagcaagaacacccaggccuccagcccgcccgugggcauccccaaguaccccguggucuccgaggcggccaacaacaacuucgggguggugcugacggacagcucccgccacagcggcgucccggaggcccccgaccgccccaccaucuccaccgccagcgagaccuccguguacgugacguggaucccccgggccaacgggggcagcccgaucaccgcguucaaggucgaguacaagcgcaugcggaccagcaacuggcugguggccgccgaggacaucccgcccuccaagcucagcguggagguccgcucccuggagcccggcagcaccuacaaguuccgggugaucgccaucaaccacuacggggaguccuuccgcagcuccgccagccggcccuaccagguggucggcuuccccaaccgcuucuccagccggcccaucacggggccgcacaucgcguacaccgaggccguguccgacacccagaucaugcugaaguggaccuacauccccagcuccaacaacaacacgcccauccagggcuucuacaucuacuaccgccccaccgacagcgacaacgacuccgacuacaagcgggacguggucgaggggagcaagcaguggcacaugaucggccaccuccagccggagaccuccuacgacaucaagaugcagugcuucaacgagggcggggagagcgaguucuccaacgugaugaucugcgagaccaaggucaagcgcgugcccggcgccagcgaguaccccgugaaggaccugagcacgcccccgaacucccuggggagcggcgggaacgucggccccgccaccucccccgcccggagcuccgacaugcucuaccugaucgugggcugcgugcugggggucauggugcucauccugaugguguucaucgcgaugugccuguggaagaaccgccagcagaacaccauccagaaguacgacccgcccggcuaccucuaccaggggagcgacaugaacggccagauggucgacuacaccacgcuguccggcgccagccagaucaacgggaacgugcacggcggguuccugaccaacggcgggcucuccagcggcuacucccaccuccaccacaaggugcccaacgccgucaacggcaucgugaacgggagccugaacggcgggcuguacuccggccacagcaacucccugacccggacccacguggacuucgagcacccccaccaccuggucaacgggggcggcauguacacggccgugccccagaucgacccgcucgagugcgugaacugccgcaacugccggaacaacaaccgcugcuucaccaagaccaacagcaccuucuccagcuccccgccgcccgucgugcccguggucgcgcccuacccccaggacgggcuggagaugaagccccugagccacgugaaggugcccgucugccucacgagcgccgugcccgacugcggccagcugcccgaggaguccgugaaggacaacgucgagcccgugccgacccagcggaccugcugccaggacaucgugaacgacgucagcuccgacgggagcgaggaccccgccgaguucucccgcggccaggaggggaugaucaaccugcgcauccccgaccaccuccagcuggccaagagcugcgugugggagggcgacuccugcgcccacagcgagaccgagaucaacaucguguccuggaacgcgcugauccucccgcccguccccgagggcugcgccgagaagacgauguggagcccgcccgggaucccccuggacucccccaccgaggugcugcagcagccccgggagaccuga

SEQ ID NO: 28082 - RNA, 789 nt, Artificial Sequence
  derived and/or modified sequence opt1 from CDR1__Homo_sapiens__NP_004056
auggccuggcuggaggacguggacuuccucgaggacgucccccugcuggaggacaucccgcuccuggaggacgugccccugcucgaggacgugccccugcuggaggacaccagccgccucgaggacaucaaccugauggaggacauggcccugcucgaggacgucgaccugcuggaggacaccgacuuccucgaggaccuggacuucuccgaggcgauggaccugcgggaggacaaggacuuccucgaggacauggacagccuggaggacauggcccugcucgaggacguggaccugcuggaggacacggacuuccucgaggaccccgacuuccuggaggccaucgaccugcgcgaggacaaggacuuccucgaggacauggacucccuggaggaccuggaggccaucggccggugcggguucagcggccgccacggguucuucggccggcgccgguucuccgggcgcccgaagcucagcggccggcugggccugcucgggcgccggggcuucuccgggcgccugggcggguacuggaagaccuggaucuucuggaagaccuggaucuucuggaagaccuggaucuuccggaagacguacaucggcuggaagaccuggaucuucagcggccgcugcgggcugaccggccggcccggguucggcggccgccggcgcuucuucuggaagacccucacggacuggaagaccuggaucuccuucuggaagacccugaucgacuggaagaccuggaucagcuucuggaagacgcugaucgacuggaagaucuga

SEQ ID NO: 28083 - RNA, 1365 nt, Artificial Sequence
  derived and/or modified sequence opt1 from CDR2__Homo_sapiens__NP_001793
augcuggccgagaaccucguggaggaguucgagaugaaggaggacgagcccugguacgaccaccaggaccugcagcaggaccugcagcucgccgcggagcugggcaagacccugcucgaccgcaacaccgagcuggaggacagcguccagcagauguacacgaccaaccaggagcagcugcaggagaucgaguaccucaccaagcaggucgagcugcugcggcagaugaacgagcagcacgccaagguguacgagcagcucgacgugaccgcccgcgagcuggaggagacgaaccagaagcugguggccgacuccaaggccagccagcagaagauccucucccugaccgagaccaucgagugccugcagaccaacaucgaccaccuccagagccagguggaggagcugaaguccagcgggcagggccggcgcuccccggggaagugcgaccaggagaagcccgcgcccagcuucgccugccugaaggagcucuacgaccugcggcagcacuucgucuacgaccacguguucgccgagaagaucacgucccugcagggccagcccagcccggacgaggaggagaacgagcaccucaagaagaccgugaccaugcugcaggcccagcugucccucgagcgccagaagcgggucaccauggaggaggaguacgggcuggugcugaaggagaacagcgagcucgagcagcagcugggcgcgacgggcgccuaccgcgcccgggcccuggagcucgaggccgagguggcggagaugcgccagaugcugcaguccgagcaccccuucgucaacgggguggagaagcuggugcccgacagccucuacguccccuucaaggagccgucccagagccugcuggaggagauguuccucaccgugcccgagucccaccggaagccccugaagcgcagcuccagcgagaccauccugagcucccucgccggcagcgacaucgugaaggggcacgaggagaccugcauccggcgcgccaaggccgucaagcagcggggcaucucccugcugcacgagguggacacgcaguacagcgcccucaaggugaaguacgaggagcugcugaagaagugccaggaggagcaggacucccucagccacaaggcgguccagaccucccgcgccgccgccaaggaccugaccggggugaacgcccagagcgagcccguggcguccggcugggagcuggccagcgucaacccggagcccguguccagccccaccacgcccccggaguacaaggcccuguucaaggagaucuucuccugcaucaagaagaccaagcaggagaucgacgagcagcggaccaaguaccgcagccucuccagccacuccuga

SEQ ID NO: 28084 - RNA, 1338 nt, Artificial Sequence
  derived and/or modified sequence opt1 from CDS2__Homo_sapiens__NP_003809
augaccgagcugcgccagcggguggcccacgagcccgucgccccgcccgaggacaaggagagcgaguccgaggcgaagguggacggcgagaccgccagcgacuccgagagccgcgccgaguccgcgccccuccccgugagcgccgacgacacgccggagguccugaaccgggcccuguccaaccucagcucccgcuggaagaacuggugggugcgggggauccugacccuggccaugaucgccuucuucuucaucaucaucuaccucggccccauggugcugaugaucaucgucaugugcgugcagaucaagugcuuccacgagaucaucaccaucggguacaacguguaccacagcuacgaccugcccugguuccgcacccucuccugguacuuccugcugugcgucaacuacuucuucuacggcgagacggugaccgacuacuucuucacccucgugcagcgggaggagccccugcgcauccugagcaaguaccaccgguucaucuccuucacccucuaccugaucggguucugcauguucguccugagccucgugaagaagcacuaccgccugcaguucuacauguucggcuggacgcacgugacccugcucaucgucgugacccagucccaccuggugauccacaaccuguucgagggcaugaucugguucaucgucccgaucagcugcgugaucugcaacgacaucauggccuacauguucggguucuucuucggccggacgccccucaucaagcugucccccaagaagaccugggagggguucaucggcggguucuucgcgaccguggucuucggccugcuccugagcuacgugauguccggcuaccgcugcuucgugugccccgucgaguacaacaacgacaccaacagcuucaccguggacugcgagccgagcgaccuguuccggcuccaggaguacaacauccccggggucauccaguccgugaucggcuggaagacggugcgcauguaccccuuccagauccacagcaucgcccuguccaccuucgccagccugaucgggcccuucggcggcuucuucgccuccggguucaagcgggccuucaagaucaaggacuucgcgaacaccaucccgggccacgggggcaucauggaccgcuucgacugccaguaccucauggccaccuucgucaacguguacaucgccagcuucauccgggggcccaaccccuccaagcugauccagcaguuccugacgcuccgccccgaccagcagcugcacaucuucaacacccugcggagccaccucaucgacaagggcaugcugaccuccaccacggaggacgaguga

SEQ ID NO: 28085 - RNA, 1641 nt, Artificial Sequence
  derived and/or modified sequence opt1 from CDT1__Homo_sapiens__NP_112190
auggagcagcgccgggugaccgacuucuucgcccgccggcgccccggcccgccccggaucgccccgcccaagcuggcgugccgcacccccagccccgcccggcccgcccuccgcgcccccgccuccgcgacgagcgggucccggaagcgcgcccggccgcccgccgcccccggccgcgaccaggcgcggcccccggcccgccggcgccugcggcugagcgucgacgagguguccagccccuccacccccgaggcccccgacaucccggccugccccagccccgggcagaagaucaagaaguccacccccgccgcgggccagccgccccaccucaccagcgcccaggaccaggacacgaucuccgagcuggccagcugccugcagcgcgcccgggagcucggggcccgcgugcgggcgcugaaggccuccgcccaggacgccggcgagagcugcacccccgaggccgagggccgccccgaggagccgugcggggagaaggcgcccgccuaccagcgcuuccacgcccuggcccagcccggccuccccgggcugguccugccguacaaguaccaggugcucgccgagauguuccgguccauggacaccaucgugggcaugcugcacaaccgcagcgagacccccacguucgcgaagguccagcgcggggugcaggacaugaugcggcggcgcuucgaggagugcaacgugggccagaucaagaccgucuaccccgccuccuaccgguuccgccaggagcggagcgugccgaccuucaaggacggcacccgccgguccgacuaccagcugacgaucgagccccuccuggagcaggaggccgacggggccgcgccccagcugaccgccagccgccuccugcagcggcgccagaucuucagccagaagcugguggagcacgucaaggagcaccacaaggccuuccucgccucccugagccccgccaugguggugccggaggaccagcugacccgguggcacccccgcuucaacgucgacgaggugcccgacaucgagcccgcggcccucccgcagccgcccgccaccgagaagcugacgaccgcccaggaggugcuggcccgggcgcgcaaccucaucagcccccggauggagaaggcccugucccagcuggcccuccgcuccgccgcccccagcucccccggcagcccccgccccgcgcugccggccaccccgcccgccaccccgcccgccgcgucccccagcgcccugaagggggucucccaggaccuccuggagcggauccgcgccaaggaggcccagaagcagcuggcccagaugacgcggugccccgagcaggagcagcgccuccagcggcuggagcgccugcccgagcucgcgcgggugcugcgcagcguguucgucuccgagcggaagcccgcccugagcauggagguggccugcgcccgcauggugggcuccugcugcaccaucaugagccccggcgagauggagaagcaccuccugcugcucuccgagcugcugcccgacuggcucagccugcaccggauccgcaccgacaccuacgucaagcuggacaaggccgcggaccuggcccacaucacggcccggcucgcccaccagacccgcgccgaggaggggcuguga

SEQ ID NO: 28086 - RNA, 642 nt, Artificial Sequence
  derived and/or modified sequence opt1 from CDV3__Homo_sapiens__NP_001127894
auggccgagaccgaggagcgcagccuggacaacuucuucgccaagcgggacaagaagaagaagaaggagcgcuccaaccgggcggccagcgccgccggcgccgcgggguccgccggcgggagcuccggcgccgccggggcggccggcggcggggccggcgccgggacccgccccggcgacgggggcacggccagcgcgggcgccgccgggcccggcgccgccaccaaggcggugaccaaggacgaggacgaguggaaggagcucgagcagaaggaggucgacuacuccgggcugcgggugcaggccaugcagaucagcuccgagaaggaggaggacgacaacgagaagcgccaggaccccggcgacaacugggaggagggcgggggcgggggcgggggcauggagaaguccagcggccccuggaacaagaccgcccccgugcaggccccgcccgcccccgucaucgugacggagacccccgagccggcgaugaccagcgggguguaccggccgcccggcgcccgccugaccacgacccggaagacgccccaggggccgcccgagaucuacuccgacacccaguuccccagccuccaguccaccgccaagcacgucgagagccgcaaccgguaccugaaguga

SEQ ID NO: 28087 - RNA, 798 nt, Artificial Sequence
  derived and/or modified sequence opt1 from CDX1__Homo_sapiens__NP_001795
auguacgugggcuacguccuggacaaggacagccccguguacccggggcccgcccgccccgccucccucggccuggggccccaggcguacggcccgcccgccccgccgcccgccccgccccaguaccccgacuucagcuccuacagccacguggagcccgcccccgccccgcccaccgcguggggcgcccccuuccccgcccccaaggacgacugggccgcggccuacgggcccggccccgccgcccccgccgcgucccccgccagccuggccuucgggcccccgcccgacuucucccccguccccgccccgcccggccccgggccgggccuccuggcccagccccucgggggccccggcacccccagcuccccgggggcgcagcggcccacgcccuacgaguggaugcgccggagcguggccgccggcgggggcggcggguccggcaagacccgcaccaaggacaaguaccggguggucuacaccgaccaccagcgccuggagcuggagaaggaguuccacuacagccgguacaucacgauccgccggaaguccgagcuggccgccaaccucgggcugaccgagcgccaggugaagaucugguuccagaaccggcgcgcgaaggagcggaaggugaacaagaagaagcagcagcagcagcagcccccgcagccgcccauggcccacgacaucaccgccacccccgccggccccagccucgggggccugugccccuccaacacgagccugcuggccaccuccagccccaugcccgucaaggaggaguuccucccguga

SEQ ID NO: 28088 - RNA, 942 nt, Artificial Sequence
  derived and/or modified sequence opt1 from CDX2__Homo_sapiens__NP_001256
auguacgugagcuaccugcucgacaaggacgucuccauguaccccagcuccgugcgccacagcggcgggcugaaccuggcgccccagaacuucguguccccgccccaguaccccgacuacggcggguaccacgucgccgccgccgccgccgccgcggccaaccucgacagcgcccagucccccggccccagcuggcccgccgcguacggggcgccccugcgggaggacuggaacggcuacgccccgggcggggccgccgccgccgccaacgccguggcccacggccugaacgggggcucccccgcggccgccaugggguacagcucccccgccgacuaccacccccaccaccacccgcaccaccacccccaccaccccgccgcggcccccagcugcgccuccggccuccugcagacccugaacccgggcccgcccgggcccgccgccaccgcggccgccgagcagcucagccccggcgggcagcgccggaaccugugcgaguggaugcgcaagcccgcccagcagucccugggcagccaggugaagacgcggaccaaggacaaguaccgcgucguguacaccgaccaccagcggcucgagcuggagaaggaguuccacuacucccgcuacaucaccauccggcgcaaggcggagcuggccgccacgcucggccugagcgagcgccaggugaagaucugguuccagaaccggcgggccaaggagcgcaagaucaacaagaagaagcugcagcagcagcagcagcagcagccgccccagcccccgccgccgccgccccagccgccccagccccagcccgggccccuccgguccguccccgagccccugagccccgugagcucccugcaggccagcguguccggcagcguccccggggugcucggccccaccgggggcgugcugaaccccaccgucacccaguga

SEQ ID NO: 28089 - RNA, 855 nt, Artificial Sequence
  derived and/or modified sequence opt1 from CDX4__Homo_sapiens__NP_005184
auguacggcagcugccugcucgagaaggaggccgggauguaccccggcacccugaugucccccgggggcgacgggaccgccggcacgggcgggaccggcgggggcgggagccccaugcccgcguccaacuucgccgccgcccccgccuucagccacuacaugggcuacccgcacaugcccuccauggacccccacuggcccagccugggcguguggggguccccguacagcccgccccgcgaggacugguccgucuaccccggcccgagcuccaccauggggaccgugcccgugaacgacgucacgagcucccccgcggccuucugcagcaccgacuacuccaaccucggccccgugggcgggggcaccagcggguccagccugccgggccaggccgggggcucccuggugcccaccgacgccggcgcggccaaggccagcagccccucccggagccgccacucccccuacgccuggaugcggaagacgguccaggugaccgggaagacccgcaccaaggagaaguaccggguggucuacacggaccaccagcgccucgagcuggagaaggaguuccacugcaaccgguacaucaccauccagcgcaagagcgagcuggccgugaaccucggccuguccgagcgccaggugaagaucugguuccagaaccggcgggcgaaggagcgcaagaugaucaagaagaagaucagccaguucgagaacuccgggggcagcguccaguccgacagcgacuccaucagcccgggggagcugcccaacaccuucuucaccacgcccuccgccgugcggggcuuccagcccaucgagauccagcaggucaucgugagcgaguga

SEQ ID NO: 28090 - RNA, 1623 nt, Artificial Sequence
  derived and/or modified sequence opt1 from CDY1B__Homo_sapiens__NP_001003894
auggccagccaggaguucgagguggaggccaucgucgacaagcgccaggacaagaacggcaacacccaguaccuggugcgguggaagggguacgacaagcaggacgacaccugggagcccgagcagcaccucaugaacugcgagaagugcgugcacgacuucaaccgccggcagacggagaagcagaagaagcugaccuggaccaccacgucccgcaucuucagcaacaacgcgcggcgccggaccucccgcagcaccaaggccaacuacuccaagaacagcccgaagacccccgucacggacaagcaccaccgguccaagaaccgcaagcuguucgccgccagcaagaacgugcggcgcaaggccgcguccauccucagcgacaccaagaacauggagaucaucaacuccaccaucgagacccuggcccccgacagccccuucgaccacaagacgguguccggcuuccagaagcuggagaagcucgacccgaucgccgccgaccagcaggacaccgucguguucaaggugaccgaggggaagcugcugcgggacccccucagccgccccggcgcggagcagaccgggauccagaacaagacgcagauccacccccugaugucccagaugagcggcuccgucaccgccagcauggccaccggcuccgccacccggaaggggaucguggugcugaucgacccgcucgccgcgaacggcacgaccgacaugcacaccagcgucccccgcgugaagggcgggcagcggaacaucaccgacgacagccgcgaccagcccuucaucaagaagaugcacuucacgauccggcugaccgaguccgccagcaccuaccgcgacaucguggucaagaaggaggacggguucacccagaucgugcuguccacgcggagcaccgagaagaacgcccucaacaccgaggugaucaaggagaucgucaacgcccugaacuccgccgcggccgacgacagcaagcuggugcuguucuccgccgccggcagcguguucugcugcggccuggacuucggguacuucgucaagcaccuccgcaacaaccgcaacaccgccucccucgagaugguggacacgaucaagaacuucgugaacaccuucauccaguucaagaagcccaucgucgugagcgucaacggcccggcgaucgggcugggcgccuccauccugccccucugcgaccuggugugggccaacgagaaggccugguuccagacccccuacaccacguucggccagagccccgacgggugcuccagcaucaccuucccgaagaugaugggcaaggccuccgcgaacgagaugcugaucgccgggcggaagcucaccgcccgcgaggccugcgcgaagggccuggugagccaggucuuccugaccgggaccuucacgcaggaggugaugauccagaucaaggagcucgccuccuacaaccccaucgugcuggaggagugcaaggcccugguccggugcaacaucaagcucgagcuggagcaggccaacgagcgcgagugcgaggugcugcggaagaucuggagcuccgcccagggcaucgagagcaugcucaaguacguggagaacaagaucgacgaguucuga

SEQ ID NO: 28091 - RNA, 1626 nt, Artificial Sequence
  derived and/or modified sequence opt1 from CDY2B__Homo_sapiens__NP_001001722
auggccagccaggaguucgagguggaggccaucgucgacaagcgccaggacaagaacggcaacacccaguaccuggugcgguggaagggguacgacaagcaggacgacaccugggagcccgagcagcaccucaugaacugcgagaagugcgugcacgacuucaaccgccggcagacggagaagcagaagaagcugaccuggaccaccacgucccgcaucuucagcaacaacgcgcggcgccggaccucccgcagcaccaaggccaacuacuccaagaacagcccgaagacccccgucacggacaagcaccaccgguccaagaacugcaagcuguucgccgccagcaagaacgugcgccggaaggccgcguccacccucagcgacaccaagaacauggagaucaucaacuccaccaucgagacgcuggcccccgacagccccuucgaccacaagaagaccguguccggcuuccagaagcuggagaagcucgacccgaucgccgccgaccagcaggacaccgucguguucaaggugaccgaggggaagcugcugcgcgacccccucagccaccccggcgcggagcagacggggauccagaacaagacccagaugcacccccugaugucccagaugagcggcuccgucaccgccagcauggccaccggcuccgccacgcggaaggggaucguggugcugaucgacccgcucgccgcgaacggcaccaccgacaugcacaccagcgucccccgcgugaagggcgggcagcggaacaucacggacgacagccgcgggcagcccuucaucaagaagaugcacuucaccauccggcugaccgaguccgccaucaccuaccgcgacaucguggucaagaaggaggacggcuucacgcagaucgugcugagcacccgguccaccgagaagaacgcccucaacaccgaggugaucaaggagauggucaacgcccugaacagcgccgcggccgacgacuccaagcuggugcuguucagcgccgccggcuccguguucugcugcgggcuggacuucggcuacuucguccgccaccuccggaacgaccgcaacacggccagccucgagaugguggacaccaucaagaacuucgugaacaccuucauccaguucaagaagcccaucgucguguccgucaacgggccggcgaucggccugggcgccagcauccugccccucugcgaccuggugugggccaacgagaaggccugguuccagacccccuacacgaccuucgggcagucccccgacggcugcagcuccaucaccuucccgaagaugauggggaaggccagcgcgaacgagaugcugaucgccggccgcaagcucaccgcccgggaggccugcgcgaaggggcuggugucccaggucuuccugaccggcacguucacccaggaggugaugauccagaucaaggagcucgccagcuacaacgccaucgugcuggaggagugcaaggcccugguccgcugcaacaucaagcucgagcuggagcaggccaacgagcgggagugcgaggugcugcgcaagaucugguccagcgcgcagggcaucgaguccaugcucaaguacguggagaacaagaucgacgaguucuga

SEQ ID NO: 28092 - RNA, 1521 nt, Artificial Sequence
  derived and/or modified sequence opt1 from CDYL2__Homo_sapiens__NP_689555
auggccagcggcgaccuguacgagguggagcgcaucgucgacaagcggaagaacaagaaggggaagugggaguaccucauccgcuggaagggcuacggguccaccgaggacaccugggagcccgagcaccaccuccugcacugcgaggaguucaucgacgaguucaacggccugcacaugagcaaggacaagcggaucaaguccgggaagcagagcuccacgagcaagcugcugcgcgacucccggggcccgagcguggagaagcucucccaccgccccagcgaccccggcaaguccaaggggaccagccacaagcggaagcgcaucaacccgccccuggccaagcccaagaagggcuacuccgggaagcccagcuccggcggggaccgggcgaccaagaccgugagcuaccgcacgacccccuccggccugcagaucaugccgcucaagaagucccagaacggcauggagaacggggacgccggcagcgagaaggacgagcggcacuucgggaacggcagccaccagcccggccuggaccugaacgaccacgucggggagcaggacaugggcgagugcgacgugaaccacgccacccucgccgagaacgggcugggcagcgcccugaccaacgggggccucaaccugcacucccccgugaagcgcaagcuggaggcggagaaggacuacgucuucgacaagcggcuccgcuacagcgugcggcagaacgaguccaacugccgcuuccgggacaucgugguccgcaaggaggagggcuucacgcacauccugcugagcucccagaccagcgacaacaacgcccucacccccgagaucaugaaggaggugcggcgcgcccugugcaacgccgcgaccgacgacuccaagcugcuccugcugagcgccgugggguccgucuucugcagcggccucgacuacuccuaccugaucgggcggcugagcuccgaccgccgcaaggagagcacgcggaucgccgaggccauccgcgacuucgugaaggccuucauccaguucaagaagccgaucguggucgcgaucaacggccccgcccucgggcugggcgccuccauccugccccucugcgacaucgugugggccagcgagaaggccugguuccagacccccuacgcgaccauccggcugaccccggccggcugcuccagcuacacguucccccagauccuggggguggcccucgccaacgagaugcuguucugcggccgcaagcugaccgcccaggaggcgugcucccgggggcucgucagccagguguucuggcccaccaccuucagccaggaggugaugcugcgcgucaaggagauggccuccugcagcgccguggugcuggaggaguccaagugccucguccggagcuuccugaaguccgugcuggaggacgucaacgagaaggagugccucaugcugaagcagcuguggagcuccagcaagggccucgacucccuguucagcuaccugcaggacaagaucuacgagguguga

SEQ ID NO: 28093 - RNA, 1239 nt, Artificial Sequence
  derived and/or modified sequence opt1 from CDYL__Homo_sapiens__NP_001137442
auggaccuggccaagagcggcaucaagauccucgugcccaaguccccggucaagagccgcaccgccguggacggguuccaguccgagagccccgagaagcuggaccccguggagcagggccaggaggacaccgucgcgcccgagguggccgccgagaagccggugggggcccugcucggccccggggccgagcgggcgcgcaugggcucccggccccgcauccacccccuggucccccaggugccgggccccgugacggccgccauggccaccgggcuggcggucaacggcaaggggaccagccccuucauggacgcccucaccgccaacggcacgaccaacauccagaccuccgugaccggggugacggccagcaagcggaaguucaucgacgaccgccgggaccagccguucgacaagcgccugcgguucuccguccgccagaccgagagcgccuaccgguaccgcgacaucguggugcggaagcaggacggcuucacccacauccugcucuccaccaagagcuccgagaacaacagccugaaccccgaggucaugcgcgaggugcaguccgcgcugagcacggccgccgccgacgacuccaagcucgugcugcugagcgccgucggcuccguguucugcugcgggcucgacuucaucuacuucauccggcgccugaccgacgaccggaagcgcgagagcaccaagauggcggaggccauccggaacuucgugaacaccuucauccaguucaagaagcccaucaucgucgccgugaacggccccgccaucgggcugggcgccagcauccucccgcugugcgacguggucugggcgaacgagaaggccugguuccagacgcccuacaccaccuucggccagucccccgacgggugcagcaccgugauguuccccaagaucaugggcggggccuccgccaacgagaugcugcucagcggccgcaagcugacggcccaggaggcgugcgggaagggccuggucucccagguguucuggccgggcaccuucacccaggaggugaugguccggaucaaggagcucgccagcugcaaccccguggugcuggaggaguccaaggcccugguccgcugcaacaugaagauggagcucgagcaggccaacgagcgcgagugcgaggugcugaagaagaucugggggagcgcgcagggcauggacuccaugcugaaguaccuccagcggaagaucgacgaguucuga

SEQ ID NO: 28094 - RNA, 1278 nt, Artificial Sequence
  derived and/or modified sequence opt1 from CEACAM16__Homo_sapiens__NP_001034302
auggcccugaccggcuacagcuggcugcugcuguccgccaccuuccucaacgugggggccgagaucagcaucacgcuggagcccgcccagccguccgagggcgacaacgucacccugguggugcacgggcucagcggcgagcugcuggccuacuccugguacgccgggcccacccucagcgucuccuaccugguggccagcuacaucguguccaccggcgacgagacgcccggccccgcgcacaccgggcgcgaggccguccggccggacggcagccuggacauccaggggauccucccccgccacuccggcaccuacauccugcagaccuucaaccggcagcugcagacggaggugggguacggccacgugcagguccacgagauccucgcccagcccaccgugcuggccaacagcaccgcgcugguggagcgccgggacacccuccgccugaugugcuccagccccuccccgacggccgagguccggugguucuucaacggcggggcccugcccguggcccuccgccugggccugagccccgacgggcgggugcucgcccgccacggcauccggcgcgaggaggcgggcgccuaccagugcgaggucuggaaccccguguccgugagccgguccgagccgaucaaccugaccgucuacuucgggcccgagcgcguggccauccugcaggacagcaccacccggacgggcugcaccaucaagguggacuucaacaccagccucacccuguggugcgucucccgcagcugccccgagcccgaguacguguggacguucaacgggcaggcccugaagaacggccaggaccaccucaacaucuccagcaugaccgccgcgcaggaggggaccuacacgugcaucgccaagaacaccaagacccugcuguccggcagcgccuccguggucgugaagcucagcgccgccgcggucgccaccaugaucgugccggugcccaccaagcccacggagggccaggacgucacccugaccgugcagggguaccccaaggaccugcucguguacgccugguaccggggcccggccuccgagcccaaccgccugcugagccagcuccccuccgggaccuggaucgccggccccgcgcacacggggcgggaggucggcuucccgaacugcagccugcuggugcagaagcucaaccugaccgacaccggccgcuacacccugaagacggugaccguccaggggaagaccgagacccucgagguggagcuccagguggcgccccugggcuga

SEQ ID NO: 28095 - RNA, 900 nt, Artificial Sequence
  derived and/or modified sequence opt1 from CEACAM19__Homo_sapiens__NP_001121365
auggagauccccaugggcacccaggggugcuucagcaagucccugcuccugagcgccuccauccuggugcucuggaugcugcagggcagccaggccgcgcuguacauccagaagaucccggagcagccccagaagaaccaggaccuccugcuguccguccagggggugcccgacaccuuccaggacuucaacugguaccucggcgaggagacguacgggggcacccgccuguucaccuacauccccggcauccagcggccgcagcgcgacgggagcgccaugggccagcgggacaucgugggguuccccaacggcuccaugcugcuccgccgggcccagcccaccgacagcgggacguaccaggucgccaucaccaucaacuccgaguggaccaugaaggccaagaccgagguccagguggcggagaagaacaaggagcugcccagcacgcaccucccgaccaacgccggcauccuggccgccaccaucaucggcucccuggcggccggggcccugcucaucagcugcaucgccuaccugcuggugacccgcaacuggcggggccagucccaccgccuccccgcgccccgggggcagggcagccuguccauccugugcagcgccgugucccccgugccgagcgucacgcccuccaccuggauggccaccaccgagaagcccgagcucggccccgcccacgacgccggggacaacaacaucuacgaggugaugccgagccccgugcugcuggucagccccaucuccgacacgcgcagcaucaaccccgcccggccgcuccccaccccgccccaccuccaggcggagcccgagaaccaccaguaccaggaccugcugaaccccgaccccgcccccuacugccagcuggugccgaccuccuga

SEQ ID NO: 28096 - RNA, 1395 nt, Artificial Sequence
  derived and/or modified sequence opt1 from CEACAM1__Homo_sapiens__NP_001020083
augggccaccugagcgcgccccuccaccgcgugcgggucccguggcaggggcugcugcucaccgccucccugcugaccuucuggaacccgcccacgaccgcccagcucaccaccgagagcaugcccuucaacguggccgagggcaaggaggugcugcugcucguccacaaccugccccagcagcuguucggguacuccugguacaagggcgagcgcguggacgggaaccggcagaucgugggcuacgccaucggcacgcagcaggccacccccgggcccgccaacagcggccgcgagaccaucuaccccaacgcgucccuccugauccagaacgucacccagaacgacacgggguucuacacccuccaggugaucaagagcgaccuggugaacgaggaggccaccggccaguuccacgucuacccggagcugcccaagcccuccaucagcuccaacaacagcaaccccguggaggacaaggacgccguggccuucacgugcgagccggagacccaggacaccaccuaccugugguggaucaacaaccagucccuccccgucagcccccggcugcagcuguccaacgggaaccgcacccucacgcugcugagcgugacccggaacgacaccggccccuacgagugcgagauccagaacccgguguccgcgaaccgcagcgaccccgucacccucaacgugacguacggccccgacacccccaccaucuccccgagcgacaccuacuaccggcccggggccaaccugucccugagcugcuacgccgccagcaacccgcccgcccaguacuccuggcucaucaacggcacguuccagcagagcacccaggagcuguucauccccaacaucaccgugaacaacuccgggagcuacacgugccacgcgaacaacuccgucaccggcugcaaccgcaccaccgugaagaccaucaucgugacggagcugagccccgucguggccaagccccagaucaaggccuccaagaccaccgugaccggcgacaaggacagcgucaaccucacgugcuccaccaacgacaccgggaucagcauccggugguucuucaagaaccagucccugcccagcuccgagcgcaugaagcugagccagggcaacaccacccucuccaucaacccggugaagcgggaggacgccgggacguacuggugcgaggucuucaaccccaucagcaagaaccaguccgaccccaucaugcugaacgugaacuacaacgcccugccgcaggagaacggccucagccccggggcgaucgccggcaucgugaucggcgucguggcccugguggcccugaucgccgucgcgcucgccugcuuccugcacuucgggaagaccggcuccagcgggccccugcaguga

SEQ ID NO: 28097 - RNA, 882 nt, Artificial Sequence
  derived and/or modified sequence opt1 from CEACAM21__Homo_sapiens__XP_006725457
auggggcccccgagcgccugcccccaccgcgagugcauccccuggcagggccugcuccugaccgccucccugcucaccuucuggaacgcgcccacgaccgccuggcuguucaucgccagcgccccguucgagguggccgagggcgagaacguccaccuguccgugguguaccuccccgagaaccuguacagcuacgggugguacaagggcaagaccgucgagcccaaccagcugaucgcggccuacgugaucgacacccacgugcggacgcccgggccggccuacuccggccgcgagaccaucagccccuccggcgaccuccacuuccagaacgucacccuggaggacaccggguacuacaaccugcaggucacguaccggaacagccagaucgagcaggccucccaccaccuccgcguguacgagagcguggcgcagcccuccauccaggccagcuccaccaccgugaccgagaagggcagcgugguccugacgugccacaccaacaacaccgggaccuccuuccaguggaucuucaacaaccagcggcuccaggugacgaagcgcaugaagcugagcugguucaaccacgugcugaccaucgaccccauccggcaggaggacgccggcgaguaccagugcgaggucuccaacccggugagcuccaaccgcagcgacccccugaagcucaccgucaagagcgacgacaacacccuggggauccugaucggcgugcucgugggcucccugcugguggccgcccucgucugcuuccugcugcuccggaagacggggcgcgcgagcgaccaguccgacuuccgggagcagcagccgcccgccagcacccccggccacgggcccuccgacagcuccaucagcuga

SEQ ID NO: 28098 - RNA, 639 nt, Artificial Sequence
  derived and/or modified sequence opt1 from CEACAM3__Homo_sapiens__NP_001264092
auggggcccccgagcgccagcccccaccgcgagugcauccccuggcagggccugcuccugaccgccucccugcucaacuucuggaacccgcccaccacggcgaagcugaccaucgaguccaugccccugagcguggccgagggcaaggagguccuccugcuggugcacaaccucccccagcaccuguucggguacuccugguacaagggcgagcggguggacgggaacagccugaucgucggcuacgugaucggcacccagcaggccacccccggggccgccuacuccggccgcgagacgaucuacaccaacgcgagccuccugauccagaacgugacccagaacgacaucggguucuacacccugcaggucaucaaguccgaccucgugaacgaggaggccacgggccaguuccacguguaccaggagaacgccccggggcugcccgucggcgccguggcgggcaucgugaccgggguccuggugggcguggcccucgucgccgcccuggugugcuuccugcuccuggccaagaccgggcggcccuggagccugccccagcucugccugcuggacgugccgucccuccacugccccggcccgcccacccagccccaggacagcuccuuccaccuguga

SEQ ID NO: 28099 - RNA, 735 nt, Artificial Sequence
  derived and/or modified sequence opt1 from CEACAM4__Homo_sapiens__NP_001808
auggggcccccgagcgccgcgccccgcggcggccaccggcccuggcaggggcugcucaucaccgccucccugcugaccuucuggcacccgcccacgaccgugcaguucaccaucgaggcccuccccagcuccgccgccgagggcaaggacguccugcugcucgccugcaacaucagcgagaccauccaggcguacuacuggcacaaggggaagacggccgagggcagcccccugaucgccggcuacaucaccgacauccaggccaacauccccggggcggccuacuccggccgcgagaccguguacccgaacgggucccuccuguuccagaacaucacccuggaggacgccggcagcuacacgcugcggaccaucaacgccuccuacgacagcgaccaggccaccgggcagcuccacgugcaccagaacaacguccccggccugcccgugggcgcgguggccgggaucgucaccggcgugcuggugggggucgcccucguggccgcccuggugugcuuccugcuccugucccgcacgggccgggcgagcauccagcgcgaccugcgggagcagcccccgcccgccuccacccccggccacgggcccagccaccgcuccaccuucagcgccccgcuccccagcccccggaccgccacgcccaucuacgaggagcugcuguacuccgacgccaacaucuacugccagaucgaccacaaggcggacgucguguccuga

SEQ ID NO: 28100 - RNA, 2109 nt, Artificial Sequence
  derived and/or modified sequence opt1 from CEACAM5__Homo_sapiens__NP_001278413
auggagagccccuccgccccgccccaccgcuggugcauccccuggcagcggcugcuccugaccgccagccugcucaccuucuggaacccgcccacgaccgcgaagcugaccaucgaguccacccccuucaacguggccgagggcaaggagguccugcuccuggugcacaaccugccccagcaccucuucggguacagcugguacaagggcgagcgcguggacgggaaccggcagaucaucggcuacgucaucgggacgcagcaggccacccccggcccggccuacuccggccgcgagaucaucuaccccaacgccagccugcugauccagaacaucauccagaacgacaccggguucuacacccuccacgugaucaaguccgaccuggugaacgaggaggcgacgggccaguuccgggucuaccccgagcugcccaagccgagcaucuccagcaacaacuccaagcccguggaggacaaggacgccguggccuucacgugcgagcccgagacccaggacgccaccuaccucuggugggucaacaaccagagccugcccguguccccgcgccugcagcucagcaacgggaaccggacgcugacccuguucaacgugacccgcaacgacaccgcguccuacaagugcgagacgcagaaccccgucagcgcccggcgcuccgacagcgugauccucaacgugcuguacggccccgacgcccccaccaucuccccgcugaacaccagcuaccggagcggggagaaccucaaccuguccugccacgccgccagcaacccgcccgcgcaguacuccugguucgucaacggcaccuuccagcagagcacgcaggagcuguucauccccaacaucaccgugaacaacuccggcagcuacacgugccaggcccacaacuccgacaccgggcucaaccgcaccaccgugaccaccaucacggucuacgccgagccgcccaagcccuucaucaccagcaacaacuccaaccccguggaggacgaggacgccguggcccugaccugcgagcccgagauccagaacaccacguaccuguggugggucaacaaccagagccuccccgugagcccccggcugcagcuguccaacgacaaccgcacccucacccugcuguccgugacccggaacgacgucggcccguacgagugcgggauccagaacgagcucagcguggaccacuccgaccccgucauccugaacgugcuguacggccccgacgaccccacgaucagcccguccuacaccuacuaccgccccggcgugaaccucagccuguccugccacgcggccagcaacccgcccgcccaguacagcuggcugaucgacgggaacauccagcagcacacccaggagcuguucaucuccaacaucaccgagaagaacagcggccucuacacgugccaggccaacaacuccgccagcgggcacucccggaccaccgucaagaccaucaccgugagcgcggagcugcccaagcccuccaucagcuccaacaacagcaagcccguggaggacaaggacgccgucgccuucacgugcgagcccgaggcccagaacaccaccuaccucuggugggugaacggccagucccugccggugagcccccgccugcagcucuccaacgggaaccggacccugacgcuguucaacgucacccgcaacgacgcccgggcguacgugugcggcauccagaacagcguguccgccaaccgcagcgaccccgucacccuggacgugcucuacggccccgacaccccgaucaucuccccgcccgacagcagcuaccuguccggggccaaccugaaccucagcugccacuccgccagcaaccccagcccccaguacuccuggcgcaucaacggcaucccccagcagcacacccaggugcuguucaucgcgaagaucacccccaacaacaacgggaccuacgccugcuucgucuccaaccuggccaccggccggaacaacagcaucgugaaguccaucacggugagcgccuccgggaccagccccggccucuccgccggcgcgaccgucgggaucaugaucggcgugcuggugggggucgcccugaucuga

SEQ ID NO: 28101 - RNA, 1035 nt, Artificial Sequence
  derived and/or modified sequence opt1 from CEACAM6__Homo_sapiens__NP_002474
auggggcccccgagcgccccgcccugccgccugcacgugcccuggaaggagguccuccugaccgccucccugcucaccuucuggaacccgcccacgaccgcgaagcugaccaucgagagcacccccuucaacguggccgagggcaaggaggugcugcuccuggcccacaaccugccccagaaccggaucggcuacuccugguacaagggggagcgcgucgacggcaacagccucaucgugggguacgugaucggcacgcagcaggccacccccggccccgccuacuccgggcgggagaccaucuaccccaacgcgagccugcugauccagaacgucacccagaacgacacgggcuucuacacccuccaggugaucaaguccgaccuggugaacgaggaggccaccgggcaguuccacgucuaccccgagcugccgaagcccagcaucuccagcaacaacuccaaccccguggaggacaaggacgccguggccuucacgugcgagcccgagguccagaacaccaccuaccucuggugggugaacggccagagccugccggugagcccccgccugcagcucuccaacgggaacaugacccugacccugcucuccgucaagcggaacgacgcgggcagcuacgagugcgagauccagaaccccgccuccgccaaccgcagcgaccccgugacgcugaacgugcuguacggcccggacguccccaccaucucccccagcaaggccaacuaccggcccggggagaaccucaaccugagcugccacgccgcguccaacccgcccgcccaguacagcugguucaucaacggcaccuuccagcaguccacccaggagcuguucauccccaacaucacggugaacaacagcggguccuacaugugccaggcccacaacagcgccaccggccucaaccgcaccaccgugacgaugaucaccgucuccggcagcgcccccgugcuguccgcgguggccaccgucgggaucaccaucggcgugcuggcccgggucgcccucaucuga

SEQ ID NO: 28102 - RNA, 798 nt, Artificial Sequence
  derived and/or modified sequence opt1 from CEACAM7__Homo_sapiens__NP_001278414
augggcagccccuccgccugcccguaccgcgugugcauccccuggcaggggcugcuccugaccgccagccugcucaccuucuggaaccugcccaacuccgcgcagacgaacaucgacgucgugcccuucaacguggccgagggcaaggagguccugcucguggugcacaacgagagccagaaccuguacggguacaacugguacaagggcgagcggguccacgccaacuaccgcaucaucggguacgugaagaacaucucccaggagaacgccccgggccccgcccacaacggccgggagaccaucuaccccaacgggacccugcucauccagaacgugacccacaacgacgcgggcaucuacacgcugcacgucaucaaggagaaccuggugaacgaggaggugacccgccaguucuacgucuucagcgagcccccgaagcccuccaucaccagcaacaacuucaaccccguggagaacaaggacaucgugguccugaccugccagcccgagacgcagaacaccaccuaccucuggugggugaacaaccagucccugcucgugagcccgcggcugcugcucuccaccgacaaccgcacgcugguccugcucagcgccaccaagaacgacaucgggcccuacgagugcgagauccagaaccccgugggcgccucccggagcgaccccgugacccugaacguccgcuacgaguccgugcaggccagcuccccggaccugagcgcggggaccgccguguccaucaugaucggcguccucgccggcauggcccugaucuga

SEQ ID NO: 28103 - RNA, 1050 nt, Artificial Sequence
  derived and/or modified sequence opt1 from CEACAM8__Homo_sapiens__NP_001807
augggccccaucagcgccccguccugccgcuggcggauccccuggcaggggcugcuccugaccgccagccuguucaccuucuggaacccgcccacgaccgcgcagcucaccaucgaggccgugcccuccaacgccgccgagggcaaggagguccugcugcucgugcacaaccugccccaggacccccgcggguacaacugguacaagggcgagaccguggacgccaaccggcgcaucaucggguacgucaucagcaaccagcagaucacgcccggcccggcguacuccaaccgggagaccaucuaccccaacgccagccugcucaugcgcaacgugacccggaacgacaccggcuccuacacgcuccaggugaucaagcugaaccucaugagcgaggaggucaccgggcaguucuccgugcaccccgagacccccaagccgagcaucuccagcaacaacuccaaccccguggaggacaaggacgccgucgccuucacgugcgagcccgagacccagaacaccaccuaccuguggugggugaacggccagagccugcccguguccccgcgccuccagcugagcaacgggaaccggacccugacgcuccuguccgucacccgcaacgacgugggccccuacgagugcgagauccagaaccccgcgagcgccaacuucuccgaccccgugacccugaacguccucuacgggccggacgcccccaccaucagccccagcgacacguacuaccacgccggcgugaaccugaaccuguccugccacgccgcgagcaacccgcccucccaguacagcugguccgugaacggcaccuuccagcaguacacccagaagcuguucauccccaacaucaccacgaagaacagcggguccuacgccugccacaccaccaacagcgccaccggccggaaccgcacgaccguccggaugaucaccguguccgacgcccuggugcaggggagcucccccggccugagcgcccgcgcgaccgucuccaucaugaucggcgugcucgcccggguggcccugaucuga

SEQ ID NO: 28104 - RNA, 1182 nt, Artificial Sequence
  derived and/or modified sequence opt1 from CEBPA__Homo_sapiens__NP_001274353
augcgcggccgggggcgcgccggcagccccgggggccggcgccggcgcccggcccaggccgggggccggcgcggcucccccugccgggagaacagcaacucccccauggagagcgcggacuucuacgaggccgagccccgcccgcccauguccagccaccuccaguccccgccccacgcccccagcuccgccgcguucggguucccccggggcgccgggcccgcccagcccccggccccgcccgcggcccccgagccccucggcgggaucugcgagcacgagaccagcaucgacaucuccgccuacaucgaccccgccgccuucaacgacgaguuccuggcggaccuguuccagcacagccgccagcaggagaaggccaaggccgccgugggccccaccggcgggggcgggggcggcgacuucgacuaccccggggccccggcgggccccgggggcgccgucaugcccgggggcgcccacgggcccccgcccggcuacggcugcgccgccgcgggguaccuggacggccggcuggagccccuguacgagcgcgugggggcccccgcccuccggccgcuggugaucaagcaggagccccgcgaggaggacgaggccaagcagcuggcccucgcgggccuguuccccuaccagccgcccccgcccccgccgcccucccacccccacccccacccgccgcccgcccaccuggccgcgccccaccuccaguuccagaucgcccacugcggccagacgaccaugcaccuccagcccgggcaccccacgcccccgcccacccccguccccagcccccaccccgcccccgcccugggcgccgccgggcugcccggccccggguccgcgcugaagggccugggcgccgcccaccccgaccuccgggccagcgggggcuccggggccggcaaggcgaagaaguccguggacaagaacagcaacgaguaccgcgugcggcgcgagcggaacaacaucgccguccgcaagagccgcgacaaggccaagcagcggaacguggagacccagcagaaggugcuggagcugaccagcgacaacgaccgccuccggaagcgcgucgagcagcugucccgggagcuggacacccuccgcggcaucuuccggcagcugcccgagagcucccuggugaaggccauggggaacugcgccuga

SEQ ID NO: 28105 - RNA, 1038 nt, Artificial Sequence
  derived and/or modified sequence opt1 from CEBPB__Homo_sapiens__NP_005185
augcagcgccugguggccugggaccccgccugccucccccugcccccgcccccgcccgcguucaagagcauggaggucgccaacuucuacuacgaggccgacugccuggccgccgcguacggcgggaaggccgcccccgccgcgcccccggccgcccggcccggcccccggcccccggccggggagcucggcuccaucggggaccacgagcgcgccaucgacuucagccccuaccuggagccccugggcgcgccccaggccccggcccccgccaccgccaccgacacguucgaggcggccccgcccgcccccgcccccgcccccgcguccagcggccagcaccacgacuuccucuccgaccuguucagcgacgacuacgggggcaagaacugcaagaagcccgccgaguacggguacgugucccugggccgccucggggccgccaagggcgcccugcaccccggcugcuucgcgccccugcacccgcccccgcccccgcccccgccgcccgccgagcucaaggccgagcccggguucgagcccgccgacugcaagcggaaggaggaggcgggcgcccccgggggcggcgccgggauggccgccggcuuccccuacgcgcugcgcgccuaccugggguaccaggccgugcccagcggcuccagcgggucccucagcaccuccagcuccagcuccccgcccggcacccccagccccgccgacgccaaggcgccgcccaccgccugcuacgccggcgccgcccccgcgcccucccaggucaagagcaaggccaagaagacgguggacaagcacagcgacgaguacaagauccggcgcgagcggaacaacaucgccgugcgcaagucccgggacaaggccaagaugcgcaaccuggagacccagcacaagguccuggagcucaccgcggagaacgagcggcugcagaagaagguggagcagcugagccgcgagcucuccacccugcggaaccuguucaagcagcuccccgagccccugcuggccagcuccgggcacugcuga

SEQ ID NO: 28106 - RNA, 810 nt, Artificial Sequence
  derived and/or modified sequence opt1 from CEBPD__Homo_sapiens__NP_005186
augagcgccgcccuguucucccucgacggccccgcgcgcggggccccguggcccgccgagcccgcccccuucuacgagccgggccgggccgggaagcccggccgcggggcggagcccggcgcccugggcgagcccggggccgccgcgccggccauguacgacgacgagagcgccaucgacuucuccgccuacaucgacagcauggccgcggugcccacccuggagcucugccacgacgagcuguucgccgaccuguucaacuccaaccacaaggccggcggggccggcccccucgagcugcugcccgggggcccggcccggccccucggccccgggcccgcggccccgcgccugcugaagcgggagcccgacuggggcgacggggacgcccccggcagccuccugcccgcccaggucgccgcgugcgcccagaccguggugucccuggccgccgccggccagccgacgccgcccaccagccccgagccgccccgcuccagcccccggcagacccccgcgcccgggcccgcccgcgagaaguccgccggcaagcgggggcccgaccgcggcagcccggaguaccggcagcgccgggagcgcaacaacaucgccguccggaagucccgcgacaaggcgaagcggcgcaaccaggagaugcagcagaagcucguggagcugagcgccgagaacgagaagcugcaccagcggguggagcagcucacccgcgaccuggccgggcugcggcaguucuucaagcagcuccccuccccgcccuuccugcccgccgccggcacggcggacugccgcuga

SEQ ID NO: 28107 - RNA, 846 nt, Artificial Sequence
  derived and/or modified sequence opt1 from CEBPE__Homo_sapiens__NP_001796
augagccacggcaccuacuacgagugcgagccccgcgggggccagcagccgcuggaguucuccgggggccgggccgggcccggcgagcucggcgacaugugcgagcacgaggccagcaucgaccuguccgcguacaucgagagcggggaggagcagcugcucuccgaccuguucgccgugaagcccgcccccgaggcccgcggccugaaggggccgggcacccccgccuucccccacuaccugcccccggacccccggcccuucgcguacccgccccacacguucgggcccgaccgcaaggcccucggccccggcaucuacagcucccccgggagcuacgacccgcgggccguggccgugaaggaggagccccgcggccccgaggggucccgggcggccagccgcggcuccuacaacccccugcaguaccagguggcccacugcggccagaccgccaugcaccucccgcccacccuggccgcgcccgggcagccccugcggguccucaaggccccgcuggccaccgccgccccgcccugcagcccccugcucaaggcgcccucccccgccggcccccugcacaaggggaagaaggccgugaacaaggacagccuggaguaccgccuccggcgcgagcggaacaacaucgccgugcgcaagucccgggacaaggccaagcgccggauccuggagacgcagcagaagguccuggaguacauggcggagaacgagcgccuccggagccgcguggagcagcugacccaggagcuggacacccuccggaaccuguuccgccagaucccggaggccgccaaccugaucaagggcgucgggggcugcuccuga

SEQ ID NO: 28108 - RNA, 453 nt, Artificial Sequence
  derived and/or modified sequence opt1 from CEBPG__Homo_sapiens__NP_001239225
augagcaagaucucccagcagaacagcacccccggcgugaacgggaucuccgucauccacacccaggcccacgccagcggccugcagcaggucccgcagcucgugcccgcggggcccggcgggggcggcaaggccguggcccccuccaagcagagcaagaaguccagcccgauggaccgcaacuccgacgaguaccggcagcgccgggagcgcaacaacauggccgugaagaagucccggcucaagagcaagcagaaggcccaggacacgcugcagcgcgugaaccagcugaaggaggagaacgagcggcuggaggcgaagaucaagcugcucaccaaggagcugagcguccugaaggaccucuuccuggagcacgcccacaaccuggccgacaacgugcaguccaucagcaccgagaacaccacggccgacggggacaacgcgggccaguga

SEQ ID NO: 28109 - RNA, 3165 nt, Artificial Sequence
  derived and/or modified sequence opt1 from CEBPZ__Homo_sapiens__NP_005751
auggccgccgugaaggagccccuggaguuccacgcgaagcgcccguggcggcccgaggaggccgucgaggaccccgacgaggaggacgaggacaacaccagcgaggccgagaacggcuucucccucgaggaggugcugcgccucgggggcaccaagcaggacuaccucaugcuggccacgcuggacgagaacgaggaggugaucgacgggggcaagaagggggccaucgacgaccuccagcagggcgagcuggaggcguucauccagaaccugaaccucgccaaguacaccaaggccagccuggucgaggaggacgagcccgccgagaaggagaacuccagcaagaaggaggugaagaucccgaagaucaacaacaagaacaccgcggagucccagcggaccagcgugaacaaggucaagaacaagaaccgccccgagccccacuccgacgagaacggcagcacgacccccaaggugaagaaggacaagcagaacaucuucgaguucuucgagcggcagacccugcuccugcgccccgggggcaagugguacgaccuggaguacuccaacgaguacagccucaagccccagccccaggacguggucuccaaguacaagacccuggcccagaagcuguaccagcacgagaucaaccucuucaagagcaagacgaacucccagaagggggccagcuccaccuggaugaaggccaucgugagcuccggcacccugggggaccggauggccgcgaugauccugcucauccaggacgacgccgugcacacccugcaguucgucgagacgcuggugaaccucgugaagaagaagggcagcaagcagcagugccugauggcccuggacaccuucaaggagcuccugaucaccgaccugcuccccgacaaccgcaagcugcggaucuucucccagcgcccguucgacaagcuggagcagcucagcagcggcaacaaggacucccgggaccgccggcugauccugugguacuucgagcaccagcucaagcaccuggucgccgaguucguccaggugcuggagacccucagccacgacacgcuggugaccaccaagacccgcgcccugacgguggcgcacgagcuccugugcaacaagcccgaggaggagaaggcccugcucgugcaggucgugaacaagcugggggacccccagaaccggaucgccaccaaggccucccaccuccucgagacccugcugugcaagcaccccaacaugaagggcguggucagcggggagguggagcgccugcuguuccgguccaacaucagcuccaaggcccaguacuacgcgaucugcuuccugaaccagauggcccugagccacgaggaguccgagcucgccaacaagcugaucaccgucuacuucugcuucuuccgcacgugcgugaagaagaaggacguggagagcaagaugcuguccgcccuccugaccggcgucaaccgggccuacccguacagccagaccggcgacgacaaggugcgcgagcagaucgacacccuguucaaggugcuccacaucgucaacuucaacacguccgugcaggcgcugaugcugcuguuccaggugaugaacagccagcagaccaucuccgaccgguacuacaccgcccuguaccgcaagaugcuggaccccgggcucaugaccugcagcaagcaggccauguuccugaaccuggucuacaagucccucaaggccgacaucgugcugcgccgggugaaggcguucgucaagcgccugcuccaggugacgugccagcagaugccgcccuucaucugcggcgcccuguaccuggugagcgagauccucaaggccaagccggggcugcggucccagcuggacgaccaccccgagagcgacgacgaggagaacuucaucgacgccaacgacgacgaggacauggagaaguucaccgacgccgacaaggagaccgagaucgucaagaagcucgagaccgaggagacggugcccgagaccgacguggagaccaagaagcccgaggucgcgagcugggugcacuucgacaaccugaagggcgggaagcagcugaacaaguacgacccguucucccgcaacccccucuucugcggcgccgagaacaccagccugugggagcugaagaagcucuccgugcacuuccaccccagcgucgcccuguucgccaagaccauccugcagggcaacuacauccaguacuccggggacccccuccaggacuucacgcugaugcgguuccuggaccgcuucguguaccggaacccgaagccccacaagggcaaggagaacaccgacagcguggucaugcagcccaagcgcaagcacuucaucaaggacauccggcaccucccggugaacuccaaggaguuccuggccaaggaggagagccagauccccguggacgaggucuucuuccaccgcuacuacaagaagguggcggugaaggagaagcagaagcgggacgccgacgaggaguccaucgaggacgucgacgacgaggaguucgaggagcugaucgacaccuucgaggacgacaacugcuucagcuccgggaaggacgacauggacuucgccggcaacgugaagaagcgcaccaagggggccaaggacaacacgcucgacgaggacagcgagggcuccgacgacgagcugggcaaccuggacgacgacgaggugagccucggguccauggacgacgaggaguucgccgaggucgacgaggacggcgggaccuucauggacgugcuggacgacgagagcgaguccgugcccgagcuggagguccacagcaaggugagcaccaagaaguccaagcggaagggcaccgacgacuucgacuucgcggggagcuuccagggcccccgcaagaagaagcggaaccucaacgacuccagccuguucguguccgccgaggaguucggccaccuccuggacgagaacauggggagcaaguucgacaacaucggcaugaacgccauggccaacaaggacaacgcgucccugaagcagcugcgcugggaggccgagcgggacgacuggcuccacaaccgcgacgccaagagcaucaucaagaagaagaagcacuucaagaagaagcggaucaagacgacccagaagaccaagaagcagcgcaaguga

SEQ ID NO: 28110 - RNA, 813 nt, Artificial Sequence
  derived and/or modified sequence opt1 from CECR1__Homo_sapiens__NP_803124
auggacagccuggaguggaacugggcccucguguacgagcuguccggcgagcaccacgacgaggaguggagcgucaagaccuaccaggagguggcccagaaguucguggagacccaccccgaguucaucgggaucaagaucaucuacuccgaccaccgcagcaaggacgucgcggugaucgccgaguccauccggauggccaugggccugcgcaucaaguucccgacgguggucgccggguucgaccucgugggccacgaggacaccgggcacagccugcacgacuacaaggaggcccugaugauccccgcgaaggacggcgugaagcuccccuacuucuuccacgccggcgagaccgacuggcaggggaccuccaucgaccggaacauccuggacgcccugaugcucaacacgacccgcaucggccacggguucgcccugagcaagcaccccgcgguccggaccuacuccuggaagaaggacaucccgaucgaggugugccccaucagcaaccaggugcugaagcucgucuccgaccugcgcaaccaccccguggccacccugauggccacgggccaccccauggugaucagcuccgacgacccggccauguucggggccaagggccucagcuacgacuucuacgaggucuucaugggcaucgggggcaugaaggcggaccugcggacccugaagcagcucgccaugaacuccaucaaguacagcacccugcuggaguccgagaagaacaccuucauggagaucuggaagaagcgcugggacaaguucaucgccgacguggccacgaaguga

SEQ ID NO: 28111 - RNA, 4395 nt, Artificial Sequence
  derived and/or modified sequence opt1 from CECR2__Homo_sapiens__NP_001276976
augugccccgaggagggcggggccgccggccugggggagcuccgcagcuggugggaggugccggcgaucgcccacuucugcucccuguuccggaccgccuuccgccugcccgacuucgagaucgaggagcucgaggccgcccugcaccgggacgacgucgaguucaucagcgaccugaucgcgugccuccugcagggcugcuaccagcgccgggacaucaccccccagacguuccacuccuaccuggaggacaucaucaacuaccgcugggagcucgaggaggggaagcccaacccgcugcgggaggccagcuuccaggaccugccccuccgcacccggguggagauccugcaccgccugugcgacuaccggcucgacgccgacgacguguucgaccugcugaagggccucgacgccgacucccugcgcgucgagccccugggcgaggacaacagcggggcgcucuacugguacuucuacggcacccggauguacaaggaggaccccgugcaggggaaguccaacggcgagcugagccugucccgcgagagcgaggggcagaagaacguguccagcaucccgggcaagaccggcaagcggcgcgggcggccccccaagcgcaagaagcuccaggaggagauccugcuguccgagaagcaggaggagaacagccucgccuccgagccccagacgcggcacggcagccaggggccgggccagggcaccugguggcugcugugccagaccgaggaggaguggcgccaggucaccgaguccuuccgggagcgcacgagccuccgcgagcggcagcuguacaagcugcucuccgaggacuuccugcccgagaucugcaacaugaucgcccagaaggggaagcgcccccagcggaccaaggccgagcugcacccccgcuggaugagcgaccaccucagcaucaagccggugaagcaggaggagacccccgugcugacccggaucgagaagcagaagcgcaaggaggaggaggaggagcggcagauccugcucgccguccagaagaaggagcaggagcagaugcugaaggaggagcgcaagcgggagcuggaggagaaggugaaggcgguggaggaccgcgccaagcggcgcaagcuccgggaggagcgcgccuggcugcuggcccagggcaaggagcucccccccgagcugucccaccuggacccgaacagccccaugcgggaggagaagaagacgaaggaccucuucgagcuggacgacgacuucaccgccauguacaagguccuggacguggugaaggcgcacaaggacuccuggcccuuccuggagcccgucgacgagagcuacgccccgaacuacuaccagaucaucaaggcccccauggacaucuccagcauggagaagaagcucaacgggggccuguacugcaccaaggaggaguucgugaacgacaugaagaccauguuccgcaacugccggaaguacaacggggaguccagcgaguacacgaagauguccgacaaccuggagcgcugcuuccaccgggccaugaugaagcacuuccccggcgaggacggcgacaccgacgaggaguucuggauccgcgaggacgagaagcgcgagaagcggcgcagccgggccgggcgcuccggcgggagccacguguggacccggucccgcgaccccgagggcagcucccggaagcagcagccgauggagaacgggggcaagagccucccccccacccgccgggcgccguccagcggcgacgaccaguccagcagcuccacgcagcccccccgcgaggucgggaccagcaacggccggggguucucccacccccugcacugcggcgggaccccgagccaggcccccuuccugaaccagaugcgccccgccgugcccggcaccuucggcccgcuccggggguccgaccccgccacgcuguacggcagcuccggggugcccgagccccacccgggcgagcccguccagcagcgccagcccuucaccaugcagcccccggugggcaucaacagccugcgggggccccgccucggcacccccgaggagaagcagaugugcgggggccugacccaccuguccaacauggggccccacccgggcagccuccagcugggccagaucuccgggcccagccaggacggcuccauguacgcccccgcgcaguuccagcccggguucaucccgccccggcacggcggggcccccgcccgcccgcccgacuuccccgagagcuccgagauccccccgagccacauguaccgguccuacaaguaccugaaccgcgugcacagcgccgucuggaacggcaaccacggcgcgacgaaccaggggccccucggccccgacgagaagccccaccuggggccgggccccagccaccagccccggacccuggggcacgugauggacucccgcgucaugcgccccccggugccccccaaccaguggaccgagcagagcggcuuccucccccacggcgugccguccagcggguacaugcggccccccugcaaguccgccggccaccgccugcagcccccgcccguccccgcccccagcucccuguucggggccccggcccaggcgcuccggggcgugcaggggggcgacagcaugauggacucccccgagaugaucgccaugcagcagcugagcucccgcgugugcccccccggcgucccguaccacccccaccagcccgcccacccgcggcugcccgggcccuucccccagguggcccacccgaugagcgugaccgucuccgcccccaagcccgcgcucggcaaccccgggcgcgccccggagaacagcgaggcccaggagcccgagaacgaccaggccgagccccugcccggccuggaggagaagccgcccggcguggggacguccgagggcguguaccucacccagcugccccaccccaccccgccccugcagaccgacugcacgcggcagagcuccccccaggagcgcgagaccgucgggcccgagcucaagagcuccagcagcgaguccgccgacaacugcaaggcgaugaagggcaagaacccguggcccagcgacuccagcuaccccgggcccgccgcccagggcugcgugcgggaccuguccaccguggccgaccgcggcgcgcugagcgagaacggggucaucggcgaggccuccccgugcgggagcgagggcaaggggcucggcuccagcggcuccgagaagcugcugugcccccgggggcgcacccuccaggagaccaugcccugcacgggccagaacgccgccacccccccgagcaccgaccccgggcugaccggcgggacggugucccaguuccccccgcuguacaugcccggccucgaguaccccaacagcgccgcgcacuaccacaucucccccggccugcagggggugggcccggucauggggggcaagagccccgccucccacccccagcacuuccccccgcggggcuuccagagcaaccacccccacuccgggggcuucccccgcuaccggcccccgcaggggaugcgcuacagcuaccacccccccccccagccgagcuaccaccacuaccagcggacccccuacuacgccugcccccaguccuucagcgacuggcagcgcccccugcacccgcagggcucccccagcgggccccccgccucccagccgccccccccgcggagccucuucuccgacaagaacgccauggcgagccugcagggcugcgagacccugaacgccgcccucaccucccccacgcgcauggacgccguggccgcgaaggugcccaacgacggccagaaccccgggccggaggaggagaagcuggacgagagcauggagcgccccgagucccccaaggaguuccuggaccucgacaaccacaacgccgccaccaagcggcagagcucccugagcgccuccgaguaccuguacggcacccccccgccccucagcuccgggaugggcuucgggagcuccgcguuccccccccacagcgucaugcugcagaccggcccgcccuacacgccccagcgccccgccagccacuuccagccgcgggccuacuccagccccguggccgcccugcccccccaccacccgggcgcgacccagcccaacgggcucucccaggagggccccaucuaccgcugccaggaggaggggcugggccacuuccaggccgugaugauggagcagaucgggacccggagcggcauccgcggccccuuccaggagauguaccggccguccgggaugcagaugcaccccguccagagccaggccuccuuccccaagacccccacggccgccaccagccaggaggaggugccgccccacaagcccccgacccugccccucgaccaguccuga

SEQ ID NO: 28112 - RNA, 777 nt, Artificial Sequence
  derived and/or modified sequence opt1 from CELA1__Homo_sapiens__NP_001962
augcuggugcucuacggccacagcacccaggaccugcccgagaccaacgcccgcgucgucgggggcacggaggccgggcggaacuccuggccgagccagaucucccugcaguaccgcagcggcgggucccgguaccacacgugcggcggcacccucauccgccagaacugggugaugaccgcggcccacugcguggacuaccagaagaccuuccgggugguggccggggaccacaaccugagccagaacgacggcaccgagcaguacgucuccgugcagaagaucgugguccaccccuacuggaacagcgacaacguggccgccggguacgacaucgcgcugcuccgccuggcccaguccgugacccugaacagcuacguccagcucggcgugcugccccaggagggggccauccuggccaacaacucccccugcuacaucaccggcuggggcaagacgaagaccaacgggcagcucgcgcagacccugcagcaggccuaccugccgagcguggacuacgccaucugcuccagcuccagcuacuggggcuccaccgucaagaacacgauggugugcgccgggggcgacggcgugcggagcgggugccagggcgacuccgggggcccccuccacugccuggucaacgggaaguacagcgugcacggcgugaccagcuucgucuccagccgcggcugcaacgugucccggaagcccaccguguucacccaggucagcgccuacaucuccuggaucaacaacgugaucgcgagcaacuga

SEQ ID NO: 28113 - RNA, 882 nt, Artificial Sequence
  derived and/or modified sequence opt1 from CELA3B__Homo_sapiens__XP_011539434
augaugcugcgccuccugagcucccugcuccugguggccgucgccagcggcuacgggcccccguccagccggcccuccagccgcguggugaacggcgaggacgcgguccccuacuccuggcccuggcaggucagccugcaguacgagaaguccgggagcuucuaccacacgugcggcgggucccucaucgccccggacuggguggugaccgccggccacugcaucagcuccagccggaccuaccagguggugcugggcgaguacgaccgcgccgucaaggaggggcccgagcaggucauccccaucaacuccggcgaccuguucgugcacccccucuggaaccggagcugcguggccugcgggaacgacaucgcgcugaucaagcugucccgcagcgcccagcucggcgacgccgugcagcuggccucccugccgcccgcgggggacauccuccccaacgagacccccugcuacaucaccggcuggggccggcuguacaccaacgggccgcugcccgacaagcuccaggaggcccugcugcccguggucgacuacgagcacugcagccgcuggaacugguggggcagcuccgugaagaagacgauggugugcgccgggggcgacauccggagcggcugcaacggggacuccggcgggccccucaacugcccgaccgaggacggcggguggcagguccacggcgugaccagcuucguguccgccuucggcugcaacacccgccggaagcccacggucuucacccgcgugagcgccuucaucgacuggaucgaggaggggcugugccggauggagaccacccuggcgugccuccccggcucccagaagcugcaggggaacaaggcccccgagagccgcacguga

SEQ ID NO: 28114 - RNA, 1539 nt, Artificial Sequence
  derived and/or modified sequence opt1 from CELF1__Homo_sapiens__NP_001166110
auggccgccuucaagcuggacuuccuccccgagaugaugguggaccacugcagccugaacuccagcccggucuccaagaagaugaacggcacccuggaccaccccgaccagcccgaccucgacgcgaucaagauguucgugggccaggugccccgcaccuggagcgagaaggaccugcgggagcuguucgagcaguacggggccgucuacgagaucaacgugcuccgcgaccggucccagaacccgccccagagcaaggggugcugcuucgugacguucuacacccgcaaggccgcccuggaggcccagaacgcgcugcacaacaugaagguccuccccggcaugcaccaccccauccagaugaagccggccgacuccgagaagaacaacguggaggaccggaagcuguucaucgggaugaucagcaagaagugcaccgagaacgacauccgcgugauguucuccagcuucggccagaucgaggagugccggauccugcgcggccccgacgggcucucccggggcugcgccuucgucaccuucacgacccgcgccauggcgcagaccgccaucaaggccaugcaccaggcccagaccauggaggggugcagcucccccaugguggugaaguucgccgacacgcagaaggacaaggagcagaagcggauggcgcagcagcugcagcagcagaugcagcagaucagcgccgccuccgucuggggcaaccuggccgggcucaacacccugggcccccaguaccuggcccucuaccugcagcugcuccagcagaccgcgagcuccggcaaccugaacacccugagcucccuccacccgaugggcgggcugaacgccaugcagcugcagaaccucgccgcccuggccgcggccgccagcgccgcccagaacacgcccagcgggaccaacgcgcugaccaccuccagcagcccccucuccgugcugacguccagcggcuccagccccuccagcuccagcuccaacagcgugaacccgaucgccucccugggcgcccuccagacccuggccggggcgaccgccggccugaacgucgggagccucgccggcauggccgcccugaacgggggccugggcuccagcgggcucuccaacggcaccgggagcacgauggaggcgcugacccaggccuacagcggcauccagcaguacgccgccgccgcgcugcccacccucuacaaccagaaccugcugacccagcaguccaucggggccgccggcagccagaaggagggccccgagggggccaaccucuucaucuaccaccucccccaggaguucggcgaccaggaccugcugcagauguucaugccguucgggaacgugguguccgccaaggucuucaucgacaagcagacgaaccugagcaagugcuucggcuucguguccuacgacaaccccgugagcgcgcaggccgccauccaguccaugaacggguuccagaucggcaugaagcgccugaagguccagcugaagcggagcaagaacgacuccaagcccuacuga

SEQ ID NO: 28115 - RNA, 1473 nt, Artificial Sequence
  derived and/or modified sequence opt1 from CELF2__Homo_sapiens__NP_001020247
augaacggcgcccuggaccacagcgaccagcccgacccggacgccaucaagauguucguggggcagaucccccgcuccuggagcgagaaggagcucaaggagcuguucgagcccuacggcgcggucuaccagaucaacgugcugcgggaccgcucccagaacccgccccagagcaaggggugcugcuucgugaccuucuacacccggaaggccgcccucgaggcccagaacgcccugcacaacaucaagacgcugcccggcaugcaccaccccauccagaugaagcccgcggacuccgagaaguccaacgccgucgaggaccgcaagcuguucaucgggauggugagcaagaagugcaacgagaacgacauccgggugauguucagcccguucggccagaucgaggagugccgcauccuccggggccccgacgggcugucccgcggcugcgccuucgucaccuucagcacccgggccauggcgcagaacgccaucaaggccaugcaccagucccagaccauggaggggugcagcucccccaucguggugaaguucgccgacacgcagaaggacaaggagcagcgccggcuccagcagcagcuggcccagcagaugcagcagcugaacaccgcgaccuggggcaaccucaccgggcugggcggccugacgccccaguaccucgcccugcugcagcaggccaccagcuccagcaaccucggggccuucuccggcauccagcagauggccgggaugaacgcgcugcagcugcagaaccucgccacccuggccgccgccgcggccgccgcccagaccagcgccacguccaccaacgcgaacccgcugagcaccaccagcuccgcccucggcgcccugacgagccccgucgccgcguccacccccaacagcaccgccggcgccgccaugaacucccugaccagccucgggacgcugcagggccuggccggggcgaccgugggccucaacaacaucaacgcccuggccguggcccagaugcuguccgggauggccgcgcucaacggcggccugggggccaccggccugaccaacgggacggccggcaccauggacgcccucacccaggccuacagcgggauccagcaguacgcggccgccgcccugcccacccuguacucccagagccuccugcagcagcaguccgcggccggcagccagaaggagggcccggagggggccaaccuguucaucuaccaccucccccaggaguucggcgaccaggacauccugcagauguucaugcccuucgggaacgucaucuccgccaagguguucaucgacaagcagacgaaccugagcaagugcuucggcuucguguccuacgacaaccccgucagcgcccaggcggccauccaggccaugaacggguuccagaucggcaugaagcgccucaaggugcagcugaagcgguccaagaacgacagcaagccguacuga

SEQ ID NO: 28116 - RNA, 1458 nt, Artificial Sequence
  derived and/or modified sequence opt1 from CELF4__Homo_sapiens__NP_001020258
auguacaucaagauggccacccuggccaacggccaggcggacaacgccagccucuccaccaacgggcugggcagcucccccgggagcgccggccacaugaacgggcugucccacagcccgggcaaccccuccacgauccccaugaaggaccacgacgccaucaagcuguucaucggccagaucccccgcaaccucgacgagaaggaccugaagccccucuucgaggaguucgggaagaucuacgagcugaccgugcugaaggaccgguucaccggcaugcacaaggggugcgccuuccucaccuacugcgagcgcgagagcgcgcugaaggcccaguccgcccugcacgagcagaagacgcuccccggcaugaaccggcccauccaggucaagcccgccgacagcgagucccgcgggggcagcuccugccugcggcagccgcccagccaggaccgcaagcuguucgugggcaugcucaacaagcagcaguccgaggacgacgugcggcgccuguucgaggcguucgggaacaucgaggagugcaccauccugcggggccccgacgggaacagcaagggcugcgccuucgucaaguacuccagccacgccgaggcccaggccgcgaucaacgcccuccacggcucccagaccaugcccggggccagcagcucccugguggugaaguucgccgacaccgacaaggagcgcacgaugcggcgcaugcagcagauggccggccagauggggauguucaacccgauggcgauccccuucggcgccuacggggccuacgcccaggccaugcagcagcaggcggcccugauggccagcgucgcccagggcggcuaccucaaccccauggccgcguucgccgccgcccagaugcagcagauggcggcccugaacaugaacgggcuggccgccgcccccaugaccccgaccuccggcgggagcaccccgcccggcaucacggcgcccgccgugccguccauccccagccccaucggggugaacggcuucaccggccugcccccgcaggccaacgggcagcccgccgccgaggcggucuucgccaacggcauccaccccuaccccgcccaguccccgaccgccgccgacccccuccagcaggcguacgccggggugcagcaguacgccggccccgccgcguacccggccgccuacgggcagaucagccaggccuucccccagcccccgcccaugaucccccagcagcagcgggagggccccgagggcugcaaccuguucaucuaccaccucccccaggaguucggggacgccgagcugaugcagauguuccugccguucggcuucguguccuucgacaaccccgcgagcgcccagaccgccauccaggccaugaacggguuccagaucggcaugaagcgccucaagguccagcugaagcggcccaaggacgccaaccgccccuacuga

SEQ ID NO: 28117 - RNA, 1230 nt, Artificial Sequence
  derived and/or modified sequence opt1 from CELF5__Homo_sapiens__NP_001166144
auggcccgccugaccgagagcgaggcccggcgccagcagcagcagcuccugcagccccggccgucccccgugggcagcuccgggcccgagcccccgggcgggcagcccgacggcaugaaggaccuggacgcgaucaagcuguucgucgggcagaucccccgccaccucgacgagaaggaccugaagccccucuucgagcaguucggccggaucuacgagcugaccgugcugaaggacccguacacgggcaugcacaaggggugcgccuuccucaccuacugcgcccgcgacagcgccaucaaggcccagaccgcgcugcacgagcagaagacccugcccggcauggcccggcccauccaggugaagcccgccgacuccgagagccgcgggggccgggaccgcaagcuguucgucgggaugcucaacaagcagcaguccgaggaggacgugcugcgccucuuccagccguucggcgugaucgacgagugcacgguccugcggggccccgacgggagcuccaagggcugcgccuucgugaaguucagcucccacaccgaggcgcaggccgccauccacgcccugcacgggagccagaccaugcccggcgccuccagcucccucguggucaaguucgcggacaccgacaaggagcggacgcugcgccggaugcagcagauggugggccagcuggggauccucacccccagccugacccugccguucucccccuacagcgccuacgcccaggcccucaugcagcagcagaccacggugcuguccaccagcggcagcuaccugucccccggggucgccuucagccccugccacauccagcagaucggcgcggugucccucaacgggcugccggccacccccaucgcccccgccagcggcgugguccccuucccgggcgggcaccccgcccuggagaccguguacgcgaacggccucgugcccuaccccgcccaguccccgacggucgccgagacccugcaccccgccuucagcggggugcagcaguacaccgccauguaccccaccgcggccaucacgccgaucgcccacuccgugccccagcccccgccccugcuccagcagcagcagcgcgagggcgucuggcggcacggggccgacgcggacgugcccacccugcgccaguaccacuuccugcagggcguguacggcagcuccuaccagcccgagcaggucuuccggcuccgcgagcuguga

SEQ ID NO: 28118 - RNA, 1365 nt, Artificial Sequence
  derived and/or modified sequence opt1 from CELF6__Homo_sapiens__NP_001166155
auggccgccgcgcccggcgggagcgcccagccggccggccccgggccccgccugggcuucuccaccgccgacagcggggugggcauguccggccucaaccccgggccggccguccccaugaaggaccacgacgcgaucaagcuguucgugggccagaucccccgggggcuggacgagcaggaccucaagccccuguucgaggaguucggccgcaucuacgagcugaccgugcucaaggaccggcugacggggcugcacaagggcugcgccuuccucaccuacugcgcccgcgacagcgcccugaaggcgcaguccgcccugcacgagcagaagacccucccgggcaugaaccggcccauccaggucaagcccgccgccagcgaggggcgcggcgaggaccggaagcuguucguggggaugcugggcaagcagcagggcgaggaggacgugcgccggcuguuccagcccuucgggcacaucgaggagugcaccguccugcgcuccccggacggcacgagcaaggggugcgccuucgugaaguucggcucccagggggaggcgcaggccgccauccggggccugcacggcagccgcaccauggccggggccuccagcucccucguggucaagcuggcggacaccgaccgggagcgcgcccugcggcgcaugcagcagauggccggccaccucggggccuuccaccccgcgccccugccccugggcgccugcggggccuacaccacggccauccuccagcaccaggccgcccugcuggcggccgcccagggcccgggccucgggcccguggccgcgguggccgcccagaugcagcacgucgccgccuucagccugguggcggcgccccugcuccccgccgccgccgccaacuccccgcccggcagcgggcccggcacccugcccgggcugccggcccccaucggcgugaacggcuucgggccccucacgccccagaccaacggccagccgggguccgacacccuguacaacaacggccugagccccuaccccgcccaguccccgggcgucgccgacccccuccagcaggccuacgcggggaugcaccacuacgccggccccgaggggugcaaccuguucaucuaccaccucccccaggaguucggcgacgccgagcucauccagaccuuccugccguucggggccguggugagcgcgaaggucuucguggaccgggccaccaaccagagcaagugcuucggcuucguguccuucgacaaccccaccagcgcccagacggccauccaggccaugaacggcuuccagaucgggaugaagcgccugaagguccagcucaagcggcccaaggacgcgaaccgccccuacuga

SEQ ID NO: 28119 - RNA, 2271 nt, Artificial Sequence
  derived and/or modified sequence opt1 from CEL__Homo_sapiens__NP_001798
augcugaccaugggccgccuccagcuggugguccuggggcucaccugcugcugggccguggccagcgcggccaagcugggcgccguguacacggaggggggcuucgucgagggggugaacaagaagcugggccuccugggcgacuccguggacaucuucaaggggauccccuucgccgccccgaccaaggcgcuggagaacccccagccccaccccggcuggcaggggacccucaaggccaagaacuucaagaagcggugccugcaggccaccaucacgcaggacagcaccuacggcgacgaggacugccuguaccucaacaucugggucccgcaggggcgcaagcaggugucccgggaccugcccgugaugaucuggaucuacggcggcgccuuccugauggggagcggccacggggcgaacuuccucaacaacuaccuguacgacggcgaggagaucgccacccgcggcaacgucaucguggugaccuucaacuaccgggucgggccccugggcuuccucuccacgggggacgccaaccugcccggcaacuacgggcugcgcgaccagcacauggccaucgccugggugaagcggaacaucgcggccuucggcggcgacccgaacaacaucacccucuucggggagagcgccggcggggccuccgugagccugcagacccugucccccuacaacaagggccucauccgccgggccaucagccaguccggggucgcgcugagccccugggugauccagaagaacccccuguucugggccaagaagguggccgagaaggucggcugcccggugggcgacgccgcccgcauggcgcagugccucaaggugaccgacccccgggcccugacgcuggccuacaaggucccccucgccgggcuggaguaccccaugcugcacuacgugggcuucgugccggucaucgacggggacuucauccccgccgaccccaucaaccucuacgcgaacgccgccgacaucgacuacaucgccggcaccaacaacauggacgggcacaucuucgcguccaucgacaugcccgccaucaacaagggcaacaagaaggugaccgaggaggacuucuacaagcuggucagcgaguucaccaucacgaagggccugcgcggggccaagaccaccuucgacguguacaccgaguccugggcccaggacccgagccaggagaacaagaagaagacgguggucgacuucgagaccgacgugcucuuccuggugcccaccgagaucgcccuggcgcagcaccgggccaacgccaaguccgccaagaccuacgccuaccucuucagccaccccucccgcaugcccgucuacccgaagugggugggcgcggaccacgccgacgacauccaguacguguucgggaagcccuucgccacgcccaccggcuaccggccccaggaccgcaccgucagcaaggccaugaucgccuacuggaccaacuucgcgaagacgggcgacccgaacaugggggacagcgccgugcccacccacugggagcccuacaccaccgagaacuccggcuaccuggagaucacgaagaagauggggagcuccagcaugaagcggucccugcgcaccaacuuccuccgguacuggacccugaccuaccuggcccucccgacggugaccgaccaggaggccacccccgucccccccaccggcgacagcgaggcgaccccggugccccccacgggggacuccgagaccgcccccgugccgcccaccggcgacagcggcgccccccccgucccgcccaccggggacuccggcgccccccccgugccgcccacgggggacagcggcgccccccccgugccgcccaccggggacuccggcgcgccccccgucccgcccaccggcgacagcggggcccccccggugccccccaccggcgacuccggggcccccccggugccccccacgggcgacagcggggcccccccggucccccccaccggcgacuccggcgcccccccggugccccccaccggggacgcgggccccccgcccgugccccccaccggggacagcggcgccccgcccgucccccccacgggggacuccggcgccccgcccgugacccccaccggcgacagcgagaccgcccccgugccgcccacgggggacuccggcgcccccccggucccccccaccggggacagcgaggcggcccccgugccgcccaccgacgacagcaaggaggcccagaugcccgccgugauccgcuucuga

SEQ ID NO: 28120 - RNA, 9045 nt, Artificial Sequence
  derived and/or modified sequence opt1 from CELSR1__Homo_sapiens__NP_055061
auggcccccccgcccccccccgugcugccgguccuccugcugcucgccgcggccgccgcccugcccgccaugggccugcgcgcggccgccugggagccccgggugcccgggggcacccgcgccuucgcgcuccggccggggugcaccuacgccgugggcgccgccugcacgccccgcgccccccgggagcugcuggacgucgggcgcgacggccggcucgcgggccgccggcgcgugagcggggccggccggccccugccgcugcaggugcgccucgucgcccgguccgcccccaccgcccugagccgccggcugcgcgcgcggacccaccuccccgggugcggcgcccgcgcccggcugugcgggaccggcgcccgccugugcggcgcccucugcuuccccgugccggggggcugcgcggccgcccagcacuccgcccuggccgcgcccacgacccugcccgccugccggugccccccgcgcccccgcccccggugccccgggcgcccgaucugccucccccccggcggcagcgugcggcugcgccugcucugcgcccugcggcgcgccgcgggggccguccgggugggccuggcccucgaggccgccaccgcggggacccccuccgccagcccgucccccagccccccgcugccccccaaccugcccgaggcccgcgccggcccggcccggcgcgcgcggcgcgggacguccggccggggcagccucaaguuccccaugcccaacuaccagguggcccuguucgagaacgagcccgccgggacccugauccuccagcugcacgcccacuacaccaucgagggcgaggaggagcgcgucuccuacuacauggaggggcuguucgacgagcggagccgcggcuacuuccggaucgacuccgccaccggggcggugagcacggacuccgugcucgaccgcgagaccaaggagacccacguccugcgggugaaggccguggacuacagcaccccgccccgcuccgccacgaccuacaucaccguccuggugaaggacaccaacgaccacagccccguguucgagcaguccgaguaccgcgagcggguccgcgagaaccucgaggugggcuacgaggugcugacgauccgggccagcgaccgcgacagccccaucaacgcgaaccugcgguaccgcguccucggcggggccugggacguguuccagcugaacgaguccagcggcgucguguccacccgggccgugcuggaccgcgaggaggccgccgaguaccagcuccuggucgaggcgaacgaccaggggcggaacccgggcccccugagcgccaccgccaccguguacaucgagguggaggacgagaacgacaacuacccccaguucuccgagcagaacuacgucgugcaggugcccgaggacgucgggcucaacacggccgugcugcgcgugcaggccaccgaccgggaccagggccagaacgcggccauccacuacagcauccuguccggcaacgucgccgggcaguucuaccugcacagccucuccggcauccuggacgugaucaacccgcuggacuucgaggacgugcagaaguacagccucuccaucaaggcccaggacgggggccgccccccccugaucaacagcuccggcgucgugagcgugcagguccuggacgugaacgacaacgagcccaucuucguguccagcccguuccaggccaccguccucgagaacgugccccugggguaccccgugguccacauccaggcgguggacgccgacuccggcgagaacgcccggcugcacuaccgccucguggacaccgccagcacguuccuggggggcggguccgcgggccccaagaacccggcccccacccccgacuucccguuccagauccacaacagcagcggcuggaucaccgucugcgccgagcuggaccgggaggagguggagcacuacuccuucgggguggaggccgucgaccacggcagcccccccauguccagcuccaccagcguguccaucacggugcucgacgucaacgacaacgaccccguguucacccagccgaccuacgagcugcgccugaacgaggacgccgcgguggggagcuccguccucacccugcaggcccgggaccgcgacgccaacagcgugaucacguaccagcugaccggcgggaacacccggaaccgcuucgcccucuccagccagcggggcggcgggcugaucacccuggcccucccccuggacuacaagcaggagcagcaguacgugcuggcggucaccgccuccgacggcacgcgcagccacaccgcccacgugcucaucaacgugaccgacgccaacacccaccgccccgucuuccaguccagccacuacacgguguccgugagcgaggaccggcccgucgggaccagcaucgccacccuguccgcgaacgacgaggacaccggcgagaacgcccgcaucacguacgugauccaggacccggugccccaguuccggaucgaccccgacagcgggaccauguacaccaugauggagcuggacuacgagaaccaggucgccuacacccucacgaucauggcccaggacaacggcaucccccagaaguccgacaccaccacccuggagauccugauccucgacgccaacgacaacgcgccgcaguuccugugggacuucuaccagggcagcaucuucgaggacgccccccccuccacgagcauccugcagguguccgccaccgaccgcgacagcgggcccaacggccggcuccuguacaccuuccaggggggcgacgacggggacggcgacuucuacaucgagccgaccuccggcgugauccgcacgcagcggcgccuggaccgggagaacgucgccguguacaaccucugggcgcuggccgucgaccgcgggagccccaccccccuguccgccagcguggagauccaggugaccauccucgacaucaacgacaacgcccccauguucgagaaggacgagcuggagcuguucgucgaggagaacaacccggugggcuccguggucgccaagauccgggcgaacgaccccgacgaggggcccaacgcccagaucauguaccagaucguggagggcgacaugcgccacuucuuccagcucgaccugcugaacggcgaccuccgggccaugguggagcuggacuucgagguccgccgggaguacgugcuggugguccaggccaccagcgccccccucgugucccgcgcgacggugcacauccugcuggucgaccagaacgacaacccgcccgugcuccccgacuuccagauccuguucaacaacuacgugaccaacaagagcaacuccuuccccaccggggucaucggcugcaucccggcccacgaccccgacgugagcgacucccugaacuacaccuucgugcaggggaacgagcuccggcugcugcuccuggaccccgccacgggcgagcugcagcucagccgcgaccuggacaacaaccggccgcuggaggcccucauggaggucagcguguccgacgggauccacagcgugaccgccuucugcacccugcgcgucaccaucaucacggacgacaugcugaccaacuccaucaccgugcgccucgagaacaugagccaggagaaguuccuguccccccugcucgcgcuguucguggagggcgucgccgccgugcugagcaccacgaaggacgacguguucgucuucaacgugcagaacgacaccgacguguccagcaacauccucaacgucaccuucuccgcccugcugcccggcggggugcggggccaguucuuccccagcgaggaccuccaggagcagaucuaccugaaccgcacccugcucaccacgaucuccacccagcgggugcugccguucgacgacaacaucugccugcgcgagcccugcgagaacuacaugaagugcgucagcgugcuccgguucgacuccagcgcgcccuuccuguccagcaccaccgugcuguuccgccccauccacccgaucaacgggcuccggugccgcugcccccccggcuucacgggggacuacugcgagaccgagaucgaccugugcuacuccgaccccugcggcgccaacggccggugccgcagccgggaggggggcuacaccugcgagugcuucgaggacuucaccggggagcacugcgaggucgacgcccgcuccggccggugcgccaacggggugugcaagaacggcggcacgugcgugaaccugcucaucgggggcuuccacugcgucugcccgcccggggaguacgagcgccccuacugcgaggugaccacccggagcuuccccccgcagagcuucgugaccuuccgcggccugcggcagcgcuuccacuucacgaucucccugaccuucgccacccaggagcggaacggccuccugcuguacaacgggcgcuucaacgagaagcacgacuucaucgcgcucgagaucgucgacgagcaggugcagcugaccuucagcgccggcgagacgaccaccaccguggcccccaagguccccuccggggugagcgacggccgguggcacuccgugcagguccaguacuacaacaagcccaacaucgggcaccugggccugccgcacggccccagcggggagaagauggccguggucacgguggacgacugcgacaccaccauggccgugcgcuucggcaaggacaucgggaacuacuccugcgcggcccagggcacccagacggggagcaagaagucccucgaccugaccggcccccugcuccugggcgggguccccaaccugccggaggacuuccccgugcacaaccgccaguucgugggcugcaugcggaaccucagcgucgacgggaagaacguggacauggccggcuucaucgccaacaacgggacccgcgagggcugcgccgcgcggcgcaacuucugcgacggccggcgcugccagaacgggggcaccugcgugaaccgguggaacauguaccugugcgagugcccccugcgcuucgggggcaagaacugcgagcaggccaugccccacccgcagcucuucuccggggagagcgucguguccuggagcgaccugaacaucaucaucuccgugcccugguaccugggccucauguuccggacgcgcaaggaggacagcguccugauggaggccaccuccggcgggcccaccagcuuccggcugcagauccucaacaacuaccugcaguucgaggugucccacggcccgagcgacguggagagcgucaugcuguccgggcuccgcgugaccgacggcgaguggcaccaccugcugaucgagcucaagaacgugaaggaggacagcgagaugaagcaccuggucacgaugacccuggacuacggcauggaccagaacaaggccgacaucgggggcaugcuccccgggcugaccgugcgguccguggucgugggcggggcgagcgaggacaagguguccguccgccggggcuuccgcggcugcaugcagggggugcggaugggcgggacccccacgaacguggccacccugaacaugaacaacgcccucaagguccgcgugaaggacggcugcgacguggacgaccccugcaccagcuccccgugcccccccaacagccggugccacgacgccugggaggacuacuccugcgucugcgacaagggguaccugggcaucaacugcguggacgccugccaccugaaccccugcgagaacaugggcgcgugcgugcgcagcccgggguccccccagggcuacgucugcgagugcgggcccagccacuacggccccuacugcgagaacaagcucgaccugccgugcccccgcgggugguggggcaaccccgugugcggccccugccacugcgccguguccaagggguucgacccggacugcaacaagaccaacggccagugccagugcaaggagaacuacuacaagcugcucgcccaggacaccugccugcccugcgacugcuucccccacgggagccacucccggacgugcgacauggccaccggccagugcgccugcaagcccggggucaucggccgccagugcaaccggugcgacaacccguucgcggaggugaccacccugggcugcgaggugaucuacaacgggugccccaaggccuucgaggccggcaucugguggccccagacgaaguucgggcagcccgccgccgucccgugccccaagggcagcgugggcaacgcggugcgccacugcuccggggagaagggcuggcuccccccggagcuguucaacugcaccaccaucagcuucgucgaccugcgggccaugaacgagaagcucucccgcaacgagacccagguggacggggcccgggcccugcagcuggugcgcgcccuccggagcgcgacgcagcacaccggcacccuguucgggaacgacguccgcaccgccuaccagcugcucggccacgugcugcagcacgagagcuggcagcagggcuucgaccuggccgccacgcaggacgcggacuuccacgaggacgugauccacuccgggagcgcccuccuggcccccgccacccgggccgcgugggagcagauccagcgcuccgagggcgggaccgcccagcugcuccggcgccuggagggcuacuucagcaacgucgcccggaacgugcgccggaccuaccugcgccccuucgugaucgucacggccaacaugauccucgccguggacaucuucgacaaguucaacuucaccggggcgcgggucccccgcuucgacaccauccacgaggaguucccgcgggagcuggaguccagcguguccuuccccgccgacuucuuccgcccccccgaggagaaggagggcccgcugcuccgccccgccggccggcgcaccacgccccagaccacccggcccgggccgggcaccgagcgcgaggcccccaucagccggcgccggcgccaccccgacgacgccgggcaguucgcgguggcccuggucaucaucuaccggacgcugggccagcuccugcccgagcgcuacgacccggaccggcgcucccugcggcucccccaccgccccaucaucaacacccccauggugagcacccugguguacuccgagggggccccgcugccccggccccucgagcgccccguccugguggaguucgcccugcucgagguggaggagcggaccaagccggucugcguguucuggaaccacagccuggcggugggcggcacggggggcugguccgcccgcgggugcgagcugcucagccggaaccgcacccacgucgccugccagugcucccacaccgccagcuucgccgugcugauggacaucucccgccgggagaacggcgaggugcugccccucaagaucgucaccuacgcggccgugagccugucccuggccgcccuccugguggccuucguccugcucagccuggugcgcaugcugcggagcaaccuccacuccauccacaagcaccuggcgguggcccuguuccucagccagcuggucuucgugaucggcaucaaccagacggagaaccccuuccugugcaccguggucgccauccuccugcacuacaucuacauguccaccuucgccuggacccugguggagagccuccacguguaccgcaugcugacggagguccggaacaucgacaccgggcccaugcgcuucuacuacguggugggcugggggaucccggccaucgucaccggccuggcgguggggcucgacccccagggcuacggcaaccccgacuucugcuggcugucccugcaggacacccucaucuggagcuucgccgggccgaucggcgccgugaucaucaucaacacggucaccuccgugcugagcgccaagguguccugccagcggaagcaccacuacuacgggaagaagggcaucgucagccugcugcgcaccgcguuccuccugcugcuccugaucuccgccaccuggcugcucgggcugcuggccgugaaccgggacgcccucagcuuccacuaccuguucgccaucuucuccggccugcagggccccuucgugcuccuguuccacugcguccugaaccaggaggugcgcaagcaccucaagggggugcugggcgggcggaagcugcaccucgaggacagcgcgaccacgcgcgccacccugcugacccggucccucaacugcaacaccacguucggcgacgggcccgacaugcugcgcaccgaccugggcgagagcaccgccucccucgacagcaucguccgggacgagggcauccagaagcugggggugagcuccggccuggugcgcgggagccacggcgagcccgacgccucccucaugccgcggagcugcaaggacccccccgggcacgacuccgacagcgacuccgagcugagccuggacgagcaguccagcuccuacgccagcucccacagcuccgacagcgaggacgacggcgucggcgcggaggagaagugggaccccgcccgcggggccgugcacuccaccccgaagggcgacgccguggccaaccacguccccgcgggguggcccgaccagagccucgccgaguccgacagcgaggaccccagcggcaagccgcggcugaagguggagacgaagguguccgucgagcugcaccgcgaggagcagggcagccaccggggggaguacccccccgaccaggaguccggcggggccgcccgccucgccagcucccagcccccggagcagcgcaagggcauccugaagaacaaggugaccuacccccccccccugacccucaccgagcagacgcugaaggggcggcugcgcgagaagcucgcggacugcgagcagagcccgaccuccagccggaccuccagccugggcuccggcgggcccgacugcgccaucaccgucaagagccccggccgcgagcccgggcgggaccaccugaacggcguggccaugaacgugcgcacgggguccgcccaggcggacggcagcgacuccgagaagccguga

SEQ ID NO: 28121 - RNA, 9939 nt, Artificial Sequence
  derived and/or modified sequence opt1 from CELSR3__Homo_sapiens__NP_001398
augauggcccgccggccgcccuggcgcggccucggcgggcgguccacccccauccuccugcugcuccugcugucccucuucccccugagccaggaggagcucgggggcgggggccaccagggcugggaccccgggcuggccgccaccaccggcccccgcgcccacaucgggggcggggcccuggcccugugccccgaguccuccggcgugcgggaggacggcgggcccggccucgggguccgcgagcccaucuucgugggccugcggggccgccggcaguccgcccgcaacagccgggggccgcccgagcagcccaacgaggagcugggcaucgagcacggggugcagccccucggcucccgcgagcgggagaccgggcagggccccggcagcguccuguacuggcgccccgagguguccagcugcgggcggaccggcccccugcagcgcgggucccucagccccggcgcccuguccagcggggugcccggcuccggcaacagcagcccccuccccagcgacuuccucauccggcaccacgggcccaagcccgucuccagccagcgcaacgccggcaccgggagccggaagcgcgugggcaccgcccggugcugcggggagcugugggccaccggcuccaagggccagggggagcgcgccaccaccagcggcgccgagcgcaccgcgccccggcgcaacugccugcccggggccuccggcagcggccccgagcucgacuccgccccgcggaccgcccgcaccgcccccgccagcggguccgcgccccgggagagccgcaccgcccccgagccggcccccaagcggaugcgcucccggggccuguuccgcugccgguuccugccccagcgcccggggccccggccgcccggccucccggcccgccccgaggcccggaaggugaccagcgccaaccgcgcccgguuccgccgggccgccaaccgccacccccaguucccccaguacaacuaccagacccuggucccggagaacgaggccgccgggaccgccgugcugcgcguggucgcccaggaccccgacgccggcgaggccggccggcucguguacucccuggccgcccugaugaacagccgcucccucgagcuguucagcaucgacccccaguccgggcugauccggaccgccgccgcccucgaccgcgagagcauggagcggcacuaccugcgcgugaccgcccaggaccacggcagcccccggcugagcgccaccaccauggucgccgugaccguggccgaccgcaacgaccacuccccggucuucgagcaggcccaguaccgggagacgcuccgcgagaacguggaggagggguaccccauccugcagcugcgggccaccgacggcgacgccccgcccaacgccaaccuccgcuaccgguucguggggccgcccgccgcccgcgccgcggccgccgccgccuucgagaucgacccccggagcggccugaucagcaccuccggccgcgucgaccgggagcacauggagagcuacgagcuggugguggaggccuccgaccaggggcaggagcccggcccgcgcagcgccaccguccgggugcacaucacgguccucgacgagaacgacaacgcgccccaguucuccgagaagcgcuacguggcccaggugcgggaggacguccgcccccacaccguggugcugcgcgucaccgcgaccgaccgggacaaggacgccaacgggcuggugcacuacaacaucaucagcggcaacucccgcgggcacuucgccaucgacagccucacgggcgagauccagguggucgcgccccuggacuucgaggccgagcgggaguacgcgcugcgcauccgggcccaggacgccggccgcccgccccuguccaacaacaccgggcucgccagcauccaggugguggacaucaacgaccacauccccaucuucgucuccaccccguuccaggugagcgugcuggagaacgcgccccugggccacuccgucauccacauccaggcgguggacgccgaccacggggagaacgcccggcucgaguacagccugaccggcguggcccccgacacgcccuucgucaucaacuccgcgaccgggugggugagcguguccggcccgcuggaccgcgagagcgucgagcacuacuucuucggcguggaggcccgggaccacggguccccgccccuguccgccagcgccuccgugaccgucaccgugcuggacgugaacgacaaccgccccgaguucacgaugaaggaguaccaccuccggcucaacgaggacgccgcggucggcaccagcgugguguccgucaccgccguggaccgcgacgccaacagcgccaucuccuaccagaucaccgggggcaacacccggaaccgcuucgccaucagcacgcagggcggggugggccuggucacccuggcgcucccgcuggacuacaagcaggagcgguacuucaagcuggugcucaccgccuccgaccgcgcccugcacgaccacugcuacgugcacaucaacaucaccgacgccaacacgcaccggcccgucuuccagagcgcccacuacuccgugagcgugaacgaggaccgccccaugggguccaccaucgucgugaucagcgcguccgacgacgacgugggcgagaacgcccggaucaccuaccugcucgaggacaaccugccccaguuccgcaucgacgccgacagcggggccaucacccugcaggccccgcucgacuacgaggaccaggucacguacacccuggcgaucaccgcccgcgacaacggcaucccccagaaggccgacaccacguacguggaggugauggucaacgacgugaacgacaacgcgccccaguucguggcgucccacuacaccggccuggucagcgaggacgcgccgcccuucaccuccgugcuccagaucagcgccaccgaccgggacgcccacgccaacgggcgcgugcaguacacguuccagaacggcgaggacggggacggcgacuucaccaucgagcccaccagcgggaucguccggaccgugcgccggcuggaccgcgaggcggucuccguguacgagcugacggccuacgccguggaccggggcgugccgccccugcgcacccccgugagcauccaggugaugguccaggacgugaacgacaacgcccccguguuccccgccgaggaguucgagguccgggugaaggagaacuccaucgugggcagcgucguggcgcagaucaccgccguggaccccgacgaggggccgaacgcccacaucauguaccagaucgucgagggcaacauccccgagcuguuccagauggacaucuucuccggggagcugaccgcccucaucgaccuggacuacgaggcccgccaggaguacgugaucgugguccaggcgacgagcgcgccccuggugucccgggccaccgugcacguccgccucguggaccagaacgacaacagccccgugcugaacaacuuccagauccuguucaacaacuacgucuccaaccggagcgacaccuucccguccggcaucaucgggcgcauccccgccuacgaccccgacgugagcgaccaccucuucuacuccuucgagcggggcaacgagcugcagcugcucguggucaaccagaccagcggcgagcugcgccugucccggaagcucgacaacaaccgcccgcugguggcgagcaugcuggugacggucaccgacgggcuccacuccgugaccgcccagugcgugcugcgggucgugaucaucaccgaggagcugcucgccaacagccugacggugcgccuggagaacauguggcaggagcgguuccucagcccccugcugggccgcuuccucgagggggucgccgccgugcuggcgacccccgccgaggacguguucaucuucaacauccagaacgacaccgacgucggcggcaccgugcugaacgugagcuucagcgcccucgcgccccgcggggccggcgcgggggccgccggcccgugguucuccagcgaggagcugcaggagcagcuguacguccggcgggccgcccucgcggcccggucccugcuggacgugcuccccuucgacgacaacgugugccugcgcgagcccugcgagaacuacaugaagugcgucagcgugcugcgguucgacuccagcgcccccuuccucgccuccgcgagcacgcuguuccgcccgauccagcccaucgccgggcugcggugccgcugcccgcccggcuucaccggcgacuucugcgagaccgagcucgaccugugcuacuccaacccgugccggaacgggggcgccugcgcccgccgggagggcggcuacacgugcgugugccgcccccgguucaccggggaggacugcgagcuggacacggaggccggccgcugcguccccggcgugugccggaacggcgggaccugcaccgacgcgcccaacggcggguuccgcugccagugcccggccggcggggccuucgaggggccccggugcgagguggccgcccgcagcuucccgcccuccagcuucgucauguuccgggggcuccgccagcgcuuccaccugacccugucccucagcuucgcgacggugcagcaguccggccugcuguucuacaacgggcggcucaacgagaagcacgacuuccuggcccuggagcucgucgccggccaggugcgccugaccuacagcaccggggaguccaacaccguggucagcccgacggugcccggcggccuguccgacgggcaguggcacaccgugcaccuccgguacuacaacaagccccgcaccgacgcccugggcggggcccagggccccagcaaggacaaggucgcggugcugagcguggacgacugcgacgucgccguggcccuccaguucggcgccgagaucgggaacuacuccugcgccgcggccggcgugcagaccagcuccaagaagucccuggaccugacggggccgcuccugcugggcgggguccccaaccuccccgagaacuuccccgugucccacaaggacuucaucggcugcaugcgggaccugcacaucgacggccgccggguggacauggccgccuucgucgcgaacaacgggaccauggccggcugccaggccaagcugcacuucugcgacagcgggccgugcaagaacuccggcuucugcagcgagcgcuggggguccuucagcugcgacugccccgugggcuucggcgggaaggacugccagcugaccauggcccacccccaccacuuccggggcaacgggacccucuccuggaacuucggcagcgacauggccguguccgucccgugguaccuggggcuggcguuccgcacgcgggccacccagggcgugcucaugcagguccaggccggcccccacagcacccugcugugccagcucgaccgcgggcugcuguccgucaccgugacgcggggcagcgggcgcgccucccaccuccugcuggaccaggugaccgucagcgacggccgguggcacgaccuccgccuggagcugcaggaggagcccgggggccggcgcggccaccacgugcucauggugucccuggacuucagccuguuccaggacaccauggccgucgggagcgagcuccagggccugaaggugaagcagcugcacgucgggggccugccgcccggcuccgcggaggaggcgccccaggggcuggucggcugcauccaggggguguggcugggcagcacccccuccgggagccccgcccuccugccgcccucccaccgggugaacgccgagcccggcugcgucgugacgaacgccugcgcgagcggccccugcccgccccacgccgacugccgcgaccuguggcagaccuucuccugcacgugccagcccggguacuacggccccgggugcguggacgccugccuccugaaccccugccagaaccagggcagcugccggcaccuccccggggcgccccacggcuacacgugcgacugcgucggcggguacuucggccaccacugcgagcaccgcauggaccagcagugcccccgcgggugguggggcuccccgacgugcgggcccugcaacugcgacgugcacaagggcuucgaccccaacugcaacaagaccaacggccagugccacugcaaggaguuccacuaccggccccgcgggagcgacuccugccucccgugcgacugcuaccccgugggcagcaccucccggagcugcgcgccccacuccgggcagugcccgugccgccccggcgcccugggccggcagugcaacagcugcgacucccccuucgccgaggucaccgccagcgggugccgcgugcuguacgacgccugccccaagucccuccggagcggcgugugguggccgcagacgaaguucgggguccuggcgaccgugcccugcccccgcggcgcccugggggccgccgugcggcucugcgacgaggcccagggcuggcuggagcccgaccuguucaacugcaccagcccggcguuccgcgagcucucccugcugcucgacggccuggagcugaacaagaccgcccucgacacgauggaggccaagaagcuggcccagcggcugcgcgaggucaccgggcacaccgaccacuacuucagccaggacgugcgggugaccgcccgccuccuggcgcaccuccuggccuucgagucccaccagcagggcuucgggcugaccgccacgcaggacgcccacuucaacgagaaccugcugugggcgggcagcgcccugcuggcccccgagaccggggaccucugggccgcccugggccagcgggcgcccggcgggucccccggcagcgccgggcugguccgccaccucgaggaguacgccgccacccuggcccggaacauggagcugaccuaccucaacccgaugggccuggugacgcccaacaucaugcuguccaucgaccgcauggagcaccccagcagcccccgcggggcccggcgcuacccgcgguaccacagcaaccucuuccgcggccaggacgccugggacccccacacccacgugcugcugcccucccagagcccccggccgucccccagcgagguccuccccaccuccagcuccaucgagaacagcaccacgagcuccguggugcccccgcccgcgccgcccgagcccgagcccggcaucagcaucaucauccugcugguguaccgcacccucgggggccugcugcccgcccaguuccaggccgagcggcgcggggcgcggcucccgcagaaccccgugaugaacucccccgucgugagcguggccgucuuccacggccgcaacuuccugcgggggauccuggagucccccaucagccucgaguuccgccugcugcagaccgccaaccgguccaaggccaucugcgugcagugggacccgcccggccucgccgagcagcacggcguguggaccgcgcgcgacugcgagcugguccaccggaacgggagccacgcccgcugccggugcucccgcacgggcaccuucggggugcugauggacgccagcccccgggagcgccucgagggcgaccuggagcugcucgccguguucacccacgucgugguggcggucuccguggccgcccuggugcugaccgccgccauccuccugagccugcggucccucaagagcaacguccgcggcauccacgcgaacguggccgccgcccuggggguggccgagcuccucuuccugcugggcauccaccggacgcacaaccagcucgucugcaccgcgguggccauccugcugcacuacuucuuccuguccaccuucgccuggcuguucgugcaggggcugcaccuguaccgcaugcaggucgagccccgcaacguggaccggggcgccaugcgcuucuaccacgcccucggguggggcgugccggcgguccugcugggccucgccguggggcuggaccccgagggcuacgggaaccccgacuucugcuggaucagcgugcacgagccccugaucugguccuucgccggcccggucgugcucgugaucgucaugaacgggaccauguuccugcuggccgcgcggacgagcugcuccaccggccagcgcgaggccaagaagaccagcgcccucacccugcggagcuccuuccugcuccugcugcucgugagcgccuccuggcuguucggccugcucgccgugaaccacagcauccuggcguuccacuaccugcacgccgggcucugcggccugcaggggcuggccguccuccugcuguucugcgugcucaacgccgacgcccgcgcggccuggaugcccgccugccugggccggaaggccgcccccgaggaggcgcgccccgccccggggcugggccccggcgccuacaacaacacggcccucuucgaggaguccgggcugauccggaucacccugggcgccagcaccguguccagcgucuccagcgcgcgcuccgggcggacccaggaccaggacagccagcgcggccgguccuaccuccgcgacaacgugcuggugcggcacggcagcgccgccgaccacacggaccacucccugcaggcccacgcggggcccaccgaccucgacgucgccauguuccaccgcgacgccggcgccgacagcgacuccgacagcgaccugucccuggaggaggagcggagccucagcauccccuccagcgaguccgaggacaacgggcgcacccggggccgcuuccagcgcccgcugugccgggccgcgcagagcgagcgccugcucacccaccccaaggacguggacgggaacgaccugcuguccuacuggcccgcccucggcgagugcgaggccgcccccugcgcccugcagacguggggcagcgagcggcgccuggggcucgacaccuccaaggacgcggccaacaacaaccagccggaccccgcccugaccagcggcgacgagaccucccuggggcgggcccagcgccagcggaagggcauccucaagaaccgccugcaguacccccuggugccccagacgcgcggggccccggagcucagcuggugccgcgcggccacccugggccaccgggccguccccgccgcguccuacggccgcaucuacgccgggggcgggaccggcagccugucccagcccgccagccgguacuccagccgcgagcagcucgaccugcugcuccggcgccagcugucccgggagcgccuggaggaggccccggcccccgugcuccggccccugagccgccccgggucccaggagugcauggacgcggccccgggccggcuggagcccaaggaccgcggcagcacccucccccgccggcagcccccgcgcgacuaccccggggccauggccggccgguucgggagccgcgacgcccuggaccugggcgcgccccgggaguggcucuccacgcugcccccgccccgccggacccgcgaccuggacccccagcccccgccccucccccugagcccccagcggcagcugucccgcgacccgcuccugcccagccggccccuggacucccucagccgcuccagcaacucccgggagcagcuggaccaggugcccagccgccacccgucccgggaggcccuggggccccucccccagcugcugcgcgcccgggaggacagcgucuccggccccagccacggcccguccaccgagcagcucgacauccugagcuccauccuggccagcuucaacuccagcgcccucagcuccgugcagagcuccagcacgccccuggggccccacaccacggcgaccccguccgccaccgccagcgugcugggccccuccacgccccgcagcgccacgucccacagcaucuccgagcucagccccgacuccgaggucccgcggagcgaggggcacuccuga

SEQ ID NO: 28122 - RNA, 4086 nt, Artificial Sequence
  derived and/or modified sequence opt1 from CEMIP__Homo_sapiens__NP_001280227
augggcgccgccgggcgccaggacuuccuguucaaggcgaugcucaccaucagcuggcugacccugacgugcuuccccggcgccaccuccaccguggccgccgggugcccggaccagagccccgagcuccagcccuggaaccccggccacgaccaggaccaccacguccacaucgggcagggcaagacccugcugcucacguccagcgccaccguguacuccauccacaucagcgagggcgggaagcuggugaucaaggaccacgacgagccgaucguccugcggacccgccacauccucaucgacaacggcggggagcugcacgcgggcuccgcccugugccccuuccaggggaacuucaccaucauccucuacggccgggccgacgagggcauccagcccgaccccuacuacgggcugaaguacaucggcguggggaagggcggcgcccuggagcuccacgggcagaagaagcugagcuggacguuccugaacaagacccuccacccgggcgggauggcggagggcggguacuucuucgagcgcuccuggggccaccggggcgugaucguccacgugaucgaccccaagagcgggaccgugauccacuccgaccgcuucgacaccuaccggagcaagaaggaguccgagcgccugguccaguaccugaacgccgugcccgacggccggauccucagcguggccgucaacgacgaggggucccgcaaccuggacgacauggcccggaaggccaugacgaagcugggcagcaagcacuuccuccaccugggguuccgccaccccugguccuuccugaccgugaagggcaacccgagcuccagcguggaggaccacaucgaguaccacggccaccgggggagcgcggccgcccgcgucuucaagcuguuccagaccgagcacggcgaguacuucaacgugucccugagcuccgagugggugcaggacgucgaguggaccgagugguucgaccacgacaaggugagccagacgaagggcggggagaagaucuccgaccuguggaaggcccaccccgggaagaucugcaaccggcccaucgacauccaggccaccaccauggacggcgugaaccucagcaccgaggucguguacaagaagggccaggacuaccgcuucgcgugcuacgaccgggggcgcgccugccgguccuaccgcgugcgguuccugugcggcaagcccguccgcccgaagcugacggugaccaucgacaccaacgucaacagcaccauccucaaccuggaggacaacgugcaguccuggaagcccggggacacgcuggugaucgccagcaccgacuacuccauguaccaggccgaggaguuccagguccuccccugccgcagcugcgcccccaaccaggugaagguggcgggcaagccgauguaccugcacaucggcgaggagaucgacggggucgacaugcgggccgaggugggccugcucucccgcaacaucaucgugaugggggagauggaggacaagugcuaccccuaccggaaccacaucugcaacuucuucgacuucgacaccuucggcgggcacaucaaguucgcccugggcuucaaggccgcccaccuggagggcaccgagcucaagcacauggggcagcagcuggucggccaguaccccauccacuuccaccuggcgggggacguggacgagcgcggcggguacgacccgcccacguacauccgggaccucagcauccaccacaccuucucccgcugcgugaccguccacggcagcaacggccugcugaucaaggacguggugggguacaacucccucggccacugcuucuucaccgaggacgggcccgaggagcggaacacguucgaccacugccugggccugcuggucaagagcgggacccuccugcccuccgaccgcgacagcaagaugugcaagaugaucaccgaggacagcuaccccggcuacaucccgaagccccggcaggacugcaacgccguguccaccuucuggauggccaaccccaacaacaaccugaucaacugcgccgcggccggcagcgaggagacgggguucugguucaucuuccaccacgugccgaccggccccuccgucgggauguacagccccggcuacuccgagcacaucccccucgggaaguucuacaacaaccgcgcccacagcaacuaccgggccggcaugaucaucgacaacggcgugaagaccaccgaggccuccgcgaaggacaagcgcccguuccugagcaucaucuccgcccgguacagcccccaccaggacgccgacccccugaagccccgcgagccggccaucauccggcacuucaucgccuacaagaaccaggaccacggggcguggcuccgcggcggggacguguggcuggacuccugccgguucgccgacaacggcaucggccugacccucgccagcgggggcacguuccccuacgacgacggguccaagcaggagaucaagaacagccuguucgucggcgaguccgggaacgugggcaccgagaugauggacaaccgcaucuggggccccgggggccuggaccacagcgggcggacccuccccaucggccagaacuucccgauccgcgggauccagcuguacgacggccccaucaacauccagaacugcaccuuccgcaaguucguggcccuggagggccggcacacguccgcccucgcguuccgccugaacaacgccuggcagagcugcccccacaacaacgucaccgggaucgccuucgaggacgugcccaucaccagccggguguucuucggcgagccggggcccugguucaaccagcuggacauggacggcgacaagaccuccgucuuccacgacguggacgggagcguguccgaguaccccggcagcuaccucacgaagaacgacaacuggcugguccgccaccccgacugcaucaacgugccggacuggcggggcgccaucugcuccgggugcuacgcgcagauguacauccaggccuacaagaccagcaaccugcgcaugaagaucaucaagaacgacuuccccucccacccccucuaccuggagggcgcccugacccggagcacccacuaccagcaguaccagcccguggucacgcuccagaagggguacaccauccacugggaccagaccgccccggccgagcuggcgaucuggcugaucaacuucaacaagggcgacuggauccgcgugggccucugcuacccccgggggaccacguucuccauccugagcgacgugcacaaccgccugcucaagcagaccuccaagaccggcgucuucgugcggacccugcagauggacaagguggagcagagcuaccccgggcgcucccacuacuacugggacgaggacagcggccuccucuuccugaagcugaaggcccagaacgagcgggagaaguucgccuucugcuccaugaaggggugcgagcgcaucaagaucaaggcccucaucccgaagaacgccggcgucagcgacugcacggcgaccgccuaccccaaguucaccgagcgggccgugguggacguccccaugcccaagaagcuguucggcucccagcugaagaccaaggaccacuuccucgaggugaagauggagagcuccaagcagcacuucuuccaccuguggaacgacuucgccuacaucgagguggacgggaagaaguacccgagcagcgaggacggcauccaggucguggugaucgacgggaaccagggccgcgucgugucccacacgagcuuccggaacuccauccugcaggggauccccuggcagcuguucaacuacguggccaccauccccgacaacagcaucguccucauggcguccaagggccgcuacgugagccggggccccuggacccgcguccuggagaagcucggggccgaccggggccugaagcugaaggagcagauggccuucgugggguucaagggcuccuuccgcccgaucugggugacccucgacacggaggaccacaaggccaagaucuuccaggucgugcccauccccguggucaagaagaagaagcuguga

SEQ ID NO: 28123 - RNA, 744 nt, Artificial Sequence
  derived and/or modified sequence opt1 from CEMP1__Homo_sapiens__NP_001041677
augggcaccagcuccaccgacagccagcaggccgggcaccgccggugcuccacgagcaacaccuccgccgagaaccugaccugccucagccugcccggcucccccgggaagaccgcgccccugcccggccccgcccaggccggggccggccagccgcuccccaagggcugcgccgcggugaaggccgaggucgggauccccgcgccccacacgagccaggaggugcgcauccacauccggcgccugcuguccugggccgccccgggcgccugcgggcuccggagcacccccugcgcccugccccaggcccugccccaggcccgcccgugccccggccggugguucuuccccgggugcucccuccccaccggcggcgcgcagaccauccugagccuguggacguggcgccacuuccucaacugggcccugcagcagcgggaggagaacuccgggcgcgcccggcgcgugccgcccgucccccggaccgcccccgugagcaagggcgaggggucccacccgccccagaacagcaacggcgagaaggugaagaccaucacccccgacgucggccugcaccagucccucacgagcgaccccaccguggccgugcugcgcgcgaagcgggccccggaggcccacccgccccgcuccugcagcgggagccugaccgcccgggucugccacaugggcgugugccaggggcagggcgacaccgaggacgggcgcaugacgcucaugggcuga

SEQ ID NO: 28124 - RNA, 450 nt, Artificial Sequence
  derived and/or modified sequence opt1 from CEND1__Homo_sapiens__NP_057648
auggagagccgcggcaaguccgccagcucccccaagccggacaccaaggugccccaggucaccacggaggccaaggugccgcccgcggccgacgggaaggcgccccugaccaagcccagcaagaaggaggcccccgccgagaagcagcagcccccggccgcccccaccaccgcccccgccaagaagacguccgcgaaggccgaccccgcccuccugaacaaccacagcaaccugaagccggcccccaccgugcccuccagccccgacgccaccccggagcccaagggccccggggacggcgcggaggaggacgaggccgccuccgggggccccggcgggcggggcccguggagcugcgagaacuucaacccccuccuggucgccgggggcguggccguggcggccaucgcccugauccucggggucgccuuccuggugcgcaagaaguga

SEQ ID NO: 28125 - RNA, 345 nt, Artificial Sequence
  derived and/or modified sequence opt1 from CENPA__Homo_sapiens__NP_001035891
augggcccccgccggcgcagccggaagccggaggcgccccgccggcgcucccccagccccaccccgacccccgggcccucccggcgcggccccagccugggggccuccagccaccagcacucccggcgccggcagggcuggcucaaggagauccgcaagcugcagaaguccacgcaccuccugauccggaagcugccguucagccgccuggccgccgaggccuuccucgugcaccuguucgaggacgccuaccugcucacccugcacgccgggcgggucacccuguuccccaaggacgugcagcucgcgcgccggauccgcggccuggaggagggccugggguga

SEQ ID NO: 28126 - RNA, 1800 nt, Artificial Sequence
  derived and/or modified sequence opt1 from CENPB__Homo_sapiens__NP_001801
augggccccaagcgccggcagcugaccuuccgcgagaagucccggaucauccaggagguggaggagaacccggaccuccgcaagggggagaucgcccggcgcuucaacaucccgcccagcacccugagcacgauccugaagaacaagcgggccauccucgcguccgagcgcaaguacggcgucgccagcacgugccggaagaccaacaagcugucccccuacgacaagcuggaggggcuccugaucgccugguuccagcagauccgcgccgccggccugcccgugaaggggaucauccucaaggagaaggcgcugcggaucgccgaggagcugggcauggacgacuucaccgccagcaacggcuggcucgaccgcuuccggcgccggcacgggguggucuccugcagcggcguggcccgcgcgcgggcccgcaacgccgcgccccggacccccgccgcccccgccuccccggccgccgugcccagcgagggguccggcgggagcaccaccggcuggcgcgcccgggaggagcagccgcccuccgucgcggagggcuacgccagccaggacguguucuccgccaccgagacgagccugugguacgacuuccugcccgaccaggccgccgggcucugcggcggggacggccgcccccgccaggcgacccagcggcuguccgugcugcucugcgccaacgccgacggcagcgagaagcugccgccccuggucgccgggaaguccgccaagccccgcgcgggccaggccgggcuccccugcgacuacaccgccaacagcaagggcggggugaccacgcaggcccuggcgaaguaccugaaggcccucgacacccggauggccgccgagagccgccgggugcugcugcucgccggccgccuggcggcccagucccuggacaccagcggccuccggcacguccagcuggccuucuucccgcccgggaccgugcacccccuggagcgcggcgugguccagcaggucaaggggcacuaccggcaggccaugcuccugaaggccauggcggcccuggagggccaggaccccuccgggcuccagcugggccugacggaggcccuccacuucguggccgccgcguggcaggccguggagcccagcgacaucgccgccugcuuccgcgaggcgggcuucgggggcgggcccaacgccaccaucaccaccucccucaagagcgagggcgaggaggaggaggaggaggaggaggaggaggaggaggaggagggggagggcgaggaggaggaggaggagggcgaggaggaggaggaggagggcggggagggggaggagcugggcgaggaggaggagguggaggaggagggcgacguggacuccgacgaggaggaggaggaggacgaggagagcuccagcgaggggcuggaggccgaggacugggcccagggcgucguggaggccgggggcuccuucggggcguacggcgcccaggaggaggcccagugcccgacgcugcacuuccuggagggcggggaggacagcgacuccgacagcgaggaggaggacgacgaggaggaggacgacgaggacgaggacgacgacgacgacgaggaggacggcgacgaggugcccguccccuccuucggggaggccauggccuacuucgcgauggugaagcgguaccucaccagcuuccccaucgacgaccgcguccagucccacauccugcaccuggagcacgaccucgugcacgugacccggaagaaccacgcccgccaggccggcguccgggggcugggccaccagagcuga

SEQ ID NO: 28127 - RNA, 2832 nt, Artificial Sequence
  derived and/or modified sequence opt1 from CENPC__Homo_sapiens__NP_001803
auggccgccagcggccuggaccaccucaagaacggguaccgccggcgcuucugccggcccucccgcgcgcgggacaucaacaccgagcagggccagaacgugcuggagauccugcaggacugcuucgaggagaagucccucgccaacgacuucagcaccaacagcacgaaguccgucccgaacagcacccgcaagaucaaggacacgugcauccagucccccagcaaggagugccagaagucccaccccaagagcgugcccguguccagcaagaagaaggaggccucccugcaguucgucguggagccgagcgaggccaccaaccgguccgugcaggcccacgagguccaccagaagauccuggcgacggacgugagcuccaagaacacccccgacagcaagaagaucuccagccgcaacaucaacgaccaccacagcgaggccgacgaggaguucuaccucuccguggggagccccuccguccugcuggacgccaagaccagcgugucccagaacgugauccccagcuccgcccagaagcgggagaccuacacguucgagaacagcgucaacaugcucccguccagcaccgagguguccgugaagaccaagaagcgccugaacuucgacgacaaggucaugcugaagaagaucgagaucgacaacaaggugagcgacgaggaggacaagaccuccgagggccaggagcggaagcccagcggguccagccagaaccgcauccgggacuccgaguacgagauccagcgccaggcgaagaaguccuucagcacccucuuccuggagaccgugaagcgcaagagcgagagcucccccaucguccggcacgccgccaccgcgcccccgcacagcugcccgcccgacgacaccaagcugaucgaggacgaguucaucaucgacgaguccgaccagagcuucgccucccggagcuggaucacgaucccccgcaaggccggcucccucaagcagcggaccaucagccccgccgaguccaccgcccugcugcagggccgcaagagccgggagaagcaccacaacauccuccccaagacccuggccaacgacaagcacucccacaagccccaccccguggagacgagccagccguccgacaagaccgugcuggacaccagcuacgcccucaucggggagaccgucaacaacuaccgcuccacgaaguacgagauguacagcaagaacgcggagaagcccucccgcagcaagcggaccaucaagcagaagcagcgccggaaguucauggccaagcccgccgaggagcagcuggacgugggccagagcaaggacgagaacauccacaccucccacaucacccaggacgaguuccagcgcaacagcgaccggaacauggaggagcacgaggagauggggaacgacugcguguccaagaagcagaugcccccggucggcagcaagaaguccagcacgcgcaaggacaaggaggaguccaagaagaagcgguucagcuccgagagcaagaacaagcuggugcccgaggaggucaccuccaccgugaccaagagccgccggaucucccgccggcccagcgacugguggguggucaaguccgaggagagccccguguacuccaacagcuccgugcgcaacgagcucccgaugcaccacaacagcagccggaaguccacgaagaagaccaaccagagcuccaagaacauccgcaagaagaccaucccccugaagcggcagaagaccgccacgaaggggaaccagcgcguccagaaguuccugaacgccgagggcagcggcgggaucgugggccacgacgagaucucccggugcagccucuccgagccccuggagagcgacgaggcggaccuggccaagaagaagaaccucgacugcucccgcagcacccgguccagcaagaacgaggacaacaucaugaccgcccagaacgugccgcugaagccccagaccuccggguacacgugcaacauccccaccgagagcaaccuggacuccggcgagcacaagaccagcguccucgaggaguccggccccagccgccugaacaacaacuaccugauguccgggaagaacgacguggacgacgaggaggugcacggcagcagcgacgacuccaagcagagcaaggucaucccgaagaaccgcauccaccacaagcucgugcugcccuccaacacccccaacgugcggcgcaccaagcggacgcgccugaagccccucgaguacuggcgcggggagcggaucgacuaccagggccggccgagcgggggcuucgucaucuccggcgugcugagccccgacaccaucuccagcaagcgcaaggccaaggagaacaucgggaaggugaacaagaaguccaacaagaagcggaucugccuggacaacgacgagcgcaagaccaaccucauggucaaccugggcaucccccugggggacccccuccagccgacccgggugaaggaccccgagacgcgcgagaucauccugauggaccuggugcggccccaggacaccuaccaguucuucgucaagcacggcgagcucaagguguacaagacccuggacacccccuucuucagcacggggaagcugauccugggcccgcaggaggagaagggcaagcagcacguggggcaggacauccucgucuucuacgugaacuucggcgaccugcugugcacccuccacgagacccccuacauccuguccaccggggacagcuucuacgugcccuccggcaacuacuacaacaucaagaaccugcgcaacgaggagagcguccuccuguucacgcagaucaagcgguga

SEQ ID NO: 28128 - RNA, 7743 nt, Artificial Sequence
  derived and/or modified sequence opt1 from CENPE__Homo_sapiens__NP_001273663
auggccgaggagggcgccguggcggugugcgugcgcgugcggccccugaacagccgcgaggagagccugggggagaccgcccagguguacuggaagaccgacaacaacgugaucuaccagguggacggcagcaaguccuucaacuucgaccgggucuuccacgggaacgagacgaccaagaacguguacgaggagaucgccgccccgaucaucgacagcgccauccagggcuacaacgggaccaucuucgcguacggccagaccgccuccggcaagacguacaccaugauggggagcgaggaccaccugggcgugaucccccgcgccauccacgacaucuuccagaagaucaagaaguuccccgaccgggaguuccugcuccgcgucuccuacauggagaucuacaacgagaccaucaccgaccugcugugcgggacgcagaagaugaagccccucaucauccgggaggacgugaaccgcaacguguacgucgccgaccugaccgaggaggugguguacaccagcgagauggcgcugaaguggaucaccaagggcgagaagucccggcacuacggggagacgaagaugaaccagcgcagcucccggagccacaccaucuuccgcaugauccucgagucccgggagaagggcgagccgagcaacugcgagggcuccgucaaggugagccaccugaaccugguggaccucgccggguccgagcgcgccgcccagaccggcgccgcggggguccggcugaaggagggcugcaacaucaaccgcagccuguucauccucggccaggugaucaagaagcuguccgacgggcaggucggcggguucaucaacuaccgggacagcaagcugacccgcauccuccagaacagccugggcgggaacgccaagacgcggaucaucugcaccaucacccccgucuccuucgacgagacccugacggcccuccaguucgccagcaccgccaaguacaugaagaacacccccuacgugaacgagguguccaccgacgaggcgcugcugaagcgcuaccggaaggagaucauggaccucaagaagcagcuggaggaggucagccuggagacgcgcgcccaggccauggagaaggaccagcucgcccagcugcuggaggagaaggaccuccugcagaaggugcagaacgagaagaucgagaaccugacccgcaugcucgucaccuccagcucccugacccugcagcaggagcucaaggccaagcggaagcgccgggugacguggugccugggcaagaucaacaagaugaagaacagcaacuacgcggaccaguucaacauccccaccaacaucaccaccaagacgcacaagcuguccaucaaccuccugcgcgagaucgacgagagcgugugcuccgagagcgacgucuucuccaacacccuggacacccucagcgagaucgaguggaacccggccaccaagcugcugaaccaggagaacaucgaguccgagcucaacagccugcgggccgacuacgacaaccuggugcucgacuacgagcagcugcgcacggagaaggaggagauggagcugaagcugaaggagaagaacgaccucgacgaguucgaggcccuggagcggaagaccaagaaggaccaggagaacgagcuguccagcaagguggagcuccugcgcgagaaggaggaccagaucaagaagcugcaggaguacaucgacucccagaagcucgagaacaucaagauggaccugagcuacagccuggaguccaucgaggaccccaagcagaugaagcagacccucuucgacgccgagaccgucgcgcuggacgccaagcgggagagcgccuuccugcgcuccgagaaccucgagcugaaggagaagaugaaggagcuggccaccacguacaagcagauggagaacgacauccagcucuaccagagccagcuggaggcgaagaagaagaugcaggucgaccuggagaaggagcuccaguccgccuucaacgagaucaccaagcugaccagccugaucgacggcaaggugcccaaggaccuccugugcaaccuggagcucgaggggaagaucaccgaccugcagaaggagcugaacaaggaggucgaggagaacgaggcccuccgggaggaggugauccugcuguccgagcucaagagccugcccuccgagguggagcgccugcggaaggagauccaggacaagagcgaggagcuccacaucaucacguccgagaaggacaagcuguucagcgaggucgugcacaaggagucccgcgugcagggccugcucgaggagaucgggaagaccaaggacgaccuggccaccacccagagcaacuacaaguccacggaccaggaguuccagaacuucaagacccugcacauggacuucgagcagaaguacaagaugguccucgaggagaacgagcggaugaaccaggagaucgugaaccugagcaaggaggcccagaaguucgacuccagccugggcgcgcucaagaccgagcugagcuacaagacccaggagcugcaggagaagacgcgcgaggugcaggagcggcucaacgagauggagcagcugaaggagcagcuggagaaccgcgacuccacccuccagaccgucgagcgggagaagacccugaucacggagaagcugcagcagacccucgaggaggugaagacccugacccaggagaaggacgaccugaagcagcuccaggagagccugcagaucgagcgcgaccagcugaaguccgacauccacgacacggugaacaugaacaucgacacccaggagcagcuccgcaacgcccuggagagccugaagcagcaccaggagaccaucaacacccucaaguccaagaucagcgaggaggucucccggaaccugcacauggaggagaacacgggggagaccaaggacgaguuccagcagaagauggugggcaucgacaagaagcaggaccuggaggccaagaacacccagacccucacggccgacgugaaggacaacgagaucaucgagcagcagcgcaagaucuucagccugauccaggagaagaacgagcugcagcagaugcucgaguccgucaucgccgagaaggagcagcugaagaccgaccugaaggagaacaucgagaugaccaucgagaaccaggaggagcuccggcugcugggcgacgagcucaagaagcagcaggagaucguggcgcaggagaagaaccacgccaucaagaaggagggggagcugagccggaccugcgaccggcuggccgagguggaggagaagcucaaggagaagucccagcagcugcaggagaagcagcagcagcugcucaacguccaggaggagaugagcgagaugcagaagaagaucaacgagaucgagaaccugaagaacgagcugaagaacaaggagcucacgcuggagcacauggagaccgagcgccuggagcucgcccagaagcugaacgagaacuacgaggaggugaaguccaucaccaaggagcggaaggugcugaaggagcuccagaaguccuucgagaccgagcgcgaccaccuccgcggcuacauccgcgagaucgaggccacggggcugcagaccaaggaggagcucaagaucgcgcacauccaccugaaggagcaccaggagaccaucgacgagcugcggcgcuccgucagcgagaagaccgcccagaucaucaacacccaggaccucgagaagucccacacgaagcugcaggaggagaucccggugcugcacgaggagcaggagcugcuccccaacgugaaggaggucagcgagacccaggagaccaugaacgagcuggagcugcucaccgagcaguccacgaccaaggacagcaccacccuggcccggaucgagauggagcgccugcggcucaacgagaaguuccaggagagccaggaggagaucaagucccugacgaaggagcgcgacaaccugaagaccaucaaggaggcccucgaggugaagcacgaccagcugaaggagcacauccgggagacccuggcgaagauccaggagagccaguccaagcaggagcagagccucaacaugaaggagaaggacaacgagaccacgaagaucguguccgagauggagcaguucaagcccaaggacagcgcccugcugcgcaucgagaucgagaugcucggccuguccaagcggcugcaggagagccacgacgagaugaaguccgucgccaaggagaaggacgaccuccagcgccugcaggaggugcugcagagcgaguccgaccagcucaaggagaacaucaaggagaucguggccaagcaccuggagaccgaggaggagcugaaggucgcccacugcugccucaaggagcaggaggagaccaucaacgagcugcgggugaaccugagcgagaaggagaccgagaucuccacgauccagaagcagcucgaggcgaucaacgacaagcugcagaacaagauccaggagaucuacgagaaggaggagcaguucaacaucaagcagaucagcgaggugcaggagaaggucaacgagcugaagcaguucaaggagcaccgcaaggccaaggacuccgcccuccagagcaucgaguccaagaugcuggagcugaccaaccgccuccaggagagccaggaggagauccagaucaugaucaaggagaaggaggagaugaagcgggugcaggaggcccugcagaucgagcgcgaccagcugaaggagaacaccaaggagaucguggccaagaugaaggagucccaggagaaggaguaccaguuccucaagaugaccgcggucaacgagacgcaggagaagaugugcgagaucgagcaccugaaggagcaguucgagacccagaagcugaaccucgagaacaucgagaccgagaacauccggcugacccagauccugcacgagaaccucgaggagaugcgcagcgugacgaaggagcgggacgaccugcgcagcguggaggagacccugaaggucgagcgggaccagcucaaggagaaccugcgcgagaccaucacccgggaccuggagaagcaggaggagcucaagaucgugcacaugcaccugaaggagcaccaggagacgaucgacaagcugcgcgggaucguguccgagaagaccaacgagaucagcaacaugcagaaggaccucgagcacuccaacgacgcccugaaggcccaggaccugaagauccaggaggagcuccggaucgcccacaugcaccugaaggagcagcaggagaccaucgacaagcugcgcggcaucgucagcgagaagaccgacaagcucuccaacaugcagaaggaccuggagaacagcaacgccaagcugcaggagaagauccaggagcucaaggcgaacgagcaccagcugaucacgcugaagaaggacgugaacgagacccagaagaaggucuccgagauggagcagcucaagaagcagaucaaggaccagagccugacccuguccaagcucgagaucgagaaccugaaccuggcccagaagcuccacgagaaccuggaggagaugaaguccgugaugaaggagcgggacaaccugcgccggguggaggagacccucaagcuggagcgcgaccagcugaaggagucccuccaggagacgaaggcccgggaccuggagauccagcaggagcugaagaccgcccgcaugcucagcaaggagcacaaggagaccgucgacaagcugcgggagaagaucuccgagaagaccauccagaucagcgacauccagaaggaccuggacaaguccaaggacgagcuccagaagaagcaggaccgccagaaccaccaggugaagcccgagaagcgccugcugagcgacggccagcagcaccucaccgagucccugcgggagaagugcagccgcaucaaggagcugcucaagcgguacuccgagauggacgaccacuacgagugccugaaccgccugagccucgaccuggagaaggagaucgaguuccagaaggagcugagcaugcgggugaaggcgaaccucucccugccguaccugcagacgaagcacaucgagaagcuguucaccgccaaccagcgcugcagcauggaguuccaccggaucaugaagaagcugaaguacguccuguccuacgugaccaagaucaaggaggagcagcacgagagcaucaacaaguucgagauggacuucaucgacgagguggagaagcagaaggagcuccugaucaagauccagcaccuccagcaggacugcgacguccccucccgcgagcugcgggaccucaagcugaaccagaacauggaccugcacaucgaggagauccucaaggacuucagcgaguccgaguuccccagcaucaagaccgaguuccagcagguccuguccaaccgcaaggagaugacgcaguuccuggaggaguggcucaacacccgguucgacaucgagaagcugaagaacgggauccagaaggagaacgaccgcaucugccaggugaacaacuucuucaacaaccggaucaucgccaucaugaacgagagcaccgaguucgaggagcgcuccgccaccaucagcaaggagugggagcaggaccugaagucccucaaggagaagaacgagaagcuguucaagaacuaccagacgcugaagaccagccucgccuccggcgcgcaggucaaccccaccacccaggacaacaagaacccgcacgugacgagccgggccacccagcugaccaccgagaagauccgcgagcuggagaacucccuccacgaggccaaggagagcgccaugcacaaggaguccaagaucaucaagaugcagaaggagcuggaggugacgaacgacaucaucgccaagcugcaggcgaagguccacgagagcaacaagugccucgagaagaccaaggagaccauccaggugcugcaggacaagguggcccugggggccaagcccuacaaggaggagaucgaggaccucaagaugaagcuggucaagaucgaccuggagaagaugaagaacgccaaggaguucgagaaggagaucagcgccaccaaggcgacgguggaguaccagaaggaggugauccggcuccugcgcgagaaccugcggcgcucccagcaggcccaggacaccagcgucaucuccgagcacaccgacccccagcccagcaacaagccgcugaccugcggcggcggguccggcaucgugcagaacacgaaggcccugauccucaagagcgagcacauccggcucgagaaggagaucuccaagcugaagcagcagaacgagcagcugaucaagcagaagaacgagcuccugagcaacaaccagcaccuguccaacgaggugaagaccuggaaggagcgcacccucaagcgcgaggcccacaagcaggucacgugcgagaacagccccaagucccccaaggugaccgggaccgccagcaagaagaagcagaucacccccucccagugcaaggagcggaaccugcaggacccggugcccaaggagagccccaaguccugcuucuucgacagccgcuccaagagccugccgagcccccaccccgugcgguacuucgacaacagcagccucggccugugccccgaggugcagaacgcgggggccgaguccguggacagccagccgggccccuggcacgccuccagcggcaaggacguccccgagugcaagacccaguga

SEQ ID NO: 28129 - RNA, 9345 nt, Artificial Sequence
  derived and/or modified sequence opt1 from CENPF__Homo_sapiens__NP_057427
augagcugggcccuggaggaguggaaggaggggcugcccacccgcgcccugcagaagauccaggagcuggaggggcagcuggacaagcugaagaaggagaagcagcagcggcaguuccagcuggacagccuggaggccgcccugcagaagcagaagcagaagguggagaacgagaagaccgagggcaccaaccugaagcgcgagaaccagcggcucauggagaucugcgagagccuggagaagaccaagcagaagaucagccacgagcugcaggucaaggagagccaggugaacuuccaggaggggcagcucaacagcggcaagaagcagaucgagaagcuggagcaggagcugaagcgcugcaagagcgagcucgagcggucccagcaggccgcccagagcgccgacgugucccugaacccgugcaacacgccccagaagaucuucaccacgccccugacccccagccaguacuacuccgggagcaaguacgaggaccucaaggagaaguacaacaaggaggucgaggagcgcaagcggcuggaggcggaggugaaggcccugcaggccaagaaggccucccagacccucccgcaggcgaccaugaaccaccgcgacaucgcccggcaccaggccagcuccagcguguucuccuggcagcaggagaagacgcccagccaccuguccagcaacagccagcgcacccccauccggcgcgacuucuccgccagcuacuucuccggcgagcaggaggucacccccagccgguccacccugcagaucggcaagcgcgacgccaacagcuccuucuucgacaacagcuccagcccgcaccuccuggaccagcugaaggcgcagaaccaggagcuccggaacaagaucaacgagcuggagcugcgccuccaggggcacgagaaggagaugaagggccaggugaacaaguuccaggagcugcagcugcagcucgagaaggccaagguggagcugaucgagaaggagaagguccugaacaagugccgggacgagcucgugcgcacgaccgcccaguacgaccaggccuccaccaaguacaccgcccuggagcagaagcugaagaagcucacggaggaccugagcugccagcggcagaacgcggaguccgcccgcugcagccuggagcagaagaucaaggagaaggagaaggaguuccaggaggagcucucccggcagcagcgcagcuuccagacccuggaccaggagugcauccagaugaaggcccgccugacccaggagcuccagcaggccaagaacaugcacaacgugcugcaggccgagcuggacaagcucaccuccgucaagcagcagcuggagaacaaccuggaggaguucaagcagaagcugugccgggcggagcaggccuuccaggccagccagaucaaggagaacgagcuccgccgguccauggaggagaugaagaaggagaacaaccugcugaagucccacagcgagcagaaggcccgcgaggugugccaccucgaggccgagcugaagaacaucaagcagugccugaaccagucccagaacuucgcggaggagaugaaggccaagaacacgagccaggagaccaugcuccgggaccugcaggagaagaucaaccagcaggagaacucccugacccucgagaagcugaagcuggccguggccgaccucgagaagcagcgcgacugcagccaggaccugcugaagaagcgggagcaccacaucgagcagcucaacgacaagcuguccaagaccgagaaggagagcaaggcgcugcucuccgcccuggagcugaagaagaaggaguacgaggagcucaaggaggagaagacgcuguucagcugcuggaaguccgagaacgagaagcugcucacccagauggagagcgagaaggagaaccugcaguccaagaucaaccaccuggagaccugccucaagacccagcagaucaagagccacgaguacaacgagcgcguccggacgcuggagauggaccgcgagaaccuguccguggagauccggaaccuccacaacgugcuggacagcaaguccgucgagguggagacccagaagcuggccuacauggagcuccagcagaaggccgaguucagcgaccagaagcaccagaaggagaucgagaacaugugccugaagaccucccagcugaccggccagguggaggaccucgagcacaagcugcagcugcucagcaacgagaucauggacaaggaccgcugcuaccaggaccugcacgccgaguacgagagccugcgggaccuccugaaguccaaggacgcgagccuggucacgaacgaggaccaccagcgcucccuccuggccuucgaccagcagcccgccaugcaccacagcuucgccaacaucaucggcgagcagggguccaugcccagcgagcgguccgagugccgccuggaggccgaccagagccccaagaacuccgcgauccuccagaaccggguggacagccuggaguucucccuggagagccagaagcagaugaacuccgaccuccagaagcagugcgaggagcuggugcagaucaagggcgagaucgaggagaaccugaugaaggccgagcagaugcaccagagcuucgucgccgagaccucccagcgcaucagcaagcuccaggaggacaccuccgcccaccagaacguggucgccgagacccugagcgcgcuggagaacaaggagaaggagcuccagcugcugaacgacaagguggagacggagcaggccgagauccaggagcucaagaaguccaaccaccuccuggaggacagccucaaggagcugcagcugcucagcgagacccugucccuggagaagaaggagaugagcuccaucaucagccucaacaagcgggagaucgaggagcugacccaggagaacggcacccugaaggagaucaacgccucccucaaccaggagaagaugaaccugauccagaaguccgaguccuucgccaacuacaucgacgagcgcgagaaguccaucuccgagcugagcgaccaguacaagcaggagaagcucauccugcugcagcgcugcgaggagaccgggaacgcguacgaggaccucucccagaaguacaaggccgcccaggagaagaacagcaagcuggagugccugcucaacgagugcacgucccugugcgagaaccggaagaacgagcuggagcagcucaaggaggccuucgccaaggagcaccaggaguuccugaccaagcuggcguucgccgaggagcgcaaccagaaccucaugcuggagcuggagaccgugcagcaggcccuccggagcgagaugaccgacaaccagaacaacuccaagagcgaggccggcgggcugaagcaggagaucaugacgcugaaggaggagcagaacaagaugcagaaggaggucaacgaccuccugcaggagaacgagcagcugaugaaggugaugaagaccaagcacgagugccagaaccuggaguccgagccgauccgcaacagcgugaaggagcgggaguccgagcgcaaccagugcaacuucaagccccagauggaccucgaggucaaggagaucagccuggacagcuacaacgcccagcuggugcagcucgaggcgaugcugcggaacaaggagcugaagcuccaggaguccgagaaggagaaggagugccugcagcacgagcugcagaccauccgcggcgaccucgagaccagcaaccugcaggacaugcagucccaggagaucagcggccugaaggacugcgagaucgacgccgaggagaaguacaucuccgggccccacgagcucagcacgucccagaacgacaacgcccaccuccagugcagccugcagaccaccaugaacaagcucaacgagcuggagaagaucugcgagauccugcaggccgagaaguacgagcucgugaccgagcugaacgacucccggagcgagugcaucacggccacccgcaagauggcggaggaggucggcaagcugcucaacgaggugaagauccugaacgacgacuccgggcugcuccacggcgagcugguggaggacauccccgggggcgaguucggcgagcagccgaacgagcagcaccccgucagccuggcgccccuggacgaguccaacagcuacgagcaccugacccuguccgacaaggaggugcagaugcacuucgccgagcuccaggagaaguuccugagccugcaguccgagcacaagauccuccacgaccagcacugccagaugagcuccaagaugagcgagcugcagaccuacguggacagccugaaggccgagaaccucguccuguccacgaaccugcggaacuuccagggggaccucgugaaggagaugcagcugggccuggaggaggggcucgugcccagccuguccagcuccugcgucccggacagcuccagccuguccagccucggcgacuccagcuucuaccgcgcgcugcuggagcagaccggggacaugucccuccugagcaaccuggagggcgccguguccgccaaccagugcagcguggacgaggucuucugcuccagccuccaggaggagaaccugacccggaaggagacccccuccgcccccgccaagggcguggaggagcuggagagccucugcgagguguaccgccagagccuggagaagcuggaggagaagauggagucccaggggaucaugaagaacaaggagauccaggagcucgagcagcugcugagcuccgagcggcaggagcucgacugccugcgcaagcaguaccugagcgagaacgagcaguggcagcagaagcucacguccgucacccuggagauggagagcaagcuggcggccgagaagaagcagaccgagcagcucucccuggagcuggagguggcccggcuccagcugcagggccuggaccucagcucccgcagccugcuggggaucgacaccgaggacgccauccagggccggaacgaguccugcgacaucagcaaggagcacacguccgagaccaccgagcgcacccccaagcacgacgugcaccagaucugcgacaaggacgcccagcaggaccucaaccuggacaucgagaagaucacggagaccggggcggucaagccgaccggcgagugcagcggcgagcagucccccgacaccaacuacgagccgcccggggaggacaagacgcagggcagcuccgagugcaucagcgagcuguccuucagcgggccgaacgcccucgugcccauggacuuccugggcaaccaggaggacauccacaaccugcagcuccgggugaaggagaccagcaacgagaaccugcgccugcuccacgucaucgaggaccgcgaccggaagguggagucccugcugaacgagaugaaggagcucgacagcaagcugcaccuccaggaggugcagcucaugaccaagaucgaggccugcaucgagcuggagaagaucgucggcgagcugaagaaggagaacuccgaccucagcgagaagcuggaguacuucuccugcgaccaccaggagcugcuccagcgcguggagaccagcgaggggcugaacuccgaccuggagaugcacgccgacaagagcucccgggaggacaucggcgacaacguggccaaggucaacgacagcuggaaggagcgcuuccucgacguggagaacgagcugucccggauccgcagcgagaaggcguccaucgagcacgaggcccuguaccuggaggccgaccucgaggugguccagacggagaagcugugccuggagaaggacaacgagaacaagcagaaggugaucgugugccucgaggaggagcugagcgucgugaccuccgagcggaaccagcugcgcggggagcucgacaccaugagcaagaagaccaccgcccuggaccagcuguccgagaagaugaaggagaagacgcaggagcucgagagccaccagagcgagugccugcacugcauccagguggccgaggcggaggucaaggagaagaccgagcugcuccagacccuguccagcgacguguccgagcugcucaaggacaagacccaccuccaggagaagcugcagagccucgagaaggacucccaggcccugagccugacgaagugcgagcucgagaaccagaucgcccagcugaacaaggagaaggagcugcucgugaaggaguccgagagccugcaggcccggcuguccgagagcgacuacgagaagcucaacgucuccaaggcgcuggaggccgcccugguggagaagggcgaguucgcccuccgccugagcuccacccaggaggaggugcaccagcugcggcgcgggaucgagaagcuccggguccgcaucgaggccgacgagaagaagcagcugcacaucgcggagaagcugaaggagcgggagcgcgagaacgacagccucaaggacaagguggagaaccuggagcgggagcugcagauguccgaggagaaccaggagcucgucauccuggacgccgagaacagcaaggccgagguggagacccugaagacccagaucgaggagauggcccgcucccucaagguguucgagcuggaccuggucacgcuccggagcgagaaggagaaccugaccaagcagauccaggagaagcagggccagcuguccgagcucgacaagcugcugagcagcuucaagucccuccuggaggagaaggagcaggccgagauccagaucaaggaggagagcaagaccgcgguggagaugcugcagaaccagcucaaggagcugaacgaggccguggccgcccugugcggcgaccaggagaucaugaaggccaccgagcagucccucgacccgcccaucgaggaggagcaccagcugcgcaacagcaucgagaagcugcgcgcgcggcucgaggccgacgagaagaagcagcugugcguccugcagcagcucaaggaguccgagcaccacgccgaccugcugaaggggcgcguggagaaccucgagcgggagcuggagaucgcccgcacgaaccaggagcacgcggcccuggaggccgagaacagcaagggcgagguggagacccucaaggccaagaucgaggggaugacccagucccugcggggccuggagcucgacgucgugaccauccgcagcgagaaggagaaccugacgaacgagcugcagaaggagcaggagcggaucuccgagcucgagaucaucaacagcuccuucgagaacauccugcaggagaaggagcaggagaaggugcagaugaaggagaaguccuccaccgccauggagaugcugcagacccagcucaaggagcugaacgagcgcgucgcggcccugcacaacgaccaggaggccugcaaggccaaggagcagaaccucagcucccagguggagugccuggagcuggagaaggcccagcuccugcaggggcuggacgaggcgaagaacaacuacaucgugcuccagagcuccgucaacggccugauccaggagguggaggacggcaagcagaagcuggagaagaaggacgaggagaucagccggcucaagaaccagauccaggaccaggagcagcugguguccaagcugagccaggucgagggggagcaccagcucuggaaggagcagaaccuggagcugcgcaaccucaccguggagcuggagcagaagauccaggugcugcagagcaagaacgccucccugcaggacacgcucgagguccugcagagcuccuacaagaaccuggagaacgagcucgagcugaccaagauggacaagaugagcuucguggagaaggugaacaagaugaccgccaaggagaccgagcugcagcgggagaugcacgagauggcccagaagacggccgagcuccaggaggagcuguccggcgagaagaaccgccuggcgggggagcuccagcugcugcucgaggagaucaagagcuccaaggaccagcugaaggagcugacccucgagaacagcgagcugaagaagucccuggacugcaugcacaaggaccaggucgagaaggagggcaaggugcgggaggagaucgccgaguaccagcuccgccugcacgaggccgagaagaagcaccaggcccugcuccuggacaccaacaagcaguacgagguggagauccagaccuaccgggagaagcugacgagcaaggaggagugccucuccagccagaagcuggagaucgaccugcucaaguccagcaaggaggagcugaacaacucccugaaggcgaccacccagauccucgaggagcugaagaagaccaagauggacaaccugaaguacgucaaccagcucaagaaggagaacgagcgcgcccaggggaagaugaagcugcugaucaagagcugcaagcagcucgaggaggagaaggagauccugcagaaggagcugucccagcuccaggccgcccaggagaagcagaagacgggcaccgugauggacaccaagguggacgagcugaccacggagaucaaggagcugaaggagacccucgaggagaagaccaaggaggccgacgaguaccuggacaaguacugcagccugcucaucucccacgagaagcuggagaaggcgaaggagaugcuggagacccaggucgcccaccucugcagccagcagagcaagcaggacucccggggcagcccccugcuggggcccguggugcccggccccucccccauccccagcgucaccgagaagcgccucuccagcgggcagaacaaggccuccggcaagcggcagcgcagcuccgggaucugggagaacggccggggccccacgccggccacccccgagagcuucuccaagaaguccaagaaggccgugauguccgggauccaccccgcggaggacaccgagggcaccgaguucgagcccgaggggcugccggagguggucaagaagggcuucgccgacauccccacgggcaagaccagccccuacauccugcgccgcaccaccauggccacgcggaccagcccccgccucgccgcccagaagcuggcgcugagcccgcucucccuggggaaggagaaccuggccgagagcuccaagcccaccgccggcgggagccggagccagaaggugaagguggcccagcgcucccccgucgacagcggcaccauccuccgggagcccacgaccaaguccgugccggugaacaaccugcccgagcgcagccccaccgacagcccccgggaggggcugcgcgucaagcggggccgccucgugccgagccccaaggccggccuggaguccaacgggagcgagaacugcaaggugcaguga

SEQ ID NO: 28130 - RNA, 744 nt, Artificial Sequence
  derived and/or modified sequence opt1 from CENPH__Homo_sapiens__NP_075060
auggaggagcagccccagaugcaggacgccgacgagccggccgacagcggcggggagggccgcgccgggggcccgccccagguggcgggggcccaggccgccugcuccgaggaccggaugacccugcuccugcgccugcgggcgcagaccaagcagcagcuccuggaguacaagagcauggucgacgccuccgaggagaagacgcccgagcagaucaugcaggagaagcagaucgaggccaagaucgaggaccuggagaacgagaucgaggaggugaagguggccuucgagaucaagaagcucgcgcuggaccgcaugcggcugagcaccgcccucaagaagaaccuggagaagaucucccgccagagcuccguccugauggacaacaugaagcaccuccuggagcugaacaagcucaucaugaagucccagcaggagagcugggaccuggaggagaagcugcucgacauccggaagaagcgccugcagcugaagcaggccagcgaguccaagcuccuggagauccagaccgagaagaacaagcagaagaucgaccuggacagcauggagaacuccgagcggaucaagaucauccgccagaaccuccagauggagaucaagaucaccacggugauccagcacguguuccagaaccugauccugggcagcaaggucaacugggccgaggaccccgcccucaaggagaucgugcugcagcuggagaagaacguggacaugauguga

SEQ ID NO: 28131 - RNA, 4017 nt, Artificial Sequence
  derived and/or modified sequence opt1 from CENPJ__Homo_sapiens__NP_060921
auguuccugaugcccaccagcuccgagcucaacagcggccagaacuuccugacccaguggaugacgaacccgucccgcgccggggugauccugaaccggggcuuccccauccucgaggccgacaaggagaagcgcgcggccgucgacaucagcaccuccuuccccaucaaggggacccacuucagcgacuccuucagcuucaucaacgaggaggacucccugcuggaggagcagaagcucgagagcaacaaccccuacaagccgcaguccgacaagagcgagacccacacggccuuccccugcaucaagaagggcccccagguggccgccugccacuccgcgcccgggcaccaggaggagaacaagaacgacuucaucccggaccuggccagcgaguucaaggagggcgccuacaaggacccccuguucaagaagcucgagcagcugaaggaggugcagcagaagaagcaggagcagcugaagcggcagcagcucgagcagcugcagcgccugauggaggagcaggagaagcuccugaccauggucuccggccagugcacccugcccgggcucagccugcugcccgacgaccagucccagaagcaccggagcccgggcaacaccacgaccggggagcgcgcgaccugcugcuuccccuccuacguguaccccgaccccacccaggaggagacguacccgagcaacauccucagccacgagcaguccaacuucugccggaccgcccacggcgacuucgugcugaccagcaagcgcgccucccccaaccuguucagcgaggcccaguaccaggaggcccccgucgagaagaacaaccucaaggaggagaaccggaaccaccccaccggggaguccauccugugcugggagaaggugacggagcagauccaggaggccaacgacaagaaccugcagaagcacgacgacagcuccgagguggcgaacaucgaggagcgcccgaucaaggccgccaucggcgagcggaagcagaccuucgaggacuaccucgaggagcagauccagcuggaggagcaggagcugaagcagaagcagcucaaggaggccgagggcccccugcccaucaaggccaagcccaagcagccguuccugaagcgcggggagggccucgcgcgguucaccaacgccaagagcaaguuccagaaggggaaggaguccaagcuggucaccaaccagagcacguccgaggaccagccccuguucaagauggaccgccagcagcuccagcggaagaccgcccugaagaacaaggagcugugcgccgacaaccccauccucaagaaggacagcaaggcccgcaccaaguccggcagcgugacccugucccagaagcccaagaugcugaagugcagcaaccggaagucccucagcccguccggccugaagauccagacggggaagaagugcgacggccaguuccgcgaccagaucaaguucgagaacaaggugaccagcaacaacaaggagaacgucaccgagugccccaagcccugcgacaccgggugcacgggcuggaacaagacccaggggaaggaccggcugccgcucagcaccggccccgcgucccgccuggccgccaagagccccauccgggagaccaugaaggaguccgagagcucccuggacgugagccuccagaagaagcuggagacgugggagcgcgagaaggagaaggagaaccuggagcuggacgaguuccucuuccuggagcaggccgccgacgagaucuccuucagcuccaacagcuccuucgugcugaagauccucgagcgcgaccagcagaucugcaagggccaccggaugagcuccacccccgucaaggcggugccgcagaagaccaaccccgccgaccccaucagccacugcaaccgcuccgaggaccuggaccacaccgcccgggagaaggagagcgagugcgagguggcccccaagcagcugcacucccucagcagcgcggacgagcugcgcgagcagccgugcaagauccggaaggccguccagaaguccacgagcgagaaccagaccgaguggaacgcccgcgacgacgagggggugcccaacuccgacagcuccaccgacagcgaggagcagcuggacgugaccaucaagcccuccaccgaggaccgggagcgcggcaucagcucccgggaggacagcccccaggucugcgacgacaaggggccguucaaggacacgcgcacccaggaggacaagcggcgcgacguggaccucgaccuguccgacaaggacuacagcuccgacgagagcaucauggaguccaucaagcacaaggugagcgagcccucccggagcuccagccugagccucuccaagauggacuucgacgacgagcgcaccuggaccgaccuggaggagaaccugugcaaccacgacgucgugcucggcaacgagagcacguacgggacgccccagaccugcuaccccaacaacgagaucggcauccuggacaagaccaucaagcggaagaucgccccggucaagcgcggcgaggaccuguccaagagccggcgcucccggagcccgcccaccuccgagcucaugaugaaguucuuccccagccugaagcccaagcccaaguccgacagccaccuggggaacgagcucaagcugaacaucucccaggaccagccgcccggcgacaacgcccgcagccaggugcugcgcgagaagaucaucgagcucgagaccgagaucgagaaguucaaggcggagaacgccucccuggccaagcugcggaucgagcgcgagagcgcccucgagaagcugcggaaggagaucgccgacuucgagcagcagaaggcgaaggagcuggcccgcaucgaggaguucaagaaggaggagaugcggaagcuccagaaggagcgcaagguguucgagaaguacaccaccgccgcccggacguuccccgacaagaaggagcgcgaggagauccagacccugaagcagcagaucgccgaccugcgggaggaccucaagcgcaaggagaccaagugguccagcacccacucccggcugcgcagccagauccagaugcugguccgggagaacacggaccuccgcgaggagaucaaggugauggagcgguuccgccuggacgcguggaagcgggccgaggccaucgaguccagccuggagguggagaagaaggacaagcucgccaacaccagcguccgcuuccagaacucccagaucagcuccgggacccagguggagaaguacaagaagaacuaccugcccaugcagggcaacccgccccggcgcagcaaguccgcgccgccccgggaccuggggaaccucgacaagggccaggccgccagcccccgcgagccccuggagccccugaacuuccccgaccccgaguacaaggaggaggaggaggaccaggacauccagggcgagaucucccacccggacgggaagguggagaaggucuacaagaacggcugccgcgugauccucuuccccaacgggacccggaaggaggugagcgccgacggcaagacgaucaccgucaccuucuucaacggcgacgugaagcaggucaugcccgaccagcgcgugaucuacuacuacgccgcggcccagaccacgcacaccaccuaccccgaggggcuggaggugcugcacuucuccagcggccagaucgagaagcacuacccggacgggcggaaggagaucaccuuccccgaccagacggugaagaaccucuuccccgacggccaggaggaguccaucuuccccgacgggaccaucguccgcgugcagcgggacggcaacaagcugaucgaguucaacaacggccagcgcgagcugcacaccgcccaguucaagcggcgcgaguacccggacgggaccgugaagacggucuacgccaacggccaccaggagaccaaguaccggagcgggcgcauccgggugaaggacaaggagggcaacgugcucauggacaccgagcuguga

SEQ ID NO: 28132 - RNA, 810 nt, Artificial Sequence
  derived and/or modified sequence opt1 from CENPK__Homo_sapiens__NP_001253967
augaaccaggaggaccuggaccccgacagcaccaccgacgugggcgacgucacgaacaccgaggaggagcucauccgcgagugcgaggagauguggaaggacauggaggagugccagaacaagcugucccugaucgggaccgagacccucacggacagcaacgcccagcugucccugcucaucaugcaggucaagugccugaccgccgagcugagccaguggcagaagaagaccccggagaccaucccccucacggaggacgugcugaucacccugggcaaggaggaguuccagaagcuccggcaggaccuggagauggugcuguccaccaaggagagcaagaacgagaagcucaaggaggaccuggagcgcgagcagcgguggcuggacgagcagcagcagaucauggagucccucaacgugcugcacagcgagcugaagaacaagguggagaccuucuccgagagccgcaucuucaacgagcucaagacgaagaugcugaacaucaaggaguacaaggagaagcugcucuccacccugggggaguuccuggaggaccacuucccccuccccgaccggagcgucaagaagaagaagaagaacauccaggaguccagcgugaaccugaucacccugcacgagaugcucgagauccugaucaaccgccuguucgacgugccgcacgaccccuacgucaagaucuccgacagcuucuggccgcccuacguggagcuccugcugcggaacggcaucgcgcuccgccaccccgaggaccccacccggauccgccuggaggccuuccaccaguga

SEQ ID NO: 28133 - RNA, 1062 nt, Artificial Sequence
  derived and/or modified sequence opt1 from CENPN__Homo_sapiens__NP_001094095
auggacgagaccguggccgaguucaucaagcgcaccauccugaagauccccaugaacgagcucacgaccauccugaaggccugggacuuccugagcgagaaccagcuccagaccgucaacuuccggcagcgcaaggaguccguggugcagcaccugauccaccugugcgaggagaagcgggcgagcaucuccgacgccgcccuccuggacaucaucuacaugcaguuccaccagcaccagaaggucugggagguguuccagaugagcaagggcccgggggaggacguggaccuguucgacaugaagcaguucaagaacuccuucaagaagauccuccagcgcgcccugaagaacgucaccgugagcuuccgggagacggaggagaacgccguguggauccgcaucgcguggggcacccaguacaccaagcccaaccaguacaagcccaccuacgucguguacuacucccagacgcccuacgccuucaccagcuccagcaugcugcggcgcaacaccccgcuccuggggcaggcccugaccaucgccuccaagcaccaccagaucgugaagauggaccuccggagccgcuaccuggacucccugaaggcgaucgucuucaagcaguacaaccagacguucgagacccacaacagcaccacgccccuccaggagcggucccugggccuggacaucaacauggacagccgcaucauccacgagaacaucguggagaaggagcgggugcagcgcaucacccaggagaccuucggggacuacccccagccccagcucgaguucgcccaguacaagcuggagaccaaguucaaguccggccugaacggcagcauccucgccgagcgggaggagccgcugcgcugccugaucaaguucuccagcccccaccuccuggaggcccucaagagccucgcccccgcggcccuggucugccggauccagaagcugcucugcuacuccgggagccacucccagggcacccaggaccccagcuccuggcagaaggaccuguaccugcuguucgugccgcuguacccccgcugcuga

SEQ ID NO: 28134 - RNA, 885 nt, Artificial Sequence
  derived and/or modified sequence opt1 from CENPO__Homo_sapiens__NP_001186732
auggccggcauccuggccagcgggcucggcgugcuggcgcaccuggagcgccucgagacccaggucucccggagccgcaagcaguccgaggagcugcagagcgugcaggcccaggagggggcccugggcaccaagauccacaagcuccggcgccugcgggacgagcugcgcgccgugguccggcaccgccgggccuccgugaaggcgugcaucgccaacguggagcccaaccagacggucgagaucaacgagcaggaggcccucgaggagaagcuggagaacgugaaggccauccugcaggcguaccacuucaccgggcucagcggcaagcugaccucccgcggcgugugcgucugcaucagcaccgccuucgaggggaaccugcucgacuccuacuucguggaccuggugauccagaagccgcugcggauccaccaccacagcguccccguguucaucccccucgaggagaucgccgccaaguaccugcagacgaacauccagcacuuccuguucucccucugcgaguaccugaacgccuacagcggccgcaaguaccaggcggaccggcugcaguccgacuucgccgcccuccugaccgggccccugcagcgcaacccgcucugcaaccugcugagcuucaccuacaagcucgaccccggcgggcaguccuuccccuucugcgcccggcugcuguacaaggaccucaccgccacgcugcccaccgacgugaccgugaccugccagggcgucgaggugcugagcacguccugggaggagcagcgcgcgagccacgagacccucuucugcaccaagccgcugcaccaggucuucgccuccuucacccggaagggcgagaagcuggacaugagccucgugagcuga

SEQ ID NO: 28135 - RNA, 807 nt, Artificial Sequence
  derived and/or modified sequence opt1 from CENPQ__Homo_sapiens__NP_060602
augagcggcaaggccaacgccuccaagaagaacgcgcagcagcugaagcgcaaccccaagcggaagaaggacaacgaggaggugguccucagcgagaacaaggugcgcaacaccgugaagaagaacaagaaccaccugaaggaccuguccagcgaggggcagaccaagcacacgaaccucaagcacggcaagaccgccgccuccaagcggaagaccuggcagccgcugagcaaguccacccgcgaccaccuccagacgaugauggagagcgucaucaugaccauccuguccaacagcaucaaggagaaggaggagauccaguaccaccugaacuuccugaagaagcggcuccugcagcagugcgagacccugaaggugccgcccaagaagauggaggaccucaccaacguguccagccugcugaacauggagcgcgcccgggacaaggccaacgaggaggggcucgcgcugcugcaggaggagaucgacaagauggucgagacgaccgagcucaugaccggcaacauccagucccugaagaacaagauccagauccuggccagcgagguggaggaggaggaggagcgcgugaagcagaugcaccagaucaacuccagcgggguccucucccugcccgagcugagccagaagacccucaaggcccccacgcugcagaaggagauccuggcccucauccccaaccagaacgcgcugcugaaggaccucgacauccugcacaacuccagccagaugaaguccaugagcaccuucaucgaggaggccuacaagaagcuggacgccagcuga

SEQ ID NO: 28136 - RNA, 1257 nt, Artificial Sequence
  derived and/or modified sequence opt1 from CENPU__Homo_sapiens__NP_078905
auggcgccccgcggccggcgccggccgcgcccccaccggagcgagggggcccgccgguccaagaacacccuggagcgcacccacagcaugaaggacaaggccggccagaagugcaagcccaucgacguguucgacuuccccgacaacuccgacgucagcuccaucgggcggcucggcgagaacgagaaggacgaggagacguacgagaccuucgacccgccccugcacagcaccgccaucuacgccgacgaggaggaguucuccaagcacugcgggcugagccucuccagcaccccgcccggcaaggaggccaagcgcuccagcgacacguccggcaacgaggccagcgagaucgaguccgugaagaucagcgcgaagaagcccgggcggaagcugcgccccaucuccgacgacagcgaguccaucgaggagagcgacacccggcgcaaggucaagagcgccgagaagaucuccacccagcggcacgaggugauccgcaccacggccagcuccgagcugagcgagaagcccgccgaguccgugaccagcaagaagaccggcccccucuccgcgcagccgagcguggagaaggagaaccuggccaucgagucccagagcaagacccagaagaaggggaagaucucccacgacaagcggaagaagucccgcagcaaggccaucggcagcgacacguccgacaucguccacaucuggugccccgaggggaugaagaccagcgacaucaaggagcugaacaucgugcuccccgaguucgagaagacccaccuggagcaccagcagcggaucgaguccaaggugugcaaggccgccaucgcgaccuucuacgucaacgugaaggagcaguucaucaagaugcugaaggagagccagaugcucacgaaccugaagcgcaagaacgccaagaugaucuccgacaucgagaagaagcggcagcgcaugaucgaggugcaggacgagcugcuccgccuggagccccagcugaagcagcuccagaccaaguacgacgagcugaaggagcgcaagagcagccugcggaacgccgccuacuuccucuccaaccugaagcagcuguaccaggacuacagcgacguccaggcccaggagccgaacgugaaggagaccuacgacuccagcucccuccccgcgcugcuguucaaggcccggacccuccugggcgccgagagccaccuccgcaacaucaaccaccagcuggagaagcugcuggaccagggcuga

SEQ ID NO: 28137 - RNA, 819 nt, Artificial Sequence
  derived and/or modified sequence opt1 from CENPV__Homo_sapiens__NP_859067
augcgccggagccgcuccagcgccgccgcgaagcugcggggccagaagcgcuccggggccagcgccgcccccgccgcguccgccgccgccgcgcucgccccgagcgccacccggacccgccgguccgccagccaggccggcuccaagagccaggcgguggagaagccccccuccgagaagccccgccugcggcgcagcuccccgcgggcccaggaggaggggcccggcgagccccccccgcccgagcuggcccuccugccccccccgcccccccccccgcccacgcccgccacccccaccagcuccgccagcaaccuggaccucggggagcagcgcgagcggugggagaccuuccagaagcgccagaagcugacguccgagggcgcggccaagcugcuccuggacaccuucgaguaccagggccuggucaagcacaccgggggcugccacugcggggccgugcgguucgaggugugggccagcgccgaccuccacaucuucgacugcaacugcuccaucugcaagaagaagcagaaccgccacuucaucgucccggcgagccgguucaagcugcugaagggcgccgagcacaucaccacguacaccuucaacacccacaaggcccagcacaccuucugcaagcgcugcggggugcagagcuucuacacgccccgguccaaccccggcggcuucgggaucgccccccacugccucgacgagggcaccgugcgcagcauggucaccgaggaguucaacggguccgacugggagaaggccaugaaggagcacaagaccaucaagaacaugagcaaggaguga

SEQ ID NO: 28138 - RNA, 267 nt, Artificial Sequence
  derived and/or modified sequence opt1 from CENPW__Homo_sapiens__NP_001012525
auggcccugagcaccaucgugucccagcgcaagcagaucaagcggaaggcgccccgcggcuuccucaagcgggucuucaagcgcaagaagccgcagcugcggcuggagaaguccggggaccuccuggugcaccugaacugccuccuguucgugcaccgccuggccgaggagagccggaccaacgccugcgccagcaagugccgcgucaucaacaaggagcacgugcucgccgccgcgaaggugauccugaagaagucccggggcuga

SEQ ID NO: 28139 - RNA, 636 nt, Artificial Sequence
  derived and/or modified sequence opt1 from CEP112__Homo_sapiens__NP_001032402
augugggccagccugucccucgaccaccccagcgccaaggagaaccaggcgcugcgccugaucgagaugcgggaggagaacggcaacgugccgaagaccgagcaggccgggucccucaagccccugcgcgacaccggcaagagcaaccugaaggagaagaaggccaacuccaagcucaagcagaucgagaaggaguacacgcagaagcuggccaagagcucccagaucaucgccgagcugcagaccaccaucagcucccucaaggaggagaacagccagcagcagcuggcggccgagcggcgccugcaggacguccggcagaaguucgaggacgagaagaagcagcucauccgcgacaacgaccaggccaucaaggugcugcaggacgagcuggagaaccgguccaaccaggugcgcugcgccgagaagaagcuccagcacaaggagcuggagagccaggagcagaucaccuacauccggcaggaguacgagacgaagcugaaggggcucaugcccgcgucccugcgccaggagcuggaggacaccaucagcucccucaagagccaggucaacuuccugcagaagcgggccuccauccugcaggaggagcucaccaccuaccagggccgccgguga

SEQ ID NO: 28140 - RNA, 2883 nt, Artificial Sequence
  derived and/or modified sequence opt1 from CEP120__Homo_sapiens__NP_001159698
augcugguggucgaggccaaguucgacggcgagcagcucgccaccgaccccguggaccacaccgaccagccggaguucgcgacggagcuggccugggagaucgaccgcaaggcccugcaccagcaccggcuccagcgcacccccaucaagcugcagugcuucgcccuggaccccgugaccagcgccaaggagaccaucggguacaucguccucgaccugcggacggcgcaggagaccaagcaggcccccaagugguaccagcugcucuccaacaaguacaccaaguucaagagcgagauccagaucuccaucgcccuggagaccgacacgaagccgcccguggacagcuucaaggccaagggcgcgccgccccgcgacgggaaggugcccgccauccuggccggccucgacccccgggacaucgucgccgugcugaacgaggagggcggguaccaccagaucggccccgccgaguacugcaccgacuccuucaucaugagcgugaccaucgcguucgccacccagcuggagcagcucauccccugcacgaugaagcugccggagcgccagcccgaguucuucuucuacuacucccugcucgggaacgacgucaccaacgagcccuucaacgaccugaucaaccccaacuucgagccggagcgggccagcgugcgcauccgguccagcguggagauccugcgcgucuaccucgcccugcaguccaagcugcagauccaccucugcugcggcgaccagagccugggguccaccgagaucccccugaccggccuccugaagaaggggagcacggagaucaaccagcaccccgugaccguggagggcgccuucacccuggacccgcccaaccgggcgaagcagaagcucgcccccauccccgucgagcuggcccccaccgugggcguguccgucgcccugcagcgcgaggggaucgacagccagucccucaucgagcugaagacgcagaacgagcacgagccggagcacagcaagaagaaggugcugacccccaucaaggagaagacccucaccggccccaagucccccacggugagcccgguccccagccacaaccaguccccgcccaccaaggacgacgccaccgagagcgagguggagucccugcaguacgacaaggacaccaagcccaaccccaaggcgagcuccagcgugcccgccucccuggcccagcucgucacgaccagcaacgccuccgagguggccagcgggcagaagaucgcggucccggccaccucccaccacuucugcuucagcaucgaccugcgguccauccacgcccuggagaucggcuuccccaucaacugcauccuccgcuacagcuaccccuucuucggcuccgccgcgcccaucaugaccaacccgcccguggaggugcggaagaacauggaggucuuccugccccagagcuacugcgccuucgacuucgccacgaugccccaccagcugcaggacaccuuccuccgcaucccgcugcugguggagcucuggcacaaggacaagauguccaaggaccugcugcuggggaucgcccggauccagcucagcaacauccuguccagcgagaagacccgcuuccugggcagcaacggggagcagugcuggcggcagaccuacuccgagagcgugcccgucaucgccgcgcagggcuccaacaaccgcaucgccgaccucagcuacacggugacccuggaggacuacgggcuggugaagaugcgggagaucuucaucuccgacagcucccagggcgucagcgccgugcagcagaagcccuccagccugcccccggcccccugccccuccgagauccagaccgagccccgcgagacccucgaguacaaggccgcgcuggagcucgagauguggaaggagaugcaggaggacaucuucgagaaccagcugaagcagaaggagcuggcccacaugcaggcccucgccgaggaguggaagaagcgcgaccgggagcgcgagagccuggugaagaagaaggucgccgaguacaccauccuggagggcaagcuccagaagacgcugaucgaccuggagaagcgggagcagcagcucgcguccguggagagcgagcugcagcgcgagaagaaggagcugcaguccgagcggcagcgcaaccuccaggagcugcaggacagcauccggcgcgccaaggaggacugcauccaccagguggagcuggagcggcucaagaucaagcagcuggaggaggacaagcaccgccugcagcagcagcucaacgacgccgagaacaaguacaagauccuggagaaggaguuccagcaguucaaggaccagcagaacaacaagccggagauccggcugcaguccgagaucaaccuccugacccuggagaaggucgagcucgagcgcaagcuggagagcgccaccaagagcaagcugcacuacaagcagcagugggggcgggcgcucaaggagcuggcccgccugaagcagcgggagcaggagucccagauggcccgccucaagaagcagcaggaggagcuggagcagaugcggcugcgcuaccucgccgccgaggagaaggacaccgugaagacggagcggcaggagcugcuggacauccgcaacgagcucaaccgccugcggcagcaggagcagaagcaguaccaggacagcaccgagaucgcguccggcaagaaggacgggccccacggcagcgugcuggaggaggggcucgacgacuaccugacccgccugaucgaggagcgggacacccucaugcgcacgggcgucuacaaccacgaggaccggaucaucuccgagcuggaccgccagauccgggagauccuggccaagagcaacgccuccaacuga

SEQ ID NO: 28141 - RNA, 3285 nt, Artificial Sequence
  derived and/or modified sequence opt1 from CEP128__Homo_sapiens__XP_006720119
auggccgagagcuccagcgaguccgaccacuuccgcugccgggaccgccugagccccugggccgcgcgguccacccaccgcggcacccggagccucccgacgguggaggucaccgagaaggugaacaccaucaccuccacgcugcaggacaccagccgcaaccugcgccagguggaccagaugcucgggcgguaccgggaguacuccaacggccaggccggggccaucgagcaccugaaggagagccuggagcaguccaucgaccagcuccgcagccagcggcugcugcgcaacuccggcgggcggagcaucuccgucaccagccucuccgccagcgaccuggacggcggcaccggguccgagcugcaccacuucccgcccacgagcccccucaaggacuacggcgacccccaggggaucaagcgcaugcggagccgcaccggcgugcgguucgugcaggagaccgacgacaugacccagcugcacggguuccaccagucccugcgcgaccucagcuccgagcagauccggcugggcgacgacuucaaccgcgagcugagccggcgcucccgcagcgacgccgagacgaagcgggcgcucgaggagcugaccgagaagcugaacgaggcccagaagcaggaggucguguccgaccgcguggagcggcgccuccaggagcuggagcgggagaugcgcaccgagcgggagcuggucgagcgccggcaggaccagcucggccugaugagccugcagcuccaggaggcccugaagaagcaggaggccaaggcggacgagcacgagggggccaucaagaacaagcugcgccagaccgagacggagaagaaccagcucgagcaggagcuggagcugucccggcgccuccugaaccagagcgagggcucccgggagacccugcuccaccagguggaggagcugcgcacccagcugaccaaggccgagggggaccggaagggccuccagcaccaggugagccagaucuccaagcagcagagcaacuaccaggacgagcagggcgaggacuggcgcuuccggcgcggggucgagcgggagaagcaggaccuggagaagcagauguccgaccugcgcgugcagcucaacuucagcgccauggccuccgagcuggaggaggugaagcgcugcauggagcggaaggacaaggagaaggcgcaccuggccagccaggucgagaaccucacgcgcgagcuggagaacggcgagaagcagcagcugcagaugcucgaccggcugaaggagauccagaaccacuucgacacgugcgaggccgagcgcaagcacgccgaccugcagaucuccgagcugacccggcacgccgaggacgcgaccaagcaggccgagcgcuaccucagcgagcugcagcagagcgaggcccugaaggaggaggccgagaagcggcgcgaggaccucaagcugaaggcccaggaguccauccggcaguggaagcugaagcacaagaagcucgagcgcgcgcuggagaagcagagcgagaccguggacgagcugaccgggaagaacaaccagauccucaaggagaaggacgagcugaagacccagcuguacgccgcccuccagcagaucgagaaccugcggaaggagcugaacgacgugcucaccaagcgcgcccugcaggaggaggagcugcacuccaaggaggagaagcuccgggacaucaagagccaccaggccgaccuggagcuggaggucaagaacucccucgacacgauccaccgccuggagagcgagcugaagaagcaguccaagauccagagccagaugaagguggagaaggcgcaccucgaggaggagaucgccgagcugaagaagucccaggcccaggacaaggccaagcugcucgagaugcaggagagcaucaaggaccuguccgcgauccgggccgaccuggccaacaagcucgccgaggaggagcgcgccaagaaggcggugcugaaggaccugagcgaccucaccgcccaggccaagucccgggacgaggagaccgccaccaucaucacgcagcugaagcuggagcgcgacguccaccagcgggagcucaaggaccugaccagcucccugcagagcgugaagaccaagcacgagcagaacauccaggagcucaugaagcacuucaagaaggagaaguccgaggccgagaaccacauccgcacccugaaggcggagagccuggaggagaagaacauggccaagauccaccggggccagcucgagaagcucaagagccagugcgaccgccugacggaggagcugacccagaacgagaacgagaacaagaagcugaagcugaaguaccagugccucaaggaccagcuggaggagcgcgagaagcacaucuccaucgaggaggagcaccuccggcgcauggaggaggcccggcugcagcugaaggaccagcugcucugccuggagaccgagcaggagagcauccugggggugaucggcaaggagaucgacgccgccugcaagaccuucuccaaggacagcgucgagaagcucaagguguucuccagcggccccgacauccacuacgacccccaccgcuggcuggcggaguccaagaccaagcugcaguggcucugcgaggagcugaaggagcgggagaaccgcgagaagaaccugcggcaccagcucaugcugugccgccagcagcugcggaaccucacggagaacaaggagagcgagcugcagugccuguuccagcagaucgagcgccaggagcagcuccuggacgagauccaccgggagaagcgcgaccugcucgaggagacccagcggaaggacgaggagauggggucccugcaggaccgcgucaucgcccuggagaccagcacccagguggcccucgaccaccuggaguccgugcccgagaagcugagccuccuggaggacuucaaggacuuccgggacuccugcagcuccagcgagcgcacggacggccgguacuccaaguaccgcguccggcgcaacagccugcagcaccaccaggacgacaccaaguaccgcaccaaguccuucaagggggaccggaccuuccucgagggcagccacacgcgcgggcuggaccacagcuccagcuggcaggaccacucccgguuccugagcuccccgcgcuucagcuacgugaacuccuucaccaagcggaccguggcccccgacagcgcguccaacaaggaggacgccaccaugaacggcacgagcucccagcccaagaaggaggaguacggcagcuga

SEQ ID NO: 28142 - RNA, 3135 nt, Artificial Sequence
  derived and/or modified sequence opt1 from CEP131__Homo_sapiens__NP_001009811
augaagggcacccgcgccaucgggagcgugcccgagcgguccccggccggcgucgaccugagccucaccgggcugcccccgcccgugucccgccggccgggcagcgcggccacgaccaagcccaucgugcgcuccgucagcguggugaccggguccgagcagaagcggaagguccuggaggccaccggccccggcgggagccaggccaucaacaaccuccgccgguccaacagcacgacccaggugucccagccccgcagcggcuccccgcggcccaccgagcccaccgacuuccugaugcuguucgaggggagccccuccggcaagaagcgcccggccagccucuccacggcgcccagcgagaagggggccaccuggaacgugcuggacgaccagccccggggcuucacccugcccuccaacgcccgcagcagcuccgcccucgacagcccggcgggcccccggcgcaaggagugcaccgucgcccuggcccccaacuucacggccaacaaccgguccaacaagggggccgugggcaacugcgugaccaccaugguccacaaccgcuacacccccagcgagcgggcgccgccccugaaguccagcaaccagacggcccccucccucaacaacaucaucaaggccgcgaccugcgaggggagcgaguccagcggcuucggcaagcugcccaagaacguguccagcgccacccacuccgcccgcaacaacaccgggggcagcacggggcugccgcggcgcaaggaggugaccgaggaggaggccgagcgguucauccaccaggucaaccaggccaccgugaccauccagcgcugguaccgccaccaggugcagcggcgcggcgccggggccgcgcggcucgagcaccuccugcaggccaagcgcgaggagcagcggcagcgcuccggcgagggcacgcugcuggaccugcaccagcagaaggaggccgcccggcgcaaggcccgggaggagaaggcgcgccaggcccggcgcgccgccauccaggagcuccagcagaagcgggcgcugcgcgcccagaaggccagcaccgccgagcgggggccgcccgagaacccccgcgagacccggguccccggcaugcgccagcccgcccaggagcugucccccacccccgggggcacggcgcaccaggcccucaaggccaacaacaccgggggcggccugcccgccgccgggcccggcgaccggugccugcccaccagcgacuccagcccggagccccagcagccgcccgaggaccgcacccaggacgugcucgcgcaggacgccgccggggacaaccuggagaugauggcccccagccgcggcuccgccaagagccgggggccccuggaggagcuccugcacacgcugcagcuccuggagaaggagcccgacgugcugccccgcccgcggacccaccaccgcggccgguacgcgugggccuccgaggaggacgacgccagcucccucaccgccgacaaccuggagaaguucggcaagcugagcgcguuccccgagccgcccgaggacgggacccuccuguccgaggccaagcugcagagcaucauguccuuccucgacgagauggagaaguccggccaggaccagcuggacagccagcaggagggguggguccccgaggccggccccggcccccuggagcucgggagcgagguguccacgagcgugaugcgccugaagcuggaggucgaggagaagaagcaggccaugcuccugcugcagcgggcccuggcgcagcagcgcgaccucaccgcccggcgcgugaaggagaccgagaaggcccugucccggcagcugcagcgccagcgggagcacuacgaggccaccauccagcgccaccucgccuucaucgaccagcugaucgaggacaagaagguccugagcgagaagugcgaggcggugguggccgagcucaagcaggaggaccagcggugcaccgagcgcgucgcccaggcccaggcccagcacgagcuggagaucaagaagcugaaggagcucauguccgcgacggagaaggcccggcgcgagaaguggaucagcgagaagaccaagaagaucaaggaggugaccgugcggggccuggagcccgagauccagaagcugaucgcccgccacaagcaggagguccggcgccucaagagccugcacgaggccgagcugcuccaguccgacgagcgcgcgagccagcggugccugcgccaggccgaggagcugcgggagcagcucgagcgcgagaaggaggcccuggggcagcaggagcgggagcgcgcccggcagcgccagcgggccgagcuggaggagcuccgccagcagcuggaggaguccagcuccgcgcugacccgggcccuccgcgccgaguucgagaagggccgggaggagcaggagcgccggcaccagauggagcugaacacgcugaagcagcagcucgagcuggagcgccaggccugggaggccgggcggacccgcaaggaggaggcguggcugcucaaccgggagcaggagcugcgcgaggagauccgcaagggccgggacaaggagaucgagcuggugauccaccgccucgaggccgacauggcccuggccaaggaggagagcgagaaggccgcggagucccggaucaagcgccugcgggacaaguacgaggccgagcucagcgagcuggagcaguccgagcgcaagcugcaggagcggugcagcgagcucaagggccagcugggggaggccgagggcgagaaccugcgccuccaggggcuggugcggcagaaggagcgcgcccuggaggacgcccaggcggucaacgagcagcucuccagcgagcgguccaaccuggcccaggugauccgccaggaguucgaggaccggcuggccgccagcgaggaggagacccgccaggcgaaggccgagcucgccacccugcaggcccggcagcagcuggagcucgaggaggugcaccgccgggucaagacggcccuggcgcgcaaggaggaggccguguccagccugcggacccagcacgaggccgccgugaagcgcgccgaccaccucgaggagcugcuggagcagcaccggcgcccgacccccuccaccaaguga

SEQ ID NO: 28143 - RNA, 3423 nt, Artificial Sequence
  derived and/or modified sequence opt1 from CEP135__Homo_sapiens__NP_079285
augaccaccgccguggagcgcaaguacaucaacauccggaagcgccuggaccagcucggcuaccggcagacgcugaccgucgagugccugccccucguggagaagcuguucagcgaccuggugcacaccaccgagucccuccgccagagcaagcuguccgccgucaaggcggagaaggagagcgccaacuucgacuucgugcuggagccguacaagcucgagaacgcccggcugucccgcgagaacaacgagcuguaccucgagcugaugaagcugcgggagcacagcgaccagcacgugaaggagcucaagacgucccugaagaagugcgcccgcgagaccgccgaccugaaguuccucaacaaccaguacgcgcacaagcugaagcugcucgagaaggagagcaaggccaagaacgagcggauccagcagcugcaggagaagaaccugcacgccgucgugcagacccccgggggcaagaagcgcuccaucgccuuccggcgccagcggaugcagaucgacgagcccgugcccccgagcgaggucuccagcuaccccgugccccagcccgacgacccguacaucgcggaccuccuccagguggccgacaaccgcauccaggagcugcagcaggagguccaccagcugcaggagaagcuggccaugauggaguccggggugcgggacuacagcaagcagaucgagcugcgcgagcgggagaucgagcgccucuccguggcccuggacggcgggcggagccccgacguccugucccucgagagccgcaacaagaccaacgagaagcugaucgcccaccugaacauccagguggacuuccuccagcaggcgaacaaggaccuggagaagcggauccgcgagcugauggagacgaaggagaccgugaccuccgaggucgugaaccucagcaacaagaacgagaagcugugccaggagcugaccgagaucgaccagcucgcccagcagcuggagcgccacaaggaggaggugcuggagacggccgacaaggagcucggcgaggccaagaaggagaucaagcggaagcugagcgagaugcaggaccuggaggagaccauggccaagcuccagcuggagcugaaccugugccagaaggagaaggagcgccucuccgacgagcugcuggucaagagcgaccucgagaccguggugcaccagcuggagcaggagaagcagcggcuguccaagaaggucgagagcuucgcggugaccgagcgccagcucacgcuggaggucgagcggaugcgccuggagcacggcaucaagcggcgcgaccggucccccagccgccucgacaccuuccugaaggggaucgaggaggagcgggacuacuacaagaaggagcuggagcgccuccagcacaucauccagcggcgcuccugcagcaccuccuacagcgcccgggagaaguccagcaucuuccgcacccccgagaagggcgacuacaacuccgagauccaccagaucacgcgggagcgcgacgagcugcagcggaugcuggagcgcuucgagaaguacauggaggacauccagagcaacgugaagcuccugaccgccgagcgcgacaagcuguccgugcucuacaacgaggcccaggaggagcugagcgcccugcggaaggaguccacccagaccacggcgccgcacaacaucgucagccucauggagaaggagaaggagcuggcccuguccgaccuccgccggaucauggccgagaaggaggcccugcgcgagaagcuggagcacaucgaggaggugagccucuucggcaagagcgagcuggagaagaccaucgagcaccugaccugcgugaaccaccagcucgaguccgagaaguacgagcucaagagcaagguccugaucaugaaggagaccaucgagucccuggagaacaagcugaaggugcaggcccagaaguucagccacguggcgggggacuccagccaccagaagacggaggucaacucccugcggaucgugaacgagcagcuccagcgcagcguggacgacuaccagcaccggcuguccaucaagcgcggggagcuggagagcgcccaggcccagaucaagauccucgaggagaagaucgacgagcugaaccugaagaugaccucccaggacgaggaggcccacgucaugaagaagaccaucggcgugaucgacaaggagaaggacuuccuccaggagaccguggacgagaagacggagaagaucgcgaaccugcaggagaaccuggccaacaaggagaaggccgucgcccagaugaagaucaugaucagcgagugcgaguccagcgugaaccagcucaaggagacccuggugaaccgggaccgcgagaucaacucccugcggcgccagcucgacgccgcgcacaaggagcuggacgaggucggccggagccgcgagaucgccuucaaggagaaccggcgccugcaggacgaccucgccaccauggcccgggagaaccaggagaucucccuggagcuggaggccgcggugcaggagaaggaggagaugaagucccgcgugcacaaguacaucaccgaggucagccggugggagagccucauggccgccaaggagaaggagaaccaggaccugcuggaccgcuuccagaugcuccacaaccgggccgaggacugggaggugaaggcccaccaggcggagggggagagcuccagcgugcgccuggagcugcucuccaucgacacggagcgccggcaccuccgcgagcgggucgagcugcuggagaaggagauccaggagcacaucaacgcccaccacgccuacgagagccagaucuccagcauggccaaggcgaugucccgccuggaggaggagcugcggcaccaggaggacgagaaggccaccgugcucaacgaccugagcucccugcgcgagcucugcaucaagcuggacagcggcaaggacaucaugacccagcagcugaacuccaagaaccucgaguucgagcggguggucguggagcuggagaacgucaagagcgaguccgaccugcucaagaagcagcugagcaacgagcgccacaccgugaagaaccuggagucccuccuggccaccaaccgggacaaggaguuccacagccaccugacgucccacgagaaggacaccgagauccagcuccugaaggagaagcugacccucagcgagagcaagcugaccucccagagccgcgagaacacgaugcugcgggccaagguggcccagcuccagaccgacuacgacgcgcugaagcgccagaucuccaccgagcgguacgagcgcgagcgggccauccaggagaugcgccggcacgggcuggccaccccgccccucagcuccacgcugcgcagccccucccacagccccgagcaccggaacguguga

SEQ ID NO: 28144 - RNA, 4965 nt, Artificial Sequence
  derived and/or modified sequence opt1 from CEP152__Homo_sapiens__NP_055800
augagccuggacuucggcuccguggcccuccccguccagaacgaggacgaggaguacgacgaggaggacuacgagcgcgagaaggagcugcagcagcugcucaccgaccugccgcacgacaugcuggacgacgaccucagcucccccgagcugcaguacagcgacugcuccgaggacgggaccgacggccagccccaccaccccgagcagcuggagaugagcuggaacgagcagaugcucccgaagucccagagcgugaacggguacaacgagauccagucccuguacgccggcgagaagugcgggaacgugugggaggagaaccggagcaagacggaggaccgccaccccgucuaccaccccgaggagggcggcgacgagggcggguccggguacagcccgcccuccaagugcgagcagaccgaccuguaccaccuccccgagaacuuccggcccuacaccaacggccagaagcaggaguucaacaaccaggcgaccaacgugaucaaguucagcgacccccaguggaaccacuuccaggggccguccugccagggccuggagcccuacaacaaggugacguacaagcccuaccagagcuccgcccagaacaacggcagccccgcccaggagaucaccggguccgacaccuucgagggccugcagcagcaguuccucggggccaacgagaacagcgccgagaacaugcagaucauccagcugcagguccugaacaaggcgaaggagcgccagcucgagaaccugaucgagaagcugaacgagagcgagcggcagauccgcuaccucaaccaccagcuggugaucaucaaggacgagaaggacggccugacccucucccugcgggagagccagaagcuguuccagaacggcaaggagcgcgagauccagcucgaggcccagaucaaggcccuggagacgcagauccaggcccugaaggugaacgaggagcagaugaucaagaagucccggaccaccgagauggcgcucgagagccugaagcagcagcuggucgaccuccaccacuccgagagccugcagcgcgcccgggagcagcacgaguccaucgugauggggcugaccaagaaguacgaggagcagguccucagccugcagaagaaccuggacgccacggugaccgcccucaaggagcaggaggacaucugcucccgccugaaggaccacgugaagcagcuggagcggaaccaggaggccaucaagcucgagaagaccgagaucaucaacaagcugacccgcagccuggaggagucccagaagcagugcgcgcaccuccugcagagcggcuccgugcaggaggucgcccagcugcaguuccagcuccagcaggcccagaaggcccacgccaugagcgcgaacaugaacaaggcccugcaggaggagcugacggagcugaaggacgagaucucccucuacgagagcgccgccaagcuggggauccacccguccgacagcgagggcgagcugaacaucgagcucaccgaguccuacguggaccuggggaucaagaaggugaacuggaagaaguccaaggucaccagcaucgugcaggaggaggaccccaacgaggagcugagcaaggacgaguucauccucaagcugaaggccgaggugcagcggcugcucggcagcaacuccaugaagcgccaccuggucagccagcugcagaacgaccucaaggacugccacaagaagaucgaggaccugcaccaggugaagaaggacgagaaguccaucgagguggagaccaagacggacaccagcgagaagcccaagaaccagcuguggcccgaguccagcaccuccgacgucgugcgggacgacauccuccugcugaagaacgagauccagguccuccagcagcagaaccaggagcugaaggagaccgagggcaagcugcgcaacacgaaccaggaccucugcaaccagaugcggcagauggugcaggacuucgaccacgacaagcaggaggcgguggaccgcugcgagcggaccuaccagcagcaccacgaggccaugaagacccagauccgcgagagccugcuggccaagcacgcccucgagaagcagcagcuguucgaggccuacgagcgcacccaccuccagcugcgguccgagcuggacaagcugaacaaggaggucacggcggugcaggagugcuaccucgaggugugccgcgagaaggacaaccuggagcugacccuccggaagaccaccgagaaggagcagcagacgcaggagaagaucaaggagaagcugauccagcagcuggagaaggaguggcagagcaagcucgaccagaccaucaaggccaugaagaagaagacccuggacugcgggucccagaccgaccaggucacgaccagcgacgugaucuccaagaaggagauggccaucaugaucgaggagcagaagugcaccauccagcagaaccuggagcaggagaaggacaucgccaucaagggcgcgaugaagaagcucgagaucgagcuggagcugaagcacugcgagaacaucaccaagcaggucgagaucgccgugcagaacgcccaccagcgcuggcucggggagcugccggagcuggccgaguaccaggcccucgugaaggcggagcagaagaagugggaggagcagcacgaggugagcgucaacaagcggaucuccuucgccgugagcgaggccaaggagaaguggaaguccgagcuggagaacaugcgcaagaacauccugcccggcaaggagcucgaggagaagauccacagccugcagaaggagcuggagcucaagaacgaggaggugcccgucgugauccgggccgagcuggccaaggcgcgcagcgaguggaacaaggagaagcaggaggagauccaccggauccaggagcagaacgagcaggacuaccgccaguuccuggacgaccaccggaacaagaucaacgaggugcucgccgccgccaaggaggacuucaugaagcagaagaccgagcugcugcuccagaaggagacggagcugcagaccugccuggaccagucccgccgggaguggaccaugcaggaggccaagcgcauccagcucgagaucuaccaguacgaggaggacauccugaccguccugggggugcuccugagcgacacgcagaaggagcacaucuccgacagcgaggacaagcagcugcucgagaucauguccacgugcagcuccaaguggaugagcgugcaguacuucgagaagcugaagggcugcauccagaaggcguuccaggacacccugccccuccuggucgagaacgccgacccggaguggaagaagcggaacauggccgagcuguccaaggacagcgccucccagggcaccgggcagggcgaccccgggcccgcggccggccaccacgcccagccccucgcccugcaggccaccgaggcggaggccgaggagaacaacaaggugguggaggagcugaucgaggagaacaacgacaugaagaacaagcucgaggagcugcagacccugugcaagaccccgccccgcagccucuccgccggggccaucgagaacgccugccugcccugcagcggcggcgcgcuggaggagcuccgggggcaguacaucaaggccgucaagaagaucaagugcgacaugcugcgcuacauccaggaguccaaggagcgggccgccgagauggugaaggccgaggugcugcgcgagcgccaggagaccgcgcggaagaugcgcaaguacuaccucaucugccugcagcagauccugcaggacgacggcaaggagggggccgagaagaagaucaugaacgccgccagcaagcucgcgacgauggccaagcugcuggagaccccgaucuccagcaagagccaguccaagaccacccagagcgcccucccccugacguccgagaugcugaucgccgucaagaaguccaagcggaacgacgugaaccagaagauccccugcugcaucgagagcaagagcaacuccgugaacaccaucacccgcacccucugcgagcaggcccccaagcggcgcgcggccugcaaccugcagcggcugcuggagaacagcgagcaccaguccaucaagcacgucggcagcaaggagacgcaccucgaguuccaguucggcgacggguccugcaagcaccugaacagccugccgcgcaacgugucccccgaguucgugcccugcgagggcgagggcggguucgggcuccacaagaagaaggaccugcugagcgacaacggcuccgagagccucccccacuccgccgccuacccguuccugggcacccuggggaacaagcccagcccccggugcacccccggcccguccgagagcgggugcaugcacaucaccuuccgcgacagcaacgagcggcucggccugaaggucuacaagugcaacccccugauggaguccgagaacgccgcgagcgagaagucccaggggcucgacgugcaggagccgcccgugaaggacggcggcgaccugagcgacugccugggguggcccuccagcuccgccacgcucagcuucgacucccgcgaggccagcuucguccacggccggccccaggggacccuggagauccccuccgagagcgugaaguccaagcaguucagccccuccggcuaccugagcgacaccgaggaguccaacaugaucugccagaccaugaagugccagcgcuaccagacgccguaccucagcgaggagaccaccuaccuggagcccgggaagaucuccgugaacugcggccaccccagccggcacaaggccgaccgccucaagagcgacuucaagaagcuguccagcacccugcccuccagcgucugccagcagccgucccggaagcugaucgugccccucagcucccagcaggacagcggcuucgacucccccuucgugaaccuggacuga

SEQ ID NO: 28145 - RNA, 4212 nt, Artificial Sequence
  derived and/or modified sequence opt1 from CEP162__Homo_sapiens__NP_055710
auggccaacugcagccaggaggagcuggacgaggaguucgagcaguucaugaaggagcucuccgacgacagcuucgagaacuccgacaagaccgcccgccagagcaagaaggagaugaagaagaaggacaccgugcccugguggaucacggaggacgacuucaaggacgacggccugcuggggaccaacgucuccuaccucaagaccaagaagaccagccagccggugauggagaucgaggaggaguccgcggagaagauccaguuccucaagagcuccggcacgagccugcucuccaccgacagccuggagaccaacgagcugguggucuccgagcucaaccacagcucccugggggugggccuggacacccucgaggagcaggaggagaaggagcaguucuucgcccggcuggagaaggggcugacgagcuccaucgacuacagccgccucaacaaggagcuggacuccaacgacagcacccacuucaaggcccugcacagcaaccaggccaacgccgagcucaccgacgacgagcacgagaacgaguccaagcacgaggagcuggcggagaacuacagcgacgacuucgaggacgaguacgugggcgcgccccugaccacgaaggacgaggagaugcccuccaaggagaacagcaaguccgagaagaucagcguccccaagcaggaggaggagaagaccggcaugcucgccaacguggugcugcuggacucccucgacagcgucgccgaggugaaccuggacgagcaggacaagaucaccccgaagccccggugccugcccgagaugaccgagaacgagaugacggggaccggcguguccuacgggcagagcuccagcgacgucgaggcccuccaccaggccuacugccacaucgcccacucccugggcgacgaggacaagcagaagaucgagagcaacaccguggaggacaucaaguccagcgugaaggggcacccccaggagaacgaggagaacuccaagaacaucagcaccauggaguccgaccugccgacggucgaggagcucaugaagcccauccgcaucgacagcuucggcaucagcggcuucgaccugcagcccguguccagcgagaagguggccgagcggaaggagaccgaguucuucuccagccugccccucaagaugaacccgaacauccugucccaggacagccagcacgucaaccuguucuucgacaagaacgacgagaacgugauccuccagaagaccaccaacgaguccauggagaacagcugcccccaggugacggaggucaccgccaccgaggagcacguggacaagauguaccugaacauccugcgcaagaagaucaccgugaacuccagcucccucagccaggacgacaagaucaacaagacguaccggucccagcugagcuccgaggaggagggggcggucaugggcaagcagguccccuacaagaaggcccgcagcgcgcccccgcugcucaagcggaagccccaguccgggcuguacgccagcgugcgcagcuccggcuacggcaagcccagcagcccccugaagauguucagcacccucgagaagaagaccuccgaggacaucaucaagagcaagaaccugcgguccaucagcaccuccaaccagccgcgcaagaaggagauccugagcgggacgaagcucaucaagcccgccgcccuggacaagcccgcccacaagaccgaguccugccugagcacccggaagaaguccgagaaccccaccgagacggacagcugcauccaguuccagaccgacucccugggcuacugcggggagaacaaggagaagaagcuccugauguucaagcgcgugcaggaggccgaggacaaguggcggggcgcccaggcccugaucgagcagaucaaggcgaccuucagcgagaaggagaaggagcucgagaacaagcuggaggagcugaagaagcagcaggagaaggagcuguucaagcugaaccaggacaacuacauccugcaggccaagcucuccagcuucgaggagaccaacaagaagcagcgcuggcugcacuucggggaggccgccgacccggugaccggcgagaagcugaagcagauccagaaggagauccaggagcaggagacgcuccugcagggcuaccagcaggagaacgagcggcuguacaaccaggucaaggaccuccaggagcagaacaagaagaacgaggagcgcauguucaaggagaaccagucccuguucagcgagguggccagccugaaggagcagaugcacaagucccgguuccucagccagguggucgaggacuccgagcccacccgcaaccagaacuucaccgaccugcuggcggagcuccggauggcccagaaggagaaggacagccugcuggaggacaucaagcgccucaagcaggacaagcaggcccuggagguggacuucgagaagaugaagaaggagcgcgaccaggccaaggaccagaucgcguacgugaccggggagaagcuguacgagaucaagauccucgaggagacgcacaagcaggagaucucccggcugcagaagcgccugcagugguacgccgagaaccaggagcuccuggacaaggacgcccugcggcuccgcgaggccaacgaggagaucgagaagcugaagcuggagaucgagaagcucaaggccgagagcggcaaccccuccauccggcagaagauccgccugaaggacaaggcggccgacgccaagaagauccaggaccuggagcggcaggucaaggagauggaggggauccucaagcgccgguaccccaacagccugccggcccugauccucgccgcguccgccgccggcgacaccguggacaagaacaccguggaguucauggagaagcgcaucaagaagcuggaggccgaccuggaggggaaggacgaggacgccaagaagucccuccggaccauggagcagcaguuccagaagaugaagauccaguacgagcagcgccuggagcagcaggagcagcugcucgcgugcaagcugaaccagcacgacagcccccggaucaaggcccuggagaaggagcucgacgacaucaaggaggcccaccagaucacgguccgcaaccuggaggccgagaucgacgugcugaagcaccagaacgcggagcucgacgugaagaagaacgacaaggacgacgaggacuuccaguccaucgaguuccaggucgagcaggcccacgccaaggccaagcuggugcggcugaacgaggagcucgccgcgaagaagcgcgagauccaggaccuguccaagaccguggagcggcugcagaaggaccgccggaugaugcucagcaaccagaacuccaagggccgcgaggagaugagcgccaagcgcgccaagaaggacguccugcacuccagcaagggcaacgccaacuccuuccccgggacccuggacagcaagcucuaccagccgcacaccuucacggacagccacguguccgaggugcugcaggagaacuaccggcugaagaacgagcucgagggccugaucagcgagaagaacgagcugaagaugaaguccgaggccgucaugaaccaguucgagaacagcaugcgccgggugaaggaggacaccgcggcccacaucgccucccucaaggccagccaccagcgcgagaucgagaagcugcugugccagaacgccguggagaacuccagcuccaaggucgcggagcucaaccggaagaucgccacccaggaggugcugauccgccacuuccagagccaggugaacgagcugcaguccaagcaggagagccucgucguguccgaggugcgggaggagauccugcagaaggagaucaccaagcugcucgaggagcugcgcgaggccaaggagaaccacacgcccgagaugaagcacuucgucgggcuggagaagaagaucaagcagauggagaugcggcacgcccagcgcgagcaggagcuccagcagaucauccagcagacccaccaggugguggagaccgagcagaacaaggaggucgagaaguggaagcggcuggcgcagcugaagaaccgcgagcucgagaaguuccggaccgagcuggacagcauccuggacgugcuccgcgagcugcaccggcagggcguggucgugcccguggccuucgccgacgagaugaacgcccccgaguacuga

SEQ ID NO: 28146 - RNA, 4368 nt, Artificial Sequence
  derived and/or modified sequence opt1 from CEP164__Homo_sapiens__NP_001258862
auggccggccgcccccugcggaucggggaccagcucgugcuggaggaggacuacgacgagaccuacaucccgagcgagcaggagauccuggaguucgcccgcgagaucggcaucgaccccaucaaggagcccgagcucauguggcuggcgcgggaggggaucgucgcgccccugccgggcgaguggaagcccugccaggacaucaccggggacaucuacuacuucaacuucgccaacggccaguccaugugggaccaccccugcgacgagcacuaccgcagccucgugauccaggagcgggccaagcuguccacgagcggcgccaucaagaagaagaagaagaagaaggagaagaaggacaagaaggaccgcgacccgcccaaguccagccuggcccucggguccagccuggcccccgugcacgucccccugggcgggcucgcgccccugcggggccugguggacaccccgcccuccgcccuccgcgggagccaguccgugagccugggcuccagcgucgaguccggccggcagcugggggagcucaugcugcccagccagggccugaagaccuccgccuacaccaaggggcuccugggcagcaucuacgaggacaagacggcccugucccuccugggccugggggaggagaccaacgaggaggacgaggaggagagcgacaaccagagcgugcacuccagcuccgagccccuccgcaaccugcaccuggacaucggcgcccucgggggcgacuucgaguacgaggagagccugcggaccucccagccggaggagaagaaggacgugagccuggacuccgacgccgccgggccgcccacccccugcaagcccagcucccccggcgcggacagcucccucagcuccgccgucggcaaggggcgccagggcagcggggcccggcccggccugcccgagaaggaggagaacgagaaguccgagccgaagaucugccgcaaccuggugacgcccaaggccgaccccaccgggagcgagcccgccaaggcguccgagaaggaggccccggaggacaccguggacgccggcgaggagggcagccggcgcgaggaggccgccaaggagcccaagaagaaggcguccgcccucgaggaggggagcagcgacgccucccaggagcuggagaucagcgagcacaugaaggagccccagcuguccgacagcaucgccuccgaccccaagagcuuccacggccucgacuucggguuccggucccgcaucagcgagcaccuccuggacgucgacgugcucucccccgugcugggcggggccugccggcaggcgcagcagccccugggcaucgaggacaaggacgacagccaguccagccaggacgagcuccaguccaagcagagcaagggccuggaggagcgcuaccaccggcugagcccgccccucccccacgaggagcgcgcccaguccccgccccgcucccuggccaccgaggaggagccgccccaggggcccgagggccagcccgaguggaaggaggccgaggagcugggggaggacagcgcggccagccugucccugcagcugagccugcagcgggagcaggccccguccccgcccgccgccugcgagaagggcaaggagcagcacagccaggcggaggagcucggccccgggcaggaggaggccgaggaccccgaggagaaggucgccgugucccccacgccgcccgugagccccgagguccgcuccaccgagcccguggccccgcccgagcagcugagcgaggccgcgcugaaggccauggaggaggccguggcccagguccucgagcaggaccagcggcaccuccuggaguccaagcaggagaagaugcagcagcugcgcgagaagcugugccaggaggaggaggaggagauccugcggcuccaccagcagaaggagcagagccuguccagccugcgcgagcggcuccagaaggccaucgaggaggaggaggcgcgcaugcgggaggaggagucccagcgccugagcuggcugcgggcccaggugcaguccagcacccaggccgacgaggaccagauccgcgccgagcaggaggcgucccuccagaagcugcgggaggagcuggagagccagcagaaggccgagcgcgccucccucgagcagaagaaccggcagaugcuggagcagcugaaggaggagaucgaggccagcgagaaguccgagcaggccgcgcucaacgccgccaaggagaaggcccugcagcagcugcgcgagcagcucgagggcgagcggaaggaggccguggcgacccuggagaaggagcacagcgccgagcuggagcgccucugcagcucccuggaggccaagcaccgggaggucgugagcucccugcagaagaagauccaggaggcccagcagaaggaggaggcccagcuccagaagugccuggggcaggucgagcaccgcgugcaccagaaguccuaccacguggcgggcuacgagcacgagcugagcagccuccugcgcgagaagcggcaggaggucgagggggagcacgagcgccggcuggacaagaugaaggaggagcaccagcaggucauggccaaggcccgcgagcaguacgaggccgaggagcggaagcagcgcgcggagcuccugggccaccugacgggcgagcucgagcggcugcagcgcgcccacgagcgggagcuggagaccgugcgccaggagcagcacaagcggcucgaggaccugcgccggcgccaccgggagcaggagcgcaagcugcaggaccucgagcuggaccuggagacccgggccaaggacgugaaggcccgccucgcccugcuggaggugcaggaggagaccgcgcggcgcgagaagcagcagcuccuggacgugcagcggcaggucgcccugaaguccgaggaggccacggccacccaccagcagcucgaggaggcccagaaggagcacacccaccuccugcagagcaaccagcagcugcgcgagauccuggacgagcugcaggcgcgcaagcucaagcuggagucccagguggaccugcuccaggcccagagccagcagcugcagaagcacuucuccagccuggaggccgaggcccagaagaagcagcaccuccugcgggaggugaccgucgaggagaacaacgccagcccccacuucgagcccgaccugcacaucgaggaccuccgcaagucccuggggacgaaccagaccaaggagguguccagcucccugagccagagcaaggaggaccucuaccuggacucccugagcucccacaacguguggcaccuccugagcgcggagggcgucgcccugcgguccgccaaggaguuccucgugcagcagacccgcagcaugcggcgccggcagaccgcccugaaggccgcgcagcagcacuggcgccacgagcuggccuccgcccaggagguggccaaggacccgcccgggaucaaggcgcucgaggacaugcggaagaaccuggagaaggagacgcgccaccuggacgagaugaaguccgccaugcggaagggccacaaccuccugaagaagaaggaggagaagcugaaccagcucgagagcagccugugggaggaggccuccgacgaggggacccugggcggcagccccaccaagaaggccgucaccuucgaccucuccgacauggacagccuguccagcgaguccagcgaguccuucagcccgccccaccuggacagcacgcccucccugaccagccgcaagauccacgggcucucccacagccugcggcagaucuccagccagcuguccagcgugcucuccauccuggacagccugaacccccaguccccgccgccccuccuggccagcaugcccgcgcagcugccgccccgcgaccccaaguccacccccacccccacguacuacggcagccucgcccgguucuccgcccugagcuccgccacccccaccagcacccagugggccugggacuccgggcagggcccccgccugcccagcagcguggcgcagaccgucgacgacuuccuccuggagaaguggcggaaguacuuccccuccgggaucccccugcucagcaacuccccgacgccccuggagagccgccugggcuacauguccgccagcgagcagcuccggcugcugcagcacucccacagccaggugcccgaggccggcuccaccaccuuccaggggaucaucgaggccaaccgccgcuggcucgagcgggugaagaacgacccccgccugccgcuguucagcuccacccccaagcccaaggccacgcucagccugcugcagcucggccuggacgagcacaaccgggucaagguguaccgcuucuga

SEQ ID NO: 28147 - RNA, 4461 nt, Artificial Sequence
  derived and/or modified sequence opt1 from CEP170__Homo_sapiens__NP_001035863
augagccugaccuccugguuccucgugagcuccggcgggacccgccaccggcugccccgcgagaugaucuucgucggccgggacgacugcgagcugaugcuccagagccgcuccguggacaagcagcacgccgugaucaacuacgacgccagcacggacgagcaccuggucaaggaccuggggucccucaacggcaccuucgugaacgacgugcggaucccggagcagaccuacaucacccugaagcuggaggacaagcuccgcuucggguacgacacgaaccuguucaccgucgugcagggcgagaugcgggugcccgaggaggcgcugaagcacgagaaguucaccauccagcuccagcugagccagaaguccagcgaguccgagcugagcaaguccgccagcgccaaguccaucgacagcaaggucgccgacgccgcgaccgaggugcagcacaagacgaccgaggcccucaaguccgaggagaaggccauggacaucagcgccaugccccgcggcacgccccuguacgggcagccguccugguggggcgacgacgagguggacgagaagcgggcguucaagaccaacgggaagcccgaggagaagaaccacgaggccggcaccagcgggugcggcaucgacgccaagcaggucgaggagcagagcgccgccgcgaacgaggaggugcuguuccccuucugccgcgagcccuccuacuucgagaucccgaccaaggaguuccagcagcccagccagaucaccgaguccaccauccacgagauccccacgaaggacacccccagcucccacaucaccggcgccgggcacgccagcuucaccaucgaguucgacgacuccacgccgggcaaggugaccauccgggaccacgucaccaaguucaccagcgaccagcgccacaaguccaagaaguccucccccgggacgcaggaccuccugggcauccagaccggcaugauggcccccgagaacaagguggccgacuggcuggcgcagaacaacccgccccagaugcucugggagcggaccgaggaggacagcaaguccaucaagagcgacgugcccgucuaccugaagcgccugaaggggaacaagcacgacgacggcacccaguccgacagcgagaacgccggggcccaccggcgcugcuccaagcgggccacgcucgaggagcaccuccgccggcaccacagcgagcacaagaagcugcagaaggugcaggccaccgagaagcaccaggaccaggcgguggucuucggcguggacgacaaccaggacuacaaccgccccgugaucaacgagaagcacaaggaccucaucaaggacugggcccuguccagcgccgccgccgucauggaggagcggaagccccugaccaccagcggguuccaccacuccgaggagggcacgagcuccagcggcuccaagcgcugggugagccagugggcgucccucgccgccaaccacacccgccacgaccaggaggagcggaucauggaguucagcgccccgcugccccuggagaacgagaccgagaucagcgagagcgggaugaccguccgcuccacgggcagcgcgaccucccuggccagccagggggagcggcgccggcgcacccugccccagcugcccaacgaggagaagucccucgagagccaccgggccaagguggugacccagcgcuccgagaucggcgagaagcaggacaccgagcugcaggagaaggagacgccgacccaggucuaccagaaggacaagcaggacgccgaccggccccugagcaagaugaaccgcgccgugaacggggagacccucaagaccggcggcgacaacaagacgcugcugcaccucgggagcuccgcgcccggcaaggagaaguccgagaccgacaaggagaccagccuggugaagcagacccuggccaagcuccagcagcaggagcagcgggaggaggcccaguggacgcccaccaagcugagcuccaagaacgucagcgggcagaccgacaagugccgcgaggagaccuucaagcaggagucccagccgcccgagaagaacagcggccacuccacgagcaagggggaccggguggcccaguccgagagcaagcgccggaaggccgaggagauccugaagucccagacccccaagggcggcgacaagaaggagagcuccaagagccucgugcgccagggguccuucaccaucgagaagccgagccccaacauccccaucgagcugaucccccacaucaacaagcagaccuccagcacgccgagcucccuggcgcugaccagcgccucccggauccgcgagcggagcgagucccucgaccccgacagcuccauggacaccacccugauccugaaggacacggaggccgucauggccuuccucgaggccaagcugcgcgaggacaacaagaccgacgagggccccgacacccccagcuacaaccgcgacaacuccaucagcccggaguccgacguggacaccgcgagcacgaucucccuggugaccggggagaccgagcgcaagagcacccagaagcggaaguccuucacgagccucuacaaggaccggugcuccaccggcagccccuccaaggacgucaccaagagcagcuccagcggcgcccgcgagaagauggagaagaagaccaagucccggagcacggacguggggucccgcgccgacggccggaaguucgugcagagcuccgggcgcauccggcagcccagcgucgaccugaccgacgacgaccagaccuccagcgugccccacuccgccaucagcgacaucauguccagcgaccaggagaccuacuccugcaagccgcacggccgcacgccccugaccagcgcggacgagcacgugcacuccaagcucgaggggagcaaggucaccaaguccaagaccagccccguggugagcggcuccagcuccaagagcaccacgcugccccggccgcgccccacccggaccucccugcuccgccgggcccgccugggcgaggccagcgacuccgagcuggccgacgccgacaaggcgagcgucgccuccgaggugagcaccacguccagcaccuccaagccgcccaccgggcggcgcaacaucagccggaucgaccuccuggcccagccccgccggacccgccugggcucccucagcgcccgcuccgacagcgaggccacgaucucccggagcagcgcguccagccgcaccgccgaggccaucauccgguccggggcccgccuggugcccagcgacaaguucagcccccggauccgcgccaacuccaucucccggcugagcgacuccaaggucaagagcaugaccuccgcgcacggcagcgccuccgugaacagccgcuggcggcgcuuccccaccgacuacgccuccacgagcgaggacgaguucggguccaaccggaacagcccgaagcacacccgccuccggaccucccccgcccugaagaccacgcgccugcagagcgcgggcagcgccaugcccaccuccagcuccuucaagcaccggaucaaggagcaggaggacuacauccgcgacuggaccgcccaccgggaggagaucgcccgcaucagccaggaccucgcccugaucgcgcgggagaucaacgacguggccggcgagaucgacuccgucaccagcuccgggacggccccgagcaccaccguguccaccgccgccacgacccccggcagcgcgaucgacacccgcgaggagcugguggaccgcgucuucgacgagucccucaacuuccggaagaucccgccccuggugcacagcaagacccccgaggggaacaacggccgcuccggggacccccggccccaggccgccgagcccccggaccaccugacgaucacccgccggcgcaccuggagccgggacgaggugaugggcgacaaccuccugcuguccagcgucuuccaguucuccaagaagauccgccagagcaucgacaagaccgccggcaagauccggauccucuucaaggacaaggaccgcaacugggacgacaucgagagcaagcugcgggccgaguccgaggugcccaucgugaagacgagcuccauggagaucagcuccauccugcaggagcucaagcgcgucgagaagcagcugcaggcgaucaacgccaugaucgaccccgacgggacccuggaggcccucaacaacaugggcuuccccagcgccaugcugccguccccgcccaagcagaaguccagccccgugaacaaccaccacagccccgggcagacccccacccugggccagcccgaggcccgggcgcuccaccccgccgccguguccgccgcggccgaguucgagaacgccgagagcgaggccgacuucuccauccacuucaaccgcuucaacccggacggggaggaggaggacgucacggugcaggaguga

SEQ ID NO: 28148 - RNA, 7614 nt, Artificial Sequence
  derived and/or modified sequence opt1 from CEP192__Homo_sapiens__NP_115518
auggaggacuuccgcgggaucgccgaggaguccuuccccuccuuccugaccaacagccucuucgggaacuccggcauccuggagaacgugacccugagcuccaaccucgggcugcccgucgccgugagcacccuggcgcgcgaccgcuccagcaccgacaaccgguaccccgacauccaggccuccuaccucguggagggccgcuucagcguccccuccgggagcucccccggcagccaguccgacgccgagccccgggagcgccugcagcugagcuuccaggacgacgacuccaucagccggaagaaguccuacguggagagccagcgccucagcaacgcccuguccaagcagagcgcccugcagauggagaccgccggccccgaggaggagcccgccggggccaccgagucccuccagggccaggaccuguucaaccgggccagcccccuggagcaggcgcaggacucccccaucgacuuccaccuccagagcuggaugaacaacaaggagcccaagaucgugguccuggacgccgggaagcacuucgaggacaagacgcugaaguccgaccucagccacaccucccugcuggagaacgagaagcucauccugcccaccagccuggaggacuccagcgacgacgacaucgacgacgagauguucuacgacgaccaccucgaggccuacuucgagcagcuggccauccccggcaugaucuacgaggaccuggaggggcccgagccgcccgagaagggcuucaagcuccccaccaacggccugcgccaggccaacgagaacgggucccugaacugcaaguuccagagcgagaacaacuccagccucaucucccuggacagccacuccagcgagacgacccacaaggagagcgaggagucccaggugaucugccugccgggcaccagcaacuccaucgggaccggcgacagccggcgcuacacggacggcaugcuccccuucuccagcgggaccuggggcaccgagaaggagaucgagaaccugaaggggaucgugcccgaccugaacuccgagugcgcgagcaaggacguccucgugaagacccugcgggccaucgacgugaagcugaacuccgacaacuuccacgacgccaacgccaaccgcggcggguucgaccucacggaccccgucaagcagggcgccgagugcccgcaccagaacaagaccgugcugcacauggacggcugccuggacaccgagacccccacggugagcauccaggagaacgucgacguggcgucccucaagcccaucagcgacuccgggaucaacuucaccgacgccaucuggagcccgaccugcgagcggcggaccugcgagugccacgaguccaucgagaagaacaaggacaagacggaccugccgcagagcguggucuaccagaacgaggagggccggugggugaccgaccuggccuacuacaccuccuucaacagcaagcagaaccucaacgugagccuguccgacgagaugaacgaggacuuccgcagcggguccgaggccuucgaccugaucgcccaggacgaggaggaguucaacaaggagcaccaguucauccaggaggagaacaucgacgcgcacaacaccagcgucgcccucggcgacacguccuggggcgccaccaucaacuacagccugcugcggaagucccgcagcaccuccgaccuggacaaggacgacgccagcuaccuccggcugucccugggcgaguucuucgcccagcgcagcgaggcgcucggcugccugggcggcgggaacaacgugaagcgccccuccuucggguacuucauccggagccccgagaagcgcgagcccaucgcccugauccggaaguccgacgugagccgcgggaaccucgagaaggagauggcccaccugaaccacgaccuguacuccggggaccucaacgagcagagccaggcccagcuguccgagggcagcaucacccugcaggucgaggcgguggagagcacgucccaggucgacgagaacgacgugacccucaccgccgacaaggggaagaccgaggacacguucuucaugagcaacaagccgcagcgguacaaggacaagcugcccgacuccggcgacagcaugcugcgcaucuccaccaucgccagcgccaucgccgaggcguccgugaacaccgaccccagccagcucgccgccaugaucaaggcccuguccaacaagacccgggacaagaccuuccaggaggacgagaagcagaaggacuacagccacguccgccacuuccugccgaacgaccucgagaaguccaacgggagcaacgcccuggacauggagaaguaccugaagaagacggaggugucccgguacgagagcgcgcucgagaacuucucccgcgccagcauguccgacaccugggaccugagccugcccaaggagcagaccacccaggacauccaccccguggaccucuccgccacgagcgucagcgugcgggcccccgaggagaacaccgccgcgaucguguacgucgagaacggcgaguccgagaaccaggagagcuuccgcaccaucaacuccagcaacuccgugaccaaccgggagaacaacagcgccguggucgacgugaagacgugcuccaucgacaacaagcugcaggacgugggcaacgacgagaaggccaccagcaucuccaccccgagcgacuccuacagcuccguccgcaacccccggaucaccagccugugccuccugaaggacugcgaggagauccgcgacaaccgggagaaccagcgccagaacgagugcguguccgagaucagcaacuccgagaagcacgugacguucgagaaccaccggaucgucagccccaagaacuccgaccugaagaacaccagccccgagcacgggggccgcgggagcgaggacgagcaggaguccuuccgcccgagcaccagcccccucagccacuccagccccuccgagaucagcggcaccuccagcuccgggugcgcccuggagagcuucggcuccgcggcccagcagcagcagcccccgugcgagcaggagcugagcccccucgugugcucccccgccggcgugagccggcugacguacgucuccgagcccgagagcuccuacccgaccaccgccaccgacgacgcccuggaggaccgcaagagcgacaucacgagcgagcucuccaccaccaucauccaggggagccccgcggcccuggaggagcgggccauggagaagcugcgcgagaaggugcccuuccagaaccggggcaaggggacccucuccagcaucauccagaacaacuccgacacgcgcaaggccaccgagaccaccagccuguccagcaagcccgaguacgugaagccggacuuccggugguccaaggaccccagcuccaagagcggcaaccugcucgagacguccgaggucggguggaccagcaaccccgaggagcuggaccccauccgccuggcccuccugggcaaguccggccugagcugccaggugggguccgcgaccagccacccgguguccugccaggagcccaucgacgaggaccagcggaucagccccaaggacaagagcaccgccggccgcgaguucuccgggcaggucagccaccagacgaccuccgagaaccagugcaccccgauccccagcuccaccgugcacagcuccguggccgacaugcagaacaugcccgccgccguccacgcgcuccugacgcagcccagccuguccgccgccccguucgcccagcgguaccucggcacccugcccagcaccggguccaccacccugccccagugccacgcgggcaacgccacggugugcggcuucagcgggggccuccccuacccggccguggccggggagcccguccagaacuccguggccgugggcaucugccuggggagcaacaucggcuccggcuggauggggaccagcucccugugcaaccccuacagcaacacccucaaccagaaccugcugagcaccacgaagcccuucccgguccccuccgugggcaccaacugcgggaucgagcccugggacagcggcgugaccuccggccucgggagcguccgcgugcccgaggagcugaagcugccgcacgcgugcugcgugggcaucgccucccagacccuccugagcguccugaaccccacggaccgguggcuccagguguccaucggggugcugagcaucuccgucaacggcgagaagguggaccugagcaccuaccgcugccucguguucaagaacaaggccaucauccggccccacgccaccgaggagaucaagguccuguucauccccuccagcccggggguguuccgcugcaccuucuccguggccagcuggcccugcuccacggacgcggagaccaucguccaggccgaggcccuggccagcaccgugacccucacggccaucgcggagucccccgucaucgagguggagaccgagaagaaggacgugcuggacuucggcgaccugaccuacggcggguggaaggcccucccccugaagcugaucaaccggacccacgccacggucccgauccgccucaucaucaacgccaacgccguggcguggcggugcuucaccuucagcaaggaguccgugcgcgcccccgucgagguggcccccugcgccgacguggucacccggcuggcgggccccagcguggugaaccacaugaugccggccagcuacgacgggcaggaccccgaguuccugaugaucuggguccucuuccacucccccaagaagcagaucagcuccagcgacauccuggacuccgccgaggaguucagcgccaagguggacaucgagguggacuccccgaaccccacccccguccugcgcagcgugucccuccgcgcccgggcgggcaucgcccgcauccacgcgccccgggaccugcagacgaugcacuuccuggccaagguggccagcucccgcaagcagcaccucccgcugaagaacgccgggaacaucgaggucuaccuggacaucaaggugcccgagcagggcagccacuucuccguggaccccaagaaccuccugcugaagcccggcgaggagcacgaggucaucgugagcuucaccccgaaggaccccgaggccugcgaggagcggauccucaagaucuucgugcagcccuucgggccccaguacgaggucgugcugaagggcgaggugaucuccagcggguccaagccgcugagccccggccccugccuggacauccccuccauccucagcaacaagcaguuccuggccuggggcggcgucccgcugggccgcacccagcuccagaagcuggcccugcggaacaacagcgccuccaccacgcagcaccuccgccugcugauccgggggcaggaccaggacugcuuccagcuccagaacaccuucggcagcgagcagcgccugaccuccaacugcgagauccggauccaccccaaggaggacaucuucaucagcgugcuguucgcgcccacccgccucuccugcaugcuggcccggcuggagaucaagcagcucgggaaccgcagccagcccggcaucaaguucacgaucccgcuguccggcuacgggggcaccagcaaccugauccucgagggggugaagaagcuguccgacagcuacauggucaccgugaacggccuggugcccgggaaggaguccaagaucgucuucagcgugcggaacaccggcucccgcgccgccuucgugaaggcggucggcuucaaggacagccagaagaaggugcuccuggaccccaaggugcugcggaucuuccccgacaaguucguccucaaggagcgcacgcaggagaacgugacccugaucuacaacccguccgaccgggggaucaacaacaagaccgccaccgagcugagcaccguguaccucuucggcggggacgagaucucccgccagcaguaccgccgggcccugcugcacaagcccgagaugaucaagcagauccuccccgagcacagcguccugcagaacaucaacuucguggaggccuuccaggacgagcugcucgugacggaggucuacgaccugccccagcgcccgaacgacgugcagcuguucuacggcuccaugugcaagaucauccucagcgugaucggggaguuccgggacugcaucagcucccgcgaguuccugcagcccagcuccaaggccagccuggaguccaccagcgaccucggcgcguccggcaagcacgggggcaacgucagccuggacgugcugcccgugaaggggccgcagggcagcccccuccugagccgggccgcccggccgccccuggaccagcucgccuccgaggagccguggaccguccugcccgagcaccugauccucguggcccccagccccugcgacauggcgaagaccgggcgguuccagaucgucaacaacuccgugcgccugcugcgguucgagcucugcuggccggcccacugccugacggugacgccccagcacggcugcgucgcccccgagagcaagcugcagauccucgugucccccaacagcucccugagcaccaagcaguccauguucccguggagcggccugaucuacauccacugcgacgacgggcagaagaagaucgugaagguccagauccgcgaggaccucacccagguggagcugcugacgcggcucaccagcaagcccuucggcauccugucccccgugagcgagcccuccgucagccaccuggugaagccgaugaccaagccgcccuccaccaagguggagauccgcaacaagagcaucacguuccccaccaccgagccgggggagaccuccgagagcugccucgagcuggagaaccacggcacgaccgacgucaaguggcaccuguccagccucgcgccgcccuacgugaaggggguggacgaguccggcgacgucuuccgggccaccuacgcggccuuccgcugcagccccaucuccggccugcuggagagccacgggauccagaagguguccaucaccuuccucccgcggggccgcggggacuacgcccaguucugggacguggagugccacccccugaaggagccccacaugaagcacacgcugcgguuccagcucagcggccaguccaucgaggccgagaacgagccggagaacgcgugccugagcaccgacucccugaucaagaucgaccaccucgucaagccccgccggcaggccgugagcgaggccagcgcccgcauccccgagcagcuggacgugaccgcccggggcgucuacgcgcccgaggacguguaccgcuuccgcccgaccuccgugggggagagccggacgcugaaggucaaccuccgcaacaacuccuucaucacccacagccugaaguuccugagcccccgcgagcccuucuacgugaagcacuccaaguacucccuccgcgcccagcacuacaucaacaugcccgugcaguucaagcccaaguccgccggcaaguucgaggcccugcuggucauccagaccgacgaggggaaguccaucgccauccggcucaucggcgaggcgcuggggaagaacuga

SEQ ID NO: 28149 - RNA, 504 nt, Artificial Sequence
  derived and/or modified sequence opt1 from CEP19__Homo_sapiens__NP_116287
auguacaugggcaugaugugcaccgccaagaagugcgggauccgguuccagcccccggccaucauccugaucuacgagagcgagaucaagggcaagauccggcagcgcaucaugcccgugcggaacuucuccaaguucagcgacugcacccgcgcggccgagcagcucaagaacaacccccggcacaaguccuaccuggagcaggucagccugcgccagcucgagaagcuguucuccuuccugcggggguaccucagcggccagucccuggccgagacgauggagcagauccagcgcgagaccaccaucgaccccgaggaggaccugaacaagcucgacgacaaggagcuggccaagcgcaagagcaucauggacgagcuguucgagaagaaccagaagaagaaggacgacccgaacuucguguacgacaucgagguggaguucccccaggacgaccagcuccaguccugcgggugggacaccgagagcgccgacgaguucuga

SEQ ID NO: 28150 - RNA, 7329 nt, Artificial Sequence
  derived and/or modified sequence opt1 from CEP250__Homo_sapiens__NP_009117
auggagacccgcagccccggccugaacaacaugaagccgcagagccugcagcuggugcuggaggagcagguccuggcccugcagcagcagauggccgagaaccaggcggccagcuggcggaagcugaagaacagccaggaggcccagcagcgccaggccacccucgugcggaagcugcaggccaaggugcugcaguaccgcagcuggugccaggagcucgagaagcggcuggaggcgaccggcgggcccaucccccagcgcugggagaacguggaggagcccaaccuggacgagcuccuggugcggcuggaggaggagcagcagcgcugcgagagccucgccgaggugaacacccagcugcggcugcacauggagaaggccgacguggugaacaaggcccuccgcgaggacguggagaagcugaccguggacuggagccgggcgcgcgacgagcugaugcggaaggagucccaguggcagauggagcaggaguucuucaagggguaccucaagggggagcacgggcgccugcugagccucuggcgggagguggugaccuuccgccggcacuuccuggagaugaaguccgccacggaccgcgaccugauggagcucaaggccgagcacguccggcugagcggcucccugcugacgugcugccugcgccugaccgugggcgcccagagccgggagccgaacggguccggccgcauggacgggcgcgagcccgcccagcuccugcugcuccuggcgaagacccaggagcuggagaaggaggcccacgagcggagccaggagcucauccagcugaagucccagggcgaccuggagaaggccgagcuccaggaccgcgugacggagcugagcgcccugcucacccagucccagaagcagaacgaggacuacgagaagaugaucaaggcccugcgggagaccgucgagauccuggagaccaaccacacggagcucauggagcacgaggcgagccugucccgcaacgcccaggaggagaagcugagccugcagcaggucaucaaggacaucacccaggugauggucgaggagggggacaacaucgcccagggcagcggccacgagaacucccucgagcuggacagcuccaucuucagccaguucgacuaccaggacgccgacaaggcccugacccucgugcgguccgugcugacccgccggcgccaggcgguccaggaccugcggcagcagcucgccgggugccaggaggccgugaaccugcugcagcagcagcacgaccagugggaggaggagggcaaggcccuccgccagcggcugcagaagcugacgggggagcgcgacacccucgccggccagaccguggaccugcagggcgaggucgacagccuguccaaggagcgggagcuccugcagaaggcgcgcgaggagcugcggcagcagcucgaggugcuggagcaggaggccuggcgccugcggcgcgucaacguggagcuccagcugcagggggacagcgcccagggccagaaggaggagcagcaggaggagcugcaccucgccgugcgggagcgcgagcgccugcaggagaugcugauggggcucgaggcgaagcaguccgagagccuguccgagcugaucacccuccgggaggcccuggagagcucccaccuggagggcgagcuccugcgccaggagcagacggaggucaccgccgcccuggcccgggcggagcagagcaucgccgagcucuccagcuccgagaacacccugaagaccgagguggccgaccugcgcgccgccgcggugaagcucagcgcccugaacgaggcccuggcccucgacaaggucgggcugaaccagcagcugcuccagcuggaggaggagaaccaguccgugugcagccggauggaggccgcggagcaggcccgcaacgcccuccagguggaccucgccgaggcggagaagcggcgcgaggcccugugggagaagaacacgcaccuggaggcccagcuccagaaggccgaggaggccggcgcggagcugcaggccgaccugcgggacauccaggaggagaaggaggagauccagaagaagcucagcgagucccgccaccagcaggaggccgccaccacccagcuggagcagcugcaccaggaggccaagcggcaggaggagguccucgcgcgcgccgugcaggagaaggaggcccuggugcgggagaaggccgcccuggagguccgccuccaggcgguggagcgggaccgccaggaccuggccgagcagcugcagggccucagcuccgccaaggagcugcuggagagcucccucuucgaggcccagcagcagaacagcgugaucgaggucaccaaggggcagcuggaggugcagauccagacggugacccaggcgaaggaggucauccagggcgaggugcggugccugaagcucgagcuggacaccgagcgcucccaggccgagcaggagcgggacgccgccgcccgccagcuggcgcaggccgagcaggaggggaagaccgcccucgagcagcagaaggccgcccacgagaaggaggugaaccagcugcgggagaagugggagaaggagcgcagcuggcaccagcaggagcuggcgaaggcccucgagucccuggagcgcgagaagauggagcuggagaugcggcucaaggagcagcagacggagauggaggccauccaggcccagcgcgaggaggagcggacccaggccgagagcgcgcugugccagaugcagcuggagaccgagaaggagcgcgucucccuccuggagacccugcuccagacgcagaaggagcuggccgacgccagccagcagcuggagcggcuccgccaggacaugaaggugcagaagcugaaggagcaggagaccaccggcauccugcagacccagcuccaggaggcccagcgggagcugaaggaggccgcgcgccagcaccgggacgaccuggccgcccuccaggaggaguccagcucccugcugcaggacaagauggaccugcagaagcaggucgaggaccucaagagccagcuggucgcccaggacgacucccagcgccugguggagcaggaggugcaggagaagcuccgggagacccaggaguacaaccgcauccagaaggagcuggagcgggagaaggcgagccugacgcucagccugauggagaaggagcagcgccugcucguccugcaggaggccgacuccauccggcagcaggagcugagcgcccuccgccaggacaugcaggaggcccagggggagcagaaggagcuguccgcccagauggagcugcuccggcaggaggugaaggagaaggaggcggacuuccuggcccaggaggcccagcugcucgaggagcuggaggccagccacaucaccgagcagcagcugcgcgccucccucugggcgcaggaggccaaggccgcccagcugcagcugcggcuccgcagcaccgagucccagcuggaggcccuggcggccgagcagcagcccggcaaccaggcccaggcccaggcgcagcucgccagccuguacuccgcccugcagcaggcccucggcagcgugugcgagucccgccccgagcugagcgggggcggggacuccgccccgagcgucuggggccuggagcccgaccagaacggggcgcggucccucuucaagcgcggcccccugcugaccgcccucagcgccgaggccguggccuccgcgcugcacaagcugcaccaggaccucuggaagacgcagcagacccgggacgugcugcgcgaccagguccagaagcuggaggagcggcucaccgacaccgaggccgagaagucccaggugcacacggagcugcaggaccugcagcgccagcucucccagaaccaggaggagaaguccaagugggagggcaagcagaacagccuggaguccgagcugauggagcuccacgagaccauggccagccugcagucccggcugcgccgggccgagcuccagcgcauggaggcccagggggagcgggagcugcugcaggcggccaaggagaaccucaccgcccagguggagcaccuccaggccgcggucguggaggcccgcgcccaggccagcgccgcgggcauccuggaggaggaccuccggaccgcccgcuccgcccugaagcugaagaacgaggagguggagagcgagcgggagcgcgcccaggcccuccaggagcagggggagcugaaggucgcgcagggcaaggcccugcaggagaaccucgcccugcugacgcagacccucgccgagcgggaggaggagguggagacccugcgcggccagauccaggagcuggagaagcagcgggagaugcagaaggccgcgcucgagcugcugucccucgaccugaagaagcgcaaccaggagguggaccugcagcaggagcagauccaggagcucgagaagugccggagcguccuggagcaccuccccauggccgugcaggagcgcgagcagaagcucaccgugcagcgcgagcagauccgggagcuggagaaggaccgcgagacgcagcggaacguccuggagcaccagcuccuggagcuggagaagaaggaccagaugaucgagucccagcgcggccaggugcaggaccucaagaagcagcuggugacccuggagugccucgcccuggagcuggaggagaaccaccacaagauggagugccagcagaagcucaucaaggagcuggagggccagcgggagacccagcgcgucgcccugacccaccucacgcuggaccuggaggagcggagccaggagcuccaggcccaguccagccagauccacgaccuggagucccacagcaccgugcuggcgcgcgagcuccaggagcgggaccaggaggugaagucccagcgcgagcagaucgaggagcugcagcggcagaaggagcaccugacccaggaccuggagcgccgggaccaggagcucaugcugcagaaggagcgcauccagguccuggaggaccagcggacccgccagacgaagauccucgaggaggaccuggagcagaucaagcugagccuccgggagcgcgggcgggagcugaccacccagcgccagcugaugcaggagcgcgccgaggagggcaaggggccguccaaggcccagcggggcagccucgagcacaugaagcugauccugcgcgacaaggagaaggagguggagugccagcaggagcacauccacgagcuccaggagcugaaggaccagcuggagcagcagcuccagggccugcaccggaaggucggggagaccucccugcuccugagccagcgcgagcaggagaucguggugcugcagcagcagcuccaggaggcccgggagcagggcgagcugaaggagcagagccugcagucccagcucgacgaggcgcagcgcgcccuggcccagcgggaccaggagcuggaggcccuccagcaggagcagcagcaggcccaggggcaggaggagcgcgucaaggagaaggcggacgcccugcagggcgcccuggagcaggcccacaugacgcucaaggagcggcacggggagcugcaggaccacaaggagcaggcccgccggcuggaggaggagcucgcgguggagggccgccgggugcaggcccuggaggagguccugggcgaccuccgcgccgagagccgggagcaggagaaggcccugcuggcccuccagcagcagugcgcggagcaggcccaggagcacgagguggagacccgcgcccugcaggacuccuggcugcaggcccaggcggugcucaaggagcgggaccaggagcuggaggcccugcgcgccgagagccaguccagccggcaccaggaggaggccgcccgcgcgcgggccgaggcccuccaggaggcccuggggaaggcccacgcggcccugcagggcaaggagcagcaccuccuggagcaggccgagcugucccgcagccucgaggccuccaccgccacccugcaggcgagccuggacgccugccaggcccacucccgccagcucgaggaggcccugcggauccaggagggggagauccaggaccaggaccugcgcuaccaggaggacguccagcagcuccagcaggcgcuggcccagcgggacgaggagcugcgccaccagcaggagcgggagcagcuccuggagaagucccuggcccagcgcgugcaggagaacaugauccaggagaagcagaaccucggccaggagcgggaggaggaggagauccgcgggcugcaccaguccgugcgggagcugcagcucacgcuggcccagaaggagcaggagauccuggagcuccgcgagacccagcagcggaacaaccuggaggcccugccccacagccacaagaccucccccauggaggagcagagccucaagcuggacucccuggagccccgccuccagcgggagcuggagcgccugcaggcggcccuccggcagaccgaggcccgcgagaucgaguggcgggagaaggcccaggaccuggcccugagccucgcgcagacgaaggccuccgucagcagccugcaggagguggccauguuccugcaggccuccgugcucgagcgcgacagcgagcagcagcggcugcaggacgagcuggagcucacccgccgcgcccuggagaaggagcggcugcacuccccgggcgcgaccagcaccgccgagcucggcucccgcggggagcagggcguccagcugggggaggugagcggcguggaggccgagcccucccccgacgggauggagaagcagagcuggcggcagcgccuggagcaccuccagcaggccgucgcccggcuggagaucgaccgcucccggcugcagcgccacaacgugcagcuccggagcacccuggagcaggucgagcgcgagcggcgcaagcugaagcgggaggcgaugcgcgccgcccaggccggcucccuggagaucagcaaggcgacggccuccagccccacccagcaggacggccgggggcagaagaacuccgacgccaagugcgucgccgagcuccagaaggagguggugcugcugcaggcccagcucacccuggagcgcaagcagaagcaggacuacaucacccggagcgcgcagacgucccgcgagcuggccggccuccaccacagccugucccacagccugcucgccgucgcccaggccccggaggcgaccgugcuggaggccgagacccggcgccuggacgagagccucacccagucccugacgagccccgggcccgugcugcuccaccccuccccgagcaccacccaggccgccucccgguga

SEQ ID NO: 28151 - RNA, 7440 nt, Artificial Sequence
  derived and/or modified sequence opt1 from CEP290__Homo_sapiens__NP_079390
augcccccgaacaucaacuggaaggagaucaugaagguggaccccgacgaccugccccgccaggaggagcucgccgacaaccugcugaucagccucuccaaggucgaggugaacgagcugaagagcgagaagcaggagaacgugauccaccuguuccggaucacccagucccucaugaagaugaaggcccaggaggucgagcuggcgcuggaggagguggagaaggccggcgaggagcaggccaaguucgagaaccagcucaagaccaaggugaugaagcuggagaacgagcuggagauggcccagcagagcgccgggggccgcgacacgcgguuccuccgcaacgagaucugccagcuggagaagcagcuggagcagaaggaccgggagcucgaggacauggagaaggagcuggagaaggagaagaaggucaacgagcagcuggcgcuccgcaacgaggaggccgagaacgagaacuccaagcugcggcgcgagaacaagcggcugaagaagaagaacgagcagcucugccaggacaucaucgacuaccagaagcagaucgacagccagaaggagacccugcugucccgccggggggaggacagcgacuaccgcucccagcucagcaagaagaacuacgagcugauccaguaccuggacgagauccagacccucaccgaggccaacgagaagaucgaggugcagaaccaggagaugcggaagaaccuggaggaguccgugcaggagauggagaagaugacggacgaguacaaccgcaugaaggccaucguccaccagaccgacaacgugaucgaccagcugaagaaggagaacgaccacuaccagcuccaggugcaggagcugaccgaccugcucaagagcaagaacgaggaggacgaccccaucauggucgcggugaacgccaagguggaggaguggaagcugauccuguccagcaaggacgacgagaucaucgaguaccagcagaugcuccacaaccugcgggagaagcugaagaacgcccagcucgacgccgacaaguccaacgucauggcccugcagcagggcauccaggagcgcgacagccagaucaagaugcugaccgagcagguggagcaguacacgaaggagauggagaagaacaccugcaucaucgaggaccucaagaacgagcugcagcggaacaagggggcguccacccugagccagcagacccacaugaagauccaguccacgcucgacauccugaaggagaagaccaaggaggccgagcgcaccgccgagcuggccgaggccgacgcgcgggagaaggacaaggagcucguggaggcccugaagcgccugaaggacuacgagagcggcgucuacggccuggaggacgccgugguggagaucaagaacugcaagaaccagaucaagauccgggaccgcgagaucgagauccucaccaaggagaucaacaagcuggagcugaagaucagcgacuuccucgacgagaacgaggcccugcgcgagcgggucgggcuggagccgaagacgaugaucgaccucaccgaguuccgcaacuccaagcaccugaagcagcagcaguaccgggccgagaaccagauccugcucaaggagaucgagagccuggaggaggagcgccuggaccucaagaagaagauccggcagauggcgcaggagcgcggcaagcgguccgccaccagcgggcugaccacggaggaccugaaccucaccgagaacaucucccagggcgaccgcaucagcgagcggaagcuggaccugcucucccugaagaacaugagcgaggcccaguccaagaacgaguuccugagccgcgagcucaucgagaaggagcgggaccuggagcgcucccggaccgugaucgccaaguuccagaacaagcugaaggagcucguggaggagaacaagcagcuggaggaggggaugaaggagauccugcaggccaucaaggagaugcagaaggaccccgacgucaagggcggcgagaccagccucaucauccccucccuggagcgccuggugaacgcgaucgagagcaagaacgccgaggggaucuucgacgccucccuccaccugaaggcccaggucgaccagcugacgggccggaacgaggagcuccgccaggagcugcgggagagccgcaaggaggcgaucaacuacucccagcagcuggccaaggccaaccucaagaucgaccaccuggagaaggagaccagccugcuccggcaguccgaggggagcaacgugguguucaagggcaucgaccugcccgacggcaucgccccgagcuccgccagcaucaucaacucccagaacgaguaccugauccaccuccugcaggagcuggagaacaaggagaagaagcucaagaaccuggaggacagccuggaggacuacaaccgcaaguucgcggucauccgccaccagcagucccuccuguacaaggaguaccugagcgagaaggagaccuggaagaccgaguccaagacgaucaaggaggagaagcggaagcucgaggaccaggugcagcaggacgccaucaaggugaaggaguacaacaaccugcugaacgcccuccagauggacagcgacgagaugaagaagauccuggccgagaacucccgcaagaucaccguccugcaggugaacgagaagagccucauccggcaguacaccacccugguggagcuggagcgccagcuccggaaggagaacgagaagcagaagaacgagcugcuguccauggaggccgaggucugcgagaagaucgggugccuccagcgcuucaaggagauggcgaucuucaagaucgccgcccugcagaaggugguggacaacagcgucucccugagcgagcucgagcuggccaacaagcaguacaacgagcugacggccaaguaccgggacauccuccagaaggacaacaugcuggugcagcgcaccuccaaccuggagcaccucgagugcgagaacaucagccugaaggagcagguggaguccaucaacaaggagcuggagaucaccaaggagaagcuccacaccaucgagcaggcgugggagcaggagacgaagcugggcaacgagagcagcauggacaaggccaagaaguccaucaccaacagcgacaucgucuccaucagcaagaagaucaccaugcuggagaugaaggagcucaacgagcggcagcgcgccgagcacugccagaagauguacgagcaccugcggaccucccugaagcagauggaggagcgcaacuucgagcucgagaccaaguucgccgagcugacgaagaucaaccuggacgcgcagaagguggagcagaugcuccgggacgagcuggccgacagcguguccaaggccgucagcgacgccgaccgccagcggauccuggagcucgagaagaacgagauggagcugaagguggagguguccaagcugcgcgagaucagcgacaucgcccggcgccaggucgagauccucaacgcgcagcagcagucccgggacaaggagguggagagccugcgcaugcagcugcucgacuaccaggcccaguccgacgagaagagccugaucgccaagcugcaccagcacaacgugucccugcagcucagcgaggccaccgcccuggggaagcuggaguccaucaccagcaagcuccagaagauggaggcguacaaccugcggcuggagcagaagcucgacgagaaggagcaggcccuguacuacgcccgccuggagggccgcaaccgggccaagcaccuccgccagaccauccagucccugcggcgccaguucagcggggcccugccccucgcgcagcaggagaaguucagcaagacgaugauccagcugcagaacgacaagcugaagaucaugcaggagaugaagaacucccagcaggagcaccggaacauggagaacaagacccucgagauggagcugaagcugaagggccucgaggagcugaucagcacccugaaggacaccaagggcgcccagaaggucaucaacuggcacaugaagaucgaggagcuccgccugcaggagcugaagcucaaccgggagcuggugaaggacaaggaggagaucaaguaccugaacaacaucaucuccgaguacgagcgcacgaucagcucccucgaggaggagaucgugcagcagaacaaguuccacgaggagcggcagauggccugggaccagcgcgaggucgaccuggagcggcagcuggacaucuucgaccgccagcagaacgagauccucaacgccgcgcagaaguucgaggaggccaccgggagcauccccgaccccucccugccgcugcccaaccagcucgagaucgcccugcggaagaucaaggagaacauccgcaucauccuggagacccgggccaccugcaagagccucgaggagaagcugaaggagaaggaguccgcccugcgccucgcggagcagaacauccugagccgggacaaggugaucaacgagcugcgccuccggcugcccgccacggccgagcgcgagaagcugaucgccgagcucggccgcaaggagauggagcccaagucccaccacacccugaagaucgcccaccagaccaucgcgaacaugcaggcccggcugaaccagaaggaggaggugcucaagaaguaccagcgccugcuggagaaggcccgggaggagcagcgcgagaucgucaagaagcacgaggaggaccuccacauccugcaccaccggcuggagcuccaggccgacagcucccugaacaaguucaagcagaccgccugggaccugaugaagcagagcccgacgcccgugcccaccaacaagcacuucauccgccucgcggagauggagcagaccguggccgagcaggacgacucccugagcucccugcucgucaagcugaagaaggugagccaggaccuggagcggcagcgcgagaucaccgagcucaaggugaaggaguucgagaacaucaagcugcagcugcaggagaaccacgaggacgaggucaagaaggugaaggccgagguggaggaccucaaguaccugcuggaccagucccagaaggagagccagugccucaagagcgagcugcaggcccagaaggaggccaacucccgggcgcccacgaccaccaugcgcaaccuggucgagcggcucaagagccagcuggcccugaaggagaagcagcagaaggcccucucccgcgcccugcuggagcuccgggcggagaugaccgccgccgccgaggagcgcaucaucagcgccacgucccagaaggaggcgcaccugaacgugcagcagaucguggaccggcacacccgcgagcugaagacccaggucgaggaccucaacgagaaccugcugaagcucaaggaggcccugaagaccagcaagaaccgggagaacucccugacggacaaccucaacgaccugaacaacgagcugcagaagaagcagaaggccuacaacaagauccuccgcgagaaggaggagaucgaccaggagaacgacgagcugaagcggcagaucaagcgccugaccagcgggcuccagggcaagccgcugaccgacaacaagcagucccugaucgaggagcuccagcggaaggugaagaagcuggagaaccagcuggaggggaagguggaggaggucgaccucaagcccaugaaggagaagaacgccaaggaggagcugauccgcugggaggagggcaagaaguggcaggccaagaucgagggcauccgcaacaagcugaaggagaaggagggggagguguucacccugacgaagcagcucaacacccugaaggaccuguucgcgaaggccgacaaggagaagcucacccugcagcggaagcugaagaccacgggcaugaccguggaccagguccucgggauccgcgcccuggagagcgagaaggagcuggaggagcucaagaagcggaaccuggaccuggagaacgacauccucuacaugcgcgcccaccaggcccugccccgggacuccgugguggaggaccugcaccuccagaaccgcuaccugcaggagaagcugcacgcgcucgagaagcaguucagcaaggacaccuacuccaagcccagcaucuccggcaucgagagcgacgaccacugccagcgggagcaggagcugcagaaggagaaccugaagcucuccagcgagaacaucgagcugaaguuccagcuggagcaggccaacaaggaccucccgcgccugaagaaccagguccgggaccugaaggagaugugcgaguuccucaagaaggagaaggccgaggugcagcgcaagcuggggcacguccggggcuccggccgcagcgggaagaccauccccgagcuggagaagaccaucggccucaugaagaaggugguggagaagguccagcgggagaacgagcagcugaagaaggccagcgggauccugacguccgagaagauggcgaacaucgagcaggagaacgagaagcucaaggccgagcuggagaagcugaaggcccaccucggccaccagcugagcaugcacuacgaguccaagaccaagggcaccgagaagaucaucgccgagaacgagcgccugcggaaggagcucaagaaggagaccgacgccgcggagaagcugcgcaucgccaagaacaaccuggagauccucaacgagaagaugacggugcagcuggaggagaccgggaagcggcugcaguucgccgagagccgcggcccccagcucgagggggccgacuccaagagcuggaaguccaucguggucacccggauguacgagaccaagcugaaggagcuggagacggacaucgccaagaagaaccagagcaucaccgaccucaagcagcuggugaaggaggcgaccgagcgcgagcagaaggugaacaaguacaacgaggaccuggagcagcagaucaagauccucaagcacguccccgagggcgccgagaccgagcaggggcugaagcgcgagcugcaggugcuccggcuggccaaccaccagcuggacaaggagaaggccgagcucauccaccagaucgaggccaacaaggaccaguccggcgcggagagcacgaucccggacgccgaccagcugaaggagaagaucaaggaccuggagacccagcucaagauguccgaccuggagaagcagcaccugaaggaggagaucaagaagcucaagaaggagcuggagaacuucgaccccagcuucuucgaggagaucgaggaccugaaguacaacuacaaggaggaggugaagaagaacauccuccuggaggagaaggucaagaagcuguccgagcagcucggcguggagcugaccagccccguggccgccuccgaggaguucgaggacgaggaggagagcccggucaacuuccccaucuacuga

SEQ ID NO: 28152 - RNA, 906 nt, Artificial Sequence
  derived and/or modified sequence opt1 from CEP41__Homo_sapiens__NP_001244087
augagccugcgccggcacaucggcaaccccgaguaccucaugaagcgcaucccgcagaacccccgguaccagcacaucaagucccgccuggacaccgggaacagcaugaccaaguacacggagaagcuggaggagaucaagaagaacuaccgguacaagaaggacgagcuguucaagcgccucaaggugaccaccuucgcccagcugaucauccaggucgccucccucagcgaccagacccuggaggugacggcggaggagauccagcggcuggaggacaacgacuccgccgccagcgaccccgacgccgagaccaccgcccgcaccaacggcaaggggaaccccggcgagcaguccccgagccccgagcaguucaucaacaacgcgggggccggcgacuccagccgguccacgcuccagagcgugaucuccggcgucggggagcuggaccuggacaagggccccgugaagaaggccgagccccacaccaaggacaagccguaccccgacugccccuuccuccugcuggacgugcgcgaccgggacagcuaccagcagugccacaucgucggggccuacuccuaccccaucgcgacccucagccgcaccaugaacccguacuccaacgacauccuggaguacaagaacgcccacggcaagaucaucauccuguacgacgacgacgagcggcucgccagccaggccgccacgaccaugugcgagcgcggguucgagaaccuguucaugcuguccggcggccggcucaaccaggcgaacagcagcgggcgcgaguccaaggugcccggcgcccggagcgcccagaaccugcccgggggcggccccgccucccacagcaacccgcgcucccugagcuccgggcaccuccagggcaagcccuggaaguga

SEQ ID NO: 28153 - RNA, 1395 nt, Artificial Sequence
  derived and/or modified sequence opt1 from CEP55__Homo_sapiens__NP_001120654
augagcucccgcagcaccaaggaccugaucaaguccaaguggggcagcaagcccuccaacagcaaguccgagaccacgcucgagaagcugaagggggagaucgcccaccugaagaccagcguggacgagaucaccuccggcaaggggaagcucaccgacaaggagcggcaccgccugcuggagaagauccggguccucgaggccgagaaggagaagaacgcguaccagcugacggagaaggacaaggagauccagcgccugcgggaccagcucaaggcccgcuacagcaccaccgcccugcuggagcagcucgaggagaccacgcgggagggcgagcgccgggagcagguccugaaggcccuguccgaggagaaggacgugcucaagcagcagcugagcgccgcgaccucccgcaucgccgagcuggagagcaagaccaacacccuccggcugucccagacgguggccccgaacugcuucaacagcuccaucaacaacauccacgagauggagauccagcugaaggacgcccucgagaagaaccagcaguggcugguguacgaccagcagcgcgagguguacgucaaggggcugcucgcgaagaucuucgagcuggagaagaagaccgagaccgccgcccacagccugccccagcagaccaagaagcccgaguccgagggcuaccuccaggaggagaagcagaagugcuacaacgaccugcuggccagcgccaagaaggaccucgagguggagcggcagacgaucacccagcugagcuucgagcuguccgaguuccgccggaaguacgaggagacccagaaggaggugcacaaccucaaccagcugcuguacagccagcgccgggcggacguccagcaccucgaggacgaccgccacaagaccgagaagauccagaagcugcgggaggagaacgacaucgcccgcggcaagcuggaggaggagaagaagcgguccgaggagcuccugagccaggugcaguuccuguacacgucccuccugaagcagcaggaggagcagacccgcguggcccugcucgagcagcagaugcaggccugcacccuggacuucgagaacgagaagcuggaccgccagcacguccagcaccagcuccacgugauccugaaggagcugcggaaggcccgcaaccagaucacccagcuggagagccucaagcagcugcacgaguucgcgaucacggagccccuggugaccuuccagggggagaccgagaaccgggagaaggucgccgccucccccaagagcccgaccgccgcccucaacgagucccugguggagugccccaagugcaacauccaguaccccgcgacggagcaccgcgaccugcucgugcacgucgaguacugcagcaaguga

SEQ ID NO: 28154 - RNA, 1476 nt, Artificial Sequence
  derived and/or modified sequence opt1 from CEP57__Homo_sapiens__NP_001230705
augcugacccgcaucgacaacagcuucgccgagcccucccggagcaacggcuccauggugcgccacagcuccagcccguacgucguguaccccuccgacaagcccuuccucaacagcgaccugcggcgcucccccagcaagccgacccuggccuaccccgaguccaacagccgggcgaucuucuccgcccucaagaaccugcaggacaagauccgccggcuggagcucgagcgcauccaggccgaggagagcgugaagacgcugucccgggagaccaucgaguacaagaagguccuggacgagcagauccaggagcgcgagaacagcaagaacgaggaguccaagcacaaccaggagcucaccagccagcugcuggccgccgagaacaagugcaaccuccuggagaagcagcuggaguacaugcggaacaugaucaagcacgcggagauggagcgcaccuccgugcucgagaagcaggucagccuggagcgggagcgccagcacgaccagacgcacgugcagagccagcuggagaagcucgaccugcuggagcaggaguacaacaagcucaccaccaugcaggcccuggccgagaagaagaugcaggagcuggaggccaagcuccacgaggaggagcaggagcggaagcgcaugcaggcgaaggccgccgagcugcagaccgggcuggagacgaaccggcucaucuucgaggacaaggccacccccugcgugcccaacgcccgccggaucaagaagaagaaguccaagccgcccgagaagaaguccagccgcaacuacuucggcgcgcagccccacuaccggcugugccugggggacaugcccuucguggccggcaagagcaccuccccgagccacgccgucguggccaacgugcagcucguccugcaccugaugaagcagcacuccaaggcccucugcaacgaccgcgugaucaacagcaucccccuggcgaagcaggucuccagccgcgggggcaaguccaagaagcugagcgugaccccgcccuccagcaacggcaucaacgaggagcucuccgaggugcugcagacgcugcaggacgaguucgggcagaugagcuucgaccaccagcagcucgccaagcugauccaggagucccccaccguggagcugaaggacaagcucgagugcgagcuggaggcccuggucggccggauggaggccaaggccaaccagaucaccaaggugcgcaaguaccaggcgcagcucgagaagcagaagcuggagaagcagaagaaggagcugaaggccaccaagaagacgcucgacgaggagcggaacagcuccagccgcagcgggaucaccggcaccaccaacaagaaggacuucaugaagcugcggcccggggagaagcgccggaagaaccugcagcugcucaaggacaugcaguccauccagaacagccugcaguccagcucccugugcugggacuacuga

SEQ ID NO: 28155 - RNA, 1488 nt, Artificial Sequence
  derived and/or modified sequence opt1 from CEP63__Homo_sapiens__NP_001035842
auggaggcccugcucgagggcauccagaaccgcgggcacggcgggggcuuccugaccagcugcgaggccgagcugcaggagcucaugaagcagaucgacaucaugguggcgcacaagaaguccgagugggaggggcggacccacgcccuggagacgugccugaagauccgcgagcaggagcucaagagccugcggucccagcuggacgucacccacaaggaggugggcaugcuccaccagcaggucgaggagcacgagaagaucaagcaggagaugaccauggaguacaagcaggagcugaagaagcugcacgaggagcucugcauccugaagcgcagcuacgagaagcugcagaagaagcagaugcgggaguuccgcggcaacaccaagaaccaccgggaggaccgcuccgagaucgagcggcucacggccaagaucgaggaguuccgccagaagucccuggacugggagaagcagcggcugaucuaccagcagcaggucagcagccucgaggcccagcgcaaggcccuggcggagcaguccgagaucauccaggcccagcuggugaaccggaagcagaagcucgagagcguggagcuguccagccaguccgagauccagcaccugagcuccaagcucgagcgcgccaacgacaccaucugcgccaacgagcuggagaucgagcggcugaccaugcgcgugaacgaccucguggggaccagcaugacggugcugcaggagcagcagcagaaggaggagaagcugcgggaguccgagaagcuccuggaggcgcugcaggaggagaagcgcgagcucaaggccgcccugcagagccaggagaaccugauccacgaggcccggauccagaaggagaagcuccaggagaaggucaaggccaccaacacccagcacgcgguggaggccaucucccuggagagcgugagcgcgaccugcaagcagcugucccaggagcucauggagaaguacgaggagcugaagcgcauggaggcccacaacaacgaguacaaggccgagaucaagaagcugaaggagcagauccuccagggcgagcagagcuacuccagcgcccuggaggggaugaagauggagaucucccaccugacgcaggagcuccaccagcgggacaucaccaucgccagcaccaagggcuccagcuccgacauggagaagcgccugcgcgccgagaugcagaaggccgaggacaaggccgucgagcacaaggagauccuggaccagcucgagagccugaagcuggagaaccggcaccuguccgagauggugaugaagcucgagcuggggcugcacgagugcagccuccccguguccccgcugggcagcaucgcgacccgcuuccuggaggaggaggagcuccggucccaccacauccuggagcgccuggacgcccacaucgaggagcucaagcgggagagcgagaagacgguccgccaguucaccgcccugaaguga

SEQ ID NO: 28156 - RNA, 2274 nt, Artificial Sequence
  derived and/or modified sequence opt1 from CEP68__Homo_sapiens__NP_055962
auggcccugggcgaggagaaggccgaggcggaggccagcgaggacaccaaggcccaguccuacgggcgcggcagcugccgggagcgcgagcucgacauccccgggccgauguccggcgagcagccgccccggcuggaggccgagggcgggcugaucagccccguguggggcgccgaggggauccccgcgccgaccugcuggaucggcacggaccccgggggccccucccgcgcccaccagccccaggccagcgacgccaaccgggagcccgucgcggagcgcuccgagcccgcccucagcgggcugcccccggccaccaugggcuccggcgaccugcuccugagcggggagucccagguggagaagaccaagcugagcuccagcgaggaguucccccagacccucucccugccccggacgaccaccaucugcagcggccacgacgccgacaccgaggacgaccccucccuggccgaccucccgcaggcgcuggaccugagccagcagccccacuccagcgggcucagcugccugucccaguggaaguccgugcugucccccggcagcgccgcccagcccuccagcugcuccaucagcgccuccagcacgggcuccagccuccaggggcaccaggagcgcgccgagccgcggggcgggucccuggcgaaggucagcuccagccuggagcccguggugccccaggagcccuccagcgucgugggccucgggccgcgcccccaguggagcccccagcccguguucagcggcggcgacgccagcgggcugggccggcgccggcuguccuuccaggccgaguacugggccugcguccucccggacagccugccgcccucccccgaccgccacagcccccuguggaaccccaacaaggaguacgaggaccuccuggacuacaccuacccccugcggccggggccccagcuccccaagcaccuggacucccgcgugcccgccgacccggugcugcaggacagcggcgucgaccucgacuccuucagcgugucccccgcgagcacccugaagucccccaccaacgugagccccaacugcccgcccgccgaggccacggcccugcccuucuccgggccccgggagccgagccucaagcaguggcccucccgcgucccccagaagcagggcggcauggggcuggccagcuggucccagcuggcgagcacgccccgggccccgggcagccgcgacgcccggugggagcgccgcgagcccgcccuccgcggggcgaaggaccggcugaccaucggcaagcaccuggacauggggagcccccagcuccggacccgcgaccggggcuggcccagcccgcgccccgagcgggagaagcgcaccucccagagcgcccggcgcccgaccugcaccgagucccgguggaaguccgaggaggagguggaguccgacgacgaguaccuggcccugcccgcccgccucacccaggugagcucccuggucagcuaccugggcuccaucagcacgcucgugacccugcccaccggggacaucaagggccagagcccccuggagguguccgacuccgacgggcccgccagcuucccguccagcuccagccagagccagcugccgcccggcgcggcccuccagggcuccggggaccccgagggccagaaccccugcuuccugcggagcuucguccgcgcccacgacuccgccggggagggcagccugggguccagccaggcccucggcguguccagcggccugcugaagacccggcccucccuccccgcgcgccuggaccgguggcccuucagcgacccggacguggaggggcagcugccccgcaagggcggggagcagggcaaggagucccucguccagugcgugaagacguucugcugccagcuggaggagcugaucugcuggcucuacaacgucgccgacgugaccgaccacgggaccgccgcccggagcaaccugaccucccucaagagcucccugcagcuguaccgccaguucaagaaggacaucgacgagcaccagagccugacggaguccgugcuccagaagggcgagauccugcugcagugccuccuggagaacacccccguccuggaggacgugcucggccgcaucgccaagcagagcggggagcuggagucccacgcggaccggcuguacgacagcauccucgccagccuggacaugcuggccggcugcacccucauccccgacaagaagccgauggccgcgauggagcaccccugcgaggggguguga

SEQ ID NO: 28157 - RNA, 1944 nt, Artificial Sequence
  derived and/or modified sequence opt1 from CEP72__Homo_sapiens__NP_060610
auggcccgcgccggcccccggcuggugcucagcgaggaggcgguccgcgccaaguccgggcugggcccgcaccgggaccuggccgagcuccagagccuguccauccccgggaccuaccaggagaagaucacccaccugggccacagccucaugucccugacggggcucaagagccuggaccugucccgcaacagccuggugucccucgagggcauccaguaccugaccgcccuggagagccucaaccuguacuacaacugcaucuccagccuggccgagguguuccggcuccacgcgcugaccgagcuggucgacguggacuuccgccucaaccccguggucaagguggagcccgacuaccggcuguucgugguccaccuccugccgaagcugcagcagcuggacgaccgccccgugcgggccuccgagcgcaaggccagccggcuccacuucgccuccgaggacagccuggacuccaaggagagcgugcccgcgucccugaaggagggccgcccccaccacccgcgggccaagugcaccgaggcccucgccaagcagagccuggucauggacgccgacgacgaggcggugcugaaccucaucgccgagugcgagugggaccuggggcgcccgcccggcagcacguccuucagccagaaggggcgggaggccgacucccgcggcagccaggagucccggcaccuccugagcccccagcuggugcaguaccagugcggggacuccggcaagcagggccgcgagacccggcgcagcuccugccgggggugcugccuggagaagaugcccuggagccagcucugcggcgagcugccgccccuguacggggccgagcccgaggccucccgcgcgccccgcccccacaccuacuucacgccccaccccgacagcauggacaccgaggacuccgccagcucccagaagcucgaccugagcggcgagauggucccgggcccccugcccgcccccgggaagugccggaagcgccggaugccggugggccgcuuccagaccuucuccgaccaggaggggcucggcugccccgagcggacccacgggagcuccgugcccaaggagagccugagccgccaggacuccagcgagucccggaacggccgcacccugagccagcccgaggccuccgagacggaggagcagcggagccgcggcgucaccgacacccgggagccgucccccgggagccacuccgcccuccccggcaagaagaccgcgcugcaggccgcccugcuggagacgcuccuggaccugguggaccgcagcuggggcgggugccggucccuccacagcaacgaggccuuccuggcccaggcgcgccacauccuguccagcguggaggaguucaccgccgcccaggacuccagcgccauggucggggaggacgugggcucccucgcgcuggagagcaagagccugcagucccggcucgccgagcagcagcagcagcacgcccgcgagaugagcgaggugaccgccgagcugcaccacacccacaaggagcuggacgaccuccggcagcaccuggacaagucccuggaggagaacagccgccucaagucccugcugcucagcaugaagaaggaggucaaguccgccgacacggcggccacccugaaccugcagaucgccggccuccagaccagcgugaagcggcugugcggggagaucgucgagcugaagcagcaccucgagcacuacgacaagauccaggagcugacccagaugcugcaggagucccacagcucccucgugagcacgaacgagcaccuccugcaggagcugucccaggugcgcgcccagcaccgcgccgaggucgagcagaugcacuggagcuaccaggagcugaagaagaccauggcgcuguucccgcacuccagcgccucccacggcgggugccaggccugcuga

SEQ ID NO: 28158 - RNA, 1755 nt, Artificial Sequence
  derived and/or modified sequence opt1 from CEP76__Homo_sapiens__NP_001258918
augagccugcccccggagaaggccuccgagcucaagcagcugauccaccagcagcugagcaagauggacgugcacggccgcauccgggagauccucgccgagaccauccgcgaggagcuggcgcccgaccagcagcaccuguccaccgaggaccucaucaaggcccugcggcgccgggggaucaucgacgacgucaugaaggagcugaacuucgugacggacagcguggagcaggagcuccccuccagccccaagcagccgaucugcuucgaccgccaguccacccugaagaaguccgacggcacccggauggccgacagcaccacgaugcugagcaucuccgaccccauccacaugguccucaucaagaccgacaucuucggggagaccacccugguggccagcuacuuccuggaguggcgcuccgugcucggcagcgagaacggggucacgucccugaccguggagcugaugggcgugggcaccgagagcaaggucuccguggggauccucaacaucaagcuggagauguacccgccccugaaccagacccucagccaggagguggucaacacgcagcuggcccuggagcggcagaagaccgcggagaaggagcgccucuuccugguguacgccaagcagugguggcgggaguaccugcagauccgccccucccacaacagccggcucgugaagaucuucgcccaggacgagaacggcaucaaccgccccgucugcagcuacgugaagccccugcgggccgggcgccugcucgacacgccccggcaggcggcccgcuucgugaacguccugggcuacgagcgggccccggugaucgggggcggcgggaagcaggagcaguggugcacccugcucgccuuccugugccgcaacaagggcgacugcgaggaccacgccaaccugcucugcucccugcugcucggguacggccuggaggcguucgugugcgucggcaccaaggccaagggggugccccacgccugggugaugaccugcggcaccgacggggccaucaccuucugggagagccugacgggccaccgguacauccacaagcccaccaaccccgacgagccgcccgucgccgagcagcccaagccccucuacccguaccgcaccaucgggugcguguucaaccaccagauguuccugggcaacugccagcccuccgacgcggucgagaccugcguguucgaccugaacgacgagagcaaguggaagcccauguccgaggaggccaucaagagcgugugcgcccccggcgccacgaccucccucccgcccuucccgccccugugcgccagcaccaucgacgcguccgucaccagcaacgagaucgagaugcagcugcgccuccugguguccgagcaccggaaggaccuggggcugacgaccgugugggaggaccagcucagcuaccugcugucccccgcccucgccagcuacgaguucgagcgcaccaccuccaucagcgccggcaacgaggaguuccaggacgccauccggcgcgcgguccccgacgggcacacguucaagggcuuccccauccacuucguguaccggaacgcccgccgggccuucgcgaccugccugcgcuccccguucugcgaggagaucaucugcugccgcggggaccaggugcggcuggccguccgggugcgcguguucaccuaccccgagagcgccugcgccgucuggaucauguucgccugcaaguaccgguccgugcucuga

SEQ ID NO: 28159 - RNA, 2106 nt, Artificial Sequence
  derived and/or modified sequence opt1 from CEP83__Homo_sapiens__NP_057206
augguggucagcaccuucaccgacauggacacguuccccaacaacuucccgcccggcggggacuccggccugaccgggagccaguccgaguuccagaagaugcucaucgacgagcgccugcggugcgagcaccacaaggccaacuaccagacccugaaggccgagcacacccgccuccagaacgagcacgugaagcugcagaacgagcugaagcaccucuucaacgagaagcagacgcagcaggagaagcugcagcugcuccuggaggagcugcggggcgagcucguggagaagaccaaggaccuggaggagaugaagcugcagauccucacgccccagaagcuggagcugcuccgcgcgcagauccagcaggagcuggagacccccaugcgggagcgcuuccggaaccuggacgaggaggucgagaaguaccgcgccguguacaacaagcuccgguacgagcacaccuuccucaagagcgaguucgagcaccagaaggaggaguacgcccgcauccuggacgaggggaagaucaaguacgaguccgagaucgcccggcuggaggaggacaaggaggagcugcgcaaccagcugcucaacguggaccugaccaaggacagcaagcgggucgagcagcuggcccgcgagaagguguaccucugccagaagcugaagggccuggaggcggagguggccgagcucaaggccgagaaggagaacuccgaggcccaggucgagaacgcgcagcggauccaggugcgccagcuggccgagaugcaggccaccgugcggagccuggaggccgagaagcaguccgccaaccuccgcgcggagcggcuggagaaggagcugcagagcuccagcgagcagaacaccuuccucaucaacaagcugcacaaggccgagcgcgagaucaacacgcuguccagcaaggucaaggagcucaagcacuccaacaagcuggagaucaccgacaucaagcuggagaccgcccgggccaagagcgagcucgagcgcgagcgcaacaagauccaguccgagcuggacggccugcagagcgacaacgagauccucaaggccgcgguggagcaccacaaggugcugcuggucgagaaggaccgggagcugauccgcaaggugcaggccgccaaggaggagggguaccagaagcucgugguccugcaggacgagaagcuggagcucgagaaccggcuggccgaccuggagaagaugaagguggagcacgacguguggcgccaguccgagaaggaccaguacgaggagaagcuccgggccagccagauggcggaggagaucacccgcaaggagcugcagagcguccggcugaagcuccagcagcagaucgugacgaucgagaacgccgagaaggagaagaacgagaacuccgaccugaagcagcagaucagcucccugcagauccaggugaccagccucgcccaguccgagaacgaccugcugaacagcaaccagaugcucaaggagauggucgagcgccugaagcaggagugccggaacuuccgcucccaggccgagaaggcccagcuggaggcggagaagacccucgaggagaagcagauccaguggcuggaggagaagcacaagcugcacgagcggaucaccgaccgcgaggagaaguacaaccaggccaaggagaagcuccagcgggccgccaucgcgcagaagaagcgcaagagccugcacgagaacaagcugaagcggcuccaggagaagguggagguccuggaggccaagaaggaggagcuggagacggagaaccaggugcucaaccgccagaacgugccguucgaggacuacacccggcugcagaagcgccugaaggacauccagcggcgccacaacgaguuccgcucccucauccugguccccaacaugccgcccaccgccagcaucaaccccguguccuuccagagcuccgccauggugcccagcauggagcugcccuucccgccccacaugcaggaggagcagcaccagcgggagcucucccugcugcgcaagcggcucgaggagcuggagaccacgcagcgcaagcagcuggaggagcucggcagcuccggggaguga

SEQ ID NO: 28160 - RNA, 2418 nt, Artificial Sequence
  derived and/or modified sequence opt1 from CEP85L__Homo_sapiens__NP_001035940
auguggggccgcuuccuggcccccgaggccagcgggcgggacuccccgggcggggcgcgcagcuuccccgccggccccgacuacuccagcgccuggcuccccgccaacgagucccuguggcaggccaccaccgugccgagcaaccaccggaacaaccacauccgccggcacuccaucgcgagcgacuccggggacacgggcaucggcaccagcugcuccgacagcgucgaggaccacuccaccagcuccgggacccugagcuucaagcccucccagagccucaucacgcugcccaccgcccacgugaugcccuccaacagcagcgccuccaucagcaagcugcgcgagucccucaccccggacggcagcaagugguccaccagccugaugcagacgcuggggaaccacucccggggcgagcaggacagcucccucgacaugaaggacuuccgcccccugcggaaguggagcucccugagcaagcucaccgcccccgacaacugcgggcagggcggcaccgugugccgcgaggagucccggaacgggcuggagaagaucggcaaggcgaaggcccugaccagccagcuccgcacgaucgggcccuccugccugcacgacagcauggagaugcugcggcucgaggacaaggagaucaacaagaagcgcuccagcacccuggacugcaaguacaaguucgaguccugcagcaaggaggacuuccgggccagcuccagcacccugcgccggcagccggucgacaugaccuacuccgcccuccccgagagcaagcccaucaugacguccagcgaggccuucgagcccccgaaguaccugaugcugggccagcaggcggugggcggggugcccauccagcccuccguccgcacccagauguggcucaccgagcagcugcggaccaacccccuggagggccgcaacacggaggacagcuacucccucgccccguggcagcagcagcagaucgaggacuuccggcaggggagcgagacccccaugcagguccugaccggcuccagccgccaguccuacagccccggguaccaggacuucuccaagugggagagcaugcugaagaucaaggagggccuccugcgccagaaggagaucgugaucgaccggcagaagcagcagaucacccaccuccacgagcgcauccgggacaacgagcuccgcgcccagcacgccaugcugggccacuacgugaacugcgaggacuccuacguggccagccugcagccccaguacgagaacacgagccuccagaccccguucuccgaggagagcgugucccacagccagcagggggaguucgagcagaagcuggcguccaccgagaaggagguccugcagcucaacgaguuccugaagcagcggcugagccucuucuccgaggagaagaagaagcuggaggagaagcugaagacccgcgaccgguacaucagcucccucaagaagaagugccagaaggagagcgagcagaacaaggagaagcagcgccggaucgagacgcuggagaaguaccuggccgaccuccccacccuggacgacgugcagucccagagccugcagcugcagauccucgaggagaagaacaagaaccugcaggaggcccugaucgacaccgagaagaagcucgaggagaucaagaagcagugccaggacaaggagacccagcugaucugccagaagaagaaggagaaggagcuggugacgaccguccagucccuccagcagaagguggagcgcugccuggaggacggcauccggcugcccaugcucgacgccaagcagcugcagaacgagaacgacaaccugcgccagcagaacgagaccgccagcaagaucaucgacucccagcaggacgagaucgaccggaugauccucgagauccagagcaugcaggggaagcuguccaaggagaagcugaccacgcagaagaugauggaggagcucgagaagaaggagcgcaacgugcagcggcugaccaaggcgcugcucgagaaccagcgccagaccgacgagaccugcagccugcuggaccagggccaggagcccgaccagucccggcagcagaccguccucagcaagcgcccgcuguucgaccugacggugaucgaccagcuguucaaggagaugagcugcugccuguucgaccugaaggcccucugcuccauccugaaccagcgggcccaggggaaggagcccaaccugagccuccugcugggcauccgcuccaugaacugcagcgccgaggagaccgagaacgaccacuccaccgagacccucacgaagaagcugagcgacgugugccagcugcgccgggacaucgacgagcuccgcaccaccaucuccgaccgguacgcccaggacaugggcgacaacugcaucacccaguga

SEQ ID NO: 28161 - RNA, 2352 nt, Artificial Sequence
  derived and/or modified sequence opt1 from CEP89__Homo_sapiens__NP_116205
augcugcucggcuuccgccgggggcgccggagccacuucaagcacaucauccacggccugcugcccgccgccuccguggcgcccaaggccgccgucccccgcaccccgccgccccggagccccaaccccucccccgagcgcccccggagcgcccucgccgcggccauccuggccaccacgcugaccgggcgcaccguggccaucccccagccccggcagcgcucccggagcgaguccgacgugagcuccgucgagcaggacagcuucaucgagcccuacgcgaccacgucccagcuccgcccgcggcccaacuggcagagcgagaugggccgccgguccagccugcccuccuucgagacccuggacuacggggacgaggaggacaucgagacccagcucagcuccagcggcaaggagcugggcgacguguccgcccgcgaggaccgcgggggccacagcgacgaccuguacgccgugccccaccggaaccaggucccgcuccugcacgaggugaacagcgaggacgacgagaacaucucccaccaggacggguuccccggcagcccgcccgcgccccagcggacccagcagaaggacgggaagcaccccgugcugaaccucaaggacgagaagccgccccugugcgagaagcccccgcccucccccgacaucacgggccgcgcccggcagcgcuacaccgagaucacccgcgagaaguucgaggcccugaaggaggagaacauggaccucaacaacaugaaccagagccugacccuggagcucaacacgaugaagcaggccaugaaggagcugcagcugaagcucaagggcauggagaaggagaagcggaagcugaaggaggccgagaaggccuccagccaggaggucgccgcgcccgagcugcucuaccugcgcaagcaggcccaggagcugguggacgagaacgacgggcucaagaugaccgugcaccggcugaacgucgagcugucccgcuaccagaccaaguuccggcaccucagcaaggaggagucccugaacaucgagggccugcccagcaaggggcccaucccgcccuggcuccuggacaucaaguaccugagcccccuccugcuggccuacgaggacaugaugaaggagaaggacgagcucaacgccacccugaaggaggagaugcgcauguuccggaugcgcgugcaggagguggucaaggagaacgaggagcugcaccaggagcucaacaagagcuccgccgugacgagcgaggaguggcggcagcugcagacccaggcgaagcuggugcucgaggagaacaagcugcugcuggagcagcucgagauccagcagcgcaaggccaaggacucccaccaggagcggcugcaggaggucagcaagcugaccaagcagcucaugcugcuggaggccaagacccacggccaggagaaggagcucgccgagaaccgcgagcagcuggagauccugcgggccaagugccaggagcucaagacgcacuccgacggcaagaucgcgguggaggugcacaagagcaucgucaacgagcugaagucccagcugcagaaggaggaggagaaggagcgcgccgagauggaggagcucauggagaagcugaccgugcugcaggcccagaagaagucccuccugcuggagaagaacagccucaccgagcagaacaaggcccuggaggcggagcuggagcgggcccagaagaucaaccgcaagucccagaagaagaucgaggugcucaagaagcaggucgagaaggccauggggaacgagaugagcgcccaccaguaccuggccaaccuggugggccucgcggagaacaucacccaggagcgggacucccugaugugccuggccaagugccucgagagcgagaaggacgggguccugaacaaggugaucaaguccaacauccgccugggcaagcucgaggagaaggugaagggguacaagaagcaggccgcccugaagcugggcgacaucagccaccggcuccuggagcagcaggaggacuucgccggcaagacggcgcaguaccgccaggagaugcgccaccuccaccagguccugaaggacaagcaggaggugcuggaccaggcccugcagcagaaccgggagauggagggggagcucgaggugaucugggaguccaccuuccgcgagaaccggcgcauccgggagcugcugcaggacacccucacccgcacgggcguccaggacaacccccgggcccugguggccccgagccugaacggggugucccaggccgaccuccuggacggcugcgacgucugcagcuacgaccugaagucccacgcgccgaccugcuga

SEQ ID NO: 28162 - RNA, 804 nt, Artificial Sequence
  derived and/or modified sequence opt1 from CER1__Homo_sapiens__NP_005445
augcaccuccugcuguuccagcugcucgugcugcugccccucggcaagaccacccgccaccaggacgggcggcagaaccagagcucccugagcccgguccugcucccccgcaaccagcgggagcugcccacgggcaaccacgaggaggccgaggagaagcccgaccuguucguggccgugccgcaccucgucgcgaccucccccgccggggagggccagcgccagcgggagaagaugcugagccgcuucgggcgguucuggaagaagcccgagcgcgagaugcaccccucccgggacagcgacuccgagccguucccgcccggcacccagagccugauccagcccaucgacggcaugaagauggagaaguccccgcuccgcgaggaggccaagaaguucuggcaccacuucauguuccggaagacccccgccagccagggggugauccugcccaucaagucccacgaggugcacugggagacgugccgcaccguccccuucagccagaccaucacccacgagggcugcgagaagguggugguccagaacaaccugugcuucgggaagugcggcuccgugcacuuccccggggccgcgcagcacagccacacguccugcagccacugccuccccgccaaguucaccaccaugcaccucccccugaacugcaccgagcuguccagcgugaucaaggucgugaugcugguggaggagugccagugcaaggucaagacggagcacgaggacggccacauccugcacgccggcucccaggacagcuucauccccggggugagcgccuga

SEQ ID NO: 28163 - RNA, 1614 nt, Artificial Sequence
  derived and/or modified sequence opt1 from CERK__Homo_sapiens__NP_073603
augggcgccaccggggccgcggagccccugcagagcgugcucugggucaagcagcagcgcugcgccgugucccuggagccggcccgggcccugcuccgcugguggcggagccccggccccggggccggcgcgcccggggccgacgccugcuccgugccggucagcgagaucaucgccguggaggagaccgacgugcacggcaagcaccagggcuccgggaaguggcagaagauggagaagcccuacgcguucacgguccacugcgugaagcgcgcccggcgccaccgguggaagugggcccaggugaccuucuggugccccgaggagcagcugugccaccuguggcuccagacccugcgcgagaugcuggagaagcucaccagccggcccaagcaccuccuggucuucaucaacccguucggcgggaagggccaggggaagcgcaucuacgagcggaagguggcgccccuguucacgcuggccuccaucaccaccgacaucaucgugaccgagcacgccaaccaggccaaggagacgcuguacgagaucaacaucgacaaguacgacggcaucgucugcgugggcggggacggcauguucagcgaggugcuccacgggcugaucggccgcacccagcgguccgccggcgucgaccagaaccacccccgcgccgugcuggugcccagcucccuccggaucgggaucaucccggccggcagcaccgacugcgucugcuacuccaccguggggacgagcgacgcggagaccuccgcccugcacaucguggucggcgacagccuggccauggacguguccagcgugcaccacaacuccacccuccugcgcuacagcgucagccugcucggguacggcuucuacggcgacaucaucaaggacuccgagaagaagcgguggcuggggcuggcccgcuacgacuucagcggccucaagaccuuccugucccaccacugcuacgaggggacggugagcuuccugcccgcccagcacaccgucggcagcccccgggaccgcaagcccugccgggcggggugcuucgugugccgccaguccaagcagcagcucgaggaggagcagaagaaggcccuguacggccuggaggccgccgaggacguggaggaguggcaggucgugugcggcaaguuccucgccaucaacgcgaccaacauguccugcgccugccgccggagcccgcgcgggcugucccccgccgcccaccugggcgacgggagcuccgaccucauccugauccggaagugcagccgcuucaacuuccugcgguuccucauccgccacaccaaccagcaggaccaguucgacuucacguucguggaggucuaccgggugaagaaguuccaguucaccuccaagcacauggaggacgaggacagcgaccugaaggagggcgggaagaagcgcuucggccacaucugcuccagccaccccuccugcugcugcaccgugagcaacuccagcuggaacugcgacggcgagguccugcacagccccgcgaucgaggugcgggugcacugccagcucguccgccuguucgcccgggggaucgaggagaacccgaagcccgacucccacagcuga

SEQ ID NO: 28164 - RNA, 1677 nt, Artificial Sequence
  derived and/or modified sequence opt1 from CERKL__Homo_sapiens__NP_001025482
augcccuggcgccggcgccggaaccgcgugagcgcccuggagggcgggcgggaggaggaggccccgcccgaggcggccgccgucccgcccgcccuccugaccuccccgcagcagaccgaggccgcggccgagcgcauccugcuccggggcaucuucgagaucgggcgcgacagcugcgacguggugcuguccgagcgggcccugcgcuggcggcccauccagcccgagcgccccgccggcgacagcaaguacgaccuccugugcaaggaggaguucaucgagcugaaggacaucuucuccgucaagcucaagcggcgcugcagcgugaagcagcagcgguccgggacgcugcugggcaucacccucuucaucugccugaagaaggagcagaacaagcugaagaacagcacccucgaccugaucaaccuguccgaggaccacugcgacaucugguuccgccaguucaagaagauccucgcgggcuucccgaaccggcccaagagccugaagauccugcucaacccccagucccacaagaaggaggccacccagguguacuacgagaaggucgagccccugcugaagcucgccgggaucaagacggacgugaccaucauggaguacgagggccacgcccugagccugcucaaggagugcgagcugcagggguucgacggcgggcaccgcaagccccuguucgccauccacugguccgugcagcgccucuucaccggcaugcagacccuggagcccagcgucgugugcgugggcggggacggcuccgcgagcgaggucgcccacgcccugcuccugcgggcccagaagaacgccgggauggagacggaccggauccugacccccgugcgcgcgcagcucccccugggccugaucccggccggcuccaccaacgugcucgcccacagccugcacggggucccccacgugaucaccgccacgcugcacaucaucaugggccacgugcagcucgucgacgugugcaccuucuccaccgccgggaagcugcugcgcuucggcuucagcgcgauguucggguucggcggccggacccucgcccuggccgagaaguaccgcuggaugagccccaaccagcggcgcgacuucgccguggucaaggcccuggcgaagcucaaggccgaggacugcgagaucuccuuccugcccuucaacagcuccgacgacgugcaggagcggcgcgcccaggggagcccgaaguccgacugcaacgaccaguggcagaugauccagggccaguuccugaacgugagcaucauggccauccccugccugugcuccgucgcgccccgggggcucgcccccaacacgcgccugaacaacggcagcauggcccugaucaucgcccggaacaccucccgcccggaguucaucaagcaccucaagcgguacgccagcgugaagaaccaguucaacuuccccuucgucgagaccuacaccguggaggaggugaagguccacccccgcaacaacaccgggggcuacaaccccgaggaggaggaggacgagacggcguccgagaacugcuucccguggaacguggacggcgaccugauggagguggccagcgagguccacauccggcugcacccccgccucaucucccuguacgggggcagcauggaggagaugauccccaaguga

SEQ ID NO: 28165 - RNA, 720 nt, Artificial Sequence
  derived and/or modified sequence opt1 from CERS1__Homo_sapiens__NP_001277194
augcccgagagcgccuggaaguuccuguucuaccucggguccuggagcuacuccgccuaccugcuguucgggaccgacuacccguucuuccacgacccgcccagcguguucuacgacuggacccccggcauggcggucccccgcgacaucgccgccgccuaccuccugcagggguccuucuacggccacagcaucuacgccacgcuguacauggacaccuggcggaaggacuccguggugaugcuccugcaccacgucgugacccugauccucaucgugagcuccuacgcguuccgcuaccacaacgucgggauccuggugcuguuccuccacgacaucagcgacgugcagcuggaguucaccaagcugaacaucuacuucaagucccggggcggcagcuaccaccgccuccacgcccuggccgccgaccuggggugccucuccuucggcuucagcugguucugguuccggcuguacugguucccccugaagguccucuacgcgacgucccacugcagccugcgcaccgugcccgacauccccuucuacuucuucuucaacgcccugcuccugcugcucacccugaugaaccuguacugguuccucuacaucguggccuucgccgccaagguccugaccggccaggugcacgagcugaaggaccuccgggaguacgacacggcggaggcccagucccugaagccgagcaaggccgaguga

SEQ ID NO: 28166 - RNA, 1203 nt, Artificial Sequence
  derived and/or modified sequence opt1 from CERS2__Homo_sapiens__XP_011507753
auggugccccuggcccuccacuucccgggcgaggucgggcugcaggagaccgccgugcgcaugcugcagacccucuacgacuacuucuggugggagcggcuguggcugcccgugaaccucacgugggcggaccuggaggaccgcgacggccgggucuacgccaaggccagcgaccuguacaucacccucccccuggcccuccuguuccugaucgugcgcuacuucuucgagcuguacguggccacgccccucgcggcccugcugaacaucaaggagaagacccggcuccgcgccccgcccaacgccacccuggagcacuucuaccugaccuccgggaagcagcccaagcaggucgagguggagcuccugagccggcaguccggccugagcgggcgccagguggagcggugguuccgccggcgccggaaccaggaccgccccucccuccugaagaaguuccgggaggcgagcuggcgcuucaccuucuaccugaucgccuucaucgccggcauggccgucaucguggacaagccgugguucuacgacaugaagaaggugugggagggcuaccccauccaguccaccauccccagccaguacugguacuacaugaucgagcucuccuucuacuggagccugcuguucuccaucgccagcgacgucaagcggaaggacuucaaggagcagaucauccaccacguggcgacgaucauccucaucuccuucagcugguucgccaacuacauccgcgccgggacccugaucauggcccugcacgacuccagcgacuaccuccuggaguccgccaagauguucaacuacgcgggcuggaagaacacgugcaacaacaucuucaucguguucgccaucgucuucaucaucacccggcuggugauccuccccuucuggauccugcacugcacccugguguacccgcucgagcuguaccccgccuucuucggguacuacuucuucaacagcaugaugggcguccugcagcuccugcacaucuucugggccuaccugauccuccgcauggcccacaaguucaucaccgggaagcugguggaggacgagcgguccgaccgcgaggagaccgagagcagcgagggcgaggaggcggccgccggcgggggcgccaagucccgcccccuggccaacgggcaccccauccucaacaacaaccaccggaagaacgacuga

SEQ ID NO: 28167 - RNA, 1185 nt, Artificial Sequence
  derived and/or modified sequence opt1 from CERS3__Homo_sapiens__NP_001277270
augcugcacaccaccgcccgccgggccgcgcgcauguucuggacguucaaggagugguucuggcucgagcgguucuggcugcccccgaccaucaaguggagcgaccuggaggaccacgacggccucguguucgucaagcccucccaccuguacgugaccauccccuacgccuuccugcuccugaucauccgccggguguucgagaaguucgucgccagcccccuggccaaguccuucgggaucaaggagaccgugcgcaaggugacgccgaacaccguccucgagaacuucuucaagcacagcacccggcagccccugcagaccgacaucuacggccuggccaagaagugcaaccucacggagcgccagguggagcggugguuccgcucccggcgcaaccaggagcggcccagccgccugaagaaguuccaggaggcgugcuggcgguucgccuucuaccugaugaucaccguggccgggaucgccuuccucuacgacaagcccuggcuguacgaccugugggaggucuggaacggcuacccgaagcagccccuccugcccucccaguacugguacuacauccuggagaugagcuucuacuggucccuccuguuccgccugggguucgacgugaagcggaaggacuuccucgcgcacaucauccaccaccuggccgccaucagccugauguccuucagcuggugcgccaacuacauccgcuccggcacccucgugaugaucguccacgacguggccgacaucuggcuggagagcgcgaagauguucuccuacgccggcuggacccagacgugcaacacccuguucuucaucuucagcaccaucuucuucaucucccggcucaucguguuccccuucuggauccuguacugcacccugauccucccgauguaccaccuggagcccuucuucagcuacaucuuccugaaccuccagcugaugauccugcagguccuccaccuguacuggggguacuacauccugaagaugcucaaccgcugcaucuucaugaaguccauccaggacgugcggagcgacgacgaggacuacgaggaggaggaggaggaggaggaggaggaggccacgaagggcaaggagauggacugccugaagaacgggcugcgcgccgagcgccaccucauccccaacggccagcacgggcacuga

SEQ ID NO: 28168 - RNA, 1185 nt, Artificial Sequence
  derived and/or modified sequence opt1 from CERS4__Homo_sapiens__NP_078828
augcugagcuccuucaacgagugguucuggcaggaccgcuucuggcugcccccgaacgugaccuggaccgagcucgaggaccgggacggccgcgucuacccccacccccaggaccugcucgccgcccugccccuggcgcucgugcugcuggccaugcggcucgccuucgagcgcuucaucgggcugccgcugagccgguggcucggcgugcgcgaccagacgcggcgccaggucaagcccaacgccacccuggagaagcacuuccugaccgaggggcaccggcccaaggagccccagcucucccugcuggccgcgcagugcggccucacccugcagcagacgcagcgcugguuccggcgccggcgcaaccaggaccggccgcagcugaccaagaaguucugcgaggccagcuggcgcuuccucuucuaccuguccagcuucgucgggggccuguccgugcucuaccacgagagcuggcugugggcccccgugaugugcugggaccgguaccccaaccagacccugaagcccucccucuacuggugguaccugcuggagcucggcuucuaccugagccugcucauccgccugccguucgacgugaagcggaaggacuucaaggagcaggucauccaccacuucguggccgugauccugaugaccuucuccuacagcgcgaaccuccugcgcaucgggucccuggugcuccugcugcacgacagcuccgacuaccuccuggaggccugcaagauggucaacuacaugcaguaccagcaggucugcgacgcccuguuccucaucuucagcuucguguucuucuacacgcggcuggugcuguuccccacccagauccucuacaccaccuacuacgaguccaucagcaaccgcggccccuucuucggguacuacuucuucaacggccugcugaugcugcuccagcugcugcacguguucugguccugccucauccugcgcaugcuguacagcuucaugaagaaggggcagauggagaaggacauccggagcgacguggaggaguccgacagcuccgaggaggccgccgcggcccaggagccccuccagcugaagaacggcgccgccggcgggccgcgccccgcccccacggacggcccccggagccgcgucgcggggcggcugaccaaccgccacaccaccgccacguga

SEQ ID NO: 28169 - RNA, 1179 nt, Artificial Sequence
  derived and/or modified sequence opt1 from CERS6__Homo_sapiens__NP_001243055
auggccggcauccuggccugguucuggaacgagcgcuucuggcucccccacaacgugaccugggcggaccugaagaacaccgaggaggccacguucccgcaggccgaggaccuguaccucgccuucccccuggccuucugcaucuucaugguccggcugaucuucgagcgcuucguggcgaagcccugcgccaucgcccucaacauccaggccaacgggccccagaucgcgccgcccaacgccauccuggagaagguguucaccgccaucaccaagcaccccgacgagaagcggcuggagggccucagcaagcagcuggacugggacguccgcuccauccagcggugguuccgccagcggcgcaaccaggagaagcccagcacccugacgcgguucugcgaguccauguggcgcuucagcuucuaccucuacguguucaccuacggggugcgguuccugaagaagaccccguggcuguggaacacccgccacugcugguacaacuaccccuaccagccccucacgaccgaccugcacuacuacuacauccuggagcucuccuucuacuggagccugauguucucccaguucaccgacaucaagcggaaggacuucggcaucauguuccugcaccaccucgucagcaucuuccugaucaccuucuccuacgugaacaacauggcccgcguggggacgcugguccucugccugcacgacagcgccgacgcgcugcucgaggccgccaagauggccaacuacgccaaguuccagaagaugugcgaccugcuguucgugauguucgcgguggucuucaucaccacccggcucggcaucuucccccugugggugcugaacaccacccucuucgaguccugggagaucgugggcccguaccccagcuggugggucuucaaccugcugcuccugcuggugcaggggcucaacugcuucugguccuaccugaucgugaagaucgccugcaaggccgucagccgcggcaaggccgggaaguggaacccccugcacguguccaaggacgaccggagcgacaucgaguccagcuccgacgaggaggacagcgagcccccgggcaagaacccccacacggccaccaccacgaacgggaccagcggcaccaacggcuaccuccugaccggguccugcagcauggacgacuga

SEQ ID NO: 28170 - RNA, 1704 nt, Artificial Sequence
  derived and/or modified sequence opt1 from CES1__Homo_sapiens__NP_001020365
auguggcugcgcgccuucauccucgccacccugagcgcguccgccgccuggggccaccccagcuccccgcccguggucgacaccgugcacgggaaggugcugggcaaguucgucagccucgagggguucgcccagcccguggccaucuuccugggcauccccuucgcgaagccgccccuggggccccuccgguucacgcccccgcagcccgccgagcccugguccuucgugaagaacgccaccagcuacccgcccaugugcacccaggaccccaaggccggccagcugcuguccgagcuguucaccaaccgcaaggagaacaucccccucaagcugagcgaggacugccucuaccugaacaucuacacgcccgcggaccugaccaagaagaaccggcuccccgucaugguguggauccacggcgggggccugauggugggggccgccuccaccuacgacggccuggcccucgccgcgcacgagaacgucgugguggucaccauccaguaccgccuggggaucuggggcuucuucagcacgggcgacgagcacucccgggggaacuggggccaccuggaccagguggccgcccuccgcugggugcaggacaacaucgccagcuucgggggcaaccccggcuccgucaccaucuucggggagagcgccggcggggaguccgugagcgugcugguccugagcccccucgcgaagaaccuguuccaccgggccaucagcgaguccggcguggcccugaccagcgugcucgucaagaagggggacgugaagccccuggccgagcagaucgccaucaccgcgggcugcaagacgaccaccagcgccgugaugguccacugccugcgccagaagaccgaggaggagcuccuggagacgacccugaagaugaaguuccucucccuggaccugcagggcgacccgcgggagagccagccccuccuggggaccgugaucgacggcaugcugcuccugaagacccccgaggagcugcaggccgagcgcaacuuccacacgguccccuacaugguggggaucaacaagcaggaguucggcuggcucaucccgaugcagcugauguccuacccccugagcgaggggcagcucgaccagaagaccgccaugucccugcuguggaaguccuacccccucgugugcaucgccaaggagcugauccccgaggcgaccgagaaguaccugggcggcaccgacgacacggucaagaagaaggaccuguuccucgaccugaucgccgacgugauguucggggugccguccgucaucguggcccggaaccaccgcgacgccggcgcgcccaccuacauguacgaguuccaguaccggcccagcuucuccagcgacaugaagccgaagaccgugaucggggaccacggcgacgagcuguucuccgucuucggggcccccuuccucaaggagggcgccagcgaggaggagauccgccuguccaagauggugaugaaguucugggccaacuucgcccggaacggcaaccccaacggggagggccugccccacuggccggaguacaaccagaaggagggguaccuccagaucggcgcgaacacccaggccgcccagaagcugaaggacaaggagguggccuucuggacgaaccuguucgccaagaaggcggucgagaagccgccccagaccgagcacaucgagcucuga

SEQ ID NO: 28171 - RNA, 1872 nt, Artificial Sequence
  derived and/or modified sequence opt1 from CES2__Homo_sapiens__NP_003860
augaccgcccagagccgcucccccaccacgccgaccuuccccggccccagccagcggaccccgcugacccccugccccgugcagacgccccgccucgggaaggcccugauccacugcuggaccgaccccggccagccgcugggggagcagcagcggguccgccggcagcgcaccgagaccuccgagcccacgaugcggcuccaccgccugcgggcgcgccugagcgccguggccugcggccuccugcugcuccuggugcgggggcagggccaggacuccgccagccccauccgcaccacccacaccggccagguccuggggucccucgugcacgugaagggcgccaacgcggggguccagacguuccugggcauccccuucgccaagccgccccuggggccccuccgguucgcgcccccggagccgcccgagagcugguccggcgugcgcgacggcaccacccaccccgccaugugccugcaggaccugaccgccguggagagcgaguuccucucccaguucaacaugacguuccccagcgacuccaugagcgaggacugccuguaccuguccaucuacacccccgcccacagccacgagggguccaaccuccccgucaugguguggauccacggcggggcccugguguucggcauggccagccuguacgacggcuccaugcucgccgcgcuggagaacgucgugguggucaucauccaguaccggcugggggugcucggcuucuucagcaccggggacaagcacgccaccggcaacuggggguaccuggaccagguggccgcccugcgcuggguccagcagaacaucgcccacuucggcggcaaccccgaccgggugacgaucuucggggagagcgcgggcgggaccuccgugagcucccucgucgugagcccgaucucccagggccuguuccacggggccaucauggagagcggcguggcccugcuccccggccugaucgccuccagcgccgacgucaucuccaccguggucgcgaaccugagcgccugcgaccagguggacuccgaggcccucguggggugccugcgcggcaagagcaaggaggagauccuggccaucaacaagcccuucaagaugauccccggggucguggacggcguguuccucccgcggcacccccaggagcugcuggccuccgcggacuuccagcccgucccgagcaucgugggggugaacaacaacgaguucggcuggcucauccccaaggucaugcgcaucuacgacacccagaaggagauggaccgggaggccucccaggccgcccugcagaagaugcugacgcuccugaugcugccgcccaccuucggcgaccuccugcgcgaggaguacaucggggacaacggcgacccccagacccugcaggcgcaguuccaggagaugauggccgacagcauguucgugauccccgcccuccagguggcccacuuccagugcucccgcgcccccgucuacuucuacgaguuccagcaccagcccagcuggcugaagaacauccggccgccccacaugaaggcggaccacggggacgagcugcccuucguguuccgcuccuucuucggcggcaacuacaucaaguucaccgaggaggaggagcagcugagccggaagaugaugaaguacugggccaacuucgcccgcaacgggaaccccaacggcgaggggcucccgcacuggccccuguucgaccaggaggagcaguaccugcagcucaaccugcagcccgccgugggccgggcccugaaggcgcaccgccuccaguucuggaagaaggcccugccccagaagauccaggagcuggaggagccggaggagcggcacacggagcucuga

SEQ ID NO: 28172 - RNA, 633 nt, Artificial Sequence
  derived and/or modified sequence opt1 from CES3__Homo_sapiens__NP_001172105
auggagcagaugagccgcgaggacaugcuggccaucuccacccccgugcucaccagccuggacgucccgcccgagaugaugcccacggugaucgacgaguaccugggcuccaacagcgacgcccaggcgaagugccaggccuuccaggaguucaugggggacguguucaucaacguccccaccguguccuucagccgguaccuccgcgacuccggcagcccgguguucuucuacgaguuccagcaccggcccuccagcuucgccaagaucaagcccgccugggucaaggccgaccacggggcggagggcgccuucguguucgggggccccuuccugauggacgaguccagccgccuggccuucccggaggccaccgaggaggagaagcagcucucccugaccaugauggcgcaguggacgcacuucgcccggaccggcgaccccaacagcaaggcccugccgcccuggccccaguucaaccaggccgagcaguaccucgagaucaaccccgugccccgcgccgggcagaaguuccgggaggcguggaugcaguucugguccgagacccugcccagcaagauccagcaguggcaccagaagcagaagaaccgcaaggcccaggaggaccuguga

SEQ ID NO: 28173 - RNA, 519 nt, Artificial Sequence
  derived and/or modified sequence opt1 from CETN1__Homo_sapiens__NP_004057
auggccagcggcuucaagaagcccuccgccgcgagcaccgggcagaagcgcaagguggccccgaagcccgagcugaccgaggaccagaagcaggagguccgggaggccuucgaccucuucgacguggacggcuccgggacgaucgacgccaaggagcugaagguggccaugcgcgcgcugggcuucgagccccggaaggaggagaugaagaagaugaucagcgaggucgaccgcgaggggaccggcaagaucuccuucaacgacuuccucgccgugaugacccagaagaugagcgagaaggacaccaaggaggagauccugaaggccuuccggcuguucgacgacgacgagacgggcaagaucuccuucaagaaccucaagcgcguggccaacgagcugggggagaaccugaccgacgaggagcuccaggagaugaucgacgaggcggaccgggacggcgacggggaggucaacgaggaggaguuccugcgcaucaugaagaagaccagccuguacuga

SEQ ID NO: 28174 - RNA, 519 nt, Artificial Sequence
  derived and/or modified sequence opt1 from CETN2__Homo_sapiens__NP_004335
auggccagcaacuucaagaaggccaacauggcguccagcucccagcgcaagcggaugagccccaagccggagcugaccgaggagcagaagcaggagauccgcgaggccuucgaccucuucgacgccgacggcaccgggacgaucgacgugaaggagcugaaggucgccaugcgggcccugggcuucgagcccaagaaggaggagaucaagaagaugaucuccgagaucgacaaggaggggaccggcaagaugaacuucggggacuuccucaccgugaugacccagaagaugagcgagaaggacacgaaggaggagauccugaaggcguucaagcuguucgacgacgacgagaccggcaagaucuccuucaagaaccucaagcgcguggccaaggagcugggcgagaaccugaccgacgaggagcuccaggagaugaucgacgaggccgaccgggacggggacggcgaggucagcgagcaggaguuccugcgcaucaugaagaagaccucccuguacuga

SEQ ID NO: 28175 - RNA, 504 nt, Artificial Sequence
  derived and/or modified sequence opt1 from CETN3__Homo_sapiens__NP_004356
augagccuggcccuccgcuccgagcugguggucgacaagaccaagcggaagaagcgccgggagcugagcgaggagcagaagcaggagaucaaggacgccuucgagcuguucgacaccgacaaggacgaggcgaucgacuaccacgagcucaagguggccaugcgcgcccugggcuucgacgugaagaaggccgacguccucaagauccugaaggacuacgaccgggaggccacggggaagaucaccuucgaggacuucaacgagguggugaccgacuggauccuggagcgcgacccccacgaggagauccucaaggcguucaagcuguucgacgacgacgacuccggcaagaucagccugcggaaccuccgccgggucgcccgcgagcugggggagaacauguccgacgaggagcugcgggccaugaucgaggaguucgacaaggacggcgacggggagaucaaccaggaggaguucaucgccaucaugaccggcgacaucuga

SEQ ID NO: 28176 - RNA, 1482 nt, Artificial Sequence
  derived and/or modified sequence opt1 from CETP__Homo_sapiens__NP_000069
augcuggccgccaccgugcucacccuggcgcugcucggcaacgcccacgccugcagcaaggggacgucccacgaggccggcaucgucugccgcaucaccaagcccgcccugcuggugcucaaccacgagaccgcgaaggugauccagaccgccuuccagcgggccagcuacccggacaucacgggggagaaggccaugaugcugcugggccaggucaaguacgggcuccacaacauccagaucucccaccugagcaucgcguccagccagguggagcugguggaggccaaguccaucgacgucagcauccagaacguguccguggucuucaagggcacccucaaguacggcuacaccaccgccugguggcuggggaucgaccagagcaucgacuucgagaucgacuccgccaucgaccugcagaucaacacgcagcugaccugcgacagcggccgcgugcggaccgacgcccccgacugcuaccuguccuuccacaagcugcuccugcaccuccagggggagcgcgagcccggcuggaucaagcagcuguucaccaacuucaucagcuucacgcucaagcuggugcucaaggggcagaucugcaaggagaucaacgucaucuccaacaucauggcggacuucgugcagacccgggccgccagcauccuguccgacggcgacaucggcguggacaucagccugaccggggaccccgucaucaccgccuccuaccucgagagccaccacaagggccacuucaucuacaagaacgugagcgaggaccugccgcugcccacguucucccccacccuccugggggacagccgcaugcuguacuucugguucuccgagcggguguuccacagccucgccaaggucgcguuccaggacggccgccugaugcugucccucaugggcgacgaguucaaggccgugcuggagaccuggggguucaacaccaaccaggagaucuuccaggagguggucggcggguuccccagccaggcccaggugacggugcacugccugaagaugccgaagaucuccugccagaacaagggcgucguggucaacagcuccgugauggugaaguuccucuucccccggcccgaccagcagcacagcgucgccuacaccuucgaggaggacaucgugaccaccgugcaggccuccuacagcaagaagaagcuguuccugucccuccuggacuuccagaucacgcccaagaccgucagcaaccugaccgaguccagcuccgagagcgugcaguccuuccuccagagcaugaucaccgcgguggggaucccggaggucaugagccgccuggaggugguguucacggcccugaugaacuccaagggcgucagccucuucgacaucaucaaccccgagaucaucacccgggacggcuuccugcugcugcagauggacuucggguuccccgagcaccuccugguggacuuccugcagucccucagcuga

SEQ ID NO: 28177 - RNA, 534 nt, Artificial Sequence
  derived and/or modified sequence opt1 from CFAP126__Homo_sapiens__NP_001013647
auggccaccaacuacagcgccaaccaguacgagaaggcguucuccagcaaguaccugcagaacuggucccccaccaagccgacgaaggagagcaucuccagccacgagggcuacacccagaucaucgccaacgaccgcgggcaccuccugcccuccgugccccggagcaaggccaaccccuggggcuccuucauggggaccuggcagaugccgcugaagaucccgcccgcccgcgucacccucacgagccggaccaccgccggcgcggccucccugaccaaguggauccagaagaaccccgaccugcucaaggccagcaacgggcugugccccgagauccugggcaagccccacgaccccgacucccagaagaagcuccgcaagaaguccaucacgaagaccgugcagcaggcccggagccccaccaucaucccgagcucccccgcggccaaccugaacagccccgacgagcugcaguccagccaccccagcgccggccacaccccggggccccagcgccccgccaaguccuga

SEQ ID NO: 28178 - RNA, 1104 nt, Artificial Sequence
  derived and/or modified sequence opt1 from CFAP36__Homo_sapiens__NP_001269690
auggccgccgaggaggaggacgagguggagugggucguggagagcaucgcgggcuuccugcgcgggcccgacugguccaucccgauccucgacuucguggagcagaagugcgaggucaacugcaagggcgggcacgugaucacccccggcagccccgagcccgugauccuggucgccugcgugccgcugguguucgacgacgaggaggaguccaagcucaccuacacggagauccaccaggaguacaaggagcuggucgagaagcugcucgagggguaccugaaggagaucggcaucaacgaggaccaguuccaggaggccugcaccagcccccuggccaagacccacaccucccaggccauccuccagcccgugcuggcggccgaggacuucacgaucuucaaggccaugauggugcagaagaacaucgagaugcagcugcaggccauccggaucauccaggagcgcaacggcguccuccccgacugccugaccgacgggagcgacgugguguccgaccuggagcacgaggagaugaagauccuccgggagguccugcgcaagagcaaggaggaguacgaccaggaggaggagcggaagcgcaagaagcagcuguccgaggcgaagaccgaggagccgaccgugcacagcuccgaggccgccaucaugaacaacagccagggcgacggggagcacuucgcccacccgcccuccgaggugaagaugcacuucgccaaccagagcaucgagccccucggccggaaggucgagcgcuccgagacgagcucccugccccagaaggaccugaagauccccgggcucgagcacgcgagcaucgagggccccaucgccaaccuguccgugcugggcaccgaggagcuccggcagcgcgagcacuaccugaagcagaagcgggacaagcugaugagcaugcgcaaggacaugcggaccaagcagauccagaacauggagcagaaggggaagcccaccggcgagguggaggagaugacggagaagccggagaugaccgccgaggagaagcagacccuccugaagcgccggcugcucgccgagaagcugaaggaggaggucaucaacaaguga

SEQ ID NO: 28179 - RNA, 2949 nt, Artificial Sequence
  derived and/or modified sequence opt1 from CFAP44__Homo_sapiens__NP_060808
augaaggagcccgacgaccaggacaccgacggcgagaaguccgugaccuccaagagcgacgggaagaagucccugcgcagcuccaagagcgagucccggagcccgguccaggaggacaacacguuccucgaggacgacaccgacgagaccuucaccaagggcgagggguccuaccuggaggaggacagcgacgaggagcgccuggagggcucccucagcuccuuccaguacggggaccugcagagcacgaccgugccccagcagacccccgcccccgccguggaggaggcggaggaggaggucaagaagaagaucuccgagagcuucuucuacgacuacauggagcuggccuccaugccguucgugacccucgacagcaacaucccccuggaccugcucacgcuggugcacuccuucggcuacgacugccggaagcgcgccaaccugcagcuccuggacgacagcaucgccaucuacaucgccggcaaccagcugaucuuccucaaccugaagaccaaggagcagaucuaccugcggagcuccagcggggagggcaucggggucaucggcgugcacccccacaagaccuacuucaccguggcggagaagggguccuuccccgacaucaucaucuacgaguacccgagccuccgccccuaccggguccugcgcgacggcacggagaagggcuacgccuacguggacuucaacuacuccgggaaccugcucgccagcgugggcuccaaccccgacuacacccugaccaucuggaacuggaaggaggagcagcccauccugcggaccaaggccuucagccaggaggucuucaaggugacguucaacccggacaaggaggagcagcucaccaccuccgggagcggccacaucaaguucugggagauggcguucaccuucacgggccugaagcugcaggggucccucggccgcuucgggaagaccaucaccaccgacaucgagggcuacauggagcugcccgacgggaaggugcugagcggcuccgaguggggcaacaugcuccugugggagggcgggcugaucaaggucgagcucugccgggggacgagcaaguccugccacaacggccccaucaaccagaucaugcuguacgagggggaggugaucaccgugggcagcgacggcuacguccgcaucugggacuucgagaccaucgacaccgccgacgugaucgacgagacggggcugcucgagaucgagcccaucaacgagcuccagguggacaagaacgucaaccuguucuccaugaucaagaugaacgagaccggcaacaacuucuggcuggcccaggacgccaacggggccaucuggaagcuggaccugagcuucuccaacaucacccaggacccggagugccucuucagcuuccacagcggcgcgaucgaggccguggccgugagcccccugaccuaccugauggccacgaccgcccucgacugcagcguccggaucuacgacuucgcguccaagacgccccuggcccagaugaaguucaagcagggcgggaccgcccuggugugggucccccgcauggugaacuucaccggcgcccagaucaucgugggguucgaggacggcgucgugcggauccucgagcuguacgacccgaaggggcugaccaucuucgccggccgcaagaagauccuggacgcggacauccagcucaagcaggucuucaagccccacaccgccugcgugaccgcccuggccuacgagcgggacggcgagauccuggccaccgggagcaaggaccagacgguguucuucuucgagguggagcgcgacuacaagcccaucggcuacaucaacacccccgggccggucugccagcucauguggucccccaugagccaccccgaguccacccugcugaucaucugcgagaacggcuacauccucgaggcgccccugccgaccaucaagcaggaggaggacgaccacgacguggugagcuacgagaucaaggacaugugcaucaagugcuuccacuucuccagcgucaaguccaagauccugcggcucaucgagaucgagaagcgcgagcggcagcgcgagcugaaggagaagauccgcgaggagcggcgcaacaagcuggccgccgagaugggggaggacggcgagaaggaguuccaggaggaggaggaggagaaggaggaggaggaggaggaggaggagccccuccccgagaucuucaucccgagcacgcccucccccauccugugcggcuucuacagcgagcccgggaaguucugggugucccugggcggguacgacagcggcuuccucuaccacugcgaguucccgcccugcgacgaguccagcgacuucaaggagcagaaggacgagcccaucgacgugcgguaccuggccgacaccgaggacaaccccauccagaccaucaccuucaacaucaacaaggucaugauguucugcgggaugaagaacggcgcgauccgcguguacgugcugaaccagaacgacccgagccucacgucccuggucgacuacuggcacuucaacaugcacgacaacaacuacggcugcaucaagagcaucgccaacuccuucgacgaccgguuccuggugaccgccggggccgacggcaacaucuucguguucaacaucuucagcgaguucaugcuccgcaaggacaugaaggccaagguccccagcccccgguucgggaucgagaccgagcccaucccggaggacaucgaggaccccaaggcguacuccaucgagaacgcccgccggaagcgcgagcacgacaagcugaugaaggaggugggcgagaucaaggcccggaagcgcgagcagaucaaggcccugcgguccgaguucugcaaccuccuggagaugaacgagaagcugcccaagcacaugcaguucaagcgcaccgugagccucaucuga

SEQ ID NO: 28180 - RNA, 1659 nt, Artificial Sequence
  derived and/or modified sequence opt1 from CFAP52__Homo_sapiens__NP_001074025
auggacaacaagaucagccccgaggcccagguggccgagcuggagcucgacgcggucaucggcuucaacgacaucauccugugggacuacaagaaccgcgagcugcucgcccggcugucccugcacaaggggaagaucgaggcccucgccuucagcccgaacgaccuguaccuggugucccucggcgggcccgacgacggcagcguggucgugugguccaucgccaagcgcgacgcgaucugcgggagccccgccgccggccugaacgugggcaacgccaccaacgucaucuucucccggugccgcgacgagauguucaugaccgcggggaacggcacgauccgggugugggagcuggaccuccccaaccgcaagaucuggccgaccgagugccagaccgggcagcugaagcggaucgugaugagcaucggcgucgacgacgacgacuccuucuucuaccuggggaccacgaccggcgacauccucaagaugaacccccgcaccaagcugcugaccgacgugggccccgccaaggacaaguucagccucgggguguccgccauccggugccugaagaugggcgggcugcucgucggcagcggcgccgggcugcugguguucugcaagucccccggcuacaagccgaucaagaagauccagcuccagggcgggaucacgagcaucacccugcgcggggagggccaccaguuccuggugggcaccgaggagucccacaucuaccgggucagcuucaccgacuucaaggagacgcucaucgcgaccugccacuucgacgccguggaggacaucguguuccccuucgggaccgccgagcuguucgcgaccugcgccaagaaggacauccgcgucuggcacacguccagcaaccgggagcugcuccgcaucaccgugcccaacaugaccugccacggcaucgacuucaugcgggacgggaaguccaucaucagcgccuggaacgacggcaagauccgcgccuucgcccccgagaccgggcggcugauguacgugaucaacaacgcccaccgcaucggcgucacggccaucgccaccaccagcgacugcaagcgggugaucuccggcgggggcgagggggaggugcgcgucuggcagaucggcugccagacccagaagcuggaggaggcgcucaaggagcacaagagcuccgugagcugcauccgggucaagcgcaacaacgaggagugcgugacggccuccaccgacgggaccugcaucaucugggaccuggugcgccugcggcgcaaccagaugauccucgccaacacccuguuccagugcgucugcuaccacccggaggaguuccagaucaucacgagcggcaccgaccggaagaucgccuacugggagguguucgacggcaccgugauccgcgagcuggaggggucccucagcggcuccaucaacgggauggacaucacccaggagggcguccacuucgugacgggcgggaacgaccaccuggugaaggucugggacuacaacgagggcgaggugacccacgugggggucggccacagcgggaacaucacccggauccgcaucucccccggcaaccaguacaucgugagcguguccgccgacggcgcgauccugcgguggaaguaccccuacaccagcuga

SEQ ID NO: 28181 - RNA, 1545 nt, Artificial Sequence
  derived and/or modified sequence opt1 from CFAP53__Homo_sapiens__NP_659457
auguacagccagcgcuucggcaccgugcagcgggaggucaaggggcccacccccaagguggugaucguccgcuccaagccgcccaagggccagggggccgagcaccaccuggagcggauccgccggagccaccagaagcacaacgccauccucgcguccaucaagagcuccgagcgcgaccggcugaaggccgagugggaccagcacaacgacugcaagauccuggacagccucgugcgcgcccggaucaaggacgccgugcagggcuucaucaucaacaucgaggagcgccggaacaagcugcgcgagcugcucgcccuggaggagaacgaguacuucacggagaugcagcugaagaaggagaccaucgaggagaagaaggaccggaugcgcgagaagaccaagcuccugaaggagaagaacgagaaggagcggcaggacuucgucgcggagaagcuggaccagcaguuccgcgagcggugcgaggagcuccgcguggagcugcuguccauccaccagaagaaggugugcgaggagcggaaggcccagaucgccuucaacgaggagcucagccgccagaagcuggucgaggagcagauguucuccaagcugugggaggaggaccggcucgccaaggagaagcgcgaggcgcaggaggcccgccggcagaaggagcugauggagaacacccgccuggggcucaacgcccagaucacgagcaucaaggcccagcggcaggccacccagcugcugaaggaggaggaggcgcgccucguggaguccaacaacgcccagaucaagcacgagaacgagcaggacaugcugaagaagcagaaggccaagcaggagacccggaccauccugcagaaggcccuccaggagcgcaucgagcacauccagcaggaguaccgggacgagcaggaccugaacaugaagcuggugcagcgcgcccuccaggaccugcaggaggaggcggacaagaagaagcagaagcgggaggacaugauccgcgagcagaagaucuaccacaaguaccuggcccagcggcgcgaggaggagaaggcccaggagaaggaguucgaccggauccucgaggaggacaaggccaagaagcuggccgagaaggacaaggagcugcgccucgagaaggaggcgcggcgccagcuggucgacgaggugaugugcacgcggaagcuccaggugcaggagaagcugcagcgcgaggccaaggagcaggaggagcgggccauggagcagaagcacaucaacgagagccugaaggagcugaacugcgaggagaaggagaacuucgcccgccgccagcggcucgcccaggaguaccgcaagcagcugcagaugcagaucgcguaccagcagcagucccaggaggccgagaaggaggagaagcggcgcgaguucgaggccggcgucgccgcgaacaagaugugccuggacaaggugcaggaggugcucagcacccaccagguccugccccagaacauccaccccaugcggaaggccugccccuccaagcugccgcccuga

SEQ ID NO: 28182 - RNA, 3366 nt, Artificial Sequence
  derived and/or modified sequence opt1 from CFAP57__Homo_sapiens__XP_011539101
augagcgccguggucgcccagacccugcacguguucggccuccgcucccacguggcgaacaacaucuucuacuucgacgagcagaucaucaucuuccccagcgggaaccacugcgucaaguacaacguggaccagaaguggcagaaguucaucccgggcuccgagaagucccaggggaugcuggcccugagcaucagccccaaccggcgcuaccucgccaucuccgagaccgugcaggagaagcccgccaucacgaucuacgagcugagcuccauccccugccggaagcgcaagguccugaacaacuucgacuuccaggugcagaaguucaucagcauggccuucuccccggacagcaaguaccuccuggcgcagaccuccccgcccgagagcaaccugguguacuggcucugggagaagcagaaggucauggccaucgugcggaucgacacccagaacaaccccguguaccaggucuccuucagcccccaggacaacacccaggugugcgugacgggcaacgggauguucaagcugcugcgcuucgccgagggcacccucaagcagaccuccuuccagcggggcgagccccagaacuaccuggcccacaccugggucgcggacgacaagaucgugguggggacggacaccggcaagcuguuccucuucgagagcggggaccagcgcugggagaccuccaucauggucaaggagcccaccaacggcagcaagagccuggacgugauccaggaguccgagagccugaucgaguucccgcccguguccagcccccuccccuccuacgagcagauggucgccgccagcucccacagccagauguccaugccccagguguucgccaucgccgcguacagcaagggguucgccugcuccgccggcccgggccgggugcugcuguucgagaagauggaggagaaggacuucuaccgcgagagccgggagauccgcauccccgucgacccccaguccaacgaccccagccaguccgacaagcaggacgugcucugccugugcuucagcccguccgaggagacgcuggucgccagcaccuccaagaaccagcucuacagcaucaccaugagccugaccgagaucuccaagggggagcccgcccacuucgaguaccugauguacccccuccacagcgcgcccaucacgggccuggcgaccugcauccggaagccgcugaucgcgaccugcucccucgaccgcagcauccggcuguggaacuacgagaccaacacgcuggagcuguucaaggaguaccaggaggaggccuacuccaucagccugcaccccuccgggcacuucaucguggugggcuucgccgacaagcugcgccucaugaaccugcugaucgacgacauccggagcuucaaggaguacuccguccgcggcugcggggagugcagcuucuccaacggcgggcaccucuucgccgccgugaacggcaacgugauccacgucuacaccaccaccagccuggagaacaucuccagccugaaggggcacacgggcaagaugcuccugaccuucgacgaccaguuccugcucaccgccgccgaggacggcugccuguucaccuggaagguguucgacaaggacgggcggggcaucaagcgcgagcgggaggugggguucgccgaggagguccuggugacgaagaccgacauggaggagaaggcccaggugaugcucgagcugaagacccgcgucgaggagcugaagauggagaacgaguaccagcugcgccucaaggacaugaacuacuccgagaagaucaaggagcugaccgacaaguucauccaggagauggagagccugaagacgaagaaccaggugcuccggaccgagaaggagaagcaggacguguaccaccacgagcacaucgaggaccugcuggacaagcagucccgcgagcuccaggacauggagugcugcaacaaccagaagcugcugcucgaguacgagaaguaccaggagcugcagcucaagagccagcggaugcaggaggaguacgagaagcagcuccgcgacaacgacgagaccaagagccaggcccuggaggagcugaccgaguucuacgaggccaagcuccaggagaagacgacccugcuggaggaggcccaggaggacguccggcagcagcuccgcgaguucgaggagaccaagaagcagaucgaggaggacgaggaccgggagauccaggacaucaagaccaaguacgagaagaagcugcgcgacgagaaggaguccaaccugcggcucaagggcgagaccgggaucaugcgcaagaaguucagcucccugcagaaggagaucgaggagcggacgaacgacaucgagacccugaagggcgagcagaugaagcuccagggcgugaucaagagccuggagaaggacauccaggggcugaagcgcgagauccaggagcgggacgagaccauccaggacaaggagaagcgcaucuacgaccucaagaagaagaaccaggagcugggcaaguucaaguucgugcuggacuacaagaucaaggagcucaagaagcagaucgagccccgggagaacgagauccgcgucaugaaggagcagauccaggagauggaggcggagcuggagaacuuccacaagcagaacacccagcuggagcucaacaucacggagcuguggcagaagcugcgggccaccgaccaggagaugcgccgggagcgccagaaggagcgcgaccucgaggcccuggugaagcgguucaagaccgaccugcacaacugcguggccuacauccaggagccccgccuccugaaggagaagguccgggggcuguucgagaaguacgugcagcgcgccgacaugguggagaucgcgggccucaacaccgaccugcagcaggaguacacgcggcagcgcgagcaccuggagcggaaccucgccacccugaagaagaaggucgugaaggagggggagcugcaccgcaccgacuacgugcggaucaugcaggagaacgucucccucaucaaggagaucaacgagcugcgccgggagcugaaguucacccgcagccagguguacgaccucgaggccgcccugaagcugacgaagaaggugcggccgcaggaggucuccgagaccgagcccagccgcgacaugcucuccaccgcccccaccgcgcggcugaacgagcaggaggagacgggccgcaucaucgagaugcagcggcuggagauccagcgccuccgggaccagauccaggagcaggagcaggucaccggcuuccacacccuggccggggugcgccugccgagccucuccaacagcgagguggaccuggaggugaagaccaacuga

SEQ ID NO: 28183 - RNA, 2619 nt, Artificial Sequence
  derived and/or modified sequence opt1 from CFAP58__Homo_sapiens__NP_001008723
auggccgaggagaagggcgggaagcagguccuggaggagagcgccuucgaggagauggagcgcgacuuccagggcgugcuccacgagcuguccggggacaagagccuggagaaguuccggaucgaguacgagcgccuccacgcggugaugaagaaguccuacgacaacgagaagcggcugauggccaagugccgcgagcugaacgccgagaucguggucaacagcgccaagguggccaccgcgcucaagcugucccaggacgaccagaccacgaucgccagccugaagaaggagaucgagaaggccuggaagaugguggacuccgccuacgacaaggagcagaaggcgaaggagaccauccucgcccugaaggaggagaucgucaaccugaccaagcucguggagcagggcagcgggcuguccauggaccagcacagcaacauccgggaccugcuccgcuucaaggaggaggugaccaaggagcgggaccagcugcuguccgaggucgugaagcuccgcgagagccuggcccagacgaccgagcagcagcaggagaccgagcgguccaaggaggaggccgagcacgccaucagccaguuccagcaggagauccagcagcgccagaacgaggcgucccgggaguuccgcaagaaggagaagcuggagaaggagcucaagcagauccaggccgacauggacagccggcagaccgagaucaaggcccugcagcaguacgugcagaaguccaaggaggagcugcagaagcucgagcagcagcugaaggagcagaagauccugaacgagcgcgccgccaaggagcucgagcaguuccagaugcggaacgcgaagcugcagcaggagaacgagcagcacagccuggucugcgagcagcucucccaggagaaccagcagaaggcccuggagcugaaggccaaggaggaggaggugcaccagaugcgccucgacaucggcaagcugaacaagauccgggagcagauccacaagaagcugcaccacacggaggaccagaaggccgagguggagcagcacaaggagacccucaagaaccagaucgucggccuggagcgcgagguggaggccagcaagaagcaggcggagcuggaccggaaggccauggacgagcuccugcgcgagcgggacauccugaacaagaacaugcucaaggccgugaacgccacccagaagcagaccgaccuggucaagcugcacgagcaggccaagcgcaaccucgagggggagauccagaacuacaaggacgaggcgcagaagcagcgcaagaucaucuuccaccuggagaaggagcgggaccgcuacaucaaccaggccagcgaccugacgcagaaggugcucaugaacauggaggacaucaaggugcgggagacccagaucuucgacuaccgcaagaagaucgccgaguccgagaucaagcugaagcagcagcagaaccuguacgaggccguccggagcgaccgcaaccuguacuccaagaaccucguggaggcgcaggacgagaucaccgacaugaagcggaagcugaagaucaugauccaccagguggacgagcugaaggaggacaucagcgccaaggaguccgcccucgucaagcugcaccuggagcagcagcgcaucgagaaggagaaggagacccucaaggccgagcugcagaagcugcggcagcaggcccucgagacgaagcacuucaucgagaagcaggaggcggaggagcgcaagcugcugcggaucaucgccgaggccgacggcgagcgccuccggcagaagaaggagcuggaccaggugaucagcgagcgcgacauccuggggucccagcucguccggcgcaacgacgagcuggcccugcucuacgagaagaucaagauccagcagagcgugcugaacaagggcgagucccaguacaaccagcggcuggaggacaugcgcauccuccggcuggagaucaagaagcugcgccgcgagaaggggauccucgcccggagcauggcgaacguggaggagcugcgccaggaguucuuccacaugcagcgggagcugcucaaggagcgcacccggugccgcgcccuggaggaggagcuggagaacccccucaacguccaccgguggcgcaagcuggaggccuccgacccgaacgccuacgagcugauccagaagauccacacccuccagaagcggcugaucagcaagaccgaggaggugguggagaaggagcugcuccugcaggagaaggagaagcuguacauggagcucaagcacguccuggcccgccagcccggccccgaggcggccgagcagcugaagcucuaccggcgcacgcugcacgacaagaagcagcagcugaaggugcucuccagcgagcugaacauguacgaggugcaguccaaggaguacaaguacgaggucgagaagcugaccaacgagcuccagaaccugaagaagaaguaccuggcccagaagcggaaggagcagcuccagaagaacaaggacaccgcccccauggacaacaccuuccugauggugaagccgaacggccccggguucacgggcgggggcuucccccugcgcagcaccaagaugaccuucuga

SEQ ID NO: 28184 - RNA, 3714 nt, Artificial Sequence
  derived and/or modified sequence opt1 from CFAP61__Homo_sapiens__NP_056400
augagcgugcugaccuccccgcgcggcaaggucgagguggugcacugccggcgcaccgagagccaggacgucuacugcaucaagucccucauccggaaguucacgugcaagcuguucgggaagcugaacaucaucuaccuccuggagaaggccaaccuggccgugacccucugcaacgacaaggaggagaucauggcgcaggccaccuuccuggacuacccgaacuggaacguggccaagcaggacgacugggucagcguguuccgcgagcuggacuccgacauccccugcacgccccucaacacccuguucaugcaccuguucguggccgucgacgaguacagcgugggcugcugcaaggagauccuccggaccguguacaaggccguccccgagcugcacuucaucuuccugaucgugccguccuacaugagccucggguccacccugaucaccguguucgaccaggucggcaacauccccugccugacguacgaggaggacuucgcggugcacaucugccaccgccacagccacuacccccagcuccacgugcggaaggcccgcgucgaggaccacgacgaccugaugcccaucuucaugcgguacgacaccauccugaaggagaccuacggggaguacuuccucgccgagcugaucgaggcccaggacgaggagaaccacgcgguggugugcgaggucgagggcaccgccgugggcuucauguccgugugcagccgcgucaacaugcagcugcuccacgagugcuucgaccuggggccguuccacggccugugcuucccccaccccgacgacgugcucgagagcccccaggaccuguccguccggcgcucccaggacgccgagcugcggagcuccagccaggggucccagaagaucguggaggagcuccaggagccggugagccccgacacgauggagaacauccagggcaacaucgcccgcgaggccgcgagcgaggaggcccugaccgccguccaguccgggaacgugagcgagcccgaggacaucgagaagcuguccgacaucagcaccggcuacgcccaguaccaccacguguccagccggucccucgccagccugguccugcccgaggagccggugcacuuccgccccaucuaccggggcgcguccgccgccuucugcauccagcuguucugcaucgacgagaaguacgaggcccgcagccuggacuucaugaacuucguguucucccuguucagcgacaagaacuucugcgucaucucccucccccaccugacccccgaguucuuccugauccagaacuucgugaagauggugccguucaacacgugcacccucgagcaggaccuguacgucuuccaccgggccgggcugcucaagagcaucaacauccgcuucgcgacccugcuggacacccccggcguggagaaccucguguccacgcugaugcugaacaagagcauccuggaggaccucgaccgguacaacaaggcccgcaaggaccccgacgggacccugcugcaggccuucgucgccgagguggccgagcagaucgugggcaucgcggucauccgcaacgagauggacaucgaguacauccggucccacuacaacaucgaggacuucaucuacuucagccaccaccagcgcgaggagcacggccacaugcaccacuucgcccucaaccccaucuuccggcacuacaccaaguucuuccugaaggagauccugcgccucggguucaaguccugccuguacuaccggguguaccccaagagccgcgagggcaaguuccagaaccccuacgcccacagccugaccuccgcccuccacuaccuggugcccguccggccccgccggcagaucguguacccgcuggagaagcucgggaucaacgcgcccagcaaggccguguccaaggaccccaugagcuacgcccugaaccacacgaaccgcaagcugacccucgagccgaagaucaccgucaacgccaagaucaucguggugggcgccuccagcgucgggaucuccuuccuggagacccugguguucugcagccacaugaaguucaacaaccucacgcugaucuccacccacggccugcccggcaagaagcuccuggacaccgagcagcggaaguuccuggcgagcgaccacugcuucaacgacaaggacuacgcccucaugucccugugcagcugggugaacgucgugguggggcgcaugaccggcaucgaccgggccgccaagcacgucgugcuguccacggacgagaucgugcccuacgaccaccucauccugugcaccgggcagcaguaccagguccccugcccgaccgaggccgacaucagccagcaccugaccaaccgcgaggugcccaacuccagccagcggcgcuacacgggcaaggugcccugcaaccacuucacccucaacgaggaggaggacugcuucaaggcgcugaucuggauccggaacaacuccaucaccaccgaggggaacaucaucgucuacggcaacaccaucgacacguacaccaccguggagacccugcucaaccugggcgugagcgggagccgcauccaccugguccagcccccgcccgccuccacgaucacgugcaucaacaacuacagcguggaguccgccguggccgacgcccucggcgcggccggggucaccauguaccgggacgccauccuggcccaguggaacgacggccugcaccccgaccccaucuacagcgcguccuucaccaccccgaccaagcccuuccgccuccagugcagcauguucuucuccuucugcgagaagaacguggacuacgagaccuucaaggcccugaacgacgccugccugguguacgacagccgccucgucaucgacaccaacuuccacacgaacgacaucgccauccgggccgcggggucccugaccaaguucagcaaccgcuacuacuccaacgaguggacccacagcaacuucuccagcaaggagaucggcuuccagcuggccgccgccaugcuccaccuguucgaccccacccuggagcccgugacggagccgcccgccaaccucgaccggcugauccccauguacaagggcgcgaagauccagggcgggauccugcccggguccuaccacuaccuccacaucgccaagccggccauccccacgccccuggaggugcagauggcccagcccaacuacggccuggagcucgucaccggcagcgccaagaacgggaccuacuuccgcauccacaucaacaaguacaagaugguggagaccaucacgugccugucccgggagccguuccccgcgagcaacuacauccgccuguucggccagcacgagcagcuccugaacaaccugugcgcccgguacgacgagaaccucaucaccgaccuguacuccuacuucaccgagcccuggugccuggcccucuuccacgaccgcuucaucgaccugcggaaggagcugcgccagauccucgccagcaaggaggaggaggaccugccgagcaucgagcagcuggcgcaccagaucgaggacgaggagaucaaccccaccgagaagccccggcaguaccucaagcgcgucuucgaggaguccaucuacaagacccugguggagcggagcacccuggacuaccuccacuacaaccgcuaccaccuccccauguacgccuggccggggaucguguga

SEQ ID NO: 28185 - RNA, 2826 nt, Artificial Sequence
  derived and/or modified sequence opt1 from CFAP69__Homo_sapiens__NP_001034795
auguggaccgaggaggccggcgccaccgcggaggcccaggagagcgggauccgcaacaaguccagcuccagcucccagauccccguggucggcguggugacggaggacgacgaggcccaggacgucuucaagccgauggaccugaaccgggugaucaagcuccuggaggagaccgacaaggacgggcuggaggagaagcagcucaaguucgugaagaagcugguccagugcuaccagaacggccugccccuccgcgaccuggcccagaucuucaagauccugaaccucugcagcgggaagaucaagaaccagccccgguucaucgaguccgccuacgacaucaucaagcugugcggccugcccuuccucaagaagaaggugagcgacgagaucaccuacgcggaggacaccgccaacuccaucgcccugcugggcgaccucaugaagaucccgagcuccgagcugcgcauccagaucugcaagugcaucguggacuucuaccacgccgagccgcccaagaagcacauccccggguaccagcaggcgagcuccagcuacaagauccagauggccgaggucggcgggcuggccaagacgauggugcaguccaugacccuccuggagaaccagcugguggagaagcucuggguccugaaggugcugcagcaccucagcaccuccgaggugaacugcaccaucaugaugaaggcccaggccgcgagcggcaucugcacgcaccugaacgacccggaccccuccgggcagcuccuguuccggagcagcgagauccuguggaaccugcucgagaaguccagcaaggaggaggucauccagcagcuguccaaccuggagugccuccuggcccugaaggagguguucaagaaccucuucaugcgcggcuucagccacuacgaccggcagcugcgcaacgacauccuggugaucaccaccaucaucgcccagaaccccgaggcccccaugaucgagugcggcuucaccaaggaccucauccuguucgccacguucaacgaggucaagucccagaaccugcucgugaaggggcugaagcugagcaacuccuacgaggacuucgagcucaagaagcugcuguucaacgugaucgucauccucugcaaggaccugccgaccgugcagcugcugaucgacggcaaggugauccucgcgcuguucaccuacgucaagaagcccgagaagcagaagaucaucgacuggagcgccgcccagcacgaggagcugcagcuccacgccaucgccacccuguccagcguggcgccccugcucaucgaggaguacauguccugccaggggaacgcccggguccuggccuuccuggaguggugcgagagcgaggaccccuucuucucccacggcaacagcuuccacggcaccgggggccgcgggaacaaguucgcccagaugcgguacucccuccgccugcugcgggccgugguguaccucgaggacgagacggucaacaaggaccugugcgagaagggcaccauccagcagaugaucgggaucuucaagaacaucaucagcaagccgaacgagaaggaggaggcgaucgugcuggagauccaguccgacauccuccugauccugagcggccucugcgagaaccacauccagcgcaaggagaucuucggcaccgaggggguggacaucguccugcacgugaugaagacggacccccggaagcugcaguccggccucggguacaacgugcugcuguucagcacccucgacagcaucuggugcugcauccugggcugcuaccccuccgaggacuacuuccuggagaaggaggggaucuuccuccugcuggaccuccuggcccugaaccagaagaaguucugcaaccucauccugggcaucauggucgaguucugcgacaaccccaagaccgccgcccacgugaacgcguggcagggcaagaaggaccagaccgccgccagccugcucaucaagcuguggcgcaaggaggagaaggagcugggggugaagcgggacaagaacggcaagaucaucgacacgaagaagccccucuucaccuccuuccaggaggagcagaagaucaucccccugcccgccaacugccccagcaucgccgucauggacguguccgagaacauccgcgcgaagaucuacgccauccuggggaagcucgacuucgagaaccugccgggccugagcgccgaggacuucgugacccucugcaucauccaccgguaccuggacuucaagaucggggagaucuggaacgagaucuacgaggagaucaagcuggagaagcuccgccccgucaccacggacaagaaggcccuggaggccaucaccaccgcguccgagaacaucggcaagaugguggccagccugcaguccgacaucaucgagagccaggccugccaggacaugcagaacgagcagaagguguacgccaagauccaggccacccacaagcagcgggagcucgcgaacaaguccugggaggacuuccuggcccgcacgagcaacgccaagacccugaagaaggccaagucccuccaggagaaggcgaucgaggccagccgcuaccacaagcggccccagaacgccaucuuccaccagacccacaucaagggccugaacaccacgguccccuccgggggcguggugaccgucgagagcaccccggcccgccuggucgggggcccccucguggacaccgacaucgcccugaagaagcugcccauccggggcggggcgcuccagcgcgugaaggccgugaagaucguggacgccccgaagaaguccauccccaccuga

SEQ ID NO: 28186 - RNA, 1362 nt, Artificial Sequence
  derived and/or modified sequence opt1 from CFAP97__Homo_sapiens__NP_001278962
auggaccaguucggcgacauccuggagggggagguggaccacagcuucuucgacuccgacuucgaggagggcaagaagugcgagaccaacagcgucuucgacaagcagaacgacgaccccaaggagcgcaucgacaaggacaccaagaacgugaacuccaacacggggaugcagaccaccgagaacuaccucaccgagaagggcaacgagcggaacgugaaguucccgcccgagcaccccgucgagaacgacgugacgcagaccgugagcuccuucagccugcccgccuccagccgcuccaagaagcugugcgacgucaccaccgggcucaagauccacgugagcauccccaaccggauccccaagaucgugaaggagggcgaggacgacuacuacacggacggcgaggaguccagcgacgacgggaagaaguaccacgucaaguccaagagcgccaagcccuccaccaacgugaagaaguccauccgcaagaaguacugcaaggugagcagcuccagcagcuccagccuguccagcuccagcuccggcagcgggaccgacugccuggacgcgggcuccgacagccaccucuccgacagcucccccagcuccaagagcuccaagaagcacgucagcgggaucacccugcuguccccgaagcacaaguacaagagcggcaucaagagcacggagacccagcccuccagcaccacccccaagugcggccacuaccccgaggaguccgaggacacggugaccgacgugagcccgcucuccacccccgacaucagcccccugcaguccuucgagcuggggaucgccaacgaccagaaggucaagaucaagaagcaggagaacgugagccaggagaucuacgaggacguggaggaccucaagaacaacuccaaguaccugaaggccgccaagaagggcaaggagaagcacgagcccgacgucagcuccaagagcuccagcgugcuggacuccagccucgaccaccggcacaagcagaaggugcugcacgacaccauggaccugaaccaccuccugaaggccuuccugcagcucgacaagaaggggccgcagaagcaccacuucgaccagcccuccgucgcgcccggcaagaacuacagcuucacgcgcgaggaggugcggcagaucgaccgcgagaaccagcggcugcugaaggagcucagccgccaggccgagaagcccggcuccaagagcaccaucccgcgguccgccgaccacccgcccaagcuguaccacagcgcccugaaccgccagaaggagcagcagcggaucgagcgcgagaaccucaccaucucccugugccaccccggguggagcgcggugaccuga

SEQ ID NO: 28187 - RNA, 2295 nt, Artificial Sequence
  derived and/or modified sequence opt1 from CFB__Homo_sapiens__NP_001701
augggcagcaaccugagcccccagcucugccugaugccguucauccuggggcuccuguccggcggggugaccaccacccccuggucccuggcccgcccccagggcagcugcucccucgaggggguggagaucaagggcggcagcuuccggcugcugcaggaggggcaggcccucgaguacgugugccccuccggcuucuacccguaccccgugcagacccggaccugccgcagcaccggguccuggagcacccugaagacccaggaccagaagaccguccgcaaggcggagugccgggccauccacugcccccgcccccacgacuucgagaacggcgaguacuggccgcggucccccuacuacaacgugagcgacgagaucuccuuccacugcuacgacggguacacccugcgcggcagcgccaaccggacgugccaggugaacggccgcugguccgggcagaccgccaucugcgacaacggcgccggguacugcagcaaccccggcauccccaucggcacccggaaggucgggucccaguaccgccucgaggacagcgugaccuaccacugcucccggggccugacgcugcgcgggagccagcggcggaccugccaggagggcgggagcugguccggcaccgagccgagcugccaggacuccuucauguacgacacgccccaggagguggcggaggccuuccucagcucccugaccgagaccaucgagggcgucgacgccgaggacgggcacggccccggggagcagcagaagcgcaagaucgugcuggaccccagcggcuccaugaacaucuaccucgugcuggacgggagcgacuccaucggcgccagcaacuucaccggcgcgaagaagugccuggucaaccucaucgagaagguggccuccuacggggugaagccgcgcuacggccuggucaccuacgccacguaccccaagaucugggugaaggugagcgaggccgacuccagcaacgccgacugggucaccaagcagcugaacgagaucaacuacgaggaccacaagcucaaguccgggaccaacaccaagaaggcgcugcaggccguguacagcaugauguccuggcccgacgacgugcccccggagggcuggaaccggacgcgccacgucaucauccugaugaccgacgggcuccacaacaugggcggcgaccccaucaccgugaucgacgagauccgggaccugcuguacaucgggaaggaccgcaagaacccccgcgaggacuaccucgacguguacgucuucggcguggggccccuggucaaccaggugaacaucaacgcccuggccagcaagaaggacaacgagcagcacguguucaaggucaaggacauggagaaccucgaggacguguucuaccagaugaucgacgagucccagagccugagccugugcggcauggugugggagcaccggaagggcaccgacuaccacaagcagccguggcaggccaagaucuccgucauccgccccagcaaggggcacgaguccugcaugggcgcgguggugagcgaguacuucguccucacggccgcccacugcuucaccguggacgacaaggagcacuccaucaaggugagcgucgggggcgagaagcgggaccuggagaucgagguggugcuguuccaccccaacuacaacaucaacgggaagaaggaggccggcauccccgaguucuacgacuacgacgucgcccucaucaagcugaagaacaagcugaaguacggccagaccauccgcccgaucugccuccccugcaccgaggggacgacccgggcgcugcgccugcccccgaccaccacgugccagcagcagaaggaggagcuccugcccgcccaggacaucaaggcccuguucguguccgaggaggagaagaagcucacccggaaggagguguacaucaagaacggcgacaagaaggggagcugcgagcgcgacgcccaguacgcccccggcuacgacaaggucaaggacaucuccgagguggugacgccccgguuccugugcaccgggggcgucagcccguacgcggaccccaacacgugccgcggcgacuccgggggcccccugaucgugcacaagcggagccgcuucauccaggugggggucaucuccuggggcgugguggacgucugcaagaaccagaagcggcagaagcagguccccgcccacgcccgcgacuuccacaucaaccuguuccaggugcucccguggcugaaggagaagcugcaggacgaggaccucggguuccuguga

SEQ ID NO: 28188 - RNA, 672 nt, Artificial Sequence
  derived and/or modified sequence opt1 from CFC1B__Homo_sapiens__NP_001072998
augaccuggcgccaccacgugcggcuccuguucaccgucagccuggcccugcagaucaucaaccucggcaacuccuaccagcgcgagaagcacaacgggggccgggaggaggugacgaagguggccacccagaagcaccgccagagcccccugaacuggaccuccagccacuucggggaggucaccggcuccgcggagggguggggcccggaggagccccugcccuacagcugggccuucggcgagggggccuccgcccggccccgcugcugccggaacggcgggacgugcgugcucggcagcuucugcgugugcccggcccacuucaccgggcgcuacugcgagcacgaccagcggcgcuccgagugcggcgcgcuggagcacggcgccuggacccugcgggccugccaccucugccgcugcaucuucggggcccugcacugccugccccuccagacccccgaccggugcgaccccaaggacuuccuggcgagccacgcccacggcccguccgccgggggcgcccccagccugcuccugcugcuccccugcgcccugcugcaccgccuccugcggcccgacgcgccggcccacccccgcucccugguccccagcgugcuccagcgggagcgccggcccugcggccgcccggggcugggccaccggcuguga

SEQ ID NO: 28189 - RNA, 672 nt, Artificial Sequence
  derived and/or modified sequence opt1 from CFC1__Homo_sapiens__NP_115934
augaccuggcgccaccacgugcggcuccuguucaccgucagccuggcccugcagaucaucaaccucggcaacuccuaccagcgcgagaagcacaacgggggccgggaggaggugacgaagguggccacccagaagcaccgccagagcccccugaacuggaccuccagccacuucggggaggucaccggcuccgcggagggguggggcccggaggagccccugcccuacagccgggccuucggcgagggggccuccgcccgcccccggugcugccgcaacggcgggacgugcgugcucggcagcuucugcgugugcccggcccacuucaccgggcgguacugcgagcacgaccagcgccgguccgagugcggcgcgcuggagcacggcgccuggacccugcgcgccugccaccucugccggugcaucuucggggcccugcacugccugccccuccagacccccgaccgcugcgaccccaaggacuuccuggcgagccacgcccacggcccguccgccgggggcgcccccagccugcuccugcugcuccccugcgcccugcugcaccggcuccugcgccccgacgcgccggcccacccccggucccugguccccagcgugcuccagcgcgagcggcgccccugcggccggccggggcugggccaccgccuguga

SEQ ID NO: 28190 - RNA, 762 nt, Artificial Sequence
  derived and/or modified sequence opt1 from CFD__Homo_sapiens__NP_001919
augcacagcugggagcgccuggccgugcucguccugcugggcgccgcggccugcgccgcgcccccgcgggggcgcauccucggcgggcgggaggccgaggcccacgcccgccccuacauggccuccgugcagcugaacggcgcccaccugugcgggggcgugcucgucgcggagcagugggugcugagcgccgcccacugccuggaggacgccgccgacggcaaggugcagguccuccugggggcgcacucccugagccagcccgagcccuccaagcggcucuacgacgugcugcgcgccgugccgcaccccgacagccagcccgacaccaucgaccacgaccugcuccugcugcagcucuccgagaaggccacccugggccccgccguccggccgcugcccuggcagcgcguggaccgggacguggcccccgggacgcucugcgacgucgcgggcugggggaucgugaaccacgccggccgccggcccgacagccugcagcacgugcugcucccgguccuggaccgcgcgaccugcaaccggcgcacccaccacgacggcgccaucaccgagcggcugaugugcgccgaguccaaccgccgggacagcugcaagggggacuccggcgggccccucgugugcggcggcgugcuggagggggucgugacgagcggcucccgcgugugcgggaaccggaagaagcccggcaucuacacccgcgucgccagcuacgccgccuggaucgacuccgugcuggccuga

SEQ ID NO: 28191 - RNA, 900 nt, Artificial Sequence
  derived and/or modified sequence opt1 from CFDP1__Homo_sapiens__NP_006315
auggaggaguucgacagcgaggacuucuccaccagcgaggaggacgaggacuacgugcccuccggcggggaguacagcgaggacgacgucaacgagcuggugaaggaggacgagguggacggcgaggagcagacccagaagacgcaggggaagaagcgcaaggcccaguccaucccggcccggaagcgccggcagggcgggcucagccuggaggaggaggaggaggaggacgcgaacuccgagagcgagggcuccagcuccgaggaggaggacgacgccgccgagcaggagaagggcaucgggagcgaggacgcccgcaagaagaaggaggacgagcugugggccuccuuccucaacgacgucggccccaagagcaaggugccgcccuccacccaggugaagaagggggaggagaccgaggagaccagcuccagcaagcugcuggucaaggcggaggagcucgagaagcccaaggagacggagaaggugaagaucaccaagguguucgacuucgccggcgaggagguccgggugaccaaggagguggacgccaccuccaaggaggccaagagcuucuucaagcagaacgagaaggagaagccccaggcgaacguccccagcgcccugcccucccugccggccgggagcggccucaagcgcuccagcggcauguccagccugcuggggaagaucggcgccaagaagcagaagauguccacgcucgagaaguccaagcuggacugggagagcuucaaggaggaggaggggaucggcgaggagcuggccauccacaaccggggcaaggagggguacaucgagcgcaaggcguuccucgaccggguggaccaccgccaguucgagaucgagcgggaccugcgccugagcaagaugaagcccuga

SEQ ID NO: 28192 - RNA, 3696 nt, Artificial Sequence
  derived and/or modified sequence opt1 from CFH__Homo_sapiens__NP_000177
augcgccugcucgccaagaucaucugccugaugcugugggccaucugcguggcggaggacugcaacgagcuccccccgcggcgcaacaccgagauccugaccggcagcugguccgaccagacguaccccgaggggacccaggccaucuacaagugccggcccggcuaccgcagccuggggaacgucaucauggugugccggaagggcgaguggguggcccucaacccccugcgcaagugccagaagcggccgugcgggcaccccggcgacacccccuucggcaccuucacgcugaccgggggcaacgucuucgaguacggggugaaggccguguacaccugcaacgagggcuaccagcuccugggggagaucaacuaccgcgagugcgacaccgacggcuggacgaacgacauccccaucugcgaggucgugaagugccugccggugaccgcccccgagaacggcaagaucgucuccagcgcgauggagcccgaccgggaguaccacuucgggcaggccgugcgcuucgugugcaacuccggcuacaagaucgagggggacgaggagaugcacugcagcgacgacggcuucugguccaaggagaagcccaagugcgucgagaucagcugcaaguccccggacgugaucaacggcagccccaucucccagaagaucaucuacaaggagaacgagcgguuccaguacaagugcaacaugggguacgaguacagcgagcgcggcgacgccgugugcaccgaguccggguggcggccccuccccagcugcgaggagaaguccugcgacaacccguacauccccaacggcgacuacagcccccugcgcaucaagcaccggaccggggacgagaucacguaccagugccgcaacggcuucuaccccgccacccggggcaacaccgcgaagugcaccuccacgggguggaucccggccccccgcugcacccugaagcccugcgacuaccccgacaucaagcacggcgggcucuaccacgagaacaugcggcgcccguacuuccccgucgccgugggcaaguacuacagcuacuacugcgacgagcacuucgagacccccuccgggagcuacugggaccacauccacugcacccaggacggcuggagccccgccgugccgugccugcggaagugcuacuuccccuaccuggagaacggcuacaaccagaaccacgggcgcaaguucguccagggcaaguccaucgacguggccugccaccccggguacgcgcucccgaaggcccagacgaccgugaccugcauggagaacggcuggagccccaccccccgcugcauccgggucaagacgugcuccaagagcuccaucgacaucgagaacggguucaucagcgagucccaguacaccuacgcccugaaggagaaggccaaguaccagugcaagcugggcuacgugaccgccgacggcgagaccagcggguccaucacgugcggcaaggacggguggagcgcgcagcccaccugcaucaaguccugcgacaucccgguguucaugaacgcccgcaccaagaacgacuucaccugguucaagcucaacgacacgcuggacuacgagugccacgacggcuacgagagcaacaccggcuccaccaccgggagcaucgucugcggcuacaacgggugguccgaccugcccaucugcuacgagcgggagugcgagcuccccaagaucgacgugcaccugguccccgaccgcaagaaggaccaguacaaggugggcgaggugcugaaguucagcugcaagccgggguucacgaucgucggccccaacuccgugcagugcuaccacuucggccucagccccgaccugcccaucugcaaggagcaggugcaguccugcgggccgccccccgagcugcucaacggcaacgucaaggagaagaccaaggaggaguacgggcacagcgaggugguggaguacuacugcaacccccgguuccugaugaagggcccgaacaagauccagugcgucgacggggaguggaccacccugcccgugugcaucguggaggagagcaccugcggcgacauccccgagcucgagcacggcugggcccagcuguccagccccccguacuacuacggggacuccgucgaguucaacugcagcgaguccuucacgaugaucggccaccgcagcaucaccugcauccacgggguguggacccagcugccccagugcguggccaucgacaagcucaagaagugcaaguccagcaaccugaucauccuggaggagcaccucaagaacaagaaggaguucgaccacaacuccaacauccgguaccgcugccggggcaaggagggguggauccacaccgucugcaucaacggccgcugggaccccgaggugaacugcagcauggcccagauccagcugugccccccgcccccccagaucccgaacucccacaacaugacgaccacccugaacuaccgggacggcgagaaggugagcguccucugccaggagaacuaccugauccaggagggggaggagaucaccugcaaggacggccgcuggcaguccaucccccugugcguggagaagauccccugcagccagcccccgcagaucgagcacgggacgaucaacuccagccgguccagccaggagagcuacgcgcacggcaccaagcucuccuacaccugcgaggggggcuuccgcaucagcgaggagaacgagaccacgugcuacaugggcaagugguccagccccccccagugcgaggggcugcccugcaaguccccgcccgagaucagccacggcguggucgcccacauguccgacagcuaccaguacggggaggaggugaccuacaagugcuucgagggcuucggcaucgacgggcccgccaucgccaagugccugggcgagaaguggucccaccccccgagcugcaucaagaccgacugccucucccugcccagcuucgagaacgccauccccaugggggagaagaaggacguguacaaggcgggcgagcaggucaccuacacgugcgccaccuacuacaagauggacggggccuccaacgugaccugcaucaacagccgguggaccggccgccccacgugccgggacaccuccugcgugaacccgcccaccguccagaacgccuacaucgugagccgccagauguccaaguaccccagcggcgagcgggugcgcuaccagugccgcucccccuacgagauguucggggacgaggaggucaugugccugaacggcaacuggaccgagccgccccagugcaaggacagcacggggaagugcggcccccccccgcccaucgacaacggggacaucaccagcuucccccuguccguguacgcgcccgccagcuccguggaguaccagugccagaaccucuaccagcuggagggcaacaagcggaucaccugccgcaacggccaguggagcgagccgcccaagugccugcaccccugcgucaucucccgggagaucauggagaacuacaacaucgcccuccgcuggaccgccaagcagaagcuguacagccggacgggggaguccguggaguucgugugcaagcgcggcuaccggcugagcucccgcagccacacccuccggaccaccugcugggacgggaagcuggaguacccgacgugcgccaagcgcuga

SEQ ID NO: 28193 - RNA, 993 nt, Artificial Sequence
  derived and/or modified sequence opt1 from CFHR1__Homo_sapiens__NP_002104
auguggcugcucgugagcgucauccugaucucccgcaucagcuccgugggcggggaggccaccuucugcgacuuccccaagaucaaccacggcauccuguacgacgaggagaaguacaagcccuucagccaggugcccaccggggaggucuucuacuacuccugcgaguacaacuucgugagccccuccaagagcuucuggacccggaucacgugcaccgaggagggcuggucccccacccccaagugccuccgccugugcuucuuccccuucguggagaacgggcacagcgaguccagcggccagacccaccuggagggcgacaccguccagaucaucugcaacaccggguaccggcuccagaacaacgagaacaacaucuccugcguggagcgcggcuggagcaccccgcccaagugccgguccacggacaccagcugcgugaacccgcccaccguccagaacgcccacauccugucccgccagaugagcaaguaccccuccggggagcgggugcgcuacgagugccggagccccuacgagauguucggcgacgaggaggugaugugccugaacgggaacuggaccgagccgccccagugcaaggacagcacgggcaagugcgggcccccgccgcccaucgacaacggcgacaucaccuccuucccccucagcgucuacgcgcccgccuccagcguggaguaccagugccagaaccuguaccagcuggagggcaacaagcgcaucacgugccggaacgggcagugguccgagccgcccaagugccuccaccccugcgugaucagccgcgagaucauggagaacuacaacaucgcccugcgguggaccgccaagcagaagcuguaccuccgcaccggcgaguccgccgaguucgucugcaagcggggcuaccgccugagcucccggagccacacccugcgcacgaccugcugggacgggaagcucgaguaccccacgugcgcgaagcgguga

SEQ ID NO: 28194 - RNA, 813 nt, Artificial Sequence
  derived and/or modified sequence opt1 from CFHR2__Homo_sapiens__NP_005657
auguggcugcucgugagcgucauccugaucucccgcaucagcuccgugggcggggaggccauguucugcgacuuccccaagaucaaccacggcauccuguacgacgaggagaaguacaagcccuucagccaggugcccaccggggaggucuucuacuacuccugcgaguacaacuucgugagccccuccaagagcuucuggacccggaucacgugcgccgaggagggcuggucccccaccccgaagugccuccgccugugcuucuuccccuucguggagaacgggcacagcgaguccagcggccagacccaccuggagggcgacaccguccagaucaucugcaacacgggguaccggcuccagaacaacgagaacaacaucuccugcguggagcgcggcuggagcaccccgcccaagugccgguccaccaucagcgcggagaagugcgggcccccgccgcccaucgacaacggcgacaucaccuccuuccugcugagcguguacgcccccggguccagcgucgaguaccagugccagaaccucuaccagcuggagggcaacaaccagaucacgugccgcaacggccaguggagcgagccgcccaagugccuggaccccugcgugaucucccaggagaucauggagaaguacaacaucaagcucaaguggaccaaccagcagaagcuguacagccggaccggggacaucguggaguucgucugcaaguccggcuaccaccccaccaagagccacuccuuccgcgccaugugccagaacgggaagcugguguaccccagcugcgaggagaaguga

SEQ ID NO: 28195 - RNA, 810 nt, Artificial Sequence
  derived and/or modified sequence opt1 from CFHR3__Homo_sapiens__NP_001160096
augcugcuccugaucaacgugauccugacccucugggucagcugcgccaacggccaggugaagcccugcgacuucccggacaucaagcacgggggccuguuccacgagaacaugcgccggcccuacuuccccguggccgucgggaaguacuacuccuacuacugcgacgagcacuucgagacccccagcggcuccuacugggacuacauccacugcacgcagaacggguggagcccggcggugcccugccugcgcaagugcuacuuccccuaccucgagaacggcuacaaccagaacuacggccggaaguucgugcaggggaacuccaccgaggucgccugccaccccggcuacgggcugccgaaggcccagaccaccgugacgugcaccgagaagggcuggagccccacgccccgcugcauccgggugaacuccagcgagaagugcgggcccccgccgcccaucuccaacggcgacaccaccagcuuccugcucaaggucuacgugccccagucccgcguggaguaccagugccagcccuacuacgagcugcagggcagcaacuacgugaccugcuccaacggggaguggagcgagccgccccggugcauccaccccugcaucaucaccgaggagaacaugaacaagaacaacaucaagcugaagggccgcuccgaccggaaguacuacgccaagaccggggacacgaucgaguucaugugcaagcucggcuacaacgccaacaccagcauccuguccuuccaggcggucugccgcgagggcaucguggaguacccccggugcgaguga

SEQ ID NO: 28196 - RNA, 1734 nt, Artificial Sequence
  derived and/or modified sequence opt1 from CFHR4__Homo_sapiens__NP_001188480
augcugcuccugaucaacgugauccugacccucugggucagcugcgccaacggccaggugaagcccugcgacuuccccgagauccagcacgggggccuguacuacaagucccugcgccggcucuacuuccccgccgcggccgggcagagcuacuccuacuacugcgaccagaacuucgugacccccagcggcuccuacugggacuacauccacugcacgcaggacggguggagccccaccguccccugccugcggaccugcuccaagagcgacguggagaucgagaacggcuucaucuccgagagcuccagcaucuacauccugaacgaggagacccaguacaacugcaagcccggcuacgccacggccgaggggaacuccagcggcuccaucacgugccuccagaacggguggagcacccagcccaucugcaucaaguucugcgacaugcccguguucgagaacucccgggccaagagcaacggcaugugguucaagcugcacgacacccuggacuacgagugcuacgacggguacgaguccagcuacggcaacacgaccgacagcaucgucugcggcgaggacggguggucccaccucccgaccugcuacaacagcuccgagaacugcgggcccccgcccccgaucagcaacggcgacaccaccuccuucccccagaagguguaccugcccuggagccgcguggaguaccagugccaguccuacuacgagcugcagggcagcaaguacgugaccugcuccaacggcgacuggagcgagcccccgcgcugcaucuccaugaagcccugcgaguuccccgagauccagcacgggcaccucuacuacgagaacacccgccggcccuacuucccggucgcgaccggccagagcuacuccuacuacugcgaccagaacuucgugacgcccagcggguccuacugggacuacauccacugcacccaggacggcuggcugcccaccguccccugccugcggaccugcagcaaguccgacaucgagaucgagaacggguucaucagcgaguccagcagcaucuacauccucaacaaggagauccaguacaagugcaagccgggcuacgccacggccgacggcaacuccagcggguccaucacgugccugcagaacggcuggagcgcccagcccaucugcaucaaguucugcgacaugcccguguucgagaacucccgcgccaagagcaacgggaugcgcuucaagcugcacgacacccucgacuacgagugcuacgacggcuacgagaucuccuacgggaacaccaccggcagcaucgugugcggcgaggacggguggucccacuucccgaccugcuacaacagcuccgagaagugcggcccgcccccgcccaucagcaacggggacaccaccuccuuccugcugaaggucuacgugccccagagccggguggaguaccagugccaguccuacuacgagcuccagggcagcaacuacgucacgugcuccaacggggaguggagcgagccgccccgcugcauccaccccugcaucaucaccgaggagaacaugaacaagaacaacauccagcugaagggcaagagcgacaucaaguacuacgcgaagaccggcgacaccaucgaguucaugugcaagcugggguacaacgccaacacguccgugcucagcuuccaggccgugugccgggagggcaucgucgaguacccccgcugcgaguga

SEQ ID NO: 28197 - RNA, 1710 nt, Artificial Sequence
  derived and/or modified sequence opt1 from CFHR5__Homo_sapiens__NP_110414
augcugcuccuguucagcgugauccugaucuccugggucagcaccgugggcggggagggcacccucugcgacuuccccaagauccaccacggguuccuguacgacgaggaggacuacaaccccuucucccaggugcccacgggcgaggucuucuacuacagcugcgaguacaacuucgugucccccagcaaguccuucuggacccgcaucacgugcaccgaggagggguggagccccacgcccaagugccugcggaugugcuccuuccccuucgugaagaacggccacagcgaguccagcggccucauccaccuggagggggacaccguccagaucaucugcaacaccggcuacucccugcagaacaacgagaagaacaucagcugcguggagcgcgggugguccaccccgcccaucugcagcuucacgaagggcgagugccacgugcccauccucgaggccaacgucgacgcccagcccaagaaggaguccuacaaggugggggacgugcugaaguucagcugccggaagaaccugauccgcgucggcuccgacagcgugcagugcuaccaguucggcuggagccccaacuucccgaccugcaagggccaggugcgguccugcgggcccccgccccagcucagcaacggggaggucaaggagauccgcaaggaggaguacggccacaacgaggugguggaguacgacugcaaccccaacuucaucaucaacggccccaagaagauccagugcgucgacggggaguggaccacccugccgaccugcguggagcaggucaagaccugcggcuacauccccgagcuggaguacggguacgugcagcccuccgugccgcccuaccagcacggcgugagcgucgaggugaacugccggaacgaguacgcgaugaucgggaacaacaugaucacgugcaucaacggcaucuggaccgagcuccccaugugcgucgccacccaccagcugaagcgcugcaagaucgccggcgugaacaucaagacccugcucaagcuguccgggaaggaguucaaccacaacagccggauccgcuaccggugcuccgacaucuuccgcuaccggcacagcgugugcaucaacggcaaguggaaccccgaggucgacugcaccgagaagcgcgagcaguucugcccgccgccgccccagauccccaacgcccagaacaugaccacgaccgugaacuaccaggacggggagaagguggccguccugugcaaggagaacuaccuccugcccgaggcgaaggagaucgugugcaaggacggccgguggcagucccugccccgcugcguggagagcaccgccuacugcgggcccccgcccuccaucaacaacggcgacaccacgagcuucccccucuccgucuacccgcccggcagcaccgugaccuaccggugccaguccuucuacaagcugcaggggagcgugaccgucacgugccgcaacaagcagugguccgagccgccccggugccuggaccccugcguggugagcgaggagaacaugaacaagaacaacauccagcucaaguggcgcaacgacggcaagcuguacgccaagaccggggacgccgucgaguuccagugcaaguucccccacaaggcgaugaucuccagcccgcccuuccgggccaucugccaggagggcaaguucgaguaccccaucugcgaguga

SEQ ID NO: 28198 - RNA, 1752 nt, Artificial Sequence
  derived and/or modified sequence opt1 from CFI__Homo_sapiens__NP_000195
augaagcugcuccacguguuccugcuguuccucugcuuccaccuccgcuucugcaaggucaccuacaccagccaggaggaccugguggagaagaagugccuggccaagaaguacacgcaccuguccugcgacaagguguucugccagcccuggcagcggugcaucgaggggaccugcgucugcaagcugccguaccagugccccaagaacgggaccgccgugugcgcgaccaaccgccggagcuuccccacguacugccagcagaagucccucgagugccugcaccccggcaccaaguuccugaacaacgggaccugcaccgccgagggcaaguucagcgugucccucaagcacgggaacacggacagcgagggcaucgucgaggugaagcugguggaccaggacaagaccauguucaucugcaaguccagcugguccaugcgcgaggccaacgucgccugccuggaccucggcuuccagcagggggccgacacccagcggcgcuucaagcugagcgaccuguccaucaacagcaccgagugccuccacgugcacugccggggccuggagacgucccuggcggagugcaccuucaccaagcgccggaccaugggguaccaggacuucgccgacguggucugcuacacgcagaaggccgacagcccgauggacgacuucuuccagugcgugaacggcaaguacaucucccagaugaaggccugcgacgggaucaacgacugcggcgaccagagcgacgagcucugcugcaaggcgugccagggcaagggguuccacugcaaguccggcgugugcauccccagccaguaccagugcaacggggaggucgacugcaucaccggcgaggacgaggugggcugcgccggguucgccuccguggcccaggaggagaccgagauccugaccgccgacauggacgcggagcgccggcgcaucaagagccugcuccccaagcugagcugcggcgucaagaaccggaugcacauccgccggaagcgcaucgucgggggcaagcgggcccagcugggggaccuccccuggcaggucgccaucaaggacgccuccggcaucacgugcggcgggaucuacaucggcgggugcuggauccugaccgccgcgcacugccugcgcgccagcaagacccaccgguaccagaucuggaccacggugguggacuggauccacccggaccucaagcgcaucgugaucgaguacguggaccggaucaucuuccacgagaacuacaacgccggcaccuaccagaacgacaucgcccugaucgagaugaagaaggacgggaacaagaaggacugcgagcugccccgcuccauccccgccugcgugcccuggagcccguaccucuuccagcccaacgacacgugcaucgucuccggcuggggccgcgagaaggacaacgagcggguguucagccugcaguggggcgaggugaagcugaucuccaacugcagcaaguucuacggcaaccgcuucuacgagaaggagauggagugcgcggggaccuacgacggcuccaucgacgccugcaagggggacagcggcggcccccucgucugcauggacgccaacaacgugaccuacguguggggcgucguguccuggggcgagaacugcgggaagcccgaguucccggggguguacaccaaggucgccaacuacuucgacuggaucagcuaccacgugggccggcccuucaucucccaguacaacguguga

SEQ ID NO: 28199 - RNA, 501 nt, Artificial Sequence
  derived and/or modified sequence opt1 from CFL1__Homo_sapiens__NP_005498
auggccagcggcguggccgucuccgacggggugaucaagguguucaacgacaugaagguccgcaagagcuccacccccgaggaggugaagaagcggaagaaggcggugcuguucugccucagcgaggacaagaagaacaucauccuggaggagggcaaggagauccuggucggggacgugggccagaccguggacgacccguacgccacguucgucaagaugcuccccgacaaggacugccgcuacgcccuguacgacgccaccuacgagaccaaggaguccaagaaggaggaccugguguucaucuucugggcccccgagagcgcgccccucaaguccaagaugaucuacgccagcuccaaggacgccaucaagaagaagcugaccgggaucaagcacgagcugcaggccaacugcuacgaggaggugaaggaccggugcacgcucgcggagaagcugggcggcagcgccgucaucucccuggaggggaagccgcucuga

SEQ ID NO: 28200 - RNA, 501 nt, Artificial Sequence
  derived and/or modified sequence opt1 from CFL2__Homo_sapiens__NP_068733
auggccagcggcgugaccgucaacgacgaggugaucaagguguucaacgacaugaagguccgcaaguccagcacccaggaggagaucaagaagcggaagaaggccgugcuguucugccucuccgacgacaagcgccagaucaucguggaggaggcgaagcagauccuggucggggacaucggcgacacgguggaggaccccuacaccagcuucgugaagcugcucccgcugaacgacugccgguacgcccuguacgacgccaccuacgagaccaaggaguccaagaaggaggaccucgucuucaucuucugggcccccgagagcgcgccccugaaguccaagaugaucuacgccagcuccaaggacgccaucaagaagaaguucacggggaucaagcacgaguggcaggucaacggccuggacgacaucaaggaccgcagcacccucggggagaagcugggcggcaacgugguggugucccuggaggggaagccccucuga

SEQ ID NO: 28201 - RNA, 666 nt, Artificial Sequence
  derived and/or modified sequence opt1 from CFLAR__Homo_sapiens__NP_001120656
augagcgccgaggugauccaccaggucgaggaggcccuggacaccgacgagaaggagaugcuccuguuccugugccgcgacguggcgaucgacguggugcccccgaacguccgggaccuccuggacauccugcgcgagcggggcaagcucuccgugggggaccuggccgagcugcucuaccgcguccggcgcuucgaccugcugaagcggauccucaagauggaccgcaaggccguggagacccaccuccugcggaacccccaccuggugagcgacuaccgcguccugauggccgagaucggcgaggaccuggacaaguccgacgugagcucccucaucuuccugaugaaggacuacauggggcggggcaagaucagcaaggagaaguccuuccuggaccucguggucgagcuggagaagcugaaccucguggcccccgaccagcuggaccugcucgagaagugccugaagaacauccaccgcaucgaccugaagacgaagauccagaaguacaagcagagcgugcagggggcgggcaccuccuaccggaacguccuccaggccgccauccagaagucccugaaggaccccagcaacaacuuccgcaugaucaccccguacgcccacugccccgaccugaagauccucggcaacugcagcauguga

SEQ ID NO: 28202 - RNA, 1410 nt, Artificial Sequence
  derived and/or modified sequence opt1 from CFP__Homo_sapiens__NP_002612
augaucaccgagggcgcccaggcgccccgccugcuccugccgccccugcuccugcugcucacccugcccgccacggggagcgaccccgugcugugcuucacccaguacgaggaguccagcggcaagugcaaggggcuccugggcgggggcgucuccguggaggacugcugccugaacaccgccuucgccuaccagaagcggagcggcgggcucugccagccgugccgcagcccccgguggucccugugguccaccugggcccccugcagcgugacgugcuccgagggcagccagcugcgcuaccggcgcugcgucggguggaacggccagugcuccgggaagguggcccccggcacccucgaguggcagcugcaggcgugcgaggaccagcagugcugcccggagaugggcggguggagcggcugggggcccugggagcccugcuccgugaccugcagcaagggcacccggacgcgccggcgcgccugcaaccaccccgccccgaagugcggcgggcacugccccggccaggcccaggaguccgaggcgugcgacacccagcaggucugccccacccacggggccugggccaccuggggccccuggacgccgugcagcgccuccugccacgggggcccccacgagcccaaggagacccggagccgcaagugcuccgcccccgagccgagccagaagccgcccggcaagcccugccccgggcuggcguacgagcagcggcgcugcaccggccucccgcccugccccguggccgggggcugggggcccuggggccccgugagccccugcccggugaccugcggccuggggcagacgauggagcagcggaccugcaaccaccccgucccccagcacggcgggcccuucugcgccggcgacgccacccgcacccacaucugcaacacggccgugccgugccccgucgacggggagugggacuccuggggcgaguggagccccugcauccggcgcaacaugaaguccaucagcugccaggagauccccggccagcagucccgggggcggaccugccgcggccgcaaguucgacgggcaccgcugcgcgggccagcagcaggacauccggcacugcuacagcauccagcacugcccgcugaagggcuccuggagcgagugguccaccugggggcucugcaugccgcccugcggccccaaccccacccgcgcccggcagcgccugugcacgccccugcuccccaaguacccgcccaccgugagcaugguggaggggcagggcgagaagaacgucaccuucugggggcggccccugccccgcugcgaggagcugcagggccagaagcucgugguggaggagaagcggcccugccugcacgucccggccugcaaggaccccgaggaggaggagcuguga

SEQ ID NO: 28203 - RNA, 4443 nt, Artificial Sequence
  derived and/or modified sequence opt1 from CFTR__Homo_sapiens__NP_000483
augcagcgcagcccccuggagaaggccuccguggucagcaagcuguucuucuccuggacccggccgauccugcgcaagggcuaccggcagcgccuggagcucagcgacaucuaccagauccccuccguggacagcgccgacaaccuguccgagaagcuggagcgggagugggaccgcgagcucgcgagcaagaagaaccccaagcugaucaacgcccugcggcgcugcuucuucuggcgguucauguucuacgggaucuuccucuaccugggcgaggugaccaaggccguccagccccugcuccuggggcgcaucaucgccuccuacgacccggacaacaaggaggagcggagcaucgccaucuaccugggcaucgggcucugccugcuguucaucgugcgcacgcuccugcugcaccccgcgaucuucggccuccaccacaucggcaugcagaugcggaucgccauguucucccugaucuacaagaagacccugaagcucagcucccgcgugcuggacaagaucagcaucgggcagcuggucucccuccugagcaacaaccugaacaaguucgacgagggccucgcccuggcccacuucguguggaucgcgccccuccagguggcccuccugauggggcugaucugggagcuccugcaggccuccgccuucugcggccugggguuccucaucguccuggcccuguuccaggcgggccucggccggaugaugaugaaguaccgcgaccagcgggccgggaagaucagcgagcgccuggugaucaccuccgagaugaucgagaacauccagagcgugaaggccuacugcugggaggaggccauggagaagaugaucgagaaccugcggcagaccgagcucaagcugacgcgcaaggccgcguacguccgguacuucaacagcuccgccuucuucuucagcggcuucuucgugguguuccuguccguccuccccuacgcccugaucaaggggaucauccugcgcaagaucuucaccaccaucagcuucugcaucgugcugcgcauggccgugacccggcaguucccgugggccguccagacgugguacgacucccucggcgcgaucaacaagauccaggacuuccugcagaagcaggaguacaagacccuggaguacaaccucaccaccacggagguggugauggagaacgucaccgccuucugggaggagggcuucggggagcuguucgagaaggccaagcagaacaacaacaaccgcaagaccagcaacggcgacgacucccuguucuucagcaacuucucccuccuggggacccccgugcugaaggacaucaacuucaagaucgagcggggccagcuccuggccguggccgggagcacgggcgcgggcaagaccucccugcucauggucaucaugggggagcuggagcccagcgagggcaagaucaagcacuccgggcgcaucagcuucugcucccaguucagcuggaucaugcccggcaccaucaaggagaacaucaucuucgggguguccuacgacgaguaccgguaccgcagcgucaucaaggccugccagcuggaggaggacaucuccaaguucgccgagaaggacaacaucgugcucggcgagggcgggaucacccugagcggcgggcagcgggcccgcaucagccuggcgcgggccguguacaaggacgccgaccucuaccugcuggacuccccguucggcuaccucgacguccugacggagaaggagaucuucgagagcugcgugugcaagcugauggccaacaagacccgcauccucgugaccuccaagauggagcaccugaagaaggccgacaagauccugauccuccacgaggggagcuccuacuucuacggcaccuucagcgagcugcagaaccugcagcccgacuucuccagcaagcucaugggcugcgacuccuucgaccaguucagcgcggagcggcgcaacuccauccugacggagacccugcaccgguucagccucgagggggacgcccccgucuccuggaccgagaccaagaagcagagcuucaagcagacgggcgaguucggggagaagcgcaagaacuccauccugaaccccaucaacagcauccggaaguucuccaucgugcagaagaccccgcugcagaugaacggcaucgaggaggacagcgacgagccccucgagcgccggcugagccuggugcccgacuccgagcagggcgaggccauccucccccgcaucagcgucaucuccaccgggccgacccugcaggcccggcgccgccagagcgugcugaaccucaugacgcacuccgugaaccagggccagaacauccaccggaagaccaccgccagcacccgcaaggucucccuggcgccccaggccaaccugacggagcucgacaucuacagccggcgccugucccaggagaccgggcuggagaucagcgaggagaucaacgaggaggaccucaaggagugcuucuucgacgacauggaguccauccccgccgugaccaccuggaacaccuaccugcgguacaucacggugcacaagagccugaucuucguccucaucuggugccuggugaucuuccuggccgagguggccgcgucccucgucgugcuguggcugcucggcaacacgccccugcaggacaaggggaacagcacccacucccgcaacaacagcuacgccgugaucaucaccuccaccagcuccuacuacgucuucuacaucuacgugggcguggccgacacccugcucgccaugggcuucuuccgggggcugccgcugguccacacccucaucaccgugagcaagauccugcaccacaagaugcugcacagcgugcuccaggcgcccauguccacgcugaacacccugaaggccggcgggauccucaaccgcuucagcaaggacaucgccauccuggacgaccugcucccccugaccaucuucgacuucauccagcugcuccugaucgucaucggcgccaucgccgugguggcgguccugcagcccuacaucuucguggccaccgugccggucaucguggccuucaucaugcuccgggccuacuuccugcagacgucccagcagcugaagcagcucgagagcgaggggcgcucccccaucuucacccaccuggugaccagccugaagggccucuggacccugcgggccuucggccgccagcccuacuucgagacgcuguuccacaaggcgcucaaccugcacaccgccaacugguuccuguaccucuccacccugcggugguuccagaugcgcaucgagaugaucuucgucaucuucuucaucgccgugaccuucaucagcauccugacgaccggggagggcgaggggcgggugggcaucauccucacccuggccaugaacaucauguccacccugcagugggccgucaacagcuccaucgacguggacagccugaugcgcuccgugagccgggucuucaaguucaucgacaugccgacggaggggaagcccaccaaguccaccaagcccuacaagaacggccagcucagcaaggugaugaucaucgagaacucccacgugaagaaggacgacaucuggcccagcggcgggcagaugaccgucaaggaccugacggcgaaguacaccgagggcgggaacgccauccuggagaacaucuccuucagcaucagcccgggccagcgcguggggcuccugggccggaccggcuccggcaagagcacccugcucuccgccuuccugcgccugcucaacacggagggggagauccagaucgacggggugagcugggacuccaucacccugcagcaguggcggaaggccuucggcgucaucccccagaagguguucaucuucagcggcaccuuccgcaagaaccuggaccccuacgagcagugguccgaccaggagaucuggaagguggcggacgaggucgggcuccgcagcgugaucgagcaguuccccggcaagcuggacuucguccugguggacgggggcugcgugcucucccacgggcacaagcagcugaugugccuggcccggagcguccucuccaaggccaagauccugcugcucgacgagccgagcgcccaccuggaccccgugaccuaccagaucauccgccggacgcugaagcaggccuucgcggacugcaccgugauccucugcgagcaccgcaucgaggccaugcuggagugccagcaguuccuggucaucgaggagaacaaggugcggcaguacgacuccauccagaagcuccugaacgagcgcagccuguuccggcaggccaucucccccagcgaccgcgugaagcuguucccccaccggaacuccagcaagugcaaguccaagccgcagaucgccgcccucaaggaggagaccgaggaggagguccaggacacccgccuguga

SEQ ID NO: 28204 - RNA, 351 nt, Artificial Sequence
  derived and/or modified sequence opt1 from CGA__Homo_sapiens__NP_000726
auggacuacuaccgcaaguacgccgccaucuuccuggugacccucagcgucuuccugcacgugcugcacuccgcgcccgacgugcaggacugcccggagugcacccuccaggagaaccccuucuucagccagcccggcgcccccauccugcagugcauggggugcugcuucucccgggccuacccgacgccccugcgcagcaagaagaccaugcucguccagaagaacgugaccuccgagagcaccugcugcguggccaaguccuacaaccgggucacggugaugggcggguucaagguggagaaccacaccgccugccacugcagcaccugcuacuaccacaaguccuga

SEQ ID NO: 28205 - RNA, 468 nt, Artificial Sequence
  derived and/or modified sequence opt1 from CGB1__Homo_sapiens__NP_203695
augagcaagcgccugcuccugcugcuccugcuguccaugggcgggaccugggccagcaaggagccccuccggccgcgcugccggcccaucaacgccacccuggcgguggagaaggagggcugccccgucugcaucacggugaacaccaccaucugcgccggguacugccccaccaugacgcgcgugcugcagggcguccucccggcccugccccagguggugugcaacuaccgggacguccgcuucgaguccauccggcugcccgggugcccccgcggcgugaacccgguggucagcuacgccguggcccucuccugccagugcgcgcugugccggcgcagcaccaccgacugcggcgggcccaaggaccacccccugaccugcgacgacccccgguuccaggacuccagcuccagcaaggccccgccgcccucccuccccagccccucccgccugcccggccccuga

SEQ ID NO: 28206 - RNA, 492 nt, Artificial Sequence
  derived and/or modified sequence opt1 from CGB2__Homo_sapiens__NP_203696
augagcaagggccugcuccugcugcuccugcuguccaugggcgggaccugggccagcaaggagccccuccgcccgcggugccgccccaucaacgccacccuggcgguggagaaggaggggugccccgucugcaucacggugaacaccaccaucugcgccggcuacugccccaccaugacgcgggugcugcaggggguccucccggcccugccccagguggugugcaacuaccgcgacguccgguucgaguccauccgccugcccggcugcccccggggcgugaacccgguggucagcuacgccguggcccucuccugccagugcgcgcugugccgccggagcaccaccgacugcgggggccccaaggaccacccccugaccugcgacgacccccgcuuccaggccuccagcuccagcaaggccccgccgcccucccuccccagccccucccggcugcccgggcccagcgacacgcccauccugccgcaguga

SEQ ID NO: 28207 - RNA, 498 nt, Artificial Sequence
  derived and/or modified sequence opt1 from CGB5__Homo_sapiens__NP_149032
auggagauguuccagggccugcuccugcugcuccugcugagcaugggcgggaccugggccuccaaggagccccuccgcccgcggugccgccccaucaacgccacccuggcgguggagaaggaggggugccccgucugcaucacggugaacaccaccaucugcgccggcuacugccccaccaugacgcgggugcugcaggggguccucccggcccugccccagguggugugcaacuaccgcgacguccgguucgagagcauccgccugcccggcugcccccggggcgugaacccgguggucuccuacgccguggcccucagcugccagugcgcgcugugccgccgguccaccaccgacugcgggggccccaaggaccacccccugaccugcgacgacccccgcuuccaggacagcuccagcuccaaggccccgccgcccagccuccccucccccagccggcugcccgggcccuccgacacgcccauccugccgcaguga

SEQ ID NO: 28208 - RNA, 498 nt, Artificial Sequence
  derived and/or modified sequence opt1 from CGB7__Homo_sapiens__XP_011525821
auggagauguuccagggccugcuccugcugcuccugcugagcaugggcgggaccugggccucccgcgagaugcuccggccccgcugccggccgaucaacgccacccuggcgguggagaaggaggggugccccgucugcaucacggugaacaccaccaucugcgccggcuacugccccaccaugacgcgcgugcugcaggggguccuccccgcccugccccagguggugugcaacuaccgggacguccgcuucgagagcauccggcugcccggcugcccccgcggcgugaaccccguggucuccuacgccguggcccucagcugccagugcgcgcugugccggcgcuccaccaccgacugcgggggcccgaaggaccacccccugaccugcgacgacccccgguuccaggccagcuccagcuccaaggccccgccgcccagccuccccucccccagccgccugccggggcccuccgacacgcccauccugccccaguga

SEQ ID NO: 28209 - RNA, 3612 nt, Artificial Sequence
  derived and/or modified sequence opt1 from CGN__Homo_sapiens__XP_005245422
auggagcaggcccccaacauggccgagccgcgcggccccguggaccacgggguccagauccgguucaucaccgagcccgugagcggcgcggagauggggacccugcgccggggcgggcgccggcccgccaaggacgcccgcgccuccacguacggcguggccguccgggugcagggcaucgcggggcagccguucgugguccucaacagcggcgagaagggcggggacuccuucggggugcagaucaagggcgccaacgaccagggcgccagcggggcccuguccagcgaccuggagcuccccgagaaccccuacucccaggugaagggcuuccccgcgccgagccaguccagcaccuccgacgaggagcccggggccuacuggaacggcaagcugcugcgcagccacucccaggccagccucgccggccccgggcccgucgacccguccaaccggagcaacuccaugcuggagcuggcccccaagguggcgagccccggcuccaccaucgacaccgcgccccucagcagcguggacucccugaucaacaaguucgacagccagcucgggggccaggcccgcgggcggacgggccgccggacccgcaugcugccgcccgagcagcggaagcgcuccaagagccuggacucccggcugccccgcgacaccuucgaggagcgggagcgccagagcaccaaccacuggacguccagcaccaaguacgacaaccacgucggcaccuccaagcagcccgcccagagccagaaccucuccccgcugagcggguucucccggagccgccagacccaggacugggugcugcaguccuucgaggagccccgccggagcgcccaggaccccacgaugcuccaguucaaguccacccccgaccugcugcgcgaccagcaggaggccgccccgcccggcagcguggaccacaugaaggccaccaucuacgggauccuccgggagggcuccagcgagagcgagaccuccguccgccggaaggugagccuggugcuggagaagaugcagccccucgucaugguguccagcggguccacgaaggccguggccggccagggcgagcugacccgcaaggucgaggagcugcagcggaagcucgacgaggaggugaagaagcgccagaagcuggagcccagccagguggggcuggagcggcagcucgaggagaagaccgaggagugcucccgccugcaggagcugcucgagcggcgcaagggcgaggcgcagcagagcaacaaggagcugcagaacaugaagcggcugcucgaccagggggaggaccugcgccacggccuggagacccaggucauggagcuccagaacaagcugaagcacgugcaggggccggagcccgccaaggagguccugcucaaggaccugcuggagacgcgggagcuccuggaggaggugcuggagggcaagcagcgcguggaggagcagcuccggcugcgcgagcgggagcugaccgcccugaagggcgcccucaaggaggaggucgccucccgcgaccaggagguggagcacgugcgccagcaguaccagcgggacaccgagcagcugcgccggagcaugcaggacgcgacccaggaccacgccguccuggaggccgagcgccagaagauguccgcccucgugcgggggcugcagcgcgagcuggaggagacgagcgaggagaccggccacuggcaguccauguuccagaagaacaaggaggaccuccgggcgaccaagcaggagcugcugcagcuccgcauggagaaggaggagauggaggaggagcugggggagaagaucgaggugcugcagcgggagcucgagcaggcccgcgccagcgccggcgacacccggcaggucgaggugcugaagaaggagcugcuccgcacgcaggaggagcugaaggagcugcaggccgagcggcagucccaggagguggcgggccgccaccgggaccgcgagcucgagaagcagcuggccguccugcggguggaggccgaccgcgggcgggagcucgaggagcagaaccugcagcugcagaagacccuccagcagcugcgccaggacugcgaggaggccagcaaggccaagaugguggcggaggccgaggccaccguccugggccagcggcgcgccgccguggagaccacgcuccgcgagacccaggaggagaacgacgaguuccggcgccggauccuggggcuggagcagcagcucaaggagacccgcggccugguggacgggggcgaggcggucgaggcccggcugcgcgacaagcuccagcggcuggaggccgagaagcagcagcuggaggaggcccucaacgcgucccaggaggaggagggcagccuggccgccgccaagcgcgcccuggaggcgcggcucgaggaggcccagcgcgggcuggcccggcugggccaggagcagcagacccucaaccgcgcccuggaggaggaggggaagcagcgggaggugcugcgccggggcaaggccgagcucgaggagcagaagcgccugcuggaccggacgguggaccgccucaacaaggagcuggagaagaucggggaggacagcaagcaggcgcugcagcagcuccaggcccagcuggaggacuacaaggagaaggcccggcgcgaggucgccgacgcccagcgccaggcgaaggacugggccuccgaggccgagaagaccagcggcggccugucccggcuccaggacgagauccagcgccugcggcaggcccugcaggcgagccaggccgagcgcgacaccgcccggcucgacaaggagcugcuggcccagcgccuccaggggcuggagcaggaggccgagaacaagaagcggucccaggacgaccgcgcgcggcagcugaagggccucgaggagaaggugagccgccuggagaccgagcuggacgaggagaagaacaccguggagcuccugacggaccgggucaaccgcgggcgggaccagguggaccagcugcgcaccgagcucaugcaggagcgguccgcccgccaggaccuggagugcgacaagaucagccuggagcggcagaacaaggaccucaagacccgccuggccuccagcgagggcuuccagaagcccuccgccagccugucccagcucgagagccagaaccagcugcugcaggagcggcuccaggccgaggagcgcgagaagaccgugcugcaguccacgaaccggaagcuggagcgcaaggucaaggagcucagcauccagaucgaggacgagcgccagcacgugaacgaccagaaggaccagcugucccugcgggugaaggcgcucaagcgccaggucgacgaggccgaggaggagaucgagcggcuggacgggcugcgcaagaaggcccagcgggagguggaggagcagcacgaggugaacgagcagcuccaggcccgcaucaagagccuggagaaggacuccuggcggaaggccagccgcagcgcggccgaguccgcccugaagaacgagggccucagcuccgacgaggaguucgacagcgucuacgacccguccagcaucgccucccugcugaccgagagcaaccuccagaccuccagcugcuga

SEQ ID NO: 28210 - RNA, 3909 nt, Artificial Sequence
  derived and/or modified sequence opt1 from CGNL1__Homo_sapiens__NP_116255
auggagcuguacuucggcgaguaccagcacgugcagcaggaguacgggguccaccuccgccuggccagcgacgacacccagaagucccggagcucccagaacagcaaggccggcuccuacggggugagcauccgcgugcagggcaucgacgggcaccccuacaucguccugaacaacaccgagcggugccucgcgggcacguccuucagcgagaacggcccgcccuucccgccgcccgugaucaacaaccugccccugcacuccagcaacggguccgugcccaaggagaacagcgaggagcuccagcugcccgagaaccccuacgcccagcccucccccauccgcaaccugaagcagccccuccugcacgagggcaagaacgggguccuggaccggaaggacggcagcgugaagccgucccaccuccugaacuuccagcgccaccccgagcugcuccagcccuacgaccccgagaagaacgagcugaaccugcagaaccaccagccgagcgaguccaacuggcucaagacccugaccgaggaggggaucaacaacaagaagcccuggaccugcuuccccaagcccagcaacucccagccgacgagccccagccuggaggaccccgccaaguccggcgugaccgccauccggcucugcagcuccgucgugaucgaggaccccaagaagcagaccagcgugugcgucaacgugcaguccugcaccaaggagcgcgugggcgaggaggcccuguucacgagcgggcggccgcugaccgcgcacagcccccacgcccaccccgagaccaagaagacccgccccgacguccucccguuccggcgccaggacagcgccggccccgugcuggacggggcccggucccgccggagcuccagcuccagcacgacccccaccuccgcgaacagccuguaccgcuuccuccuggacgaccaggagugcgccauccacgccgacaacgugaaccggcacgagaaccgccgguacaucccguuccugcccggcaccggccgcgacaucgacacgggguccauccccggcgucgaccagcucaucgagaaguucgaccagaagcccgggcugcagcggcgcggccgcagcgggaagcggaaccgcaucaacaccgacgaccggaagcgcucccggagcguggacagcgccuucccguucggccugcagggcaacuccgaguaccucaucgaguucagccgcaaccuggggaaguccagcgagcaccuccugcggcccucccaggugugcccccagcgcccccugagccaggagcggcgcggcaagcaguccgucgggcggaccuucgccaagcugcagggcgcggcccacggggccagcugcgcccacucccgcccgccccagcccaacaucgacggcaaggugcucgagaccgagggcagccaggaguccacggugauccgggcccccagccugggggcgcaguccaagaaggaggaggaggucaagaccgccaccgccacccugaugcuccagaaccgcgccacggccaccagcccggacuccggcgcgaagaagaucagcgugaagaccuuccccuccgccagcaacacccaggccacgcccgaccugcugaaggggcagcaggagcucacccagcagaccaacgaggagaccgccaagcagauccuguacaacuaccugaaggagggcagcacggacaacgacgacgccaccaagcggaaggucaaccucguguucgagaagauccagacccugaagucccgcgcggccgggagcgcccagggcaacaaccaggccugcaacuccaccagcgaggugaaggaccugcuggagcagaaguccaagcucacgaucgaggucgcggagcugcagcggcagcugcagcucgaggugaagaaccagcagaacaucaaggaggagcgcgagcggaugcgcgccaaccuggaggagcugcgcagccagcacaacgagaagguggaggagaacuccacccuccagcagcggcuggaggagagcgagggcgagcugcgcaagaaccucgaggagcuguuccaggucaagauggagcgggagcagcaccagaccgagauccgcgaccugcaggaccagcucuccgagaugcacgacgagcuggacagcgccaagcgguccgaggaccgcgagaagggggcccugaucgaggagcuccugcaggccaagcaggaccugcaggaccuccugaucgcgaaggaggagcaggaggaccugcuccggaagcgcgagcgggagcugaccgcccugaagggcgcccucaaggaggaggugagcucccacgaccaggagauggacaagcugaaggagcaguacgacgccgagcugcaggcccuccgcgagagcguggaggaggcgaccaagaacgucgaggugcuggccucccggagcaacacguccgagcaggaccaggccgggaccgagaugcgcgugaagcugcuccaggaggagaacgagaagcugcagggccggagcgaggagcuggagcgccgggucgcccagcuccagcgccagaucgaggaccugaagggcgacgaggccaaggcgaaggagacccugaagaaguacgagggggagauccggcagcucgaggaggcccuggugcacgcccgcaaggaggagaaggaggccguguccgcgcggcgcgcccuggagaacgagcucgaggccgcccagggcaaccugagccagaccacgcaggagcagaagcagcugagcgagaagcucaaggaggaguccgagcagaaggagcagcugcggcgccugaagaacgagauggagaacgagcgcuggcaccucgggaagaccaucgagaagcugcagaaggagauggccgacaucgucgaggcgagccggaccuccacccuggagcuccagaaccagcuggacgaguacaaggagaagaaccgccgggagcuggccgagaugcagcgccagcucaaggagaagacgcuggaggccgagaagucccggcugaccgccaugaagaugcaggacgagaugcgccucauggaggaggagcugcgggacuaccagcgcgcccaggacgaggcgcugaccaagcggcagcuccuggagcagacccugaaggaccucgaguacgagcuggaggccaagucccaccugaaggacgaccgcagccggcucgugaagcagauggaggacaaggugucccagcuggagauggagcuggaggaggagcgcaacaacagcgaccuccuguccgagcggaucagccgcucccgggagcagauggagcagcugcgcaacgagcuccugcaggagcgggccgcccgccaggaccuggagugcgacaagaucagccucgagcggcagaacaaggaccugaagucccgcaucauccaccuggagggcagcuaccgcuccagcaaggaggggcucgucgugcagauggaggcccggaucgcggagcuggaggaccgccuggaguccgaggagcgggaccgcgccaaccuccagcugagcaaccggcgccuggagcggaaggugaaggagcucgucaugcaggucgacgacgagcaccugucccugacggaccagaaggaccagcucagccugcgccugaaggccaugaagcgccagguggaggaggccgaggaggagaucgaccggcucgagagcuccaagaagaagcugcagcgggagcuggaggagcagauggacaugaacgagcaccuccagggccagcugaacagcaugaagaaggaccugcgccucaagaagcugcccuccaaggugcuggacgacauggacgacgacgacgaccugagcaccgacggcgggucccucuacgaggcgccggugagcuacaccuucuccaaggacagcaccguggccucccagaucuga

SEQ ID NO: 28211 - RNA, 999 nt, Artificial Sequence
  derived and/or modified sequence opt1 from CGRRF1__Homo_sapiens__NP_006559
auggccgccguguuccuggucacccucuacgaguacagcccccuguucuacaucgcggugguguucacgugcuucaucgucaccaccggccuggugcucgggugguucggcugggacgugccggucauccugcgcaacuccgaggagacccaguucagcacccggguguucaagaagcagaugcgccaggugaagaaccccuucgggcuggagaucacgaaccccuccagcgccuccaucaccaccggcaucacccucacgaccgacugccuggaggacagccugcugaccugcuacugggggugcuccguccagaagcucuacgaggcccugcagaagcacguguacugcuuccggaucagcacgccccaggcccucgaggacgcccuguacuccgaguaccuguaccaggagcaguacuucaucaagaaggacagcaaggaggagaucuacugccagcucccgcgcgacaccaagaucgaggacuucggcaccgugccccggucccgcuacccccuggucgcgcugcucacccuggccgacgaggacgaccgggagaucuacgacaucaucagcaugguguccgugauccacauccccgaccgcaccuacaagcugagcugccggauccucuaccaguaccugcugcucgcccagggccaguuccacgaccugaagcagcuguucauguccgccaacaacaacuucacgccgagcaacaacuccagcuccgaggagaagaacaccgaccgcagccuccuggagaaggucgggcugagcgaguccgagguggagcccagcgaggagaacuccaaggacugcguggucugccagaacggcaccgugaacugggugcuccugcccugccggcacacgugccugugcgacgggugcgucaaguacuuccagcagugccccaugugccgccaguucgugcaggagagcuucgcgcucugcucccagaaggagcaggacaaggacaagccgaagacccuguga

SEQ ID NO: 28212 - RNA, 819 nt, Artificial Sequence
  derived and/or modified sequence opt1 from CH25H__Homo_sapiens__NP_003947
augagcugccacaacugcuccgacccccaggugcugugcagcuccggccagcuguuccuccagccgcugugggaccaccuccgcagcugggaggcccugcugcagucccccuucuuccccgucaucuucagcaucaccaccuacgugggguucugccuccccuucgugguccuggacauccugugcuccugggugccggcccuccggcgcuacaagauccaccccgacuucagccccuccgcgcagcagcugcugcccugccucggccagacgcuguaccagcacgugauguucgucuucccggugacccugcuccacugggcccggagccccgcccugcugccccacgaggcccccgagcuccugcugcuccugcaccacauccuguucugccuccugcuguucgacauggaguucuucguguggcaccuccugcaccacaaggucccguggcuguaccgcaccuuccacaaggugcaccaccagaacuccagcuccuucgcccucgcgacccaguacaugagcgugugggagcuguucucccugggguucuucgacaugaugaacgucacgcuccugggcugccacccccugaccacccucaccuuccacguggugaacaucuggcugagcgucgaggaccacuccggguacaacuuccccuggagcacgcaccggcuggugcccuucggcugguacggcggggugguccaccacgaccuccaccacucccacuucaacugcaacuucgccccguacuucacccacugggacaagauccugggcacccugcgcaccgccagcgugcccgcccgguga

SEQ ID NO: 28213 - RNA, 660 nt, Artificial Sequence
  derived and/or modified sequence opt1 from CHAC1__Homo_sapiens__NP_001136248
augggcggggcccagcuggagcuccccagcggcgcccgcccgggggugugcguccggcgcuccuuccgggcgcacgccggcgaccagccccgccggccgcccgggcccauccccgugcccggcaccaugaagcaggagagcgccgcccccaacaccccgcccacgucccagagccccacccccuccgcccaguucccgcgcaacgacggcgacccccaggcgcuguggaucuucggguacggcagccugguguggcggcccgacuucgccuacuccgacagccgcgucggguucgugcggggcuacucccgccgguucuggcagggggacaccuuccaccgcggcagcgacaagaugcccggccggguggucacccuccuggaggaccacgaggggugcacguggggcguggccuaccaggugcagggggagcagaacccgggcuaccugggccccgcccccgaggaggcgaucgccacccagauccucgccugccgcggguucuccggccacaaccuggaguaccugcuccggcuggccgacuucaugcagcugugcgggccccaggcccaggacgagcaccucgcggccaucgucgacgccgugggcaccaugcugccgugcuucugccccaccgagcaggcccuggcccucguguga

SEQ ID NO: 28214 - RNA, 1323 nt, Artificial Sequence
  derived and/or modified sequence opt1 from CHAD__Homo_sapiens__XP_011522516
augcacggcagccgccugggggagcggccccgcccgcucccccggggcgggcgcggccggaucuccgggcgcgagcgggugaagcccagcggccuggacgcgccccgccgguccuggcugggcugccgccuccggagcgggccgcccuacaaggagggcgggcgccccgagcggcugggccuggccgccgcccgcgcgcccccgccccuccugccgcccgcccccgcccccgggguccccgccauggugcggcccaugcugcuccugucccugggccuccuggccggccugcucccggcccuggccgcgugcccccagaacugccacugccacagcgaccugcagcacgugaucugcgacaaggucgggcuccagaagauccccaagguguccgagaagaccaagcugcugaaccuccagcgcaacaacuuccccgugcuggccgccaacagcuuccgggccaugccgaaccuggucucccuccaccuccagcacugccagauccgcgagguggccgcgggcgccuuccgggggcugaagcagcugaucuaccuguaccugagccacaacgacauccgcgugcuccgggccggcgccuucgacgaccugaccgagcugacguaccucuaccuggaccacaacaaggucaccgagcugccccgcggccuccugagcccccuggugaaccucuucauccugcagcugaacaacaacaagauccgcgagcuccgggccggggcguuccagggcgccaaggaccugcgcuggcuguaccucuccgagaacgcccuguccagccugcagcccggggcccucgacgacguggagaaccuggccaaguuccacgucgaccggaaccagcuguccagcuacccguccgcggcccugagcaagcuccgcgugguggaggagcugaagcugucccacaacccccucaagagcauccccgacaacgccuuccagagcuucggccgguaccuggagacccuguggcucgacaacaccaaccuggagaaguucuccgacggggccuuccugggcgucacgacccucaagcacgugcaccuggagaacaaccgccugaaccagcuccccagcaacuucccguucgacucccuggagacccuggcccucaccaacaaccccuggaagugcacgugccagcugcggggccugcgccgguggcucgaggcgaaggccagccgccccgacgcgaccugcgccuccccggccaaguucaaggggcagcacauccgggacaccgacgccuuccgcagcugcaaguuccccaccaagcgguccaagaaggccggccgccacuga

SEQ ID NO: 28215 - RNA, 2871 nt, Artificial Sequence
  derived and/or modified sequence opt1 from CHAF1A__Homo_sapiens__NP_005474
augcuggaggagcucgagugcggcgcccccggggcccgcggcgcggccaccgccauggacugcaaggaccggccggccuuccccgugaagaagcugauccaggcccgccugcccuucaagcggcucaaccugguccccaaggggaaggcggacgacaugagcgacgaccagggcaccuccgugcagagcaaguccccggaccuggaggccagccucgacacgcuggagaacaacugccacgugggguccgacaucgacuuccgccccaagcuggucaacggcaagggcccccucgacaacuuccugcggaaccgcaucgagaccagcaucgggcaguccaccgugaucaucgaccugaccgaggacagcaacgagcagcccgacucccucguggaccacaacaagcugaacagcgaggccuccccgagccgggaggccaucaacggccagcgcgaggacacgggggaccagcagggccugcucaaggcgauccagaacgacaagcuggccuuccccggggagacccuguccgacauccccugcaagaccgaggaggagggcgucggcugcgggggcgccgggcggcgcggcgacagccaggagugcagcccccgguccugcccggagcucaccuccggcccccgcaugugcccccggaaggagcaggacagcugguccgaggccgggggcauccuguucaaggggaaggugcccauggugguccugcaggacauccucgccgugcgcccgccccagaucaagagccugcccgcgacgccccagggcaagaacaugaccccggagagcgaggugcuggaguccuuccccgaggaggacagcguccucucccacagcucccugagcucccccagcuccaccagcucccccgaggggccgcccgccccgcccaagcagcacagcuccaccagccccuuccccacguccacgccccugcggcgcaucaccaagaaguucgugaagggcagcaccgagaagaacaagcuccggcugcagcgcgaccaggagcggcugggcaagcagcucaagcugcgcgccgagcgggaggagaaggagaagcugaaggaggaggccaagcgcgccaaggaggaggcgaagaagaagaaggaggaggagaaggagcucaaggagaaggagcgccgggagaagcgcgagaaggacgagaaggagaaggccgagaagcagcggcugaaggaggagcgccggaaggagcgccaggaggcccuggaggccaagcucgaggagaagcggaagaaggaggaggagaagcgccugcgggaggaggagaagcgcaucaaggccgagaaggcggagaucacccgguucuuccagaagccgaagacgccccaggcccccaagacccuggccggguccugcggcaaguucgcccccuucgagaucaaggagcacauggugcucgccccgcgccggcgcaccgcguuccaccccgaccugugcagccagcuggaccagcuccugcagcagcaguccggggaguucagcuuccugaaggaccucaagggccggcagccccugcgcagcgggcccacccacgucuccacccggaacgccgacaucuucaacagcgacguggugaucgucgagcgcggcaagggcgacggggugccggagcggcgcaaguucggccgcaugaagcugcuccaguucugcgagaaccaccggcccgccuacugggggaccuggaacaagaagaccgcccugauccgcgcgcgggaccccugggcccaggacacgaagcugcuggacuacgagguggacuccgacgaggagugggaggaggaggagcccggcgagagccucucccacagcgagggggacgacgacgacgacaugggcgaggacgaggacgaggacgacggcuucuucgucccgcacggguaccuguccgaggacgagggcgugaccgaggagugcgccgaccccgagaaccacaaggugcgccagaagcugaaggccaaggagugggacgaguuccucgccaaggggaagcgguuccgcguccugcagcccgugaagaucggcugcgucugggcggccgaccgggacugcgccggcgacgaccugaaggugcuccagcaguucgccgccugcuuccuggagacccugcccgcgcaggaggagcagaccccgaaggccagcaagcgcgagcggcgcgacgagcagauccucgcccagcugcugccccuccugcacgggaacgugaacggcuccaaggucaucauccgggaguuccaggagcacugccgccgggggcugcucagcaaccacacgggcagcccccgcucccccuccaccaccuaccugcacaccccgacgcccagcgaggacgccgccauccccuccaagagccggcugaagcgccucaucuccgagaacagcguguacgagaagcggcccgacuuccgcaugugcugguacgugcacccgcagguccugcagagcuuccagcaggagcaccuccccgugcccugccagugguccuacgugaccagcgucccguccgcgcccaaggaggacagcggguccgugcccagcaccggccccucccagggcaccccgaucagccugaagcggaaguccgccgggagcaugugcaucacgcaguucaugaagaagcgccggcacgacggccagaucggggccgaggacauggacggcuuccaggccgacaccgaggaggaggaggaggaggagggggacugcaugaucguggacguccccgacgcggccgaggugcaggcccccugcggcgccgccuccggcgccgggggcggggugggcgucgacaccgggaaggcgacccugaccgccagcccccugggcgccuccuga

SEQ ID NO: 28216 - RNA, 1680 nt, Artificial Sequence
  derived and/or modified sequence opt1 from CHAF1B__Homo_sapiens__NP_005432
augaaggugaucacgugcgagaucgccuggcacaacaaggagcccgucuacagccuggacuuccagcacggcaccgccgggcgcauccaccggcucgcguccgccggcguggacacgaacgugcgcaucuggaaggucgagaaggggccggacggcaaggccaucguggaguuccugagcaaccuggcccggcacaccaaggccgugaacgucgugcgcuucucccccaccggggagauccucgcgagcggcggcgacgacgccgugauccugcuguggaaggucaacgacaacaaggagcccgagcagaucgccuuccaggacgaggacgaggcccagcucaacaaggagaacuggaccguggugaagacgcugcgggggcaccuggaggacgucuacgacaucugcugggcgaccgacggcaaccucauggccuccgccagcguggacaacaccgccaucaucugggacguguccaaggggcagaagaucagcaucuucaacgagcacaaguccuacguccagggcgugaccugggacccccuggggcaguacguggccacccugagcugcgaccgcguccuccggguguacuccauccagaagaagcgcguggcguucaacgucagcaagaugcuguccggcaucggcgccgagggggaggcccggagcuaccgcauguuccacgacgacuccaugaaguccuucuuccggcgccugagcuucaccccggacggcagccuccugcugacccccgccgggugcguggaguccggcgagaacgugaugaacaccacguacgucuucagccggaagaaccucaagcgccccaucgcccaccuccccugcccgggcaaggcgacccuggccgugcggugcugccccgucuacuucgagcugcgccccgugguggagaccggggucgagcugaugagccugcccuaccggcucguguucgccguggccuccgaggacagcguccugcuguacgacacccagcaguccuucccguucggcuacgugagcaacauccacuaccacacgcucuccgacaucagcugguccagcgacggggccuuccuggcgaucuccagcaccgacggcuacugcuccuucgugaccuucgagaaggacgagcuggggaucccccucaaggagaagcccguccugaacaugcgcacccccgacacggccaagaagaccaagagccagacccaccggggcuccagcccgggcccccgccccguggaggggacccccgccucccggacgcaggacccgagcucccccggcaccaccccgccccaggcccgccaggcccccgcgcccaccgugauccgcgacccgcccagcaucacgcccgccgucaagagcccccugcccgggccguccgaggagaagacccuccagcccagcucccagaacaccaaggcccaccccagccggcgcgugacccugaacacgcugcaggccugguccaagaccacgccccggcgcaucaaccucaccccgcugaagaccgacaccccgcccagcuccgugcccaccagcgucaucuccacccccagcaccgaggagauccaguccgagacgcccggcgacgcgcaggggagcccgcccgagcugaagcggccccgccucgacgagaacaagggcggcaccgagucccuggaccccuga

SEQ ID NO: 28217 - RNA, 2439 nt, Artificial Sequence
  derived and/or modified sequence opt1 from CHAMP1__Homo_sapiens__NP_001157617
auggaggccuuccaggagcugcgcaagcccagcgcccggcucgagugcgaccacugcuccuuccgcggcaccgacuacgagaacgugcagauccacauggggaccauccaccccgaguucugcgacgagauggacgcgggcgggcugggcaagaugaucuucuaccagaaguccgccaagcuguuccacugccacaagugcuucuucacgagcaagauguacagcaacgucuacuaccacaucaccuccaagcacgccagccccgacaaguggaacgacaagcccaagaaccagcucaacaaggagaccgaccccgugaaguccccgccccugcccgagcaccagaagauccccugcaacagcgccgagccgaaguccauccccgcccugagcauggagacccagaagcucggguccgugcugagccccgagucccccaagccgacgccccugacgccccucgagccccagaagccgggcagcgucgugucccccgagcugcagacgccccugcccagcccggagcccuccaagcccgcgagcguguccagccccgagccgcccaagagcguccccgugugcgagucccagaagcucgcccccgugccgagccccgagccccagaagccggcccccgucucccccgagagcgugaaggccacccuguccaaccccaagccgcagaagcagagccacuuccccgagacccugggcccgcccuccgcgagcucccccgagagccccgugcucgccgccucccccgagcccugggggccgagccccgccgccucccccgagagccggaaguccgcgcgcaccaccagccccgagccgcggaagcccucccccagcgagucccccgagccguggaagcccuuccccgccgucagccccgagccgcgccggcccgcccccgccgugagcccgggcuccuggaagcccgggccgcccggcagcccccgccccuggaaguccaaccccagcgccuccagcgggcccuggaagccggcgaagcccgcccccuccgugagccccggcccguggaagcccauccccuccgucagccccggcccguggaagcccacccccuccgugagcuccgccagcuggaaguccagcuccgugagccccagcuccuggaaguccccgcccgccagccccgagagcuggaaguccgggcccccggagcugcggaagaccgcccccacccugagccccgagcacuggaaggcggugcccccggucucccccgagcuccgcaagcccggcccgccccugagccccgagauccggucccccgccgggagcccggagcugcgcaagcccuccggcagccccgaccucuggaagcugucccccgaccagcggaagaccagcccggccucccuggacuuccccgagagccagaaguccagccgcggcgggucccccgaccucuggaaguccagcuucuucaucgagccccagaagccgguguuccccgagacccggaagcccggccccagcgggccgagcgagucccccaaggccgccagcgacaucuggaagcccguccuguccaucgacacggagccccgcaagccggcgcuguuccccgagcccgccaagaccgcgcccccggccagccccgaggcccggaagcgcgcccucuuccccgagccccggaagcacgcccuguucccggagcugcccaaguccgcccucuucagcgagucccagaaggccguggagcugggcgacgagcugcagaucgacgcgaucgacgaccagaagugcgacauccucgugcaggaggagcugcuggccagccccaagaagcuccuggaggacacccuguucccguccagcaagaagcucaagaaggacaaccaggaguccagcgacgccgagcuguccagcuccgaguacaucaagaccgaccuggacgccauggacaucaaggggcaggagagcuccagcgaccaggagcaggucgacguggagagcaucgacuucuccaaggagaacaagauggacaugacgagccccgagcagucccgcaacguccuccaguucaccgaggagaaggaggccuucaucagcgaggaggagaucgcgaaguacaugaagcggggcaagggcaaguacuacugcaagaucugcugcugccgcgccaugaagaagggggccgugcugcaccaccuggugaacaagcacaacguccacucccccuacaagugcaccaucugcggcaaggccuuccuccuggagagccugcucaagaaccacguggccgcgcacgggcagucccugcugaagugcccccgcugcaacuucgagagcaacuucccgcggggcuucaagaagcaccugacccacugccagucccgccacaacgaggaggccaacaagaagcucauggaggcccuggagccgccccuggaggagcagcagaucuga

SEQ ID NO: 28218 - RNA, 1893 nt, Artificial Sequence
  derived and/or modified sequence opt1 from CHAT__Homo_sapiens__NP_001136401
auggccgccaagacccccagcuccgaggagagcggccugccgaagcuccccgugccgccccugcagcagacccuggcgacguaccuccagugcaugcgccaccuggucuccgaggagcaguuccgcaagagccaggccaucgugcagcaguucggggcccccggcgggcugggcgagacccuccagcagaagcugcuggagcggcaggagaagaccgccaacuggguguccgaguacuggcucaacgacauguaccugaacaaccggcuggcccuccccgucaacagcucccccgcggugaucuucgcccgccagcacuuccccgggaccgacgaccagcugcgguucgccgccagccugaucuccggcgugcucagcuacaaggcgcugcuggacucccacagcaucccgacggacugcgccaagggccagcucuccgggcagccccugugcaugaagcaguacuacggccuguucagcuccuaccgccuccccgggcacacccaggacacccuggucgcccagaacagcuccaucaugcccgagccggagcacgugaucguggccugcugcaaccaguucuucguccuggacguggugaucaacuuccggcgccucagcgagggcgaccuguucacccagcugcggaagaucgucaagauggccuccaacgaggacgagcgccucccgcccaucgggcugcugacgagcgacggccggagcgagugggcggaggcccgcaccgugcucgugaaggacuccaccaaccgggacagccuggacaugaucgagcgcugcaucugccuggucugccucgacgcccccggcgggguggagcuguccgacacccaccgggcccugcagcuccugcacggcgggggcuacagcaagaacggcgccaaccgcugguacgacaagucccugcaguucguggucgggcgggacggcacgugcgggguggugugcgagcacagccccuucgacggcaucguccucgugcagugcaccgagcaccuccugaagcacaugacccaguccagccgcaagcugauccgggcggacuccgugagcgagcugcccgcgccccgccggcugcgcuggaagugcucccccgagauccaggggcaccucgccagcuccgccgagaagcugcagcgcaucgucaagaaccuggacuucaucguguacaaguucgacaacuacggcaagaccuucaucaagaagcagaagugcagcccggacgccuucauccaggucgcccuccagcuggccuucuaccggcugcaccgccggcuggugcccacguacgaguccgccagcauccgccgguuccaggagggccgcguggacaacauccgguccgccacccccgaggcccucgcguucguccgcgccgugaccgaccacaaggccgccgugcccgcgagcgagaagcugcugcuccugaaggacgccauccgggcccagaccgccuacacggucauggccaucaccgggauggcgaucgacaaccaccuccuggcccugcgcgagcuggcccgggccaugugcaaggagcucccggagauguucauggacgagaccuaccugauguccaaccgcuucgugcugagcaccagccaggugcccacgaccaccgagauguucugcugcuacggccccgucgugcccaacggguacggcgccugcuacaacccgcagcccgagaccauccucuucugcaucuccagcuuccacuccugcaaggagacgagcuccagcaaguucgcgaaggccguggaggagucccugaucgacaugcgggaccugugcagccuccugcccccgaccgaguccaagccccuggccaccaaggagaaggccacccgccccagccaggggcaccagcccuga

SEQ ID NO: 28219 - RNA, 429 nt, Artificial Sequence
  derived and/or modified sequence opt1 from CHCHD10__Homo_sapiens__NP_998885
augccccgcggcagccgguccgccgccagccgcccggcgucccggcccgccgcccccagcgcccacccgcccgcccacccgccgcccuccgcggccgcccccgcccccgcgcccagcgggcagcccggccugauggcccagauggccaccaccgccgccgggguggcggucggcuccgccguggggcacgugaugggcagcgcccucacgggcgccuucuccgggggcagcuccgagcccagccagcccgccguccagcaggcgcccacccccgccgccccgcagccccugcagauggggcccugcgccuacgagauccgccaguuccuggacugcuccaccacccagagcgaccucucccugugcgagggcuucagcgaggcccugaagcagugcaaguacuaccacgggcucuccagccugcccuga

SEQ ID NO: 28220 - RNA, 357 nt, Artificial Sequence
  derived and/or modified sequence opt1 from CHCHD1__Homo_sapiens__NP_976043
auggccacccccagccugcgcggccggcucgcccgcuucgggaacccgcggaagcccgugcugaagcccaacaagccccugauccucgcgaaccgcgucggcgagcggcgccgggagaagggggaggcgaccugcaucacggagauguccgugaugauggccugcuggaagcagaacgaguuccgcgacgacgccugccggaaggagauccagggcuuccuggacugcgccgcccgcgcccaggaggcccggaagaugcgcagcauccaggagacccugggggaguccggcagccuccugccgaacaagcugaacaagcuccugcagcgguuccccaacaagcccuaccuguccuga

SEQ ID NO: 28221 - RNA, 684 nt, Artificial Sequence
  derived and/or modified sequence opt1 from CHCHD3__Homo_sapiens__NP_060282
augggcgggaccaccagcacgcgccgggugaccuucgaggccgacgagaacgagaacaucaccgucgugaagggcauccgccuguccgagaacgugaucgaccggaugaaggagagcucccccagcggguccaagagccagcgcuacuccggcgccuacggggcgagcgucuccgacgaggagcucaagcggcgcguggccgaggagcuggcccuggagcaggccaagaaggagagcgaggaccagaagcggcucaagcaggccaaggagcuggaccgcgagcgggcggccgccaacgagcagcugacccgcgccauccuccgggagcgcaucugcuccgaggaggagcgggcgaaggccaagcaccuggcccgccagcuggaggagaaggaccgggugcucaagaagcaggacgccuucuacaaggagcagcuggcccgccuggaggagcggagcuccgaguucuaccgcgucacgaccgagcaguaccagaaggcggccgaggagguggaggccaaguucaagcgguacgagagccacccggugugcgccgaccuccaggccaagauccugcagugcuaccgcgagaacacccaccagacccugaagugcuccgcgcucgccacgcaguacaugcacugcgucaaccacgccaagcagagcaugcuggagaagggcggcuga

SEQ ID NO: 28222 - RNA, 333 nt, Artificial Sequence
  derived and/or modified sequence opt1 from CHCHD5__Homo_sapiens__NP_115685
augcaggccgcccuggaggugaccgcgcgcuacugcggccgggagcucgagcaguacgggcagugcgucgccgccaagcccgagagcuggcagcgcgacugccacuaccugaagauguccaucgcccagugcaccagcucccacccgaucauccggcagauccgccaggccugcgcgcagcccuucgaggccuucgaggagugccugcggcagaacgaggccgccgugggcaacugcgcggagcacaugcgccgguuccuccagugcgccgagcagguccagccgccccgcagccccgccacgguggaggcccagccccugcccgccuccuga

SEQ ID NO: 28223 - RNA, 708 nt, Artificial Sequence
  derived and/or modified sequence opt1 from CHCHD6__Homo_sapiens__NP_115719
augggcagcaccgaguccagcgaggggcgccggguguccuucggcgucgacgaggaggagcgcgugcgggugcugcaggggguccgccucagcgagaacguggugaaccggaugaaggagcccuccagcccgccgcccgcccccaccuccagcacguucggccugcaggacgggaaccugcgcgcgccccacaaggaguccacccucccccggagcggcuccagcggcgggcagcagcccuccggcaugaaggagggggucaagcgcuacgagcaggagcacgccgccauccaggacaagcuguuccagguggccaagcgggagcgcgaggccgccaccaagcacagcaaggcgucccugcccaccggcgaggggagcaucucccacgaggagcagaaguccgugcggcucgcccgcgagcuggagagccgggaggccgagcugcgccggcgcgacacguucuacaaggagcagcucgagcggaucgagcgcaagaacgccgagauguacaagcugagcagcgagcaguuccacgaggcggccuccaagauggagagcaccaucaagccgcggcgcgucgagcccgugugcuccggccugcaggcccagauccuccacugcuaccgggaccgcccccacgaggugcugcugugcagcgaccucgucaaggccuaccagcgcugcguguccgccgcgcacaagggcuga

SEQ ID NO: 28224 - RNA, 333 nt, Artificial Sequence
  derived and/or modified sequence opt1 from CHCHD7__Homo_sapiens__NP_001011668
augaagugcgaggagacccacgcccccaacagcaacuggguguacgucaugcugccguccaagaagaccgugcgcaugcccagcgugacgcagcggcuccgcgaccccgacaucaaccccugccuguccgagagcgacgccuccacccggugccuggacgagaacaacuacgaccgcgagcggugcagcaccuacuuccuccgcuacaagaacugccggcgcuucuggaacuccaucgucaugcagcggcgcaagaacggcgugaagccguucaugcccaccgcggccgagcgggacgagauccugcgcgccguggggaacaugcccuacuga

SEQ ID NO: 28225 - RNA, 5397 nt, Artificial Sequence
  derived and/or modified sequence opt1 from CHD1__Homo_sapiens__XP_005271923
augaacggccacagcgacgaggagagcgugcgcaacagcagcggggagagcagccagagcgacgacgacagcggcagcgccuccgggagcggcuccgggagcuccagcggcuccagcuccgacggcagcuccagccagagcggguccagcgacuccgacagcggcuccgagagcgggucccagagcgaguccgagagcgacaccucccgggagaacaaggugcaggccaagccgcccaagguggacggcgcggaguucuggaaguccucccccagcauccuggccgugcagcgcuccgccauccucaagaagcagcagcagcagcagcagcagcagcagcaccaggccagcuccaacagcggguccgaggaggacagcagcuccagcgaggacuccgacgacagcuccagcgaggugaagcggaagaagcacaaggacgaggacuggcagauguccggcagcggcucccccagccaguccgggagcgacuccgagagcgaggaggagcgcgagaaguccagcugcgacgagaccgaguccgacuacgagcccaagaacaaggucaagagccggaagccccagaaccgcagcaaguccaagaacggcaagaagauccuggggcagaagaagcggcagaucgacagcuccgaggaggacgacgacgaggaggacuacgacaacgacaagcgcagcucccggcgccaggccaccgugaacgucagcuacaaggaggacgaggagaugaagaccgacuccgacgaccugcucgaggugugcggcgaggacgugccccagcccgaggaggaggaguucgagaccaucgagcgguucauggacugccgcaucggccggaagggggcgaccggcgccacgaccaccaucuacgccgucgaggccgacggggaccccaacgcgggcuucgagaagaacaaggagccgggggagauccaguaccugaucaaguggaagggcuggagccacauccacaacaccugggagacggaggagacccugaagcagcagaacgugcgcggcaugaagaagcucgacaacuacaagaagaaggaccaggagaccaagcgguggcugaagaacgccucccccgaggacguggaguacuacaacugccagcaggagcugaccgacgaccuccacaagcaguaccagaucgucgagcgcaucaucgcccacagcaaccagaaguccgccgccggguaccccgacuacuacugcaaguggcagggccugcccuacagcgagugcuccugggaggacggggcgcugaucagcaagaaguuccaggccugcaucgacgaguacuucucccggaaccagagcaagacgaccccguucaaggacugcaaggugcucaagcagcgcccccgguucguggcccugaagaagcagcccuccuacaucggcgggcacgagggccuggagcuccgcgacuaccagcugaacggccugaacuggcucgcccacagcuggugcaaggggaacuccugcauccuggccgacgagaugggccuggggaagaccauccagaccaucagcuuccucaacuaccuguuccacgagcaccagcuguacggccccuuccuccuggucgugccgcugagcacgcucaccuccuggcagcgggagauccagaccugggcgagccagaugaacgccguggucuaccugggggacaucaacucccgcaacaugauccgcacccacgaguggacgcaccaccagaccaagcggcugaaguucaacauccuccugaccaccuacgagauccugcucaaggacaaggccuuccugggcggccugaacugggccuucaucgggguggacgaggcccaccgccucaagaacgacgacagccugcuguacaagacgcucaucgacuucaaguccaaccaccggcugcugaucaccggcacgccccuccagaacagccugaaggagcuguggucccuccugcacuucaucaugcccgagaaguucagcuccugggaggacuucgaggaggagcacgggaagggccgcgaguacggcuacgcgagccugcacaaggagcucgagcccuuccugcugcggcgcgugaagaaggacgucgagaagucccugccggccaagguggagcagauccuccggauggagaugagcgcccugcagaagcaguacuacaaguggauccugacccgcaacuacaaggcccucuccaaggggagcaagggcuccacgagcggguuccugaacaucaugauggagcugaagaagugcugcaaccacugcuaccucaucaagccgcccgacaacaacgaguucuacaacaagcaggaggcccugcagcaccugauccgguccagcggcaagcucauccugcuggacaagcuccugauccgccugcgggagcgcgggaaccgggugcucaucuucucccagaugguccgcaugcuggacauccuggcggaguaccucaaguaccggcaguuccccuuccagcgccuggacggcagcaucaagggcgagcugcggaagcaggcccucgaccacuucaacgccgaggggagcgaggacuucugcuuccugcuguccacccgcgccggcgggcucggcaucaaccuggcgagcgccgacaccguggucaucuucgacuccgacuggaacccgcagaacgaccugcaggcccaggcccgggcccaccgcaucgggcagaagaagcaggucaacaucuaccgccucgugaccaagggcagcgucgaggaggacauccuggagcgggcgaagaagaagauggugcuggaccaccucgugauccagcgcauggacacgaccggcaagaccguccugcacaccggguccgcccccagcuccagcacgcccuucaacaaggaggagcuguccgccauccucaaguucggcgccgaggagcuguucaaggagcccgagggggaggagcaggagccgcaggagauggacaucgacgagauccugaagcgggccgagacccacgagaacgagcccggcccccucaccgugggggacgagcugcugagccaguucaagguggcgaacuucuccaacauggacgaggacgacaucgagcucgagccggagcgcaacagcaagaacugggaggagaucauccccgaggaccagcggcgccggcuggaggaggaggagcgccagaaggagcuggaggagaucuacaugcucccccggaugcgcaacugcgccaagcagaucuccuucaacggcagcgagggccggcgcucccggagccgccgguacuccgggagcgacuccgacagcaucagcgagggcaagcgccccaagaagcgggggcgcccgcggaccaucccccgcgagaacaucaagggcuucuccgacgccgagauccggcgcuucaucaagagcuacaagaaguucgggggcccccuggagcgccuggacgccaucgcccgggacgcggagcucgucgacaaguccgagaccgaccugcgccggcugggcgagcucgugcacaacgggugcaucaaggcccugaaggacagcuccagcggcacggagcgcaccgggggccggcugggcaaggugaaggggcccaccuuccgcaucuccggcguccaggugaacgccaagcucgugaucagccacgaggaggagcugaucccgcugcacaaguccauccccagcgaccccgaggagcggaagcaguacaccauccccugccacacgaaggccgcgcacuucgacaucgacugggggaaggaggacgacuccaaccuccugaucggcaucuacgaguacggguacggcagcugggagaugaucaagauggacccggaccugucccucacccacaagauccugcccgacgaccccgacaagaagccccaggccaagcagcugcagacccgcgccgacuaccucaucaagcugcugagccgggaccucgccaagaaggaggcccuguccggcgcggggagcuccaagcgccggaaggcccgcgccaagaagaacaaggccaugaaguccaucaaggucaaggaggagaucaaguccgacagcagcccgcugcccuccgagaaguccgacgaggacgacgacaaggacgagaucuccagcgugaagcaccccaacaagaagaucaagaccgagcgggacuccgaggagaagcccgagccggacguguacaucaagaaggagcccgaggagaagcgcgaggccaaggagaaggagaacaagaaggagcucaagcgggagaucaaggagaaggaggacaagaaggacaucaaggagaaggacuucaaggagaagcgcgagaacaaggucaaggaggcgauccagaaggagaaggacaucaaggaggagaagcugagcgaguccaagagcgacggccgggagcgcuccaagaaguccuccgugagcgacgcccccgugcacaucacggccuccggggagcccgucccgaucagcgaggaguccgaggagcuggaccagaagaccuucagcaucugcaaggagcggaugcgccccgugaaggccgcccucaagcagcuggaccgccccgagaagggccuguccgagcgggagcagcucgagcacacccgccagugccugaucaagaucggggaccacaucaccgagugccugaaggaguacacgaacccggagcagaucaagcaguggcggaagaaccucuggaucuucgugagcaaguucaccgaguucgacgcgcgcaagcugcacaagcuguacaagcacgccaucaagaagcggcaggagucccagcagaacagcgaccagaacagcaaccucaacccccacgucauccgcaaccccgacguggagcggcugaaggagaacaccaaccacgacgacuccagccgcgacuccuacagcuccgaccggcaccugacccaguaccacgaccaccacaaggaccgccaccagggcgacagcuacaagaaguccgacagccggaagcgccccuacuccagcuucuccaacggcaaggaccaccgggacugggaccacuacaagcaggacagccgcuacuacuccgaccgggagaagcaccgcaagcucgacgaccaccggagccgcgaccaccgguccaaccuggaggggagccugaaggaccgcucccacagcgaccaccggagccacuccgaccaccgccuccacagcgaccaccgcuccagcuccgaguacacgcaccacaagagcucccgggacuaccgcuaccacagcgacuggcagauggaccaccgggccuccagcuccggcccgcgcagcccccuggaccagcggucccccuacgggagccgcucccccuucgagcacagcguggagcacaaguccaccccggagcacaccuggagcucccggaagaccuga

SEQ ID NO: 28226 - RNA, 1506 nt, Artificial Sequence
  derived and/or modified sequence opt1 from CHD2__Homo_sapiens__NP_001036037
augaugcgcaacaaggacaagagccaggaggaggacuccagccugcacuccaacgccagcucccacagcgccuccgaggaggcgagcggcuccgacagcgggucccagagcgaguccgagcagggcagcgaccccggguccggccacgggagcgaguccaacagcuccagcgagagcuccgagagccaguccgagagcgaguccgagagcgccggcuccaagagccagccggugcuccccgaggccaaggagaagcccgccuccaagaaggagcggaucgccgacgucaagaagaugugggaggaguaccccgacguguacggcgugcgccggagcaaccgcucccggcaggagccgagccgcuucaacaucaaggaggaggcguccagcggguccgagagcggcucccccaagcggcgcgggcagcggcagcugaagaagcaggagaaguggaagcaggagcccagcgaggacgagcaggagcagggcaccuccgccgagagcgagcccgagcagaagaaggucaaggcccgccggccggugccccgccggaccgugcccaagccccgcgucaagaagcagccgaagacgcagcgggggaagcgcaagaagcaggacagcuccgacgaggacgacgacgacgacgaggcccccaagcggcagacccgccggcgcgcggccaagaacgugagcuacaaggaggacgacgacuucgagaccgacuccgacgaccugaucgagaugaccggcgagggcguggacgagcagcaggacaacagcgagacgaucgagaagguccucgacucccggcuggggaagaagggcgccaccggggccagcaccaccguguacgccaucgaggcgaacggcgaccccuccggcgacuucgacacggagaaggacgagggggagauccaguaccugaucaaguggaagggcuggagcuacauccacuccaccugggagagcgaggagucccuccagcagcagaaggugaaggggcugaagaagcuggagaacuucaagaagaaggaggacgagaucaagcaguggcucggcaaggucagccccgaggacguggaguacuucaacugccagcaggagcuggccuccgagcugaacaagcaguaccagaucguggagcgcgucaucgccgugaagaccagcaaguccacccucgggcagacggacuucccggcccacagccgcaagcccgcccccuccaacgagcccgaguaccugugcaaguggaugggccugccguacagcgagugcagcugggaggacgaggcgcucaucggcaagaaguuccagaacugcaucgacuccuuccacagccggaacaacuccaagaccauccccacccgcgagugcaaggcccugaagcagcggccccgcuucguggcccugaagaagcagcccgccuaccucgggggcgagaaccuggagcugcgggacuaccagcucgaggggcugaacuggcuggcccacagcuggugcaaguga

SEQ ID NO: 28227 - RNA, 6180 nt, Artificial Sequence
  derived and/or modified sequence opt1 from CHD3__Homo_sapiens__NP_001005271
auggccagcccccugcgcgacgaggaggaggaggaggaggagaugguggucuccgaggaggaggaggaggaggaggaggagggcgacgaggaggaggaggaggagguggaggccgcggacgaggacgacgaggaggacgacgacgagggggugcucggccgggggccgggccacgaccgcgggcgggaccgccacagcccccccggcugccaccuguuccccccgcccccccccccgccccccccccugccgcccccccccccgcccccccccccggacaaggacgacauccggcuccugcccuccgcccugggcgucaagaagcgcaagcgggggcccaagaagcagaaggagaacaagcccggcaagccgcgcaagcggaagaagcgcgacagcgaggaggaguucggguccgagcgggacgaguaccgcgagaagagcgaguccggcgggagcgaguacggcaccggccccgggcggaagcgccggcgcaagcaccgggagaagaaggagaagaagaccaagcgccggaagaagggcgagggggacggcggccagaagcagguggagcagaaguccagcgccacgcuccugcugaccugggggcucgaggacguggagcacgucuucuccgaggaggacuaccacacccugaccaacuacaaggccuucagccaguucaugcgcccccugaucgccaagaagaaccccaagaucccgauguccaagaugaugacgauccucggcgcgaaguggcgggaguucagcgccaacaaccccuucaagggguccgccgccgcgguggccgccgccgccgcggccgccgccgccgcgguggccgagcaggucagcgccgccguguccagcgccacccccaucgcgccguccggcccccccgcccugcccccgccccccgccgccgacauccagcccccgcccauccgccgcgccaagaccaaggaggggaagggccccggccacaagcggcgcagcaagagcccccgggugccggacgggcgcaagaagcugcggggcaagaagauggcgccccucaagaucaagcuggggcugcucggcgggaagcgcaagaagggcggcuccuacgucuuccagagcgacgaggggcccgagcccgaggccgaggaguccgaccuggacagcggcuccgugcacagcgccuccgggcggccggacggccccgugcgcaccaagaagcugaagcgggggcgccccggccggaagaagaagaagguccucggcugccccgccguggcgggggaggaggagguggacggcuacgagacggaccaccaggacuacugcgaggucugccagcaggggggcgagaucauccugugcgacaccugcccgcgcgccuaccaccuggugugccucgaccccgagcuggaccgggcccccgagggcaaguggagcugcccccacugcgagaaggagggggugcagugggaggccaaggaggaggaggaggaguacgaggaggagggcgaggaggagggggagaaggaggaggaggacgaccacauggaguacugccgcgucugcaaggacggcggggagcugcucugcugcgacgccugcaucuccagcuaccacauccacugccugaacccgccccugcccgacaucccgaacggcgaguggcucugcccccggugcaccugccccgugcugaagggccgcgugcagaagauccugcacuggcgguggggggagcccccggucgcggugcccgccccccagcaggccgacggcaaccccgacgucccgcccccccgcccccuccaggggcgguccgagcgcgaguucuucgugaagugggugggccugagcuacuggcacugcuccugggccaaggagcugcagcucgagaucuuccaccuggucauguaccgcaacuaccagcggaagaacgacauggacgagccgcccccccuggacuacgggagcggcgaggacgacggcaaguccgacaagcgcaaggugaaggacccccacuacgccgagauggaggagaaguacuaccgguucgggaucaagccggaguggaugaccgugcaccgcaucaucaaccacagcgucgacaagaagggcaacuaccacuaccucgugaaguggcgggaccugcccuacgaccaguccacgugggaggaggacgagaugaacauccccgaguacgaggagcacaagcagagcuacuggcgccaccgggagcugaucaugggggaggaccccgcgcagccgcgcaaguacaagaagaagaagaaggagcuccagggcgacgggccccccuccagccccaccaacgacccgaccgugaaguacgagacccagccccgguucaucacggccaccggcggcacccugcacauguaccagcuggaggggcucaacuggcugcgcuucagcugggcccagggcaccgacacgauccuggccgacgagauggggcucggcaagaccauccagaccaucgucuuccuguacucccuguacaaggaggggcacaccaagggccccuuccuggugagcgccccccucuccacgaucaucaacugggagcgggaguuccagaugugggcgccgaaguucuacguggucaccuacaccggcgacaaggacagccgcgccaucauccgggagaacgaguucuccuucgaggacaacgccaucaaggggggcaagaaggccuucaagaugaagcgcgaggcgcaggugaaguuccacgugcugcugaccagcuacgagcucaucacgaucgaccaggccgcccugggguccauccggugggccugccuggucguggacgaggcccaccgccucaagaacaaccagagcaaguucuuccgggugcugaacggcuacaagaucgaccacaagcugcuccugaccggcaccccccugcagaacaaccucgaggagcuguuccaccugcucaacuuccugacccccgagcgcuucaacaaccuggagggguuccucgaggaguucgcggacaucuccaaggaggaccagaucaagaagcugcacgaccugcucggcccgcacaugcugcggcgccugaaggccgacgucuucaagaacaugcccgccaagacggagcucaucgugcggguggagcugagccccaugcagaagaaguacuacaaguacauccugacccgcaacuucgaggcccucaacucccgcgggggcgggaaccaggucagccugcugaacaucaugauggaccucaagaagugcugcaaccaccccuaccuguucccgguggccgcgauggagucccccaagcugcccagcggcgccuacgagggcggggcccucaucaaguccagcggcaagcugaugcugcuccagaagaugcugcggaagcugaaggagcaggggcaccgcgugcucaucuucucccagaugaccaagaugcuggaccugcucgaggacuuccuggacuacgagggcuacaaguacgagcggaucgacgggggcaucaccggcgcccugcgccaggaggccaucgaccgguucaacgcgcccggggcccagcaguucugcuuccuccugagcacgcgcgccggcgggcugggcaucaaccucgccaccgcggacaccgucaucaucuucgacagcgacuggaacccgcacaacgacauccaggccuucucccgggcccaccgcaucgggcaggccaacaaggugaugaucuaccgguucgugacccgcgccagcgucgaggagcggaucacccagguggcgaagcgcaagaugaugcugacgcaccuggugguccggcccggccucggcuccaaggccgggagcauguccaagcaggagcuggacgacauccugaaguucggcaccgaggagcucuucaaggacgagaacgagggggagaacaaggaggaggacagcuccgugauccacuacgacaacgaggccaucgcccgccugcuggaccggaaccaggacgccaccgaggacaccgacgugcagaacaugaacgaguaccucagcuccuucaaggucgcgcaguacguggugcgcgaggaggacaagaucgaggagaucgagcgggagaucaucaagcaggaggagaacgucgaccccgacuacugggagaagcugcugcgccaccacuacgagcagcagcaggaggaccucgcccggaaccugggcaagggcaagcgcgugcgcaagcaggugaacuacaacgacgccgcccaggaggaccaggacaaccagagcgaguacuccgucgggagcgaggaggaggacgaggacuucgacgagcggcccgagggccgccggcaguccaagcgccagcugcggaacgagaaggacaagccgcuccccccccugcuggcccgcguggggggcaacaucgaggugcucggguucaacacgcggcagcgcaaggcguuccugaacgccgucaugcgguggggcaugcccccgcaggacgccuucaccacccaguggcuggugcgcgaccuccggggcaagaccgagaaggaguucaaggccuacgugagccuguucaugcgccaccugugcgagcccggggccgacggcuccgagacguucgcggacggggucccccgggagggccucagccgccagcaggugcugacccggaucggggugaugucccuggucaagaagaaggugcaggaguucgagcacaucaacggccgcuggagcaugcccgagcucaugccggaccccuccgccgacagcaagcggagcucccgcgccagcucccccaccaagaccagccccacgaccccggaggccuccgcgaccaacagccccugcaccuccaagcccgccacgcccgccccgagcgagaagggcgaggggauccggaccccccuggagaaggaggaggccgagaaccaggaggagaagcccgagaagaacucccgcaucggcgagaagauggagaccgaggccgacgcgccgagccccgcccccucccugggggagcggcucgagccccgcaagaucccgcuggaggacgaggugcccggcguccccggggagauggagcccgagccgggcuaccgcggcgaccgggagaagagcgccaccgaguccacgcccggggagcgcggcgaggagaagccccuggacgggcaggagcaccgggagcgccccgagggcgagaccggggaccucggcaagcgggaggacgugaagggcgaccgcgagcugcggccggggccccgcgacgagccccggagcaacggccgccgggaggagaagaccgagaagccccgcuucauguucaacaucgccgacgggggcuucaccgagcugcacacgcucuggcagaacgaggagcgggccgcgaucuccagcggcaagcugaacgagaucuggcaccgccggcacgacuacuggcugcucgccgggaucguccugcacggcuacgcccgcuggcaggacauccagaacgacgcccaguucgccaucaucaacgagccguucaagaccgaggcgaacaaggggaacuuccuggagaugaagaacaaguuccucgcccggcgcuucaagcugcuggagcaggcccucgugaucgaggagcagcugcggcgcgccgcguaccugaaccugucccaggagcccgcccaccccgccauggcccuccacgcccgcuucgcggaggccgagugccuggccgagagccaccagcaccuguccaaggagagccucgccggcaacaagcccgccaacgcggugcugcacaagguccugaaccagcucgaggagcugcugagcgacaugaaggccgacgugacccggcucccggccacccugucccgcaucccccccaucgccgcccggcugcagaugagcgagcgcuccauccucagccggcuggcguccaaggggacggagccccacccgacccccgccuaccccccgggccccuacgccaccccccccggcuacggggccgcguucagcgccgccccggugggcgcccuggccgcggccggggccaacuacucccagaugcccgccggcagcuucaucaccgccgcgacgaacgggccccccguccucgugaagaaggagaaggagauggugggcgcccuggucuccgacggccuggaccgcaaggagccgcgggccggggaggugaucugcaucgacgacuga

SEQ ID NO: 28228 - RNA, 5718 nt, Artificial Sequence
  derived and/or modified sequence opt1 from CHD4__Homo_sapiens__NP_001284482
auggccagcggccuggggagccccagccccugcuccgccggcagcgaggaggaggacauggacgcccuccugaacaacucccugccgccgccccaccccgagaacgaggaggaccccgaggaggaccucagcgagaccgagacccccaagcugaagaagaagaagaagcccaagaagccccgcgaccccaagauccccaaguccaagcggcagaagaaggagcugggggacagcuccggcgaggggcccgaguucguggaggaggaggaggaggucgcccuccgcagcgacuccgagggcagcgacuacacccccggcaagaagaagaagaagaagcuggggcccaagaaggagaagaaguccaagagcaagcggaaggaggaggaggaggaggaggacgacgacgacgacuccaaggagcccaagagcuccgcccagcugcucgaggacuggggcauggaggacaucgaccacguguucagcgaggaggacuaccgcacccugaccaacuacaaggccuucucccaguucgugcggccccugaucgccgccaagaaccccaagaucgccgucagcaagaugaugauggugcucggggccaaguggcgcgaguucagcaccaacaaccccuucaagggcuccagcggggccuccguggccgccgccgccgccgcggccgucgccgugguggagagcauggucaccgccaccgagguggcgccgccgccgccgcccguggagguccccauccggaaggcgaagaccaaggagggcaagggccccaacgcccgccggaagcccaaggggagcccccgcgugcccgacgccaagaagcccaagcccaagaagguggcgccccugaagaucaagcugggcggguucggcagcaagcggaagcgcuccagcuccgaggacgacgaccucgacgucgagagcgacuucgacgacgccuccaucaacagcuacuccgugagcgacggcuccaccagccgguccagccgcucccggaagaagcugcgcaccaccaagaagaagaagaagggggaggaggaggugaccgcggucgacggcuacgagaccgaccaccaggacuacugcgaggugugccagcagggcggggagaucauccugugcgacacgugcccccgggccuaccacauggugugccucgaccccgacauggagaaggcccccgaggggaaguggagcugcccccacugcgagaaggagggcauccagugggaggccaaggaggacaacagcgagggcgaggagauccuggaggaggucgggggcgaccuggaggaggaggacgaccaccacauggaguucugccgcgugugcaaggacgggggcgagcuccugugcugcgacacgugccccuccagcuaccacauccacugccugaacccgccccuccccgagaucccgaacggggaguggcugugcccccggugcacgugccccgcccugaagggcaaggugcagaagauccucaucuggaaguggggccagcccccgucccccacccccgucccccgcccgcccgacgcggaccccaacacccccagcccgaagccccuggaggggcggcccgagcgccaguucuucgugaaguggcagggcauguccuacuggcacugcagcugggucuccgagcugcagcucgagcugcacugccaggugauguuccgcaacuaccagcggaagaacgacauggacgagcccccgagcggggacuucggcggggacgaggagaagucccgcaagcggaagaacaaggaccccaaguucgccgagauggaggagcgcuucuaccgguacggcaucaagcccgaguggaugaugauccaccgcauccugaaccacagcguggacaagaagggccacguccacuaccucaucaaguggcgggaccugccguacgaccaggccuccugggagagcgaggacguggagauccaggacuacgaccuguucaagcaguccuacuggaaccaccgcgagcucaugcgcggggaggagggccgccccgggaagaagcugaagaaggugaagcugcggaagcucgagcggccgcccgagaccccgaccgucgaccccaccgugaaguacgagcggcagcccgaguaccuggacgccacgggcggcacccugcaccccuaccagauggaggggcucaacuggcugcgcuucagcugggcgcagggcaccgacaccauccuggccgacgagauggggcucggcaagacggugcagaccgccgucuuccuguacucccuguacaaggaggggcacagcaagggcccguuccucguguccgcgccccugagcaccaucaucaacugggagcgggaguucgagaugugggcccccgacauguacguggucaccuacgugggcgacaaggacagccgcgcgaucauccgggagaacgaguucuccuucgaggacaacgccauccgcgggggcaagaaggccagccggaugaagaaggaggccuccgugaaguuccacguccugcugacgagcuacgagcucaucaccaucgacauggccauccugggguccaucgacugggcgugccugaucguggacgaggcccaccgccucaagaacaaccagagcaaguucuuccgcgugcugaacggcuacucccugcagcacaagcuccugcugaccgggacgccccuccagaacaaccuggaggagcuguuccaccuccugaacuuccugacgccggagcgguuccacaaccucgagggcuuccuggaggaguucgccgacaucgccaaggaggaccagaucaagaagcugcacgacaugcucggcccccacaugcugcgccggcugaaggccgacgucuucaagaacaugcccagcaagaccgagcucaucgugcgcguggagcugucccccaugcagaagaaguacuacaaguacauccugacccggaacuucgaggcgcucaacgcccgcgggggcgggaaccaggucagccugcugaacguggugauggaccucaagaagugcugcaaccacccguaccuguuccccgucgccgccauggaggcgcccaagaugcccaacggcauguacgacggguccgcccugauccgggccagcggcaagcuccugcugcuccagaagaugcugaagaaccugaaggagggcgggcaccgcgugcucaucuucucccagaugaccaagaugcuggaccugcucgaggacuuccuggagcacgagggcuacaaguacgagcggaucgacgggggcaucacggggaacaugcgccaggaggccaucgaccgguucaacgccccgggcgcgcagcaguucugcuuccugcucagcacccgcgccggcgggcugggcaucaaccuggccaccgccgacaccgugaucaucuacgacuccgacuggaacccccacaacgacauccaggccuucagccgggcgcaccgcaucgggcagaacaagaaggucaugaucuaccgguucgugacccgcgccuccguggaggagcggaucacgcaggucgccaagaagaagaugaugcucacccaccugguggugcgccccggccugggcagcaagaccggguccaugagcaagcaggagcucgacgacauccugaaguucggcaccgaggagcuguucaaggacgaggccacggacgggggcggggacaacaaggagggcgaggacagcuccgucauccacuacgacgacaaggccaucgagcggcuccuggaccgcaaccaggacgagaccgaggacaccgagcugcagggcaugaacgaguaccucagcuccuucaagguggcgcaguacgugguccgggaggaggagaugggggaggaggaggagguggagcgcgagaucaucaagcaggaggagagcguggaccccgacuacugggagaagcugcugcgccaccacuacgagcagcagcaggaggaccucgcccggaaccugggcaaggggaagcgcauccggaagcaggucaacuacaacgacggcucccaggaggaccgcgacuggcaggacgaccagagcgacaaccaguccgacuacagcguggccuccgaggagggggacgaggacuucgacgagcggagcgaggccccgcgccggcccucccgcaagggccugcggaacgacaaggacaagccccucccgccccugcuggcgcgcgugggcgggaacaucgagguccucggcuucaacgcccggcagcgcaaggccuuccugaacgccaucaugcgguacgggaugccgccccaggacgccuucaccacgcaguggcuggugcgcgaccuccggggcaagagcgagaaggaguucaaggcguacgugucccuguucaugcgccaccugugcgagcccggggccgacggcgccgagaccuucgccgacggcgucccccgggaggggcucagccgccagcacgugcugacccggaucggcgugaugucccugauccgcaagaagguccaggaguucgagcacgugaacgggcgcuggagcaugcccgagcucgccgagguggaggagaacaagaagaugucccagcccggcagcccgucccccaagacccccacgcccagcaccccgggcgacacccagcccaacacccccgcgcccgucccgcccgccgaggacgggaucaagaucgaggagaacagccugaaggaggaggaguccaucgagggcgagaaggaggugaaguccacggcccccgagaccgccaucgagugcacccaggcccccgcgccggccuccgaggacgagaaggucgugguggagccgcccgagggggaggagaaggucgagaaggccgaggugaaggagcggaccgaggagcccauggagacggagccgaagggcgccgccgacguggagaaggucgaggagaaguccgcgaucgaccugacccccaucgugguggaggacaaggaggagaagaaggaggaggaggagaagaaggaggucaugcuccagaacggggagacccccaaggaccugaacgacgagaagcagaagaagaacaucaagcagcgcuucauguucaacaucgccgacggcggcuucaccgagcugcacucccucuggcagaacgaggagcgggccgccacggugaccaagaagaccuacgagaucuggcaccgccggcacgacuacuggcugcuggcggggaucaucaaccacggcuacgcccgcuggcaggacauccagaacgacccccgguacgccauccucaacgagccguucaagggggagaugaaccgcggcaacuuccuggagaucaagaacaaguuccuggcccggcgcuucaagcuccuggagcaggcccuggugaucgaggagcagcuccggcgcgcggccuaccugaacaugagcgaggaccccucccaccccagcauggcccugaacacccgguucgccgaggucgagugccucgccgagucccaccagcaccugagcaaggaguccauggcggggaacaagcccgccaacgccgugcugcacaaggugcucaagcagcuggaggagcugcugagcgacaugaaggccgacgucacgcgccucccggccaccaucgcgcggaucccgcccguggccgugcgccugcagauguccgagcggaacauccugagccgccucgccaaccgggccccggagcccacgccccagcaggucgcgcagcagcaguga

SEQ ID NO: 28229 - RNA, 8148 nt, Artificial Sequence
  derived and/or modified sequence opt1 from CHD6__Homo_sapiens__NP_115597
augaagaugaagauccagaagaaggagaagcagcugagcaaccucaaggugcugaaccacagccccaugagcgacgccuccgucaacuucgacuacaagagccccucccccuucgacugcagcaccgaccaggaggagaagaucgaggacguggccucccacugccugccccagaaggaccucuacaccgccgaggaggaggccgccacccuguucccccggaagaugaccagccacaacggcauggaggacuccgggggcgggggcaccggggugaagaagaagcggaagaagaaggagcccggcgaccaggagggcgccgccaaggggagcaaggaccgcgagcccaagcccaagcggaagcgcgagcccaaggagccgaaggagccccggaaggccaaggagcccaagaaggccaaggagcacaaggagcccaagcagaaggacggcgccaagaaggcccgcaagccgcgggaggccuccgggaccaaggaggccaaggagaagcgcagcugcacggacuccgccgcccggaccaagagccgcaaggccuccaaggagcagggccccacccccgucgagaagaagaagaaggggaagcgcaagagcgagaccacgguggagucccuggagcucgaccagggccugaccaaccccagccugcgguccccggaggagagcaccgagagcaccgacucccagaagcggcgcagcggccgccaggugaagcgccggaaguacaacgaggaccucgacuucaaggucguggacgacgacggggagacgaucgcggugcugggcgccgggcgcaccuccgcccugagcgccuccacccucgccuggcaggcggaggagccgcccgaggacgacgccaacaucaucgagaagauccuggccagcaagaccguccaggaggugcaccccggcgagccgcccuucgaccuggagcuguucuacgugaaguaccggaacuucuccuaccugcacugcaagugggccacgauggaggagcuggagaaggacccccgcaucgcccagaagaucaagcgguuccgcaacaagcaggcgcagaugaagcacaucuucaccgagcccgacgaggaccucuucaacccggacuacgucgagguggaccgcauccuggagguggcccacaccaaggacgccgagaccggcgaggaggucacgcacuaccuggugaaguggugcagccuccccuacgaggaguccaccugggagcuggaggaggacguggaccccgccaaggucaaggaguucgagagccuccaggugcuccccgagaucaagcacguggagcggccggccuccgacagcuggcagaagcuggagaagucccgcgaguacaagaacagcaaccagcugcgggaguaccagcucgaggggaugaacuggcugcuguucaacugguacaaccgcaagaacugcauccucgcggacgagaugggccuggggaagaccauccaguccaucaccuuccugagcgagaucuuccuccggggcauccacgggcccuuccugaucaucgcgccccucuccacgaucaccaacugggagcgcgaguuccggaccuggaccgagaugaacgccaucgucuaccacggcagccagaucucccgccagaugauccagcaguacgagaugguguaccgggacgcccagggcaacccgcucagcgggguguucaaguuccacgucgugaucacgaccuucgagaugauccuggcggacugccccgagcugaagaagauccacuggagcugcgucaucaucgacgaggcccaccgccucaagaaccggaacugcaagcugcuggagggccucaagcugauggcccuggagcacaaggugcuccugaccgggacgccccugcagaacuccguggaggagcuguucagccugcugaacuuccuggagcccucccaguucccgagcgagacggccuuccucgaggaguucggcgaccugaagaccgaggagcaggucaagaagcugcaguccauccucaagcccaugaugcugcgccggcugaaggacgacguggagaagaaccucgcccccaagcaggagaccaucaucgagguggagcugaccaacauccagaagaaguacuaccgcgcgauccuggagaagaacuucagcuuccucacgaagggggccaaccagcacaacaugcccaaccugaucaacaccaugauggagcugcggaagugcugcaaccacccguaccucaucaacggcgccgaggagaagauccuggaggacuuccgcaagacccacucccccgacgcccccgacuuccagcugcaggccaugauccaggcggccggcaagcucguccugaucgacaagcugcuccccaagcugaucgccgggggccacaaggugcugaucuucagccagauggugcggugccucgacauccuggaggacuaccugauccagcgccgguacaccuacgagcgcaucgacgggcgcguccggggcaaccuccgccaggccgccaucgaccgguucugcaagccggacuccgaccgcuucguguuccugcugugcacccgggcgggcgggcucgggaucaaccugacggccgccgacacgugcaucaucuucgacagcgacuggaacccccagaacgaccugcaggcccaggcgcgcugccaccggaucgggcaguccaaggccgugaaggucuaccgccucaucacccggaacagcuacgagcgcgagauguucgacaaggccucccugaagcugggccucgacaaggccgugcugcaggacaucaaccggaagggcggcaccaacggcgugcagcagcugagcaagauggaggucgaggaccuccugcgcaagggggccuacggcgcgcugauggacgaggaggacgagggguccaaguucugcgaggaggacaucgaccagauccuccagcggcgcacgcacaccaucaccauccagagcgagggcaagggguccaccuucgccaaggccagcuucguggccagcggcaaccggacggacaucucccuggacgaccccaacuucuggcagaagugggccaagaucgcggagcuggacaccgaggccaagaacgagaaggagagccucgugaucgaccgcccccggguccgcaagcagaccaagcacuacaacuccuucgaggaggacgagcugauggaguucagcgagcuggacuccgacagcgacgagcggccgacccgcucccggcgccucaacgacaaggcccgccgguaccugcgcgccgagugcuuccggguggagaagaaccugcucaucuucggcugggggcgcuggaaggacauccugacgcacggccgguucaaguggcaccugaacgagaaggacauggagaugaucugccgcgcccuccugguguacugcgucaagcacuacaagggggacgagaagaucaagagcuucaucugggagcugaucacccccaccaaggacggccaggcgcagacccuccagaaccacuccgggcugagcgcccccgugccccggggccgcaagggcaagaagacgaagaaccagcugcucaucccggagcugaaggacgccgacuggcuggcgaccugcaaccccgaggugguccuccacgacgacggguacaagaagcaccugaagcagcacugcaacaaggugcugcuccgggugcgcaugcuguacuaccugaaggcggagauccucggcgaggccgccgagaaggccuucgaggggucccccgcccgggagcuggacgucccccugccggacaucgacuacauggagauccccguggacuggugggacgcggaggccgacaagagccuccugaucggcguguucaagcacggguacgagcgcuacaacgccaugcgggccgaccccgcccugugcuuccucgagaaggucggcaugccggacgagaagucccugagcgcggagcagggcgugaccgacgggaccuccgacauccccgagcgcggcaacacggacaaggaggacaacgccgaggacaagguggacgggcugcagaagcagaccgagagcuccagcgacggcggggacggcgucuucuccgagaagaaggacgacagccgggccgcccaggacggcagcgaccccgacaagucccccuggccggugagcuccgcccucaccgcgcgccugcggcgccuggugaccgucuaccagcggugcaaccgcaaggagcucugccgccccgagauccuggggcccggcaaccagggguacugggugcaggaggagauguuccggcgcacgagcgagauggaccugaucaacaaggaggcccagaagcgguggacccgccgggagcaggccgacuucuaccgcaccguguccagcuucggcgucguguacgaccaggagaagaagaccuucgacuggacgcaguuccggaucaucucccgccucgacaagaaguccgacgagucccuggagcaguacuucuacagcuucguggccaugugccggaacgucugccgccugcccaccuggaaggacggcgggccgcccgacaccaccaucuacguggagcccaucacggaggagcgggccgcgcgcacccucuaccggaucgagcugcugcgcaaggugcgggagcagguccucaagugcccccagcugcacgagcgccugcagcucugccggccgucccuguaccugcccguguggugggagugcggcaagcacgaccgcgaccuccugaucgggaccgccaagcacggccugaaccggaccgacugcuacaucaugaacgacccccagcugagcuuccucgacgccuaccgcaacuacgcccagcacaagcgguccgggacgcaggcgcccggcaaccugugcugccuguaccagaccaacagcaagcucuacgagucccugaccuacagccagaugucccgcaccagcgagucccuggagaacgagccggagaaccucgugcgcgucgagagccgggacgaccaccugagccugcccgacgugaccugcgagaacuucaucuccaaggugcaggacgucaucagcaucaaccacgacgagucccuccugcccgagagccuggaguccaugauguacggcaagaaggugcucagccaggagcccuccagcuuccaggaguccccgagcacgaacaccgagucccgcaaggacgucaucaccaucagcaucuccaaggacgggaacugccagagcggcgggcccgaggccgagaucgccuccggccccaccuucauggggagccuggaggccggcggcguggcccaggcgaacaucaagaacgggaagcaccuccugauguccaucagcaaggagggcgagcugugcugcuccgaggccgggcagcggcccgagaacaucggccagcuggaggccaagugccucgccagcccgagccugaaccccgggaacgaguccggcuucguggacaugugcagccuguccgucugcgacagcaagcgcaaccucuccagcgaccagcagcugaucgaccugcucgagaacaagucccuggagagcaagcugauccucucccagaaccacagcgacgaggaggaggaggaggaggagaacgaggaggagaaccuggccauggcggugggcaugggggagcggcccgaggugcugcaccucacggagcccaccaccaacaucucccgcgagaagaaccagggcuuccaggacgagaccaagaaggggagccuggaggucgccaaccagacgccgggccugcagcgggccuuccccgcccccgccgcgugccagugccacugcaagcacauggagcgcuggaugcacggccucgagaacgacgaguucgagaucgagaagccgaaggccuacauccccgaccuguucaaguccaagaccaacaccaucgccauggagggggagcccaccgccauccccagccagccguucaaggugaagcacgagcugcucaaggagcccuggaaggaguccgcggagggccagaacguguuccccacguacccccuggaggggagcgagcugaaguccgaggacauggacuucgagaacaaggacgacuacgaccgggacggcaacugccacagccaggacuacccggggaaguacuccgaggaggagagcaagagcuccaccagcggcaucaccggcgacaucggggacgagcuccaggaggcccgcgcccccaccaucgcccagcugcugcaggagaagacgcucuacuccuucagcgaguggcccaaggaccgggucaucaucaaccgccuggacaacaucugccacguggugcugaagggcaaguggcccuccagccagcaguacgagccguccgggacccuccccacccccguccugaccagcuccgccggcagccggacgucccugagcgagcccgaggcggccgagcacuccuucagcaacggggccgcccucgccgcgcagauccacaaggaguccuuccuggccccgguguucaccaaggacgagcagaagcaccgccggcccuacgaguucgagguggagcgcgacgccaaggcccggggccuggagcaguucagcgccacccacggccacacccccaucauccucaacggguggcacggcgaguccgcgauggaccugagcugcuccagcgaggggagccccggcgccacguccccguuccccgucagcgccuccacccccaagaucggggccaucagcucccugcagggcgcgcucggcauggaccugagcgggauccugcaggccggccucauccaccccgugaccgggcagaucgugaacggcucccugcgccgggacgacgccgccacccgccgccggcgcgggcggcgcaagcacgucgagggcggcauggaccugaucuuccucaaggagcagacgcugcaggccgggauccuggaggugcacgaggacccgggccaggcgacccucagcaccacccaccccgaggggcccggccccgccacguccgccccggagcccgccaccgccgcgagcucccaggccgagaaguccauccccuccaagagccugcuggacuggcuccggcagcaggccgacuacucccuggaggugccgggcuucggggccaacuucagcgacaagcccaagcagcgccggccccgcugcaaggagcccggcaagcuggacgucuccagccucagcggggaggagcgggugccggccauccccaaggagcccggccugcgcggguuccugcccgagaacaaguucaaccacacccucgcggagccgauccugcgggacaccggcccccgccggcgcggccggcgcccccgguccgagcugcucaaggcccccagcaucguggccgacuccccgagcgggaugggcccccuguucaugaacgggcugaucgccggcauggaccucgucgggcugcagaacaugcgcaacaugcccggcaucccccugacgggccucgugggguucccggccggcuucgcgaccaugcccaccggggaggaggugaaguccacccugagcaugcugcccaugaugcuccccggcauggccgccgucccgcagauguucggggugggcggccugcugagcccgcccauggccaccacgugcaccagcaccgcgcccgccucccucagcuccaccaccaagagcgggaccgccgugaccgagaagaccgccgaggacaagccguccagccacgacgucaagacggacacccuggccgaggacaagcccggccccgggccguucuccgaccagagcgagcccgcgaucaccaccuccagccccguggccuucaaccccuuccugaucccgggcgugucccccgggcucaucuaccccagcauguuccugagccccggcaugggcauggcccugccggccaugcagcaggcccggcacuccgagaucgucgggcucgagagccagaagcgcaagaagaagaagacgaagggcgacaaccccaacucccaccccgagcccgcgccgagcugcgagcgggagcccuccggggacgagaacugcgccgagcccagcgcgccccugccggccgagcgcgagcacggcgcccaggcgggcgagggggcccugaaggacuccaacaacgacaccaacuga

SEQ ID NO: 28230 - RNA, 8994 nt, Artificial Sequence
  derived and/or modified sequence opt1 from CHD7__Homo_sapiens__NP_060250
auggccgaccccggcaugaugagccuguucggggaggacggcaacaucuucagcgaggggcucgagggccugggggagugcggcuaccccgagaaccccgugaaccccaugggccagcagaugcccaucgaccagggguucgccagccugcagcccucccuccaccaccccagcaccaaccagaaccagaccaagcugacccacuucgaccacuacaaccaguacgagcagcagaagaugcaccugauggaccagcccaaccgcaugauguccaacacccccggcaacgggcucgccagcccccacucccaguaccacacgccgcccgugccccaggugccccacggcgggagcggcggcgggcagaugggcguguaccccgggaugcagaacgagcggcacggccaguccuucgucgacagcuccagcauguggggcccccgcgccguccaggugcccgaccagauccgggcccccuaccagcagcagcagccccagccccagccgccccagcccgcccccuccgggccgcccgcccagggccacccccagcacaugcagcagauggggagcuacauggcgcgcggcgacuucuccaugcagcagcacgggcagccccagcagcggaugagccaguucucccagggccaggagggccugaaccaggggaaccccuucaucgccaccagcggccccgggcaccugucccacgucccccagcagagccccagcauggcccccucccuccgccacagcgugcagcaguuccaccaccaccccuccaccgcccugcacggcgagagcguggcgcacagcccccgcuucagccccaacccgccccagcagggggccguccgcccccagacccugaacuucuccagccggucccagaccgugcccagccccaccaucaacaacuccggccaguacagccgcuaccccuacuccaaccucaaccagggccuggugaacaacacggggaugaaccagaaccugggccucaccaacaacacccccaugaaccagagcgucccccgguacccgaacgccgugggguuccccuccaacagcggccaggggcugaugcaccagcagcccauccaccccuccggcagccugaaccagaugaacacccagaccaugcacccgucccagccccagggcaccuacgccuccccgccgcccaugagccccaugaaggccauguccaaccccgcggggacgcccccgccccaggugcgccccggcagcgccgggauccccauggaggucggcuccuaccccaacaugccccacccccagcccagccaccagccgcccggcgccauggggaucggccagcggaacauggggccccgcaacaugcagcagucccggccguucaucggcaugagcuccgcgccccgggagcucaccgggcacaugcggcccaacggcugccccggcguggggcugggcgacccgcaggccauccaggagcgccugauccccgggcagcagcaccccggccagcagcccagcuuccagcagcucccgaccugcccgccccuccagccccacccggggcugcaccaccaguccuccccgccccacccccaccaccagccgugggcgcagcuccaccccagcccccagaacacgccccagaaggugccgguccaccagcacagccccuccgagcccuuccuggagaagccggugcccgacaugacccaggugagcggccccaacgcccagcuggucaaguccgacgacuaccuccccagcaucgagcagcagccgcagcagaagaagaagaagaagaagaacaaccacaucguggccgaggaccccuccaagggcuucgggaaggacgacuuccccggcgggguggacaaccaggagcugaaccggaacagccuggacggcagccaggaggagaagaagaagaagaagcgcuccaaggccaagaaggaccccaaggagccgaaggagcccaaggagaagaaggagcccaaggagcccaagaccccgaaggcccccaagauccccaaggagcccaaggagaagaaggcgaagaccgccaccccgaagcccaagagcuccaagaaguccuccaacaagaagcccgacagcgaggccuccgcccucaagaagaaggucaacaaggggaagaccgagggcagcgagaacuccgaccuggacaagacgcccccgcccagcccgccgcccgaggaggacgaggaccccggcgugcagaagcggcgcuccucccgccaggucaagcggaagcgcuacaccgaggaccuggaguucaagaucuccgacgaggaggccgacgacgcggacgccgccgggcgggacagccccuccaacaccagccaguccgagcagcaggagagcguggacgccgagggccccguggucgagaagaucauguccagccgcagcgugaagaagcagaaggaguccggggaggagguggagaucgaggaguucuacgucaaguacaagaacuucagcuaccuccacugccagugggcguccaucgaggaccuggagaaggacaagcggauccagcagaagaucaagcgcuucaaggccaagcagggccagaacaaguuccugagcgagaucgaggacgagcuguucaaccccgacuacguggagguggaccggaucauggacuucgcccgcuccaccgacgaccgcggggagcccgucacccacuaccuggugaaguggugcagccugcccuacgaggacuccaccugggagcgccggcaggacaucgaccaggccaagaucgaggaguucgagaagcucaugagccgcgagcccgagaccgagcggguggagcggccgcccgccgacgacuggaagaaguccgagagcucccgggaguacaagaacaacaacaagcugcgcgaguaccagcuggagggcgucaacuggcuccuguucaacugguacaacaugcggaacugcauccuggcggacgagaugggccucgggaagaccauccagagcaucaccuuccuguacgagaucuaccugaagggcauccacgggcccuuccucgugaucgccccgcuguccaccauccccaacugggagcgcgaguuccggaccuggaccgagcugaacguggucguguaccacggcagccaggccucccgccgcaccauccagcuguacgagauguacuucaaggacccccagggccgggugaucaaggggagcuacaaguuccacgccaucaucacgaccuucgagaugauccucaccgacugccccgagcugcgcaacaucccguggcggugcgucgugaucgacgaggcccaccgccugaagaaccggaacugcaagcuccuggagggccugaagaugauggaccucgagcacaaggugcugcugaccgggacgccccugcagaacacggucgaggagcuguucucccugcuccacuuccuggagcccagccgcuuccccuccgagaccaccuucaugcaggaguucggcgaccugaagaccgaggagcagguccagaagcuccaggcgauccugaagccgaugaugcugcggcgccucaaggaggacguggagaagaaccuggcccccaaggaggagacgaucaucgagguggagcugaccaacauccagaagaaguacuaccgggccauccucgagaagaacuucaccuuccugagcaagggcgggggccaggccaacgugcccaaccugcucaacaccaugauggagcugcgcaagugcugcaaccaccccuaccugaucaacggggccgaggagaagauccucgaggaguucaaggagacgcacaacgcggagagcccggacuuccagcugcaggccaugauccaggccgccggcaagcuggugcucaucgacaagcugcugcccaagcucaaggccggcgggcaccggguccugaucuucucccagauggugcgcugccuggacauccucgaggacuaccugauccagcggcgcuaccccuacgagcggaucgacgggcgcgugcgggggaaccugcgccaggccgccaucgaccgguucagcaagcccgacuccgaccgcuucgucuuccuccugugcacccgggccggcgggcugggcaucaaccucaccgccgcggacacgugcaucaucuucgacagcgacuggaacccgcagaacgaccugcaggcccaggcccgcugccaccgcaucgggcaguccaagagcgugaagaucuaccggcugaucacgcgcaacuccuacgagcgggagauguucgacaaggccagccucaagcugggccuggacaaggccgugcuccaguccaugagcgggcgcgagaacgcgaccaacggcguccagcagcuguccaagaaggagaucgaggaccugcuccggaagggcgccuacggggcccugauggacgaggaggacgagggcagcaaguucugcgaggaggacaucgaccagauccugcuccgccggacccacaccaucacgaucgaguccgaggggaagggcagcaccuucgccaaggccuccuucguggcgagcggcaaccgcaccgacaucucccuggacgaccccaacuucuggcagaagugggccaagaaggccgagcuggacaucgacgcccucaacgggcggaacaaccuggugaucgacacgccccgcguccggaagcagacgcgccuguacagcgcggugaaggaggacgagcucauggaguucuccgaccuggagagcgacagcgaggagaagcccugcgccaagccgcggcgcccccaggacaagucccagggcuacgcccggagcgagugcuuccgcguggagaagaaccugcucgucuacggguggggccgguggaccgacauccugucccacgggcgcuacaagcggcagcugaccgagcaggacguggagaccaucugccgcacgauccucguguacugccugaaccacuacaagggcgacgagaacaucaagagcuucaucugggaccugaucacccccaccgccgacggccagacccgcgcccucgucaaccacuccgggcugagcgcgccggugccccggggccgcaaggggaagaaggugaaggcccaguccacgcagcccgucgugcaggacgccgacuggcuggccagcugcaaccccgacgcccucuuccaggaggacuccuacaagaagcaccugaagcaccacugcaacaaggugcugcuccggguccgcaugcuguacuaccugcggcaggaggugaucggcgaccaggcggacaagauccucgagggggccgacagcuccgaggccgacguguggaucccggagcccuuccacgccgagguccccgccgacuggugggacaaggaggcggacaagagccugcugaucggcguguucaagcacggcuacgagaaguacaacuccaugcgcgccgaccccgcccucugcuuccuggagcgggucgggaugccggacgccaaggccaucgcggccgagcagcgcggcaccgacaugcuggccgacgggggcgacgggggcgaguucgaccgggaggacgaggaccccgaguacaagcccacccgcacccccuucaaggacgagaucgacgaguucgccaacagcccguccgaggacaaggaggagagcauggagauccacgcgacgggcaagcacuccgagagcaacgccgagcucgggcagcuguacuggcccaacaccuccacccugaccacgcggcuccgccggcugaucaccgccuaccagcgcagcuacaagcggcagcagaugcgccaggaggcccugaugaagaccgaccggcgccggcgccggccccgcgaggaggugcgcgcccucgaggcggagcgggaggccaucaucagcgagaagcgccagaaguggacccggcgcgaggaggccgacuucuaccggguggucuccaccuucggcgugaucuucgaccccgugaagcagcaguucgacuggaaccaguuccgcgccuucgcccggcuggacaagaaguccgacgagucccuggagaaguacuucagcugcuucgucgcgaugugccgccgggugugccgcaugccggugaagcccgacgacgagccgcccgaccucuccagcaucaucgagccgaucacggaggagcgggccucccgcacccuguaccggaucgagcugcugcgcaagauccgggagcagguccuccaccacccccagcugggggagcgccugaagcucugccagcccagccuggaccugcccgaguggugggagugcggccggcacgaccgcgaccuccuggugggggccgccaagcacggcgugucccggaccgacuaccacauccugaacgacccggagcucagcuuccuggacgcccacaagaacuucgcgcagaaccgcggcgccgggaacaccuccagccugaacccccucgccgucggcuucgugcagacgccgcccgugaucuccagcgcccacauccaggacgagcgcguccuggagcaggcggaggggaagguggaggagccggagaaccccgccgccaaggagaagugcgagggcaaggaggaggaggaggagaccgacggcuccgggaaggagagcaagcaggagugcgaggccgaggccuccagcgugaagaacgagcugaagggcgucgaggugggggcggacaccggcuccaagagcaucagcgagaagggguccgaggaggacgaggaggagaagcucgaggacgacgacaagagcgaggaguccagccagcccgaggccggcgccgugucccggggcaagaacuucgacgaggagagcaacgccuccaugagcaccgcccgcgacgagacgcgggacggguucuacauggaggacggcgacccguccgucgcgcagcugcugcacgagcgcaccuucgccuucagcuucuggcccaaggaccgggugaugaucaaccgccucgacaacaucugcgaggccgugcugaaggggaaguggcccgucaaccggcgccagauguucgacuuccagggccugauccccggguacaccccgaccacgguggacagcccccuccagaagcggagcuucgccgagcuguccauggugggccaggccagcaucuccggcagcgaggacaucaccaccagcccccagcugagcaaggaggacgcgcucaaccugagcgucccccgccagcggcgccggcgccggcgcaagaucgagaucgaggccgagcgggccgccaagcgccggaaccugauggagaugguggcgcagcuccgcgagucccagguggucagcgagaacgggcaggagaaggugguggaccuguccaaggccagccgggaggccaccuccagcacguccaacuucagcucccugagcuccaaguucauccucccgaacgucagcacccccguguccgacgccuucaagacccagauggagcugcugcaggccggccucagccgcacccccacgcgccaccuccugaacgggucccucguggacggcgagcccccgaugaagcggcgccgggggcgccggaagaacgucgagggccuggaccuccucuucaugagccacaagcgcaccucccugagcgcggaggacgccgaggugaccaaggccuucgaggaggacaucgagacgccgcccacgcggaacauccccuccccgggccagcuggaccccgacacccgcauccccgugaucaaccucgaggacgggacccggcuggucggcgaggacgcccccaagaacaaggaccugguggaguggcucaagcugcacccgaccuacacgguggacaugcccagcuacguccccaagaacgccgacgugcuguucagcuccuuccagaagcccaagcagaagcgccaccggugccgcaacccgaacaagcucgacaucaacacccugaccggggaggagcgggugcccgucgugaacaagcgcaacggcaagaagaugggcggcgcgauggcgccgcccaugaaggaccugccgcgguggcucgaggagaaccccgaguucgccguggcccccgacuggaccgacaucgucaagcagagcggcuucgugccggaguccauguucgaccgccugcugacggggcccgugguccggggcgagggggccagccgccggggccgccgccccaaguccgagaucgcgcgggccgccgccgccgcggccgccguggccagcaccuccggcaucaacccccuccuggucaacagccuguucgcggggauggaccucaccucccugcagaaccugcagaaccuccagagccugcagcuggccggccucaugggguucccgcccggccuggccaccgccgccacggccgggggcgacgcgaagaaccccgccgccgugcugccccucaugcugccgggcauggccgggcugcccaacguguucggccucgggggccugcugaacaacccccucuccgcggccaccgggaacaccaccaccgccagcucccagggcgagcccgaggacagcacguccaagggcgaggagaaggggaacgagaacgaggacgagaacaaggacagcgagaaguccaccgacgccgucagcgccgcggacuccgccaacggcagcgugggggccgccaccgcgccggccggccugcccagcaacccccuggccuucaaccccuuccuccuguccaccauggccccggggcuguucuaccccagcauguuccugccgcccggccugggcgggcugacgcucccgggcuuccccgcccuggcggggcugcagaacgccgugggcuccagcgaggagaaggccgccgacaaggccgagggcgggcccuucaaggacggcgagacccucgagggguccgacgcggaggagagccuggacaagaccgccgaguccagccugcucgaggacgagaucgcccagggcgaggagcuggacucccuggacgggggcgacgagaucgagaacaacgagaacgacgaguga

SEQ ID NO: 28231 - RNA, 7746 nt, Artificial Sequence
  derived and/or modified sequence opt1 from CHD8__Homo_sapiens__NP_001164100
auggccgaccccaucauggaccuguucgacgaccccaaccucuucggccuggacagccugaccgacgacagcuucaaccaggugacccaggaccccaucgaggaggcccucgggcugcccagcucccuggacagccucgaccagaugaaccaggacggcgggggcggggacgugggcaacuccagcgccuccgagcuggugcccccgcccgaggagaccgcccccaccgagcugagcaaggaguccaccgcccccgcccccgagagcaucacccuccacgacuacaccacccagcccgccucccaggagcagcccgcccagcccgugcugcagaccagcacccccaccuccggccugcuccaggugagcaagucccaggagauccugagccaggggaaccccuucaugggcguguccgccaccgccgugagcuccagcagcgccgggggccagccgccccaguccgcccccaagaucgucauccugaaggcgccgcccagcuccagcgugaccggggcccacguggcccagauccaggcccagggcaucaccuccaccgcgcagccccucgucgccggcaccgccaacgggggcaaggugaccuucaccaaggugcugaccgggacgccccugcggcccggcgucagcaucguguccggcaacaccgugcucgccgccaagguccccgggaaccaggcggccgugcagcggaucgugcagcccagccgcccggucaagcagcuggugcugcagcccgugaagggcuccgcccccgccgggaaccccggcgccaccgggccgccccucaagcccgcggucacccugaccagcaccccgacccagggcgaguccaagcggaucacgcuggugcuccagcagccccagagcggcgggccccagggccaccgccacgugguccuggggucccugcccggcaagaucgugcuccaggggaaccagcuggccgcccugacccaggccaagaacgcccagggccagccggcgaaggucgugaccauccagcuccaggugcagcagccccagcagaagauccagaucgucccccagcccccgagcucccagccccagccccagcagcccccgagcacccagcccgugacgcuguccagcgugcagcaggcccagaucaugggccccgggcagucccccggccagcggcugagcgucccggugaaggugguccuccagccccaggccgggagcucccagggcgccagcuccgggcugagcguggugaagguccuguccgcgagcgagguggccgcccucuccagccccgccuccagcgcgccccacuccggcggcaagaccgggauggaggagaaccgccggcuggagcaccagaagaagcaggagaaggcgaaccgcaucguggccgaggccaucgcccgggcccgcgcgcggggcgagcagaacaucccgcgcguccugaacgaggacgagcuccccagcgugcggcccgaggaggagggggagaagaagcgccggaagaaguccgccggcgagcgccugaaggaggagaagcccaagaaguccaagaccuccggcgccagcaagaccaaggggaaguccaagcugaacacgaucaccccgguggucggcaagaagcggaagcgcaacaccagcagcgacaacuccgacguggaggugaugcccgcccagagcccccgggaggacgaggaguccagcauccagaagcgccgguccaaccgccaggucaagcgcaagaaguacaccgaggaccucgacaucaagaucacggacgacgaggaggaggaggagguggacgugaccgggccgaucaagcccgagcccauccugcccgagccgguccaggagcccgacggcgagacccugcccagcaugcaguucuucguggagaaccccuccgaggaggacgccgcgaucguggacaagguccucagcaugcggaucgugaagaaggagcugccguccgggcaguacaccgaggccgaggaguucuucgugaaguacaagaacuacagcuaccugcacugcgagugggccaccaucucccagcucgagaaggacaagcgcauccaccagaagcugaagcgguucaagacgaagauggcccagaugcgccacuucuuccacgaggacgaggagcccuucaaccccgacuacgucgagguggaccggauccuggacgagagccacuccaucgacaaggacaacggcgagcccgugaucuacuaccuggucaaguggugcagccucccguacgaggacuccaccugggagcugaaggaggacguggacgagggcaagauccgcgaguucaagcggauccagagccgccaccccgagcugaagcgggugaaccgcccccaggcguccgccuggaagaagcucgagcugagccacgaguacaagaaccggaaccagcugcgcgaguaccagcucgagggggucaacuggcugcuguucaacugguacaaccggcagaacugcauccucgccgacgagaugggccuggggaagaccauccaguccaucgccuuccugcaggagguguacaacgugggcauccacgggcccuuccucgucaucgccccgcugagcaccaucacgaacugggagcgcgaguucaacaccuggaccgagaugaacaccaucguguaccacggcagccuggcgucccggcagaugauccagcaguacgagauguacugcaaggacagccgcggccggcucauccccggggccuacaaguucgacgcccugaucacgaccuucgagaugauccuguccgacugccccgagcuccgcgagaucgaguggcggugcgugaucaucgacgaggcccaccgccugaagaaccgcaacugcaagcugcucgacagccugaagcacauggaccuggagcacaagguccuccugaccggcacgccccuccagaacacgguggaggagcuguucucccugcugcacuuccucgagccgagccaguuccccuccgagagcgaguuccugaaggacuucggggaccugaagaccgaggagcagguccagaagcuccaggccauccugaagcccaugaugcugcggcgccucaaggaggacgucgagaagaaccuggcgcccaagcaggagaccaucaucgagguggagcugaccaacauccagaagaaguacuaccgggccauccucgagaagaacuucuccuuccugagcaagggcgccgggcacacgaacaugccgaaccugcucaacaccaugauggagcugcgcaagugcugcaaccaccccuaccugaucaacggcgccgaggagaagauccucaccgaguuccgggaggccugccacaucaucccccacgacuuccaccuccaggcgauggugcgcuccgccggcaagcugguccucaucgacaagcugcugcccaagcucaaggccgggggccacaaggugcugaucuucagccagauggugcggugccuggacauccucgaggacuaccugauccagcgccgguaccuguacgagcgcaucgacgggcggguccgcggcaaccuccggcaggccgcgaucgaccgcuucuccaagccggacagcgaccgguucguguuccugcugugcacccgcgccgggggccucggcaucaaccugacggccgccgacacgugcaucaucuucgacuccgacuggaacccccagaacgaccugcaggcccaggcgcggugccaccgcaucgggcagagcaaggccgucaagguguaccggcucaucacccgcaacuccuacgagcgggagauguucgacaaggccagccugaagcugggccucgacaaggccgugcugcaguccaugagcgggcgcgacggcaacaucaccggcauccagcaguucagcaagaaggagaucgaggaccugcuccgcaagggggccuacgcggccaucauggaggaggacgacgagggcuccaaguucugcgaggaggacaucgaccagauccugcugcggcgcacgaccaccaucaccaucgagagcgaggggaagggcuccacguucgccaaggccagcuucgucgccuccgagaaccggaccgacaucagccucgacgaccccaacuucuggcagaagugggcgaagaaggccgaccuggacauggaccugcucaacuccaagaacaaccuggugaucgacaccccgcgcgugcggaagcagacccgccacuucagcacgcugaaggacgacgaccucgucgaguucuccgaccuggagagcgaggacgacgagcggccccgcucccggcgccacgaccggcaccacgccuacgggcgcaccgacugcuuccggguggagaagcaccuccugguguacggcuggggccgcuggcgggacauccugagccacgggcgcuucaagcggcgcaugaccgagcgggacgucgagaccaucugccgcgccauccugguguacugccugcugcacuaccgcggcgacgagaacaucaagggguucaucugggaccugaucucccccgccgagaacggcaagacgaaggagcuccagaaccacagcgggcuguccauccccgugccgcggggccgcaagggcaagaaggucaagagccaguccaccuucgacauccacaaggcggacuggauccggaaguacaaccccgacacccuguuccaggacgagagcuacaagaagcaccucaagcaccagugcaacaaggugcugcugcgcgugcggaugcucuacuaccugcgccaggaggucaucggggaccaggccgagaaggugcugggcggggccaucgccuccgagaucgacaucugguuccccguggucgaccagcuggaggugcccaccaccuggugggacagcgaggcggacaagagccuccugaucggcguguucaagcacggguacgagaaguacaacacgaugcgggccgacccggcccugugcuuccucgagaaggccggccgccccgacgacaaggccaucgcggccgagcaccggguccuggacaacuucuccgacaucguggagggcguggacuucgacaaggacugcgaggaccccgaguacaagccccugcaggggccgcccaaggaccaggacgacgagggcgacccccucaugaugauggacgaggagaucagcgucaucgacggggacgaggcccaggugacccagcagcccggccaccuguucuggccgcccggcuccgcccugaccgcccgccuccggcgccuggugaccgcguaccagcggagcuacaagcgcgagcagaugaagaucgaggccgccgagcgcggggaccgccggcgccggcgcugcgaggccgccuucaagcugaaggagaucgcgcggcgcgagaagcagcagcgcuggacgcggcgcgagcagaccgacuucuaccgggucguguccaccuucggcguggaguacgaccccgacaccaugcaguuccacugggaccgcuuccggacguucgcccgccucgacaagaagaccgacgagagccugaccaaguacuuccacggguucgucgccaugugccgccaggugugccgccugcccccggccgcgggcgacgagccgcccgaccccaaccucuucaucgagccgaucaccgaggagcgggccucccgcacgcuguaccggaucgagcugcuccgccggcugcgcgagcagguccugugccacccccuccuggaggaccggcuggcccucugccagccgcccgggccggagcugcccaaguggugggagcccguccgccacgacggcgagcugcuccggggcgccgcccgccacggggugagccagaccgacugcaacaucaugcaggacccggacuucuccuuccuggcggcccggaugaacuacaugcagaaccaccaggccggcgcccccgcccccagccugucccgcugcagcacgccccugcugcaccagcaguacaccucccgcacggcgagcccgcugccccuccggcccgacgcccccguggagaaguccccggaggagaccgccacccagguccccagccuggagucccugacccucaagcuggagcacgaggugguggcccgcagccggcccacgccccaggacuacgagaugcgcgucuccccgagcgacaccacgccccuggugagccgguccgugccgcccgucaagcucgaggacgaggacgacagcgacuccgagcuggaccugagcaagcucuccccgagcuccagcuccagcuccagcuccagcuccagcuccagcuccaccgacgagagcgaggacgagaaggaggagaagcugacggaccagagccgcuccaagcuguacgacgaggagagccuccugucccugaccaugagccaggacggguuccccaacgaggacggcgagcagaugacccccgagcuccugcugcuccaggagcggcagcgcgccuccgaguggcccaaggaccgggugcugaucaaccgcaucgaccuggugugccaggcgguccucagcgggaaguggccguccagccggcgcucccaggagauggugaccggcggcauccuggggcccggcaaccaccuccucgacagccccucccugacgcccggggaguacggcgacagcccggugcccacgccccgguccagcuccgccgccagcauggccgaggaggaggcguccgccgucagcaccgccgccgcccaguucaccaagcugcgccgggggauggacgagaaggaguucacggugcagaucaaggacgaggagggccucaagcugaccuuccagaagcacaagcugauggcgaacggcgugaugggggacggccacccccucuuccacaagaagaaggggaaccgcaagaagcuggucgagcuggagguggagugcauggaggagcccaaccaccucgacgucgaccuggagacccggauccccgugaucaacaagguggacggcacccugcucgucggggaggacgcgccccggcgggccgagcuggagauguggcugcagggccacccggaguucgccguggacccccgcuuccucgccuacauggaggaccggcgcaagcagaaguggcagcgcugcaagaagaacaacaaggcggagcugaacugccugggcauggagcccgugcagacggccaacagccggaacgggaagaagggccaccacaccgagaccgucuucaaccgcgugcuccccgggccgaucgcccccgaguccagcaagaagcgggcccgccggaugcgccccgaccuguccaagaugauggcccugaugcagggcggcagcaccgggucccucagccugcacaacaccuuccagcacuccagcuccggccugcagagcguguccagccucgggcacuccagcgcgacguccgccagccugcccuucaugccguucgucaugggcggggcccccuccagcccccacguggacuccagcaccaugcugcaccaccaccaccaccacccccacccgcaccaccaccaccaccaccaccccggccuccgggcccccggcuaccccagcuccccggugaccaccgccagcgggacgacccugcgccugccgccccuccagcccgaggaggacgacgacgaggacgaggaggacgacgacgaccugucccagggcuacgacagcuccgagcgggacuucagccugaucgacgacccgaugaugcccgcgaacuccgacagcuccgaggacgccgacgacuga

SEQ ID NO: 28232 - RNA, 1785 nt, Artificial Sequence
  derived and/or modified sequence opt1 from CHDH__Homo_sapiens__NP_060867
auguggugccugcuccgcggccuggggcggcccggcgcccuggcccgcggggcgcucggccagcagcagagccugggggcccgggcccuggccuccgccggcagcgagucccgcgacgaguacagcuacguggucgugggcgcgggguccgccggcugcgugcucgccgggcggcugaccgaggacccggccgagcgcguccugcuccuggaggcgggccccaaggacgugcuggccgggagcaagcggcucuccuggaagauccacaugcccgccgcccugguggccaaccugugcgacgaccgcuacaacuggugcuaccacaccgagguccagcggggccucgacggccgcgugcuguacuggccccgggggcgcguguggggcgggagcuccagccugaacgcgauggucuacgugcggggccacgccgaggacuacgagcgcuggcagcggcagggcgcccgcgggugggacuacgcccacugccucccguacuuccggaaggcccagggccacgagcugggggcgucccgcuaccggggcgccgacgggccccugcgcgugagccggggcaagacgaaccacccccuccacugcgccuuccuggaggccacccagcaggccggcuacccccugaccgaggacaugaacggguuccagcaggagggcuucggguggauggacaugaccauccacgagggcaagcgcugguccgcggccugcgccuaccuccacccggcccugagccgcacgaaccugaaggccgaggcggagacccucgucucccgggugcuguucgaggggacccgcgccgugggcgucgaguacgugaagaacggccagagccaccgggccuacgccuccaaggaggugauccugagcgggggcgcgaucaacagcccccagcuccugaugcuguccgggaucggcaacgccgacgaccucaagaagcuggggauccccgucgugugccaccuccccggcgugggccagaaccugcaggaccaccuggagaucuacauccagcaggccugcacccgcccgaucacgcugcacagcgcccagaagccccuccggaaggucugcaucgggcuggaguggcuguggaaguucaccggcgagggggccaccgcgcaccucgagaccggcggcuucauccgcucccagcccggggugccccacccggacauccaguuccacuuccugcccagccaggugaucgaccacggccggguccccacgcagcaggaggccuaccaggugcacgucgggcccaugcgcggcaccuccgugggguggcugaagcuccggagcgccaacccgcaggaccaccccgugauccagcccaacuaccuguccaccgagaccgacaucgaggacuuccgccugugcgucaagcucacgcgggagaucuucgcccaggaggcccuggcgcccuuccgcggcaaggagcugcagccgggcagccacauccaguccgacaaggagaucgacgccuucgugcgggccaaggccgacagcgccuaccaccccuccugcacgugcaagauggggcagcccagcgaccccaccgcgguggucgacccgcagacccgcgugcugggcguggagaaccuccgggucguggacgccuccaucaugcccagcaugguguccgggaaccugaacgcccccaccaucaugaucgccgagaaggcggccgacaucaucaagggccagccggcccugugggacaaggacguccccguguacaagccccgcacccucgccacccagcgguga

SEQ ID NO: 28233 - RNA, 1329 nt, Artificial Sequence
  derived and/or modified sequence opt1 from CHEK1__Homo_sapiens__NP_001231775
auggccgugcccuucgucgaggacugggaccuggugcagacccucggcgagggggccuacggcgaggugcagcuggcggucaaccgcgugaccgaggaggccguggccgucaagaucguggacaugaagcgggccguggacugcccggagaacaucaagaaggagaucugcaucaacaagaugcugaaccacgagaacgucgugaaguucuacgggcaccgccgggagggcaacauccaguaccucuuccuggaguacugcagcgggggcgagcuguucgaccgcaucgagcccgacaucggcaugcccgagcccgacgcccagcgguucuuccaccagcucauggcggggguggucuaccugcacggcaucgggaucacgcaccgcgacaucaagccggagaaccugcuccuggacgagcgggacaaccugaagaucuccgacuucggccucgccaccguguuccgcuacaacaaccgggagcgccugcugaacaagaugugcgggacccuccccuacguggcccccgagcugcugaagcggcgcgaguuccacgccgagcccgucgacguguggagcugcggcaucgugcucaccgcgaugcuggccggcgagcugccgugggaccagcccuccgacagcugccaggaguacuccgacuggaaggagaagaagacguaccucaaccccuggaagaagaucgacagcgcgccccuggcccugcuccacaagauccuggucgagaacccguccgcccggaucaccauccccgacaucaagaaggaccgcugguacaacaagccccugaagaagggggccaagcggccccgcgugaccagcggcgggguguccgagagcccguccggcuucagcaagcacauccaguccaaccucgacuucagccccgucaacuccgccagcuccgaggagaacgugaaguacagcuccagccagcccgagccccggaccggccugagccugugggacacguccccgagcuacaucgacaagcucgugcaggggaucuccuucagccagccgaccugccccgaccacaugcugcugaacucccagcuccugggcacccccgggagcucccagaaccccuggcagcgccuggucaagcggaugacccgcuucuucacgaagcucgacgccgacaagagcuaccagugccugaaggagaccugcgagaagcugggcuaccaguggaagaaguccugcaugaaccagggggacggccucgaguucaagcggcacuuccugaagaucaagggcaagcugaucgacaucgugagcucccagaagaucuggcuccccgccaccuga

SEQ ID NO: 28234 - RNA, 969 nt, Artificial Sequence
  derived and/or modified sequence opt1 from CHEK2__Homo_sapiens__NP_001244316
augagcaagacccugggcuccggggccugcggcgaggugaagcucgccuucgagcgcaagaccugcaagaaggucgcgaucaagaucaucagcaagcggaaguucgccaucggguccgcccgcgaggccgaccccgcccugaacguggagacggagaucgagauccugaagaagcucaaccacccgugcaucaucaagaucaagaacuucuucgacgcggaggacuacuacaucgugcuggagcugauggagggcggggagcuguucgacaaggucgugggcaacaagcggcucaaggaggcgaccugcaagcuguacuucuaccagaugcuccuggccgugcaguaccugcacgagaacggcaucauccaccgcgaccucaagcccgagaacguccugcugagcucccaggaggaggacugccucaucaagaucaccgacuucgggcacagcaagauccugggcgagaccucccugaugcggacgcucugcgggacccccaccuaccuggcccccgaggugcuggugagcgucggcaccgccggguacaaccgcgccguggacugcuggucccucggcgugauccuguucaucugccugagcggcuacccgcccuucuccgagcaccggacgcaggucagccucaaggaccagaucaccuccgggaaguacaacuucauccccgaggugugggccgaggugagcgagaaggcccuggaccuggucaagaagcuccuggugguggaccccaaggcccgcuucaccaccgaggaggcgcugcggcacccguggcuccaggacgaggacaugaagcgcaaguuccaggaccugcuguccgaggagaacgagagcacggcccucccccagguccuggcccagcccuccaccagccggaagcgcccccgggagggcgaggccgagggggccgagaccaccaagcgcccggcggugugcgccgccgugcuguga

SEQ ID NO: 28235 - RNA, 2751 nt, Artificial Sequence
  derived and/or modified sequence opt1 from CHERP__Homo_sapiens__NP_006378
auggagaugccccugccgcccgacgaccaggagcuccgcaacgugaucgacaagcuggcccaguucgucgcccggaacggccccgaguucgagaagaugaccauggagaagcagaaggacaaccccaaguucagcuuccuguucgggggcgaguucuacuccuacuacaagugcaagcucgcgcuggagcagcagcagcugaucugcaagcagcagaccccggagcucgagcccgccgccacgaugcccccccugccgcagcccccccuggcccccgccgcgccgaucccccccgcccagggggcccccagcauggacgagcucauccagcagucccaguggaaccugcagcagcaggagcagcaccugcucgcccugcgccaggagcaggugaccgcggccguggcccacgccgucgagcagcagaugcagaagcugcucgaggagacccagcuggacaugaacgaguucgacaaccugcuccagccgaucaucgacaccugcacgaaggacgccaucagcgcgggcaagaacuggauguucuccaacgccaagagccccccccacugcgagcugauggccgggcaccugcggaaccgcaucaccgccgacggcgcccacuucgagcuccggcugcaccugaucuaccucaucaacgacgugcugcaccacugccagcgcaagcaggcgcgggagcugcucgccgcccugcagaagguggucgugcccaucuacugcaccuccuuccuggccguggaggaggacaagcagcagaagaucgcccgccuccugcagcugugggagaagaacggcuacuucgacgacagcaucauccagcagcuccaguccccggcgcuggggcugggccaguaccaggccacccucaucaacgaguacagcuccgucgugcagcccgugcagcuggccuuccagcagcagauccagacgcugaagacccagcacgaggaguucgucaccagccucgcccagcagcagcagcagcagcagcagcagcagcagcagcugcagaugccccagauggaggccgaggugaaggcgacccccccgccccccgcccccccgcccgcccccgccccggcgcccgccaucccccccacgacccagccggacgacuccaagccccccauccagaugcccgggagcuccgaguacgaggccccgggcggggugcaggaccccgccgccgcgggcccccggggccccgggccgcacgaccagaucccccccaacaagcccccgugguucgaccagccccaccccgucgcccccuggggccagcagcagccgcccgagcagccccccuacccgcaccaccaggggggccccccccacugcccgcccuggaacaacagccacgagggcauguggggggagcagcgcggcgaccccggguggaacggccagcgggacgcccccuggaacaaccagccggacgccgccuggaacucccaguucgaggggcccuggaacagccagcacgagcagccccccuggggcggcgggcagcgcgagccgcccuuccggaugcagcgccccccccacuuccggggcccguuccccccccaccagcagcacccccaguucaaccagccgccccacccccacaacuucaaccgcuuccccccgcgguucaugcaggacgacuuccccccccgccaccccuucgagcggccgcccuacccccaccgcuucgacuacccccagggggacuucccggcggagaugggccccccccaccaccacccggggcaccggaugccccaccccggcaucaacgagcaccccccgugggccggcccccagcaccccgacuucgggcccccgccccacggcuucaacgggcagcccccccacaugcgccgccagggcccgccccacaucaaccacgacgaccccucccuggugcccaacgugccguacuucgaccuccccgccgggcugauggccccccuggucaagcucgaggaccacgaguacaagccccuggacccgaaggacauccggcugcccccccccaugccgcccagcgagcgccuccuggccgcgguggaggccuucuacagcccccccucccacgaccggccgcgcaacagcgagggcugggagcagaacggccuguacgaguucuuccgggccaagaugcgcgcccggcgccggaaggggcaggagaagcgcaacuccggccccagccggucccgcagccgguccaagagccgcgggcgguccagcucccgcagcaacucccggagcuccaagagcuccggcagcuacucccgcagccggagccgcuccugcagccgcuccuacagccggucccgcagccggucccgcagccggucccgcagcucccggagccgcucccggagccagucccgcagccgguccaagagcuacagccccggccgccggcgccggucccgcagccgguccccgaccccccccagcuccgcggggcugggcagcaacuccgcccccccgauccccgacagccgccucggggaggagaacaagggccaccagaugcuggugaagauggggugguccggcagcggcgggcugggcgccaaggagcaggggauccaggaccccaucaagggcggggacguccgggacaagugggaccaguacaagggcgugggcguggcccucgacgaccccuacgagaacuaccgccggaacaaguccuacagcuucaucgcccgcaugaaggcgcgcgacgagugcaaguga

SEQ ID NO: 28236 - RNA, 1995 nt, Artificial Sequence
  derived and/or modified sequence opt1 from CHFR__Homo_sapiens__NP_001154816
auggagcgccccgaggagggcaagcagagcccgccgccccagcccugggggcggcugcuccgccugggcgccgaggagggggagccccacgugcugcuccggaagcgcgaguggaccaucggccggcgccgggggugcgaccuguccuuccccagcaacaagcuggucuccggcgaccacugccgcaucgugguggacgagaaguccggccaggucacccucgaggacacgagcaccagcgggaccgugaucaacaagcugaagguggucaagaagcagaccugcccccugcagacgggcgacgugaucuaccucguguaccggaagaacgagcccgagcacaacgucgccuaccuguacgagucccugagcgagaagcaggggaugacccaggaguccuucgaggcgaacaaggagaacguguuccacggcaccaaggacaccagcggggccggcgccggccgcggggccgacccgcgggugccgcccuccagccccgccacgcaggucugcuucgaggagccccagcccuccaccagcaccuccgaccucuuccccaccgcgagcgccuccagcacggagcccuccccggccggccgcgagcggagcagcuccugcgggagcggcggcgggggcaucucccccaaggggagcggccccuccguggccagcgacgagguguccagcuucgcguccgcccugcccgaccgcaagaccgccagcuucuccagccuggagccgcaggaccaggaggaccucgagcccgucaagaagaagaugcgcggggacggcgaccuggaccugaacggccagcuccugguggcccagccccggcggaacgcccagaccgugcacgaggacguccgcgcggccgccgggaagcccgacaagauggaggagacccugacgugcaucaucugccaggaccuccugcacgacugcgugucccugcagccgugcaugcacaccuucugcgccgccugcuacagcggcuggauggagcgguccagccucugcccgaccugccgcugccccguggagcggaucugcaagaaccacauccugaacaaccuggucgaggcguaccucauccagcaccccgacaagucccgcagcgaggaggacgugcaguccauggacgcccgcaacaagaucacccaggacaugcugcagcccaaggugcggcgcagcuucagcgacgaggagggguccagcgaggaccugcucgagcuguccgacgucgacagcgaguccagcgacaucucccagcccuacguggucugccggcagugccccgaguaccgccggcaggccgcccagccgccccacugccccgcccccgagggcgagccgggggcgccccaggcccugggcgacgcccccagcacguccgugagccucaccaccgccgugcaggacuacgucugcccccugcagggcucccacgcccugugcacgugcugcuuccagccgaugcccgaccgccgggcggagcgcgagcaggacccccggguggcgccccagcagugcgccgugugccuccagccguucugccaccuguacugggggugcacccgcaccggcugcuacgggugccuggcccccuucugcgagcucaaccugggcgacaagugccuggacgggguccucaacaacaacagcuacgaguccgacauccugaagaacuaccuggccacccggggccucaccuggaagaacaugcugacggagagccugguggcccuccagcgcggcguguuccugcuguccgacuaccgggucaccggggacaccgugcugugcuacugcugcggccuccgcagcuuccgggagcugaccuaccaguaccgccagaacauccccgccuccgagcugcccguggccgucacgagccggccggacugcuacugggggcgcaacugccggacccaggugaaggcccaccacgcgaugaaguucaaccacaucugcgagcagacccgcuucaagaacuga

SEQ ID NO: 28237 - RNA, 921 nt, Artificial Sequence
  derived and/or modified sequence opt1 from CHGA__Homo_sapiens__NP_001288619
augcgcagcgccgccgugcuggcgcuccugcugugcgccggccaggucaccgcccuccccgugaacuccccgaugaacaagggggacaccgaggugaugaagugcaucgucgaggugaucagcgacacgcuguccaagcccagccccaugcccgugucccaggagugcuucgagacccugcggggcgacgagcgcauccucagcauccugcggcaccagaaccugcucaaggagcugcaggaccuggcccuccagggggccaaggagcgcgcgcaccagcagaagaagcacuccggcuucgaggacgagcugagcgagguccuggagaaccaguccagccaggccgagcucaaggggcgguccgaggcccuggccguggacggcgcgggcaagccgggggccgaggaggcccaggaccccgagggcaagggggagcaggagcacagccagcagaaggaggaggaggaggagauggccguggucccccagggccuguuccgcgggggcaaguccggcgagcucgagcaggaggaggagcggcugagcaaggagugggaggacuccaagcgcuggagcaagauggaccagcuggccaaggagcucaccgcggagaagcggcuggaggggcaggaggaggaggaggacaaccgcgacuccagcaugaagcuguccuuccgggcccgcgccuacggcuuccgggggcccggcccgcagcuccgccggggcuggcgccccagcagccgggaggacucccuggaggccgggcugccccuccaggugcgcggcuaccccgaggagaagaaggaggaggaggggagcgccaaccggcgcccggaggaccaggagcuggagucccugagcgcgaucgaggccgagcucgagaagguggcccaccagcugcaggcccugcggcgcggcuga

SEQ ID NO: 28238 - RNA, 2034 nt, Artificial Sequence
  derived and/or modified sequence opt1 from CHGB__Homo_sapiens__NP_001810
augcagcccacccugcuccugagccugcucggcgccguggggcuggccgcggucaacuccaugccgguggacaaccgcaaccacaacgagggcauggugacccggugcaucaucgagguccugagcaacgcccucuccaagagcuccgccccgcccaucacgcccgagugccgccaggugcugaagaccagccggaaggacgugaaggacaaggagaccaccgagaacgagaacacgaaguucgagguccgccugcuccgggaccccgccgacgccuccgaggcgcacgagagcuccagccgcggggaggccggcgcccccggggaggaggacauccagggccccaccaaggccgacaccgagaagugggcggagggcgggggccacucccgggagcgcgccgacgagccccaguggagccuguacccguccgacagccagguguccgaggaggugaagacccggcacagcgagaagucccagcgcgaggacgaggaggaggaggagggggagaacuaccagaagggcgagcgcggggaggacagcuccgaggagaagcaccuggaggagcccggcgagacgcagaacgccuuccucaacgagcggaagcaggccagcgccaucaagaaggaggagcuggucgcgcggagcgagacccacgccgccggccacucccaggagaagacccacagccgcgagaaguccagccaggaguccggggaggagaccggcagccaggagaaccacccccaggaguccaaggggcagccccggagccaggaggaguccgaggagggcgaggaggacgccacgagcgagguggacaagcgccggacccgcccgcggcaccaccacggccgcucccggcccgaccgcagcucccagggcgggagccugcccuccgaggagaaggggcacccccaggaggagagcgaggaguccaacgugagcauggccucccucggcgagaagcgcgaccaccacagcacccacuaccgggcgagcgaggaggagccggaguacggggaggagaucaagggcuaccccggcguccaggcccccgaggaccuggagugggagcgcuaccgggggcgcggcuccgaggaguaccgggcgccccgcccgcagagcgaggaguccugggacgaggaggacaagcggaacuaccccagccuggagcucgacaagauggcccacggguacggcgaggaguccgaggaggagcgcgggcuggagcccggcaagggccggcaccaccgcgggcggggcggggagccccgcgccuacuucaugagcgacacccgggaggagaagcgcuuccugggcgaggggcaccaccgggugcaggagaaccagauggacaaggcccgccggcacccgcagggcgccuggaaggagcucgaccgcaacuaccugaacuacggcgaggagggggcccccggcaaguggcagcagcagggggaccugcaggacacgaaggagaaccgggaggaggcccgcuuccaggacaagcaguacuccagccaccacaccgccgagaagcgcaagcggcucggcgagcuguucaaccccuacuacgacccccugcaguggaaguccagccacuucgagcgccgggacaacaugaacgacaacuuccucgagggcgaggaggagaacgagcugacccugaacgagaagaacuucuucccggaguacaacuacgacuggugggagaagaagcccuucuccgaggacgugaacuggggguacgagaagcgcaaccucgcgcggguccccaagcuggaccugaagcgccaguacgaccggguggcccagcucgaccagcugcugcacuaccgcaagaaguccgccgaguucccggacuucuacgacagcgaggagcccgugagcacccaccaggaggccgagaacgagaaggaccgggcggaccagacgguccucaccgaggacgagaagaaggagcuggagaaccuggccgccauggaccucgagcugcagaagaucgccgagaaguucucccagcgcggcuga

SEQ ID NO: 28239 - RNA, 987 nt, Artificial Sequence
  derived and/or modified sequence opt1 from CHI3L1__Homo_sapiens__XP_011507410
augggcgugaaggccagccagaccggguucgucgugcuggugcuccugcagugcugcuccgccuacaagcuggucugcuacuacaccagcuggucccaguaccgcgagggcgacgggagcugcuuccccgacgcgcucgaccgguuccugugcacgcacaucaucuacuccuucgccaacaucagcaacgaccacaucgacaccugggaguggaacgacgugacccuguacggcaugcucaacacccugaagaaccgcaacccgaaccugaagacgcuccuguccgucgggggcuggaacuucggcagccagcgggccgacuucgggccccgcuucuccaagaucgccagcaacacccagucccggcgcaccuucaucaagagcgugccgcccuuccugcggacccacggcuucgacgggcucgaccuggccuggcuguaccccggccgccgggacaagcagcacuucacgacccucaucaaggagaugaaggcggaguucaucaaggaggcccagcccgggaagaagcagcugcugcucuccgccgcccugagcgcgggcaaggugaccaucgacuccagcuacgacaucgccaagaucucccagcaccuggacuucaucagcaucaugaccuacgacuuccacggcgccuggcgcgggacgaccggccaccacagcccccucuuccgggggcaggaggacgccagccccgaccgcuucagcaacaccaucugcgacuuccugcggggcgccaccgugcaccgcauccugggccagcaggucccguacgcgacgaaggggaaccagugggugggcuacgacgaccaggaguccgugaaguccaagguccaguaccucaaggaccggcagcuggccggggccauggugugggcccuggaccucgacgacuuccagggcuccuucugcgggcaggaccugcgcuucccccugaccaacgccaucaaggacgcgcucgccgccaccuga

SEQ ID NO: 28240 - RNA, 675 nt, Artificial Sequence
  derived and/or modified sequence opt1 from CHIC1__Homo_sapiens__NP_001034929
augagcauccugcuccccaacauggccgaguucgacaccaucuccgagcuggaggaggaggaggaggaggaggccgcgaccagcuccagcuccccgagcuccagcuccagcguguccggccccgacgacgacgaggaggacgaggaggaggaggaggaggaggaggaggaggaggaggaggaggaggaggaggaggaggaggaggccccgccgccgccccgcgucgugagcgaggagcaccuccggcgcuacgcccccgaccccgugcugguccgcggggccggccacaucacgguguucgggcuguccaacaaguucgacaccgaguuccccagcgugcugaccggcaaggucgcccccgaggaguucaagaccuccaucgggcgggugaacgcgugccucaagaaggcccugcccgugaacgucaaguggcugcucugcggcugccugugcugcugcugcacgcugggcugcagccucuggcccgugaucugccugaacaagcggacccgccgguccauccagaagcugaucgagugggagaacaaccgccucuaccacaagcuggcccugcacuggaagcucaccaagcggaagugcgagaccagcaacaugauggaguacgugauccugaucgaguuccugcccaaguaccccaucuuccgccccgacuga

SEQ ID NO: 28241 - RNA, 498 nt, Artificial Sequence
  derived and/or modified sequence opt1 from CHIC2__Homo_sapiens__NP_036242
auggccgacuucgacgagaucuacgaggaggaggaggacgaggagcgcgcccuggaggagcagcuccugaaguacagccccgacccgguggucgugcggggcuccgggcacgugaccgucuucggccugagcaacaaguucgaguccgaguuccccagcucccucaccgggaagguggcgcccgaggaguucaaggccagcaucaaccgcgugaacuccugccugaagaagaaccugcccgucaacgugcgguggcuccugugcggcugccugugcugcugcugcacgcucgggugcagcauguggccggugaucugccuguccaagcgcacccggcgcagcaucgagaagcugcucgagugggagaacaaccggcuguaccacaagcugugccuccacuggcgccuguccaagcggaagugcgagaccaacaacaugauggaguacgucauccugaucgaguuccuccccaagacccccaucuuccgccccgacuga

SEQ ID NO: 28242 - RNA, 1344 nt, Artificial Sequence
  derived and/or modified sequence opt1 from CHIT1__Homo_sapiens__NP_001243054
auggugcgcagcgucgccugggccggcuucauggugcugcucaugauccccuggggguccgcggccaagcuggugugcuacuucaccaacugggcccaguaccggcagggcgaggcccgcuuccugccgaaggaccucgaccccagccugugcacccaccugaucuacgccuucgcggggaugacgaaccaccagcucuccaccaccgaguggaacgacgagacccuguaccaggaguucaacggccugaagaagauguucacggacauggucgccaccgccaacaaccggcagaccuucgugaacagcgccauccgcuuccuccggaaguacuccuucgacgggcuggaccuggacugggaguaccccggcagccagggcucccccgcgguggacaaggagcgcuucaccacgcucguccaggaccuggccaacgccuuccagcaggaggcccagaccagcgggaaggagcggcugcuccuguccgccgcggugccggccggccagaccuacguggacgccggguacgaggucgacaagaucgcccagaaccuggacuucgugaaccucauggccuacgacuuccacggcagcugggagaaggugaccgggcacaacagcccccuguacaagcgccaggaggaguccggcgcggccgccucccugaacgucgacgccgccgugcagcaguggcuccagaagggcacgcccgcgagcaagcugauccuggggaugcccaccuacggccgguccuucacccucgccagcuccagcgacacccgcgugggggccccggccacgggcuccggcacccccgggcccuucaccaaggagggcgggaugcuggccuacuacgaggucugcagcuggaagggcgcgaccaagcagcggauccaggaccagaaggugcccuacaucuuccgcgacaaccagugggugggguucgacgacgucgagagcuucaagacgaagguguccuaccugaagcagaagggccucggcggggccauggugugggcccuggaccuggacgacuucgccggcuucagcugcaaccaggggcgguacccgcucauccagacccugcgccaggagcugucccuccccuaccugcccagcggcacccccgagcuggaggucccgaagcccgggcagcccuccgagcccgagcacggcccgagccccggccaggacaccuucugccaggggaaggcggacggccucuaccccaacccccgggagcgcuccagcuucuacuccugcgccgccgggcggcuguuccagcagagcugcccgacgggccugguguucuccaacagcugcaagugcugcaccuggaacuga

SEQ ID NO: 28243 - RNA, 1320 nt, Artificial Sequence
  derived and/or modified sequence opt1 from CHKA__Homo_sapiens__NP_997634
augaagaccaaguucugcaccggcggggaggccgagcccagcccgcugggccuccugcuguccugcgggagcggcuccgccgcgcccgcccccggggugggccagcagcgcgacgccgccagcgaccucgaguccaagcagcugggcgggcagcagcccccgcuggcccugcccccgcccccgccccucccccugccccucccgcugccccagccgccgccgccccagccgcccgcggacgagcagcccgagccccggacgcgccggcgcgccuaccuguggugcaaggaguuccuccccggcgccuggcgggggcugcgcgaggacgaguuccacaucagcgucauccggggcgggcuguccaacaugcuguuccagugcagccuccccgacaccaccgccacccugggcgacgagccccgcaaggugcuccugcggcuguacggcgcgauccuccagaugggggccgaggccauggugcuggaguccgucauguucgccauccuggccgagcgcagccucggccccaagcuguacgggaucuucccccagggccggcuggagcaguucauccccucccgccggcucgacacggaggagcugagccugcccgacaucuccgcggagaucgccgagaagauggccaccuuccacggcaugaagaugcccuucaacaaggagcccaaguggcuguucgggaccauggagaaguaccucaaggaggugcugcgcaucaaguucaccgaggagagccggaucaagaagcuccacaagcugcuguccuacaaccucccccuggagcuggagaaccuccgcagccugcuggaguccacgcccagccccguggucuucugccacaacgacugccaggagggcaacauccuccugcuggaggggcgggagaacuccgagaagcagaagcucaugcugaucgacuucgaguacagcagcuacaacuaccgcggcuucgacaucgggaaccacuucugcgaguggauguacgacuacuccuacgagaaguaccccuucuuccgggccaacauccgcaaguacccgaccaagaagcagcagcugcacuucaucagcuccuaccuccccgccuuccagaacgacuucgagaaccugagcaccgaggagaaguccaucaucaaggaggagaugcugcuggaggugaaccgguucgcgcucgccagccacuuccuguggggccugugguccaucgugcaggccaagaucagcuccaucgaguucggcuacauggacuacgcccaggcccgcuucgacgcguacuuccaccagaagcgcaagcucggggucuga

SEQ ID NO: 28244 - RNA, 1188 nt, Artificial Sequence
  derived and/or modified sequence opt1 from CHKB__Homo_sapiens__NP_005189
auggccgccgaggcgaccgccguggccggcagcggggccgucggcgggugccuggccaaggacggccuccagcaguccaagugccccgacaccacgccgaagcgccggcgcgcgagcucccugagccgggacgccgagcgccgggccuaccaguggugccgcgaguaccucgggggcgccuggcggcgcgugcagcccgaggagcuccggguguaccccgucuccggcgggcugagcaaccugcuguuccgcugcucccugcccgaccaccucccgagcgugggcgaggagccccgggaggugcugcugcgccuguacggggcgauccuccagggcgucgacucccuggugcuggagagcgugauguucgccauccucgccgagcggucccuggggccccagcuguacggcgucuuccccgagggccgccucgagcaguacaucccgagccggccccugaagacccaggagcugcgcgagcccgugcucuccgccgccaucgcgaccaagauggcccaguuccacgggauggagaugcccuucaccaaggagccgcacuggcuguucggcacgauggagcgguaccugaagcagauccaggaccucccgcccaccgggcugcccgagaugaaccugcucgagauguacagccugaaggacgagaugggcaaccugcgcaagcuccuggaguccacccccagccccguggucuucugccacaacgacauccaggagggcaacauccugcuccuguccgagcccgagaacgccgacagccugaugcucguggacuucgaguacuccagcuacaacuaccggggguucgacaucggcaaccacuucugcgaguggguguacgacuacacccacgaggaguggcccuucuacaaggcccgcccgacggacuaccccacccaggagcagcagcugcacuucauccggcacuaccuggccgaggcgaagaagggggagacccucagccaggaggagcagcgcaagcuggaggaggaccugcucgucgaggugucccgcuacgcccuggccagccacuucuucuggggccugugguccauccuccaggccagcauguccaccaucgaguucggguaccuggacuacgcccagagccgguuccaguucuacuuccagcagaagggccagcugacguccgugcacagcuccagcuga

SEQ ID NO: 28245 - RNA, 3516 nt, Artificial Sequence
  derived and/or modified sequence opt1 from CHL1__Homo_sapiens__NP_001240317
auggagccccugcuccugggccgcgggcugaucguguaccucauguuccugcugcucaaguucagcaaggccaucgagaucccguccagcguccagcagguccccaccaucaucaagcaguccaagguccagguggccuuccccuucgacgaguacuuccagaucgagugcgaggcgaagggcaaccccgagccgaccuucagcuggacgaaggacgggaaccccuucuacuucaccgaccaccggaucauccccuccaacaacagcggcaccuuccgcauccccaacgaggggcacaucucccacuuccagggcaaguaccggugcuucgccagcaacaagcugggcaucgccauguccgaggagaucgaguucaucgugccgagcgugcccaaguuccccaaggagaagaucgacccccuggagguggaggagggggacccgaucgugcuccccugcaacccgcccaagggccugccgccccugcacaucuacuggaugaacaucgagcucgagcacaucgagcaggacgagcgcguguacaugucccagaagggggaccuguacuucgccaacgucgaggagaaggacagccggaacgacuacugcugcuucgccgcguucccccgccugcggaccaucgugcagaagaugcccaugaagcucacggugaacucccugaagcacgccaacgacagcuccagcuccaccgagaucggcagcaaggccaacuccaucaagcagcgcaagcccaagcugcuccugccgcccaccgagagcgggagcgaguccagcaucaccauccugaagggcgagauccuccugcuggagugcuucgccgagggccuccccacgccccaggucgacuggaacaagaucgggggcgaccugcccaaggggcgggagaccaaggagaacuacggcaagacccugaagaucgagaacguguccuaccaggacaagggcaacuaccgcugcaccgcgagcaacuuccucgggacggccacccacgacuuccacgugaucgucgaggagccgccccgguggaccaagaagccccaguccgccguguacagcaccggcuccaacgggauccugcugugcgaggccgagggcgagccccagcccacgaucaaguggcgcgugaacgggagcccggucgacaaccaccccuucgccggcgacgugguguucccccgggagaucuccuucaccaaccuccagcccaaccacaccgcggucuaccagugcgaggccagcaacgugcacggcaccauccuggccaacgccaacaucgacguggucgacgugcgcccgcugauccagacgaaggacggggagaacuacgccaccgucgugggcuacuccgcguuccuccacugcgaguucuucgccagccccgaggccguggucuccuggcagaagguggaggaggugaagccccuggaggggcggcgcuaccacaucuacgagaacggcacccugcagaucaaccggaccacggaggaggacgccgggagcuacuccugcugggucgagaacgccaucggcaagaccgcggugaccgccaaccucgacauccgcaacgccaccaagcugcgggugagccccaagaacccgcgcauccccaagcugcacaugcucgagcugcacugcgaguccaagugcgacagccaccugaagcacucccucaagcugagcuggagcaaggacggcgaggccuucgagaucaacgggacggaggacggccggaucaucaucgacggggccaaccugaccaucuccaacgucacccucgaggaccagggcaucuacugcugcagcgcgcacaccgcccuggacuccgccgccgacaucacccaggugacggugcuggacguccccgacccgcccgagaaccuccaccugagcgagcgccagaaccgcuccgugcggcugaccugggaggcgggggccgaccacaacagcaacaucuccgaguacaucguggaguucgagggcaacaaggaggagcccggccgcugggaggagcugacccggguccaggggaagaagacgaccgugauccucccccuggcccccuucgugcgcuaccaguuccgggucaucgccgugaacgaggugggccgcagccagccgucccagcccagcgaccaccacgagaccccgcccgccgcgcccgaccggaacccccagaacauccgcguccaggccucccagcccaaggagaugaucaucaagugggagccccucaagagcauggagcagaacgggccgggccuggaguaccgggugaccuggaagccccagggcgcccccguggagugggaggaggagaccgucacgaaccacacccugcgcgugaugaccccggccguguacgcccccuacgacgucaaggugcaggcgaucaaccagcugggguccggccccgacccccagagcgugacccucuacuccggggaggacuacccggacacggcccccgucauccacggcguggacgugaucaacagcacccuggucaaggugaccugguccaccgugcccaaggaccggguccacgggcgccugaagggcuaccagaucaacugguggaagaccaagagccuccuggacggccggacgcaccccaaggaggugaacauccugcgcuucagcgggcagcggaacuccggcauggugccgagccucgacgccuucuccgaguuccaccugaccguccuggccuacaacagcaagggggccggccccgaguccgagcccuacaucuuccagacccccgagggggugccggagcagcccacguuccucaaggugaucaaggucgacaaggacaccgcgacccugagcuggggccugcccaagaagcucaacggcaaccugaccggguaccugcuccaguaccagaucaucaacgacacguacgagaucggcgagcugaacgacaucaacaucaccacccccuccaagccgagcuggcaccuguccaaccucaacgccaccacgaaguacaaguucuaccugcgcgccugcaccagccaggggugcggcaagcccaucaccgaggaguccagcacccugggggagggcaaguacgccggccucuacgacgacaucuccacgcaggggugguucaucggccugaugugcgcgaucgcccugcucacccugcugcuccugaccgugugcuucgugaagcggaaccgcgggggcaaguacagcgucaaggagaaggaggaccugcaccccgaccccgagauccaguccgugaaggacgagaccuucggggaguacagcgacuccgacgagaagccgcucaagggcagccugcggucccugaaccgcgacaugcagcccacggagagcgccgacagccucguggaguacggcgagggggaccacggccuguucuccgaggacgggagcuucaucggcgccuacgccggcuccaaggagaaggggagcgucgaguccaacggcagcuccaccgcgaccuucccccugcgcgccuga

SEQ ID NO: 28246 - RNA, 1962 nt, Artificial Sequence
  derived and/or modified sequence opt1 from CHM__Homo_sapiens__NP_000381
auggccgacacccugcccagcgaguucgacgugaucgucaucggcaccgggcuccccgaguccaucaucgccgcggccugcagccgcuccggccggcgcgugcugcacguggacagccgguccuacuacgggggcaacugggccagcuucuccuucagcgggcugcucuccuggcugaaggaguaccaggagaacagcgacaucgucuccgacagccccguguggcaggaccagauccuggagaacgaggaggccaucgcccucucccgcaaggacaagacgauccagcacguggaggucuucugcuacgcgagccaggaccugcacgaggacguggaggaggccggcgcccugcagaagaaccacgcccucgugaccuccgcgaacagcaccgaggccgccgacuccgccuuccugcccaccgaggacgagagccuguccacgaugagcugcgagaugcucaccgagcagacccccagcuccgacccggagaacgcccuggaggucaacggcgcggaggugaccggggagaaggagaaccacugcgacgacaagacgugcgugcccagcaccuccgccgaggacaugagcgagaacguccccaucgccgaggacaccaccgagcagcccaagaagaaccggaucacguacucccagaucaucaaggagggccgccgguucaacaucgaccuggugagcaagcuccuguacucccgcgggcugcucaucgaccugcugaucaagagcaacgugucccgguacgccgaguucaagaacaucacccgcauccucgccuuccgggagggccgcgucgagcaggucccgugcagccgggcggacguguucaacuccaagcagcugaccaugguggagaagcgcaugcugaugaaguuccucaccuucugcauggaguacgagaaguaccccgacgaguacaagggguacgaggagaucacguucuacgaguaccugaagacccagaagcugacccccaaccuccaguacaucgugaugcacagcaucgccaugaccuccgagacggccagcuccaccaucgacggccugaaggccaccaagaacuuccugcacugccucggccgguacgggaacacccccuuccuguucccgcuguacggccagggggagcucccccagugcuucugccgcaugugcgccguguucggcggcaucuacugccugcggcacagcguccagugccuggugguggacaaggagucccgcaagugcaaggcgaucaucgaccaguucgggcagcggaucaucagcgagcacuuccucgucgaggacuccuacuuccccgagaacaugugcagccgcgugcaguaccggcagaucagccgcgccguccugaucacggaccgcuccgugcugaagaccgacagcgaccagcagaucuccauccucaccgugcccgccgaggagccgggcaccuucgccguccgggugaucgagcugugcagcuccacgaugaccugcaugaaggggaccuaccuggugcaccugaccugcacgagcuccaagaccgcccgcgaggaccucgagagcgucgugcagaagcuguucgugcccuacaccgagauggagaucgagaacgagcaggucgagaagccccggauccucugggcgcuguacuucaacaugcgcgacuccagcgacaucucccggagcugcuacaacgaccugcccuccaacguguacgugugcagcggcccggacugcgggcucggcaacgacaacgccgucaagcaggccgagacccuguuccaggagaucugccccaacgaggacuucugcccgccgccgcccaaccccgaggacaucauccuggacggcgacucccugcagcccgaggccagcgaguccagcgcgauccccgaggccaacagcgagacguucaaggaguccaccaaccucgggaaccuggaggagagcuccgaguga

SEQ ID NO: 28247 - RNA, 1971 nt, Artificial Sequence
  derived and/or modified sequence opt1 from CHML__Homo_sapiens__NP_001812
auggccgacaaccugcccaccgaguucgacguggucaucaucggcaccgggcucccggagagcauccuggccgcggccugcucccgcagcggccagcgggugcugcacaucgacucccgcagcuacuacgggggcaacugggccuccuucagcuucuccgggcuccugagcuggcugaaggaguaccagcagaacaacgacaucggcgaggaguccacgguggucuggcaggaccucauccacgagaccgaggaggccaucacccugcggaagaaggacgagaccauccagcacacggaggccuucugcuacgcgagccaggacauggaggacaacguggaggagaucggcgcccugcagaagaaccccucccucggggugagcaacaccuucaccgagguccuggacuccgcccugcccgaggagagccagcucuccuacuucaacagcgacgagaugcccgccaagcacacccagaaguccgacacggagaucagccuggaggugaccgacguggaggaguccgucgagaaggagaaguacugcggcgacaagaccugcaugcacaccgugagcgacaaggacggggacaaggacgagagcaaguccacgguggaggacaaggcggacgagccgauccgcaaccggaucaccuacagccagaucgucaaggagggccgccgguucaacaucgaccugguguccaagcuccuguacagccaggggcugcucaucgaccugcugaucaaguccgacgugagccgcuacgucgaguucaagaacgugacccggauccucgccuuccgcgagggcaagguggagcagguccccugcucccgggccgacguguucaacagcaaggagcugaccaugguggagaagcgcaugcugaugaaguuccucacguucugccuggaguacgagcagcaccccgacgaguaccaggccuuccggcagugcuccuucagcgaguaccugaagaccaagaagcucacccccaaccugcagcacuucguccugcacuccaucgccaugaccagcgaguccagcugcacgaccaucgacggccucaacgcgaccaagaacuuccugcagugccuggggcgcuucggcaacaccccguuccucuucccccuguacgggcagggcgagaucccccagggcuucugccggaugugcgccguguucgggggcaucuacugccugcgccacaaggugcagugcuucgucguggacaaggaguccgggcggugcaaggccaucaucgaccacuucggccagcgcaucaacgccaaguacuucaucgucgaggacagcuaccucuccgaggagacgugcagcaacgugcaguacaagcagaucucccgggccgugcugaucaccgaccagagcauccugaagaccgaccucgaccagcagaccagcauccugaucgugcccccggcggagcccggggccugcgccguccgcgugacggagcugugcuccagcaccaugaccugcaugaaggacaccuaccucguccaccugacgugcuccagcuccaagaccgcccgggaggaccuggagagcguggugaagaagcuguucacccccuacaccgagacggagaucaacgaggaggagcucaccaagccccgccugcucugggcccuguacuucaacaugcgcgacuccagcggcaucucccggagcuccuacaacggccugccgagcaacgucuacgugugcuccgggcccgacugcggccuggggaacgagcacgcggugaagcaggccgagacccucuuccaggagaucuuccccaccgaggaguucugcccgcccccgcccaaccccgaggacaucaucuucgacggcgacgacaagcagcccgaggcccccgggaccaacaacgucgugauggccaagcuggagagcuccgaggagagcaagaaccuggagucccccgagaagcaccuccagaacuga

SEQ ID NO: 28248 - RNA, 723 nt, Artificial Sequence
  derived and/or modified sequence opt1 from CHMP1A__Homo_sapiens__NP_001076783
auggacgugcacggcgaggccgccggggaggcgggccaggagggcggggaggggcugcagggcggcgccgggcagagcgaggagggccccuccgccgagaagugccgcgucugcccgugcgugugccgggagcgccacccccaggaggagcggcgcugcgagcucgccagcgacggggugccccggcgccgguccggccugcagggggccgacagcugcgacuacgagggcggcgaccaggaguacgggcccggcgaccaguccccggggcagggccccgagcaccacggccccgcggaggggcugcucagcgacggccagguccgcgccgccggggccgagcccggccggccguacaucggggacggcggccugcacgagcuggggcaccaccccgaccacgcggccggcgccgggggccagccccaccacgccgaccgccgcggggaguggcccggcggcgccgggccggcgcagcccgccgcccggggccggcucugccgcgggcgggagcugugcgcccagcccggcgggcccgccgugaccgaggugggccgccuggaggagcucgcggucccgcggcgcugcgccccgccccugccccgggacgugcuggagggcuccugcccccuccccaccgccagcugccugugcgccgaccccgccgggcugcgccccgcggccacgcuccggcuguccccggcccgccccgccuggcccuga

SEQ ID NO: 28249 - RNA, 600 nt, Artificial Sequence
  derived and/or modified sequence opt1 from CHMP1B__Homo_sapiens__NP_065145
augagcaacauggagaagcaccuguucaaccucaaguucgccgccaaggagcugucccgcagcgcgaagaagugcgacaaggaggagaaggccgagaaggccaagaucaagaaggccauccagaagggcaacauggagguggcccggauccacgcggagaacgccauccgccagaagaaccaggccgucaacuuccugcggauguccgcccgcguggacgcgguggccgcccggguccagaccgccgugaccauggggaaggugaccaagagcauggccggcgucgugaaguccauggacgcgacccucaagaccaugaaccuggagaagaucagcgcccugauggacaaguucgagcaccaguucgagacccucgacgugcagacgcagcagauggaggacaccauguccagcaccaccacgcugaccacgccccagaaccaggucgacaugcugcuccaggagauggccgacgaggccgggcuggaccugaacauggagcucccgcagggccagaccggguccgugggcacgagcguggccuccgcggagcaggacgagcugagccagcgccuggcccggcuccgcgaccaggucuga

SEQ ID NO: 28250 - RNA, 519 nt, Artificial Sequence
  derived and/or modified sequence opt1 from CHMP2B__Homo_sapiens__NP_001231573
auggagcuggagaucaagaagauggccaagaucggcaacaaggaggccugcaaggugcucgcgaagcagcugguccaccuccgcaagcagaagacccggaccuucgccgugagcuccaaggugacgagcauguccacccagaccaaggucaugaacagccagaugaagauggccggggccauguccaccacggccaagaccaugcaggcggugaacaagaagauggacccccagaagacccugcagaccaugcagaacuuccagaaggagaacaugaagauggagaugacggaggagaugaucaacgacacccuggacgacaucuucgacggcagcgacgacgaggaggagucccaggacaucgugaaccagguccuggacgagaucgggaucgagaucagcggcaagauggccaaggccccguccgccgcgcgcagccuccccuccgccagcaccuccaaggccaccaucagcgacgaggagaucgagcggcagcugaaggcccuggggguggacuga

SEQ ID NO: 28251 - RNA, 471 nt, Artificial Sequence
  derived and/or modified sequence opt1 from CHMP3__Homo_sapiens__NP_001005753
augauccgcagccggaaggccguguccaagcuguacgccagcaaggcgcacaugaacuccguccucaugggcaugaagaaccagcuggccgugcugcgcguggccgggagccuccagaaguccaccgaggucaugaaggccaugcagagccuggugaagauccccgagauccaggccaccaugcgggagcuguccaaggagaugaugaaggcgggcaucaucgaggagaugcucgaggacacguucgagagcauggacgaccaggaggagauggaggaggaggccgagauggagaucgaccgcauccuguucgagaucaccgccggggcccugggcaaggcgccguccaaggugaccgacgcccuccccgagcccgagcccccgggggccauggccgccagcgaggacgaggaggaggaggaggaggcgcuggaggccaugcagucccggcuggccacccuccgcagcuga

SEQ ID NO: 28252 - RNA, 798 nt, Artificial Sequence
  derived and/or modified sequence opt1 from CHMP4A__Homo_sapiens__NP_054888
augagccgccggcgccccgaggacggccuggggaaggccggcccgugcgugaugcggcaccacccgccccgcuccaaggccgaggucuggcggacccuccgcgggggcgggggccggggcgagcuggcgaugagcgggcugggccgccucuucgggaagggcaagaaggagaaggggcccacccccgaggaggccauccagaagcugaaggagacggagaagauccugaucaagaagcaggaguuccucgagcagaagauccagcaggagcugcagaccgccaagaaguacggcaccaagaacaagcgggccgcccugcaggcgcuccgccggaagaagcgcuucgagcagcagcuggcccagaccgacggcacgcuguccacccucgaguuccagcgggaggccaucgagaacgccaccaccaacgcggaggugcugcgcacgauggagcuggccgcccagagcaugaagaaggccuaccaggacauggacaucgacaagguggacgagcucaugaccgacaucaccgagcagcaggaggucgcccagcagaucuccgacgcgaucagccggcccaugggguucggcgacgacguggacgaggacgagcugcuggaggagcucgaggagcuggagcaggaggagcuggcccaggagcuccugaacgugggggacaaggaggaggagcccuccgucaagcugcccagcgugccguccacccaccuccccgccggccccgcccccaagguggacgaggacgaggaggcccugaagcagcuggcggagugggucagcuga

SEQ ID NO: 28253 - RNA, 675 nt, Artificial Sequence
  derived and/or modified sequence opt1 from CHMP4B__Homo_sapiens__NP_789782
augagcguguucggcaagcuguucggggccggcgggggcaaggccgggaagggcggccccaccccgcaggaggcgauccagcgccuccgggacaccgaggagaugcuguccaagaagcaggaguuccuggagaagaagaucgagcaggagcucacggccgccaagaagcacgggaccaagaacaagcgcgccgcccugcaggcgcugaagcggaagaagcgcuacgagaagcagcucgcccagaucgacggcacccugagcaccaucgaguuccagcgggaggcccuggagaacgccaacacgaacaccgagguccucaagaacaugggguacgcggccaaggccaugaaggccgcccacgacaacauggacaucgacaagguggacgagcugaugcaggacaucgcggaccagcaggagcuggccgaggagaucuccaccgccaucagcaagcccgugggcuucggggaggaguucgacgaggacgagcucauggccgagcuggaggagcuggagcaggaggagcucgacaagaaccugcuggagaucuccggccccgagaccgucccccucccgaacgugcccagcaucgcccugcccuccaagcccgcgaagaagaaggaggaggaggacgacgacaugaaggagcuggagaacugggccggcagcauguga

SEQ ID NO: 28254 - RNA, 702 nt, Artificial Sequence
  derived and/or modified sequence opt1 from CHMP4C__Homo_sapiens__NP_689497
augagcaagcugggcaaguucuucaagggcggcggguccagcaagucccgcgccgcccccagcccgcaggaggcgcucgugcggcugcgcgagaccgaggagaugcuggggaagaagcaggaguaccucgagaaccggauccagcgcgagaucgcccuggccaagaagcacgggacccagaacaagcgggccgcccugcaggcgcucaagcgcaagaagcgguucgagaagcagcugacgcagaucgacggcacccuguccaccaucgaguuccagcgcgaggcccucgagaacagccacaccaacacggagguccugcggaacaugggcuucgccgccaaggcgaugaaguccgugcacgagaacauggaccugaacaagaucgacgaccucaugcaggagaucaccgagcagcaggacaucgcccaggagaucagcgaggccuucucccagcgcgugggguucggcgacgacuucgacgaggacgagcugauggccgagcuggaggagcucgagcaggaggagcugaacaagaagaugaccaacauccggcugcccaacguccccagcuccagccuccccgcccagccgaaccgcaagcccgggauguccagcaccgcgcggcgcucccgggccgccagcucccagcgcgccgaggaggaggacgacgacaucaagcagcuggccgcgugggccacguga

SEQ ID NO: 28255 - RNA, 516 nt, Artificial Sequence
  derived and/or modified sequence opt1 from CHMP5__Homo_sapiens__NP_001182465
augaaccgccuguucggcaaggccaagcccaaggccccgccgcccagccucaccgacugcaucgggaccguggacucccgggcggagagcaucgacaagaagaucucccgccuggacgccgagcuggugaaguacaaggaccagaucaagaagaugcgggagggccccgccaagaacauggugaagcagaaggcccuccgcgugcugaagcagaagcggauguacgagcagcagcgcgacaaccuggcccagcagagcuucaacauggagcaggcgaacuacacgauccagucccucaaggacaccaagaccaccgucgacgccaugaagcugggggugaaggagaugaagaaggccuacaagcaggucaagaucgaccagaucgaggaccugcaggaccagcucgaggacaugauggaggacgccaacgagauccaggaggcgcugagccgguccuacggcacgcccgagcuggacgaggacgaccucgaggccggguggagcuccggcggcuga

SEQ ID NO: 28256 - RNA, 1302 nt, Artificial Sequence
  derived and/or modified sequence opt1 from CHN1__Homo_sapiens__NP_001020372
auggcccugacccucuucgacaccgacgaguaccggcccccgguguggaaguccuaccuguaccagcugcagcaggaggcgccccacccccgccgcaucacgugcacgugcgaggucgagaaccggcccaaguacuacggccgcgaguuccacgggaugaucagccgggaggccgccgaccagcuccugaucguggccgagggcagcuaccugauccgcgagucccagcggcagccggggaccuacacccucgcccugcgcuucggcagccagacccggaacuuccgccuguacuacgacgggaagcacuucgugggcgagaagcgguucgaguccauccacgaccucgucaccgacggccugaucacccuguacaucgagaccaaggccgcggaguacaucgccaagaugacgaucaaccccaucuacgagcacgugggguacaccacccucaaccgcgagcccgccuacaagaagcacaugcccgugcugaaggagacccacgacgagcgggacagcacgggccaggacggggucuccgagaagcgcgugcacaccuuccggggcccgcacuggugcgaguacugcgccaacuucaugugggggcugaucgcgcagggcgugaagugcgccgacugcggccucaacguccacaagcagugcagcaagauggugcccaacgacugcaagcccgaccugaagcacgugaagaaggucuacuccugcgaccugaccacccucgugaaggcccacacgaccaagcgccccaugguggucgacaugugcauccgggagaucgagagccgcgggcugaacuccgagggccuguaccgggugagcggguucuccgaccucaucgaggacgugaagauggccuucgaccgcgacggcgagaaggccgacaucagcgucaacauguacgaggacaucaacaucaucaccggcgcgcugaagcuguacuuccgggaccucccgaucccccugaucaccuacgacgccuaccccaaguucaucgaguccgccaagaucauggaccccgacgagcagcuggagacgcuccacgaggcccugaagcugcucccgcccgcccacugcgagacccugcgcuaccugauggcgcaccucaagcgcgugacccugcacgagaaggagaaccugaugaacgccgagaaccucgggaucguguucggccccacccugaugcggagccccgagcuggacgccauggccgcccucaacgacauccgcuaccagcggcuggucguggagcugcucaucaagaacgaggacauccuguucuga

SEQ ID NO: 28257 - RNA, 999 nt, Artificial Sequence
  derived and/or modified sequence opt1 from CHN2__Homo_sapiens__NP_001035025
auguucagcgaggagcuguggcucgagaacgagaagaagugcgccgugguccgcaaguccaagcagggccggaagcgccaggagcugcuggccguggcguucggggugaaggucggcgugaagggcggguuccucuggcccccgcugaagcuguucgccugcagccagaucuccagccucgugcggcgcgccgcccugacccacaacgacaaccacuucaacuacgagaagacccacaacuucaagguccacacguuccgggggccccacuggugcgaguacugcgccaacuucauguggggccugaucgcgcagggcgugcgcugcuccgacugcgggcucaacgugcacaagcagugcagcaagcacguccccaacgacugccagcccgaccugaagcggaucaagaagguguacugcugcgaccugaccacccucgugaaggcccacaacacccagcgcccgauggucguggacaucugcauccgggagaucgaggcccgcggccugaaguccgaggggcuguaccgggugagcggcuucacggagcacaucgaggacgucaagauggccuucgaccgcgacggggagaaggcggacaucuccgccaacguguaccccgacaucaacaucaucaccggcgcccucaagcuguacuuccgggaccugcccauccccgugaucaccuacgacaccuacagcaaguucaucgacgccgccaagaucuccaacgcggacgagcgccucgaggccguccacgaggugcugaugcugcucccgcccgcccacuacgagacgcugcgguaccugaugauccaccucaagaaggugaccaugaacgagaaggacaacuucaugaacgccgagaaccugggcaucgucuucgggcccacccugaugcggcccccggaggacagcacccucacgacccugcacgacaugcgcuaccagaagcugaucgugcagauccucaucgagaacgaggacgugcuguucuga

SEQ ID NO: 28258 - RNA, 765 nt, Artificial Sequence
  derived and/or modified sequence opt1 from CHODL__Homo_sapiens__NP_001191103
augaccgccggcagcgcccacucccagaaggugugcuucgcggacuucaagcaccccugcuacaagauggccuacuuccacgagcugagcucccgcgucagcuuccaggaggcccggcucgccugcgaguccgagggcggggugcugcugagccucgagaacgaggccgagcagaagcugaucgaguccaugcugcagaaccucaccaagccggggacgggcaucagcgacggggacuucuggaucggccuguggcgcaacggcgacgggcagaccuccggcgcgugccccgaccuguaccaguggagcgacggguccaacagccaguaccggaacugguacaccgacgagcccuccugcggcagcgagaagugcguggucauguaccaccagcccaccgccaacccggggcucggcggccccuaccuguaccaguggaacgacgaccgcugcaacaugaagcacaacuacaucugcaaguacgagcccgagaucaaccccacggccccgguggagaagcccuaccugaccaaccagcccggggacacccaccagaacguggucgugaccgaggccggcaucauccccaaccucaucuacguggucaucccgacgaucccccugcugcuccugauccugguggcguucgggaccugcugcuuccagaugcuccacaaguccaagggccggaccaagaccagccccaaccaguccacgcuguggaucagcaaguccacccgcaaggagagcggcauggagguguga

SEQ ID NO: 28259 - RNA, 942 nt, Artificial Sequence
  derived and/or modified sequence opt1 from CHORDC1__Homo_sapiens__NP_001137545
auggcccugcucugcuacaaccgcggcugcgggcagcgguucgaccccgagaccaacagcgacgacgccugcaccuaccacccgggcgugcccgucuuccacgacgcgcugaaggggugcacgaagggccgccacaacuccgagaagccgcccgagcccgugaagcccgaggugaagaccaccgagaagaaggagcugugcgagcucaagcccaaguuccaggagcacaucauccaggcccccaagccggucgaggccaucaagcggcccagccccgacgagcccaugaccaaccuggagcugaagaucuccgccagccucaagcaggcccuggacaagcugaagcucuccagcgggaacgaggagaacaagaaggaggaggacaacgacgagaucaagaucggcacguccugcaagaacggcgggugcagcaagaccuaccagggccuggagucccuggaggaggugugcguguaccacagcggggucccgaucuuccacgagggcaugaaguacugguccugcugccgccggaagaccagcgacuucaacaccuuccucgcgcaggaggggugcacgaagggcaagcacauguggaccaagaaggacgccggcaagaagguggugcccugccgccacgacuggcaccagaccgggggcgaggucaccaucuccguguacgccaagaacagccugcccgagcugucccggguggaggccaacagcacgcuccugaacguccacaucguguucgagggggagaaggaguucgaccagaacgugaagcuguggggcgucaucgacgugaagcgcuccuacgugaccaugaccgcgaccaagaucgagaucacgaugcggaaggccgagcccaugcagugggccagccucgagcugccggccgccaagaagcaggagaagcagaaggacgcgaccaccgacuga

SEQ ID NO: 28260 - RNA, 588 nt, Artificial Sequence
  derived and/or modified sequence opt1 from CHP1__Homo_sapiens__NP_009167
augggcagccgcgccuccacccugcuccgggacgaggagcuggaggagaucaagaaggagaccggguucagccacucccagaucacgcgccuguacagccgguucaccucccucgacaagggcgagaacgggacccugagccgcgaggacuuccagcggauccccgagcuggccaucaacccgcucggcgaccgcaucaucaacgcguucuuccccgagggggaggaccaggugaacuuccggggcuucaugcgcacccuggcccacuuccggcccaucgaggacaacgagaaguccaaggacgucaacggccccgagccgcugaacagccgcuccaacaagcuccacuucgccuuccggcuguacgaccuggacaaggacgagaagaucagccgcgacgagcuccuccaggugcugcggaugauggugggggucaacaucuccgacgagcagcugggcagcaucgccgaccgcacgauccaggaggccgaccaggacggggacuccgcgaucagcuucaccgaguucgugaaggugcuggagaaggucgacguggagcagaagauguccauccgguuccugcacuga

SEQ ID NO: 28261 - RNA, 591 nt, Artificial Sequence
  derived and/or modified sequence opt1 from CHP2__Homo_sapiens__NP_071380
augggcagccgcuccagccacgccgccgugauccccgacggggacuccauccggcgcgagaccggcuucagccaggcgucccugcuccggcugcaccaccgcuuccgggcccuggaccgcaacaagaagggguaccucagccggauggaccugcagcagaucggcgcccuggccgucaacccgcucggggaccgcaucaucgaguccuucuuccccgacggcagccagcggguggacuuccccggcuucgugcgcguccuggcccacuuccggcccguggaggacgaggacaccgagacgcaggacccgaagaagcccgagccccugaacucccgccggaacaagcuccacuacgcguuccagcuguacgaccuggaccgcgacgggaagaucagccggcacgagaugcuccaggugcugcgccugauggucggcguccaggugaccgaggagcagcucgagaacaucgccgaccggaccgugcaggaggccgacgaggacggggacggcgccguguccuucguggaguucaccaagagccuggagaagauggacgucgagcagaagauguccauccgcauccugaaguga

SEQ ID NO: 28262 - RNA, 2328 nt, Artificial Sequence
  derived and/or modified sequence opt1 from CHPF__Homo_sapiens__NP_078812
augcgcgccagccugcuccuguccgugcugcggcccgccggcccggucgcgguggggaucagccucggcuucacccugucccugcucagcgugaccugggucgaggagcccugcgggcccgggcccccgcagcccggggacuccgagcugccgccccgcggcaacacgaacgccgcccggcgccccaacagcgugcagcccggcgccgagcgggagaagcccggggccggcgagggggcgggcgagaacugggagccccgcgugcugccguaccaccccgcccagcccgggcaggccgccaagaaggcgguccggacccgcuacaucuccaccgagcucggcauccggcagcgccugcugguggccgugcucaccagccagacgacccugcccacccugggcgucgccgugaaccggacccucgggcaccgccuggagcggguggucuuccugacgggcgcccgcgggcggcgcgccccgcccggcauggcgguggugacccucggcgaggagcggcccaucgggcaccuccaccuggcccugcgccaccuccuggagcagcacggcgacgacuucgacugguucuuccugguccccgacaccaccuacacggaggcccacgggcuggcccggcugaccggccaccucucccuggccagcgcggcccaccuguaccucgggcgcccgcaggacuucaucggcggcgagcccacccccgggcgguacugccacggcggguucggcgugcugcugucccgcaugcuccugcagcagcugcgcccccaccucgaggggugccggaacgacaucgugagcgcccgcccggacgaguggcugggccggugcauccuggacgccaccggcgucgggugcacgggcgaccacgagggggugcacuacucccaccucgagcugagccccggcgagcccgugcaggagggggacccccacuuccgcuccgcccugaccgcgcacccgguccgggaccccgugcacauguaccagcuccacaaggccuucgcccgcgccgagcuggagcggaccuaccaggagauccaggagcugcagugggagauccagaacaccagccaccucgccguggacggcgaccgcgcggccgccuggcccgucggcaucccggcccccucccggcccgcgagccgcuucgaggugcugcggugggacuacuucacggagcagcacgccuucuccugcgccgacgggagcccccgcugcccgcugcggggcgccgaccgcgccgacgucgcggacgugcucgggaccgcccuggaggagcugaaccggcgcuaccaccccgcccugcggcuccagaagcagcagcuggugaacggcuaccgccgguucgaccccgcccgcggcauggaguacacccuggaccuccagcuggaggcccugacgccccagggcggccgccggccgcucacccgccggguccagcugcugcgcccccucagccggguggagauccugcccgugcccuacgucaccgaggcgucccgccugaccgugcuccugccgcuggccgccgccgagcgggaccucgcccccggguuccuggaggcguucgccaccgccgcccuggagcccggcgacgcggccgccgcccucacgcugcugcuccuguacgagccccgccaggcccagcggguggcgcacgccgacgucuucgccccggugaaggcccacguggccgagcuggagcgccgguuccccggggcgcgcguccccuggcucagcgugcagaccgccgcccccuccccgcugcggcugauggaccuccugagcaagaagcacccccuggacacccucuuccugcuggccggccccgacaccgugcucacgcccgacuuccugaaccgcugccggaugcacgccaucuccggcuggcaggcguucuucccgaugcacuuccaggccuuccaccccgccgucgcgcccccgcaggggcccggcccgcccgagcuggggcgcgacaccggccgguucgaccgccaggccgccagcgaggccugcuucuacaacuccgacuacguggccgcccgggggcgccucgcggccgccagcgagcaggaggaggagcugcuggagucccucgacguguacgagcuguuccugcacuucagcucccuccacguccugcgggccguggagcccgcccugcuccagcgcuaccgcgcgcagaccugcagcgcccggcuguccgaggaccuguaccaccgcugccuccagagcgugcuggagggccugggcucccggacccagcucgccaugcugcuguucgagcaggagcaggggaacagcacguga

SEQ ID NO: 28263 - RNA, 1221 nt, Artificial Sequence
  derived and/or modified sequence opt1 from CHPT1__Homo_sapiens__NP_064629
auggccgccggcgcgggggccggcagcgcgccccgcuggcugcgggcccucuccgagccgcugagcgccgcccagcugcgccggcucgaggagcaccgcuacuccgccgccggggugagccugcuggagccgccccuccagcuguacuggaccuggcugcuccaguggaucccccuguggauggcccccaacuccaucacccugcucggccuggcggucaacguggugacgacccugguccucaucagcuacugccccaccgccaccgaggaggcccccuacuggacguaccugcugugcgcccucgggcuguucaucuaccagucccuggacgccaucgacggcaagcaggcgcggcgcaccaacagcugcagcccccucggcgagcuguucgaccacgggugcgacagccuguccaccguguucauggccgugggcgccagcaucgccgcccggcucgggaccuacccggacugguucuucuucugcuccuucaucggcauguucgucuucuacugcgcgcacuggcagacguacgugagcgggaugcugcgcuucggcaagguggacgucaccgagauccagaucgcccuggugaucguguucguccucuccgccuucggcggggccaccaugugggacuacaccauccccauccuggagaucaagcugaagauccuccccgugcugggcuuccucgggggcgugaucuucagcugcuccaacuacuuccacgucauccuccacggcggggugggcaagaacgggagcacgaucgccggcaccuccgugcugagccccgggcugcacaucggccucaucaucauccuggcgaucaugaucuacaagaaguccgccaccgacgucuucgagaagcacccgugccuguacauccucauguucggcugcguguucgccaaggugucccagaagcuggucguggcccacaugaccaagagcgagcuguaccuccaggacacgguguuccuggggcccggccugcuguuccuggaccaguacuucaacaacuucaucgacgaguacgucgugcuguggauggccauggucaucuccagcuucgacauggugaucuacuucuccgcgcucugccugcagaucagccggcaccuccaccugaacaucuucaagaccgccugccaccaggcccccgagcagguccaggugcuguccagcaagucccaccagaacaacauggacuga

SEQ ID NO: 28264 - RNA, 396 nt, Artificial Sequence
  derived and/or modified sequence opt1 from CHRAC1__Homo_sapiens__NP_059140
auggccgacguggucgugggcaaggacaagggcggggagcagcgccugaucagccucccccugucccggauccgcgugaucaugaaguccagcccggaggucagcuccaucaaccaggaggcccuggugcucaccgcgaaggccaccgagcuguucgugcagugccuggccacguacagcuaccggcacggguccggcaaggagaagaagguccucaccuacagcgaccuggccaacaccgcccagcaguccgagaccuuccaguuccuggcggacauccuccccaagaagauccuggccagcaaguaccugaagaugcucaaggaggagaagcgcgaggaggacgaggagaacgacaacgacaacgaguccgaccacgacgaggccgacagcuga

SEQ ID NO: 28265 - RNA, 2865 nt, Artificial Sequence
  derived and/or modified sequence opt1 from CHRD__Homo_sapiens__NP_001291401
augcccagccugccggccccccccgccccccuccugcugcucggccugcugcuccuggggucccgcccggcgcggggcgccgggcccgagccccccgugcugccgauccgcagcgagaaggagccccuccccguccggggcgccgccgggugcaccuucggcggcaagguguacgcccuggacgagaccuggcaccccgaccugggggagccguucggcgugaugcgcugcguccucugcgcgugcgaggccccccagugggggcggcgcacgcggggccccgggcgcguguccugcaagaacaucaagcccgagugcccgacccccgccugcggccagccccggcagcugcccggccacugcugccagaccugcccgcaggagcgcagcuccagcgagcggcagcccuccgggcugagcuucgaguacccccgcgaccccgagcaccgguccuacagcgaccgcggcgagccgggggccgaggagcgggcgcgcggcgacggccacaccgacuucguggcccuccugacggggccccggucccaggccgucgcccgcgcccgggugagccugcuccgcuccagccugcgguucuccaucagcuaccgccgccuggaccggcccacccgcauccgguucuccgacagcaacggcuccgugcucuucgagcaccccgcggccccgacccaggacgggcuggucugcggcguguggcgcgccgugccccggcugagccuccgccugcugcgggccgagcagcuccacgucgcccuggugacccugacgcaccccagcggggagguguggggcccgcucauccgccaccgggcgcuggccgccgagaccuucuccgccauccugacccucgagggccccccccagcagggggucggcgggaucacccugcugacgcucagcgacaccgaggacucccugcacuuccugcuccuguuccgcggccugcucgagccccggagcgggggccugacccaggugccgcugcgccuccagauccugcaccagggccagcugcuccgggagcugcaggccaacguguccgcgcaggagcccggguucgccgagguccugcccaaccugaccgugcaggagauggacuggcucgugcugggcgagcugcagauggcccucgagugggccgggcgccccggccugcggaucagcgggcacaucgccgcgcgcaaguccugcgacguccugcagagcgugcucugcggcgccgacgcccugaucccggugcagacgggcgccgcgggguccgccagccugacccuccugggcaacgggucccugaucuaccagguccagguggucggcaccagcuccgaggugguggccaugacccucgagacgaagccccagcggcgcgaccagcggaccguccugugccacauggccggccugcagcccgggggccacaccgccguggggaucugccccggccucggggcgcgcggcgcccacaugcugcugcagaacgagcucuuccugaacgugggcaccaaggacuucccggacggggagcugcgcggccacgucgccgcccuccccuacugcgggcacagcgcccggcacgacacgcugcccgugccccuggcgggcgcccucgugcugccgcccgucaagucccaggccgccgggcacgccuggcugagccucgacacccacugccaccugcacuacgaggugcugcucgcgggccugggcggguccgagcagggcaccgugaccgcccaccugcucgggccccccggcacgccggggccccgccggcugcugaagggcuucuacggcagcgaggcccagggggucgugaaggaccucgagcccgagcugcugcgccaccucgccaagggcauggcgucccugaugaucaccaccaaggggagcccccggggcgagcugcgcgggcaggugcacaucgccaaccagugcgaggucggcggccuccggcuggaggccgccggggccgagggcgugcgcgcgcugggggccccggacaccgccagcgccgccccccccguggucccgggccuccccgcgcuggcccccgccaagcccggcgggccgggccggccccgcgaccccaacacgugcuucuucgaggggcagcagcggccccacggcgcccgcugggccccgaacuacgacccccugugcucccucugcaccugccagcggcgcaccgugaucugcgaccccguggucugccccccgcccagcugcccccaccccgugcaggcgccggaccagugcugccccgugugccccgagaagcaggacguccgggaccugcccgggcugccgcgcucccgggaccccggcgagggcugcuacuucgacggggaccgcagcuggcgggccgccggcacccgcuggcaccccguggugcccccguucgggcucaucaagugcgccgucugcacgugcaagggcgggaccggcgaggugcacugcgagaaggugcagugcccccggcuggcgugcgcccagcccguccgcgugaaccccaccgacugcugcaagcagugcccggugggcuccggggcccacccccagcugggcgaccccaugcaggccgacgggccgcgcggcugccgguucgccgggcagugguuccccgagagccaguccuggcaccccagcguccccccguucggcgagauguccugcaucaccugccgcugcggcgcgggggugccccacugcgagcgggacgacugcagccucccccuguccugcggcagcgggaaggagucccgcugcugcagccggugcaccgcccaccgccggcccccggagacgcgcaccgaccccgagcuggagaaggaggccgagggcuccuga

SEQ ID NO: 28266 - RNA, 1137 nt, Artificial Sequence
  derived and/or modified sequence opt1 from CHRDL1__Homo_sapiens__NP_001137455
augcgcaagaaguggaagaugggcgggaugaaguacaucuucagccuccuguucuuccugcugcucgagggcgggaagaccgagcaggucaagcacuccgagaccuacugcauguuccaggacaagaaguaccgggugggcgagcgcuggcaccccuaccuggagccguacgggcugguguacugcgugaacugcaucugcagcgagaacggcaacguccucugcucccgggugcgcugccccaacgugcacugccugagccccguccacaucccccaccugugcugcccgcggugccccggcgacggggagcucuccugggagcacagcgacggcgacaucuuccgccagcccgccaaccgggaggcccgccacuccuaccaccggagccacuacgacccgccgcccucccgccaggccgggggccugagccgguuccccggggcgcgcucccaccggggcgcccugauggacagccagcaggccuccggcacgaucgugcagaucgugaucaacaacaagcacaagcacgggcaggucugcgugagcaacggcaagaccuacucccacggggagagcuggcaccccaaccuccgcgccuucggcaucguggagugcguccugugcacgugcaacgugaccaagcaggagugcaagaagauccacugccccaaccgguaccccugcaaguacccccagaagaucgacggcaagugcugcaaggugugccccgggaagaaggcgaaggaggagcugccgggccaguccuucgacaacaagggguacuucugcggcgaggagaccaugcccgucuacgagagcguguucauggaggacggggagaccacccgcaagaucgcccucgagaccgagcggccgccccagguggagguccacguguggacgauccgcaagggcauccugcagcacuuccacaucgagaagaucuccaagcggauguucgaggagcugccccacuucaagcucgugacccgcaccacccugagccaguggaagaucuucacggagggcgaggcccagaucagccagaugugcuccagccgggucugccgcaccgagcuggaggaccucgugaaggugcuguaccuggagcgcuccgagaaggggcacugcuga

SEQ ID NO: 28267 - RNA, 1239 nt, Artificial Sequence
  derived and/or modified sequence opt1 from CHRFAM7A__Homo_sapiens__XP_011520455
augcagaaguacugcaucuaccagcacuuccaguuccagcugcucauccagcaccuguggaucgccgccaacugcgacaucgcggacgagcgcuucgacgccaccuuccacaccaacgugcuggucaacagcuccggccacugccaguaccugcccccggggaucuucaagagcuccugcuacaucgacgugcggugguuccccuucgacgugcagcacugcaagcugaaguucggcagcugguccuacgggggcuggagccuggaccuccagaugcaggaggccgacaucuccggguacauccccaacggcgagugggaccuggucggcauccccgggaagcgcagcgagcgguucuacgagugcugcaaggagccguaccccgacgugacguucaccgugaccaugcgccggcgcacccuguacuacggccucaaccugcugauccccugcguccucaucuccgcccuggcccugcucguguuccugcugcccgcggacagcggggagaagaucucccucggcaucacggugcugcugagccucaccgucuucaugcugcugguggccgagaucaugccggccaccuccgacagcgugccccucaucgcccaguacuucgcguccaccaugaucaucgucgggcugagcgugguggucacggugaucgugcugcaguaccaccaccacgaccccgacggcggcaagaugcccaaguggacccgggucauccuccugaacuggugcgccugguuccugcgcaugaagcggccgggggaggacaaggugcgccccgccugccagcacaagcagcggcgcugcucccucgccagcguggagauguccgccgucgcgcccccgcccgccagcaacggcaaccugcuguacaucggguuccggggccucgacggcgugcacugcgugcccacccccgacagcggggucgugugcggccgcauggccugcucccccacccacgacgagcaccuccugcacgggggccagccgcccgagggggaccccgaccucgccaagauccuggaggagguccgguacaucgccaaccgcuuccggugccaggacgagagcgaggcggugugcuccgaguggaaguucgccgccugcguggucgaccgccugugccucauggccuucagcguguucacgaucaucugcaccaucggcauccugauguccgcccccaacuucguggaggcggucagcaaggacuucgccuga

SEQ ID NO: 28268 - RNA, 1383 nt, Artificial Sequence
  derived and/or modified sequence opt1 from CHRM1__Homo_sapiens__XP_011543044
augaacaccagcgcgcccccggccgugucccccaacaucaccguccuggcccccggcaaggggcccuggcaggucgccuucaucggcaucacgaccgggcuccugagccuggccaccgugaccggcaaccuccuggugcugaucuccuucaaggugaacacggagcucaagaccgugaacaacuacuuccugcugagccucgccugcgccgaccugaucaucgggaccuucuccaugaaccuguacaccacguaccuccugaugggccacugggcgcugggcacccucgccugcgaccuguggcuggcccucgacuacgucgccagcaacgcguccgugaugaaccugcugcucaucagcuucgaccgcuacuucuccgugacccggccgcugagcuaccgcgccaagcggacgccccgccgggccgcccugaugaucgggcucgccuggcuggucuccuucgugcugugggcgcccgccauccucuucuggcaguaccuggugggcgagcgcaccguccuggccgggcagugcuacauccaguuccucagccagcccaucaucaccuucggcaccgccauggccgcguucuaccugccggugaccgugaugugcacgcuguacuggcggaucuaccgcgagaccgagaaccgggcccgcgagcucgccgcccugcagggguccgagacccccggcaagggcgggggcagcuccagcuccagcgagcggucccagcccggggccgagggcagccccgagaccccgcccggccgcugcugccggugcugccgcgcgccccggcugcuccaggccuacagcuggaaggaggaggaggaggaggacgagggguccauggagagccugacguccagcgagggcgaggagcccggguccgaggucgugaucaagaugccgaugguggaccccgaggcccaggcccccaccaagcagcccccgcgcagcucccccaacaccgucaagcggcccaccaagaagggccgcgaccgggccgggaagggccagaagccccgcggcaaggagcagcuggcgaagcggaagacguucagccucgugaaggagaagaaggccgcccgcacccuguccgccauccugcucgcguucauccugaccuggaccccguacaacaucauggugcuggucagcacguucugcaaggacugcgugcccgagacccucugggagcugggguacuggcugugcuacgugaacuccaccaucaaccccaugugcuacgcccucugcaacaaggccuuccgcgacaccuuccggcugcugcugcucugccgcugggacaagcggcgcuggcggaagauccccaagcgcccgggcagcguccaccggacgcccucccgccagugcuga

SEQ ID NO: 28269 - RNA, 1401 nt, Artificial Sequence
  derived and/or modified sequence opt1 from CHRM2__Homo_sapiens__XP_011514073
augaacaacagcaccaacuccagcaacaacucccuggcccucaccagccccuacaagacguucgagguggucuucaucgugcugguggccggcucccugagccucgucaccaucaucgggaacauccuggugaugguguccaucaaggucaaccgccaccuccagaccgugaacaacuacuuccuguucagccuggcgugcgccgaccugaucaucggcguguucuccaugaaccucuacacccuguacacggucaucggguacuggccgcugggccccguggugugcgaccucuggcuggcccuggacuacgucgugagcaacgccuccgugaugaaccuccugaucaucagcuucgaccgguacuucugcgucaccaagccccugaccuaccccgugaagcgcaccacgaagauggccgggaugaugaucgcggccgccugggugcucuccuucauccugugggccccggcgauccuguucuggcaguucaucgucggcgugcggaccguggaggacggcgagugcuacauccaguucuucagcaacgccgccgucaccuucgggaccgccaucgccgcguucuaccuccccgugaucaucaugacggugcuguacuggcacaucucccgcgccagcaagucccggaucaagaaggacaagaaggagcccgucgccaaccaggaccccgugagcccgucccugguccagggccgcaucgugaagcccaacaacaacaacaugcccagcagcgacgacgggcucgagcacaacaagauccagaacggcaaggcgccccgggacccggugaccgagaacugcguccagggggaggagaaggaguccagcaacgacuccaccagcguguccgccguggccagcaacaugcgcgacgacgagaucacccaggacgagaacacggucuccaccagccugggccacuccaaggacgagaacagcaagcagaccugcauccggaucggcaccaagacgcccaaguccgacagcugcacccccaccaacaccacgguggagguggucggguccagcggccagaacggggacgagaagcagaacaucguggcccgcaagaucgugaagaugaccaagcagcccgccaagaagaagccgccgcccucccgggagaagaaggucacccgcaccauccuggccauccuccuggccuucaucaucacgugggcgcccuacaacgugauggugcugaucaacaccuucugcgcccccugcauccccaacaccgucuggaccaucggcuacuggcucugcuacaucaacagcacgaucaaccccgccugcuacgcccugugcaacgccaccuucaagaagaccuucaagcaccuccugaugugccacuacaagaacaucggcgcgacccgguga

SEQ ID NO: 28270 - RNA, 1773 nt, Artificial Sequence
  derived and/or modified sequence opt1 from CHRM3__Homo_sapiens__NP_000731
augacccugcacaacaacagcaccacgagcccccucuucccgaacaucuccuccagcuggauccacucccccagcgacgccggccugccgcccgggaccgugacccacuucggcuccuacaacgucagccgcgccgcggggaacuucuccagccccgacggcaccacggacgacccccucgggggccacaccguguggcaggucguguucaucgccuuccugaccggcauccuggcccuggugaccaucaucgggaacauccucgugaucgucuccuucaaggugaacaagcagcugaagacggugaacaacuacuuccugcucagccuggccugcgccgaccugaucaucggcgucaucuccaugaaccucuucaccaccuacaucaucaugaaccggugggcgcuggggaaccuggccugcgaccucuggcuggccaucgacuacguggccagcaacgcguccgugaugaaccugcucgucaucagcuucgaccgcuacuucuccaucacccggccccugacguaccgcgccaagcggaccaccaagcgcgccggcgugaugaucgggcuggccugggugaucagcuucguccucugggcccccgcgauccuguucuggcaguacuucgugggcaagcggaccgugccgcccggcgagugcuucauccaguuccuguccgagcccacgaucaccuucgggaccgccaucgccgccuucuacaugcccgucaccaucaugacgauccucuacuggcgcaucuacaaggagaccgagaagcggaccaaggagcuggccggccugcaggcgagcgggaccgaggccgagacggagaacuucgugcacccgaccggcagcucccgcagcugcuccagcuacgagcuccagcagcaguccaugaagcggagcaaccgccggaaguacggccgcugccacuucugguucaccaccaaguccuggaagcccagcuccgagcagauggaccaggaccacagcuccagcgacuccuggaacaacaacgacgccgccgccagccuggagaacuccgcgagcuccgacgaggaggacaucgggagcgagacgcgggccaucuacuccaucgugcugaagcuccccggccacagcaccauccugaacagcaccaagcugcccuccagcgacaaccuccaggucccggaggaggagcuggggaugguggaccuggagcgcaaggccgacaagcuccaggcccagaaguccguggacgacggcgggagcuuccccaaguccuucagcaagcugcccauccagcuggaguccgccgucgacaccgcgaagacgagcgacgugaacuccagcgucggcaaguccaccgccacccucccccugagcuucaaggaggccacccuggccaagcgguucgcgcucaagacgcgcucccagaucaccaagcggaagcgcaugagccuggugaaggagaagaaggccgcccagacccuguccgccauccuccuggccuucaucaucaccuggaccccguacaacaucauggugcuggucaacacguucugcgacagcugcauccccaagaccuucuggaaccucggcuacuggcugugcuacaucaacuccaccgugaaccccgugugcuacgcgcugugcaacaagaccuuccggacgaccuucaagaugcugcuccugugccagugcgacaagaagaagcgccgcaagcagcaguaccagcagcggcagagcgucaucuuccacaagcgcgcccccgagcaggcccuguga

SEQ ID NO: 28271 - RNA, 1440 nt, Artificial Sequence
  derived and/or modified sequence opt1 from CHRM4__Homo_sapiens__NP_000732
auggccaacuucacccccgugaacggcagcuccgggaaccagagcguccgccuggugaccuccagcucccacaaccgguacgagacgguggagauggucuucaucgccaccgugaccggcagccucucccuggugaccgucguggggaacauccuggugaugcucagcaucaaggucaaccgccagcugcagacggugaacaacuacuuccuguucucccucgcgugcgccgaccugaucaucggcgccuucagcaugaaccuguacaccguguacaucaucaagggguacuggccccucggcgccgucgugugcgaccuguggcuggcccucgacuacguggucuccaacgcgagcgugaugaaccugcugaucaucuccuucgaccgguacuucugcgugaccaagccccucaccuaccccgcccgccggacgaccaagauggccggccugaugaucgccgcggccuggguccugagcuucgugcucugggcccccgccauccuguucuggcaguucguggucgggaagcgcaccgugcccgacaaccagugcuucauccaguuccuguccaaccccgccgugaccuucggcacggcgaucgccgccuucuaccuccccgucgugaucaugaccguccuguacauccacaucagccuggccucccggagccgcgugcacaagcaccggcccgaggggccgaaggagaagaaggccaagacccucgcguuccugaaguccccgcugaugaagcagagcgugaagaagccgccgcccggcgaggccgcccgcgaggagcuccggaacgggaagcuggaggaggccccgccgcccgcccugcccccgccgccccgccccgucgcggacaaggacaccagcaacgaguccagcuccggcagcgccacgcagaacaccaaggagcggcccgccaccgagcucuccaccacggaggccaccacccccgccaugcccgcgccgccccugcagccccgcgcccugaaccccgccagccggugguccaagauccagaucgugaccaagcagacgggcaacgagugcgugaccgccaucgagaucguccccgcgacccccgccgggaugcgccccgccgccaacguggcccggaaguucgcgagcaucgcccgcaaccaggugcggaagaagcgccagauggccgcccgggagcgcaaggucacccgcacgaucuucgccauccuccuggcguucauccugaccuggacccccuacaacgugauggugcucgucaacaccuucugccaguccugcauccccgacacgguguggagcaucggcuacuggcugugcuacgugaacuccaccaucaaccccgccugcuacgcccugugcaacgccaccuucaagaagaccuuccggcaccuccugcugugccaguaccgcaacaucgggacggcccgguga

SEQ ID NO: 28272 - RNA, 1599 nt, Artificial Sequence
  derived and/or modified sequence opt1 from CHRM5__Homo_sapiens__XP_005254198
auggagggcgacagcuaccacaacgccaccaccgugaacgggacgcccgucaaccaccagccgcuggagcgccaccggcucugggaggugaucaccaucgccgcggugaccgccgucgugucccugaucaccaucgugggcaacguccuggugaugaucagcuucaaggugaacucccagcucaagacggucaacaacuacuaccugcugagccucgccugcgccgaccugaucaucgggaucuucuccaugaaccuguacaccaccuacauccucaugggccgcugggcccuggggagccuggcgugcgaccucuggcuggcccuggacuacguggccuccaacgccagcgugaugaaccuccuggucaucuccuucgaccgguacuucagcaucacccgcccccugacguaccgggcgaagcgcacccccaagcgggccggcaucaugaucggccucgccuggcugaucuccuucauccugugggcccccgccauccucugcuggcaguaccugguggggaagcgcaccgugccgcuggacgagugccagauccaguuccucagcgagcccaccaucacguucggcaccgcgaucgccgccuucuacauccccgucuccgugaugaccauccuguacugccggaucuaccgcgagaccgagaagcggacgaaggaccuggccgaccuccaggggagcgacuccgugaccaaggccgagaagcgcaagcccgcgcaccgggcccuguuccgcagcugccugcggugcccgcgccccacccucgcccagcgggagcgcaaccaggccuccuggagcuccagccggcgcagcaccuccacgaccggcaagcccagccaggccaccgggcccuccgcgaacugggccaaggccgagcagcugaccacgugcagcuccuacccgagcuccgaggacgaggacaagcccgccaccgaccccguccuccaggugguguacaagagccagggcaaggagucccccggcgaggaguucagcgccgaggagaccgaggagaccuucgucaaggcggagacggagaaguccgacuacgacaccccgaacuaccugcugagccccgccgccgcccaccggcccaagucccagaagugcguggcguacaaguuccgccugguggucaaggccgacgggaaccaggagaccaacaacggcugccacaaggugaagaucaugcccugcccguuccccgucgccaaggagcccagcaccaaggggcucaaccccaacccgucccaccagaugacgaagcgcaagcggguggugcuggucaaggagcgcaaggccgcccagacccugagcgcgauccuccuggccuucaucaucaccuggacccccuacaacaucauggugcugguguccacguucugcgacaagugcguccccgugacccucuggcaccugggcuacuggcugugcuacgugaacagcaccgucaaccccaucugcuacgcccucugcaaccggaccuuccgcaagaccuucaagaugcugcugcucugccgguggaagaagaagaagguggaggagaagcuguacuggcagggcaacuccaagcugccguga

SEQ ID NO: 28273 - RNA, 1353 nt, Artificial Sequence
  derived and/or modified sequence opt1 from CHRNA10__Homo_sapiens__NP_065135
augggccugcgcagccaccaccucucccugggccugcuccugcuguuccuccugcccgccgagugccugggcgccgaggggcggcucgcgcugaagcuguuccgcgaccucuucgccaacuacaccagcgcccugcggccgguggccgacaccgaccagacgcugaacgucacccucgaggugacccugucccagaucaucgacauggacgagcgcaaccaggugcugacccucuaccuguggauccggcaggaguggacggacgccuaccugcgcugggaccccaacgcguacggcgggcucgacgccauccggauccccagcucccuggucuggcgccccgacaucgugcuguacaacaaggccgacgcccagccgcccggcagcgcguccaccaacgugguccuccggcacgacggcgccgugcgcugggacgcccccgccaucacccggagcuccugccgcguggacgucgccgcguuccccuucgacgcccagcacugcgggcugaccuucggcagcuggacgcacgggggccaccagcuggacgugcggccgcgcggggccgccgccucccucgcggacuucguggagaacgucgaguggcgggugcugggcaugcccgcccgccggcgcgugcugaccuacggcugcugcagcgagcccuaccccgacgucaccuucacccuccugcugcggcgccgggccgccgccuacgugugcaaccuccugcugccgugcgugcucaucucccugcuggcgccccucgccuuccaccuccccgccgacagcggggagaaggucucccugggcgugacggugcugcuggcccugaccgucuuccagcuccugcuggccgagagcaugcccccggcggaguccgugccccucaucgggaaguacuacauggccaccaugaccauggugacguucagcaccgcccugaccauccugaucaugaaccugcacuacugcggccccuccguccgccccgugccggccugggcgcgcgcccuccugcugggccaccucgcccgggggcugugcguccgcgagcggggcgagcccugcgggcagagccgcccgcccgagcugagccccagcccccagucccccgagggcggggccgggcccccggccggccccugccacgagccccggugccucugccgccaggaggcgcugcugcaccacguggccaccaucgccaacacguuccggucccaccgcgccgcccagcggugccacgaggacuggaagcgccucgcgcgggugauggaccgcuucuuccuggccaucuucuucagcauggcccuggucaugucccuccuggugcuggugcaggcccucuga

SEQ ID NO: 28274 - RNA, 1374 nt, Artificial Sequence
  derived and/or modified sequence opt1 from CHRNA1__Homo_sapiens__NP_000070
auggagcccuggccgcugcuccugcuguucagccucugcuccgccggccuggugcuggggagcgagcacgagacccgccucgucgccaagcuguucaaggacuacuccagcguggugcggcccgucgaggaccaccgccaggugguggaggucaccgugggccugcagcucauccagcugaucaacguggacgaggucaaccagaucgugacgaccaacgugcggcugaagcagcagugggucgacuacaaccucaaguggaaccccgacgacuacgggggcgugaagaagauccacauccccuccgagaagaucuggcgcccggaccuggugcuguacaacaacgcggacggggacuucgccaucgucaaguucaccaaggugcuccugcaguacaccggccacaucacguggaccccgcccgccaucuucaagagcuacugcgagaucaucgugacccacuuccccuucgacgagcagaacugcuccaugaagcugggcaccuggacguacgacgggagcgucguggccaucaaccccgaguccgaccagcccgaccucagcaacuucauggaguccggcgagugggugaucaaggagagccggggguggaagcacuccgucaccuacagcugcugccccgacacccccuaccuggacaucaccuaccacuucgugaugcagcgccugccgcucuacuucaucgugaacgucaucauccccugccugcuguucuccuuccucacgggccugguguucuaccugcccaccgacagcggggagaagaugacccucuccaucagcguccugcugucccucaccguguuccugcuggugaucgucgagcucauccccagcacgagcuccgccgugccgcugaucggcaaguacaugcuguucaccaugguguucgucaucgcgagcaucaucaucaccgugaucgugaucaacacccaccaccggucccccagcacgcacgucaugcccaacugggugcgcaagguguucaucgacaccauccccaacaucauguucuucuccaccaugaagcggccgagccgcgagaagcaggacaagaagaucuucaccgaggacaucgacaucuccgacaucagcggcaagcccgggcccccgcccaugggcuuccacagcccccucaucaagcaccccgaggucaaguccgccaucgaggggaucaaguacaucgccgagacgaugaaguccgaccaggagagcaacaacgccgcggccgaguggaaguacguggccauggugauggaccacauccugcugggcgucuucaugcucgugugcaucaucggcacccuggccguguucgccgggcggcugaucgagcucaaccagcagggcuga

SEQ ID NO: 28275 - RNA, 1590 nt, Artificial Sequence
  derived and/or modified sequence opt1 from CHRNA2__Homo_sapiens__NP_000733
augggccccagcugccccguguuccuguccuucaccaagcucagccugugguggcugcuccugacccccgccgggggcgaggaggccaagcgcccgccgccccgggcgcccggggacccccuguccagccccucccccacggcccucccccagggcgggagccacaccgagaccgaggaccgccuguucaagcaccuguuccggggcuacaaccgcugggcccggcccguccccaacaccuccgacguggugaucguccgcuucggccucagcaucgcccagcugaucgacguggacgagaagaaccagaugaugacgaccaacguguggcugaagcaggagugguccgacuacaagcuccgguggaacccgaccgacuucgggaacaucaccagccugcgcguccccuccgagaugaucuggauccccgacaucgugcuguacaacaacgccgacggcgaguucgcggugacgcacaugaccaaggcccaccucuucagcaccgggaccguccacugggugcccccggccaucuacaaguccagcugcuccaucgacgugacguucuuccccuucgaccagcagaacugcaagaugaaguucggcagcuggaccuacgacaaggccaagaucgaccuggagcagauggagcagaccgucgaccugaaggacuacugggaguccggggagugggcgaucgugaacgccaccggcacguacaacagcaagaaguacgacugcugcgccgagaucuaccccgacgugaccuacgccuucgucauccggcgccucccccuguucuacaccaucaaccugaucaucccgugccuccugaucuccugccugaccgugcucguguucuaccugcccagcgacugcggcgagaagaucacgcugugcaucagcguccuccugucccugaccguguuccuccugcugaucaccgagaucauccccagcaccucccucgugaucccccugaucggggaguaccugcuguucacgaugaucuucgucacccugagcaucgugaucaccguguucguccugaacgugcaccaccgguccccgagcacccacacgaugccccacuggguccgcggcgcccuccuggggugcgugccccgguggcugcucaugaaccggcccccgccgcccguggagcugugccacccccugcgccucaagcugucccccagcuaccacuggcuggaguccaacgucgacgcggaggagcgcgaggugguggucgaggaggaggaccggugggccugcgccggccacguggcccccagcgugggcacccucugcucccacgggcaccuccacagcggcgccuccgggcccaaggcggaggcccugcugcaggagggcgagcuccugcugagcccgcacaugcagaaggcccucgaggggguccacuacaucgccgaccaccuccgcuccgaggacgccgacagcuccgugaaggaggacuggaaguacguggcgauggucaucgaccggaucuuccuguggcuguucaucaucgugugcuuccugggcaccaucggccuguuccucccgcccuuccuggccgggaugaucuga

SEQ ID NO: 28276 - RNA, 1518 nt, Artificial Sequence
  derived and/or modified sequence opt1 from CHRNA3__Homo_sapiens__NP_000734
augggcagcgggccccugucccucccgcuggcccugagcccgccccgccuccugcugcuccugcugcucucccugcugcccguggcccgggcgagcgaggccgagcaccgccucuucgagcggcuguucgaggacuacaacgagaucauccgccccgucgccaacguguccgaccccgugaucauccacuucgaggucagcaugucccagcuggugaagguggacgaggucaaccagaucauggagaccaaccucuggcugaagcagaucuggaacgacuacaagcugaaguggaaccccagcgacuacggcggggccgaguucaugcgggugcccgcccagaagaucuggaagccggacaucgugcucuacaacaacgcggucggcgacuuccagguggacgacaagaccaaggcccugcugaaguacacgggggaggugaccuggaucccgcccgccaucuucaaguccagcugcaagaucgacgucaccuacuuccccuucgacuaccagaacugcaccaugaaguucggcuccuggagcuacgacaaggccaagaucgaccucgugcugaucggcuccagcaugaaccugaaggacuacugggaguccggggagugggcgaucaucaaggcccccggcuacaagcacgacaucaaguacaacugcugcgaggagaucuaccccgacaucacguacagccucuacauccgccggcugccccuguucuacaccaucaaccucaucauccccugccugcugaucuccuuccucaccgugcuggucuucuaccugccgagcgacugcggggagaaggugacccucugcaucuccgugcugcugagccucacggucuuccugcuggugaucaccgagaccauccccagcaccucccucgugaucccccugaucggcgaguaccuccuguucacgaugaucuucgucacccugagcaucgugaucaccguguucguccugaacgugcacuaccgcacccccacgacccacaccaugccguccugggucaagaccguguuccucaaccugcugccccgggugauguucaugacgcgccccaccagcaacgaggggaacgcccagaagccccggccgcucuacggcgccgagcuguccaaccugaacugcuucagccgcgccgaguccaagggcugcaaggagggguaccccugccaggacggcaugugcggguacugccaccaccggcgcaucaagaucagcaacuucuccgcgaaccugacccggagcuccagcuccgagagcgucgacgccgugcucucccugagcgcccugucccccgagaucaaggaggccauccagagcgugaaguacaucgccgagaacaugaaggcgcagaacgaggccaaggagauccaggacgacuggaaguacgucgccauggugaucgaccgcaucuuccucuggguguucacccuggucugcauccugggcacggccggccucuuccugcagccccugauggcccgggaggacgcguga

SEQ ID NO: 28277 - RNA, 1884 nt, Artificial Sequence
  derived and/or modified sequence opt1 from CHRNA4__Homo_sapiens__NP_000735
auggagcugggcgggcccggcgccccgcgccuccugccgccccugcuccugcugcucgggaccggccugcugcgggccagcucccacguggagacccgcgcgcacgccgaggagcggcuccugaagaagcuguucagcggguacaacaaguggucccgccccgucgccaacaucagcgacguggugcucguccgguucggccuguccaucgcccagcugaucgacguggacgagaagaaccagaugaugacgaccaacgugugggucaagcaggaguggcacgacuacaagcuccgcugggaccccgccgacuacgagaacgugaccagcauccggauccccuccgagcugaucuggcgccccgacaucgugcuguacaacaacgcggacggcgacuucgccgucacccaccucacgaaggcccaccuguuccacgacgggcgggugcaguggacgcccccggccaucuacaagagcuccugcagcaucgacgugaccuucuuccccuucgaccagcagaacugcaccaugaaguucggcuccuggaccuacgacaaggcgaagaucgaccuggucaacaugcacagccgcguggaccagcucgacuucugggaguccggggagugggugaucgucgacgccgugggcaccuacaacacccggaaguacgagugcugcgccgagaucuaccccgacaucaccuacgccuucgugauccgccggcugccccuguucuacacgaucaaccucaucauccccugccugcugaucagcugccucaccguccugguguucuaccugcccuccgagugcggggagaagaucacccucugcaucagcgugcugcugucccucaccgucuuccugcugcucaucacggagaucauccccagcaccucccuggugaucccccugaucggcgaguaccuccuguucaccaugaucuucgugacccugagcaucgucaucacgguguucguccucaacgugcaccaccgcagcccgcggacccacaccaugcccaccugggugcgccgggucuuccuggacaucgugccccgccugcuccugaugaagcggcccuccguggucaaggacaacugccgccggcugaucgagagcaugcacaagauggccuccgcgccgcgcuucuggcccgagcccgagggcgagcccccggccacgagcgggacccagucccuccacccgcccagccccuccuucugcgugccccuggacgugcccgccgagcccggcccgagcugcaagucccccagcgaccagcugccgccccagcagccccuggaggccgagaaggccagcccccaccccucccccgggccgugccgcccgccccacggcacccaggcgcccggccucgccaaggcccggucccugagcguccagcacauguccagccccggggaggccguggagggcggggugcgcugccggucccgcagcauccaguacugcgucccccgggacgacgccgcgcccgaggccgacggccaggccgccggggcccuggcgucccgcaacacccacagcgccgagcugcccccgcccgaccagcccagccccugcaagugcacgugcaagaaggagccguccagcgugucccccagcgccaccgugaagacccgguccaccaaggccccgccgccccaccucccccucagccccgcgcugacgcgcgccgucgagggcgugcaguacaucgccgaccaccugaaggccgaggacaccgacuucuccgugaaggaggacuggaaguacgucgccauggugaucgaccggaucuuccuguggauguucaucaucgugugccuccugggcaccgucgggcuguuccucccgcccuggcuggcgggcaugaucuga

SEQ ID NO: 28278 - RNA, 1407 nt, Artificial Sequence
  derived and/or modified sequence opt1 from CHRNA5__Homo_sapiens__NP_000736
auggccgcccgcggcagcgggccccgggcgcugcgccuccugcugcucgugcagcuggucgccggccggugcgggcuggccggcgccgccgggggcgcgcagcgcggccucuccgagccgagcuccaucgccaagcacgaggacagccugcugaaggaccucuuccaggacuacgagcggugggugcgccccguggagcaccugaacgacaagaucaagaucaaguucgggcuggccaucucccagcucgucgacguggacgagaagaaccagcugaugaccaccaacguguggcugaagcaggaguggaucgacgucaagcuccgguggaaccccgacgacuacggcgggaucaaggugauccgcgugcccagcgacuccgucuggacgccggacaucgugcuguucgacaacgccgacggccgguucgaggggaccagcaccaagaccgugauccgcuacaacggcacggucaccuggaccccgcccgcgaacuacaaguccagcugcaccaucgacgugacguucuuccccuucgaccugcagaacugcuccaugaaguucggcagcuggaccuacgacgggucccagguggacaucauccucgaggaccaggacgucgacaagcgggacuucuucgacaacggcgagugggagaucgugagcgccaccggguccaagggcaaccgcaccgacagcugcugcugguaccccuacgugacguacuccuucgucaucaagcggcugccccuguucuacacccucuuccugaucauccccugcaucggccugagcuuccucaccgugcugguguucuaccugcccuccaacgagggggagaagaucugccucugcaccagcguccuggugagccugacgguguuccuccuggucaucgaggagaucaucccguccagcuccaaggugaucccccugaucggcgaguaccucgucuucaccaugaucuucgugacccugagcaucauggugaccgucuucgccaucaacauccaccaccgcuccagcuccacgcacaacgccauggcgccccuggugcggaagaucuuccuccacacccugcccaagcugcucugcaugcgcagccacguggaccgguacuucacccagaaggaggagaccgaguccgggagcggcccgaaguccagccgcaacacgcuggaggccgcccuggacuccauccgguacaucacccgccacaucaugaaggagaacgacguccgggaggugguggaggacuggaaguucaucgcccagguccucgaccgcauguuccuguggaccuuccuguucgugagcaucguggggucccucggccuguucguccccgugaucuacaagugggccaacauccugauccccgugcacaucggcaacgccaacaaguga

SEQ ID NO: 28279 - RNA, 1440 nt, Artificial Sequence
  derived and/or modified sequence opt1 from CHRNA6__Homo_sapiens__NP_001186208
augcugaccagcaagggccagggguuccuccacggcgggcugugccuguggcucugcguguucacccccuucuucaagggcugcgucgggugcgccacggaggagcgccuguuccacaagcuguucucccacuacaaccaguucauccggccgguggagaacgugagcgaccccgucaccgugcacuucgagguggccaucacccagcucgcgaacgucaucuggaacgacuacaagcugcgcugggaccccauggaguacgacggcaucgagacccugcgggugcccgccgacaagaucuggaagccggacaucgugcucuacaacaacgccgucggcgacuuccagguggaggggaagacgaaggcccugcugaaguacaacggcaugaucaccuggaccccgcccgccaucuucaaguccagcugccccauggacaucaccuucuucccguucgaccaccagaacugcucccucaaguucgggagcuggacguacgacaaggcggagaucgaccugcugaucaucggcuccaagguggacaugaacgacuucugggagaacagcgagugggagaucaucgacgccuccggguacaagcacgacaucaaguacaacugcugcgaggagaucuacaccgacaucaccuacagcuucuacauccgccggcuccccauguucuacaccaucaaccugaucauccccugccuguucaucuccuuccucacgguccugguguucuaccugcccagcgacugcggcgagaaggugacccucugcaucuccguccugcugagccucaccguguuccugcuggugaucaccgagacgaucccguccaccagccucgucgugccccuggugggcgaguaccuccuguucaccaugaucuucgucacccuguccaucguggugacggucuucgugcugaacauccacuaccgcacccccaccacccacacgaugccccggugggucaagaccguguuccucaagcugcugccccaggugcuccugaugcgcuggccccuggacaagacccgggggaccggcagcgacgccgucccccgcgggcucgcccggcgccccgcgaagggcaagcuggccucccacggcgagccgcggcaccugaaggagugcuuccacugccacaagagcaacgagcucgccacgagcaagcgccggcugucccaccagccccugcagugggugguggagaacagcgagcacucccccgaggucgaggacgugaucaacagcgugcaguucaucgccgagaacaugaagucccacaacgagaccaaggaggucgaggacgacuggaaguacguggccaugguggucgaccgcguguuccucuggguguucaucaucgucugcguguucgggaccgcgggccuguuccugcagccccuccuggggaacaccggcaagagcuga

SEQ ID NO: 28280 - RNA, 1509 nt, Artificial Sequence
  derived and/or modified sequence opt1 from CHRNA7__Homo_sapiens__NP_000737
augcgcugcagccccggcgggguguggcuggcccucgccgcgucccugcugcacgucagccuccagggcgaguuccagcggaagcuguacaaggagcuggugaagaacuacaacccgcucgagcgccccguggccaacgacucccagccccugaccgucuacuucagccugucccuccugcagaucauggacguggacgagaagaaccaggugcugaccacgaacaucuggcuccagaugagcuggaccgaccacuaccugcaguggaacgucuccgaguaccccggggugaagaccgugcgguucccggacggccagaucuggaagcccgacauccugcucuacaacagcgccgacgagcgcuucgacgccaccuuccacacgaacguccuggugaacuccagcgggcacugccaguaccugccgcccggcaucuucaaguccagcugcuacaucgacgugcggugguuccccuucgacguccagcacugcaagcucaaguucggcuccuggagcuacgggggcuggucccuggaccugcagaugcaggaggccgacaucagcggguacauccccaacggcgagugggaccucguggggauccccggcaagcgcuccgagcgguucuacgagugcugcaaggagcccuacccggacgugaccuucaccgucaccaugcgccggcgcacgcuguacuacggccugaaccuccugauccccugcgugcugaucagcgcgcucgcccugcugguguuccuccugcccgccgacuccggggagaagaucagccugggcaucaccguccuccugagccugaccguguucaugcuccugguggccgagaucaugcccgcgaccuccgacagcgucccgcugaucgcccaguacuucgccuccacgaugaucaucguggggcucagcguggucgugaccgucaucgugcugcaguaccaccaccacgaccccgacggcggcaagaugcccaaguggacccgggugauccugcucaacuggugcgccugguuccugcgcaugaagcggcccggggaggacaagguccgcccggccugccagcacaagcagcggcgcugcucccuggcgagcguggagauguccgccguggcgcccccgcccgccagcaacggcaaccuccuguacaucggguuccggggccuggacgggguccacugcgugcccacccccgacuccggcguggucugcggccgcauggccugcagccccacgcacgacgagcaccuccugcacgggggccagcccccggagggggaccccgaccuggccaagauccuggaggaggugcgguacaucgccaaccgcuuccggugccaggacgaguccgaggccgugugcagcgaguggaaguucgccgccugcgucguggaccgccucugccugauggcguucuccguguucaccaucaucugcaccaucggcauccugaugagcgcccccaacuucgucgaggccguguccaaggacuucgccuga

SEQ ID NO: 28281 - RNA, 1506 nt, Artificial Sequence
  derived and/or modified sequence opt1 from CHRNB1__Homo_sapiens__NP_000738
augacccccggcgcccugcucaugcugcugggggcccucggcgcgccccuggcccccggggugcgcggcagcgaggccgaggggcggcugcgcgagaagcuguucuccggcuacgacagcuccguccggcccgcccgcgaggugggcgaccgggugcgcgucagcguggggcucauccuggcccagcucaucucccugaacgagaaggacgaggagaugagcaccaagguguaccuggaccucgaguggacggacuaccggcuguccugggaccccgcggagcacgacggcaucgacagccugcgcaucaccgccgaguccgucuggcucccggacguggugcugcugaacaacaacgacgggaacuucgacgucgcccucgacaucagcgugguggucuccagcgacggcuccgugcgguggcagccgcccgggaucuaccgcagcuccugcagcauccaggugaccuacuuccccuucgacuggcagaacugcaccauggucuucuccagcuacuccuacgacagcagcgaggugucccugcagacgggccugggccccgacgggcagggccaccaggagauccacauccacgaggggaccuucaucgagaacggccagugggagaucauccacaagcccagccggcucauccagccgcccggcgacccccgcgggggccgggaggggcagcgccaggaggugaucuucuaccugaucauccggcgcaagccccuguucuaccucgucaacgugaucgcccccugcauccugaucacccugcucgcgaucuucguguucuaccugcccccggacgccggcgagaagauggggcuguccaucuucgcccuccugacccugacggucuuccuccugcugcucgccgacaaggugcccgagaccagccuguccgugcccaucaucaucaaguaccugauguucaccaugguccucgugaccuucagcgucauccuguccguggugguccugaaccuccaccaccggagcccccacacgcaccagaugccgcugugggugcgccagaucuucauccacaagcugccccucuaccugcggcugaagcgccccaagcccgagcgggaccucaugccggagccgccccacugcuccagccccggcuccggcugggggcgcggcaccgacgaguacuucauccgcaagccgcccagcgacuuccuguuccccaagcccaaccgguuccagcccgagcuguccgcccccgaccugcgccgguucaucgacgggcccaaccgcgcgguggcccuccugccggagcugcgggaggucgugagcuccaucagcuacaucgcccgccagcuccaggagcaggaggaccacgacgcccugaaggaggacuggcaguucguggccauggucguggaccggcuguuccucuggaccuucaucaucuucaccuccgugggcacgcuggucaucuuccuggacgcgaccuaccaccucccgccgcccgaccccuuccccuga

SEQ ID NO: 28282 - RNA, 1509 nt, Artificial Sequence
  derived and/or modified sequence opt1 from CHRNB2__Homo_sapiens__NP_000739
auggcccgccggugcggccccguggcccugcuccugggguucggccugcuccgccugugcagcggggucuggggcaccgacaccgaggagcggcugguggagcaccuccuggacccgucccgcuacaacaagcugauccggcccgcgacgaacgggagcgagcucgugaccguccagcugauggugucccuggcccagcucaucagcgugcacgagcgcgagcagaucaugaccaccaacgucuggcugacgcaggagugggaggacuaccggcugaccuggaagcccgaggaguucgacaacaugaagaaggugcgccuccccuccaagcacaucuggcugccggacgugguccuguacaacaacgccgacggcauguacgaggugagcuucuacuccaacgccguggucagcuacgacggcuccaucuucuggcucccgcccgccaucuacaagagcgcgugcaagaucgaggugaagcacuuccccuucgaccagcagaacugcaccaugaaguuccgguccuggaccuacgaccgcacggagaucgaccuggugcucaagagcgaggucgccucccuggacgacuucacccccagcggggagugggacaucguggcccugcccggccggcgcaacgagaaccccgacgacuccaccuacguggacaucaccuacgacuucaucauccggcgcaagccccuguucuacacgaucaaccucaucaucccgugcguccugaucaccagccuggccauccucguguucuaccugcccuccgacugcggggagaagaugacccugugcaucagcgugcuccuggcgcugaccgucuuccuccugcugaucuccaagaucgugccgcccacgagccucgacgugccccuggucggcaaguaccugauguucaccauggugcucgucaccuucagcaucgugaccuccgugugcguccugaacgugcaccaccggagccccacgacccacaccauggcccccugggugaaggucguguuccuggagaagcuccccgcccugcuguucaugcagcagccgcgccaccacugcgcccggcagcgccuccggcugcgccggcgccagcgcgagcgggagggggccggcgcgcuguucuuccgcgaggcccccggcgccgacuccugcacgugcuucgugaaccgggccagcguccaggggcucgccggcgcguucggggccgagcccgcccccguggccggcccgggccgcuccggggagcccugcggcugcgggcugcgggaggccguggacggcguccgcuucaucgcggaccacaugcggagcgaggacgacgaccaguccgugagcgaggacuggaaguacguggccauggucaucgaccgccuguuccuguggaucuucguguucgugugcgucuucgggaccaucggcauguuccuccagccccuguuccagaacuacaccaccaccacguuccugcacuccgaccacagcgcccccuccagcaaguga

SEQ ID NO: 28283 - RNA, 1377 nt, Artificial Sequence
  derived and/or modified sequence opt1 from CHRNB3__Homo_sapiens__NP_000740
augcugcccgacuucaugcucgugcugaucguccugggcaucccgagcuccgccaccaccggguucaacagcaucgccgagaacgaggacgcgcuccugcgccaccuguuccagggcuaccagaagugggugcggcccgugcuccacuccaacgacacgaucaaggucuacuucgggcugaagaucagccagcugguggacguggacgagaagaaccagcucaugaccaccaacgucuggcugaagcaggaguggaccgaccacaagcugcgcuggaaccccgacgacuacggcgggauccacuccaucaaggugcccagcgagucccucuggcugccggacaucgugcuguucgagaacgccgacggccgguucgagggcagccucaugacgaaggucaucgugaaguccaacgggaccguggucuggaccccgcccgccagcuacaaguccagcugcaccauggacgugacguucuuccccuucgaccgccagaacugcuccaugaaguucggcagcuggaccuacgacgggaccaugguggaccugauccugaucaacgagaacgucgaccggaaggacuucuucgacaacggcgagugggagauccucaacgccaaggggaugaagggcaaccgccgggacggcguguacuccuaccccuucaucaccuacagcuucgugcugcgccggcugccccucuucuacacgcuguuccugaucauccccugccucgggcuguccuuccugaccguccucguguucuaccugcccagcgacgagggcgagaagcugucccucagcaccagcgugcuggucucccugaccguguuccuccuggugaucgaggagaucaucccgagcuccagcaaggucaucccccugaucggggaguaccuccuguucaucaugaucuucgugacgcuguccaucaucgucaccguguucgugaucaacguccaccaccgcagcuccagcaccuaccaccccauggcccccugggugaagcgccucuuccugcagaagcugccgaagcuccugugcaugaaggaccacguggaccgguacuccagccccgagaaggaggagucccagcccgucgugaagggcaaggugcuggagaagaagaagcagaagcagcucagcgacggcgagaagguccugguggcguuccuggagaaggccgccgacuccauccgguacaucagccgccacgugaagaaggagcacuucaucucccaggucgugcaggacuggaaguucguggcccagguccucgaccggaucuuccuguggcuguuccugaucgugagcgugaccggguccguccucaucuucacgcccgcgcugaagauguggcugcacagcuaccacuga

SEQ ID NO: 28284 - RNA, 1497 nt, Artificial Sequence
  derived and/or modified sequence opt1 from CHRNB4__Homo_sapiens__NP_000741
augcgccgggcccccagccugguccucuucuuccugguggcccugugcggccgcgggaacugccggguggcgaacgccgaggagaagcucauggacgaccugcugaacaagacccgcuacaacaaccucauccggccggccaccuccagcucccagcugaucagcaucaagcugcagcucucccuggcccagcugaucagcgugaacgagcgcgagcagaucaugacgaccaacgucuggcucaagcaggaguggaccgacuaccggcugaccuggaacuccagccgcuacgagggcgugaacauccugcggauccccgccaagcgcaucuggcuccccgacaucgugcuguacaacaacgcggacgggacguacgaggucuccguguacaccaaccugaucgugcggagcaacggcuccguccucuggcugcccccggccaucuacaagagcgccugcaagaucgaggugaaguacuuccccuucgaccagcagaacugcacccugaaguuccgcuccuggaccuacgaccacacggagaucgacauggugcucaugacccccaccgccagcauggacgacuucacccccuccggggagugggacaucgucgcgcugccgggccggcgcacggugaacccccaggaccccagcuacguggacgucaccuacgacuucaucaucaagcggaagccccuguucuacaccaucaaccucaucaucccgugcgugcugaccacgcugcucgccauccugguguucuaccugcccuccgacugcggcgagaagaugacccucugcaucagcguccugcuggcccucaccuucuuccugcugcucaucuccaagaucgugccgcccaccagccuggacgugccccugaucgggaaguaccucauguucacgaugguccuggugaccuucagcaucgugaccuccgucugcgugcugaacguccaccaccgcagccccuccacccacacgauggcccccugggugaagcggugcuuccuccacaagcugcccaccuuccuguucaugaagcgcccgggccccgacagcucccccgcccgggcguucccgcccagcaaguccugcgugaccaagcccgaggccaccgccacgagcaccucccccagcaacuucuacgggaacuccauguacuucgucaaccccgccagcgccgcguccaagagcccggccggcuccacccccguggccaucccccgcgacuucuggcuccggagcuccgggcgcuuccgccaggacgugcaggaggcccuggagggcgucagcuucaucgcccagcacaugaagaacgacgacgaggaccaguccgugguggaggacuggaaguacgucgcgauggugguggaccggcuguuccucugggucuucauguucgugugcgugcugggcaccgucgggcuguuccugccgccccucuuccagacgcacgccgccagcgagggccccuacgccgcccagcgcgacuga

SEQ ID NO: 28285 - RNA, 1554 nt, Artificial Sequence
  derived and/or modified sequence opt1 from CHRND__Homo_sapiens__NP_000742
auggagggccccgugcugacccucgggcugcuggccgcccucgcggucugcggcagcugggggcugaacgaggaggagcgccugauccggcaccucuuccaggagaagggcuacaacaaggagcugcgcccgguggcccacaaggaggaguccguggacgucgcccuggcccucacccugagcaaccugaucucccucaaggagguggaggagacgcugaccaccaacguguggaucgagcacggguggaccgacaaccggcugaaguggaacgccgaggaguucggcaacaucagcguccuccgccugccgcccgacaugguguggcugcccgagaucgugcucgagaacaacaacgacggcuccuuccagaucagcuacuccugcaacguccugguguaccacuacggguucguguacuggcugccgcccgcgaucuuccggagcuccugccccaucagcgucacguacuuccccuucgacuggcagaacugcucccucaaguucagcucccugaaguacaccgccaaggagaucacccugagccucaagcaggacgccaaggagaaccgcaccuaccccguggaguggaucaucaucgaccccgagggcuucacggagaacggggagugggagaucgugcaccggcccgcccgcgucaacguggacccccgggcgccgcuggacucccccagccgccaggacaucaccuucuaccugaucauccggcgcaagccccucuucuacaucaucaacauccuggugcccugcguccugaucuccuucauggugaaccucguguucuaccugccggccgacagcggcgagaagaccuccgucgccaucagcgugcugcucgcccagagcguguuccugcugcucaucuccaagcggcugcccgccaccagcauggcgaucccccugaucgggaaguuccuccuguucggcaugguccuggugacgauggucguggugaucugcgucaucgugcucaacauccacuuccgcacccccuccacccacgugcugagcgagggcgucaagaagcuguuccucgagacccugccggagcugcuccacaugucccggcccgccgaggacgggcccagccccggcgcccuggugcgccgguccagcucccugggguacaucagcaaggccgaggaguacuuccugcucaagucccgcagcgaccugauguucgagaagcaguccgagcggcacggccuggcccgccggcucacgaccgcgcgccgcccgcccgccagcuccgagcaggcccagcaggagcuguucaacgagcugaagcccgccguggacggcgccaacuucaucgucaaccacaugcgggaccagaacaacuacaacgaggagaaggacagcuggaaccgcguggcgcggaccguggaccgccucugccuguucgucgugacccccgugauggucguggggacggccuggaucuuccugcagggcguguacaaccagccgccgccccagcccuuccccggggaccccuacuccuacaacguccaggacaagcgguucaucuga

SEQ ID NO: 28286 - RNA, 1482 nt, Artificial Sequence
  derived and/or modified sequence opt1 from CHRNE__Homo_sapiens__NP_000071
auggcccgcgcgccccugggcgugcuccugcugcucgggcugcugggccgcggggucggcaagaacgaggagcuccggcuguaccaccaccuguucaacaacuacgaccccgggagccggcccgugcgcgagcccgaggacaccgugaccaucucccucaaggucacgcugaccaaccugaucagccucaacgagaaggaggagacccugaccacguccguguggaucggcaucgacuggcaggacuaccggcugaacuacagcaaggacgacuucggcgggaucgagacccuccgcgugcccuccgagcuggucuggcugccggagaucgugcucgagaacaacaucgacggccaguucgggguggccuacgacgccaacguccugguguacgagggcgggagcgugaccuggcugccgcccgccaucuaccgguccgucugcgccguggaggugaccuacuuccccuucgacuggcagaacugcagccucaucuuccgcucccagacguacaacgccgaggaggucgaguucaccuucgcgguggacaacgacggcaagaccaucaacaagaucgacaucgacaccgaggccuacacggagaacggcgagugggccaucgacuucugccccggggugauccggcgccaccacggcggggccaccgacggccccggcgagaccgacgucaucuacagccugaucauccggcgcaagccccuguucuacgugaucaacaucaucgugcccugcguccucaucuccgggcuggugcugcucgcguacuuccugccggcccaggccggcgggcagaagugcaccgugagcaucaacguccugcucgcccagacgguguuccuguuccugaucgcccagaagauccccgagaccucccucagcgucccccugcugggccgguuccucaucuucgugaugguggucgcgacccugaucgugaugaacugcgugaucguccugaacgugucccagcgcacccccacgacccacgccaugagcccgcggcuccgccacgugcugcuggagcuccugccccggcugcucggguccccgccgccgcccgaggcgccccgcgccgccagcccgccccggcgcgccuccagcgucggccugcugcuccgggccgaggagcugauccugaagaagccccgcagcgagcugguguucgagggccagcgccaccggcaggggaccuggaccgccgccuucugccagucccucggcgccgcggcccccgaggugcgcugcugcgucgacgccgugaacuucguggccgagagcacgcgggaccaggaggccaccggggaggaggucuccgacugggugcgcaugggcaacgcgcuggacaacaucugcuucugggccgcccugguccucuucagcgugggguccagccugaucuuccugggcgccuacuucaaccgggugcccgaccuccccuacgcgcccugcauccagcccuga

SEQ ID NO: 28287 - RNA, 1554 nt, Artificial Sequence
  derived and/or modified sequence opt1 from CHRNG__Homo_sapiens__NP_005190
augcacggcgggcagggcccccugcuccugcugcuccugcuggccgugugccucggggcccagggccgcaaccaggaggagcggcugcuggcggaccucaugcagaacuacgacccgaaccugcgccccgccgagcgggacagcgacgucgugaacgugucccugaagcucacccugaccaaccugaucagccucaacgagcgcgaggaggcccugacgaccaacgucuggaucgagaugcaguggugcgacuaccggcugcgcugggacccccgggacuacgaggggcucugggugcugcgcgugcccuccaccauggucuggcggccggacaucgugcuggagaacaacguggacggcgucuucgagguggcccucuacugcaacgugcuggucagccccgacggcugcaucuacuggcugccgcccgccaucuuccgcuccgcgugcagcaucuccgugaccuacuuccccuucgacuggcagaacugcagccucaucuuccagucccagacguacagcaccaacgagaucgaccugcagcugucccaggaggacgggcagaccaucgaguggaucuucaucgaccccgaggccuucaccgagaacggcgagugggccauccagcaccggcccgccaagaugcuccuggaccccgcggccccggcccaggaggccgggcaccagaagguggucuucuaccugcucauccagcgcaagccccuguucuacgugaucaacaucaucgcccccugcgugcugaucagcuccgucgcgauccucauccacuuccugcccgccaaggccggcgggcagaagugcacgguggccaucaacgugcugcucgcccagaccgucuuccuguuccugguggcgaagaaggugccggagaccagccaggccgucccccucaucuccaaguaccugaccuuccugcucguggucacgauccugaucguggugaacgccgucguggugcugaacgucagccuccggagcccccacacccacuccauggcccgcggcgugcggaagguguuccugcgccugcucccccagcugcugcggaugcacguccgcccgcuggcccccgcggccgugcaggacacccagucccggcuccagaacggcagcagcgggugguccaucaccacgggcgaggagguggcccugugccugccccgcagcgagcuccuguuccagcaguggcagcggcaggggcuggucgccgccgcgcucgagaagcuggagaagggccccgagcugggccucucccaguucugcgggagccugaagcaggccgccccggccauccaggcgugcguggaggccugcaaccugaucgccugcgcccgccaccagcagucccacuucgacaacggcaacgaggagugguuccucguggggcgcguccuggaccgggugugcuuccuggccaugcucagccuguucaucugcggcaccgcggggaucuuccugauggcccacuacaaccgcgugcccgcccuccccuuccccggcgacccgcggcccuaccugcccuccccggacuga

SEQ ID NO: 28288 - RNA, 1071 nt, Artificial Sequence
  derived and/or modified sequence opt1 from CHST10__Homo_sapiens__NP_004845
augcaccaccaguggcugcuccuggccgccugcuucugggugaucuucauguucauggucgcgagcaaguucaucacccugaccuucaaggaccccgacguguacuccgccaagcaggaguuccucuuccugacgaccaugccggaggugcgcaagcugcccgaggagaagcacauccccgaggagcucaagcccaccggcaaggagcugccggacagccagcugguccagccccucguguacauggagcggcuggagcugauccgcaacgugugccgggacgacgcccucaagaaccugucccacacccccgucagcaaguucgugcuggaccgcaucuucgugugcgacaagcacaagauccucuucugccagacgcccaaggucgggaacacccaguggaagaaggugcugaucgugcugaacggcgccuucuccagcaucgaggagaucccggagaacgucgugcacgaccacgagaagaacgggcucccccggcuguccagcuucuccgacgccgagauccagaagcgccugaagaccuacuucaaguucuucaucgugcgggaccccuucgagcgccucaucagcgcguucaaggacaaguucguccacaacccccgguucgagccgugguaccgccacgagaucgcccccggcaucauccggaaguaccgccggaaccgcaccgagacgcgggggauccaguucgaggacuucgugcgcuaccugggcgaccccaaccaccgguggcuggaccuccaguucggcgaccacaucauccacugggugaccuacgucgagcugugcgcccccugcgagaucauguacuccgugaucgggcaccacgagacccuggaggacgacgccccguacauccucaaggaggcgggcaucgaccaccuggugagcuaccccaccaucccgcccgggaucacggucuacaaccgcaccaagguggagcacuacuuccugggcaucuccaagcgggacauccgccggcucuacgcccgcuucgagggggacuucaagcuguucggcuaccagaagcccgacuuccugcucaacuga

SEQ ID NO: 28289 - RNA, 1044 nt, Artificial Sequence
  derived and/or modified sequence opt1 from CHST11__Homo_sapiens__NP_001167453
augaagcccgcccugcucgaggugaugcgcaugaaccggaucugccgcaugguccuggcgaccugccugggcagcuucauccucgugaucuucuacuuccagaucaugcggcgcaacccguucgggguggacaucugcugccggaagggcucccgcagcccccugcaggagcuguacaaccccauccagcucgagcuguccaacaccgccguccugcaccagaugcggcgcgaccaggugacggacacgugccgggccaacagcgccaccucccgcaagcggcgcgugcucacccccaacgaccugaagcaccuggucguggacgaggaccacgagcucaucuacugcuacgugccgaaggucgccugcaccaacuggaagcggcugaugauggugcugaccgggcgcggcaaguacagcgaccccauggagauccccgccaacgaggcgcacguguccgccaaccucaagacccugaaccaguacagcauccccgagaucaaccaccggcugaaguccuacaugaaguuccucuucguccgcgagccguucgagcggcuggugagcgccuaccgcaacaaguucacccagaaguacaacaucuccuuccacaagcgguacgggacgaagaucaucaagcgccagcggaagaacgccacccaggaggcgcugcgcaagggcgacgacgugaaguucgaggaguucgucgccuaccucaucgacccccacacccagcgcgaggagcccuucaacgagcacuggcagaccguguacagccugugccaccccugccacauccacuacgaccuggugggcaaguacgagacgcucgaggaggacuccaacuacguccugcagcuggccggggugggcagcuaccucaaguucccgaccuacgccaaguccacccggaccacggacgagaugaccaccgaguucuuccagaacaucagcuccgagcaccagacccagcuguacgagguguacaagcuggacuuccucauguucaacuacagcguccccuccuaccugaagcuggaguga

SEQ ID NO: 28290 - RNA, 1245 nt, Artificial Sequence
  derived and/or modified sequence opt1 from CHST12__Homo_sapiens__NP_001230724
augaccaaggcccgccuguuccggcucuggcuggugcugggcagcgucuucaugauccuccugaucaucguguacugggacuccgccggggcggcccacuucuaccugcacaccagcuucucccgcccccacacgggcccgccccuccccacccccgggccggaccgggaccgcgagcugaccgccgacagcgacguggacgaguuccuggacaaguuccucuccgccggcgucaagcagagcgaccugccccggaaggagaccgagcagccgcccgcccccggguccauggaggagagcgugcgcggcuacgacuggagcccccgggacgcgcgccggucccccgaccagggccgccagcaggccgagcggcgcuccgugcugcggggguucugcgccaacagcucccucgccuuccccacgaaggagcgcgcguucgacgacaucccgaacagcgagcugucccaccugaucgucgacgaccggcacggcgccaucuacugcuacgugcccaagguggccugcaccaacuggaagcgcgucaugaucgugcucagcgggucccugcugcaccggggcgcccccuaccgcgacccccuccggaucccgcgcgagcacgugcacaacgccagcgcgcaccugaccuucaacaaguucuggcggcgcuacgggaagcugucccgccaccucaugaaggucaagcugaagaaguacaccaaguuccuguucgugcgggaccccuucgugcgccucaucagcgccuuccggagcaaguucgagcuggagaacgaggaguucuaccgcaaguucgccguccccaugcugcggcucuacgccaaccacacgucccugcccgccagcgcgcgcgaggccuuccgggccggccugaagguguccuucgccaacuucauccaguaccuccuggacccgcacaccgagaagcuggcccccuucaacgagcacuggcgccagguguaccggcucugccaccccugccagaucgacuacgacuucgucggcaagcuggagacccuggacgaggacgcggcccagcuccugcagcugcuccagguggaccgccagcugcgguucccgcccagcuaccgcaaccggaccgccuccagcugggaggaggacugguucgccaagaucccccuggccuggcgccagcagcucuacaagcuguacgaggcggacuucgugcuguucggguaccccaagcccgagaaccuccugcgggacuga

SEQ ID NO: 28291 - RNA, 1026 nt, Artificial Sequence
  derived and/or modified sequence opt1 from CHST13__Homo_sapiens__NP_690849
augggccgccggugcugccgccggcgcgugcuggccgccgcgugccucggggccgcccugcugcuccugugcgccgcgccccggagccugcgcccggccuucggcaaccgggcccucggguccagcuggcugggcggggagaagcgcagcccccugcagaagcucuacgaccuggaccaggacccccgguccacccuggccaagguccaccgccagcggcgcgaccuccugaacuccgccugcagccggcacucccgccggcagcgccugcuccagcccgaggaccugcggcacgugcugguggacgacgcgcacggccuccuguacugcuacgucccgaagguggccugcaccaacuggaagcgcgugcugcucgcccugagcggccaggcccgcggggacccccgggccaucuccgcgcaggaggcccacgcccccggccggcugcccagccucgccgacuucuccccggccgagaucaaccgccgccugcgggcguaccuggccuuccucuucguccgcgagcccuucgagcggcuggccagcgccuaccgcaacaagcuggcccggcccuacuccgcggccuuccagcgccgguacggggcccgcaucgugcagcggcuccgcccccgggcccugccggacgcccgcgcgcggggccacgacgugcgcuucgccgaguuccuggccuaccuccuggacccccggacgcgccgggaggagcccuucaacgagcacugggagcgcgcccacgcgcugugccaccccugccggcuccgcuacgacgucguggggaaguucgagacccuggccgaggacgccgccuucgugcugggccucgccggcgcgagcgaccuguccuucccggggccgccccgcccccggggcgccgccgccagccgcgaccuggccgcgcgccucuuccgggacaucucccccuucuaccagcggcgccuguucgaccuguacaagauggacuuccuccuguucaacuacagcgcccccuccuaccugcggcuccuguga

SEQ ID NO: 28292 - RNA, 1131 nt, Artificial Sequence
  derived and/or modified sequence opt1 from CHST14__Homo_sapiens__NP_569735
auguucccccgcccgcugacgccccucgccgcccccaacggcgcggagccccuggggcgggcccugcgccgggccccgcucggccgcgcccgggccgggcugggcgggccgccccugcuccugcccagcaugcugauguucgcggugaucgucgccuccagcggccuccugcugaugaucgagcgcggcauccucgccgagaugaagccccugccccugcacccgcccgggcgggagggcaccgccuggcgcgggaaggcgcccaagcccggcgggcucucccugcgggccggcgacgccgaccuccaggugcgccaggacgugcggaaccgcacccugcgggccgucugcggccagcccgggaugccccgcgacccgugggaccugcccgugggccagcggcgcacccugcuccggcacauccuggugagcgaccgcuaccgguuccuguacugcuacguccccaagguggccugcuccaacuggaagcgcgugaugaagguccucgcgggggugcuggacagcguggacguccggcugaagauggaccaccgcuccgaccucguguuccuggccgaccugcgccccgaggagauccgguaccgccuccagcacuacuucaaguuccuguucgugcgggagccgcuggagcgccuccugagcgccuaccggaacaaguucggcgagauccgcgaguaccagcagcgguacggcgccgagaucguccgccgguaccgcgccggggcgggccccucccccgccggggacgacgugaccuuccccgaguuccugcgguaccucguggacgaggacccggagcgcaugaacgagcacuggaugcccgucuaccaccugugccagcccugcgccgugcacuacgacuucgugggcagcuacgagcggcuggaggccgacgccaaccagguccucgagugggugcgcgcgcccccgcacgugcgguuccccgcccgccaggccugguaccggcccgccuccccggagagccugcacuaccaccugugcuccgcgccccgcgcccuccugcaggacguccugcccaaguacauccucgacuucagccuguucgccuacccccugccgaacgugaccaaggaggccugccagcaguga

SEQ ID NO: 28293 - RNA, 1521 nt, Artificial Sequence
  derived and/or modified sequence opt1 from CHST15__Homo_sapiens__NP_001257694
augcgccacugcaucaacugcugcauccagcugcuccccgacggcgcccacaagcagcaggucaacugccagggcgggccgcaccacgggcaccaggccugcccgaccugcaagggcgagaacaagauccuguuccggguggacagcaagcagaugaaccugcucgcggugcuggaggugcgcaccgaggggaacgagaacuggggcggcuuccugcgguucaagaaggggaagcgcugcucccucgucuucggccugaucaucaugacccuggugauggccagcuacauccucuccggggcccaccaggagcugcugaucagcucccccuuccacuacggcggguuccccagcaaccccucccucauggacagcgagaaccccuccgacaccaaggagcaccaccaccagagcuccgugaacaacaucagcuacaugaaggacuaccccuccaucaagcugaucaucaacagcaucaccacccggaucgaguucacgacccgccagcugcccgaccucgaggaccugaagaagcaggagcugcacauguucuccgucaucccgaacaaguuccuccccaacagcaagucccccugcugguacgaggaguucagcggccagaacaccaccgaccccuaccugacgaacuccuacgugcuguacagcaagcgguuccgcagcaccuucgacgcccuccggaaggccuucuggggccaccuggcgcacgcccacgggaagcacuuccgccugcggugccucccgcacuucuacaucaucggccagcccaagugcgggaccaccgaccuguacgaccgccugcggcuccaccccgaggugaaguucuccgccaucaaggagccccacugguggacgcgcaagcgguucggcaucguccgccugcgggacggccugcgcgaccgguacccgguggaggacuaccucgaccuguucgaccuggccgcgcaccagauccaccaggggcuccaggccagcuccgccaaggagcagagcaagaugaacaccaucaucaucggcgaggccuccgccagcaccaugugggacaacaacgcguggaccuucuucuacgacaacuccacggacggggagccgcccuuccugacccaggacuucauccacgccuuccagcccaacgcccgccugaucgugaugcuccgggaccccgucgagcgccuguacagcgacuaccuguacuucgccuccagcaacaaguccgccgacgacuuccacgagaaggugaccgaggcgcuccagcuguucgagaacugcaugcuggacuacagccuccgcgccugcguguacaacaacacccugaacaacgccaugcccgucugcacgcccccgccccggacgccccgcgccggccccuggcagaaggagcuggugugcugcuacuacgccuccgggaucgugggccuccgguucagcaucggcaccgagcgcuccguccugaugugcaagugcugcagcccccuguucauggacgugaaggcggagaacuga

SEQ ID NO: 28294 - RNA, 1236 nt, Artificial Sequence
  derived and/or modified sequence opt1 from CHST1__Homo_sapiens__NP_003645
augcagugcagcuggaaggccgugcugcuccuggcccuggcguccaucgccauccaguacaccgccauccgcaccuucacggccaagagcuuccacacgugccccggccucgccgaggcggggcuggccgagcggcugugcgaggaguccccgaccuucgccuacaaccucagccgcaagacccacauccugauccuggccaccacccgguccggcagcuccuucgucgggcagcuguucaaccagcaccucgacguguucuaccuguucgagccccucuaccacgugcagaacacccugaucccccgcuucacccagggcaagagccccgcggaccggcgcgucaugcugggggccucccgggaccuccugcgcagccuguacgacugcgaccucuacuuccuggagaacuacaucaagccgccgcccgugaaccacacgaccgaccggaucuuccgccggggcgccucccgcgugcugugcagccggcccgucugcgacccgcccggccccgccgaccucgugcuggaggagggggacugcgugcgcaagugcggccugcucaaccugaccgucgccgcggaggccugccgggagcgcucccacguggccaucaagaccgugcggguccccgaggugaacgaccugcgcgcccucguggaggacccccggcugaaccugaaggucauccagcucgugcgcgacccccgggggauccuggccagccgcuccgagacguuccgcgacaccuaccggcuguggcgccucugguacggcaccgggcggaagcccuacaaccuggacgugacccagcugacgaccgucugcgaggacuucagcaacuccgugagcaccggccucaugcggcccccguggcugaagggcaaguacaugcuggugcgcuacgaggaccucgcgcgcaaccccaugaagaagaccgaggagaucuacggguuccugggcaucccccuggacucccacgucgcccgguggauccagaacaacacgcgcggggaccccacccucggcaagcacaaguacggcaccgugcggaacagcgccgccaccgccgagaaguggcgcuuccggcugagcuacgacaucguggcguucgcccagaacgccugccagcagguccuggcccagcucggguacaagaucgccgcguccgaggaggagcugaagaacccgagcgugucccuggucgaggagcgcgacuuccggcccuucagcuga

SEQ ID NO: 28295 - RNA, 1593 nt, Artificial Sequence
  derived and/or modified sequence opt1 from CHST2__Homo_sapiens__NP_004258
augagccgcuccccgcagcgggcccugccgcccggcgcccucccccgccugcugcaggcggcccccgccgccgccccgcgggcgcuccugccccaguggccccgccggcccgggcgccgguggccggccagcccccugggcaugaagguguuccgccggaaggcccucguccugugcgccggguacgcgcugcuccuggugcugaccaugcucaaccugcuggacuacaaguggcacaaggagccccuccagcagugcaaccccgacggcccgcugggggccgccgccggcgccgcgggcggguccuggggccgccccgggccgccgcccgccggcccgccccgggcccacgcccgccuggaccuccggacccccuaccgcccgcccgccgcggccgugggggccgcccccgccgcggccgccggcauggccggcgucgccgcgccgcccgggaacggcacgcgggggaccggcggcgugggggacaagcgccagcugguguacgucuucaccaccuggcggagcggcuccagcuucuucggggagcuguucaaccagaaccccgagguguucuuccucuacgagcccguguggcacgucuggcagaagcuguaccccggcgacgccgugucccugcagggggccgcccgcgacaugcucagcgcgcuguaccggugcgaccuguccguguuccagcucuacagccccgccggcuccggcgggcgcaaccugacgacccugggcaucuucggggccgccaccaacaaggucgugugcagcagcccccucugccccgccuaccggaaggagguggucggccugguggacgaccgcgugugcaagaagugcccgccccagcgccuggcgcgguucgaggaggagugccgcaaguaccggacccucgucaucaagggggugcgcguguucgacgucgccgugcuggcgccccugcuccgggaccccgcccuggaccugaaggugauccaccucguccgcgacccccgggccguggccuccucccgcauccggagccgccacggccugauccgggagucccugcaggucgugcgcagccgggacccccgcgcccaccggaugcccuuccucgaggccgccggccacaagcugggggccaagaaggagggcgucgggggccccgcggacuaccacgcccugggggccauggaggugaucugcaacuccauggccaagacgcuccagaccgcgcugcagccgcccgacuggcugcagggccacuaccucguggugcgcuacgaggaccuggucggcgaccccgugaagacccugcggcgcguguacgacuucgucgggcugcucgugagccccgagauggagcaguucgcccugaacaugaccagcggcuccgggagcuccagcaagcccuucguggucuccgcccggaacgccacgcaggccgcgaacgccuggcgcaccgcccugaccuuccagcagaucaagcaggucgaggaguucugcuaccagcccauggccgugcucggcuacgagcgcgugaacagccccgaggaggugaaggaccuguccaagacccugcuccggaagccccgccuguga

SEQ ID NO: 28296 - RNA, 1440 nt, Artificial Sequence
  derived and/or modified sequence opt1 from CHST3__Homo_sapiens__XP_006718138
auggagaagggccugacccucccccaggacugccgcgacuucgugcacagccugaagaugcgguccaaguacgcccuguuccucgucuucguggugaucgucuucguguucaucgagaaggagaacaagaucaucagccgcguguccgacaagcugaagcagaucccgcaggcccuggcggacgccaacagcaccgaccccgcccucauccuggccgagaacgccucccugcucagccuguccgagcuggacagcgcguucucccagcuccagagccggcugcgcaaccugucccuccagcugggggucgagcccgccauggaggccgccggcgaggaggaggaggagcagcggaaggaggaggagcccccgcgccccgcgguggccgggccccggcgccacgugcugcucauggccacgacccggaccggcagcuccuucgucggggaguucuucaaccagcagggcaacaucuucuaccuguucgagccccuguggcacaucgagcgcaccgugagcuucgagccgggcggggccaacgccgcgggcuccgcccucguguaccgggacguccugaagcagcuguuccucugcgaccuguacgugcuggagcacuucaucacgccccuccccgaggaccaccugacccaguucauguuccgccgggggagcucccgcagccugugcgaggaccccgugugcaccccguucgucaagaagguguucgagaaguaccacugcaagaaccggcgcugcggcccccucaacgugacccuggccgccgaggccugccggcgcaaggagcacauggcgcugaaggccguccggauccgccagcucgaguuccugcagccccuggccgaggacccccggcucgaccugcgcgugauccagcuggugcgcgacccgcgggccguccucgccucccgcaugguggcguucgccgggaaguacaagacguggaagaaguggcuggacgacgagggccaggacggccugcgggaggaggaggugcagcgccuccgggggaacugcgagagcauccgccugagcgccgagcugggccuccggcagcccgccuggcugcgcgggcgguacaugcugguccgcuacgaggacguggcccggggcccccuccagaaggcgcgcgagauguaccgguucgccggcaucccccugaccccgcaggucgaggacuggauccagaagaacacccaggccgcccacgacggguccggcaucuacagcacccagaagaacuccagcgagcaguucgagaaguggcgcuucuccaugcccuucaagcuggcccagguggugcaggcggccugcgggcccgccaugcggcuguucggcuacaagcucgcccgcgacgcggccgcccugacgaaccggagcgucucccugcucgaggagcgcgggaccuucugggugaccuga

SEQ ID NO: 28297 - RNA, 1161 nt, Artificial Sequence
  derived and/or modified sequence opt1 from CHST4__Homo_sapiens__NP_005760
augcugcuccccaagaagaugaagcugcugcuguuccuggugagccagauggccauccuggcccucuucuuccacauguacucccacaacaucagcucccugagcaugaaggcgcagccggagcgcaugcacguccuggugcucuccagcuggcgguccggcagcuccuucguggggcagcuguucggccagcaccccgacgucuucuaccugauggagcccgccuggcacguguggaugaccuucaagcagagcaccgccuggaugcuccacauggccgugcgcgaccugauccgggccgucuuccugugcgacauguccguguucgacgcguacauggagcccgggccgcgccggcagagcucccucuuccagugggagaacagccgcgcccugugcuccgcccccgccugcgacaucaucccccaggacgagaucaucccccgggcgcacugccgccugcucugcagccagcagccguucgagguggucgagaaggccugccgguccuacagccacguggugcugaaggagguccgcuucuucaaccugcagucccucuacccccugcugaaggaccccagccucaaccugcacaucgugcaccuggugcgggacccccgcgccgucuuccggagccgcgagcggacgaagggcgaccucaugaucgacucccgcaucgugauggggcagcacgagcagaagcugaagaaggaggaccagccguacuacgugaugcaggucaucugccagagccagcuggagaucuacaagaccauccagucccuccccaaggcccugcaggagcgguaccugcucgugcgcuacgaggaccuggcccgggcgcccguggcccagaccagccgcauguacgaguucgucggccuggaguuccucccccaccuccagaccugggugcacaacaucacgcggggcaaggggaugggcgaccacgccuuccacaccaacgcccgcgacgcccugaacgugucccaggcguggcgcuggagccucccguacgagaaggucucccggcugcagaaggccugcggggacgccaugaaccugcucggcuaccgccacgugcggagcgagcaggagcagcgcaaccugcugcucgaccugcuguccaccuggaccguccccgagcagauccacuga

SEQ ID NO: 28298 - RNA, 1236 nt, Artificial Sequence
  derived and/or modified sequence opt1 from CHST5__Homo_sapiens__NP_078809
augggcaugcgcgcccgggugcccaaggucgcccacagcacccgccggccgcccgcggcccgcauguggcugccccgguucuccagcaagaccgugacggugcuccugcuggcccagacgaccugccuccugcuguucaucaucucccgccccgggccgagcucccccgccggcggggaggaccggguccacgugcucgugcugagcuccuggcgcagcggcuccagcuuccuggggcagcuguucucccagcaccccgacgucuucuaccugauggagcccgccuggcacguguggaccacccugagccagggcuccgcggccacccuccacauggccgugcgggaccugaugcgcagcaucuuccugugcgacauggacgucuucgacgccuacaugccgcagucccggaaccucagcgcguucuucaacugggccaccucccgcgcccugugcagcccgcccgccugcuccgccuucccccggggcaccaucagcaagcaggacgugugcaagacgcugugcacccgccagcccuucagccucgcgcgggaggccugccgcuccuacagccacgugguccugaaggaggugcgguucuucaaccuccaggugcucuacccccugcuguccgaccccgcccucaaccugcgcaucguccaccuggugcgggacccccgcgccgugcuccggagccgcgaggccgcggggccgauccuggcccgcgacaacggcaucguccuggggaccaacggcaaguggguggaggccgacccccaccuccggcugauccgcgaggugugccggucccacguccgcaucgccgaggccgcgacccugaagcccccgcccuuccuccgggggcgcuaccggcuggugcgcuucgaggaccuggcccgggagccccucgccgagauccgcgcccuguacgccuucacgggccugacccucacgccccagcuggaggcguggauccacaacaucacccacggcagcgggaucggcaagcccaucgaggccuuccacaccuccagccggaacgcccgcaacgugucccaggccuggcggcacgcgcugccguucaccaagauccuccgcguccaggaggugugcgccggggcccugcagcugcucggcuaccggcccgucuacagcgccgaccagcagcgcgaccugacccuggaccucgugcugccccggggccccgaccacuucuccugggccagcccggacuga

SEQ ID NO: 28299 - RNA, 1188 nt, Artificial Sequence
  derived and/or modified sequence opt1 from CHST6__Homo_sapiens__XP_011521387
auguggcugccccgcgugagcuccaccgccgucaccgcccuccugcuggcgcagacguuccuccugcuguuccucgugagccggccgggccccuccagccccgccgggggcgaggcccgcgugcacguccuggugcuguccagcuggcgguccgggagcuccuucgugggccagcuguucaaccagcaccccgacgucuucuaccugauggagccggccuggcacguguggaccacccugagccagggguccgccgcgacccuccacauggccgugcgcgaccugguccggagcguguuccugugcgacauggacguguucgacgccuaccuccccuggcgccggaaccuguccgaccuguuccagugggccgucagccgcgcgcucugcuccccgcccgccugcagcgccuucccccggggcgccaucuccagcgaggccgugugcaagccccugugcgcgcgccaguccuucacgcuggcccgggaggccugccgcagcuacagccacgugguccucaaggaggugcgguucuucaaccuccaggugcuguacccccuccuguccgaccccgcccugaaccuccgcaucguccaccuggugcgggacccgcgcgccgugcugcggagccgcgagcagaccgcgaaggcccucgcccgggacaacggcaucguccuggggaccaacggcaccuggguggaggccgaccccgggcugcgcgugguccgggaggugugccgcucccacguccgcaucgccgaggcggccacgcucaagcccccgcccuuccugcggggccgcuaccggcuggugcgcuucgaggaccucgcccgggagccccuggccgagauccgcgcccuguacgcguucaccgggcucagccugacgccccagcuggaggccuggauccacaacaucacccacggcuccggccccggggcccggcgcgaggccuucaagaccagcucccggaacgcgcucaacgugagccaggccuggcgccacgcccugccguucgccaagauccggcgcguccaggagcugugcgccggcgcgcuccagcugcugggguaccggcccguguacuccgaggacgagcagcgcaaccucgcccuggaccuggugcugccccggggccucaacggcuucaccugggccagcuccaccgccagccacccccgcaacuga

SEQ ID NO: 28300 - RNA, 1275 nt, Artificial Sequence
  derived and/or modified sequence opt1 from CHST8__Homo_sapiens__XP_011525528
augacccugcgccccggcaccaugcggcucgccugcauguucagcuccauccugcuguucggggccgcgggccuccugcuguucaucagccuccaggacccgacggagcuggcgccccagcagguccccgggaucaaguucaacauccgcccccggcagccgcaccacgaccugccgcccggcgggucccaggacggcgaccucaaggagcccaccgagcgcgugacccgggaccugagcuccggcgcgccccgcgggcggaaccugcccgcccccgaccagccccagccgccccuccagcgcggcacccggcugcgccugcggcagcgccggcgccggcuccugaucaagaagaugcccgccgccgccacgauccccgccaacagcuccgacgccccguucauccgccccgggcccggcacccuggacgggcggugggugagccuccaccgcucccagcaggagcggaagcgcgugaugcaggaggccugcgccaaguaccgggccagcuccagccgccgcgccgucacgccccggcacgugucccgcaucuucguggaggaccggcaccgcguccuguacugcgaggugccgaaggccggcugcagcaacuggaagcgggugcugaugguccucgcgggccuggccuccagcaccgccgacauccagcacaacaccgugcacuacggguccgcccugaagcgccucgacaccuucgaccggcagggcauccugcaccgccugagcaccuacaccaagaugcuguucgugcgggagcccuucgagcgccucgucuccgccuuccgggacaaguucgagcaccccaacagcuacuaccaccccguguucgggaaggcgauccuggcccgcuaccgggccaacgccagccgcgaggcccuccggacgggcuccggcgugcgcuucccggaguucguccaguaccugcuggacgugcaccggcccguggggauggacauccacugggaccacgucagccgccucugcucccccugccugaucgacuacgacuucgugggcaaguucgagagcauggaggacgacgcgaacuucuuccugucccucauccgggcgccccgcaaccugaccuucccgcgcuucaaggaccggcacagccaggaggcccgcaccaccgcccggaucgcccaccaguacuucgcccagcuguccgcccuccagcgccagcggacguacgacuucuacuacauggacuaccugauguucaacuacagcaagcccuucgccgaccuguacuga

SEQ ID NO: 28301 - RNA, 225 nt, Artificial Sequence
  derived and/or modified sequence opt1 from CHST9__Homo_sapiens__NP_001243245
augcagccgagcgagauggugaugaacccgaagcaggucuuccuguccgugcucaucuucggcguggccgggcugcuccuguucauguaccugcaggucuggaucgaggagcagcacaccggccgcguggagaagcggcgcgagcagaaggugaccagcggguggggccccgucaaguaccugcggcccgugccccgcaucaagccccaggugucccacgccuga

SEQ ID NO: 28302 - RNA, 2409 nt, Artificial Sequence
  derived and/or modified sequence opt1 from CHSY1__Homo_sapiens__NP_055733
auggccgcccgcggccggcgcgcguggcugagcgugcuccuggggcugguccucggcuucgugcuggccucccggcuggugcucccccgcgccagcgagcugaagcgggccgggccgcgccggcgcgccucccccgagggcugccggagcgggcaggcggccgccucccaggccggcggcgcgcgcggggacgcccggggcgcccagcuguggccgcccgggagcgaccccgacggcgggccccgcgaccggaacuuccucuucgucggcgugaugaccgcccagaaguaccugcagacccgcgccguggcggccuaccggacgugguccaagaccauccccggcaagguccaguucuucagcuccgaggggagcgacaccuccgugcccaucccgguggucccccugcgcggcguggacgacagcuacccgccccagaagaaguccuucaugaugcucaaguacaugcacgaccacuaccuggacaaguacgagugguucaugcgggccgacgacgacguguacaucaagggggaccgccuggagaacuuccuccggagccugaacuccagcgagccccuguuccucggccagaccggccuggggacgaccgaggagaugggcaagcuggcccucgagcccggggagaacuucugcaugggcgggcccggcgucaucaugucccgcgaggugcugcggcgcauggugccccacaucggcaagugccugcgcgagauguacaccacccacgaggacgucgagguggggcggugcgugcgccgguucgccggcguccagugcguguggagcuacgagaugcagcagcuguucuacgagaacuacgagcagaacaagaagggguacauccgcgaccuccacaacuccaagauccaccaggcgaucacgcugcacccgaacaagaacccgcccuaccaguaccggcuccacagcuacaugcugagccgcaagaucuccgagcugcggcaccgcaccauccagcuccaccgggagaucgugcugaugagcaaguacuccaacaccgagauccacaaggaggaccugcagcucggcaucccgcccagcuucaugcgcuuccagccccggcagcgcgaggagauccuggagugggaguuccugaccgggaaguaccucuacuccgccgucgacggccagccgccccggcgcggcauggacagcgcccagcgggaggcccuggacgacaucgugaugcaggucauggagaugaucaacgccaacgcgaagacgcgcgggcggaucaucgacuucaaggagauccaguacggcuaccgccgggugaaccccauguacggggccgaguacauccuggaccuccugcugcucuacaagaagcacaagggcaagaagaugaccgugcccguccgccgccacgccuaccugcagcagaccuucuccaagauccaguucguggagcacgaggagcuggacgcccaggagcucgccaagcggaucaaccaggagagcgggucccugagcuuccuguccaacagccucaagaagcuggugcccuuccagcugcccggcuccaagagcgagcacaaggagcccaaggacaagaagaucaacauccugaucccccucuccggccgcuucgacauguucguccgguucauggggaacuucgagaagaccugccugauccccaaccagaacgugaagcuggugguccuccuguucaacagcgacuccaacccggacaaggcgaagcaggucgagcugaugcgcgacuaccggaucaaguaccccaaggccgacaugcagauccuccccgugagcggcgaguucucccgcgcccuggcccuggagguggggagcagccaguucaacaacgagucccuccuguucuucugcgacguggaccugguguucacgaccgaguuccuccagcggugccgcgcgaacaccguccugggccagcagaucuacuuccccaucaucuucagccaguacgacccgaagaucguguacuccggcaaggugcccagcgacaaccacuucgccuucacccagaagacgggguucuggcggaacuacggcuucgggaucacgugcaucuacaagggcgaccugguccgcgucgggggcuucgacguguccauccagggcugggggcucgaggacguggaccuguucaacaagguggugcaggccggccugaagaccuuccggagccaggaggucgggguggugcacguccaccaccccguguucugcgaccccaaccucgacccgaagcaguacaagaugugccugggcuccaaggccagcaccuacggguccacccagcagcuggccgagauguggcucgagaagaacgaccccagcuacuccaagagcuccaacaacaacggcagcgugcgcaccgcguga

SEQ ID NO: 28303 - RNA, 2649 nt, Artificial Sequence
  derived and/or modified sequence opt1 from CHSY3__Homo_sapiens__NP_787052
auggccgugcgcagccggcgccccuggauguccgucgcccugggccucgugcugggguucaccgcggccagcuggcugaucgccccgcggguggccgagcucuccgagcgcaagcggcgcggcagcucccugugcagcuacuacgggcgguccgccgcgggcccccgcgccggggcccagcagccccugccccagccgcagagccggccccgccaggagcaguccccccccccggcccggcaggaccuccagggccccccccugcccgaggcggccccgggcaucaccagcuuccgcuccagccccuggcagcagccccccccgcugcagcagcggcgccgggggcgcgagcccgagggcgccacggggcuccccggcgcccccgccgcggagggggagccggaggaggaggacggcggcgccgccgggcagcggcgcgacggccggcccggguccagccacaacggcuccggcgacgggggcgccgccgcgcccagcgcccgcccccgggacuuccuguacgucggggugaugaccgcccagaaguaccugggcucccgcgcccucgccgcgcagcgcaccugggcccgguucaucccggggcgcguggaguucuucagcucccagcagccccccaacgccggccagcccccgcccccccugccggucaucgcccugcccggcguggacgacagcuaccccccccagaagaagagcuucaugaugaucaaguacaugcacgaccacuaccucgacaaguacgagugguucaugcgggccgacgacgacguguacaucaagggggacaagcuggaggaguuccugcgcucccucaacagcuccaagccgcuguaccugggccagaccgggcucggcaacaucgaggagcuggggaagcugggccucgagcccggcgagaacuucugcauggggggccccgggaugaucuucagccgggagguccugcgccggauggugccccacaucggcgagugccugcgcgagauguacacgacccacgaggacguggaggucgggcggugcgugcgccgguucggcggcacccagugcgugugguccuacgagaugcagcagcucuuccacgagaacuacgagcacaaccgcaagggguacauccaggaccugcacaacagcaagauccacgcggccaucacccugcacccgaacaagcggcccgccuaccaguaccgccuccacaacuacaugcugucccggaagaucagcgagcugcgcuaccggacgauccagcuccaccgcgaguccgcccugaugagcaagcuguccaacaccgaggucagcaaggaggaccagcagcucggcgugauccccuccuucaaccacuuccagccccgggagcgcaacgaggugaucgagugggaguuccugaccgggaagcugcucuacagcgcggccgagaaccagccgccccgccagucccugagcuccauccugcggaccgcccucgacgacacgguccugcaggugauggagaugaucaacgagaacgccaagagccgcggccggcugaucgacuucaaggagauccaguacggcuaccgccgggugaaccccaugcacggggucgaguacauccucgaccugcugcuccuguacaagcgccacaagggccggaagcugaccgugcccgugcgccggcacgccuaccugcagcagcucuucuccaagccguucuuccgcgagaccgaggagcuggacgucaacagccugguggagagcaucaacuccgagacccagagcuucuccuucaucagcaacucccucaagauccugagcuccuuccagggggcgaaggagaugggcgggcacaacgagaagaagguccacauccuggugccccucaucggccgguacgacaucuuccugcgcuucauggagaacuucgagaacaugugccugauccccaagcagaacgugaagcucgucaucauccuguucagccgggacuccggccaggacagcuccaagcacaucgagcugaucaagggguaccagaacaaguaccccaaggccgagaugacgcucaucccgaugaagggcgaguucagccgcgggcugggccuggagauggccuccgcccaguucgacaacgacacccuccugcuguucugcgacguggaccucaucuuccgggaggacuuccugcagcgcugccgggacaacaccauccaggggcagcagguguacuaccccaucaucuucagccaguacgaccccaaggucaccaacggcggcaaccccccgacggacgacuacuucaucuucuccaagaagaccggguucuggcgcgacuacggcuacgggaucaccugcaucuacaagagcgaccugcucggcgccgggggcuucgacaccuccauccagggcugggggcuggaggacguggaccuguacaacaaggugauccucagcggccugcggcccuuccgcagccaggaggucgggguggugcacaucuuccaccccguccacugcgacccgaaccuggaccccaagcaguacaagaugugccucggcuccaaggcgagcacguucgccuccaccaugcagcuggccgagcuguggcucgagaagcaccugggggugcgguacaaccgcacccugagcuga

SEQ ID NO: 28304 - RNA, 2928 nt, Artificial Sequence
  derived and/or modified sequence opt1 from CHTF18__Homo_sapiens__NP_071375
auggaggacuacgagcaggagcugugcggcguggaggacgacuuccacaaccaguucgccgccgagcucgagguccuggcggagcuggagggggccagcacccccuccccgagcggcgugccccucuucaccgccgggcgcccgccccggacguucgaggaggcccuggcccgcggcgacgcggccuccagccccgcccccgccgcguccguggggagcucccagggcggcgcccggaagcgccaggucgacgccgaccugcagcccgccgggagccucccccacgccccgcggaucaagcgcccccggcuccagguggugaagcgccugaacuuccgguccgaggagauggaggagcccccgccgcccgacagcucccccaccgacaucacgcccccgcccagccccgaggaccucgcggagcuguggggccacggggucuccgaggccgccgccgacgugggccugacccgcgccagccccgcggcccggaacccggugcuccgccggccgcccauccuggaggacuacguccacgugaccuccaccgagggggugcgcgccuaccugguccuccgggccgaccccauggcccccggcgugcagggcagccugcugcacgugcccuggcgcgggggcgggcagcucgaccugcugggcgucucccucgcgagccugaagaagcaggucgacggcgagcggcgcgagcggcugcuccaggaggcccagaagcuguccgacacccugcacagccuccgcagcggggaggaggaggccgcccagccccugggcgcccccgaggaggagccgaccgacgggcaggacgcguccagccacugccuguggguggacgaguucgcgccccggcacuacacggagcuccuguccgacgacuucaccaaccgcugccugcucaaguggcugaagcugugggaccucgucguguucggccacgagcgccccagccggaagccgcgccccuccguggagcccgcccgggugagcaaggaggccaccgcccccgggaaguggaagucccacgagcagguccuggaggagaugcuggaggccggccuggaccccagccagcgccccaagcagaagguggcccugcugugcggcccgcccgggcucggcaagaccacgcuggcccacgugaucgcccggcacgcgggguacuccguggucgagaugaacgccagcgacgaccgcucccccgagguguuccggacccgcaucgaggccgccacccagauggagagcgugcugggcgccgggggcaagcccaacugccucgucaucgacgagaucgacggcgcgcccguggccgccaucaacgugcugcuguccauccucaaccggaaggggccccaggaggucggcccgcaggggcccgccgugcccagcggcgggggccgccggcgccgggccgagggcgggcugcugaugcgccccaucaucugcaucugcaacgaccaguucgcgccgucccugcggcagcucaagcagcaggccuuccugcugcacuucccgcccacccuccccagccgccuggugcagcggcugcaggaggucucccuccgccagggcaugcgggccgaccccggggugcuggccgcgcugugcgagaagacggacaacgacauccgcgccugcaucaacacccuccaguuccuguacagccgcggccagcgggagcuguccgugcgcgacguccaggccacccgggugggccucaaggaccagcgccgggggcuguucagcguguggcaggaggucuuccagcugccccgcgcccagcggcgccgggugggccaggaccccgcccuccccgcggacacccugcugcucggggacggcgacgccgggagccugacguccgccagccagcgcuucuaccgggugcugcacgccgccgcguccgccggcgagcacgagaaggucgugcagggccucuucgacaacuuccugcgccugcggcuccgcgacagcucccugggggccgugugcgucgcccuggacuggcucgccuucgacgaccugcuggcgggcgccgcccaccacagccaguccuuccagcuccugcgguacccgcccuuccugcccguggccuuccacguccucuucgcgagcucccacaccccgcgcaucaccuuccccagcucccagcaggaggcccagaaccggaugagccagaugcgcaaccugauccagacccugguguccgggaucgcccccgccacgcggagccgcgccacgccccaggcgcuccugcuggacgcccucugccugcugcucgacauccuggccccgaagcugcggcccguguccacccagcucuacagcacccgcgagaagcagcagcuggccucccuggugggcaccaugcucgccuacagccugaccuaccgccaggagcggacccccgacgggcaguacaucuaccgccuggagcccaacgucgaggagcucugccgguucccggagcugcccgcgcgcaagccccugaccuaccagacgaagcagcucaucgcccgggagaucgagguggagaagaugcgccgggccgaggccagcgcccgcguggagaacagcccccaggucgacggcuccccgcccggccuggaggggcugcucggcgggaucggcgagaagggggugcaccggcccgcgccccgcaaccacgagcagcggcuggagcacaucaugcgccgggccgcccgcgaggagcagccggagaaggacuucuucggccggguggucgugcgcuccaccgccgugcccagcgccggcgacaccgcgcccgagcaggacuccgucgagcggcgcauggggaccgccgugggccggagcgaggugugguuccgcuucaacgagggggucuccaacgccgugcgccggagccuguacauccgcgaccuccuguga

SEQ ID NO: 28305 - RNA, 750 nt, Artificial Sequence
  derived and/or modified sequence opt1 from CHTOP__Homo_sapiens__NP_001193541
auggccgcccagagcgcgcccaaggugguccugaaguccaccaccaagaugagccucaacgagcgcuucacgaacaugcugaagaacaagcagccgacccccgugaacauccgggccuccaugcagcagcagcagcagcuggccagcgcccgcaaccggcgccucgcccagcagauggagaaccggcccuccgugcaggcggcccugaagcugaagcagaagucccucaagcagcgccugggcaagagcaacauccaggcccggcuggggcgccccaucggcgcccucgcgcgcggggccaucggcgggcggggccugccgaucauccagcggggccugccccgcgggggccuccgcgggggccgggccacccggacccugcugcgcgggggcaugagccuccggggccagaaccugcugcgcgggggccgggccgucgcgccccgcauggggcuccggcgcggcggcgugcgcgggcggggcgggcccggccgcgggggccugggccggggcgccauggggcgcgggggcaucgggggccggggccgcgggaugaucggccgggggcgcggcggguucggcggccgggggcgcggccgggggcgcggccggggcgcccuggcccgcccggugcucacgaaggagcagcuggacaaccagcuggacgccuacauguccaagaccaaggggcaccucgacgccgagcuggacgcguacauggcccagaccgaccccgagaccaacgacuga

SEQ ID NO: 28306 - RNA, 420 nt, Artificial Sequence
  derived and/or modified sequence opt1 from CHURC1__Homo_sapiens__NP_001190992
augcgccagcccuaccugagcucccgggaggugagcuccagccgcaagcgguggcgcaccuucccggucgacugcguggccaugugcggcgacugcguggagaaggaguaccccaaccgggggaacacgugccucgagaacggcuccuuccugcugaacuucaccgggugcgccgucugcagcaagcgcgacuucaugcucaucaccaacaagucccugaaggaggaggacggcgaggagaucgugaccuacgaccaccugugcaagaacugccaccacgugaucgcgcggcacgaguacaccuucagcaucauggacgaguuccaggaguacacgaugcucugccugcugugcgggaaggccgaggacaccaucuccauccuccccgacgacccccgccagaugacccugcuguucuga

SEQ ID NO: 28307 - RNA, 1020 nt, Artificial Sequence
  derived and/or modified sequence opt1 from CIAO1__Homo_sapiens__NP_004795
augaaggacagccuggugcuccugggccgcguccccgcccacccggacucccggugcugguuccuggccuggaaccccgcggggacccuccuggccagcugcggcggggaccgccggauccgcaucuggggcaccgagggggacuccuggaucugcaagagcgugcuguccgagggccaccagcggacggugcgcaaggucgccuggagccccugcggcaacuaccucgccuccgccagcuucgacgcgacgaccugcaucuggaagaagaaccaggacgacuucgagugcgugaccacccuggaggggcacgagaacgaggugaaguccgucgccugggcccccagcggcaaccugcucgcgaccugcucccgggacaagagcgugugggugugggaggucgacgaggaggacgaguacgagugcguguccgugcugaacagccacacccaggacgucaagcacgugguguggcacccgucccaggagcugcucgccagcgccuccuacgacgacaccgucaagcuguaccgcgaggaggaggacgacugggugugcugcgccacgcuggaggggcacgagagcaccguguggucccucgccuucgaccccagcggccagcggcuggccagcugcuccgacgaccgcaccguccggaucuggcgccaguaccugcccgggaacgagcagggcguggcgugcagcggcuccgaccccagcuggaagugcaucugcacccucuccggguuccacagccggacgaucuacgacaucgccuggugccagcugaccggcgcccuggccaccgccugcggggacgacgcgauccgcguguuccaggaggacccgaacuccgacccccagcagcccaccuucagccucacggcccaccuccaccaggcccacucccaggacgucaacugcguggccuggaaccccaaggagccgggccugcuggccagcugcuccgacgacggcgagguggcguucuggaaguaccagcggcccgaggggcuguga

SEQ ID NO: 28308 - RNA, 939 nt, Artificial Sequence
  derived and/or modified sequence opt1 from CIAPIN1__Homo_sapiens__NP_064709
auggccgacuucggcaucagcgccgggcaguucguggcggucgugugggacaaguccagccccguggaggcccugaagggccucgucgacaagcugcaggcccugaccgggaacgagggccgcguguccguggagaacaucaagcagcuccugcagagcgcccacaaggaguccagcuucgacaucauccuguccgggcucgucccgggcagcaccacgcugcacuccgccgagauccuggcggagaucgcccggauccuccgccccggcgggugccuguuccugaaggagcccguggagaccgccguggacaacaacagcaaggucaagaccgccuccaagcucugcagcgcgcugacccuguccggccucguggaggugaaggagcugcagcgggagccccugacgccggaggagguccagagcgugcgcgagcaccucgggcacgaguccgacaaccugcuguucgugcagaucaccggcaagaagcccaacuucgaggucgggagcucccggcagcucaagcugagcaucaccaagaaguccagccccagcgugaagcccgccguggacccggccgccgccaagcuguggacccucuccgcgaacgacauggaggacgacagcauggaccugaucgacuccgacgagcugcucgaccccgaggaccugaagaagcccgaccccgccagccugcgcgccgccuccugcggcgagggcaagaagcggaaggccugcaagaacugcacgugcgggcucgcggaggagcuggagaaggagaagucccgcgagcagaugagcagccagccgaaguccgccugcggcaacugcuaccugggggacgccuuccggugcgccagcugccccuaccucggcaugcccgccuucaagcccggcgagaagguccugcuguccgacagcaaccuccacgacgcguga

SEQ ID NO: 28309 - RNA, 576 nt, Artificial Sequence
  derived and/or modified sequence opt1 from CIB1__Homo_sapiens__NP_006375
augggcgggagcggcucccgccugagcaaggagcuccuggccgaguaccaggaccugaccuuccucaccaagcaggagauccugcuggcccaccggcgcuucugcgagcuccugccccaggagcagcgguccguggagagcucccugcgcgcgcaggucccguucgagcagauccucagccugcccgagcugaaggccaaccccuucaaggagcggaucugccgcguguucuccacgagccccgccaaggacucccucagcuucgaggacuuccuggaccugcucuccguguucagcgacaccgccaccccggacaucaagucccacuacgccuuccggaucuucgacuucgacgacgacgggacccugaaccgcgaggaccugagccggcucgucaacugccugacgggcgagggggaggacacccgccuguccgcgagcgagaugaagcagcucaucgacaacauccuggaggaguccgacaucgaccgggacggcaccaucaaccugagcgaguuccagcacgugaucucccgcagccccgacuucgccagcuccuucaagaucgugcucuga

SEQ ID NO: 28310 - RNA, 564 nt, Artificial Sequence
  derived and/or modified sequence opt1 from CIB2__Homo_sapiens__NP_006374
augggcaacaagcagaccaucuucaccgaggagcagcuggacaacuaccaggacugcacguucuucaacaagaaggacauccucaagcugcacagccgcuucuacgagcuggcccccaaccucgugccgauggacuaccggaagucccccaucguccacgugcccaugagccugaucauccagaugcccgagcugcgcgagaacccguucaaggagcggaucguggccgcguucuccgaggacggggagggcaaccucaccuucaacgacuucgucgacauguucagcgugcugugcgaguccgcgccccgcgagcugaaggccaacuacgccuucaagaucuacgacuucaacaccgacaacuucaucugcaaggaggaccucgagcugacccuggcccggcucaccaagagcgagcuggacgaggaggaggugguccuggugugcgacaaggugaucgaggaggccgaccucgacggggacggcaagcugggguucgccgacuucgaggacaugaucgccaaggcccccgacuuccuguccacguuccacauccgcaucuga

SEQ ID NO: 28311 - RNA, 4827 nt, Artificial Sequence
  derived and/or modified sequence opt1 from CIC__Homo_sapiens__NP_055940
auguacagcgcccaccgcccccugaugccggccuccagcgcggccucccggggccucgggauguucguguggaccaacgucgagccccgcagcguggccguguuccccuggcacucccugguccccuuccuggccccgagccagcccgaccccuccgugcagcccagcgaggcccagcagccggcgucccaccccguggccagcaaccaguccaaggagcccgccgagagcgccgcggucgcccacgagcggcccccgggcgggaccggcuccgccgaccccgagcgcccccccggggccacgugcccggagagccccggccccggccccccgcacccccucggggugguggaguccggcaaggggccccccccgaccaccgaggaggaggccagcggcccccccggggagccccggcuggacuccgagaccgagagcgaccacgacgacgcguuccuguccaucaugagcccggagauccagcucccccugcccccgggcaagcgccggacgcagagccuguccgcccuccccaaggagcgcgacagcuccagcgagaaggacggccggucccccaacaagcgcgagaaggaccacauccggcgccccaugaacgccuucaugaucuucagcaagcggcaccgcgcccugguccaccagcggcacccgaaccaggacaaccgcaccguguccaagauccugggggaguggugguacgcccucggccccaaggagaagcagaaguaccacgaccuggcguuccaggugaaggaggcccacuucaaggcccaccccgacuggaaguggugcaacaaggaccggaagaagagcuccagcgaggccaagcccaccucccuggggcucgccggcggccacaaggagacccgcgagcggagcauguccgagacggggaccgcggccgccccgggcgucagcuccgagcugcugagcguggccgcccagacccuccuguccagcgacaccaaggcgcccggguccagcagcugcggcgccgagcgccugcacacgguggggggccccggcuccgcccggccccgcgccuucagccacuccgggguccacagccucgacggcggggagguggacucccaggcgcugcaggagcugacccagauggugagcggcccggccuccuacagcgggcccaagcccuccacccaguacggcgcccccggcccguucgccgcccccggggagggcggggcgcucgccgccaccggccgccccccccugcugccgacgcgggccagccgcucccagcgggccgcgagcgaggacaugaccuccgacgaggagcgcauggucaucugcgaggaggagggggacgacgacgugaucgccgacgacggcuucggcaccaccgacaucgaccucaagugcaaggagcgggugacggacagcgaguccggggacagcuccggcgaggaccccgaggggaacaagggcuucggccgcaaggucuucagccccgugauccggagcuccuucacccacugccgccccccgcuggaccccgagcccccggggccccccgaccccccgguggccuucggcaagggguacggcagcgcccccuccagcuccgccagcucccccgcgagcuccagcgccuccgccgccaccagcuucucccuggggagcggcaccuucaaggcgcaggaguccggccaggggagcacggccggcccccuccggccgcccccccccggggccggcgggccggccacccccuccaaggccacccgcuuccugcccauggaccccgcgaccuuccggcgcaagcggccggagagcgucggcggccuggagccccccgggcccuccgugaucgccgccccgcccagcggcgggggcaacauccuccagacgcugguccugccccccaacaaggaggagcaggaggggggcggcgcccgcgugccgagcgcccccgcgcccucccucgccuacggggcccccgccgccccgcugagccggcccgcggccaccauggugaccaacgucgugcgccccguguccagcaccccgguccccaucgccuccaagcccuuccccacgagcggccgggccgaggcguccccgaacgacaccgccggggcccgcaccgagaugggcaccgggagccgggugcccggcggcuccccccugggggugagccucgucuacuccgacaagaagagcgccgccgcgacgucccccgccccgcaccugguggccggcccccugcucgggaccgugggcaaggcccccgccaccgucaccaaccugcuggugggcacccccggguacggcgcgccggccccccccgccgugcaguucaucgcccagggggcccccggcgggggcacgaccgcgggcagcggggccggcgccggguccggcccgaacgggcccgucccccucggcauccugcagcccggcgcccuggggaaggccggcgggaucacccaggugcaguacauccucccgacccugccccagcagcugcagguggcgcccgcccccgccccggcccccggcacgaaggcggccgcccccagcgggcccgccccgaccaccuccauccgcuucacccugccccccggcacgagcaccaacggcaagguccucgccgcgaccgccccgacccccgggauccccauccugcaguccgugcccagcgccccgccccccaaggcccagagcgugucccccguccaggccccgccccccggcgggagcgcgcagcugcuccccggcaaggugcuggugccgcuggccgcccccuccaugagcguccgcggcgggggcgccgggcagccccucccccugguguccccgcccuucagcgugcccguccagaacggcgcccagcccccguccaagaucauccagcugacgcccgugcccgugagcacccccuccgggcucgucccgccccugagccccgcgacccugccgggccccaccucccagccccagaaggugcuccugcccagcuccacgcggaucaccuacgugcagagcgccggcgggcacgcccugccgcucggcaccucccccgccagcucccaggcggggaccgucacgagcuacggccccaccuccagcguggcccugggguucaccagccugggccccuccggcccggccuucgugcagccccuccugagcgccgggcaggccccccugcucgcgcccggccaggucgggguguccccggugcccagcccccagcugcccccggccugcgccgcccccggcgggcccgucaucaccgccuucuacuccggcagccccgcgccgacguccagcgccccccuggcccagcccucccaggcccccccgagccucguguacaccguggccaccuccaccacgccccccgcggccaccauccugcccaagggcccgcccgcccccgccaccgcgaccccggcccccacgagccccuuccccuccgccaccgccgggagcaugaccuacucccuggucgccccgaaggcgcagcgccccagccccaaggccccccagaaggugaaggccgccaucgccuccaucccggugggcagcuucgaggcgggggccuccggccggcccgggcccgccccccgccagccgcucgagcccggccccguccgggagcccaccgccccggagagcgagcuggagggccagcccacgccccccgccccgcccccccugcccgagaccuggaccccgaccgcgcgcagcucccccccccuccccccgcccgccgaggagcggaccagcgccaaggggcccgagacgauggccuccaaguucccgagcuccagcuccgacuggcgcgugcccggccaggggcuggagaaccggggcgagccccccaccccgcccagccccgcccccgcgccggccguggcccccggcggguccagcgaguccagcuccggccgcgccgcgggggacacccccgagcggaaggaggccgccggcaccgggaagaaggucaaggugcgccccccgccccugaagaagacguucgacagcguggacaaccggguccucuccgagguggacuucgaggagcgcuucgccgagcugcccgaguuccggcccgaggagguccugccgagccccacccuccagucccuggccaccagcccccgcgcgauccugggcuccuaccggaagaagcgcaagaacagcaccgaccucgacagcgcccccgaggacccgacgucccccaagcggaagaugcgccggcgcagcuccugcagcuccgagcccaacacccccaagagcgccaagugcgagggcgacaucuucaccuucgaccgcaccgggacggaggccgaggacgugcugggcgagcuggaguacgacaaggugccguacuccagccuccggcgcacccuggaccagcggcgcgcccuggucaugcagcucuuccaggaccacggguucuuccccuccgcgcaggccaccgccgccuuccaggcccgguacgcggacaucuuccccagcaaggugugccugcagcugaagauccgcgaggugcggcagaagaucaugcaggccgccacccccacggagcagccgcccggcgccgaggcgccccucccgguccccccccccaccgggaccgccgccgccccggcccccacccccucccccgcgggcggcccggaccccacgagccccuccagcgacuccgggaccgcccaggccgcccccccgcugcccccccccccggagagcggccccgggcagcccggcugggagggggccccccagccgucccccccccccccgggccccagcaccgcggccaccggccgcuga

SEQ ID NO: 28312 - RNA, 660 nt, Artificial Sequence
  derived and/or modified sequence opt1 from CIDEB__Homo_sapiens__NP_001305736
auggaguaccugagcgcccucaaccccuccgaccugcugcgcagcguguccaacaucagcuccgaguucggccggcgcgucuggaccagcgccccgccgccccagcggcccuuccgcgugugcgaccacaagcggaccauccgcaaggggcucacggcggccacccggcaggagcugcuggccaaggcccucgagacccugcugcucaacggcgugcugacccugguccucgaggaggacgggacggccguggacuccgaggacuucuuccagcugcuggaggacgacacgugccucauggugcugcagagcggccaguccuggagccccacccgcuccgggguccugagcuacggccucggccgggagcgccccaagcacuccaaggacaucgcgcgguucaccuucgacguguacaagcagaacccccgcgaccuguucgggagccugaacgugaaggccaccuucuacggccucuacuccaugagcugcgacuuccaggggcugggccccaagaagguccugcgggagcuccugcgcuggaccuccacccugcuccaggggcugggccacaugcugcucggcaucagcuccacccugcggcacgccguggagggggccgagcaguggcagcagaagggccgccugcacagcuacuga

SEQ ID NO: 28313 - RNA, 747 nt, Artificial Sequence
  derived and/or modified sequence opt1 from CIDEC__Homo_sapiens__NP_001186480
auggaguacgccaugaagucccugagccuccuguaccccaagagccugucccgccacgugagcguccggaccuccguggugacccagcagcuccugagcgagcccucccccaaggcgccccgcgcccggcccugccgcgucagcacggccgaccgguccgugcgcaagggcaucauggccuacagccuggaggaccuccugcugaagacccggaacccggaggcccgcucccaggaggugcgggacacccucaugcuggccgacaagcccuucuuccugguccucgaggaggacgggaccacgguggagaccgaggaguacuuccaggcgcuggccggcgacaccguguucaugguccugcagaaggggcagaaguggcagccgcccagcgagcagggcacccgccacccccucucccugagccacaagcccgccaagaagaucgacguggcccgggugacguucgaccuguacaagcucaacccccaggacuucaucgggugccugaacgucaaggcgaccuucuacgacaccuacucccugagcuacgaccuccacugcugcggcgccaagcgcaucaugaaggaggccuuccggugggcccuguucuccaugcaggccaccggccacgugcugcucgggacgagcugcuaccugcagcagcugcucgacgcgaccgaggagggccagcccccgaaggggaaggccuccagccugaucccgaccugccugaagauccuccaguga

SEQ ID NO: 28314 - RNA, 3393 nt, Artificial Sequence
  derived and/or modified sequence opt1 from CIITA__Homo_sapiens__NP_000237
augcgcugccuggcgccccggccggccggcagcuaccucuccgagccccaggggagcucccagugcgccaccauggagcugggcccccuggagggcggguaccucgagcugcugaacagcgacgccgacccccucugccuguaccacuucuacgaccagauggaccuggccggggaggaggagaucgagcucuacuccgagccggacaccgacacgaucaacugcgaccaguucagccgccugcugugcgacauggagggcgacgaggagacccgggaggccuacgccaacaucgcggagcucgaccaguacguguuccaggacucccagcuggagggccugagcaaggacaucuucaagcacaucgggcccgacgaggucaucggcgaguccauggagaugcccgccgagguggggcagaagucccagaagcgccccuucccggaggagcuccccgccgaccugaagcacuggaagcccgccgagcccccgaccguggucaccggcucccugcucguggggcccgugagcgacugcuccacgcugcccugccugccccucccggcgcuguucaaccaggagcccgccagcggccagaugcggcuggagaagaccgaccagauccccaugcccuucuccagcuccagccucuccugccugaaccugccggagggccccauccaguucguccccaccaucagcacccucccccacgggcuguggcagaucagcgaggccggcacggggguguccagcaucuucaucuaccacggcgaggugccgcaggccucccaggucccgccgcccagcggcuucaccgugcacgggcugcccaccucccccgaccgccccggcagcaccucccccuucgcccccagcgcgacggaccuccccuccaugcccgagccggcccugaccagccgggccaacaugaccgagcacaagaccucccccacgcagugccccgccgccggggaggugagcaacaagcugcccaaguggccggagcccgucgagcaguucuaccgcucccuccaggacaccuacggcgcggagcccgccgggcccgacggcauccugguggagguggaccugguccaggcccggcucgagcgcagcuccagcaagucccuggagcgggagcuggccaccccggacugggccgagcgccagcuggcgcagggcgggcuggccgaggugcugcucgccgccaaggagcaccggcgcccccgggagacccgcgugaucgccguccugggcaaggcggggcagggcaagagcuacugggccggggccgugagccgggccugggcgugcggccgccugccccaguacgacuucguguucagcguccccugccacugccucaaccggccgggcgacgccuacgggcugcaggaccuccuguucagccugggcccccagccccugguggccgccgacgagguguucucccacauccugaagcgccccgaccggguccuccugauccuggacggguucgaggagcucgaggcccaggacggcuuccugcacagcacgugcgggccggcgcccgccgagcccugcucccugcgcggccuccuggccggccuguuccagaagaagcuccugcgcgggugcacccugcuccugaccgcccggccccgcggccggcuggugcagagccucuccaaggccgacgcgcuguucgagcugagcggguucuccauggagcaggcccaggccuacgucaugcgcuacuucgagagcuccggcaugaccgagcaccaggaccgggcccucacgcugcugcgcgaccggccgcuccugcugagccacucccacagccccacccucugccgcgccgugugccagcuguccgaggcgcugcucgagcugggcgaggacgccaagcugcccagcacccucaccgggcuguacgugggccugcucgggcgggccgcccuggacuccccgcccggcgcgcuggccgagcucgccaagcuggccugggagcuggggcgccggcaccagagcacgcuccaggaggaccaguuccccuccgccgacguccgcaccugggcgauggccaagggccuggugcagcacccgccccgggccgccgagagcgagcuggccuuccccagcuuccuccugcagugcuuccugggcgcgcucuggcuggcccuguccggggagaucaaggacaaggagcucccccaguaccuggcccugacgccccgcaagaagcggccguacgacaacuggcucgagggcgugccccgcuuccuggccgggcugaucuuccagccgcccgcccggugccucggcgcgcugcuggggcccagcgccgccgccuccgucgaccgcaagcagaaggugcucgcgcgguaccugaagcgccugcagcccggcacccuccgcgcccggcagcugcuggagcuccugcacugcgcccacgaggccgaggaggccggcaucuggcagcacgugguccaggagcugcccgggcgccucagcuuccugggcacccggcugacgcccccggacgcgcacgugcucgggaaggcccuggaggccgccggccaggacuucucccuggaccuccgcagcaccgggaucugccccuccggccugggcagccugguggggcucuccugcgucacccgguuccgcgccgcgcugagcgacaccguggcccugugggagucccuccagcagcacggcgagaccaagcugcugcaggccgccgaggagaaguucaccaucgagcccuucaaggccaagagccucaaggacguggaggaccuggggaagcugguccagacccagcggacccgcuccagcuccgaggacacggcgggcgagcuccccgccgugcgggaccugaagaagcuggaguucgcccucgggccggugagcggcccccaggccuuccccaagcugguccgcauccugaccgccuucuccagccuccagcaccuggaccuggacgcgcucuccgagaacaagaucggcgacgagggggugagccagcugagcgccaccuucccccagcugaagucccuggagacccucaaccugagccagaacaacaucacggaccugggcgccuacaagcucgccgaggcgcugccgucccuggccgccagccuccugcggcugucccucuacaacaacugcaucugcgacgugggggccgagagccuggcccgcguccugcccgacauggugucccuccgggugauggacguccaguacaacaaguucaccgcggccggcgcccagcagcuggccgccagccugcgccggugcccccacguggagacccucgcgauguggacccccacgaucccguucuccgugcaggagcaccuccagcagcaggacagccgcaucucccugcgguga

SEQ ID NO: 28315 - RNA, 3471 nt, Artificial Sequence
  derived and/or modified sequence opt1 from CILP2__Homo_sapiens__NP_694953
auggccagccugcucccccugcugugccucugcguggucgccgcgcaccuggccggcgcccgcgacgccaccccgaccgaggagcccauggccacggcgcuggggcucgagcggcgcuccguguacaccggccagcccagccccgcccuggaggacugggaggaggccuccgaguggaccagcugguucaacguggaccaccccgggggcgacggggacuucgagucccuggccgcgauccgguucuacuacggccccgcccgcgucugcccccggccccucgcccuggaggcccgcaccacggacugggcccugccgagcgcggugggcgagcgggugcaccucaaccccacccgcggguucuggugccugaaccgggagcagccccgcggccggcgcugcuccaacuaccacguccgguuccgcugcccccuggaggccagcuggggcgccugggggccgugggggcccugcuccggcagcugcggccccgggcggcgccuccggcgccggcacugccccuccccggccggcgacgccugccccgggcgcccccuggaggcgcagaagugcgugcggccccgcugcccgggcugcagccuggacacgugcgagugccccgaccacauccuccugggcuccguggucacccccagcgggcagccccugcucggcgcccgcgugucccugcgggaccagccggggaccguggccaccagcgacgcccacggcaccuuccgcguccccggggugugcgccgacucccgggcgaacauccgcgcccagauggacggcuucagcgccggcgaggcccaggcccaggcgaacggguccaucagcguggucaccaucauccuggacaagcucgagaagcccuaccuggugaagcaccccgagagccgggugcgcgaggccggccagaacgucacguucugcugcaaggccuccgggaccccgaugcccaagaaguacagcugguuccacaacggcacccugcucgaccggcgcgcccacggguacggcgcgcaccuggagcugcggggccuccgccccgaccaggccgggaucuaccacugcaaggccuggaacgaggccggcgccgugcgguccgggaccgcgcgccugacggugcuggccccgggccagcccgccugcgacccccggccccgcgaguaccucaucaagcugccggaggacugcgggcagcccggcagcggccccgccuaccuggacgucgggcucugccccgacacccggugcccgucccuggccggcagcagcccccgcugcggggacgcguccucccggugcugcagcgugcgccggcuggagcgccgcgagauccacugccccggcuacgugcuccccgucaagguggucgccgagugcggcugccagaagugccugccgccccgggggcuggugcgcggccggguggucgccgccgacuccggggagccccuccgcuucgcccggauccugcugggccaggagcccaucggguucaccgcguaccagggcgacuucaccaucgaggugccgcccagcacgcagcgccucguggucaccuucguggaccccuccggcgaguucauggacgccgugcggguccugcccuucgacccgcgcggggccggcguguaccacgaggugaaggccaugcggaagaaggcgcccgucauccugcacaccagccaguccaacaccaucccccucggggagcuggaggacgaggcgccccugggcgagcuggugcucccgagcggggccuuccgccgggccgacggcaagcccuacuccggccccguggaggcccgcgucacguucguggacccgcgggaccugaccagcgccgccuccgcccccagcgaccugcgcuucguggacagcgacggggagcucgcgccccugcggaccuacggcauguucuccgucgaccugcgcgcccccgggagcgccgagcagcuccaggugggcccgguggccguccggguggccgccucccagauccacaugcccgggcacguggaggcccugaagcuguggagccucaaccccgagaccggccugugggaggaggaguccggcuuccgccgggaggggagcuccggcccccgcguccggcgcgaggagcgcguguuccugguggggaacgucgagauccgggagcgccgccucuucaaccuggacgugccggagcggcggcgcugcuucgugaagguccgggcguacgccaacgacaaguucacgcccagcgagcaggucgagggcgugguggugacccuggugaaccucgagcccgcccccggguucuccgccaacccgcgcgcguggggccgguucgacagcgccgucaccggccccaacggggccugccugcccgccuucugcgacgccgaccgccccgacgcguacaccgcccuggugacggccacccucggcggggaggagcuggagccggcccccucccugccccggccccucccggccaccgugggcgucacccagcccuaccuggaccgccugggcuaccggcgcacggaccacgacgaccccgcguucaagcggaacggguuccgcaucaaccucgccaagccccggccgggcgaccccgccgaggccaacgggcccguguaccccuggcgcagccugcgggagugccagggcgccccggugaccgcgucccacuuccgcuucgcccgcgucgaggccgacaaguacgaguacaacguggugcccuuccgggaggggacccccgccagcuggaccggcgaccugcucgccugguggccgaacccccaggaguuccgcgcgugcuuccugaaggucaagauccagggcccccaggaguacauggugcggucccacaacgccgggggcagccacccccgcacccgggggcagcuguacggccuccgcgacgcccgguccgugcgcgacccggagcggcccgggacgagcgccgcgugcgucgaguucaagugcagcggcaugcuguucgaccagcgccagguggaccggacccuggugaccaucaugccccagggcuccugccgccgggucgccgugaacgggcuccugcgcgacuaccugacccggcacccgccgcccguccccgccgaggaccccgccgccuucagcaugcucgcgccgcuggacccccugggccacaacuacgggguguacacggugaccgaccagagcccccgccucgccaaggagaucgccaucggccggugcuucgacggguccuccgacggcuucagccgcgagaugaaggccgacgccggcaccgcggucaccuuccagugccgggagcccccggccgggcgccccucccuguuccagcggcugcucgagagccccgccacggcccugggcgacauccgccgcgagauguccgaggccgcgcaggcccaggcccgggccagcgggccccugcgcacccggcgcggccgggugcgccaguga

SEQ ID NO: 28316 - RNA, 3555 nt, Artificial Sequence
  derived and/or modified sequence opt1 from CILP__Homo_sapiens__NP_003604
auggugggcaccaaggccugggucuucagcuuccuggugcucgaggugaccuccguccuggggcgccagacgaugcugacccagagcgugcggcgcgugcagcccggcaagaagaacccguccaucuucgccaagcccgcggacacccucgagagccccggggaguggaccacgugguucaacaucgacuaccccggcgggaagggcgacuacgagcggcuggacgccauccgcuucuacuacggcgaccgggucugcgcccgcccgcugcggcucgaggcccgcaccaccgacuggacccccgccggguccacgggccagguggugcacgggagcccccgggagggcuucuggugccugaaccgcgagcagcggcccgggcagaacugcuccaacuacaccguccgcuuccugugcccgcccggcagccuccggcgcgacaccgagcggaucuggucccccuggagccccugguccaagugcagcgcggccugcggccagaccggggugcagacgcgcacccggaucugccuggccgagauggugucccugugcagcgaggccuccgaggagggccagcacugcauggggcaggacugcaccgcgugcgaccugaccugcccgaugggccaggucaacgccgacugcgacgccugcaugugccaggacuucaugcugcacggcgccgugagccugcccgggggcgcccccgcguccggggccgccaucuaccuccugacgaagacccccaagcugcucacccagaccgacagcgacggccgcuuccggaucccggggcugugccccgacggcaaguccauccugaagaucacgaaggugaaguucgcccccaucguccucaccaugcccaagaccagccugaaggccgcgaccaucaaggccgaguucgugcgcgccgagacgccguacauggugaugaaccccgagaccaaggcccggcgcgccggccagagcgucucccugugcugcaaggcgaccgggaagccccgccccgacaaguacuucugguaccacaacgacacccuccuggacccgagccuguacaagcacgaguccaagcucgugcugcggaagcugcagcagcaccaggccggcgaguacuucugcaaggcccagagcgacgccggggccgugaaguccaaggucgcgcagcucaucgugaucgccagcgacgagacgcccugcaaccccgugcccgaguccuaccugauccgccugccgcacgacugcuuccagaacgccaccaacagcuucuacuacgacgucggccggugccccgugaagaccugcgccgggcagcaggacaacggcauccgcugccgggacgcgguccagaacugcugcggcaucuccaagaccgaggagcgcgagauccagugcagcggguacacgcuccccaccaagguggccaaggagugcuccugccagcggugcaccgagacccgcagcaucgugcggggccgcgucuccgccgccgacaacggggagccgaugcgguucggccacguguacauggggaacagccgcguguccaugacgggcuacaagggcaccuucacccugcacgucccccaggacaccgagcggcuggugcucaccuucguggaccgccugcagaaguucgucaacacgaccaaggugcugcccuucaacaagaaggggagcgccguguuccacgagaucaagaugcuccggcgcaaggagcccaucacccuggaggcgauggagaccaacaucaucccgcugggcgaggucgugggggaggaccccauggccgagcucgagauccccucccggagcuucuaccgccagaacggcgagcccuacaucggcaaggugaaggccuccgucacguuccuggacccgcggaacaucagcaccgccaccgccgcgcagaccgaccugaacuucaucaacgacgagggggacacguucccccuccgcaccuacggcauguucagcguggacuuccgcgacgaggugaccuccgagccccugaacgccgggaaggucaaggugcaccuggacagcacccaggugaagaugcccgagcacaucuccacggucaagcucuggagccugaacccggacaccggccugugggaggaggagggggacuucaaguucgagaaccagcggcgcaacaagcgggaggaccgcaccuuccuggugggcaaccucgagauccgggagcgccggcuguucaaccuggacgugcccgagucccgccggugcuucgucaaggugcgcgccuaccggagcgagcgcuuccuccccuccgagcagauccagggcguggucaucagcgugaucaaccuggagccccggaccggguuccuguccaacccgcgcgccuggggccgguucgacagcgugaucacggggcccaacggcgccugcguccccgcguucugcgacgaccagucccccgacgccuacagcgccuacgugcucgccucccuggcgggggaggagcugcaggccguggagagcuccccgaaguucaaccccaacgccaucggcgucccccagcccuaccucaacaagcugaacuaccgccggaccgaccacgaggacccgcgcgugaagaagaccgccuuccagaucagcauggccaagccccggcccaacuccgcggaggagagcaacggcccgaucuacgccuucgagaaccugcgcgccugcgaggaggccccgcccagcgccgcgcacuuccgguucuaccagaucgagggggaccgcuacgacuacaacaccgugcccuucaacgaggacgaccccauguccuggacggaggacuaccucgccugguggcccaagcccauggaguuccgcgccugcuacaucaaggucaagaucgugggcccccuggaggugaacguccggagccgcaacaugggcgggacccaccggcagaccguggggaagcuguacggcauccgcgacgugcgguccacccgcgaccgggaccagccgaacgucagcgccgccugccucgaguucaagugcuccggcaugcuguacgaccaggaccgcguggaccggacgcuggugaaggucaucccccaggggagcugccgccgggcguccgugaaccccaugcuccacgaguaccuggugaaccaccucccccucgccgucaacaacgacaccagcgaguacaccaugcuggccccgcuggacccccucggccacaacuacgggaucuacaccgugacggaccaggacccccgcaccgccaaggagaucgcgcugggccggugcuucgacgggaccuccgacggcagcucccgcaucaugaaguccaacgugggcgucgcccugaccuucaacugcguggagcggcaggucgggcgccagagcgccuuccaguaccuccagagcacgcccgcccaguccccggccgcgggcaccgugcaggggcgggugcccagccgccggcagcagcgcgccucccgcggcggccagcggcagggcggggucguggccagccugcgcuucccccggguggcccagcagccccugaucaacuga

SEQ ID NO: 28317 - RNA, 639 nt, Artificial Sequence
  derived and/or modified sequence opt1 from CINP__Homo_sapiens__NP_116019
auggaggccaagacccugggcaccgugacgccccgcaagccgguccucagcguguccgcccggaagaucaaggacaacgcggccgacuggcacaaccugauccugaagugggagacccucaacgacgccggguucaccaccgccaacaacaucgccaaccugaagaucagccugcucaacaaggacaagaucgagcuggacuccagcucccccgcgagcaaggagaacgaggagaaggugugccuggaguacaacgaggagcucgagaagcugugcgaggagcugcaggccacgcucgacggccugaccaagauccaggucaagauggagaagcuguccagcaccaccaaggggaucugcgagcucgagaacuaccacuacggcgaggaguccaagcgcccgccccuguuccacacguggcccaccacccacuucuacgaggugagccacaagcugcucgagauguaccggaaggagcugcugcucaagcgcaccguggccaaggagcuggcccacacgggggaccccgaccugacccucuccuaccugagcauguggcugcaccagcccuacgucgaguccgacagccggcuccaccuggaguccaugcugcucgagaccggccaccgcgcgcuguga

SEQ ID NO: 28318 - RNA, 1200 nt, Artificial Sequence
  derived and/or modified sequence opt1 from CIPC__Homo_sapiens__NP_219494
auggagcgcaagaaccccagccgggaguccccgcgccggcugagcgccaaggugggcaaggggaccgagaugaagaaggucgcccgccagcucggcauggcggccgccgaguccgacaaggacagcggguucuccgacggcagcuccgagugccugagcuccgccgagcagauggagagcgaggacaugcuguccgcccucggguggagccgggaggaccgcccccggcagaacuccaagaccgcgaagaacgccuuccccacgcugagccccaugguggugaugaagaacguccuggugaagcagggcuccagcuccagccagcuccaguccuggaccgugcagccgagcuucgaggucaucagcgcccagccccagcugcuguuccuccacccgcccgugcccucccccgugagccccugccacaccggcgagaagaaguccgacagccgcaacuaccugcccauccugaacuccuacaccaagaucgccccgcaccccgggaagcggggccucagccuggggcccgaggagaagggcacguccgggguccagaagaagaucugcaccgagcgccugggccccagccucuccagcuccgagccgaccaaggcgggcgccgugcccagcucccccagcacccccgccccgcccuccgccaagcuggccgaggacagcgcgcugcagggggugcccucccucgucgccggcgggagcccccagacgcugcagccgguguccagcagccacguggccaaggcccccucccugaccuucgccagccccgcgucccccgucugcgccagcgacuccacccuccacggccuggagagcaacuccccgcugagcccccucuccgccaacuacagcagcccccugugggccgccgagcaccugugccggagcccggacaucuucuccgagcagcgccagagcaagcaccggcgcuuccagaacacccucguggugcugcacaaguccggccugcucgagaucacgcugaagaccaaggagcugauccggcagaaccaggcgacccaggucgagcucgaccagcugaaggagcagacccagcuguucaucgaggccacgaagucccgcgcgccccaggccugggccaagcuccaggccucccugacccccgggagcagcaacaccggcuccgaccuggaggccuucagcgaccaccccgccaucuga

SEQ ID NO: 28319 - RNA, 1353 nt, Artificial Sequence
  derived and/or modified sequence opt1 from CIR1__Homo_sapiens__NP_004873
augggcaagagcuucgccaacuucaugugcaagaaggacuuccaccccgccuccaagagcaacaucaagaagguguggauggcggagcagaagaucuccuacgacaagaagaagcaggaggagcugaugcagcaguaccucaaggagcaggagagcuacgacaaccgccugcugaugggggacgagcgggucaagaacggccucaacuucauguacgaggccccgcccggggccaagaaggagaacaaggagaaggaggagaccgagggcgagaccgaguacaaguucgaguggcagaagggggcgccccgcgagaaguacgccaaggacgacaugaacauccgggaccagcccuucggcauccaggugcgcaacgugcggugcaucaagugccacaaguggggccacgucaacacggaccgcgagugcccgcuguucgggcuguccggcaucaacgccagcuccgugcccaccgacgggagcggccccuccaugcaccccagcgagcucaucgccgagaugcggaacuccggguucgcccugaagcgcaacgugcugggccggaaccucaccgccaacgacccgagccaggaguacgucgcguccgagggcgaggaggaccccgagguggaguuccucaagagccugaccacgaagcagaagcagaagcugcugcgcaagcuggaccggcucgagaagaagaagaagaagaaggaccgcaagaagaagaaguuccagaagucccggagcaagcacaagaagcacaaguccagcuccagcagcuccagcuccagcuccagcuccagcuccaccgagaccagcgaguccagcuccgagagcgaguccaacaacaaggagaagaagauccagcgcaagaagcggaagaagaacaagugcagcgggcacaacaacuccgacagcgaggagaaggacaaguccaagaagcgcaagcugcacgaggagcugagcagcucccaccacaaccgggagaaggccaaggagaagccccgcuuccucaagcacgagagcucccgggaggacagcaaguggucccacagcgacuccgacaagaagucccgcacccacaagcacagccccgagaagcggggcagcgagcgcaaggagggguccagccgcucccacggccgggaggagcgcagccggcgcucccggagccgcuccccgggcagcuacaagcagcgggagacgcgcaagcgggcccagcgcaaccccggggaggagcagagccggcgcaacgacucccggagccacggcaccgaccuguaccgcggggagaagauguaccgggagcaccccggcgggacccacaccaaggugacgcagcgcgaguga

SEQ ID NO: 28320 - RNA, 507 nt, Artificial Sequence
  derived and/or modified sequence opt1 from CIRBP__Homo_sapiens__NP_001287744
auggccagcgacgagggcaagcuguucgugggcgggcucuccuucgacaccaacgagcagagccuggagcaggucuucuccaaguacgggcagaucagcgaggugguggucgugaaggaccgcgagacccagcggucccgcggcuucggguucgugacguucgagaacaucgacgacgccaaggacgcgaugauggccaugaacggcaagagcgucgacggccggcagauccgcguggaccaggccgggaaguccagcgacaaccggucccgcggcuaccgcgggggcagcgccgggggccggggcuucuuccgcgggggccgggggcggggccgcggcuucucccgcgggggcggggaccggggcuacgggggcaaccgguucgagagccgcuccggcggguacggcgggagccgggacuacuacuccagccgcucccagagcggcggguacuccgaccggagcagcggcggcuccuaccgcgacagcuacgacuccuacggguga

SEQ ID NO: 28321 - RNA, 2061 nt, Artificial Sequence
  derived and/or modified sequence opt1 from CIRH1A__Homo_sapiens__NP_116219
augggcgaguucaaggugcaccgcguccgguucuucaacuacgugcccagcgggauccgcugcguggccuacaacaaccaguccaaccggcuggccgucagccgcaccgacggcaccguggagaucuacaaccucuccgcgaacuacuuccaggagaaguucuucccggggcacgagagccgggccacggaggcccugugcugggccgagggccagcgccuguucuccgccgggcucaacggcgagaucauggaguacgaccugcaggcgcugaacaucaaguacgccauggacgccuucggcgggcccaucuggagcauggccgcgucccccagcggcucccagcuccugguggggugcgaggacggcagcgucaagcuguuccagaucacccccgacaagauccaguucgagcggaacuucgaccgccagaagucccggauccucagccuguccuggcacccgagcgggacccacaucgccgccggcuccaucgacuacaucagcguguucgacgugaaguccggcagcgccguccacaagaugaucguggaccgccaguacauggggguguccaagcggaagugcaucgucuggggcguggccuuccugagcgacgggaccaucaucagcguggacuccgcgggcaagguccaguucugggacagcgccacgggcacccucgugaagucccaccugaucgccaacgccgacgugcagagcaucgccgucgcggaccaggaggacuccuucgugguggggaccgccgagggcaccgucuuccacuuccagcuggugcccgugacgagcaacuccagcgagaagcaguggguccgcaccaagcccuuccagcaccacacccacgacgugcggaccgucgcccacucccccacggcccucaucagcgggggcaccgacacccaccugguguuccgcccgcugauggagaagguggaggucaagaacuacgacgccgcgcuccggaagaucaccuucccccaccgcugccugaucuccugcagcaagaagcggcagcugcuccuguuccaguucgcccaccaccuggagcucuggcgccugggguccacgguggccaccggcaagaacggcgacacccugccccucagcaagaacgccgaccaccuccugcaccucaagaccaaggggcccgagaacaucaucugcuccugcaucagcccgugcggcuccuggaucgccuacagcacggugucccgguucuuccuguaccgccugaacuacgagcacgacaacaucagccucaagcgggucagcaagaugcccgcguuccugcgcuccgcccugcagauccucuucagcgaggacuccaccaagcuguucguggccagcaaccagggggcccugcacaucgugcagcucuccggcgggagcuucaagcaccuccacgcguuccagccccaguccggcaccgucgaggccaugugccugcuggccgugagccccgacggcaacuggcuggccgccuccgggaccagcgcgggcgugcacgucuacaacgugaagcagcugaagcuccacugcacggugccggccuacaacuuccccgucaccgccauggccaucgcccccaacaccaacaaccuggugaucgcgcacuccgaccagcaggucuucgaguacagcauccccgacaagcaguacaccgacuggucccgcacggugcagaagcagggguuccaccaccuguggcuccagcgggacaccccgaucacccacaucagcuuccaccccaagcgccccaugcacauccugcugcacgacgccuacauguucugcaucaucgacaagucccugccccucccgaacgacaagacccugcuguacaaccccuucccgcccacgaacgagagcgacgugauccggcgccggaccgcccacgccuucaagaucuccaagaucuacaagccccuccuguucauggaccugcucgacgagcgcacccugguggccgucgagcggccccuggacgacaucaucgcgcagcugcccccgcccaucaagaagaagaaguucggcaccuga

SEQ ID NO: 28322 - RNA, 327 nt, Artificial Sequence
  derived and/or modified sequence opt1 from CISD1__Homo_sapiens__NP_060934
augagccugaccuccagcuccagcgugcgcgucgaguggaucgccgccgugaccaucgcggccggcacggccgccaucggguaccucgccuacaagcgguucuacgugaaggaccaccgcaacaaggcgaugaucaaccugcacauccagaaggacaaccccaagaucguccacgccuucgacauggaggaccugggcgacaaggccguguacugccggugcuggcgcuccaagaaguucccguucugcgacggggcccacaccaagcacaacgaggagaccggcgacaacguggggccccucaucaucaagaagaaggagaccuga

SEQ ID NO: 28323 - RNA, 408 nt, Artificial Sequence
  derived and/or modified sequence opt1 from CISD2__Homo_sapiens__NP_001008389
auggugcuggagagcgucgcccgcaucgugaaggugcagcuccccgccuaccugaagcggcugccgguccccgaguccaucaccggcuucgcgcgccucaccgugagcgaguggcugcggcugcuccccuuccugggggugcuggcccuccugggcuaccuggccguccgccccuuccucccgaagaagaagcagcagaaggacucccugaucaaccugaagauccagaaggagaaccccaagguggugaacgagaucaacaucgaggaccucugccugacgaaggccgccuacugccggugcuggcgcagcaagaccuuccccgcgugcgacgggucccacaacaagcacaacgagcugaccggcgacaacgucgggccccucauccugaagaagaaggagguguga

SEQ ID NO: 28324 - RNA, 828 nt, Artificial Sequence
  derived and/or modified sequence opt1 from CISH__Homo_sapiens__NP_037456
auguaccuggagcacaccagccacugcccccaccacgacgacgacaccgccauggacacgccgcucccccgcccccggccccugcuggccguggagcgcaccggccagcggccgcucugggcgcccucccuggagcugcccaagcccgucaugcagccgcuccccgccggggccuuccuggaggagguggccgagggcacccccgcccagaccgagagcgagcccaaggugcuggacccggaggaggaccuccugugcaucgcgaagacguucuccuaccugcgcgagagcgggugguacuggggcuccaucaccgccagcgaggcccggcagcaccuccagaagaugcccgaggggaccuuccugguccgcgacuccacccaccccagcuaccuguucacgcucuccgugaagaccacccggggccccaccaacgugcgcaucgaguacgccgacagcuccuuccggcuggacagcaacugccugucccgcccgcggauccucgcguuccccgacgucgugagccuggugcagcacuacgucgccuccugcacggccgacacccgcagcgacucccccgaccccgccccgacccccgcccugcccaugcccaaggaggacgcgccgagcgaccccgcccuccccgcgcccccgcccgccaccgccgugcaccugaagcuggugcagcccuucguccggcgcuccagcgcccggagccuccagcaccugugccgccuggugaucaaccggcucguggccgacgucgacugccugccgcugccccgccggauggccgacuaccuccgccaguaccccuuccagcuguga

SEQ ID NO: 28325 - RNA, 660 nt, Artificial Sequence
  derived and/or modified sequence opt1 from CITED1__Homo_sapiens__NP_001138357
auggagcccagcgcccagcagcugcagcucgccgcgucccugccggccaaccugagcaacuucugccagggcuccgagaugcccaccaccagccgccccgcccucgacgugaagggcgggacgucccccgccaaggaggacgccaaccaggagaugagcuccgucgcguacagcaaccuggccgugaaggaccggaaggccguggccauccugcacuacccgggggucgcguccaacggcaccaaggccagcggggcccccaccuccagcuccggcagccccaucggcucccccaccacgaccccgcccaccaagccgcccagcuucaaccuccaccccgcgccccaccuccuggccuccaugcaccuccagaagcugaacagccaguaccaggggauggccgccgccacccccggccagcccggggaggccggcccgcugcagaacugggacuucggggcccaggcgggcggcgccgagucccugagccccagcgccggggcccagucccccgccaucaucgacagcgaccccguggacgaggaggugcugaugucccuggucguggagcucggccuggaccgcgcgaacgagcugccggagcucuggcuggggcagaacgaguucgacuucacggccgacuuccccagcuccugcuga

SEQ ID NO: 28326 - RNA, 813 nt, Artificial Sequence
  derived and/or modified sequence opt1 from CITED2__Homo_sapiens__NP_001161860
auggccgaccacaugauggccaugaaccacggccgcuuccccgacgggaccaacggccugcaccaccacccggcgcaccggauggggaugggccaguuccccagcccccaccaccaccagcagcagcagccccagcacgccuucaacgcccucaugggggagcacauccacuacggcgccggcaacaugaacgccaccuccgggauccgccacgcgaugggcccggggacggugaacggcgggcacccgcccagcgcccuggcccccgccgcgcgguucaacaacucccaguucaugggcccgcccgucgccagccagggcgggucccugcccgccagcaugcagcuccagaagcugaacaaccaguacuucaaccaccaccccuacccgcacaaccacuacaugcccgaccugcaccccgccgccggccaccagaugaacgggaccaaccagcacuuccgcgacugcaaccccaagcacuccggcggcagcuccacccccgggggcagcgggggcuccagcacccccgggggcuccggcagcuccagcgggggcggggcgggcuccagcaacuccgggggcggcagcgggagcggcaacaugcccgccuccguggcccacgugcccgccgccaugcucccgcccaacgucaucgacacggacuucaucgacgaggaggugcugaugagccuggugaucgagauggggcucgaccggaucaaggagcugcccgagcuguggcucggccagaacgaguucgacuucaugaccgacuucgucugcaagcagcagcccucccgcgugagcugcuga

SEQ ID NO: 28327 - RNA, 6210 nt, Artificial Sequence
  derived and/or modified sequence opt1 from CIT__Homo_sapiens__NP_001193928
augcugaaguucaaguacggcgcccgcaacccccucgacgccggggccgccgagcccaucgccagccgggccucccgccugaaccuguucuuccagggcaagccgcccuucaugacccagcagcagaugagcccccucucccgggaggggauccuggacgcccuguucguccuguucgaggagugcagccagcccgcccugaugaagaucaagcacguguccaacuucgugcgcaaguacagcgacaccaucgccgagcugcaggagcuccagcccuccgccaaggacuucgaggugcggagccuggucggcugcgggcacuucgccgagguccagguggugcgcgagaaggcgaccggcgacaucuacgccaugaaggugaugaagaagaaggcccugcucgcccaggagcaggucuccuucuucgaggaggagcggaacauccugagccgcuccaccagccccuggaucccccagcugcaguacgccuuccaggacaagaaccaccucuaccuggucauggaguaccagcccggcggggaccugcucucccugcugaaccgguacgaggaccagcucgacgagaaccugauccaguucuaccuggcggagcucauccuggccgugcacagcgugcaccugaugggcuacgugcaccgcgacaucaagcccgagaacauccucguggaccggaccgggcacaucaagcugguggacuucggcuccgccgccaagaugaacagcaacaagauggugaacgccaagcugcccaucgggacccccgacuacauggcgccggaggugcucacggugaugaacggcgacggcaaggggaccuacggccuggacugcgacuggugguccgucggggugaucgccuacgagaugaucuacggccgcagccccuucgccgagggcaccuccgcccggaccuucaacaacaucaugaacuuccagcgcuuccugaaguuccccgacgaccccaaggugagcagcgacuuccucgaccugauccagucccugcucugcgggcagaaggagcggcugaaguucgagggccugugcugccacccguucuucagcaagaucgacuggaacaacauccgcaacagcccgccgcccuucgucccgacgcucaagagcgacgacgacaccuccaacuucgacgagcccgagaagaacagcuggguguccagcucccccugccagcugagccccuccggguucagcggcgaggagcugccguucgugggguucuccuacagcaaggcccucggcauccugggccgguccgagagcgucguguccgggcuggacagccccgcgaagaccuccagcauggagaagaagcuccugaucaagagcaaggagcugcaggacucccaggacaagugccacaagauggagcaggagaugacccgccuccaccggcgcgucagcgagguggaggccgugcugucccagaaggaggucgagcugaaggccagcgagacgcagcggucccugcucgagcaggaccuggccaccuacaucaccgagugcagcucccugaagcgcagccucgagcaggcccgcauggaggugucccaggaggacgacaaggcgcugcagcugcuccacgacauccgggagcagagccgcaagcugcaggagaucaaggagcaggaguaccaggcccagguggaggagaugcggcugaugaugaaccagcucgaggaggaccuggucuccgcccgccggcgcagcgaccuguacgaguccgagcuccgggagagccgccuggccgcggaggaguucaagcggaaggccaccgagugccagcacaagcugcucaaggccaaggaccagggcaagcccgaggugggggaguacgccaagcuggagaagaucaacgccgagcagcagcugaagauccaggagcuccaggagaagcuggagaaggcggugaaggccuccacggaggccaccgagcugcuccagaacauccgccaggccaaggagcgggccgagcgcgagcuggagaagcugcagaaccgggaggacagcuccgagggcauccgcaagaagcucgucgaggcggaggagcggcgccacagccuggagaacaaggugaagcggcuggagaccauggagcgccgggagaaccgccucaaggacgacauccagaccaagagccagcagauccagcagauggccgacaagauccuggagcuggaggagaagcaccgcgaggcccagguguccgcccagcaccucgagguccaccugaagcagaaggagcagcacuacgaggagaagaucaaggugcuggacaaccagaucaagaaggaccucgccgacaaggagacgcuggagaacaugaugcagcggcacgaggaggaggcgcacgagaaggggaagauccugagcgagcagaaggccaugaucaacgccauggacuccaagauccgcagccucgagcagcggaucguggagcuguccgaggccaacaagcuggcggccaacagcucccucuucacccagcgcaacaugaaggcccaggaggagaugaucagcgagcugcggcagcagaaguucuaccuggagacccaggccggcaagcucgaggcccagaaccgcaagcuggaggagcagcuggagaagaucucccaccaggaccacagcgacaagaaccggcuccuggagcuggagacccgccuccgggaggucucccuggagcacgaggagcagaagcuggagcucaagcgccagcugacggagcugcagcucagccugcaggagcgggagucccagcugaccgcgcuccaggccgcccgcgccgcccuggagagccagcugcggcaggcgaagaccgagcucgaggagaccacggccgaggccgaggaggagauccaggcccugaccgcccaccgcgacgagauccagcggaaguucgacgcgcugcgcaacuccugcaccgugaucaccgaccucgaggagcagcugaaccagcugacggaggacaacgccgagcucaacaaccagaacuucuaccugagcaagcagcuggacgaggccuccggcgccaacgacgagaucgugcagcuccggagcgaggucgaccaccuccgccgggagaucaccgagcgcgagaugcagcugaccucccagaagcagaccauggaggcgcucaagacgaccugcaccaugcuggaggagcaggucauggaccuggaggcccucaacgacgagcugcuggagaaggagcggcagugggaggccuggcgcagcgugcucggggacgagaagucccaguucgagugccgcguccgggagcugcagcgcaugcuggacaccgagaagcagucccgggcccgcgccgaccagcggaucaccgagagccgccaggugguggagcucgcggucaaggagcacaaggccgagauccuggcccugcagcaggcccucaaggagcagaagcugaaggccgagucccugagcgacaagcucaacgaccuggagaagaagcacgcgaugcuggagaugaacgcccggucccuccagcagaagcuggagacggagcgcgagcugaagcagcggcuccuggaggagcaggccaagcugcagcagcagauggaccugcagaagaaccacaucuuccgccucacccagggccugcaggaggcccuggaccgggccgaccuccugaagaccgagcgcagcgaccuggaguaccagcucgagaacauccaggugcuguacucccacgagaaggugaagauggaggggaccaucagccagcagacgaagcugaucgacuuccuccaggcgaagauggaccagcccgccaagaagaagaagggccuguucucccggcgcaaggaggacccggcccugcccacccaggucccccuccaguacaacgagcugaagcuggcccucgagaaggagaaggcccggugcgcggagcuggaggaggcccugcagaagacccgcaucgagcuccggagcgcccgcgaggaggccgcgcaccggaaggccaccgaccacccgcaccccuccacgcccgccaccgcccgccagcagaucgccaugagcgcgaucgugcgcucccccgagcaccagccgagcgccaugucccugcuggcgccgcccagcucccggcgcaaggagagcuccacccccgaggaguucagccggcgccucaaggagcggaugcaccacaacaucccgcaccgcuucaacguggggcugaacaugcgggccaccaagugcgccgucugccuggacacggugcacuucggccgccaggcgagcaagugccucgagugccaggugaugugccaccccaagugcagcacgugccugcccgcgaccugcggccugcccgccgaguacgccacccacuucaccgaggccuucugccgggacaagaugaacagcccggggcuccagaccaaggagcccuccagcucccugcaccuggagggcuggaugaaggucccccgcaacaacaagcgggggcagcagggcugggaccgcaaguacaucgugcucgagggcagcaaggugcugaucuacgacaacgaggcgcgggaggccgggcagcgccccgucgaggaguucgagcugugccucccggacggcgacguguccauccacggggccgugggcgccagcgagcuggcgaacaccgccaaggccgacguccccuacauccugaagauggagucccacccccacaccacgugcuggcccgggcggacccucuaccugcuggccccgagcuuccccgacaagcagcgcugggugaccgcccucgaguccguggucgcgggcggccgggugagccgcgagaaggccgaggccgacgccaagcugcuggggaacucccuccugaagcuggagggcgacgaccggcucgacaugaacugcacccugcccuucagcgaccaggugguccugguggggacggaggagggccucuacgcccugaacgugcugaagaacucccucacccacguccccgggaucggcgcgguguuccagaucuacaucaucaaggaccuggagaagcugcucaugaucgccggcgaggagcgcgcccugugccugguggacgucaagaaggugaagcagagccucgcccagucccaccuccccgcccagcccgacaucagccccaacaucuucgaggcggucaaggggugccaccuguucggcgccgggaagaucgagaacggccugugcaucugcgccgccaugccguccaagguggugauccugcgguacaacgagaaccugagcaaguacugcauccgcaaggagaucgagaccagcgagcccugcuccugcauccacuucaccaacuacagcauccucaucgggacgaacaaguucuacgagaucgacaugaagcaguacacccuggaggaguuccuggacaagaacgaccacucccucgcgcccgccgucuucgccgccagcuccaacagcuuccccguguccaucgugcaggucaacagcgccggccagcgcgaggaguaccugcugugcuuccacgaguucggcguguucguggacuccuacgggcggcgcagccggaccgacgaccucaaguggucccgccugccgcuggcguucgccuaccgggagcccuaccucuucgucacccacuucaacagccuggaggugaucgagauccaggcccgcuccagcgccggcacgcccgcccgggcguaccuggacauccccaacccgcgcuaccucgggcccgccaucuccagcggcgccaucuaccuggccuccagcuaccaggacaagcugcgggugaucugcugcaaggggaaccucgucaaggaguccggcaccgagcaccaccgcggccccagcaccagccgguccagccccaacaagcgcgggccgcccaccuacaacgagcacaucacgaagcggguggccuccagccccgcgcccccggagggccccucccacccccgcgagcccagcaccccgcaccgguaccgcgaggggcggaccgagcugcgccgggacaagucccccggccgcccccuggagcgcgagaagucccccggccggaugcucuccacccgccgggagcgcagcccggggcggcuguucgaggacuccagccgcggccggcugcccgccggggccgugcgcacgccccucucccaggucaacaaggugugggaccagagcuccguguga

SEQ ID NO: 28328 - RNA, 2457 nt, Artificial Sequence
  derived and/or modified sequence opt1 from CIZ1__Homo_sapiens__NP_001124490
auguucagccagcagcagcagcagcagcugcagcagcagcagcagcagcuccagcagcugcagcagcagcagcugcagcagcagcagcuccagcagcagcagcugcugcagcuccagcagcugcugcagcagucccccccgcaggccccccuccccauggccgugagccgcggccugcccccgcagcagccccagcagccccugcucaaccugcaggggaccaacuccgcgagccugcucaacggcuccaugcugcagcgggcccugcuccugcagcagcugcaggggaaccuccgcggcuacgggauggccagccccggccuggccgccccgucccugacccccccccagcucgcgacgcccaaccugcagcaguucuucccgcaggccacccggcagagccugcucggccccccccccgucggggugccgaugaaccccucccaguucaaccugagcggccgcaacccccagaagcaggcccggaccuccagcuccaccacgcccaaccgcaaggacagcuccagccagaccaugccgguggaggacaaguccgacccccccgaggggagcgaggaggccgcggagccccggauggacaccccggaggaccaggaccugccccccugccccgaggacaucgccaaggagaagcgcaccccggcccccgagcccgagccgugcgaggccuccgagcuccccgccaagcggcugcgcagcagcgaggagcccacggagaaggagcccccgggccagcugcaggucaaggcgcagccccaggcccggaugaccgugcccaagcagacccagacccccgaccuccugccggaggcccuggaggcccaggugcucccccgcuuccagccccggguccugcaggugcaggcccaggugcagucccagacgcagccccgcaucccgagcaccgacacccagguccagcccaagcugcagaagcaggcgcagacccagacgucccccgagcaccucgugcugcagcagaagcaggugcagccccagcugcagcaggaggccgagccgcagaagcagguccagccccaggugcacacccaggcccagcccagcgugcagccccaggagcacccgcccgcccaggucuccgugcagccccccgagcagacccacgagcagccgcacacccagccccaggugagccuccuggcccccgagcagacgccggucguggugcacgucugcgggcuggagaugccccccgacgcgguggaggccggcggcgggauggagaagacccuccccgagccggugggcacccaggucuccauggaggagauccagaacgagagcgccugcgggcuggacgugggcgagugcgagaaccgggcccgcgagaugcccggcgucuggggggccggcgggucccugaaggugaccauccuccagagcuccgacagccgggcguucuccacggugccccugacccccgucccgcgccccagcgacuccgugagcuccacccccgccgccaccagcacgcccuccaagcaggcccugcaguucuucugcuacaucugcaaggcgagcugcagcucccagcaggaguuccaggaccacaugagcgagccgcagcaccagcagcggcugggcgagauccagcacaugucccaggccugccuccugagccugcuccccgugccccgcgacguccuggagaccgaggacgaggagcccccgccccggcgcuggugcaacaccugccagcuguacuacaugggggaccucauccagcaccgccggacccaggaccacaagaucgccaagcagucccugcgccccuucugcacggugugcaaccgguacuucaagaccccccgcaaguucguggagcacgucaagagccagggccacaaggacaaggccaaggagcugaagucccucgagaaggagaucgccggccaggacgaggaccacuucaucaccguggacgcgguggggugcuucgagggcgacgaggaggaggaggaggacgacgaggacgaggaggagaucgaggucgaggaggagcugugcaagcaggugcggagccgcgacaucucccgggaggaguggaaggggagcgagaccuacuccccgaacacggccuacggcguggacuuccugguccccgugaugggguacaucugccgcaucugccacaaguucuaccacagcaacuccggcgcccagcucagccacugcaagucccugggccacuucgagaaccugcagaaguacaaggccgccaagaaccccagccccaccacccggccggugucccgccggugcgcgaucaacgcccgcaacgcccucaccgcccuguucaccagcagcgggcggccccccucccagcccaacacgcaggacaagaccccgagcaaggucaccgcccgccccucccagcccccgcugccccggcgcagcacccggcucaagacguga

SEQ ID NO: 28329 - RNA, 2052 nt, Artificial Sequence
  derived and/or modified sequence opt1 from CKAP2__Homo_sapiens__NP_001091995
augagcacccccgccgugccgcaggaccugcagcucccgcccucccagcgcgcccagagcgcguucaaggagcagcggcgccagaagcugaaggagcaccuccuccggcgcaagacccuguucgccuacaagcaggagaacgagaugcuguccagcucccgggaccagcgcgucgugacgagcgaggaccaggugcaggagggcaccaagguccucaagcugaagaccaagauggccgacaaggagaacaugaagcggcccgccgaguccaagaacaacaccgugguggggaagcacugcaucccccugaagcccagcaacgagcucacgaacuccaccgucgugaucgacacccacaagcccaaggacagcaaccagacgccccaccuccugcucaccgaggacgacccgcagucccagcacaugacccugagccaggccuuccaccugaagaacaacuccaagaagaagcagaugaccaccgagaagcagaagcaggacgcgaacaugcccaagaagcccgugcucggcagcuaccgcgggcagaucguccaguccaagaucaacagcuuccggaagccccuccaggugaaggacgaguccagcgccgccacgaagaagcuguccgccaccaucccgaaggcgaccaagccccagcccgugaacaccagcagcgucacggugaaguccaaccgcagcuccaacaugaccgccaccaccaaguucgugagcacgaccucccagaacacccagcugguccggcccccgauccgcagccaccacuccaacacccgggacacggugaagcagggcaucagccgcaccuccgccaacgugaccauccggaaggggccccacgagaaggagcugcugcagagcaagaccgcccucuccagcgucaagacguccagcucccagggcaucauccgcaacaagacccugagccgguccaucgccagcgaggugaucgcgcgccccgccucccugagcaacgacaagcucauggagaaguccgagcccguggaccagcggcgccacaccgccggcaaggccaucgucgacagccggagcgcccagccgaaggagaccuccgaggagcgcaaggcgcgccugagcgaguggaaggccgggaagggccgggugcugaagcgcccgcccaacuccguggucacgcagcacgagcccgccgggcagaacgagaagcccgugggcagcuucuggaccaccauggccgaggaggacgagcagcggcuguucaccgagaaggucaacaacacguucuccgagugccugaaccugaucaacgaggggugccccaaggaggacauccucgugacccugaacgaccugaucaagaacauccccgacgccaagaagcucgugaaguacuggaucugccuggcgcugaucgagcccaucaccagcccgaucgagaacaucaucgccaucuacgagaaggccauccucgccggcgcccagcccaucgaggagaugcgccacaccaucgucgacauccugaccaugaagucccaggagaaggcgaaccugggcgagaacauggagaaguccugcgccagcaaggaggaggugaaggaggugagcaucgaggacacgggggucgacguggaccccgagaagcucgagauggaguccaagcugcaccggaaccugcuguuccaggacugcgagaaggagcaggacaacaagaccaaggacccgacccacgacgugaagacccccaacacggagacccgcaccagcugccugaucaaguacaacgucuccaccacgcccuaccugcagagcgugaagaagaaggugcaguucgacggcaccaacuccgccuucaaggagcucaaguuccugacccccguccggcgcagccggcgccugcaggagaagaccagcaagcucccggacaugcugaaggaccacuaccccugcguguccagccuggagcagcugacggagcucgggcgggagaccgacgccuucgugugccgccccaacgcggcccugugccgggucuacuacgaggccgacaccaccuga

SEQ ID NO: 28330 - RNA, 2238 nt, Artificial Sequence
  derived and/or modified sequence opt1 from CKAP2L__Homo_sapiens__NP_689728
auggugggccccgggccgaccgccgccgcggccgucgaggagcgccagcggaagcugcaggaguaccucgccgccaagggcaagcucaagagccagaacaccaagcccuaccugaaguccaagaacaacugccagaaccagccgcccagcaaguccacgauccgccccaagaacgacgugaccaaccacgugguccugcccgugaagcccaagcggagcaucuccaucaagcugcagccccgcccgcccaacaccgccgggagccagaagcccaagcuggagcccccgaagcuccugggcaagcggcugaccuccgagugcgugagcuccaaccccuacagcaagcccuccagcaaguccuuccagcagugcgaggcggggagcuccacgaccggcgagcucagccgcaagcccgucggcucccugaacaucgagcagcugaagaccaccaagcagcagcucacggaccaggggaacggcaagugcaucgacuucaugaacaacauccacguggagaacgagagccuggacaacuuccugaaggagaccaacaaggagaaccuccuggacauccugaccgagccggagcggaagcccgaccccaagcucuacacccgcuccaagcccaagacggacagcuacaaccagaccaagaacagccuggugccgaagcaggcccuggggaaguccagcgucaacuccgccgugcucaaggaccgggugaacaagcaguucgucggcgagacccagagccgcaccuuccccgugaagucccagcagcugagccgcggggccgaccuggcgcggcccggcgugaagcccucccggacggucccgagccacuucauccgcacccucuccaaggugcagagcuccaagaagcccguggucaagaacaucaaggacaucaaggugaaccggagccaguacgagcgccccaacgagaccaagauccgguccuaccccgugaccgagcagcgcgucaagcacacgaagccgcggaccuaccccagccugcugcagggcgaguacaacaaccgccaccccaacaucaagcaggaccagaaguccagccaggugugcaucccgcagaccuccugcgugcuccagaaguccaaggccaucagccagcggcccaaccugaccgucgggcgcuucaacagcgccauccccagcacgcccuccauccgcccgaacggcaccagcgggaacaagcacaacaacaacggcuuccagcagaaggcccagacccuggacuccaagcucaagaaggccgugccccagaaccacuuccugaacaagaccgcgcccaagacgcaggccgacgucaccaccgugaacggcacccagacgaaccccaacaucaagaagaaggccaccgccgaggaccggcgcaagcagcuggaggaguggcagaaguccaaggggaagaccuacaagcggccgcccauggagcucaagaccaagcgcaaggugaucaaggagaugaacaucagcuucuggaaguccaucgagaaggaggaggaggagaagaaggcccagcuggagcugagcagcaagaucaacaacacgcucaccgagugccugaaccugaucgagggcgggguccccuccaacgagauccucaacauccugagcuccauccccgaggcggagaaguucgccaaguucuggaucugcaaggccaagcugcucgccagcaagggcaccuucgacgugaucgggcuguacgaggaggccaucaagaacggcgcgaccccgauccaggagcugcggaaggugguccucaacauccugcaggacuccaaccgcaccacggagggcaucaccagcgacucccugguggccgagaccagcaucaccuccguggaggagcucgccaagaagauggagagcgucaagagcugccugucccccaaggagcgggagcaggucacggccacgccccgcaucgccaaggcggagcagcacaacuaccccgggaucaagcugcagaucggcccgaucccccggaucaacgggaugcccgaggugcaggacaugaaguucaucacccccgugcgccggagcucccgcaucgagcgggccgugagccgcuacccggagaugcugcaggagcacgaccucguggucgccucccuggacgagcugcucgagguggaggagaccaagugcuucaucuuccggcgcaacgaggcccugcccgugacccugggcuuccagacccccgagagcuga

SEQ ID NO: 28331 - RNA, 1809 nt, Artificial Sequence
  derived and/or modified sequence opt1 from CKAP4__Homo_sapiens__NP_006816
augcccagcgccaagcagcgcggcuccaagggcgggcacggggccgcgagccccuccgagaagggcgcccaccccagcgggggcgccgacgacguggccaagaagcccccgcccgccccgcagcagcccccgcccccgcccgcgccccacccccagcagcacccccagcagcacccccagaaccaggcccacggcaagggcgggcaccgcgggggcgggggcggcgggggcaaguccagcuccagcuccagcgccuccgccgcggccgccgccgccgcggccagcuccagcgccuccugcagccggcggcuggggcgcgcccucaacuuccuguucuaccuggcccucgucgcggccgccgccuucuccggcuggugcgugcaccacgugcuggaggagguccagcagguccggcgcagccaccaggacuucucccggcagcgcgaggagcugggccaggggcuccagggcguggagcagaagguccagagccugcaggccaccuucgggaccuucgagagcauccugcgguccagccagcacaagcaggaccucacggagaaggcggugaagcagggcgaguccgaggugagccgcaucuccgaggugcugcagaagcugcagaacgagauccucaaggaccugagcgacgggauccacguggugaaggacgcccgggagcgcgacuucaccucccuggagaacaccgucgaggagcggcucaccgagcugaccaagagcaucaacgacaacaucgccaucuucacggaggugcagaagcgcucccagaaggagaucaacgacaugaaggccaagguggccagccuggaggaguccgagggcaacaagcaggaccucaaggcgcugaaggaggccgucaaggagauccagaccagcgccaagucccgggagugggacauggaggcccugcgcagcacccuccagacgauggaguccgacaucuacaccgaggugcgggagcuggugagccugaagcaggagcagcaggcguucaaggaggccgccgacaccgagcgccucgcccugcaggcccugaccgagaagcuccugcgguccgaggagagcgucucccgccugcccgaggagauccggcgccucgaggaggagcugcgccagcucaagagcgacagccacggccccaaggaggacgggggcuuccggcacuccgaggcguucgaggcccugcagcagaagucccaggggcuggacagccgccugcagcacguggaggacggcgugcucagcaugcaggucgccuccgcccggcagacggagagccuggagucccugcucagcaagucccaggagcacgagcagcgccuggccgcgcugcaggggcggcucgagggccugggcagcuccgaggccgaccaggacgggcuggccagcaccgugcgcucccucggcgagacccagcuggugcuguacggggacgucgaggagcucaagcggagcgugggcgagcugcccuccaccgucgagagccugcagaaggugcaggagcagguccacacgcugcucucccaggaccaggcccaggccgcgcgccugccgccccaggacuuccuggaccggcucagcagccuggacaaccugaaggccuccgugagccagguggaggccgaccucaagaugcugcgcaccgccguggacucccuggucgcguacagcgugaagaucgagaccaacgagaacaaccucgaguccgccaaggggcugcuggacgaccuccggaacgaccuggaccgccuguucgugaaggucgagaagauccacgagaagguguga

SEQ ID NO: 28332 - RNA, 6099 nt, Artificial Sequence
  derived and/or modified sequence opt1 from CKAP5__Homo_sapiens__NP_001008938
augggcgacgacagcgaguggcugaagcuccccguggaccagaagugcgagcacaagcuguggaaggcccgccugagcggcuacgaggaggcccucaagaucuuccagaagaucaaggacgagaagucccccgaguggagcaaguuccugggccugaucaagaaguucgucaccgacagcaacgccguggugcagcucaaggggcuggaggccgcccuggucuacguggagaacgcccacguggccggcaagaccacgggggaggucgugagcggcguggucagcaagguguucaaccagcccaaggcgaaggccaaggagcucggcaucgagaucugccugauguacaucgagaucgagaagggggaggccgugcaggaggagcugcucaagggccuggacaacaagaaccccaagaucaucgucgccugcaucgagacccugcgcaaggcgcucagcgaguucgggagcaagaucauccugcugaagcccaucaucaaggugcucccgaagcuguucgagucccgcgagaaggccgugcgggacgaggccaagcugaucgccgucgagaucuaccgcuggauccgggacgcccuccggccgccccugcagaacaucaacagcgugcagcugaaggagcucgaggaggagugggugaagcugcccaccuccgcgccgcggcccacccgcuuccugcggagccagcaggagcucgaggccaagcuggagcagcagcaguccgccggcggggacgccgagggcggcggggacgacggcgacgaggucccccagaucgacgccuacgagcugcucgaggcgguggagauccugagcaagcugcccaaggacuucuacgacaagaucgaggccaagaaguggcaggagcgcaaggaggcccucgaguccguggagguccugaucaagaacccgaagcuggaggccggggacuacgccgaccucgugaaggcgcugaagaagguggucggcaaggacacgaacgugaugcuggucgcccucgccgccaagugccugaccggccuggccguggggcuccggaagaaguucggccaguacgcggggcacgugguccccaccauccuggagaaguucaaggagaagaagccccagguggugcaggcccugcaggaggccaucgacgccaucuuccucaccacgacccugcagaacaucagcgaggacguccuggcggugauggacaacaagaaccccaccaucaagcagcagaccucccucuucaucgcccgcagcuuccggcacugcacggccuccacccugcccaagagccugcugaagcccuucugcgccgcccuccugaagcacaucaacgacagcgcgcccgaggugcgcgacgccgccuucgaggcccugggcaccgcccucaaggucgugggggagaaggcggugaaccccuuccuggccgacgucgacaagcugaagcucgacaagaucaaggagugcuccgagaagguggagcugauccacggcaagaaggccggccuggccgccgacaagaaggaguucaagccgcuccccgggcggaccgcggccagcggcgccgccggggacaaggacacgaaggacaucuccgcgcccaagcccggcccgcugaagaaggcccccgccgccaaggccggcgggccgcccaagaaggggaagccggcggcccccgggggcgccgggaacaccggcaccaagaacaagaaggggcuggagaccaaggagaucguggagcccgagcucagcaucgaggucugcgaggagaaggccuccgccgugcugccgcccacgugcauccagcugcucgacagcuccaacuggaaggagcgccuggcgugcauggaggaguuccagaaggccguggagcugauggaccggaccgagaugcccugccaggcccucguccgcaugcuggccaagaagcccggcuggaaggagaccaacuuccaggugaugcagaugaagcugcacaucguggcccucaucgcgcagaagggcaacuucagcaagaccuccgcccaggucgugcuggacgggcugguggacaagaucggcgacgucaagugcgggaacaacgccaaggaggccaugacggcgaucgccgaggccugcaugcucccguggaccgccgagcaggucgugagcauggccuucucccagaagaaccccaagaaccagagcgagacccugaacuggcuguccaacgcgaucaaggaguucggcuucagcggccucaacgucaaggccuucaucuccaacgugaagaccgcccuggccgccacgaaccccgcggugcggaccgccgccaucacccugcucggggucauguaccuguacgugggccccagccugcgcauguucuucgaggacgagaagccggcccuccugucccagaucgacgccgaguucgagaagaugcaggggcaguccccgcccgcgcccacccggggcaucuccaagcacagcacgagcgggaccgacgagggcgaggacggcgacgagccggacgacggguccaacgacguggucgaccugcucccccgcaccgagaucagcgacaagaucaccuccgagcuggugagcaagaucggcgacaagaacuggaagauccgcaaggaggggcuggacgagguggccggcaucaucaacgacgccaaguucauccagcccaacaucggggagcuccccacggcccugaagggccggcugaacgacuccaacaagauccucguccagcagacccugaacauccugcagcagcucgccguggcgaugggcccgaacaucaagcagcacgugaagaaccuggggauccccaucaucaccguccugggcgacagcaagaacaacgugcgcgccgccgcccucgcgaccgugaacgccugggccgagcagaccgggaugaaggaguggcuggagggcgaggaccuguccgaggagcucaagaaggagaaccccuuccugcggcaggagcugcucggguggcuggccgagaagcugcccacgcuccgcagcaccccgaccgaccugauccugugcgucccccaccucuacuccugccuggaggaccggaacggcgacgugcgcaagaaggcccaggacgcgcugcccuucuucaugaugcaccucggcuacgagaagauggccaaggccaccgggaagcugaagcccacgagcaaggaccaggugcuggccaugcucgagaaggccaaggucaacaugccggcgaagcccgcgccgcccaccaaggccaccuccaagcccaugggcgggagcgcccccgccaaguuccagcccgcguccgcccccgccgaggacugcaucagcuccagcaccgagcccaagcccgaccccaagaaggccaaggcgccgggccuguccagcaaggccaagagcgcccaggggaagaagaugcccuccaagacgagccugaaggaggacgaggacaaguccggccccaucuucaucguggugcccaacggcaaggagcagcggaugaaggacgagaaggggcucaagguccugaaguggaacuucaccaccccgcgcgacgaguacaucgagcagcugaagacccagaugagcuccugcguggccaaguggcuccaggacgagauguuccacagcgacuuccagcaccacaacaaggcccuggcggugauggucgaccaccuggaguccgagaaggagggcgugaucgggugccucgaccugauccugaaguggcucacgcugcgguucuucgacaccaacaccagcguccugaugaaggcccucgaguaccugaagcuccuguucacccugcuguccgaggaggaguaccaccucacggagaacgaggccagcuccuucauccccuaccugguggugaaggucggcgagcccaaggacgugauccgcaaggacgugcgggccauccugaaccgcaugugccucgucuaccccgccagcaagauguucccguucaucauggagggcaccaaguccaagaacagcaagcagcgggcggagugccuggaggagcuggggugccucguggaguccuacggcaugaacgugugccagcccacccccgggaaggcccugaaggagaucgccguccacaucggcgaccgcgacaacgccgugcggaacgccgcgcugaacaccaucgugacggucuacaacgugcacggggaccagguguucaagcugaucggcaaccucagcgagaaggacauguccaugcuggaggagcgcaucaagcggagcgccaagcgccccuccgccgccccgaucaagcaggucgaggagaagccccagcgggcgcagaacaucagcagcaacgccaacaugcugcgcaagggccccgccgaggacauguccagcaagcucaaccaggcccgcuccaugagcgggcaccccgaggccgcgcagauggugcggcgcgaguuccagcuggaccuggacgagaucgagaacgacaacggcaccgugcggugcgagaugccggagcucguccagcacaagcuggacgacaucuucgagcccgugcugauccccgagcccaagauccgcgccguguccccgcacuucgacgacaugcacagcaacaccgccuccaccaucaacuucaucaucagccaggucgccuccggggacaucaacacgagcauccaggcccucacccagaucgacgaggugcugcggcaggaggacaaggcggaggccauguccggccacaucgaccaguuccugaucgccaccuucaugcagcuccgccugaucuacaacacccacauggccgacgagaagcuggagaaggacgagaucaucaagcucuacagcugcaucaucgggaacaugaucucccuguuccagaucgagagccuggcccgggaggcguccacgggcgugcucaaggaccugaugcacggccugaucacccucaugcuggacagccgcaucgaggaccuggaggaggggcagcaggucauccgguccgugaaccuccugguggucaaggugcuggagaaguccgaccagaccaacauccucuccgcccugcuggugcuccugcaggacagccugcucgccaccgccagcucccccaaguucagcgagcuggucaugaagugccuguggcgcauggugcggcuccugcccgacacgaucaacuccaucaaccuggaccgcauccuccuggacauccacaucuucaugaagguguucccgaaggagaagcugaagcagugcaagagcgaguuccccauccggacccucaagacccugcugcacacccucugcaagcugaagggccccaagauccuggaccaccucacgaugaucgacaacaagaacgaguccgagcuggaggcccaccugugccgcaugaugaagcacagcauggaccagaccggguccaagagcgacaaggagaccgagaagggcgcgucccggaucgacgagaaguccuccaaggccaaggucaacgacuuccucgccgagaucuucaagaagaucgggagcaaggagaacaccaaggagggccuggccgagcuguacgaguacaagaagaaguacuccgacgcggacaucgagcccuuccucaagaacagcucccaguucuuccagagcuacguggagcgcggccugcgggugaucgagauggagcgcgaggggaagggccggaucuccaccagcacggggaucuccccgcagauggaggugaccugcgugcccacccccaccagcacggugagcuccaucggcaacaccaacggcgaggaggucgggcccagcguguaccuggagcgccucaagauccugcggcagcgcugcggccuggacaacaccaagcaggacgaccgcccgccccucaccucccugcugagcaagcccgccgugcccacggucgccuccagcaccgacaugcuccacuccaagcugagccagcugcgggagucccgcgagcagcaccagcacagcgaccucgacuccaaccagacccacagcuccgggaccgugacgagcuccagcuccaccgccaacaucgacgaccugaagaagcggcuggagcgcaucaagagcucccggaaguga

SEQ ID NO: 28333 - RNA, 1146 nt, Artificial Sequence
  derived and/or modified sequence opt1 from CKB__Homo_sapiens__NP_001814
augcccuucagcaacucccacaacgcccugaagcuccgcuucccggccgaggacgaguuccccgaccugagcgcgcacaacaaccacauggccaaggugcugacccccgagcucuacgccgagcugcgggccaaguccacccccagcggcuucacgcuggacgacgucauccagaccgggguggacaacccgggccaccccuacaucaugaccguggggugcgucgccggcgacgaggaguccuacgagguguucaaggaccucuucgaccccaucaucgaggaccgccacgggggcuacaagcccagcgacgagcacaagaccgaccugaacccggacaaccugcagggcggggacgaccucgaccccaacuacgugcuguccagccggguccgcacgggccgguccauccgcggguucugccugccgccccacugcagccggggcgagcgccgggcgaucgagaagcucgccguggaggcccuguccagccuggacggggaccucgccggccgcuacuacgcgcugaaguccaugaccgaggccgagcagcagcagcugaucgacgaccacuuccucuucgacaagcccgugagcccccugcugcucgccuccggcauggcccgggacuggcccgacgcccgcgggaucuggcacaacgacaacaagaccuuccuggucugggugaacgaggaggaccaccuccgggugaucagcaugcagaagggcgggaacaugaaggaggucuucacccgcuucugcacgggccucacccagaucgagacccuguucaaguccaaggacuacgaguucauguggaacccccaccugggcuacauccugaccugcccgagcaaccuggggacgggccugcgggcgggggugcacaucaagcuccccaaccugggcaagcacgagaaguucuccgaggugcugaagcgccuccggcugcagaagcgcgggaccggcggcgucgacaccgccgccgucgggggcguguucgacgugagcaacgccgaccggcugggguucagcgagguggagcucgugcagauggucguggacggcgugaagcugcugaucgagauggagcagcgccucgagcaggggcaggccaucgacgaccugaugcccgcgcagaaguga

SEQ ID NO: 28334 - RNA, 342 nt, Artificial Sequence
  derived and/or modified sequence opt1 from CKLF__Homo_sapiens__NP_001035228
auggacaacgugcagcccaagaucaagcaccgcccguucugcuucagcgucaagggccacgugaagaugcugcggcucgcccugaccgugaccuccaugacguucuucaucaucgcccaggcgcccgagcccuacaucgucaucaccggguucgaggugaccgugauccuguucuucauccuccuguacguccugcgccucgaccggcugaugaaguggcuguucuggccccuccuggacaucaucaacagccuggugaccacgguguucaugcucaucgucuccgugcuggcccugaucccggagaccaccacccucacggugggcgggggccuguucuga

SEQ ID NO: 28335 - RNA, 1146 nt, Artificial Sequence
  derived and/or modified sequence opt1 from CKM__Homo_sapiens__NP_001815
augcccuucggcaacacccacaacaaguucaagcugaacuacaagccggaggaggaguaccccgaccucagcaagcacaacaaccacauggccaaggugcugacccuggagcucuacaagaagcugcgcgacaaggagacgcccuccggguucaccgucgacgacgugauccagaccggcguggacaaccccgggcacccguucaucaugaccgucggcugcguggccggggacgaggagagcuacgagguguucaaggagcuguucgaccccaucaucuccgaccggcacggcggcuacaagcccacggacaagcacaagaccgaccucaaccacgagaaccugaagggcggggacgaccuggaccccaacuacguccucagcucccgcgugcggaccgggcgcagcaucaagggcuacacccugccgccccacugcucccgcggggagcggcgggcgguggagaagcugagcgucgaggcccucaacucccugacgggcgaguucaagggcaaguacuacccccucaagagcaugaccgagaaggagcagcagcagcucaucgacgaccacuuccuguucgacaagcccguguccccgcugcuccuggccagcgggauggcccgcgacuggcccgacgcccggggcaucuggcacaacgacaacaaguccuuccuggugugggucaacgaggaggaccaccuccgcgugaucagcauggagaagggcgggaacaugaaggagguguuccggcgcuucugcgucggccugcagaagaucgaggagaucuucaagaaggcggggcaccccuucauguggaaccagcaccugggcuacgugcugaccugccccuccaaccuggggaccggccugcgcgggggcgugcacgucaagcucgcccaccugagcaagcacccgaaguucgaggagauccugacgcggcuccggcugcagaagcgcggcaccgggggcguggacaccgccgccgugggguccgucuucgacgugagcaacgcggaccggcugggcuccagcgagguggagcagguccagcucguggucgacggggugaagcugaugguggagauggagaagaagcuggagaagggccagagcaucgacgacaugauccccgcccagaaguga

SEQ ID NO: 28336 - RNA, 777 nt, Artificial Sequence
  derived and/or modified sequence opt1 from CKMT1A__Homo_sapiens__XP_005254555
augcccgugaagguccgcaccggccggagcauccgcgggcugucccucccgcccgccugcacccgggccgagcgccgggagguggagcgcguggucguggacgcgcugagcggccugaagggggaccucgccggccgguacuaccgccuguccgagaugacggaggccgagcagcagcagcugaucgacgaccacuuccucuucgacaagcccgugagcccccugcugaccgccgccgggauggcgcgggacuggccggacgcccgcggcaucuggcacaacaacgagaaguccuuccucaucugggucaacgaggaggaccacacccgggugaucagcauggagaagggcgggaacaugaagcgcguguucgagcgguucugccgcggccugaaggaggucgagcggcugauccaggagcgcgggugggaguucauguggaacgagcggcucggcuacauccugaccugccccuccaaccuggggacgggccuccgcgccggcgugcacaucaagcugccccugcucagcaaggacucccgguuccccaagauccuggagaaccugcgccuccagaagcgggggaccggcgggguggacaccgccgcgaccggcggcgucuucgacaucagcaaccuggaccgccuggggaaguccgagguggagcucgugcagcuggucaucgacggcgugaacuaccugaucgacugcgagcgccggcucgagcgcgggcaggacauccggaucccgacgcccgugauccacaccaagcacuga

SEQ ID NO: 28337 - RNA, 1347 nt, Artificial Sequence
  derived and/or modified sequence opt1 from CKMT1B__Homo_sapiens__XP_011519498
auggccggccccuucagccgccugcucuccgcccggccggggcugcgccugcucgcgcuggccggcgccgggagccuggccgccggcuuccuccugcggcccgagcccgugcgcgcggccuccgagcggcgccggcuguacccgcccagccagaccuggcccaccgggcagcuccccggcaacugcacgcgcucccggcgccugugcccgcccagcauggucaccggcuacccccugcccuccgccgaguaccccgaccuccggaagcacaacaacugcauggccagccaccugaccccggcgguguacgcccgccugugcgacaagaccacgcccaccggguggacccucgaccagugcauccagaccggcguggacaaccccgggcaccccuucaucaagacggucggcaugguggccggggacgaggagaccuacgagguguucgccgaccuguucgacccggucauccaggagcggcacaacggcuacgacccccgcaccaugaagcacaccacggaccuggacgccuccaagauccggagcggcuacuucgacgagcgcuacgugcucuccagccgggugcgcaccgggcgguccauccgcggccugagccugccgcccgcgugcacccgggccgagcgccgcgaggucgagcgggugguggucgacgcccucuccgggcugaagggcgaccuggccggccgcuacuaccggcucagcgagaugaccgaggccgagcagcagcagcugaucgacgaccacuuccuguucgacaagcccgugagcccccuccugacggcggccgggauggcccgcgacuggcccgacgcccggggcaucuggcacaacaacgagaaguccuuccugaucugggugaacgaggaggaccacacccgcgucaucuccauggagaagggcgggaacaugaagcggguguucgagcgcuucugccgggggcucaaggagguggagcgccugauccaggagcggggcugggaguucauguggaacgagcgccugggcuacauccucacgugccccagcaaccuggggaccggccugcgggccgggguccacaucaagcucccgcugcugagcaaggacucccgcuuccccaagauccucgagaaccugcggcugcagaagcgcggcaccgggggcguggacaccgcggccaccggcgggguguucgacaucagcaaccucgaccggcugggcaaguccgaggucgagcuggugcagcucgugaucgacggggucaacuaccugaucgacugcgagcgccggcuggagcgcggccaggacauccgcauccccacccccgugauccacacgaagcacuga

SEQ ID NO: 28338 - RNA, 1260 nt, Artificial Sequence
  derived and/or modified sequence opt1 from CKMT2__Homo_sapiens__NP_001093206
auggccagcaucuucuccaagcugcucaccggccgcaacgccagccugcuguucgcgaccauggggacguccgugcucaccaccggcuaccugcugaaccggcagaaggucugcgccgaggugcgcgagcagccccgccucuucccgcccagcgccgacuaccccgaccugcggaagcacaacaacugcauggccgagugccugacccccgccaucuacgcgaagcuccggaacaaggugacgccgaacggguacacccuggaccagugcauccagaccggcgucgacaaccccgggcaccccuucaucaagaccgugggcaugguggccggcgacgaggaguccuacgaggucuucgccgaccuguucgaccccgugaucaagcuccgccacaacggguacgacccgcgggugaugaagcacacgaccgaccuggacgccagcaagaucacccagggccaguucgacgagcacuacguccuguccagccgcgugcggaccgggcgcuccauccggggccucagccugccgcccgcgugcacgcgcgccgagcggcgcgagguggagaacgucgccaucaccgcccuggaggggcucaagggcgaccuggccggccgguacuacaagcuguccgagaugaccgagcaggaccagcagcgccucaucgacgaccacuuccuguucgacaagcccgugagcccccugcugaccugcgcggggauggcccgggacuggcccgacgcccgcggcaucuggcacaacuacgacaagacguuccucaucuggaucaacgaggaggaccacacccgggugaucuccauggagaagggcgggaacaugaagcgcgucuucgagcgguucugccgcggccugaaggagguggagcgccucauccaggagcgggggugggaguucauguggaacgagcgccugggcuacauccugaccugccccagcaaccucgggaccggccugcgggccggggugcacguccgcauccccaagcuguccaaggacccgcgguucagcaagauccucgagaaccugcgccugcagaagcggggcacgggcgggguggacaccgccgcgguggccgacgucuacgacaucuccaacaucgaccgcaucggccggagcgagguggagcucgugcagaucgucaucgacggggugaacuaccuggucgacugcgagaagaagcuggagcgcggccaggacaucaaggugcccccgccccucccccaguucgggaagaaguga

SEQ ID NO: 28339 - RNA, 240 nt, Artificial Sequence
  derived and/or modified sequence opt1 from CKS1B__Homo_sapiens__NP_001817
augagccacaagcagaucuacuacuccgacaaguacgacgacgaggaguucgaguaccgccacgugaugcugcccaaggacaucgccaagcucgucccgaagacccaccugaugagcgaguccgaguggcggaaccugggcgugcagcagagccaggggugggugcacuacaugauccacgagcccgagccccacauccuccuguuccgccggccccugccgaagaagcccaagaaguga

SEQ ID NO: 28340 - RNA, 240 nt, Artificial Sequence
  derived and/or modified sequence opt1 from CKS2__Homo_sapiens__NP_001818
auggcccacaagcagaucuacuacagcgacaaguacuucgacgagcacuacgaguaccgccacgugaugcugccccgggagcucuccaagcaggucccgaagacccaccugaugagcgaggaggaguggcgccggcugggcgugcagcagucccucgggugggugcacuacaugauccacgagcccgagccccacauccugcuguuccgccggccccucccgaaggaccagcagaaguga

SEQ ID NO: 28341 - RNA, 4440 nt, Artificial Sequence
  derived and/or modified sequence opt1 from CLASP1__Homo_sapiens__NP_001135745
auggagccccgcauggagagcugccuggcccaggugcuccagaaggacgucggcaagcggcuccagguggggcaggagcugaucgacuacuucuccgacaagcagaaguccgccgaccucgagcacgaccagaccaugcuggacaagcugguggacggccucgcgaccagcugggucaacagcuccaacuacaagguggugcugcuggggauggacauccucagcgcccuggucacgcgccugcaggaccgguucaaggcccagaucggcaccgugcucccgucccugaucgaccgccugggggacgccaaggacagcgugcgggagcaggaccagacccuccugcugaagaucauggaccaggccgcgaacccccaguacgucugggaccgcaugcucggcggcuucaagcacaagaacuuccggacccgcgaggggaucugccugugccugaucgccacgcucaacgccuccggcgcccagacccugacccugagcaagaucgugccccacaucugcaaccuccugggggaccccaacucccaggugcgggacgcggccaucaacagccuggucgagaucuaccgccacgugggcgagcgggugcgcgccgaccucuccaagaaggggcugccgcagagccggcugaacgucaucuucaccaaguucgacgaggugcagaaguccggcaacaugauccagagcgccaacgacaagaacuucgacgacgaggacuccguggacggcaaccgccccagcuccgccagcagcacguccagcaaggcgccgcccuccagccggcgcaacgucgggaugggcaccacccggcgccucggguccagcacccugggcuccaagagcuccgccgccaaggagggcgccggggccguggacgaggaggacuucaucaaggcguucgacgacgugcccgucgugcagaucuacagcucccgggaccuggaggagagcaucaacaagauccgcgagauccucuccgacgacaagcacgacugggagcagcgggugaacgcccugaagaagauccgcagccugcuccuggccggcgccgccgaguacgacaacuucuuccagcaccuccgccugcuggacggggcguucaagcuguccgccaaggaccuccggagccaggucgugcgcgaggccugcaucacgcugggccaccuguccagcguccucgggaacaaguucgaccacggcgccgaggccaucaugcccaccaucuucaaccugauccccaacuccgcgaagaucauggccaccagcggcgugguggccguccggcugaucauccgccacacccacaucccccggcucaucccggugaucacgagcaacugcaccuccaagagcguggccguccgccggcgcugcuucgaguuccuggaccugcugcuccaggaguggcagacccacucccuggagcggcacaucagcgugcuggcggagaccaucaagaaggggauccacgacgccgacuccgaggcccgcaucgaggcccggaagugcuacuggggcuuccacagccacuucucccgcgaggccgagcaccucuaccacacgcuggagagcuccuaccagaaggcgcugcagagccaccucaagaacuccgacagcaucgugucccugccccagagcgaccgguccagcuccagcagccaggagucccugaaccgcccccucagcgccaagcggucccccaccgggagcaccaccucccgcgccagcacggucuccaccaagagcguguccaccaccggcagccugcagcggucccgcagcgacaucgacgugaacgccgccgcguccgccaagagcaaggucuccagcuccagcgggacgaccccguucuccagcgccgccgcccugccgcccggcagcuacgcgucccucgacggcaccaccacgaaggccgaggggcggauccgcacccgccggcagagcuccggcagcgccaccaacguggccuccacccccgacaaccgcgggcggagccgcgcgaagguggucucccagagccagcggucccgcagcgccaaccccgccggcgccgggucccggagcuccagccccggcaagcugcugggcuccggguacggcgggcucacgggcggcagcucccgcgggccgcccgugacccccagcuccgagaagcggagcaagaucccccgcagccagggcugcucccgggagaccagccccaaccgcaucgggcuggaccgguucggccuggggcagcccggccgcaucccgggcuccgugaacgccaugcggguccucagcaccuccaccgaccuggaggcggccguggccgacgcccugcuccugggggacagccgcuccaagaagaagcccgugcggcgccgguacgagcccuacggcauguacagcgacgacgacgccaacuccgacgcgagcuccgucugcagcgagcgcuccuacgggagccggaacggcgggaucccgcacuaccugcgccagacggaggacguggccgaggugcucaaccacugcgccuccagcaacugguccgagcgcaaggagggccugcugggccuccagaaccugcucaagagccagcggacccugucccgcgucgagcugaagcggcugugcgagaucuucacccgcauguucgccgacccccacagcaagcggguguucagcauguuccucgagacccugguggacuucaucaucauccacaaggacgaccugcaggacuggcuguucguccugcugacgcagcuccugaagaagaugggggccgaccugcucggcuccgugcaggcgaaggugcagaaggcccuggacgucacccgcgacagcuuccccuucgaccagcaguucaacauccugaugcgguucaucguggaccagacccagacccccaaccucaaggugaaggucgccauccugaaguacaucgagucccuggcccgccagauggacccgacggacuucgugaacagcuccgagacccggcucgcggugagccgcaucaucaccuggaccacggagcccaaguccagcgacguccggaaggccgcccagaucgugcugaucucccuguucgagcucaacacccccgaguucaccaugcugcugggggcccuccccaagaccuuccaggacggcgccacgaagcugcugcacaaccaccucaagaacagcuccaacaccagcgugggguccccgagcaacaccaucggccgcacccccucccggcacacgagcucccgcaccagcccccugaccucccccaccaacugcagccacggcgggcugagcccguccaugcucgacuacgacacggagaaccugaacagcgaggagaucuacuccagccugcggggcgucaccgaggcgaucgagaaguucuccuuccgcagccaggaggaccucaacgagcccaucaagcgggacgggaagaaggagugcgacaucgugucccgcgacggcggggccgccagccccgccaccgagggccggggcggguccgagguggagggcgggcgcaccgcccuggacaacaagacgagccugcucaacacccagcccccgcgcgcguuccccggcccccgggcccgcgacuacaaccccuacccguacuccgacgccaucaacaccuacgacaagaccgcccugaaggaggccgucuucgacgacgacauggagcagcugcgggacgugcccaucgaccacagcgaccucguggcggaccugcugaaggagcucuccaaccacaacgagcgcgucgaggagcggaagggcgcccugcuggagcuccugaagaucacgcgcgaggacagccugggggugugggaggagcacuucaagaccauccuccugcugcuccuggagacccugggcgacaaggaccacuccauccgggcccucgcccugcgcgugcugcgggagauccuccgcaaccagcccgcccgguucaagaacuacgcggagcugaccaucaugaagacgcuggaggcccacaaggacagccacaaggaggucgugcgcgccgccgaggaggcggccuccacccucgccagcuccauccaccccgagcagugcaucaaggugcugugcccgaucauccagaccgccgacuaccccaucaaccuggccgcgaucaagaugcagaccaaggucguggagcggaucgccaaggagagccuccugcagcugcuggucgacaucauccccgggcuccugcagggcuacgacaacaccgagagcuccgugcgcaaggccagcguguucugccuggucgccaucuacuccgugaucggggaggaccucaagccgcaccuggcccagcugacgggcagcaagaugaagcuccugaaccuguacaucaagcgggcgcagaccaccaacuccaacagcuccagcuccagcgacguguccacccacagcuga

SEQ ID NO: 28342 - RNA, 3885 nt, Artificial Sequence
  derived and/or modified sequence opt1 from CLASP2__Homo_sapiens__NP_001193973
auggccaugggcgacgacaagagcuucgacgacgaggaguccguggacgggaaccgccccagcuccgccgcgagcgccuucaaggucccggcccccaagaccuccggcaaccccgccaacagcgcccggaagcccggguccgcgggcgggccgaaggugggcggcgccagcaaggagggcggggccggggccguggacgaggacgacuucaucaaggcguucaccgacguccccuccauccagaucuacagcucccgcgagcuggaggagacgcucaacaagauccgggagauccugagcgacgacaagcacgacugggaccagcgcgccaacgcccugaagaagauccggucccuccugguggccggcgccgcgcaguacgacugcuucuuccagcaccuccgccugcuggacggggcccugaagcucagcgccaaggaccugcggucccaggugguccgcgaggccugcaucaccguggcccaccugagcaccgugcucggcaacaaguucgaccacggcgcggaggccaucguccccacccuguucaaccuggugcccaacuccgccaaggugauggccacgagcgggugcgccgcgauccgguucaucauccgccacacccacgucccgcggcucaucccccugaucaccuccaacugcaccagcaagagcgugcccgugcgccggcgcuccuucgaguuccuggaccuccugcugcaggaguggcagacgcacagccucgagcggcacgccgccguccugguggagaccaucaagaagggcauccacgacgccgacgccgaggcgcgcguggaggcccggaagaccuacauggggcugcgcaaccacuuccccggcgaggccgagacccucuacaacucccuggagccgagcuaccagaagucccugcagacguaccucaagagcuccggcagcgucgccucccugccccagagcgaccgguccagcuccagcucccaggagagccugaaccgccccuucuccagcaagugguccaccgcgaaccccagcaccguggccgggcgggugagcgccggcuccagcaaggccuccagccucccggggucccugcagcgcagccgcuccgacaucgacgucaacgccgcggccggcgccaaggcccaccacgccgcggggcagagcgugcgguccggccgccugggcgccggggcccucaacgccggcagcuacgccucccuggaggacaccagcgacaagcuggacgggacggcguccgaggacggccgggugcgcgccaagcucagcgcgccccuggccgggaugggcaacgccaaggccgacucccggggccgcagccggaccaagauggucucccagagccagcccgggagccgcuccggcagccccgggcgggugcugaccaccacggcccucuccaccgucagcuccggcgugcagcgcgugcuggucaacagcgccuccgcccagaagcggagcaagaucccgcgcucccaggggugcagccgggaggcgucccccagccgccuguccguggcccggagcucccgcaucccccggcccagcgugucccagggcugcagccgcgaggccucccgggagagcagccgcgacaccuccccgguccgcagcuuccagccccucgccucccggcaccacagccgcuccaccggcgcccuguacgcgcccgagguguacggggccagcggccccggguacggcaucucccagagcucccggcugagcuccagcguguccgccaugcgcguccucaacacgggcagcgacguggaggaggccguggccgacgcgcugaagaagccggcccggcgccgguacgaguccuacgggaugcacagcgacgacgacgccaacuccgacgccagcuccgcgugcagcgagcgcagcuacuccagccggaacggcuccauccccaccuacaugcgccagaccgaggacgucgccgaggugcugaaccggugcgccagcuccaacuggagcgagcgcaaggaggggcuccugggccugcagaaccugcucaagaaccagcggacccugucccgcguggagcugaagcggcucugcgagaucuucacgcgcauguucgccgacccccacgggaagcgggucuucagcauguuccuggagacccugguggacuucauccaggugcacaaggacgaccuccaggacuggcuguucguccugcucacccagcugcugaagaagaugggcgccgaccuccugggcuccgugcaggcgaaggugcagaaggcccuggacgucacccgcgagagcuucccgaacgaccuccaguucaacauccugaugcgguucacgguggaccagacccagacccccucccugaaggugaaggucgccauccucaaguacaucgagacccuggccaagcagauggaccccggggacuucaucaacagcuccgagacgcgccuggccgugagccgggugaucaccuggaccaccgagcccaaguccagcgacguccgcaaggcggcccaguccgugcucaucagccuguucgagcugaacaccccggaguucacgaugcuccugggcgcccugcccaagaccuuccaggacggggccaccaagcuccugcacaaccaccuccgcaacaccggcaacgggacgcaguccagcaugggcagcccccugacccggcccaccccgcgcucccccgccaacuggagcagcccccugaccucccccacgaacaccucccagaacacccugagcccguccgcguucgacuacgacaccgagaacaugaacagcgaggacaucuacuccagccuccggggcgugacggaggccauccagaacuucuccuuccgcagccaggaggacaugaacgagccccugaagcgggacuccaagaaggacgacggggacagcaugugcggcgggcccggcauguccgacccccgcgccgggggcgacgccaccgacagcucccagaccgcccuggacaacaaggcgagccuccugcacuccaugccgacccacagcagcccccggucccgcgacuacaaccccuacaacuacagcgacuccaucagccccuucaacaaguccgcccugaaggaggccauguucgacgacgacgccgaccaguucccggacgaccucagccuggaccacuccgaccuggucgcggagcuccugaaggagcugagcaaccacaacgagcggguggaggagcgcaagaucgcccucuacgagcugaugaagcugacgcaggaggaguccuucagcgugugggacgagcacuucaagaccauccuccugcugcuccuggagacccugggcgacaaggagcccaccauccgggcccucgcccugaagguccugcgcgagauccuccggcaccagcccgcccgcuucaagaacuacgcggagcugacggugaugaagacccuggaggcccacaaggacccccacaaggaggugguccgguccgccgaggaggccgccagcgugcucgcgaccuccaucagcccggagcagugcaucaaggugcugugccccaucauccagaccgccgacuaccccaucaaccuggccgccaucaagaugcagacgaaggucaucgagcgcguguccaaggagacccucaaccugcugcucccggagaucaugcccgggcugauccagggcuacgacaacagcgaguccagcgugcggaaggccugcgucuucugccugguggcggugcacgccgucaucggggacgagcucaagccccaccugucccagcugaccggcagcaagaugaagcuccugaaccuguacaucaagcgcgcccagaccgggagcggcggcgccgaccccacgaccgacguguccgggcagagcuga

SEQ ID NO: 28343 - RNA, 1851 nt, Artificial Sequence
  derived and/or modified sequence opt1 from CLCA2__Homo_sapiens__XP_011540750
augacccagcgcagcaucgccggccccaucugcaaccugaaguucgugacccuccuggucgcccuguccagcgagcucccguuccugggggcgggcgugcagcugcaggacaacggguacaacggccuccugaucgccaucaacccccaggugcccgagaaccagaaccugaucuccaacaucaaggagaugaucacggaggccagcuucuaccucuucaacgccaccaagcggcgcgucuucuuccggaacaucaagauccugauccccgccaccuggaaggcgaacaacaacuccaagaucaagcaggagagcuacgagaaggccaacgugaucgugaccgacugguacggggcccacggcgacgacccguacacgcugcaguaccgcggcugcgggaaggagggcaaguacauccacuucacccccaacuuccuccugaacgacaaccugaccgccggguacggcucccgggggcgcgucuucgugcacgagugggcgcaccuccgguggggcguguucgacgaguacaacaacgacaagcccuucuacaucaacggccagaaccagaucaaggucacccgcugcagcuccgacaucacggggaucuucgugugcgagaagggccccugcccgcaggagaacugcaucaucagcaagcuguucaaggaggggugcaccuucaucuacaacuccacccagaacgccaccgccagcaucauguucaugcagucccugagcuccguggucgaguucugcaacgccagcacgcacaaccaggaggcccccaaccuccagaaccagaugugcucccugcggagcgcgugggacgugaucaccgacuccgccgacuuccaccacagcuuccccaugaacggcaccgagcugcccccgccgcccaccuucagccucgugcaggccggcgacaaggucgugugccuggugcuggacgucuccagcaagauggccgaggccgaccgccuccugcagcugcagcaggcggccgaguucuaccucaugcagaucguggagauccacacguucguggggaucgccuccuucgacagcaagggcgagauccgggcccagcugcaccagaucaacuccaacgacgaccgcaagcugcucgucagcuaccugcccaccaccguguccgccaagaccgacaucagcaucugcuccgggcugaagaagggcuucgagguggucgagaagcucaacgggaaggcguacggcagcgugaugauccuggucacguccggcgacgacaagcugcucgggaacugccugcccaccgugcugagcuccggcagcaccauccacuccaucgcccucgggagcuccgccgcccccaaccuggaggagcugagccggcucaccggcgggcugaaguucuucgugcccgacaucuccaacagcaacagcaugaucgacgccuucucccgcaucagcuccggcacgggcgacaucuuccagcagcacauccagcuggagagcaccggggagaacgucaagccccaccaccagcucaagaacaccgugaccguggacaacacggucggcaacgacaccauguuccuggugaccuggcaggcguccgggccgcccgagaucauccuguucgaccccgacggccggaaguacuacaccaacaacuucaucacgaaccucaccuuccgcaccgccagccuguggauccccgggaccgccaagcugcggcgcuucgccuucaucccggacggccggcugaaccucuccguggucgacuucgacacgcuggcgcuguuccucuuccugaucuacugccugggccacaaggugaaggggaacaacaagguguacuuccacuga

SEQ ID NO: 28344 - RNA, 2607 nt, Artificial Sequence
  derived and/or modified sequence opt1 from CLCA4__Homo_sapiens__XP_011539317
auggaggacauggugaccaccgccagcacguaccuguucgaggccaccgagaagcgcuucuucuucaagaacgucuccauccucauccccgagaacuggaaggagaacccgcaguacaagcggcccaagcacgagaaccacaagcacgcggacgugaucguggccccgcccacccugcccggccgcgacgagcccuacaccaagcaguucacggagugcggggagaagggcgaguacauccacuucacccccgaccugcuccuggggaagaagcagaacgaguacgggcccccgggcaagcuguucguccacgagugggcccaccuccgguggggcguguucgacgaguacaacgaggaccagcccuucuaccgcgccaagagcaagaagaucgaggccacccggugcuccgcgggcaucagcgggcgcaaccggguguacaagugccagggcggguccugccugagccgcgccugccggaucgacuccaccacgaagcuguacggcaaggacugccaguucuuccccgacaagguccagaccgagaaggccagcaucauguucaugcaguccaucgacagcgugguggaguucugcaacgagaagacccacaaccaggaggcccccucccuccagaacaucaagugcaacuuccgcagcaccugggaggucaucuccaacagcgaggacuucaagaacacgaucccgauggugaccccgccgccgccgcccguguucucccugcugaagaucagccagcggaucgucugccucgugcuggacaaguccgggagcaugggcggcaaggaccgccugaaccggaugaaccaggcggccaagcacuuccuccugcagaccguggagaacggguccugggucggcauggugcacuucgacagcaccgccacgaucgugaacaagcugauccagaucaagagcuccgacgagcgcaacacccucauggccgggcugcccaccuacccccugggcggcaccagcaucugcuccgggaucaaguacgccuuccaggucaucggcgagcuccacagccagcuggacggguccgaggugcugcuccugacggacggcgaggacaacaccgcgagcuccugcaucgacgaggugaagcagagcggggccaucguccacuucaucgcccugggccgggccgccgacgaggcggugaucgagauguccaagaucaccggcgggagccacuucuacguguccgacgaggcccagaacaacggccucaucgacgccuucggggcccugaccagcggcaacacggaccugucccagaagucccuccagcuggagagcaaggggcugacccucaacagcaacgccuggaugaacgacaccgucaucaucgacuccaccgugggcaaggacacguucuuccugaucaccuggaacagccugccgcccuccaucagccucugggaccccagcggcaccaucauggagaacuucaccgucgacgcgacguccaagauggccuaccugagcauccccgggaccgccaaggugggcaccugggccuacaaccugcaggccaaggcgaaccccgagacccucacgaucaccgugaccucccgcgccgccaacagcuccgucccgcccaucaccgugaacgccaagaugaacaaggacgugaacagcuuccccucccccaugaucgucuacgcggagauccugcagggguacgugcccgugcugggcgccaacgucaccgccuucaucgagagccagaacgggcacacggaggugcucgagcugcuggacaacggcgccggcgccgacuccuucaagaacgacgggguguacagccgguacuucaccgcguacaccgagaacggccgcuacucccucaagguccgggcccacgggggcgccaacaccgcccgccugaagcugcggccgccccucaaccgcgccgcguacauccccggcuggguggugaacggggagaucgaggccaacccgccccgccccgagaucgacgaggacacgcagaccacccuggaggacuucagccggaccgccuccggcggggccuucgucgugagccaggugcccucccugccccugcccgaccaguacccgcccagccagaucacggaccucgacgccaccguccacgaggacaagaucauccugaccuggaccgcgcccggcgacaacuucgacguggggaaggugcagcgcuacaucauccggaucuccgccagcauccuggaccuccgcgacagcuucgacgacgcccugcaggucaacacgaccgaccugucccccaaggaggccaacagcaaggaguccuucgcguucaagcccgagaacaucagcgaggagaacgccacccacaucuucaucgccaucaaguccaucgacaagagcaaccucaccuccaaggugagcaacaucgcccaggugacgcuguucaucccccaggccaaccccgacgacaucgaccccacccccacccccacccccacgcccaccccggacaagucccacaacagcggcgucaacaucuccacccuggugcucagcgugaucggcuccgucgugaucgugaacuucauccugagcaccacgaucuga

SEQ ID NO: 28345 - RNA, 648 nt, Artificial Sequence
  derived and/or modified sequence opt1 from CLCF1__Homo_sapiens__NP_001159684
augcuggccugccucugcaccgugcuguggcaccuccccgccguccccgcgcugaaccgcaccggcgaccccgggcccggccccagcauccagaagacguacgaccugacccgguaccuggagcaccagcuccgcucccuggccgggaccuaccugaacuaccucggcccgcccuucaacgagcccgacuucaacccgccccggcugggggccgagacccugccccgcgccacgguggaccucgagguguggcggagccugaacgacaagcugcgccucacccagaacuacgaggccuacucccaccuccugugcuaccugcggggccugaaccgccaggcggccaccgccgagcugcggcgcagccucgcccacuucugcaccucccugcagggccugcucgggagcaucgcgggcgucauggccgcccugggguacccccugccccagccgcuccccggcacggagcccaccuggacccccgggccggcccacuccgacuuccugcagaagauggacgacuucuggcugcucaaggagcugcagaccuggcuguggcggagcgccaaggacuucaaccgccucaagaagaagaugcagccgcccgcggccgccgugacgcugcaccugggcgcccacggcuucuga

SEQ ID NO: 28346 - RNA, 429 nt, Artificial Sequence
  derived and/or modified sequence opt1 from CLC__Homo_sapiens__NP_001819
augagccugcuccccgugccguacaccgaggccgccucccugagcaccggcuccacggucaccaucaaggggcgcccccuggcgugcuuccucaacgagcccuaccuccagguggacuuccacaccgagaugaaggaggagagcgacaucguguuccacuuccaggucugcuucggccggcgcguggugaugaacucccgggaguacggggccuggaagcagcaggucgagagcaagaacaugcccuuccaggacggccaggaguucgagcuguccaucagcgugcugccggacaaguaccaggugauggucaacgggcaguccagcuacaccuucgaccaccgcaucaagcccgaggccgugaagauggugcaggucuggcgggacaucucccugacgaaguucaacgugagcuaccugaagcgcuga

SEQ ID NO: 28347 - RNA, 2967 nt, Artificial Sequence
  derived and/or modified sequence opt1 from CLCN1__Homo_sapiens__NP_000074
auggagcagagccgcucccagcagcggggcggggagcagagcugguggggcuccgacccccaguaccaguacaugccguucgagcacugcaccagcuacgggcugcccuccgagaacggcgggcuccagcaccgccugcggaaggacgccggcccccgccacaacgugcaccccacccagaucuacggccaccacaaggagcaguucagcgaccgggagcaggacaucgggaugccgaagaagacgggcuccagcuccaccgucgacagcaaggacgaggaccacuacuccaagugccaggacugcauccaccgccugggccagguggugcggcgcaagcucggggaggacuggaucuuccugguccugcucgggcugcugauggcccucgugagcugguccauggacuacgugagcgcgaagucccugcaggccuacaaguggagcuacgcccagaugcagcccucccugccccuccaguuccuggucugggugaccuucccccuggugcucauccuguucagcgcccuguucugccaccucaucuccccgcaggccgucggcagcggcauccccgagaugaagaccauccugcgcgggguggugcugaaggaguaccucacgaugaaggcguucgucgccaaggugguggcccugaccgccggccuggggagcggcauccccgucggcaaggaggggcccuucgugcacaucgcguccaucugcgccgccgugcucagcaaguucauguccgucuucugcggcguguacgagcagccguacuacuacagcgacauccugaccguggggugcgccgucggcguggggugcugcuucggcacgccccugggcgggguccucuucuccaucgaggugaccagcaccuacuucgccgugcgcaacuacuggcggggcuucuucgcggccaccuucuccgccuucgucuuccgcgugcuggccguguggaacaaggacgccgucaccaucacggcgcuguuccggaccaacuuccgcauggacuuccccuucgaccucaaggagcugcccgccuucgccgccaucgggaucugcugcggccugcucggggccguguucguguaccugcaccggcaggucaugcugggcgugcgcaagcacaaggcgcucagccaguuccuggccaagcaccggcugcucuacccgggcaucgugaccuucgucaucgccuccuucaccuucccgcccgggaugggccaguucauggccggggagcugaugccccgcgaggccaucagcacgcuguucgacaacaacaccugggugaagcacgcgggcgaccccgagucccucgggcagagcgccguguggauccacccccgggucaacguggugaucaucaucuuccuguucuucgucaugaaguucuggauguccaucguggccaccaccaugcccauccccugcggcggcuucaugccgguguucguccugggggccgcguucggccgccucgugggggagaucauggccaugcuguuccccgacggcauccuguucgacgacaucaucuacaagauccuccccggcggguacgccgugaucggcgccgccgcgcugacgggggccgucagccacaccguguccaccgccgugaucugcuucgagcugaccggccagaucgcccacauccugcccaugauggucgccgugauccucgcgaacaugguggcccagagccugcagccgucccuguacgacagcaucauccaggucaagaagcuccccuaccugcccgaccugggguggaaccagcucuccaaguacacgaucuucguggaggacaucauggugcgggacgucaaguucgugagcgccagcuacaccuacggcgagcugcgcacccugcuccagaccacgaccgugaagacccugccgcuggucgacuccaaggacagcaugauccuccugggcuccguggagcgcagcgagcugcaggcccuccugcagcggcaccugugccccgagcgccggcuccgcgccgcgcaggagauggcccggaagcuguccgagcugcccuacgacgggaaggcccgccucgccggcgaggggcugcccggcgcgccgcccgggcggcccgagagcuucgccuucguggacgaggacgaggacgaggaccuguccggcaagagcgagcugcccccgucccucgcccugcaccccagcaccacggcgccccucucccccgaggagccgaacggcccccugcccgggcacaagcagcagcccgaggccccggagcccgccggccagcgccccagcaucuuccagucccugcuccacugccugcuggggcgggcccgccccaccaagaagaagaccacccaggacagcacggaccucgucgacaacauguccccggaggagaucgaggccugggagcaggagcagcugagccagcccgugugcuucgacuccugcugcaucgaccagagccccuuccagcugguggagcagaccacccuccacaagacccacacccuguucagccugcucggccugcaccuggccuacgucacguccauggggaagcuccggggcgugcuggcccuggaggagcuccagaaggcgaucgagggccacaccaagagcggggugcagcugcggcccccgcuggccuccuuccggaacaccaccagcacgcgcaaguccaccggcgccccgcccagcuccgccgagaacuggaaccuccccgaggaccggcccggggccaccggcaccggggacgucaucgcggccagccccgagacgcccgugccgucccccagccccgagcccccgcugucccuggcccccggcaagguggagggcgagcucgaggagcuggagcuggucgagagccccgggcucgaggaggagcuggccgacauccugcagggccccucccuccgcagcaccgacgaggaggacgaggacgagcugauccuguga

SEQ ID NO: 28348 - RNA, 2646 nt, Artificial Sequence
  derived and/or modified sequence opt1 from CLCN2__Homo_sapiens__NP_001164558
auggccgccgcggccgccgaggagggcauggagccccgcgcccugcaguacgagcagacccucauguacgggcgguacacccaggaccugggcgccuucgcgaaggaggaggccgcccgcauccggcucgggggcccggagcccuggaaggggccgcccagcucccgcgccgcgcccgagcugcuggaguacggccggagccgcugcgcccggugccgcgugugcuccguccggugccacaaguuccuggugagccgcgugggcgaggacuggaucuuccucguccugcuggggcuccugauggcccugguguccugggugauggacuacgccaucgccgcgugccuccaggcccagcaguggaugagccggggccugaacacguccauccugcuccaguaccuggccugggucaccuaccccguggugcugaucaccuucagcgccggguucacccagauccucgcgccccaggccgucggcuccgggauccccgagaugaagacgauccugcgcggcguggugcugaaggaguaccucacccugaagaccuucaucgccaaggucaucggccugaccugcgcccucgggagcggcaugccgcuggggaaggagggccccuucgugcacaucgccuccaugugcgccgcgcugcucagcaaguuccugucccuguucggcgggaucuacgagaacgagagccggaacacggagaugcucgccgccgccugcgccgugggcgucgggugcugcuucgcggcccccaucggcggggugcuguucuccaucgaggugaccagcaccuucuucgccguccgcaacuacuggcggggcuucuucgccgcgaccuucuccgccuucaucuuccgcgugcuggccguguggaaccgggacgaggagacgaucaccgcccucuucaagacccgcuuccggcuggacuuccccuucgaccugcaggagcucccggccuucgcggucaucggcaucgccagcggguucggcggggcccuguucguguaccugaaccgcaagaucgugcaggucaugcggaagcagaagaccaucaaccgcuuccucaugcgcaagcggcugcuguuccccgcccucgugacgcugcugaucuccacccucaccuucccgcccggcuucgggcaguucauggccggccagcugagccagaaggagacccuggucacccucuucgacaaccgcacgugggugcggcagggccugguggaggagcuggagccgcccagcaccucccaggcguggaacccgccccgcgccaacgucuuccugacccucgugaucuucauccugaugaaguucuggaugagcgcccuggccacgaccauccccgugcccugcggggccuucaugcccgucuucgugaucgacggcauccacaccgacuccagcaccuaccggaucgugcccgggggcuacgcggucgugggggccgccgcccucgcgggcgccgugacgcacaccgucuccaccgccgugaucguguucgagcugaccggccagaucgcccacauccugcccgucaugaucgccgugauccucgcgaacgccguggcccagagccugcagcccucccuguacgacagcaucauccgcaucaagaagcuccccuaccugcccgagcugggguggggccggcaccagcaguaccgcguccggguggaggacaucauggugcgcgacgucccgcacguggcccucuccugcacguuccgggaccugcgccuggcccuccaccggaccaaggggcgcaugcuggcgcugguggagagccccgaguccaugauccuccugggcagcaucgagcggucccaggucguggcccugcucggcgcccagcugagccccgcccgccggcgccagcacaugcaggagcggcgcgccacccagaccuccccgcugagcgaccaggaggggccgcccacgcccgaggcguccgugugcuuccaggucaacaccgaggacagcgccuuccccgccgcccgcggcgagacccacaagccccucaagcccgcgcugaagcgggggcccuccgugacccgcaaccugggcgagagcccgaccgggagcgccgaguccgccggcaucgcccuccggagccuguucugcggcagcccgccgcccgaggccgcguccgagaagcuggaguccugcgagaagcgcaagcucaagcgggugcgcaucagccuggccuccgacgccgaccuggagggggagaugagccccgaggagauccucgagugggaggagcagcagcuggacgagcccgucaacuucuccgacugcaagaucgaccccgcccccuuccagcugguggagcggacgagccuccacaagacccacaccaucuucucccugcugggcguggaccacgccuacgucaccagcaucgggcgccucaucggcaucgugacgcugaaggagcugcggaaggcgaucgagggguccgugaccgcccagggcgucaaggugcgcccgccccucgccagcuuccgggacuccgccaccagcuccagcgacaccgagacgaccgaggugcacgcccuguggggcccccacagccgccacgggcugccccgggagggcucccccagcgacuccgacgacaagugccaguga

SEQ ID NO: 28349 - RNA, 2376 nt, Artificial Sequence
  derived and/or modified sequence opt1 from CLCN3__Homo_sapiens__NP_001230301
auggagagcgagcagcuguuccaccgcggcuacuaccggaacuccuacaacagcaucaccuccgccagcuccgacgaggagcuccuggacggggccggcgugaucauggacuuccagaccagcgaggacgacaaccugcucgacggggacacggcggucggcacccacuacaccaugaccaacgggggcuccaucaacagcuccacgcaccuccuggaccugcuggacgagcccaucccgggcguggggaccuacgacgacuuccacaccaucgacugggugcgcgagaagugcaaggaccgggagcgccaccggcgcaucaacagcaagaagaaggaguccgccugggagaugaccaagagccuguacgacgccugguccggcuggcucgucgugacgcugaccgggcuggccagcggcgcccucgcggggcugaucgacaucgccgccgacuggaugaccgaccugaaggagggcaucugccucuccgcccugugguacaaccacgagcagugcugcuggggcagcaacgagaccacguucgaggagcgggacaagugcccccaguggaagaccugggcggagcugaucaucgggcaggccgagggccccggguccuacaucaugaacuacaucauguacaucuucugggcccucagcuucgccuuccuggccgugucccuggucaagguguucgcgcccuacgccugcggcagcggcaucccggagaucaagaccauccucagcggguucaucauccgcggcuaccuggggaaguggacccugaugaucaagacgaucacccucgugcuggccgucgccuccggccugagccucgggaaggagggcccccuggugcacguggccugcugcugcggcaacaucuucuccuaccuguuccccaaguacagcaccaacgaggcgaagaagcgggaggucuccuacuacuucccccucaagacccuguggcgcagcuucuucgccgcccugguggccgccuucgugcuccgguccaucaacccguucgggaacagccgccugguccuguucuacguggaguaccacacgcccugguaccucuucgagcuguuccccuucauccugcucggcguguucgggggccuguggggcgcguucuucauccgggccaacaucgccuggugccgccggcgcaaguccaccaaguucgggaaguaccccguccuggaggugaucaucguggccgccaucaccgcggucaucgccuucccgaaccccuacacccggcucaacacgagcgagcugaucaaggagcuguucaccgacugcggcccccucgaguccagcucccugugcgacuaccgcaacgacaugaacgccagcaagaucguggacgacauccccgaccggccggccgggaucggcguguacuccgcgaucuggcagcugugccucgcccugaucuucaagaucaucaugaccgucuucaccuucgggaucaaggugcccagcggccuguucauccccuccauggccaucggggccaucgccggccgcaucgucggcaucgcgguggagcagcuggccuacuaccaccacgacugguucaucuucaaggaguggugcgaggugggggccgacugcaucacgcccggccucuacgccauggucggggccgcggccugccugggcggcgugacccggaugaccgugagccuggucgugaucguguucgagcucaccgggggccuggaguacaucgucccgcugauggccgccgugaugacguccaagugggugggggacgccuucggccgcgaggggaucuacgaggcgcacauccgccucaacggcuaccccuuccuggacgccaaggaggaguucacccacaccacccuggccgccgacgucaugcggccccgccggaacgacccgccccucgcggugcugacgcaggacaacaugaccguggacgacaucgagaacaugaucaacgagaccagcuacaacggcuuccccgucaucaugagcaaggagucccagcgccuggugggguucgcccuccggcgcgaccugaccaucgccaucgagagcgcccggaagaagcaggagggcaucgugggguccagccgcgucugcuucgcccagcacacccccucccugcccgcggagagcccgcggccccucaagcugcgcuccauccuggacaugagccccuucacggugaccgaccacaccccgauggagaucguggucgacaucuuccggaagcucggccugcgccagugccuggugacccacaacgggcggcuccugggcaucaucacgaagaaggacauccugcgccacauggcccagaccgccaaccaggaccccgccuccaucauguucaacuga

SEQ ID NO: 28350 - RNA, 2001 nt, Artificial Sequence
  derived and/or modified sequence opt1 from CLCN4__Homo_sapiens__NP_001243873
augaccgaccugaaggagggcgugugccucagcgccuucugguacucccacgagcagugcugcuggaccagcaacgagacgaccuucgaggaccgcgacaagugcccccuguggcagaagugguccgagcugcucgucaaccagagcgagggggccuccgcguacauccugaacuaccugauguacauccucugggcccugcuguucgccuuccucgccgugagccuggugcgggucuucgccccguacgcgugcggcuccgggauccccgagaucaagaccauccugagcggcuucaucauccgcggguaccucggcaaguggacccugcugaucaagacggugacccucgugcuggucguguccagcggccugucccucgggaaggagggcccccuggugcacgucgccugcugcugcgggaacuucuucagcucccuguucagcaaguacuccaagaacgagggcaagcggcgcgaggugcucagcgccgccgcggccgccgggguguccgucgccuucggcgcccccaucggcggggugcuguucagccuggaggagguguccuacuacuucccgcucaagacccuguggcggagcuucuucgcggcccuggucgccgccuucacccuccgcagcaucaaccccuucggcaacucccggcuggugcuguucuacguggaguaccacacgcccugguacauggccgagcuguuccccuucauccugcugggggucuucggcggccucugggggacccuguucauccgcugcaacaucgcguggugccggcgccggaagaccacccgccugggcaaguacccggugcucgaggugaucgucgugacggccaucaccgccaucaucgccuaccccaaccccuacacccggcagagcaccuccgagcugaucagcgagcuguucaacgacugcggggcccucgaguccagccagcugugcgacuacaucaacgaccccaacaugacgcgcccgguggacgacauccccgaccggcccgcgggcgucgggguguacaccgccauguggcagcuggcccucgcccugaucuucaagaucgucgugaccaucuucaccuucggcaugaagauccccuccggccuguucaucccgagcauggccgugggggcgaucgccggccgcauggucgggaucggcguggagcagcucgccuaccaccaccacgacuggaucaucuuccggaacuggugccgccccggggccgacugcgugacgcccggccuguacgcgauggucggcgccgccgccugccucgggggcgugacccggaugaccgugucccucgucgugaucauguucgagcugaccgggggccuggaguacaucgugccccugauggccgcggccgucacgagcaaguggguggccgacgccuucgggaaggagggcaucuacgaggcccacauccaccucaacggcuacccguuccuggacgugaaggacgaguucacccaccgcacccuggcgaccgacgucaugcggccccgccgcggggagccgccccucuccgugcugacgcaggacagcaugaccguggaggacgucgagacccugaucaaggagaccgacuacaacggcuuccccgugguggucucccgggacagcgagcgccucaucggguucgcccagcggcgcgagcugauccuggccaucaagaacgcccggcagcgccaggagggcaucguguccaacagcaucauguacuucacggaggagccgcccgagcuccccgccaacagcccccacccccugaagcugcggcgcauccucaaccugucccccuucaccgugaccgaccacaccccgauggagacggucguggacaucuuccggaagcugggccuccgccagugccuggugacccgguccgggcgccugcucggcaucaucaccaagaaggacguccugcggcacauggcgcagauggccaaccaggaccccgagagcaucauguucaacuga

SEQ ID NO: 28351 - RNA, 2451 nt, Artificial Sequence
  derived and/or modified sequence opt1 from CLCN5__Homo_sapiens__NP_001121370
auggccauguggcagggcgccauggacaaccgcggguuccagcagggcagcuucuccagcuuccagaacuccagcuccgacgaggaccugauggacauccccgcgaccgccauggacuucagcaugcgggacgacgugccgccccucgaccgcgaggucggggaggacaaguccuacaacggcgggggcaucggcagcuccaaccggaucauggacuuccuggaggagcccauccccggggugggcaccuacgacgacuucaacacgaucgacugggugcgcgagaagucccgggaccgcgaccggcaccgcgagaucaccaacaagagcaaggagagcaccugggcccugauccacuccgucagcgacgccuucuccggguggcuccugaugcugcucaucggccugcugagcgggucccucgccggccugaucgacaucagcgcgcacuggaugaccgaccugaaggagggcaucugcaccgggggcuucugguucaaccacgagcacugcugcuggaacuccgagcacgugacguucgaggagcgggacaagugcccggaguggaacagcuggagccagcucaucaucuccaccgacgagggggccuucgccuacaucgugaacuacuucauguacguccugugggcccuccuguucgcguuccuggccgugagccuggugaaggucuucgcccccuacgccugcggcuccggcauccccgagaucaagaccauccucagcggguucaucauccgcggcuaccuggggaaguggacgcuggugaucaagaccaucacccucgugcuggccgucuccagcggccugucccucgggaaggagggcccccuggugcacguggcgugcugcugcggcaacauccugugccacugcuucaacaaguaccggaagaacgaggccaagcgccgggagguccucagcgccgccgccgcggccgggguguccguggccuucggcgcccccaucgggggcguccuguucagccuggaggagguguccuacuacuucccccucaagacccuguggcgcagcuucuucgccgcgcugguggccgccuucacgcuccgguccaucaaccccuucgggaacagccgccugguccuguucuacguggaguuccacacccccuggcaccucuucgagcuggugccguucauccugcucggcaucuucggcgggcuguggggcgcccuguucauccggaccaacaucgccuggugccgcaagcggaagaccacgcagcucgggaaguaccccgucaucgaggugcuggucgugaccgcgaucaccgccauccuggccuuccccaacgaguacacccgcauguccacgagcgagcucaucuccgagcuguucaacgacugcggccugcucgacagcuccaagcugugcgacuacgagaaccgguucaacaccagcaagggcggggagcugcccgaccgcccggccggcgugggggucuacagcgcgauguggcagcuggcccucacccugauccugaagaucgugaucaccaucuucacguucggcaugaagauccccuccggccucuucauccccagcauggccgugggggccaucgccggccgccugcugggggucggcauggagcagcucgcguacuaccaccaggaguggaccguguucaacuccuggugcagccagggggccgacugcaucacccccggccuguacgccauggugggggccgccgcgugccugggcggcgucacccggaugacggugucccucguggucaucauguucgagcugaccgggggccuggaguacaucgugccgcucauggccgccgccaugaccagcaaguggguggccgacgcgcuggggcgcgagggcaucuacgacgcccacauccggcugaacggguaccccuuccucgaggccaaggaggaguucgcccacaagacccuggcgauggacgucaugaagccccgccggaacgacccccugcucacggugcugacccaggacuccaugaccguggaggacgucgagaccaucaucagcgagacgaccuacuccggcuucccggugguggucagccgcgagucccagcggcuggugggcuucgugcuccgccgggaccugaucaucagcaucgagaacgcccgcaagaagcaggacggggucguguccaccagcaucaucuacuucaccgagcacuccccgccccugccgcccuacaccccgcccacgcucaagcugcggaacauccuggaccucagccccuucaccgugaccgaccugacccccauggagaucgucguggacaucuuccgcaagcugggccuccggcagugccuggugacgcacaacgggcgccugcucggcaucaucaccaagaaggacguccugaagcacaucgcccagauggccaaccaggaccccgacuccauccuguucaacuga

SEQ ID NO: 28352 - RNA, 2610 nt, Artificial Sequence
  derived and/or modified sequence opt1 from CLCN6__Homo_sapiens__NP_001277
auggccggcugccgcgggagccugugcugcugcugccgguggugcugcugcugcggcgagcgcgagacccggacccccgaggagcucacgauccugggggagacccaggaggaggaggacgagauccugccgcgcaaggacuacgagucccucgacuacgaccggugcaucaacgaccccuaccuggaggugcuggagaccauggacaacaagaagggccgccgguacgaggccgucaaguggauggugguguucgcgaucggggucugcaccggccucgugggccuguucguggacuucuucguccgccuguucacgcagcucaaguucgggguggugcagaccagcgucgaggagugcucccagaagggcugccuggcccugagccuccuggagcugcucggguucaaccugaccuucguguuccuggccucccuccuggugcugaucgagcccgucgccgccggcagcgggauccccgaggugaagugcuaccucaacggcgugaaggucccgggcaucgugcggcugcgcacccugcucugcaaggugcuggggguccuguucuccguggcgggcgggcuguucgugggcaaggagggccccaugauccacagcggguccgucgugggcgccgggcugccccaguuccagagcaucucccugcggaagauccaguucaacuuccccuacuuccgcagcgaccgggacaagcgcgacuucguguccgccggcgccgcggccggggucgccgccgccuucggcgcgccgaucggcgggacgcuguucagccuggaggagggcuccagcuucuggaaccaggggcugaccuggaaggugcuguucugcuccaugagcgccaccuucacccugaacuucuuccgguccggcauccaguucgggagcuggggcagcuuccagcugcccggccuccugaacuucggggaguucaagugcuccgacagcgacaagaagugccaccuguggacggccauggaccucggcuucuucgucgugaugggggugaucggcgggcugcugggcgccaccuucaacugccucaacaagcgccuggccaaguaccggaugcgcaacguccaccccaagcccaagcuggugcgggugcucgagucccugcuggucagccucgugaccaccguggucguguucguggcguccaugguccugggcgagugccgccagaugagcuccagcucccagaucgggaacgacagcuuccagcuccaggugacggaggacgugaacuccagcaucaagaccuucuucugcccgaacgacaccuacaacgacauggccacccuguucuucaacccccaggaguccgccauccuccagcuguuccaccaggacggcacguucagccccgucacccuggcccucuucuucgugcuguacuuccugcucgccugcuggaccuacgggaucuccgugcccagcggccuguucgucccgucccugcucugcggcgcggccuucgggcggcugguggccaacgugcucaagagcuacaucggccucgggcacaucuacuccggcaccuucgcccugaucggggccgcggccuuccugggcggcgucgugcgcaugacgaucagccucaccgugauccugaucgagagcaccaacgagaucaccuacgggcugcccaucauggucacgcucaugguggccaaguggaccggcgacuucuucaacaaggggaucuacgacauccacgugggccugcgcggggucccccugcucgagugggagaccgagguggagauggacaagcugcgggccuccgacaucauggagcccaaccugaccuacguguacccgcacacgcgcauccagagccucgucuccauccugcggaccaccgugcaccacgcguuccccguggucaccgagaaccgcggcaacgagaaggaguucaugaagggcaaccagcugaucagcaacaacaucaaguucaagaaguccagcauccucacgcgggccggggagcagcgcaagcggucccagagcaugaaguccuaccccagcuccgagcugcgcaacaugugcgacgagcacaucgccagcgaggagcccgccgagaaggaggaccugcuccagcagaugcuggagcggcgcuacaccccguaccccaaccuguaccccgaccagucccccagcgaggacuggaccauggaggagcgguuccgcccgcucaccuuccacggccugauccugcggucccagcucgugacccugcuggugcgcggggucugcuacagcgagucccagagcagcgccucccagccccggcucagcuacgcggagauggccgaggacuacccccgcuacccggacauccacgaccuggaccugacgcuccugaacccccggaugaucguggacgugacccccuacaugaaccccuccccguucaccgucagccccaacacccacgugucccagguguucaaccuguuccgcacgaugggccuccggcaccuccccgucgugaacgccgugggggagaucgucggcaucaucacccgccacaaccugaccuacgaguuccuccaggcccgccugcggcagcacuaccagaccaucuga

SEQ ID NO: 28353 - RNA, 2346 nt, Artificial Sequence
  derived and/or modified sequence opt1 from CLCN7__Homo_sapiens__NP_001107803
auggccaacgugagcaagaaggucuccuggagcggccgcgaccgggacgacgaggaggccgcgccccugcuccgccggaccgcccgccccgggggcgggacgccccugcugaacggcgccgggcccggcgccgcccggcaggacauggacccgccgcaccccuuccccaaggagaucccccacaacgagaagcuccugucccugaaguacgagagccucgacuacgacaacuccgagaaccagcuguuccuggaggaggagcgccggaucaaccacaccgcguuccgcaccguggagaucaagcggugggugaucugcgcccucaucggcauccugaccgggcuggucgccugcuucaucgacaucgugguggagaaccucgccggccugaaguaccgcgucaucaaggggaacaucgacaaguucaccgagaagggcgggcugagcuucucccuccugcugugggcgacgcucaacgccgccuucgugcuggugggcagcgucaucguggccuucaucgagccgguggccgcgggcuccgggaucccccagaucaagugcuuccugaacggcgucaagaucccccacguggugcggcucaagacccuggucaucaaggugagcggggugauccuguccgucgugggcggccucgccguggggaaggagggccccaugauccacagcggguccgucaucgccgccggcaucagccaggggcgcuccaccagccugaagcgggacuucaagaucuucgaguacuuccgccgggacaccgagaagcgcgacuucguguccgccggcgcggccgccggcgugagcgccgccuucggggcgccggucggcggggugcuguucucccucgaggagggcgccagcuucuggaaccaguuccugacguggcggaucuucuucgccagcaugaucuccaccuucacccugaacuucguccucagcaucuaccacgggaacaugugggaccuguccagccccggccugaucaacuucggccgcuucgacuccgagaagauggccuacaccauccacgagauccccguguucaucgccauggggguggucggcggggugcucggcgcgguguucaacgcccugaacuacuggcugacgauguuccggauccgcuacauccaccggcccugccuccaggucaucgaggccgugcugguggccgcggucaccgccaccguggccuucgugcugaucuacagcucccgcgacugccagccgcuccagggcgggagcauguccuacccccugcagcuguucugcgccgacggcgaguacaacagcauggccgcggccuucuucaacacccccgagaaguccgucgugagccucuuccacgacccgcccggguccuacaacccccugacgcugggccucuucacccugguguacuucuuccuggccugcuggaccuacgggcucaccgucagcgccggcguguucauccccucccugcugaucggcgccgcgugggggcgccuguucggcaucagccucuccuaccugacgggggccgccaucugggccgaccccggcaaguacgcccugaugggggcggccgcccagcucggcggcaucgugcggaugacccugagccugaccgucaucaugauggaggccaccuccaacgugacguacggguucccgaucaugcucgugcugaugaccgcgaagaucgucggcgacguguucaucgaggggcuguacgacaugcacauccagcuccagagcgugcccuuccugcacugggaggcccccgucaccagccacucccugaccgcccgcgaggugaugagcacgcccgugaccugccuccggcgccgggagaaggucggcgugaucguggacguccuguccgacaccgccagcaaccacaacggguucccggugguggagcacgccgacgacacccagcccgcgcgccugcagggccucauccugcggucccagcugaucguccuccugaagcacaagguguucguggagcgcagcaaccugggccucguccagcggcgccugcggcugaaggacuuccgcgacgccuacccccgguucccgcccauccaguccauccacgugagccaggacgagcgcgagugcacgauggaccucuccgaguucaugaaccccagccccuacaccgugccgcaggaggccucccugccccgggucuucaagcuguuccgcgcccucgggcugcggcaccuggugguggucgacaaccgcaaccagguggugggccucgucacccggaaggaccuggcccgcuaccgccuggggaagcggggccucgaggagcugagccuggcgcagaccuga

SEQ ID NO: 28354 - RNA, 1905 nt, Artificial Sequence
  derived and/or modified sequence opt1 from CLCNKB__Homo_sapiens__XP_011538921
augacccugggcgugcucauggcccuggucagcugcgccauggaccuggcgguggaguccgugguccgcgcccaccaguggcucuaccgggagaucggggacagccaccuccugcgcuaccucuccuggaccguguaccccguggcccuggucagcuucuccagcggcuucucccagagcaucacgccguccagcgggggcuccgggauccccgaggugaagaccaugcuggccggcgugguccucgaggacuaccuggacaucaagaacuucggcgccaaggugguggggcugagcugcacccucgcgugcggcuccacccuguuccuggggaaggucggccccuucgugcaccucagcgugaugauggccgccuaccuggggcggguccgcacgaccaccaucggcgagcccgagaacaaguccaagcagaacgagaugcugguggccgcggccgccgugggcgucgccaccguguucgccgcgccguucagcggggugcuguucuccaucgaggucaugagcucccacuucagcgugugggacuacuggcggggcuucuucgccgccacgugcggggccuucauguuccgccugcuggccguguucaacagcgagcaggagaccaucaccucccucuacaagaccagcuuccgggucgacgugcccuucgaccugcccgagaucuucuucuucgucgcgcugggcggccucugcgggauccugggcuccgccuaccuguucugccagcgcaucuucuucggguucauccggaacaaccgcuucagcuccaagcuccuggccacgagcaagcccguguacuccgcccuggccacccucgugcuggcgagcaucaccuacccgcccuccgccggccgguuccuggccagccgccucuccaugaagcagcaccuggacagccuguucgacaaccacuccugggcccucaugacccagaacagcuccccgcccuggcccgaggagcuggacccccagcaccuguggugggagugguaccacccccgguucacgaucuucgggacccucgccuucuuccuggucaugaaguucuggaugcugauccucgcgaccaccauccccaugccggccggcuacuucaugcccaucuucguguacggcgccgccaucgggcgccuguucggcgagacgcugagcuucaucuuccccgaggggaucguggcgggcgggaucaccaaccccaucaugccgggcggcuacgcccucgccggggccgccgcguucuccggcgccgucacccacaccaucagcacggcccugcuggccuucgaggugaccgggcagaucgugcacgcccuccccguccugauggcggugcuggccgccaacgccaucgcccaguccugccagcccagcuucuacgacggcaccgugaucgucaagaagcugcccuaccucccgcggauccuggggcgcaacaucggcagccaccgggugcgcguggagcacuucaugaaccacuccaucaccacgcuggcgaaggacaugccccucgaggaggucgugaagguggucaccagcaccgacguggccaaguacccccugguggaguccaccgagagccagauccuggucggcaucgugcggcgcgcccagcucgugcaggcccugaaggcggagcccccguccugggcccccgggcaccagcagugccugcaggacauccucgccgccggcugccccacggagccggucacccugaagcugagccccgagaccucccuccacgaggcccacaaccuguucgagcugcucaaccugcacagccuguucgugaccucccgggggcgcgcggugggcugcgucagcuggguggagaugaagaaggccaucuccaaccucacgaacccgcccgcccccaaguga

SEQ ID NO: 28355 - RNA, 624 nt, Artificial Sequence
  derived and/or modified sequence opt1 from CLDN10__Homo_sapiens__NP_001153572
augagccgcgcccagaucugggcccugguguccggcgucgggggcuucggggcgcucguggccgccaccaccagcaacgaguggaaggugacgacccgggccuccagcgucaucaccgccaccuggguguaccagggccuguggaugaacugcgcgggguacauccaggccugccgcggccugaugaucgccgccgugucccucggcuucuucgggagcaucuucgcgcuguucggcaugaagugcacgaaggucgggggcuccgacaaggccaaggccaagaucgccugccuggccgggaucguguucauccucagcggccugugcuccaugaccggcugcagccuguacgcgaacaagaucaccaccgaguucuucgacccccucuucguggagcagaaguacgagcugggggccgcccuguucaucggcugggccggggccucccucugcaucaucggcggcgucaucuucugcuucagcaucuccgacaacaacaagacgccgcgguacaccuacaacggggcgaccagcgugauguccagccgcaccaaguaccacggcggggaggacuucaagacgaccaaccccuccaagcaguucgacaagaacgccuacguguga

SEQ ID NO: 28356 - RNA, 624 nt, Artificial Sequence
  derived and/or modified sequence opt1 from CLDN11__Homo_sapiens__NP_005593
augguggcgaccugccugcaggucgugggcuucgugaccagcuucgucggguggaucggcgugaucgugacgaccuccaccaacgacugggucgugaccugcggguacacgaucccgaccugccgcaagcucgacgagcugggcagcaaggggcugugggccgacugcgugauggccaccggccucuaccacugcaagccccuggucgacauccugauccuccccggcuacgugcaggccugccgggcccugaugaucgccgccuccgugcuggggcuccccgcgauccugcugcuccugaccguccugcccugcauccgcaugggccaggagccggggguggccaaguaccggcgcgcccagcucgccggcgugcugcugauccuccuggcgcugugcgcccucgucgccacgaucugguuccccgugugcgcccaccgggagaccaccaucgugagcuucggguacucccuguacgccggcuggaucggcgcgguccugugccucgucgggggcugcgugauccugugcugcgccggggacgcccaggccuucggcgagaaccgcuucuacuacaccgccggcagcuccagccccacgcacgcgaaguccgcccacguguga

SEQ ID NO: 28357 - RNA, 720 nt, Artificial Sequence
  derived and/or modified sequence opt1 from CLDN14__Homo_sapiens__NP_036262
auggccagcaccgccgugcagcugcucggcuuccugcuguccuuccucgggauggucggcacccugaucacgaccauccugccccacuggcgccggaccgcgcacguggggaccaacauccucacggccgugagcuaccugaagggccuguggauggagugcgucuggcacuccaccgggaucuaccagugccagaucuaccgcagccuccuggcccugccccaggaccuccaggccgcccgggcgcugauggugaucuccugccugcucagcggcaucgccugcgccugcgccgugaucggcaugaagugcacccgcugcgcgaaggggacccccgccaagacgaccuucgccauccugggcgggacccuguucauccucgccggccugcugugcauggucgccguguccuggaccacgaacgacgugguccagaacuucuacaacccccuccugcccagcgggaugaaguucgagaucggccaggcgcuguaccucggcuucaucuccagcucccugagccugaucgggggcacccuccugugccuguccugccaggacgaggccccguaccggcccuaccaggccccgccccgcgccaccaccacgaccgccaacaccgcgcccgccuaccagccgcccgccgccuacaaggacaaccgggcccccagcgugaccuccgcgacgcacagcggguaccgccucaacgacuacguguga

SEQ ID NO: 28358 - RNA, 687 nt, Artificial Sequence
  derived and/or modified sequence opt1 from CLDN15__Homo_sapiens__NP_001172009
augagcauggccguggagaccuucggcuucuucauggccaccgucgggcugcucaugcugggcgugacgcugcccaacuccuacuggcgcgugagcaccguccacgggaacgugaucaccaccaacacgaucuucgagaaccucugguucuccugcgcgaccgacagccugggcguguacaacugcugggaguucccguccaugcuggcccucagcggguacauccaggccugccgggcccugaugaucaccgccauccugcucggcuuccugggccugcuccuggggaucgcgggccugcgcugcaccaacaucgggggccucgagcugucccggaaggccaagcuggccgccacggcgggggcccuccacauccuggccggcaucugcggcauggucgccaucagcugguacgccuucaacaucacccgcgacuucuucgacccccuguaccccgggaccaaguacgagcucggccccgcgcuguaccuggggugguccgccagccucaucuccauccugggcggccugugccucugcagcgccugcugcugcggguccgacgaggacccggccgccagcgcgcggcgccccuaccaggcccccguguccgugaugcccgucgccaccagcgaccaggagggcgacuccagcuucgggaaguacggccggaacgccuacguguga

SEQ ID NO: 28359 - RNA, 918 nt, Artificial Sequence
  derived and/or modified sequence opt1 from CLDN16__Homo_sapiens__NP_006571
augaccagccgcacgccccugcucgugaccgccugccuguacuacuccuacugcaacagccggcaccuccagcagggcguccgcaaguccaagcggccgguguucagccacugccaggugcccgagacccagaagaccgacacccgccaccuguccggggcccgggcgggcgucugccccugcugccaccccgacgggcugcuggccacgaugcgcgaccuccugcaguacaucgccugcuucuucgccuucuucagcgccggcuuccugaucguggcgaccuggaccgacugcuggauggugaacgccgacgacucccucgaggucagcaccaagugccgggggcuguggugggagugcgugacgaacgccuucgacggcauccggaccugcgacgaguacgacuccauccuggccgagcacccgcucaagcugguggucacccgcgcgcugaugaucaccgccgacauccucgccggcuucggguuccugacgcugcuccugggccuggacugcgugaaguuccuccccgacgagcccuacaucaaggugcgcaucugcuucgucgccggggccacccugcugaucgcgggcacccccgggaucaucggcagcgugugguacgccguggacgucuacguggagcgguccacccucgugcugcacaacaucuuccugggcauccaguacaaguucggguggagcugcuggcucggcauggccgggucccugggcugcuuccuggccggcgccguccucacgugcugccuguaccuguucaaggacguggggccggagcgcaacuaccccuacagccuccggaaggcguacuccgccgccggcgugagcauggccaaguccuacagcgcgccccgcaccgagaccgccaagauguacgccgucgacacccggguguga

SEQ ID NO: 28360 - RNA, 786 nt, Artificial Sequence
  derived and/or modified sequence opt1 from CLDN18__Homo_sapiens__NP_001002026
auggccgugaccgccugccagggccugggguucgucgugagccucaucggcaucgcggggaucaucgccgcgaccugcauggaccagugguccacgcaggaccuguacaacaaccccgugaccgccgucuucaacuaccagggccuguggcgcagcugcgugcgggaguccagcggguucaccgagugccgcggcuacuucacccuccugggccugccggccaugcuccaggccgugcgggcccugaugaucgucgggaucgugcugggcgccaucgggcuccugguguccaucuucgcccugaagugcauccgcaucggcagcauggaggacuccgcgaaggccaacaugacgcucaccagcgggaucauguucaucgucuccggccugugcgccaucgccggcgugagcguguucgccaacaugcuggucaccaacuucuggauguccaccgcgaacauguacacggggaugggcgggauggugcagaccgugcagacccgguacaccuucggcgccgcccucuucgucggcuggguggccgggggccugacgcugaucgggggcgugaugaugugcaucgccugccgcgggcucgcgcccgaggagaccaacuacaaggccgucagcuaccacgccuccggccacagcguggccuacaagcccggcggguucaaggccuccaccggcuucgggagcaacaccaagaacaagaagaucuacgacggcggggcgcggacggaggacgaggugcaguccuaccccagcaagcacgacuacgucuga

SEQ ID NO: 28361 - RNA, 636 nt, Artificial Sequence
  derived and/or modified sequence opt1 from CLDN1__Homo_sapiens__NP_066924
auggccaacgccggccugcagcuccugggguucauccuggcguuccucggcuggaucggggccaucgugagcaccgcccugccccaguggcgcaucuacuccuacgccggcgacaacaucgucaccgcccaggcgauguacgaggggcuguggaugagcugcgugucccagagcacgggccagauccagugcaagguguucgacucccuccugaaccugagcuccacccuccaggccacccgggcccugauggucgugggcauccugcucggggugaucgccaucuucgucgcgaccgugggcaugaagugcaugaagugccuggaggacgacgaggugcagaagaugcgcauggccgucaucgggggcgccaucuuccugcucgccgggcuggccauccugguggcgacggccugguacggcaaccggaucgugcaggaguucuacgacccgaugacccccgucaacgcccgcuacgaguucggccaggcccucuucaccgggugggccgcggccagccugugccugcucggcggggcccugcugugcugcuccugcccccggaagaccacgagcuaccccaccccgcgccccuaccccaagcccgccccguccagcggcaaggacuacguguga

SEQ ID NO: 28362 - RNA, 879 nt, Artificial Sequence
  derived and/or modified sequence opt1 from CLDN23__Homo_sapiens__NP_919260
augcgcacccccguggucaugacccugggcauggugcucgccccgugcgggcugcugcucaaccugacgggcacccuggcccccggguggcggcucgugaagggcuuccugaaccagcccgucgacguggagcuguaccaggggcucugggacaugugccgcgagcagagcucccgggagcgcgagugcggccagaccgaccaguggggcuacuucgaggcgcagcccgugcuggucgcccgggcccugauggugaccagccucgccgccacggugcuggggcugcuccuggcgucccugggcguccgcugcuggcaggacgagccgaacuucgugcucgccgggcugagcggcgugguccuguucguggccgggcuccugggccugauccccguguccugguacaaccacuuccucggcgaccgggacguccugcccgcccccgcgagcccggugaccgugcaggucuccuacagccuggugcucggguaccugggcuccugccugcuccugcucgggggcuucagccuggcccuguccuucgcccccuggugcgacgagcgcugccggcgccggcgcaagggccccagcgccgggccccggcgcuccagcguguccaccauccaggucgaguggccggagcccgaccuggcccccgcgaucaaguacuacagcgacggccagcaccggcccccgcccgcccagcaccgcaagcccaagcccaagccgaaggugggguuccccaugccccggccccgcccgaaggccuacaccaacuccguggacguccucgacggcgaggggugggagagccaggacgcccccuccugcagcacgcaccccugcgacagcucccugcccugcgacagcgaccuguga

SEQ ID NO: 28363 - RNA, 693 nt, Artificial Sequence
  derived and/or modified sequence opt1 from CLDN2__Homo_sapiens__NP_001164566
auggccagccugggccuccagcuggugggguacauccugggccuccuggggcugcucggcacccuggucgccaugcugcuccccuccuggaagaccagcuccuacgugggggcgagcaucgugacggccgucggcuucuccaagggccuguggauggagugcgccacccacagcaccgggaucacccagugcgacaucuacuccacgcugcucggccugccggccgacauccaggccgcgcaggccaugauggugaccagcuccgccaucagcucccuggccugcaucaucagcguggucgggaugcgcugcaccguguucugccaggagucccgggcgaaggaccgcguggccgucgccggcgggguguucuucauccucggcggccugcugggguucauccccguggccuggaaccuccacggcauccugcgggacuucuacagcccccugguccccgacuccaugaaguucgagaucggggaggcccucuaccugggcaucaucagcucccuguucagccucaucgcgggcaucauccugugcuucuccugcagcagccagcgcaaccgguccaacuacuacgacgccuaccaggcccagccgcuggccacccgcagcagcccccggcccgggcagcccccgaaggugaaguccgaguucaacuccuacagccucacgggcuacguguga

SEQ ID NO: 28364 - RNA, 912 nt, Artificial Sequence
  derived and/or modified sequence opt1 from CLDN5__Homo_sapiens__NP_001124333
augacccgcgcccggaucggcugcuucgggcccggcgggcgcgcccggggcaccgagagcgcgccggagcccuccaagcgcgugccgcccgggcggagcuggcagacgcaggagguccgccagacccggggcgccaacggccuggggccccgcgccggcuccgccggggccaaggcgcccggccccgcccagggggccgcccagcacggccucggcgggagcgcgggccugcgggugcgcgugagcccccuggccaugggguccgccgcccucgagauccugggccugguccucugccuggugggcuggggcgggcugauccucgccugcgggcugccgauguggcaggucaccgcguuccuggaccacaacaucgugaccgcccagacgaccuggaagggccucuggauguccugcguggugcagagcaccgggcacaugcagugcaaggucuacgacuccgugcuggcccugagcaccgaggugcaggccgcccgggcgcucacggucuccgccgugcugcuggccuucguggcccucuucgucacccuggccggcgcgcagugcacgaccugcguggcccccggccccgccaaggcccgcguggcccugaccgggggcguccucuaccuguucugcgggcugcucgcgcuggugccccugugcugguucgccaacaucgugguccgggaguucuacgacccgagcgugcccgugucccagaaguacgagcucggcgccgcccuguacaucgggugggcggccaccgcccugcucauggucggcggcugccugcugugcugcggggccugggugugcaccggccgccccgaccucagcuuccccgucaaguacuccgccccgcggcgccccaccgcgacgggggacuacgacaagaagaacuacguguga

SEQ ID NO: 28365 - RNA, 663 nt, Artificial Sequence
  derived and/or modified sequence opt1 from CLDN6__Homo_sapiens__NP_067018
auggccagcgccggcaugcagauccugggggugguccucacccugcugggcugggugaacgggcucguguccugcgcgcugcccauguggaaggucaccgccuucaucggcaacagcaucgugguggcccaggucgugugggaggggcuguggauguccugcgugguccagagcacgggccagaugcagugcaagguguacgacucccuccuggcccugccgcaggaccuccaggccgcgcgcgcccugugcgugaucgcccugcucgucgcccuguucggccugcucguguaccuggcgggggccaagugcacgaccugcguggaggagaaggacagcaaggcccggcugguccucaccuccggcaucguguucgugaucagcgggguccugacccugauccccgugugcuggaccgcccacgccaucauccgcgacuucuacaacccccucguggcggaggcccagaagcgggagcugggcgccucccuguaccucgggugggccgccagcggccugcugcuccugggcgggggccugcucugcugcacgugccccuccgggggcagccagggcccgucccacuacauggcgcgcuacagcaccuccgcccccgccaucagccgggggcccuccgaguaccccaccaagaacuacgucuga

SEQ ID NO: 28366 - RNA, 438 nt, Artificial Sequence
  derived and/or modified sequence opt1 from CLDN7__Homo_sapiens__NP_001171952
auggccaacagcggccugcagcuccugggguucuccauggcccugcucggcuggguggggcuggucgcgugcaccgccaucccccaguggcagaugagcuccuacgccggcgacaacaucaucaccgcccaggccauguacaaggggcuguggauggacugcgugacgcagagcaccggcaugauguccugcaagauguacgacagcgugcucgcgcuguccgccgcccugcaggccacccgcgcgcucauggucgugagccuggugcugggcuuccucgccauguucgucgccaccauggggaugaagugcacgcggugcggcggggacgacaaggugaagaaggcccgcaucgccaugggcgggggcaucaucuucaucguggcgggcaugucccuggcccugccgagccuccuggccgggcagggccugcccuga

SEQ ID NO: 28367 - RNA, 678 nt, Artificial Sequence
  derived and/or modified sequence opt1 from CLDN8__Homo_sapiens__NP_955360
auggccacccacgcccuggagaucgcgggccucuuccucgggggcguggggauggucggcaccguggccgugacggucaugccccaguggcgcgugagcgccuucaucgagaacaacaucguggucuucgagaacuucugggaggggcuguggaugaacugcgugcggcaggccaacauccgcaugcagugcaagaucuacgacucccugcuggcccugagcccggaccuccaggcggcccggggccugaugugcgccgccuccgugaugagcuuccuggcguucaugauggccauccucggcaugaagugcacccgcugcaccggggacaacgagaaggucaaggcccacauccugcugaccgccggcaucaucuucaucaucacggggaugguggugcucauccccgucuccuggguggccaacgcgaucauccgggacuucuacaacagcaucgugaacgucgcccagaagcgcgagcugggcgaggcccuguaccucggguggaccaccgcccuggugcugaucgugggcggcgcccucuucugcugcgucuucugcugcaacgagaaguccagcuccuaccgguacagcauccccucccaccgcaccacgcagaaguccuaccacaccgggaagaagucccccagcguguacagccggagccaguacguguga

SEQ ID NO: 28368 - RNA, 654 nt, Artificial Sequence
  derived and/or modified sequence opt1 from CLDN9__Homo_sapiens__NP_066192
auggccagcaccggccuggagcuccuggggaugacccuggccgugcucggcuggcuggggacgcuggucuccugcgcgcucccccuguggaaggugaccgccuucaucggcaacagcaucguggucgcccagguggugugggaggggcuguggauguccugcgucgugcagagcaccggccagaugcagugcaagguguacgacucccuccuggcccugccgcaggaccuccaggccgcgcgcgcccugugcgucaucgcccugcuccuggcccugcucggccugcugguggcgaucaccggggcccagugcacgaccugcguggaggacgagggcgccaaggcccggaucguccucaccgccggggugauccugcugcucgcgggcauccuggugcugauccccgucugcuggaccgcccacgccaucauccaggacuucuacaacccccucguggccgaggcccugaagcgcgagcugggggcgagccucuaccugggcugggccgccgccgcccugcucaugcugggcgggggccugcucugcugcacgugcccgccgccccagguggagcggccccgcgggccccggcugggcuacuccauccccagccgcuccggcgcgagcgggcuggacaagcgggacuacgucuga

SEQ ID NO: 28369 - RNA, 879 nt, Artificial Sequence
  derived and/or modified sequence opt1 from CLEC10A__Homo_sapiens__NP_006335
augacccgcaccuacgagaacuuccaguaccuggagaacaaggugaagguccagggcuucaagaacgggccccucccgcugcagagccugcuccagcggcugugcuccggccccugccaccuccugcugagccuggggcucggccugcugcuccuggugaucaucugcguggucggguuccagaacuccaaguuccagcgcgaccuggugacgcuccggaccgacuucagcaacuucaccuccaacaccguggccgagauccaggcccugacgagccagggcuccagccuggaggagaccaucgcgucccucaaggccgaggucgagggcuucaagcaggagcgccaggccgugcacagcgagaugcugcugcgggugcagcagcucguccaggaccugaagaagcugaccugccagguggccacccucaacaacaacggggaggaggccuccacggaggggaccugcugccccgugaacugggucgagcaccaggacagcugcuacugguucucccacagcggcauguccugggcggaggccgagaaguacugccagcugaagaacgcccaccugguggugaucaacagccgcgaggagcagaacuucguccagaaguaccucggcuccgccuacaccuggauggggcugagcgaccccgagggcgcguggaaguggguggacggcaccgacuacgccacgggguuccagaacuggaagccgggccagcccgacgacuggcaggggcacggccugggcgggggcgaggacugcgcccacuuccaccccgacgggcgguggaacgacgacgugugccagcgccccuaccacugggucugcgaggccggccucgggcagaccucccaggagagccacuga

SEQ ID NO: 28370 - RNA, 972 nt, Artificial Sequence
  derived and/or modified sequence opt1 from CLEC11A__Homo_sapiens__NP_002966
augcaggccgccuggcugcucggcgcgcugguggucccccagcugcucggguucggccacggggcccgcggcgccgagcgggagugggagggcggguggggcggggcccaggaggaggagcgcgagcgggaggcccugaugcugaagcaccuccaggaggcgcugggccugccggccgggcgcggcgacgagaaccccgccgggaccguggagggcaaggaggacugggagauggaggaggaccagggcgaggaggaggaggaggaggccacccccacgcccagcuccgggccgagccccucccccacccccgaggacaucgugaccuacauccucggccggcuggcggggcuggacgccggccuccaccagcugcacguccgccugcacgcccucgacacccgggugguggagcugacgcagggccugcgccagcuccggaacgccgccggggacacccgcgacgcgguccaggcccugcaggaggcccagggccgggccgagcgcgagcacgggcggcuggagggcugccucaaggggcugcgccugggccacaagugcuuccuccugagccgggacuucgaggcccaggcggccgcccaggcccgcugcaccgcccggggcgggucccuggcgcagccggccgaccgccagcagauggaggcccucacccgguaccugcgcgccgcccuggcgcccuacaacuggcccguguggcucggcgugcacgaccggcgcgccgaggggcuguaccuguucgagaacggccagcgcgucagcuucuucgccuggcaccggagcccccgcccggagcucggggcccagcccuccgcgagcccccacccccuguccccggaccagcccaacggcggcacgcuggagaacugcguggcccaggccuccgacgacgggagcuggugggaccacgacugccagcggcgccucuacuacgugugcgaguuccccuucuga

SEQ ID NO: 28371 - RNA, 828 nt, Artificial Sequence
  derived and/or modified sequence opt1 from CLEC12A__Homo_sapiens__NP_001193939
auguggaucgacuucuucaccuacagcuccaugagcgaggaggugaccuacgccgaccugcaguuccagaacuccagcgagauggagaagauccccgagaucggcaaguucggggagaaggccccgcccgcgcccucccacgucuggcgccccgccgcccucuuccugacgcugcucugccugcugcuccugaucggccugggggugcucgccagcauguuccacgugacccugaagaucgagaugaagaagaugaacaagcugcagaacaucuccgaggagcuccagcggaacaucagccugcagcugauguccaacaugaacaucagcaacaagauccgcaaccucuccaccacccugcagacgaucgccaccaagcugugccgggagcucuacagcaaggagcaggagcacaagugcaagccgugcccccgccgguggaucuggcacaaggacuccugcuacuuccugagcgacgacguccagaccuggcaggaguccaagauggcgugcgccgcccagaacgccagccugcucaagaucaacaacaagaacgcgcuggaguucaucaagucccagagccgcuccuacgacuacuggcugggccucagccccgaggaggacagcacccgggggaugcgcguggacaacaucaucaacuccagcgccugggugauccggaacgcccccgaccugaacaacauguacugcggcuacaucaaccgccuguacguccaguacuaccacugcacguacaagaagcggaugaucugcgagaagauggccaacccggugcagcucggcuccaccuacuuccgcgaggccuga

SEQ ID NO: 28372 - RNA, 1473 nt, Artificial Sequence
  derived and/or modified sequence opt1 from CLEC14A__Homo_sapiens__NP_778230
augcgccccgccuucgcccugugccuccuguggcaggcgcuguggccgggccccgggggcggggagcaccccaccgccgaccgggccggcugcagcgccuccggggccugcuacagccuccaccacgcgaccaugaagcgccaggccgccgaggaggccugcauccugcggggcggcgcgcuguccacggugcgcgccggggccgagcuccgggccguccuggcccugcuccgcgcgggccccgggccgggcgggggcagcaaggaccugcuguucuggguggcccucgagcggcgccggucccacugcacccuggagaacgagccccugcgcggcuucagcuggcucuccagcgaccccgggggccuggaguccgacacccugcaguggguggaggagccccagcggagcugcaccgcccgccggugcgccguccuccaggccaccgggggcguggagccggcgggcuggaaggagaugcgcugccaccuccgggccaacggguaccugugcaaguaccaguucgaggugcugugccccgcgccccgccccggcgccgccuccaaccugagcuaccgggccccguuccagcugcacuccgccgcccucgacuucagcccgcccgggaccgaggucuccgcccugugccgcggccagcugcccaucagcgugaccugcaucgccgacgagaucggggcgcggugggacaagcucuccggcgacgugcugugccccugccccggccgcuaccugcgggccgggaagugcgccgagcuccccaacugccuggacgaccugggcggguucgccugcgagugcgcgaccggcuucgagcucgggaaggacggccgcagcugcgucacguccggcgaggggcagcccacccugggcgggaccggcgugccgacccgccggccgcccgccacggccaccagccccgugccccagcgcaccuggcccauccgggucgacgagaagcugggggagacgccccucgugcccgagcaggacaacagcgugacguccaucccggagaucccccgcuggggcagccaguccaccaugagcacccugcagaugucccugcaggccgagagcaaggccaccaucacgcccuccggcagcgucaucuccaaguucaacagcaccaccuccagcgcgaccccgcaggccuucgacuccagcuccgccgugguguucaucuucgucagcacggccguggugguccucgugauccugaccaugaccgugcuggggcucgucaagcugugcuuccacgagucccccagcucccagccccggaaggagagcauggggcccccgggccuggagagcgaccccgagcccgccgcgcucggcuccagcuccgcccacugcaccaacaacggcgugaaggucggggacugcgaccugcgcgaccgggccgagggcgcccugcucgccgagagcccccugggguccagcgacgcguga

SEQ ID NO: 28373 - RNA, 2721 nt, Artificial Sequence
  derived and/or modified sequence opt1 from CLEC16A__Homo_sapiens__NP_001230332
auguucggccgcagccgguccugggucgggggcgggcacggcaagaccagccgcaacauccacucccuggaccaccucaaguaccuguaccacgugcugaccaagaacacgaccgugaccgagcagaaccggaaccuccugguggagaccauccgcagcaucacggagauccugaucuggggcgaccagaacgacuccagcgucuucgacuucuuccucgagaagaacauguucguguucuuccugaacauccugcggcagaaguccgggcgcuacgugugcguccagcuccugcagacccugaacauccucuucgagaacaucagccacgagaccucccuguacuaccugcucagcaacaacuacgugaacuccaucaucgugcacaaguucgacuucagcgacgaggagaucauggccuacuacaucuccuuccugaagacccugagccucaagcugaacaaccacacgguccacuucuucuacaacgagcacaccaacgacuucgcccuguacaccgaggccaucaaguucuucaaccaccccgaguccauggugcggaucgccgugcgcaccaucacgcucaacgucuacaagguggacaaccaggccaugcugcacuacauccgggacaagaccgccgugccguacuucagcaaccuggucugguucaucggcucccacgugaucgagcucgacgacugcgugcagaccgacgaggagcaccgcaaccgggggaagcugagcgaccuggucgccgagcaccucgaccaccuccacuaccugaacgacauccugaucaucaacugcgaguuccugaacgacgugcugaccgaccaccuccugaaccgccuguuccucccccuguacguguacucccuggagaaccaggacaagggcggggagcggcccaagaucagccuccccgucagccuguaccugcucucccagguguuccugaucauccaccacgcgccgcuggugaacagccucgccgaggucauccugaacggcgaccuguccgagauguacgccaagacggagcaggacauccagcgcagcuccgccaagcccagcauccggugcuucaucaagcccaccgagacccucgagcgcucccuggagaugaacaagcacaaggggaagcggcgcgugcagaagcggcccaacuacaagaacgucggcgaggaggaggacgaggagaagggcccgaccgaggacgcgcaggaggacgccgagaaggccaaggagaucgagauggugaucauggagcgcagcaagcuguccgagcuggccgccagcacguccgugcaggagcagaacaccaccgacgaggagaaguccgcggccgcgaccugcuccgagagcacgcaguggucccggcccuuccucgacauggucuaccacgcccuggacagccccgacgacgacuaccacgcccuguucgugcucugccugcuguacgccaugucccacaacaaggggauggaccccgagaagcucgagcgcauccagcugccggugcccaacgccgccgagaagaccaccuacaaccacccccuggccgagcgccucauccggaucaugaacaacgccgcgcagcccgacggcaagauccgccuggccacccuggagcucagcugccugcugcucaagcagcagguccugauguccgccgggugcaucaugaaggacgugcaccuggccugccucgagggcgcccgggaggagagcgugcaccugguccgccacuucuacaagggcgaggacaucuuccuggacauguucgaggacgaguaccggagcaugacgaugaagccgaugaacguggaguaccucaugauggacgcguccauccugcugccgcccaccgggacgccccucaccggcaucgacuucgugaagcgccugcccugcggggacgucgagaagacccggcgcgccauccggguguucuucaugcugcgcagccucucccugcagcugcggggcgagcccgagacccagcucccccugacccgcgaggaggaccugaucaagaccgacgacgugcucgaccugaacaacagcgaccugaucgccugcacggucaucaccaaggacgggggcauggugcagcgguuccucgccguggacaucuaccagaugucccuggucgagcccgacgugagccgccugggcuggggcguggucaaguucgcggggcuccugcaggacaugcaggucaccgggguggaggacgacucccgggcccugaacaucaccauccacaagccggccagcagcccccacagcaagcccuuccccauccuccaggccaccuucaucuucuccgaccacauccgcugcaucaucgccaagcagcggcuggcgaagggccgcauccaggcccggcgcaugaagaugcagcgcaucgccgcccugcucgaccugccgauccagcccacgaccgaggugcugggguucggccucggcagcuccaccagcacccagcaccuccccuuccgguucuacgaccaggggcgccggggcuccagcgacccgacggugcagcgcuccguguucgccagcgucgacaaggugcccggggagcccgcgccccggccggcgccccagcuggugcaccacggcgggcgcagccgguccuucagccuguggucccugugcgagcugcccuuccucagccagaagccccgccggcuggccgccccggccuccuga

SEQ ID NO: 28374 - RNA, 591 nt, Artificial Sequence
  derived and/or modified sequence opt1 from CLEC1B__Homo_sapiens__NP_001092901
augcaggacgaggacggcuacaucacccugaacaucaagacccgcaagcccgcccucaucagcgccgugaugcagcggaacuaccugcagggggagaacgagaaccgcacgggcacccugcagcagcucgcgaagcgguucugccaguacgucgugaagcaguccgagcugaaggggaccuucaagggccacaagugcagcccgugcgacaccaacuggcgcuacuacggggacuccugcuacggcuucuuccggcacaaccugacgugggaggagagcaagcaguacugcaccgacaugaacgccacccuccugaagaucgacaaccgcaacaucguggaguacaucaaggcccggacccaccugauccgcugggucggccucucccggcagaaguccaacgagguguggaagugggaggacgggagcgugaucagcgagaacauguucgaguuccuggaggacggcaaggggaacaugaacugcgccuacuuccacaacggcaagaugcaccccacguucugcgagaacaagcacuaccugaugugcgagcgcaaggccgggaugaccaaggucgaccagcuccccuga

SEQ ID NO: 28375 - RNA, 525 nt, Artificial Sequence
  derived and/or modified sequence opt1 from CLEC2A__Homo_sapiens__NP_001124183
augaucaaccccgagcugcgcgacggccgggccgacggguucauccaccgcaucgugccgaagcucauccagaacuggaagaucggccugaugugcuuccugagcaucaucaucaccaccgucugcaucaucaugaucgccacgugguccaagcacgcgaagcccguggccugcagcggggacuggcucggcgugcgggacaagugcuucuacuucuccgacgacacccgcaacuggaccgccagcaagaucuucugcucccugcagaaggccgagcuggcccagaucgacacccaggaggacauggaguuccucaagcgguacgcggggacggacaugcacuggaucggccugagccgcaagcagggcgacuccuggaaguggaccaacgggaccaccuucaacggcugguucgagaucaucgggaacggcagcuucgccuuccuguccgccgacgggguccacagcucccggggcuucaucgacaucaaguggaucugcagcaagcccaaguacuuccucuga

SEQ ID NO: 28376 - RNA, 450 nt, Artificial Sequence
  derived and/or modified sequence opt1 from CLEC2B__Homo_sapiens__NP_005118
augaugaccaagcacaagaagugcuucaucaucgugggcguccugaucaccacgaacaucaucacccucaucgugaagcugacccgcgacagccagucccugugccccuacgacuggaucggguuccagaacaagugcuacuacuucagcaaggaggagggcgacuggaacuccagcaaguacaacugcuccacccagcacgccgaccucacgaucaucgacaacaucgaggagaugaacuuccugcggcgcuacaagugcagcuccgaccacuggaucgggcugaagauggccaagaaccggaccggccaguggguggacggggcgaccuucaccaagagcuucggcaugcgcggcuccgaggggugcgccuaccucagcgacgacggcgccgccacggcccggugcuacaccgagcgcaaguggaucugccggaagcgcauccacuga

SEQ ID NO: 28377 - RNA, 585 nt, Artificial Sequence
  derived and/or modified sequence opt1 from CLEC2D__Homo_sapiens__NP_001004419
augcacgacagcaacaacguggagaaggacaucacccccuccgagcugccggccaaccccggcugccuccacagcaaggagcacuccaucaaggccacccugaucuggcgccuguucuuccucaucauguuccugacgaucaucgucugcgggaugguggcggcccugagcgccauccgggccaacugccaccaggagcccuccgugugccuccaggccgcgugccccgagagcuggaucggcuuccagcgcaagugcuucuacuucuccgacgacaccaagaacuggaccagcucccagcgguucugcgacagccaggacgccgaccuggcccaggucgaguccuuccaggagcugaacuuccuccugcgcuacaaggggccgagcgaccacuggaucggccugucccgggagcaggggcagcccuggaaguggaucaacggcaccgaguggacgcgccagcucgugaugaaggaggacggcgccaaccuguacguggcgaaggucagccaggugccccggaugaacccccgcccggugauggucuccuaccccgggagccggcgcgugugccuguucgaguga

SEQ ID NO: 28378 - RNA, 645 nt, Artificial Sequence
  derived and/or modified sequence opt1 from CLEC2L__Homo_sapiens__NP_001073980
auggagcccgcccgcgagccgcccagccgggcccgcccgcccccgccccuggcggcccggcccgcccccgccccggccgcgccccgcccccggucccccgccgaggccgaggcccgcggcccggaggggcuccugcggcgcagcggcuccggguacgagggcagcaccuccuggaaggcggcccuggaggacaccacgacccggcuccugcugggggccaucgccgugcuccuguucgccauccuggucgugaugagcauccucgcguccaagggcugcaucaagugcgaggcccccugccccgaggacuggcugcuguacggccgcaagugcuacuucuucagcgaggagccccgggacuggaacaccgggcgccaguacugccacacccacgaggccgugcucgccgucauccagucccagaaggagcuggaguucauguucaaguucacgcggcgcgagcccuggaucggccugcggcgcgugggggacgaguuccacugggugaacggcgaccccuucgaccccgacaccuucaccaucgccgggcccggcgagugcgucuucguggagccgacccggcucgugagcacggagugccugaugacccgccccugggucugcuccaagauggcguacaccuga

SEQ ID NO: 28379 - RNA, 609 nt, Artificial Sequence
  derived and/or modified sequence opt1 from CLEC3B__Homo_sapiens__NP_003269
auggagcuguggggcgccuaccuccugcugugccucuucagccugcugacccaggugaccacggagcccccgacccagaagcccaagaagaucgucaacgccaagaaggacguggugaacaccaagauguucgaggagcucaagucccgccuggacacccuggcgcaggaggucgcccuccugaaggagcagcaggcccugcagacggugugccucaaggggaccaaggugcacaugaagugcuuccuggccuucacccagaccaagacguuccacgaggccagcgaggacugcaucucccggggcgggacccugggcacgccccagaccgggagcgagaacgacgcgcucuacgaguaccugcgccaguccgucggcaacgaggccgagaucuggcugggccucaacgacauggccgccgaggggaccuggguggacaugaccggcgcgcggaucgccuacaagaacugggagaccgagaucaccgcccagcccgacgggggcaagacggagaacugcgccgugcugagcggggccgcgaacggcaagugguucgacaagcgcugccgggaccagcugccguacaucugccaguucggcaucgucuga

SEQ ID NO: 28380 - RNA, 714 nt, Artificial Sequence
  derived and/or modified sequence opt1 from CLEC4A__Homo_sapiens__NP_057268
augaccagcgagaucaccuacgccgaggugcgcuucaagaacgaguucaaguccagcggcaucaacacggccuccagcgcggccuccaaggagcggaccgcgccccacaagagcaacaccggguucccgaagcugcucugcgccucccugcugaucuucuuccuccugcuggccaucagcuucuucaucgccuucgucaucuucuuccagaaguacucccagcuccuggagaagaagaccacgaaggagcuggugcacaccacccucgagugcgugaagaagaacaugcccgucgaggagaccgccuggagcugcugccccaagaacuggaaguccuucagcuccaacugcuacuucaucagcacggaguccgccagcuggcaggacuccgagaaggacugcgcccgcauggaggcgcaccuccuggugaucaacacccaggaggagcaggacuucaucuuccagaaccugcaggaggagagcgccuacuucgugggccuguccgaccccgaggggcagcggcacuggcagugggucgaccagaccccguacaacgagagcagcaccuucuggcacccccgcgagcccuccgaccccaacgagcggugcguggugcugaacuuccgcaagagcccgaagcgguggggcuggaacgacgucaacugccucgggccccagcgcuccgugugcgagaugaugaagauccaccuguga

SEQ ID NO: 28381 - RNA, 642 nt, Artificial Sequence
  derived and/or modified sequence opt1 from CLEC4C__Homo_sapiens__NP_569708
auggugcccgaggaggagccgcaggaccgcgagaagggccuguggugguuccagcucaaggucuggagcauggccgugguguccauccugcugcucagcgucugcuucaccguguccagcguggucccccacaacuucauguacuccaagaccgugaagcggcugagcaagcugcgcgaguaccagcaguaccaccccucccucacgugcgugauggaggggaaggacaucgaggacuggagcugcugccccaccccguggaccuccuuccagagcuccugcuacuucaucagcaccggcaugcaguccuggaccaagagccagaagaacugcuccgucaugggggccgaccugguggugaucaacacgcgggaggagcaggacuucaucauccagaaccugaagcgcaacagcuccuacuuccucggccugagcgaccccgggggccggcgccacuggcagugggucgaccagacccccuacaacgagaacgugaccuucuggcacuccggcgagcccaacaaccuggacgagcggugcgcgaucaucaacuuccgcagcagcgaggaguggggguggaacgacauccacugccacgugccgcagaaguccaucugcaagaugaagaagaucuacaucuga

SEQ ID NO: 28382 - RNA, 648 nt, Artificial Sequence
  derived and/or modified sequence opt1 from CLEC4D__Homo_sapiens__NP_525126
augggccuggagaagccccagagcaagcucgagggcgggaugcacccgcagcugauccccuccgugaucgccgucguguucauccugcuccugagcgugugcuucaucgccuccugccuggucacccaccacaacuucagccgcugcaagcgggggaccggcgugcacaagcucgagcaccacgcgaagcugaagugcaucaaggagaaguccgagcucaagagcgccgagggguccacguggaacugcugccccaucgacuggcgcgccuuccagagcaacugcuacuucccccugaccgacaacaagaccugggccgaguccgagcggaacugcagcggcaugggcgcccaccugaugaccaucuccacggaggcggagcagaacuucaucauccaguuccuggaccgccggcucagcuacuuccuggggcugcgcgacgagaacgccaagggccaguggcgguggguggaccagaccccguucaacccccgccgggucuucuggcacaagaacgagcccgacaacucccagggggagaacugcguggugcucgucuacaaccaggacaagugggccuggaacgacgugcccugcaacuucgaggccagccgcaucugcaagaucccgggcaccacccugaacuga

SEQ ID NO: 28383 - RNA, 660 nt, Artificial Sequence
  derived and/or modified sequence opt1 from CLEC4E__Homo_sapiens__NP_055173
augaacagcuccaagagcuccgagacccagugcaccgagcgcgggugcuucagcucccagauguuccuguggacgguggccgggauccccauccucuuccugagcgccugcuucaucacccggugcgucgugaccuuccgcaucuuccagaccugcgacgagaagaaguuccagcugccggagaacuucacggagcucuccugcuacaacuacggcagcggguccgugaagaacugcugcccccugaacugggaguacuuccagagcuccugcuacuucuucagcaccgacaccaucuccugggcgcugagccucaagaacugcuccgccaugggcgcccaccuggucgugaucaacagccaggaggagcaggaguuccuguccuacaagaagcccaagaugcgggaguucuucaucgggcucagcgaccagguggucgagggccaguggcaguggguggacggcacgccccugaccaagucccugagcuucugggacgugggggagccgaacaacaucgccacccucgaggacugcgccaccaugcgcgacagcuccaacccccggcagaacuggaacgacgugaccugcuuccugaacuacuuccgcaucugcgagauggucggcaucaacccccugaacaagggcaagagccucuga

SEQ ID NO: 28384 - RNA, 846 nt, Artificial Sequence
  derived and/or modified sequence opt1 from CLEC4G__Homo_sapiens__NP_001231785
auggacaccacccgcuaccggcccuggggccgcugggugcacuggagccggcgcccgcuguuccucgcccuggccguccuggugacgaccgugcucugggcggucauccuguccauccugcucagcaaggccuccaccgagcgggccgcccugcuggacgggcacgaccuccugcgcaccaacgccagcaagcagacggcggcccugggcgcccucaaggaggaggugggggacugccacuccugcugcagcggcacccaggcccagcugcagaccacccgggcggagcugggggaggcccaggccaagcucauggagcaggaguccgcccugcgcgagcugcgggagcgcgugacgcagggccucgccgaggcgggccgggggcgcgaggacguccggaccgagcuguuccgcgcccuggaggccgugcggcuccagaacaacagcugcgagcccugccccaccuccuggcugagcuucgagggcuccugcuacuucuucagcgugcccaagaccacgugggccgccgcgcaggaccacugcgccgacgccuccgcccaccuggucaucgucgggggccucgacgagcagggguuccugacccgcaacacccggggccgcggcuacuggcuggggcuccgggccgugcgccaccugggcaaggugcagggguaccaguggguggacggcgugagccuguccuucagccacuggaaccagggcgagccgaacgacgcgugggggcgggagaacugcgucaugaugcuccacaccggccuguggaacgacgcccccugcgacuccgagaaggacggguggaucugcgagaagcgccacaacugcuga

SEQ ID NO: 28385 - RNA, 1047 nt, Artificial Sequence
  derived and/or modified sequence opt1 from CLEC4M__Homo_sapiens__NP_001138376
augagcgacuccaaggagccccgcgugcagcagcugggccuccuggggugccugggccacggggcccucguccugcagcugcucagcuucaugcugcuggccggcgugcucguggcgauccugguccagguguccaaggugccgagcucccugagccaggagcaguccgagcaggacgccaucuaccagaaccucacccagcugaaggccgccgucggggagcugagcgagaaguccaagcuccaggagaucuaccaggagcugacccagcugaaggccgcggugggcgagcuccccgagaaguccaagcugcaggagaucuaccaggagcugacgcggcucaaggccgccgugggcgagcugcccgagaaguccaagcugcaggagaucuaccaggagcucacccgccugaaggccgcggucggggagcugcccgagaaguccaagcuccaggagaucuaccaggagcugaccgagcugaaggccgccgugggcgagcucccggagaaguccaagcugcaggagaucuaccaggagcugacccagcucaaggccgccgugggggagcugcccgaccagagcaagcagcagcagaucuaccaggagcugacggaccucaagaccgcguucgagcggcugugccgccacugccccaaggacuggaccuucuuccagggcaacugcuacuucaugagcaacagccagcggaacuggcacgacuccgucaccgccugccaggaggugcgcgcccagcugguggucaucaagacggccgaggagcagaacuuccuccagcugcagaccagccgguccaaccgcuucagcuggauggggcugagcgaccucaaccaggagggcaccuggcaguggguggacggcagcccccugagcccguccuuccagcgguacuggaacagcggggagcccaacaacuccggcaacgaggacugcgccgaguucagcggguccggcuggaacgacaaccgcugcgacguggacaacuacuggaucugcaagaagcccgcggccugcuuccgggacgaguga

SEQ ID NO: 28386 - RNA, 567 nt, Artificial Sequence
  derived and/or modified sequence opt1 from CLEC5A__Homo_sapiens__NP_037384
augaacuggcacaugaucaucagcggccugaucguggucgugcucaagguggucgggaugacccuguuccugcucuacuucccccagaucuucaacaaguccaacgacggcuucaccacgacccgcagcuacgggaccgugucccagaucuucggcagcuccagcccgucccccaacggguucaucaccacgcggagcuacggcaccgugugccccaaggacugggaguucuaccaggcccgcugcuucuuccuguccaccagcgaguccagcuggaacgagucccgggacuucugcaagggcaaggggagcacccuggccaucgucaacacgcccgagaagcucaaguuccugcaggacaucaccgacgcggagaaguacuucaucggccugaucuaccaccgcgaggagaagcgguggcgcuggaucaacaacuccguguucaacgggaacgugaccaaccagaaccagaacuucaacugcgccaccaucggccucacgaagaccuucgacgccgccagcugcgacaucuccuaccggcgcaucugcgagaagaacgccaaguga

SEQ ID NO: 28387 - RNA, 630 nt, Artificial Sequence
  derived and/or modified sequence opt1 from CLEC6A__Homo_sapiens__NP_001007034
augaugcaggagcagcagccccagagcaccgagaagcgcggcuggcugucccuccggcuguggagcguggccgggaucuccaucgcccugcucagcgcgugcuucaucgucuccugcguggugaccuaccacuucacguacggcgagaccgggaagcgccugagcgagcugcacuccuaccacagcucccugaccugcuucagcgagggcaccaaggucccggccugggggugcugccccgccuccuggaaguccuucggcagcagcugcuacuucaucuccagcgaggagaaggugugguccaagagcgagcagaacugcguggagaugggcgcccaccucgucguguucaacacggaggccgagcagaacuucaucgugcagcagcugaacgaguccuucagcuacuuccucgggcugagcgacccccagggcaacaacaacuggcaguggaucgacaagacccccuacgagaagaacguccgguucuggcaccugggggagccgaaccacuccgcggagcagugcgccagcaucguguucuggaagcccaccggcuggggguggaacgacgugaucugcgagacccgccggaacuccaucugcgagaugaacaagaucuaccucuga

SEQ ID NO: 28388 - RNA, 606 nt, Artificial Sequence
  derived and/or modified sequence opt1 from CLEC7A__Homo_sapiens__NP_072092
auggaguaccaccccgaccuggagaaccucgacgaggacggcuacacccagcugcacuucgacagccaguccaacacccgcaucgccguggucagcgagaagggguccugcgccgcgagcccgcccuggcggcugaucgccgugauccucggcauccugugccuggugauccucgucaucgccguggugcuggggacgaugggcguccuguccagccccugcccgcccaacuggaucaucuacgagaaguccugcuaccucuucagcaugucccugaacagcugggacggguccaagcgccagugcuggcagcugggcagcaaccuccugaagaucgacuccagcaacgagcugggcuucaucgugaagcaggucuccagccagcccgacaacuccuucuggaucgggcucagccggccccagaccgaggugcccuggcugugggaggacggcuccaccuucagcagcaaccuguuccagauccgcaccacggccacccaggagaacccgucccccaacugcguguggauccacgugagcgucaucuacgaccagcucugcuccgugcccagcuacuccaucugcgagaagaaguucagcauguga

SEQ ID NO: 28389 - RNA, 726 nt, Artificial Sequence
  derived and/or modified sequence opt1 from CLEC9A__Homo_sapiens__NP_997228
augcacgaggaggagaucuacaccagccugcagugggacucccccgccccggacaccuaccagaagugccucagcuccaacaagugcagcggcgccugcugccuggugauggugaucuccugcguguucugcauggggcugcucacggcgagcaucuuccugggcgugaagcugcuccaggucuccaccaucgccaugcagcagcaggagaagcugauccagcaggagcgcgcccugcucaacuucaccgaguggaagcggagcugcgcccugcagaugaaguacugccaggccuucaugcagaacucccugagcuccgcgcacaacagcucccccugccccaacaacuggauccagaaccgcgagagcugcuacuacguguccgagaucuggagcaucuggcacaccucccaggagaacugccucaaggaggggagcacgcugcugcagaucgaguccaaggaggagauggacuucaucaccggcagccuccggaagaucaaggggagcuacgacuacugggugggccugucccaggacggccacagcgggcgcuggcuguggcaggacggcuccagccccuccccggggcuccugcccgccgagcggagccaguccgccaaccaggucugcggcuacgucaagagcaacucccugcucagcuccaacugcagcaccuggaaguacuucaucugcgagaaguacgcccugcgcuccagcguguga

SEQ ID NO: 28390 - RNA, 576 nt, Artificial Sequence
  derived and/or modified sequence opt1 from CLECL1__Homo_sapiens__NP_001240679
auggugagcaacuucuuccacgucauccagguguucgagaaguccgccacccugaucagcaagaccgagcacaucggcuucgugaucuacuccuggcgcaagagcacgacccaccucgggucccggcgcaaguucgccaucagcaucuaccuguccgaggucagccugcagaaguacgacugccccuucuccggcaccagcuucgugguguucucccucuuccugaucugcgcgauggccggggacgucguguacgccgacaucaagaccgugcggacgagcccgcuggagcucgccuucccccugcagcgcuccgucagcuucaacuucuccaccgugcacaagagcugccccgccaaggacuggaaggugcacaagggcaagugcuacuggaucgcggagaccaagaaguccuggaacaagagccagaacgacugcgccaucaacaacuccuaccugauggucauccaggacaucaccgccaugcucaucacguuccugcuguaccuccagauggccuuccugcagugcguguacaucagcgacgugagcgucuaccccaacuucuuccuguga

SEQ ID NO: 28391 - RNA, 1833 nt, Artificial Sequence
  derived and/or modified sequence opt1 from CLGN__Homo_sapiens__NP_004353
augcacuuccaggccuucuggcugugccucggccugcuguucaucagcaucaacgccgaguucauggacgacgacguggagaccgaggacuucgaggagaacuccgaggagaucgacgucaacgagagcgagcucuccagcgagaucaaguacaagacgccccagccgaucggggagguguacuucgcggagaccuucgacuccggccgccuggccgggugggugcugagcaaggccaagaaggacgacauggacgaggagaucuccaucuacgacggccggugggagaucgaggagcucaaggagaaccagguccccggggaccgcggccuggugcucaagagccgggccaagcaccacgccaucuccgcggugcuggccaagcccuucaucuucgccgacaagccccugaucguccaguacgaggugaacuuccaggacggcaucgacugcgggggcgccuacaucaagcugcucgcggacaccgacgaccugauccuggagaacuucuacgacaagaccagcuacaucaucauguucgggccggacaagugcggcgaggacuacaagcuccacuucaucuuccgccacaagcaccccaagaccgggguguucgaggagaagcacgccaagccgcccgacgucgaccugaagaaguucuucacggaccggaagacccaccuguacacccucgugaugaaccccgacgacaccuucgaggugcuggucgaccagacgguggugaacaagggcucccugcucgaggacgucgugccgcccaucaagccgcccaaggagaucgaggaccccaacgacaagaagcccgaggagugggacgagcgcgccaagauccccgaccccagcgccgugaagcccgaggacugggacgaguccgagcccgcccagaucgaggacagcuccgucgugaagcccgcgggcuggcuggacgacgagccgaaguucauccccgaccccaacgccgagaagcccgacgacuggaacgaggacaccgacggggagugggaggccccgcagauccugaaccccgccugccggaucggcugcggggaguggaagccgcccaugaucgacaaccccaaguacaagggcguguggcgcccgccccucgucgacaaccccaacuaccagggcaucuggagcccccggaagauccccaaccccgacuacuucgaggacgaccacccguuccugcugaccuccuucagcgcccucgggcuggagcugugguccaugaccagcgacaucuacuucgacaacuucaucaucugcagcgagaaggagguggcggaccacugggccgccgacggcuggcgcuggaagaucaugaucgccaacgccaacaagcccggggugcucaagcagcugauggcggccgccgagggccaccccuggcuguggcucaucuaccuggucacggccggggugcccaucgcccugaucaccuccuucugcuggccgcggaaggucaagaagaagcacaaggacaccgaguacaagaagaccgacaucugcaucccccagacgaagggcgugcucgagcaggaggagaaggaggagaaggcggcccuggagaagcccauggaccuggaggaggagaagaagcagaacgacggcgagaugcucgagaaggaggaggagagcgagcccgaggagaaguccgaggaggagaucgagaucaucgaggggcaggaggagagcaaccaguccaacaagagcggcuccgaggacgagaugaaggaggccgacgagagcaccggguccggcgacgggccgaucaagagcgugcgcaagcggcgcguccggaaggacuga

SEQ ID NO: 28392 - RNA, 726 nt, Artificial Sequence
  derived and/or modified sequence opt1 from CLIC1__Homo_sapiens__NP_001279
auggccgaggagcagccccagguggagcuguucgucaaggccggcagcgacggggcgaagaucggcaacugcccguucucccagcgccucuucauggugcuguggcugaagggggugaccuucaacgucaccacgguggacaccaagcggcgcaccgagaccgugcagaagcucugccccggcgggcagcugcccuuccugcucuacggcacggagguccacaccgacaccaacaagaucgaggaguuccuggaggccgugcugugcccgccccgguaccccaagcucgccgcccugaaccccgagagcaacaccgccggccuggacaucuucgcgaaguucuccgccuacaucaagaacagcaaccccgcccucaacgacaaccuggagaaggggcugcucaaggcccugaaggugcuggacaacuaccucacguccccgcugcccgaggaggucgacgagaccagcgcggaggacgagggcgugucccagcgcaaguuccuggacgggaacgagcucacccuggccgacugcaaccugcuccccaagcugcacaucgugcaggucgugugcaagaaguaccggggcuucaccauccccgaggccuuccgcggggugcaccgguaccugagcaacgccuacgcccgcgaggaguucgcguccacgugcccggacgacgaggagaucgagcucgccuacgagcaggucgccaaggcccugaaguga

SEQ ID NO: 28393 - RNA, 711 nt, Artificial Sequence
  derived and/or modified sequence opt1 from CLIC3__Homo_sapiens__NP_004660
auggccgagaccaagcugcagcuguucgugaaggccagcgaggacggcgaguccgucgggcacugccccagcugccagcgccucuucauggugcugcuccugaagggcgugccguucacccugaccaccgucgacacccggcgcucccccgacgugcucaaggacuucgcgcccgggagccagcugcccauccugcucuacgacuccgacgccaagaccgacacgcugcagaucgaggacuuccuggaggagacccucggcccgcccgacuuccccagccuggcgccccgguaccgcgaguccaacaccgccgggaacgacguguuccacaaguucagcgccuucaucaagaacccgguccccgcccaggacgaggcccuguaccagcagcuccugcgggcccuggcccgccucgacuccuaccugcgggcgccccuggagcacgagcucgccggcgagccccagcugcgcgagagccggcgccgguuccuggacggcgaccgccucacccuggccgacugcucccugcucccgaagcugcacaucguggacacggugugcgcccacuuccggcaggcccccauccccgcggagcugcgcgggguccggcgcuaccucgacagcgccaugcaggagaaggaguucaaguacacgugcccccacuccgccgagauccuggccgccuaccggccggcggugcacccccgcuga

SEQ ID NO: 28394 - RNA, 1233 nt, Artificial Sequence
  derived and/or modified sequence opt1 from CLIC5__Homo_sapiens__NP_001107558
augaacgacgaggacuacagcaccaucuacgacaccauccagaacgagcgcacguacgaggugcccgaccagccggaggagaacgagagcccccacuacgacgacguccacgaguaccugcggcccgagaacgaccucuacgccacccagcugaacacccacgaguacgacuucguguccguguacaccaucaagggcgaggagacgucccuggccagcguccaguccgaggaccgcggguaccuccugcccgacgagaucuacagcgagcugcaggaggcgcacccgggcgagccccaggaggaccgggggaucuccauggagggccucuacagcuccacccaggaccagcagcugugcgccgccgagcugcaggagaacgggagcgugaugaaggaggaccuccccucccccagcuccuucaccauccagcacagcaaggccuucuccaccacgaaguacagcugcuacuccgacgccgagggccuggaggagaaggagggcgcgcacaugaacccggagaucuaccuguucgugaaggccgggaucgacggcgagagcaucgggaacugccccuucucccagcgccucuucaugauccuguggcugaagggcgucguguucaacgugaccaccgucgaccucaagcggaagcccgccgaccugcacaaccuggcccccgggacccacccgcccuuccucacguucaacggcgacgugaagaccgacgugaacaagaucgaggaguuccuggaggagacccugacccccgagaaguaccccaagcucgcggccaagcaccgcgagagcaacacggccggcaucgacaucuucagcaaguucuccgccuacaucaagaacaccaagcagcagaacaacgccgcgcuggagcgggggcugaccaaggcccucaagaagcuggacgacuaccugaacaccccgcuccccgaggagaucgacgccaacacgugcggcgaggacaaggggagccgccggaaguuccuggacggcgacgagcugacccucgccgacugcaaccugcugcccaagcuccacgucgugaagaucguggccaagaaguaccgcaacuacgacauccccgcggagaugaccggccuguggcgguaccugaagaacgccuacgcccgcgacgaguucaccaacacgugcgccgccgacuccgagaucgagcucgcguacgccgacgucgccaagcggcugagccgcuccuga

SEQ ID NO: 28395 - RNA, 2061 nt, Artificial Sequence
  derived and/or modified sequence opt1 from CLIC6__Homo_sapiens__NP_444507
auggccgaggccgcggagcccgagggcguggccccggggccccagggcccgcccgagguccccgcgccccuggccgagcgccccggggagcccggcgccgccgggggcgaggccgagggcccggaggggagcgagggcgccgaggaggcgccccgcggggccgccgccgugaaggaggccggcgggggcggccccgaccgggggcccgaggccgaggcgcggggcacccgcggggcccacggcgagaccgaggccgaggagggcgccccggagggggccgaggugccccagggcggggaggagaccuccggcgcgcagcaggucgagggggccagccccggccggggcgcccagggggagccccgcggcgaggcccagcgggagccggaggacuccgccgcgcccgagcgccaggaggaggccgagcagcggcccgaggugcccgaggggagcgccuccggcgaggccggggacagcguggacgccgagggcccgcucggcgacaacaucgaggcggaggggcccgccggcgacuccgucgaggccgaggggcgcgugggcgacagcguggacgccgaggggcccgcgggcgacuccgucgacgccgagggcccccugggggacaacauccaggccgagggcccggccggggacagcguggacgccgagggccgggugggcgacuccgucgacgcggaggggcccgccggcgacagcguggacgccgaggggcgcgugggcgacuccgucgaggccggggaccccgccggcgacggcguggaggcgggggugcccgccggcgacagcgucgaggccgaggggccggccggcgacuccauggacgccgaggggcccgcgggccgggcccgccgggugagcggcgagccccagcaguccggggacggcagccuguccccgcaggccgaggccaucgagguggcggccggggagagcgccggccgcagccccggggagcucgccugggacgccgcggaggaggccgagguccccggcgugaagggcuccgaggaggccgcccccggggacgcccgggcggacgccggcgaggaccgcgugggggacggcccgcagcaggagcccggggaggacgaggagcggcgcgagcggagccccgagggcccccgcgaggaggaggccgccggcggggaggaggaguccccggacagcagcccccacggcgaggccucccgcggggcggccgagcccgaggcccagcuguccaaccaccuggccgaggagggccccgcggagggcagcggggaggccgcccgggucaacggccgccgggaggacggggaggccuccgagccgcgcgcccucggccaggagcacgacaucacccuguucgugaaggcgggguacgacggcgagagcaucggcaacugccccuucucccagcggcuguucaugauccucuggcugaagggggucaucuucaacgugaccaccguggaccugaagcgcaagcccgccgaccuccagaaccuggcccccggcacgaacccgcccuucaugaccuucgacggggaggucaagaccgacgugaacaagaucgaggaguuccuggaggagaagcucgccccgccccgguaccccaagcugggcacccagcaccccgagagcaacuccgccgggaacgacguguucgcgaaguucagcgccuucaucaagaacacgaagaaggacgccaacgagauccacgagaagaaccugcucaaggcccugcgcaagcuggacaacuaccucaacagcccccugcccgacgagaucgacgccuacuccaccgaggacgucaccguguccggccggaaguuccuggacggcgacgagcucacccuggcggacugcaaccugcucccgaagcugcacaucaucaagaucguggccaagaaguaccgcgacuucgaguuccccagcgagaugacggggaucuggcgguaccugaacaacgccuacgcccgcgacgaguucaccaacacgugccccgccgaccaggagaucgagcacgcguacuccgacgucgccaagcggaugaaguga

SEQ ID NO: 28396 - RNA, 1932 nt, Artificial Sequence
  derived and/or modified sequence opt1 from CLINT1__Homo_sapiens__NP_001182484
augcugaacauguggaaggugcgcgagcucgucgacaaggccaccaacguggugaugaacuacagcgagaucgaguccaagguccgggaggccaccaacgacgaccccuggggcccgagcgggcagcugaugggcgagaucgcgaaggccacguucauguacgagcaguuccccgagcugaugaacaugcucuggucccgcaugcugaaggacaacaagaagaacuggcggcgcguguacaagagccugcuccugcuggccuaccucauccggaacggguccgagcgcguggucaccagcgcccgggagcacaucuacgaccugcgcucccuggagaacuaccacuucguggacgagcacggcaaggaccaggggaucaacauccggcagaaggugaaggagcucgucgaguucgcccaggacgacgaccgccugcgggaggagcgcaagaaggcgaagaagaacaaggacaaguacgugggcgugagcuccgacagcgucggcggguuccgguacuccgagcgcuacgaccccgagcccaagagcaagugggacgaggagugggacaagaacaaguccgccuucccguucagcgacaagcugggcgagcucuccgacaagaucgggagcaccaucgacgacaccaucuccaaguuccggcgcaaggaccgggaggacagccccgagcgcugcuccgacagcgacgaggagaagaaggcccggcgcggccggagccccaagggggaguucaaggacgaggaggagacggugaccaccaagcacauccacaucacccaggccacggagaccaccaccacgcgccacaagcgcaccgcgaaccccuccaagaccaucgaccugggcgccgccgcccacuacaccggcgacaaggccagcccggaccagaacgcguccacgcacacgccccagagcuccgugaagaccagcguccccuccagcaaguccagcggggaccugguggaccucuucgacggcaccucccagagcaccgggggcuccgccgaccuguucggcggguucgccgacuucggcagcgccgccgcguccgggagcuuccccucccaggugaccgccaccagcggcaacggggacuucggcgacugguccgccuucaaccaggccccgagcggccccgucgccagcuccggggaguucuucggcagcgcgucccagcccgccguggagcuggugagcgggucccagagcgcccucgggcccccgcccgccgccuccaacagcuccgaccuguucgaccugaugggcagcucccaggcgaccaugacgagcucccagagcaugaacuucuccaugaugagcaccaacaccgucggccucggccugcccaugucccggagccagccccugcagaacgugagcaccgugcuccagaagccgaacccccuguacaaccagaacacggacaugguccagaaguccgugagcaagacccugcccuccaccuggagcgaccccuccgucaacaucagccucgacaaccugcugccggggaugcagcccuccaagccccagcagcccagccucaacaccaugauccagcagcagaacaugcagcagccgaugaacgugaugacgcaguccuucggcgccgugaaccugagcucccccagcaacaugcugcccguccgcccgcagaccaacgcccucaucgggggccccaugcccauguccaugcccaacgugaugaccgggaccaugggcauggccccgcugggcaacacgcccaugaugaaccagagcaugauggggaugaacaugaacaucggcauguccgcggccgggaugggccugaccggcaccauggggaugggcaugcccaacaucgccaugaccagcgggaccgugcagcccaagcaggacgccuucgccaacuucgcgaacuucuccaaguga

SEQ ID NO: 28397 - RNA, 4317 nt, Artificial Sequence
  derived and/or modified sequence opt1 from CLIP1__Homo_sapiens__NP_001234926
augagcaugcugaagcccuccggccucaaggccccgaccaagauccugaagcccgggagcaccgcccugaagacgcccaccgcgguggucgcccccguggagaagaccaucuccagcgagaaggccuccagcaccccguccagcgagacgcaggaggaguucguggacgacuuccgcgucggcgagcgggugugggugaacgggaacaagcccggcuucauccaguuccucggggagacccaguucgcccccggccagugggccggcaucguccuggacgagcccaucgggaagaacgacggcuccguggcgggggugcgcuacuuccagugcgagccgcugaagggcaucuucacccggcccagcaagcucacccgcaagguccaggccgaggacgaggccaacgggcugcagacgacccccgccucccgggcgaccagcccccugugcaccuccacggccagcaugguguccagcuccccgagcacccccuccaacaucccccagaagcccagccagccggccgccaaggagcccagcgccaccccgcccaucuccaaccucaccaagacggcgagcgaguccaucagcaaccuguccgaggccggcagcaucaagaagggcgagcgcgagcugaagaucggggaccgggugcucgucggcgggaccaaggccggcguggugcgcuuccugggcgagaccgacuucgccaagggggaguggugcggcgucgagcuggacgagccccucgggaagaacgacggcgccguggcggggacccgguacuuccagugccagcccaaguacggccuguucgcccccgugcacaaggucacgaagaucggcuuccccuccaccaccccggccaaggccaaggccaacgcggugcgccgggugauggccaccacgagcgccucccugaagcgcagccccuccgccagcucccucagcuccaugagcuccgucgccagcuccgugagcagccggcccucccgcaccgggcugcugaccgagaccagcucccgguacgcgcgcaagaucagcggcacgaccgcccuccaggaggcccugaaggagaagcagcagcacaucgagcagcugcucgccgagcgggaccuggagcgcgcggagguggccaaggccaccucccacgucggggagaucgagcaggagcuggcccucgcccgggacggccacgaccagcacgugcuggagcuggaggcgaagauggaccagcuccgcaccauggucgaggccgccgaccgggagaagguggagcugcugaaccagcucgaggaggagaagcgcaagguggaggaccugcaguuccgcgucgaggaggagagcaucacgaagggggaccuggagcagaagucccagaucagcgaggaccccgagaacacccagaccaagcucgagcacgcccggaucaaggagcuggagcagucccuccuguucgagaagaccaaggccgacaagcugcagcgcgagcuggaggacacgcggguggcgaccgugagcgagaagucccgcaucauggagcucgagaaggaccuggcccugcggguccaggagguggccgagcuccgccggcgccuggagagcaacaagccggccggcgacguggacaugucccugagccuccugcaggagaucuccagccugcaggagaagcuggaggucacccggaccgaccaccagcgcgagaucaccucccucaaggagcacuucggcgcccgggaggagacgcaccagaaggagaucaaggcgcuguacaccgccaccgagaagcugagcaaggagaacgagagccucaaguccaagcuggagcacgccaacaaggagaacagcgacgugaucgcccuguggaaguccaagcucgagaccgcgaucgccagccaccagcaggccauggaggagcugaagguguccuucagcaaggggcugggcacggagaccgccgaguucgccgagcucaagacccagaucgagaagaugcgccuggacuaccagcacgagaucgagaaccugcagaaccagcaggacuccgagcgggcggcccacgccaaggagauggaggcccuccgcgccaagcugaugaaggucaucaaggagaaggagaacagccuggaggcgauccgguccaagcucgacaaggccgaggaccagcaccugguggagauggaggacacccugaacaagcuccaggaggccgagaucaaggugaaggagcuggagguccugcaggccaagugcaacgagcagacgaaggugaucgacaacuucaccagccagcucaaggccaccgaggagaagcugcuggaccucgacgcgcugcgcaaggccuccagcgaggggaaguccgagaugaagaagcugcggcagcagcucgaggccgccgagaagcagaucaagcaccuggagaucgagaagaacgcggagagcuccaaggccagcuccaucacccgcgagcugcagggccgggagcucaagcugacgaaccugcaggagaaccucagcgaggugucccaggucaaggagacccuggagaaggagcugcagauccucaaggagaaguucgccgaggccagcgaggaggccgugagcgugcagcgcuccaugcaggagaccgucaacaagcugcaccagaaggaggagcaguucaacaugcugagcuccgaccucgagaagcugcgcgagaaccuggcggacauggaggccaaguuccgggagaaggacgagcgcgaggagcagcucaucaaggccaaggagaagcuggagaacgacaucgccgagaucaugaagaugagcggggacaacuccagccagcugaccaagaugaacgacgagcuccggcugaaggagcgcgacguggaggagcugcagcucaagcugacgaaggccaacgagaacgcguccuuccugcagaaguccaucgaggacaugaccgugaaggccgagcagagccagcaggaggccgccaagaagcacgaggaggagaagaaggagcucgagcggaagcugagcgaccuggagaagaagauggagaccucccacaaccagugccaggagcucaaggcccgcuacgagcgggcgaccagcgagacgaagaccaagcacgaggagauccugcagaaccugcagaagacccuccuggacaccgaggacaagcugaagggcgcccgcgaggagaacuccggccuccugcaggagcuggaggagcuccggaagcaggccgacaaggccaaggccgcgcagacggccgaggacgccaugcagaucauggagcagaugaccaaggagaagaccgagacccuggccagccuggaggacacgaagcagaccaacgcgaagcuccagaacgagcuggacacccugaaggagaacaaccucaagaacgucgaggagcugaacaaguccaaggagcugcucaccguggagaaccagaagauggaggaguuccgcaaggagaucgagacgcugaagcaggccgccgcccagaagucccagcagcugagcgcccuccaggaggagaacgugaagcuggcggaggagcuggggcggagccgcgacgaggucaccucccaccagaagcucgaggaggagcggagcgugcugaacaaccagcugcucgagaugaagaagcgcgagagcaaguucaucaaggacgccgacgaggagaaggccucccugcagaaguccaucagcaucaccagcgcccugcucaccgagaaggacgccgagcuggagaagcugcggaacgaggugacgguccuccgcggcgagaacgcguccgccaagagccugcacuccguggugcagacccuggagagcgacaaggucaagcucgagcugaaggugaagaaccuggagcuccagcugaaggagaacaagcggcagcuguccagcuccagcgggaacaccgacacccaggccgacgaggacgagcgcgcccaggagucccagaucgacuuccugaacagcgugaucgucgaccuccagcggaagaaccaggaccugaagaugaagguggagaugauguccgaggccgcgcugaacggcaacggcgacgaccucaacaacuacgacagcgacgaccaggagaagcaguccaagaagaagccccgccuguucugcgacaucugcgacugcuucgaccugcacgacaccgaggacugccccacgcaggcccagaugagcgaggacccgccccacuccacccaccacgggagccggggcgaggagcgccccuacugcgagaucugcgagauguucgggcacugggccaccaacugcaacgacgacgagaccuucuga

SEQ ID NO: 28398 - RNA, 3141 nt, Artificial Sequence
  derived and/or modified sequence opt1 from CLIP2__Homo_sapiens__NP_003379
augcagaagcccagcggccugaagccgcccgggcgcggcgggaagcacuccagccccaugggccggaccuccaccgggagcgccuccagcuccgccgcgguggccgccagcuccaaggagggcagcccccuccacaagcaguccagcggcccguccagcucccccgccgccgcggccgcccccgagaagcccgggccgaaggccgcggaggugggcgacgacuuccugggggacuucguggugggcgagcgcgucugggugaacggggugaagcccggcgucgugcaguaccugggcgagacgcaguucgcccccgggcagugggccggcgugguccucgacgaccccguggggaagaacgacggcgccgugggcgggguccgguacuucgagugcccggcccugcagggcaucuucacccgccccagcaagcugacccggcagcccaccgcggagggguccggcagcgacgcccacuccguggagagccucacggcccagaaccugagccugcacuccgggaccgccacgcccccgcucaccagccgcgugaucccccugcgggaguccguccugaacagcuccgugaagaccggcaacgagagcggcuccaaccucagcgacuccgggagcgugaagcgcggcgagaaggaccugcggcugggggaccgcguccucgugggcgggaccaagaccggcgugguccgguacgugggcgagaccgacuucgccaagggggaguggugcggcguggagcuggacgagccccuggggaagaacgacggcgcggucgccgggacgcgcuacuuccagugcccgcccaaguucggccucuucgcccccauccacaaggugauccggaucggcuuccccuccaccagccccgccaaggccaagaagaccaagcgcauggcgaugggggucuccgcccugacccacagcccguccagcuccagcaucuccagcgugagcuccguggccagcuccgucggcgggcggcccagccgcuccggccugcucacggagaccagcucccgguacgcccgcaagaucagcggcaccaccgcccugcaggaggcgcugaaggagaagcagcagcacaucgagcagcuccuggccgagcgggaccuggagcgcgccgagguggccaaggcgacgucccacaucugcgagguggagaaggagaucgcccuccugaaggcccagcacgagcaguacgucgccgaggccgaggagaagcugcagcgggcgcgccuccugguggagagcgugcgcaaggagaaggucgaccuguccaaccagcucgaggaggagcggcgcaagguggaggaccugcaguuccggguggaggaggagagcaucaccaagggggaccuggagacccagacccagcucgagcacgcccgcaucggcgagcuggagcagucccugcuccuggagaaggcccaggccgagcggcugcuccgcgagcuggccgacaaccggcugacgaccgucgcggagaagucccgcgugcuccagcuggaggaggagcugacccuccggcgcggggagaucgaggagcugcagcagugccugcugcacagcggcccgccgccgcccgaccaccccgacgccgccgagauccuccggcugcgcgagcggcugcucagcgccuccaaggagcaccagcgcgagagcggggugcugcgggacaaguacgagaaggcccugaaggcguaccaggccgaggucgacaagcuccgcgccgccaacgagaaguacgcgcaggagguggccggccugaaggacaaggugcagcaggccaccagcgagaacaugggccugauggacaacuggaaguccaagcucgacagccuggccuccgaccaccagaagucccuggaggaccucaaggccacgcugaacagcgggcccggcgcgcagcagaaggagaucggggagcugaaggccgucauggagggcaucaagauggagcaccagcucgagcuggggaaccugcaggccaagcacgaccucgagaccgccaugcacgugaaggagaaggaggcccugcgggagaagcugcaggaggcgcaggaggagcucgccggccugcagcgccacuggcgggcccagcuggaggugcaggccagccagcaccgccucgagcugcaggaggcccaggaccagcgccgggacgcggagcugcgcguccacgagcucgagaagcuggacguggaguaccggggccaggcccaggccaucgaguuccugaaggagcagaucucccucgccgagaagaagaugcuggacuacgagcgccugcagcgggcggaggcccaggggaagcaggagguggagagccuccgcgagaagcugcuggucgccgagaaccggcuccaggccguggaggcccugugcuccagccagcacacccacaugaucgaguccaacgacaucagcgaggagaccauccgcacgaaggagaccguggagggccugcaggacaagcucaacaagcgggacaaggaggucaccgcgcugaccucccagacggagaugcugcgcgcccaggugagcgcccucgaguccaagugcaagagcggggagaagaagguggacgcccugcugaaggagaagcggcgccucgaggccgagcuggagaccgucucccggaagacccacgacgcgagcggccagcuggugcucaucucccaggagcugcugcgcaaggagcggagccucaacgagcugcgcgugcugcuccuggaggccaaccggcacagccccgggcccgagcgcgaccugucccgggagguccacaaggccgaguggcgcaucaaggagcagaagcucaaggacgacauccggggccugcgcgagaagcugaccggccucgacaaggagaagucccugagcgaccagcgccgguacagccugaucgaccccuccagcgcccccgagcuccugcgccugcagcaccagcucauguccaccgaggacgcccugcgggacgcgcuggaccaggcccagcaggucgagaagcucauggaggccaugcgcagcugccccgacaaggcccagacgaucgggaacuccggcagcgccaacgggauccaccagcaggacaaggcgcagaagcaggaggacaagcacuga

SEQ ID NO: 28399 - RNA, 1581 nt, Artificial Sequence
  derived and/or modified sequence opt1 from CLK1__Homo_sapiens__NP_001155879
auggccgccggccgccggcccgcgagcgcccuguggccggagcgccgggggagcccccuccgcggcgaccugcugggguuccagaacgugcgggagcccagcuccugcggcgagacccucagcgggaugcgccacuccaagcggaccuacugccccgacugggacgacaaggacugggacuacggcaaguggcgcagcuccagcucccacaagcggcgcaagcggagccacuccagcgcccaggagaacaagcgcugcaaguacaaccacuccaagaugugcgacagccacuaccuggagucccggagcaucaacgagaaggacuaccacucccgccgguacaucgacgaguaccgcaacgacuacacgcagggcugcgagccggggcaccggcagcgcgaccacgagagccgguaccagaaccacuccagcaagagcuccggccgcagcgggcgguccagcuacaaguccaagcaccgcauccaccacagcaccucccaccgccggagccacggcaagucccaccgccggaagcgcacccggagcgucgaggacgacgaggaggggcaccugaucugccaguccggcgacgugcucagcgcccgcuacgagaucguggacacccugggcgagggggccuucggcaaggucguggagugcaucgaccacaaggccgggggccggcacguggcggucaagaucgugaagaacguggaccgcuacugcgaggccgcccgguccgagauccagguccuggagcaccucaacacgaccgaccccaacagcaccuuccgcugcgugcagaugcuggagugguucgagcaccacggccacaucugcaucguguucgagcugcucgggcuguccaccuacgacuucaucaaggagaacggcuuccugcccuuccggcucgaccacauccgcaagauggcguaccagaucugcaagagcgucaacuuccugcacuccaacaagcugacgcacaccgaccucaagcccgagaacauccuguucgugcagagcgacuacaccgaggccuacaacccgaagaucaagcgggacgagcgcacccugaucaaccccgacaucaagguggucgacuucggguccgccacguacgacgacgagcaccacagcacccucgugagcacccggcacuaccgcgcccccgaggugauccuggcccugggcuggucccagcccugcgacgucuggagcaucgggugcauccucaucgaguacuaccugggcuucaccguguucccgacgcacgacuccaaggagcaccuggcgaugauggagcggauccucggcccccugcccaagcacaugauccagaagacccgcaagcggaaguacuuccaccacgaccgccuggacugggacgagcacagcuccgccgggcgcuacgugagccggcgcugcaagccccucaaggaguucaugcugucccaggacgucgagcacgagcggcuguucgaccucauccagaagaugcuggaguacgacccggccaagcgcaucacccugcgggaggcccucaagcaccccuucuucgaccugcugaagaaguccaucuga

SEQ ID NO: 28400 - RNA, 1500 nt, Artificial Sequence
  derived and/or modified sequence opt1 from CLK2__Homo_sapiens__NP_001281267
augccccacccgcgccgguaccacagcuccgagcgcggcagccggggguccuaccgcgagcacuaccggagccgcaagcacaagcggcgccggucccgcagcugguccagcuccagcgaccggacccgccggcgccggcgcgaggacuccuaccacgugcggagccgcuccagcuacgacgaccgguccagcgaccgccgggucuacgaccgccgcuacugcggcuccuaccggcgcaacgacuacagccgggaccgcggggacgccuacuacgacaccgacuaccggcacuccuacgaguaccagcgcgagaacagcagcuaccggucccagcgcagcucccggcgcaagcaccggcgccggcgccggcgcagccggacguucucccgcagcuccagccagcacuccagccggcgcgccaaguccguggaggacgacgcggagggccaccugaucuaccacgugggggacuggcuccaggagcgcuacgagaucgucagcacccugggcgagggcaccuucgggcggguggugcagugcgucgaccaccgccggggcggggcccgcguggcccugaagaucaucaagaacguggagaaguacaaggaggccgcccggcucgagaucaacguccuggagaagaucaacgagaaggaccccgacaacaagaaccugugcgugcagauguucgacugguucgacuaccacggccacaugugcaucuccuucgagcuccuggggcugagcaccuucgacuuccucaaggacaacaacuaccugcccuaccccauccaccaggugcgccacauggcguuccagcugugccaggccgucaaguuccuccacgacaacaagcugacgcacaccgaccugaagccggagaacauccucuucgugaacuccgacuacgagcugaccuacaaccuggagaagaagcgggacgagcgcagcgugaaguccaccgccguccgggugguggacuucggcagcgccacguucgaccacgagcaccacuccaccaucgucagcacccgccacuaccgggcgcccgaggugauccucgagcugggcuggagccagcccugcgacgugugguccaucgggugcaucaucuucgaguacuacgucggcuucacccuguuccagacgcacgacaaccgcgagcaccucgccaugauggagcggauccuggggcccaucccgagccgcaugauccggaagacccgcaagcagaaguacuucuaccggggccgccuggacugggacgagaacaccuccgccggccgguacgugcgcgagaacugcaagccccuccggcgcuaccugaccagcgaggccgaggagcaccaccagcuguucgaccucaucgaguccaugcuggaguacgagcccgccaagcgccugacgcucggggaggcgcugcagcaccccuucuucgcccggcugcgcgccgagccgcccaacaagcucugggacagcucccgggacaucagccgcuga

SEQ ID NO: 28401 - RNA, 366 nt, Artificial Sequence
  derived and/or modified sequence opt1 from CLLU1__Homo_sapiens__NP_001020404
auguucaacaagugcagcuuccacuccagcaucuaccgccccgccgccgacaacuccgcgagcucccugugcgccaucaucugcuuccucaaccuggugaucgagugcgaccuggagaccaacagcgagaucaacaagcucaucaucuaccuguucucccagaacaaccggauccgcuucagcaagcugcuccugaagauccuguucuacaucuccaucuucagcuacccggagcucaugugcgagcaguacgucaccuucaucaagcccgggauccacuacggccagguguccaagaagcacaucaucuacagcacguuccuguccaagaacuucaaguuccagcugcuccgggugugcugguga

SEQ ID NO: 28402 - RNA, 3009 nt, Artificial Sequence
  derived and/or modified sequence opt1 from CLMN__Homo_sapiens__NP_079010
auggccgcccacgagugggacugguuccagcgcgaggagcugaucggccagaucagcgacauccgggugcagaaccuccaggucgagcgcgagaacgugcagaagcggaccuucacccgcuggaucaaccugcaccuggagaagugcaacccgccccucgaggugaaggaccuguucgucgacauccaggacgggaagauccugauggcgcuccuggaggugcuguccggccggaaccuccugcacgaguacaagagcuccagccaccgcaucuuccggcugaacaacaucgccaaggcccucaaguuccuggaggacuccaacgugaagcuggucagcaucgacgccgccgagaucgcggacgggaaccccucccucgugcugggccugaucuggaacaucauccucuucuuccagaucaaggagcugacggggaaccugagccgcaacucccccagcuccagccucucccccggcagcggcgggaccgacuccgacagcuccuucccgcccacccccaccgccgagcggagcguggccaucuccgucaaggaccagcgcaaggccaucaaggcgcugcuggccugggugcagcggaagacgcgcaaguacggcguggccguccaggacuucgccgggagcuggcggagcggccucgccuuccuggcggugaucaaggccaucgaccccucccugguggacaugaagcaggcccucgagaacagcacccgcgagaaccuggagaaggccuucuccaucgcccaggacgcgcugcacaucccgcggcuccuggagcccgaggacaucauggucgacacccccgacgagcagagcaucaugaccuacguggcccaguuccuggagcgcuuccccgagcucgaggccgaggacaucuucgacuccgacaaggaggugccgaucgagagcacguucguccggaucaaggagacccccuccgagcaggagagcaagguguucgugcugaccgagaacggggagcgcaccuacacggucaaccacgagaccucccacccgccgcccagcaagguguucgugugcgacaagcccgaguccaugaaggaguuccggcuggacggcgucagcucccacgcccucagcgacuccagcaccgaguucaugcaccagaucaucgaccaggugcugcagggcgggcccggcaagaccuccgacaucagcgagcccucccccgagagcagcauccuguccagccgcaaggagaacgggcgguccaacagccuccccaucaagaagacgguccacuucgaggccgacaccuacaaggaccccuucugcuccaagaaccugagccugugcuucgagggcagcccccgcguggcgaaggagagccuccgccaggacggccacgugcuggccgucgagguggccgaggagaaggagcagaagcaggaguccagcaagaucccggaguccagcuccgacaagguggccggggacaucuuccuggucgagggcaccaacaacaacagccaguccagcuccugcaacggggcccucgagagcaccgcgcggcacgacgaggagagccacucccugagcccgcccggcgagaacacggugauggccgacuccuuccagaucaaggugaaccugaugaccgucgaggcccucgaggagggggacuacuucgaggccaucccccugaaggcgagcaaguucaacuccgaccugaucgacuucgccagcaccucccaggccuucaacaaggugcccagcccccacgagaccaagcccgacgaggacgccgaggccuucgagaaccacgcggagaagcugggcaagcgcuccaucaagagcgcccacaagaagaaggacuccccggagccccaggugaagauggacaagcacgagccccaccaggacagcggcgaggaggccgaggggugccccuccgccccggaggagacgcccgucgacaagaagcccgaggugcacgagaaggccaagcggaaguccacccgcccccacuacgaggaggagggcgaggacgacgaccuccagggggugggcgaggagcuguccagcuccccgcccagcuccugcgucagccuggagacccucgggagccacuccgaggagggccuggacuucaagcccagcccgccccuguccaaggugagcgugaucccccacgaccucuucuacuucccccacuacgaggucccccuggcggccgugcuggaggccuacguggaggacccggaggaccucaagaacgaggagauggaccuggaggagcccgagggcuacaugcccgaccuggacucccgggaggaggaggccgacgggagccaguccagcuccagcuccagcguccccggcgagucccucccgagcgccuccgaccaggugcuguaccugagccgcgggggcguggggaccacgcccgcguccgagcccgcgccccucgccccgcacgaggaccaccagcagcgggagaccaaggagaacgaccccauggacagccaccagucccaggagagccccaaccuggagaacaucgccaacccgcuggaggagaacgucaccaaggagagcaucuccagcaagaagaaggagaagcgcaagcacguggaccacguggaguccagccucuucgucgcccccggcuccgugcagagcuccgacgaccuggaggaggacagcuccgacuacagcauccccucccggaccagccacuccgacagcuccaucuaccugcgccggcacacgcaccgcagcuccgagagcgaccacuucuccuacgugcagcuccggaacgccgccgaccuggacgaccgccggaaccgcauccugacccggaaggccaacagcagcggcgaggccaugucccucgggagccacagcccccaguccgacucccugacccagcugguccagcagccggacaugauguacuucauccucuuccuguggcugcucguguacugccugcuccuguucccccagcuggacgugagccgccuguga

SEQ ID NO: 28403 - RNA, 1122 nt, Artificial Sequence
  derived and/or modified sequence opt1 from CLMP__Homo_sapiens__NP_079045
augagccugcuccugcugcuccugcugguguccuacuacgucggcacccucgggacccacacggagaucaagcgcguggccgaggagaaggugacccugcccugccaccaccagcugggccucccggagaaggacacccuggacaucgaguggcugcucaccgacaacgaggggaaccagaaggucgugaucacguacagcucccggcacguguacaacaaccugaccgaggagcagaagggccgcgucgccuucgcgagcaacuuccuggccggggacgccucccuccagaucgagccccugaagcccagcgacgagggccgguacacgugcaaggugaagaacuccggccgcuacguguggagccacgucauccugaaggugcucgugcggcccuccaagccgaagugcgagcuggagggggagcugaccgagggcagcgaccucacccugcagugcgaguccagcuccgggaccgagcccaucgucuacuacuggcagcgcauccgggagaaggagggcgaggacgagcgccugccgcccaagagccggaucgacuacaaccaccccgggcgcgugcuccugcagaaccugaccauguccuacagcggccucuaccagugcaccgccggcaacgaggccgggaaggaguccugcgugguccgggugacggugcaguacguccagagcaucggcaugguggcgggggccgugaccggcaucgucgccggcgcccugcugaucuuccuccugguguggcugcucauccgccggaaggacaaggagcgcuacgaggaggaggagcggcccaacgagauccgcgaggacgcggaggcccccaaggcccggcuggugaagcccuccagcagcuccagcgggucccgcagcucccggagcggcuccagcuccacccgcagcaccgccaacuccgccagccggucccagcgcacgcugagcaccgacgcggccccgcagcccgggcucgccacccaggccuacucccuggucggccccgaggugcgcgggagcgagcccaagaagguccaccacgccaaccugaccaaggcggagacgaccccguccaugauccccagccagucccgggccuuccagaccguguga

SEQ ID NO: 28404 - RNA, 1317 nt, Artificial Sequence
  derived and/or modified sequence opt1 from CLN3__Homo_sapiens__NP_000077
augggcgggugcgccggcagccgccggcgcuucuccgacagcgagggggaggagaccgugcccgagccgcggcugccccuccuggaccaccagggcgcccacuggaagaacgcggucggguucuggcugcucggccugugcaacaacuucuccuacguggugaugcugagcgccgcccacgacauccucucccacaagcgcaccagcggcaaccagucccacgucgaccccgggcccacgccgaucccccacaacagcuccagccgguucgacugcaacuccgugagcaccgccgccgugcugcuggcggacauccuccccacccuggucaucaagcugcucgcgccccugggccugcaccuccugccguacagcccccgcgugcugguguccgggaucugcgccgccggcuccuucguccucguggccuucagccacuccguggggaccagccugugcggcgucguguucgccuccaucagcagcggccugggggaggugacguuccucucccugaccgccuucuacccccgggccgucaucagcuggugguccagcggcaccgggggcgccggccugcucggggcgcuguccuaccugggccucacccaggccgggcugagcccccagcagacgcugcucuccaugcugggcaucccggcccugcuccuggccagcuacuuccugcuccugaccucccccgaggcccaggaccccgggggcgaggaggaggcggagagcgccgcccgccagccccugauccggaccgaggccccggaguccaagcccggcagcuccagcucccucagccugcgcgagcgguggaccguguucaaggggcugcucugguacaucgugccccuggucgugguguacuucgccgaguacuucaucaaccagggccuguucgagcuccuguucuucuggaacacgucccugagccacgcgcagcaguaccgcugguaccagaugcucuaccaggccggggucuucgccucccggagcagccugcgcugcugccggauccgcuucaccugggcccuggcccugcuccagugccugaaccugguguuccuccuggcggacgugugguucggcuuccugcccuccaucuaccucgucuuccugaucauccuguacgaggggcuccugggcggcgccgccuacgugaacaccuuccacaacaucgcccuggagaccagcgacgagcaccgggaguucgcgauggccgccacgugcaucuccgacacccucgggaucagccuguccggccugcucgcccugccgcugcacgacuuccucugccagcugagcuga

SEQ ID NO: 28405 - RNA, 1224 nt, Artificial Sequence
  derived and/or modified sequence opt1 from CLN5__Homo_sapiens__NP_006484
augcgccggaaccugcgccucggccccagcuccggggccgacgcccagggccagggggcgccgcggcccggccuggccgcgccccgcaugcugcugcccccggccagccaggccucccgggggagcggcuccaccggcugcagccugauggcccaggagguggacaccgcccagggggccgagaugcgccggggcgccggggcggcccgcggccgggccuccuggugcugggcccuggcccuccuguggcuggcggucgugcccggguggagccgcguguccggcauccccagccggcgccacuggcccgucccguacaagcgguucgacuuccgccccaagcccgaccccuacugccaggccaaguacacguucugcccgaccggcucccccauccccgugauggagggggacgacgacaucgagguguuccggcuccaggcccccgucugggaguucaaguacggcgaccugcuggggcaccucaagaucaugcacgacgccaucggcuuccgcagcacccugaccggcaagaacuacacgauggagugguacgagcuguuccagcucgggaacugcaccuucccgcaccuccggcccgagauggacgcccccuucuggugcaaccagggcgcggccugcuucuucgaggggaucgacgacgugcacuggaaggagaacggcacccuggugcaggucgccaccaucuccgggaacauguucaaccagauggccaagugggugaagcaggacaacgagacgggcaucuacuacgagaccuggaacgugaaggccagccccgagaagggcgcggagaccugguucgacuccuacgacugcagcaaguucguccuccgcaccuucaacaagcuggccgaguucggggccgaguucaagaacaucgagacgaacuacacccggaucuuccuguacuccggcgagccgaccuaccucgggaacgagaccagcguguucggccccacggggaacaagacccugggccuggccaucaagcgcuucuacuaccccuucaagccccaccucccgaccaaggaguuccugcugucccuccugcagaucuucgacgccgugaucguccacaagcaguucuaccuguucuacaacuucgaguacugguuccuccccaugaaguuccccuucaucaagaucaccuacgaggagaucccccugccgauccggaacaagacgcugagcggccucuga

SEQ ID NO: 28406 - RNA, 936 nt, Artificial Sequence
  derived and/or modified sequence opt1 from CLN6__Homo_sapiens__NP_060352
auggaggccacccgccggcgccagcaccugggcgccaccgggggccccggggcgcagcucggcgccagcuuccugcaggcccggcacggguccgugagcgccgacgaggccgcgcgcacggccccguuccaccuggaccucugguucuacuucacccugcagaacuggguccuggacuucggccggcccaucgccaugcucguguucccccuggagugguucccccugaacaagccguccgugggcgacuacuuccacauggccuacaacgucaucacccccuuccuccugcugaagcucaucgagcgcagcccccggacccugccccgcuccaucacguacgugagcaucaucaucuucaucaugggggcguccauccaccuggugggcgacagcgucaaccaccggcuccuguucuccggguaccagcaccaccugagcgugcgcgagaacccgaucaucaagaaccucaagcccgagacccugaucgacuccuucgagcugcucuacuacuacgacgaguaccugggccacugcaugugguacauccccuucuuccugauccucuucauguacuucagcgggugcuucaccgccuccaaggccgagagccugauccccggcccggcccugcuccugguggcccccuccggccuguacuacugguaccucgucaccgaggggcagaucuucauccuguucaucuucacguucuucgcgaugcuggcccucgugcugcaccagaagcggaagcgccuguuccucgacagcaacggccuguuccuguucuccagcuucgcccucacccugcugcucguggcccugugggucgccuggcuguggaacgaccccgugcuccggaagaaguaccccggggugaucuacgucccggagcccugggcguucuacacccugcacguguccagccgccacuga

SEQ ID NO: 28407 - RNA, 861 nt, Artificial Sequence
  derived and/or modified sequence opt1 from CLN8__Homo_sapiens__NP_061764
augaaccccgccagcgacggcgggaccuccgagagcaucuucgaccuggacuacgccuccuggggcauccgcagcacccucaugguggcgggguucgucuucuaccugggcguguucguggucugccaccagcuguccagcucccucaacgccacguaccggagccugguggcccgcgagaagguguucugggaccuggccgccacccgggcggucuucggggugcaguccaccgccgccggccucugggcccugcugggcgacccggugcuccacgcggacaaggcccgcgggcagcagaacuggugcugguuccacaucaccacggccaccggcuucuucugcuucgagaacgucgccgugcaccugagcaaccugaucuuccggaccuucgaccucuuccuggugauccaccaccuguucgccuuccucggguuccugggcugccuggucaaccuccaggcggggcacuaccuggccaugaccacgcugcuccuggagauguccacccccuucacgugcgugagcuggaugcugcucaaggccggcugguccgagagccuguucuggaagcugaaccaguggcucaugauccacauguuccacugccgcauggugcugaccuaccacauguggugggucugcuucuggcacugggacggccugguguccagccucuaccugccccaccugacccucuuccugguggggcuggcccuccugacccugaucaucaaccccuacuggacccacaagaagacccagcagcuccugaacccggucgacuggaacuucgcccagcccgaggcgaagucccggcccgagggcaacgggcagcugcuccgcaagaagcggcccuga

SEQ ID NO: 28408 - RNA, 1287 nt, Artificial Sequence
  derived and/or modified sequence opt1 from CLNK__Homo_sapiens__NP_443196
augaaccgccagggcaaccggaagaccaccaaggaggggagcaacgaccugaaguuccagaacuucucccuccccaagaaccgcagcuggccgcggaucaacuccgccacgggccaguaccagcgcaugaacaagccccugcuggacugggagcggaacuucgccgcggugcucgacggggccaagggccacagcgacgacgacuacgacgaccccgagcugcgcauggaggagaccuggcaguccaucaagauccugcccgcccggccgaucaaggagagcgaguacgccgacacccacuacuucaaggucgccauggacacgccccucccccuggacacgcgcaccuccaucagcaucgggcagcccaccuggaacacccagacgcggcuggagcgcguggacaagccgaucuccaaggacgugcggagccagaacaucaagggcgacgcguccguccgcaagaacaagaucccccugcccccgccccggccccugaucacccugcccaagaaguaccagccccucccgcccgagcccgagagcucccggcccccgcugagccagcgccacaccuuccccgaggugcagcgcaugcccucccagaucagccugcgggaccucuccgaggugcuggaggccgagaaggucccccacaaccagcgcaagccggagagcacccaccuccucgagaaccagaacacgcaggagaucccccuggccaucuccagcagcuccuucaccaccagcaaccacuccgugcagaaccgggaccaccgcggcgggaugcagcccugcagcccccagcggugccagccgcccgccuccugcagcccccacgagaacauccugccguacaaguacaccuccuggcgcccgcccuuccccaagcgcagcgaccggaaggacgugcagcacaacgagugguacaucggcgaguacucccgccaggcggucgaggaggccuucaugaaggagaacaaggacgggagcuuccucgugcgggacugcuccaccaagagcaaggaggagcccuacgugcuggccgucuucuacgagaacaagguguacaacgugaagauccgcuuccuggagcggaaccagcaguucgcccucggcaccgggcugcgcggcgacgagaaguucgacuccgucgaggacaucaucgagcacuacaagaacuuccccaucauccugaucgacggcaaggacaagaccggggugcaccggaagcagugccaccucacccagccccugccccugacgcgccaccuccugccgcuguga

SEQ ID NO: 28409 - RNA, 714 nt, Artificial Sequence
  derived and/or modified sequence opt1 from CLNS1A__Homo_sapiens__NP_001284
augagcuuccugaaguccuucccgccgcccggccccgccgaggggcuccugcgccagcagcccgacaccgaggccgugcugaacggcaaggggcucggcaccgggacgcuguacaucgcggagagccggcuguccuggcucgacggcagcggccugggguucucccuggaguaccccaccaucagccuccacgcccugucccgcgaccggagcgacugccugggcgagcaccucuacgucauggugaacgccaaguucgaggaggaguccaaggagcccguggccgacgaggaggaggaggacagcgacgacgacgucgagcccaucaccgaguuccgcuucgugcccuccgacaagagcgcccuggaggcgauguucaccgccaugugcgagugccaggcccugcacccggaccccgaggacgaggacuccgacgacuacgacggggaggaguacgacguggaggcccacgagcagggccagggggacauccccacguucuacaccuacgaggagggccucagccaccugaccgcggagggccaggccacccuggagcggcucgaggggaugcugucccagagcgucuccagccaguacaacauggccggcgugcgcacggaggacuccauccgggacuacgaggacgggauggagguggacaccacccccaccgucgccggccaguucgaggacgccgacguggaccacuga

SEQ ID NO: 28410 - RNA, 2541 nt, Artificial Sequence
  derived and/or modified sequence opt1 from CLOCK__Homo_sapiens__NP_004889
augcuguucaccgugagcugcuccaagaugagcuccaucgucgaccgcgacgacagcuccaucuucgacggccucguggaggaggacgacaaggacaaggccaagcgggugagccgcaacaaguccgagaagaagcggcgcgaccaguucaacguccugaucaaggagcuggggagcaugcuccccggcaacgcccggaagauggacaaguccaccgugcugcagaaguccaucgacuuccugcgcaagcacaaggagaucacggcgcagagcgacgccagcgagauccggcaggacuggaagccgaccuuccucuccaacgaggaguucacccagcugaugcuggaggcccucgacggguucuuccuggccaucaugaccgacggcagcaucaucuacguguccgagagcgucacgucccugcucgagcaccuccccagcgaccugguggaccaguccaucuucaacuucauccccgagggggagcacagcgagguguacaagauccugagcacccaccuccuggaguccgacagccugacccccgaguaccugaaguccaagaaccagcuggaguucugcugccacaugcuccgcggcaccaucgacccgaaggagcccagcacguacgaguacgucaaguucaucggcaacuucaagucccugaacagcguguccagcuccgcccacaacggguucgagggcaccauccagcggacccaccgccccagcuacgaggaccgggugugcuucgucgcgaccgugcgccuggccacgccccaguucaucaaggagaugugcaccguggaggagccgaacgaggaguucaccucccggcacagccucgaguggaaguuccuguuccuggaccaccgcgccccgcccaucaucggguaccuccccuucgagguccugggcaccuccggguacgacuacuaccacguggacgaccuggagaaccucgccaagugccacgagcaccugaugcaguacggcaagggcaagagcugcuacuaccgguuccugacgaaggggcagcaguggaucuggcuccagacccacuacuacaucaccuaccaccaguggaacucccgccccgaguucaucgugugcacccacacggucgugagcuacgcggaggugcgggccgagcgccggcgcgagcugggcaucgaggagucccugcccgagaccgccgccgacaagagccaggacuccgggagcgacaaccggaucaacaccgucagccucaaggaggcccuggagcgcuucgaccacucccccacccccagcgcguccagccgcuccagccggaaguccagccacacggccguguccgacccgagcuccacccccaccaagauccccaccgacacgagcacgcccccgcgccagcaccuccccgcccacgagaagauggugcagcggcgcuccagcuucuccagccaguccaucaacagccagagcgucggcuccagccugacccagcccgugaugucccaggccaccaaccugcccaucccgcagggcaugagccaguuccaguucuccgcccagcugggggcgaugcagcaccucaaggaccagcuggagcagcggacccgcaugaucgaggccaacauccaccggcagcaggaggagcugcgcaagauccaggagcagcuccagaugguccacggccaggggcugcagauguuccugcagcagagcaaccccggccucaacuucggguccgugcagcugagcuccggcaacagcuccaacauccagcagcuggcccccaucaacaugcagggccaggugguccccaccaaccagauccagagcgggaugaacaccggccacaucgggaccacgcagcacaugauccagcagcagacccugcaguccaccagcacccagucccagcagaacgugcucagcggccacucccagcagaccagccugccgucccagacgcagagcacccugaccgcgccccucuacaacaccauggugaucagccagcccgccgccggguccaugguccagaucccgagcuccaugccccagaacagcacgcaguccgccgccgugaccaccuucacccaggaccggcagauccgcuucagccagggccagcagcuggugacgaagcuggucaccgcccccguggccugcggcgcggugaugguccccuccaccaugcucaugggccagguggugaccgccuacccgacguucgccacccagcagcagcagagccagacccuguccgucacccagcagcagcagcagcagagcucccaggagcagcagcugacgagcgugcagcagcccucccaggcccagcucacccagccgccccagcaguuccugcagaccagccggcugcuccacgggaaccccuccacccagcugauccugagcgcggccuucccccuccagcaguccacguucccccagagccaccaccagcagcaccagucccagcagcagcagcagcugagccgccaccggaccgacagccugcccgacccguccaaggugcagccccaguga

SEQ ID NO: 28411 - RNA, 1086 nt, Artificial Sequence
  derived and/or modified sequence opt1 from CLP1__Homo_sapiens__NP_001136069
augggcgaggaggccaacgacgacaagaagcccaccaccaaguucgagcuggagcgcgagacggagcuccgguucgagguggaggccagccaguccguccagcuggagcugcucaccgggauggcggagaucuucggcaccgagcugacccgcaacaagaaguucacguucgacgccggggccaagguggccguguucaccuggcacggcugcagcguccagcuguccgggcggaccgagguggccuacgugagcaaggacaccccgaugcuccuguaccugaacacgcacaccgcgcucgagcagaugcgccggcaggccgagaaggaggaggagcgcggcccccgggucaugguggugggccccaccgacgucgggaaguccaccgugugccgccugcugcucaacuacgccaucacgagccggcuggccgacguguucaaccagcgcugcgaggucaaccggcgcgcguccgugagcggcugcgugaucaacacgugcgggugggucaagggcuccggguaccaggcccuggugcacgccgccagcgccuucgagguggacgucguggugguccucgaccaggagcggcuguacaacgagcugaagcgcgaccucccccacuucgugcggaccgugcugcugccgaaguccggcggcgucguggagcgcagcaaggacuuccggcgcgagugccgggacgagcgcauccgggaguacuucuacggguuccgcggcugcuucuacccccacgcguucaacgucaaguucuccgacgugaagaucuacaaggugggggcccccaccauccccgacagcugccucccgcugggcaugucccaggaggacaaccagcugaagcucguccccgugacccccggccgcgacauggugcaccaccuccugagcgucuccaccgccgaggggaccgaggagaaccugagcgagaccuccguggccggcuucaucguggucacgagcguggaccuggagcaccagguguucaccguccugagccccgccccgcggccccuccccaagaacuuccugcugaucauggacauccgcuucauggaccucaaguga

SEQ ID NO: 28412 - RNA, 834 nt, Artificial Sequence
  derived and/or modified sequence opt1 from CLPP__Homo_sapiens__NP_006003
auguggcccggcauccuggucgggggcgcccgcguggccagcugccgguacccggcgcucgggccccgccuggccgcccacuuccccgcccagcggcccccgcagcgcacccugcagaacggccucgcccugcagcggugccugcacgcgaccgccacgcgcgcccucccccugauccccaucgugguggagcagaccgggcggggcgagcgcgccuacgacaucuacucccggcugcuccgcgagcggaucgucugcgugaugggccccaucgacgacagcguggcgucccuggucaucgcccagcugcuguuccugcagagcgaguccaacaagaagccgauccacauguacaucaacagccccgggggcguggugaccgccgggcuggccaucuacgacaccaugcaguacauccucaaccccaucugcacguggugcgucggccaggccgcguccauggggagccugcugcucgccgccggcacccccggcaugcgccacucccugccgaacagccggaucaugauccaccagcccuccgggggcgcccgcgggcaggccaccgacaucgcgauccaggccgaggagaucaugaagcugaagaagcagcucuacaacaucuacgccaagcacaccaagcagagccuccaggugaucgaguccgccauggagcgggaccgcuacaugagccccauggaggcccaggaguucggcauccuggacaaggugcucguccacccgccccaggacggcgaggacgagcccacgcuggugcagaaggagcccguggaggcggcccccgccgccgagccgguccccgccuccaccuga

SEQ ID NO: 28413 - RNA, 216 nt, Artificial Sequence
  derived and/or modified sequence opt1 from CLPS__Homo_sapiens__NP_001239527
auggagaagauccucauccuccugcugguggcccucagcgucgccuacgcggcccccggcccgcgcgggaucaucaucaaccugacccuguacggcaucuacuacaagugccccugcgagcgggggcugaccugcgagggcgacaagacgaucgugggguccaucaccaacaccaacuucggcaucugccacgacgccggccgcagcaagcaguga

SEQ ID NO: 28414 - RNA, 1968 nt, Artificial Sequence
  derived and/or modified sequence opt1 from CLPTM1__Homo_sapiens__NP_001269104
augagccgcaaggcccacaucaccgagaaggugaccuccaacggcagcaucgggcgggacccgccggccgagacgcagccccagaacccgcccgcccagcccgcccccaacgccuggcaggucaucaagggcgugcuguuccgcaucuucaucaucugggccaucuccagcugguuccggcgcgggcccgcgccccaggaccaggccggccccgggggcgcgccccggguggccucccgcaaccucuuccccaaggacacccugaugaaccugcacgucuacaucagcgagcacgagcacuucaccgacuucaacgccaccuccgcccuguucugggagcagcacgaccugguguacggcgacuggacgagcggggagaacuccgacggcugcuacgagcacuucgccgagcuggacaucccccagagcgugcagcagaacggguccaucuacauccacgucuacuucaccaagagcggcuuccacccggacccccggcagaaggcccucuaccgccggcuggccaccgugcacaugucccgcaugaucaacaaguacaagcggcgccgguuccagaagaccaagaaccugcucacgggggagaccgaggccgaccccgagaugaucaagcgcgcggaggacuacggccccguggaggucaucagccacuggcacccgaacaucaccaucaacaucguggacgaccacacccccugggugaagggcuccgugcccccgccccuggaccaguacgugaaguucgacgccgugagcggggacuacuaccccaucaucuacuucaacgacuacuggaaccugcagaaggacuacuaccccaucaacgagucccucgccagccugccccugcgggucuccuucugcccgcucagccuguggcgcuggcagcuguacgccgcccagagcacgaagucccccuggaacuuccucggcgacgagcuguacgagcagagcgacgaggagcaggacuccgugaagguggcgcugcucgagaccaaccccuaccugcuggcccucaccaucaucgucagcaucgugcacuccguguucgaguuccuggccuucaagaacgacauccaguucuggaacagccggcagucccuggaggggcucagcguccgcuccguguucuucggcguguuccagagcuucgucgugcugcuguacauccucgacaacgagaccaacuucgucguccagguguccgucuucaucggcgugcugaucgaccuguggaagaucacgaaggugauggacguccggcucgaccgcgagcaccggguggccgggaucuucccccgccugagcuucaaggacaaguccaccuacaucgagagcuccaccaagguguacgacgacauggccuuccgcuaccugagcuggauccucuucccgcugcugggcugcuacgcggucuacucccuccuguaccuggagcacaaggggugguacagcugggugcucuccaugcuguacggcuuccugcucaccuucggguucaucacgaugacgccccagcuguucaucaacuacaagcucaagagcguggcccaccuccccuggcggaugcugaccuacaaggcccugaacaccuucaucgacgaccuguucgccuucgucaucaagaugccggugauguaccgcaucggcugccuccgggacgacguggucuucuucaucuaccuguaccagcgcuggaucuaccggguggaccccacccgcgugaacgaguucggcaugagcggggaggaccccaccgccgcggcccccgucgccgaggugccgaccgccgcgggcgcccugacccccacgcccgcccccaccaccaccacggccacccgggaggaggccuccaccagccucccgaccaagcccacgcagggggcguccagcgccuccgagccccaggaggcgcccccgaagcccgccgaggacaagaagaaggacuga

SEQ ID NO: 28415 - RNA, 1617 nt, Artificial Sequence
  derived and/or modified sequence opt1 from CLPTM1L__Homo_sapiens__NP_110409
auguggagcggccgcuccagcuucaccucccugguggucgggguguucguggucuacguggugcacacgugcugggucauguacggcaucguguacacccggcccugcagcggggacgccaacugcauccagccguaccucgcccgccggcccaagcugcagcuguccguguacaccaccacccgcagccaccucggcgcggagaacaacaucgaccugguccugaacguggaggacuucgacguggaguccaaguucgagcggacggucaacgugagcgugcccaagaagacccgcaacaacgggacccucuacgccuacaucuuccugcaccacgccggcguccugcccuggcacgacggcaagcagguccaccucguguccccgcugaccacguacauggugcccaagcccgaggagaucaaccugcucaccggggagagcgacacccagcagaucgaggccgagaagaagcccaccuccgcccuggacgagccggugagccacuggcggccccgccuggcgcucaacgugauggccgacaacuucgucuucgacggcuccagccugcccgccgacgugcaccgguacaugaagaugauccagcuggggaagacggugcacuaccuccccauccuguucaucgaccagcuguccaaccgcgucaaggaccucauggugaucaaccggagcaccaccgagcugccgcugaccgucuccuacgacaaggugagccucggccgccugcgguucuggauccacaugcaggacgccguguacucccugcagcaguucggguucagcgagaaggacgcggacgaggucaagggcaucuucguggacacgaaccucuacuuccuggcccugaccuucuucguggccgccuuccaccuccuguucgacuuccuggccuucaagaacgacaucagcuucuggaagaagaagaaguccaugaucggcaugagcaccaaggcgguccucuggcgcugcuucuccaccguggugaucuuccuguuccugcucgacgagcagacgagccugcugguccucgugcccgccggggugggcgccgccaucgagcuguggaaggucaagaaggcccugaagaugaccaucuucuggcgggggcucaugcccgaguuccaguucggcaccuacuccgagagcgagcgcaagaccgaggaguacgacacgcaggcgaugaaguaccuguccuaccugcucuacccccugugcgugggcggggccguguacagccugcucaacaucaaguacaaguccugguacagcuggcugaucaacuccuucgucaacggcguguacgccuucggguuccuguucaugcugccgcagcuguucgugaacuacaagcucaagagcgucgcccaccuccccuggaaggccuucaccuacaaggcguucaacaccuucaucgacgacguguucgccuucaucaucaccaugcccacgucccaccggcuggccugcuuccgcgacgacguggucuuccugguguaccuguaccagcgguggcucuaccccguggacaagcgccgggucaacgaguucggcgagagcuacgaggagaaggccacccgcgccccgcacaccgacuga

SEQ ID NO: 28416 - RNA, 738 nt, Artificial Sequence
  derived and/or modified sequence opt1 from CLRN1__Homo_sapiens__NP_001182723
augcccagccagcagaagaagaucaucuucugcauggccggcguguucuccuucgccugcgcgcugggggucgugaccgcccucggcaccccgcuguggaucaaggccacggugcugugcaagaccggggcccuccuggucaacgccagcggccaggagcuggacaaguucaugggggagaugcaguacggccucuuccacggcgagggggugcgccagugcggccugggggcgcggcccuuccgcuucuccuucuuccccgaccugcucaaggccauccccgugagcauccacgucaacgugauccuguucuccgccauccugaucgugcucaccauggucggcaccgccuucuucauguacaacgcguucgggaagccguucgagacgcugcacggcccccugggccucuaccugcugagcuucaucuccguggcccucuggcugcccgccacccggcaccaggcccaggggagcugcggcugccuggugaugauccucuucgccuccgaggucaagauccaccaccugagcgagaagaucgcgaacuacaaggaggggaccuacguguacaagacccaguccgagaaguacacgaccagcuucugggugaucuucuucugcuucuucguccacuuccugaacggccuccugauccgccuggccggcuuccaguuccccuucgccaaguccaaggacgccgagaccaccaacguggccgcggaccucauguacuga

SEQ ID NO: 28417 - RNA, 3999 nt, Artificial Sequence
  derived and/or modified sequence opt1 from CLSPN__Homo_sapiens__XP_011540241
augaccggcgagguggggagcgagguccaccuggagaucaacgaccccaacgugaucucccaggaggaggccgacagcccguccgacagcggccagggguccuacgagaccaucggcccccucagcgagggggacuccgacgaggagaucuucgugagcaagaagcugaagaaccgcaagguccugcaggacuccgacagcgagacggaggacaccaacgccucccccgagaagaccaccuacgacagcgcggaggaggagaacaaggagaaccucuacgccggcaagaacacgaagaucaagcggaucuacaagaccguggccgacuccgacgagagcuacauggagaagucccuguaccaggagaaccuggaggcccaggugaagcccugccucgagcugagccugcaguccggcaacagcaccgacuucaccacggaccgcaaguccagcaagaagcacauccacgacaaggaggggaccgccggcaaggcgaaggucaagagcaagcggcgccucgagaaggaggagcggaagauggagaagauccgccagcugaagaagaaggagaccaagaaccaggaggacgacguggagcagccguucaacgacuccgggugccugcucguggacaaggaccuguucgagaccggccuggaggacgagaacaacagcccccucgaggacgaggagucccuggagagcauccgggccgccgucaagaacaaggugaagaagcacaagaagaaggagcccucccuggagagcggggugcacuccuucgaggagggcagcgagcucuccaagggcacgacccgcaaggagcggaaggccgcgcgccugagcaaggaggcccugaagcagcuccacuccgagacccagcggcugauccgcgagagcgcccugaaccuccccuaccacaugccggagaacaagaccauccacgacuucuucaagcggaagccccgccccacgugccacgggaacgccauggcccugcugaaguccagcaaguaccaguccagccaccacaaggagaucaucgacaccgcgaacaccaccgagaugaacuccgaccaccacagcaagggcuccgagcagacgaccggggccgagaacgaggucgagaccaacgcccuccccguggugagcaaggagacccagaucaucacgggcagcgacgaguccugccggaaggaccuggucaagaacgaggagcuggagauccaggagaagcagaagcagagcgacauccgcccgucccccggcgacagcuccgugcuccagcaggagagcaacuuccuggggaacaaccacuccgaggagugccaggugggcgggcuggucgccuucgagccccacgcccucgagggcgaggggccccagaacccggaggagaccgacgagaagguggaggagcccgagcagcagaacaagagcuccgcggugggcccgcccgagaagguccggcgcuucacccuggaccggcugaagcagcucggcguggacgugagcaucaagccccgccugggggccgacgaggacuccuucgucauccuggagcccgagaccaaccgggagcucgaggcccugaagcagcgcuucuggaagcacgccaaccccgccgcgaagccccgcgccggccagacggugaacgucaacgugaucgugaaggacauggggaccgacggcaaggaggagcugaaggccgacgucgugccggugacccucgcccccaagaagcuggacggggccagccacaccaagcccggcgagaagcugcagguccucaaggcgaagcugcaggaggccaugaagcugcggcgcuucgaggagcggcagaagcgccaggcccucuucaagcuggacaacgaggacggcuucgaggaggaggaggaggaggaggaggagaugacggacgaguccgaggaggacggggaggagaagguggagaaggaggagaaggaggaggagcuggaggaggaggaggagaaggaggaggaggaggaggaggagggcaaccaggagaccgccgaguuccugcucagcuccgaggagaucgagaccaaggacgagaaggagauggacaaggagaacaacgacgggagcuccgagaucggcaaggcggugggguuccugagcguccccaagagccuguccagcgacuccacccuccugcuguucaaggacagcuccagcaagaugggcuacuucccgacggaggagaaguccgagaccgacgagaacagcggcaagcagcccuccaagcucgacgaggacgacagcugcucccugcugaccaaggagagcucccacaacagcuccuucgagcucaucgggagcaccauccccuccuaccagccgugcaaccggcagaccggccgcgggacgagcuucuuccccaccgccggcggcuuccggucccccagccccgggcuguuccgcgccagccugguguccagcgccuccaagagcuccggcaagcucagcgagccgucccugcccaucgaggacagccaggaccuguacaacgccucccccgagcccaagacccucuuccugggggcgggcgacuuccaguucugccuggaggacgacacccagagccagcuccuggacgccgacggguuccugaacgugcggaaccaccgcaaccaguaccaggcccucaagccgcggcugccccuggccuccauggacgagaacgccauggacgcgaacauggacgagcuccuggaccugugcacgggcaaguucaccagccaggccgagaagcaccucccccgcaaguccgacaagaaggagaacauggaggagcugcugaaccucugcagcggcaaguucaccucccaggacgccagcacccccgccuccagcgagcugaacaagcaggagaaggaguccagcaugggggacccgauggaggaggcccuggcgcucugcagcggcuccuuccccacggacaaggaggaggaggacgaggaggaggaguucggggacuuccggcuggucagcaacgacaacgaguucgacuccgacgaggacgagcacagcgacuccggcaacgaccuggcccucgaggaccacgaggacgacgacgaggaggagcugcugaagcgcagcgagaagcucaagcggcagaugcgccugcggaaguaccuggaggacgaggccgagguguccgggagcgacgugggcuccgaggacgaguacgacggcgaggagaucgacgaguacgaggaggacgucaucgacgaggugcuccccagcgacgaggagcugcagucccagaucaagaagauccacaugaagaccaugcuggacgacgacaagcgccagcuccggcuguaccaggagcgcuaccuggccgacggggaccuccacagcgacggccccgggcgcaugcggaaguuccgcuggaagaacaucgacgacgcgucccagauggaccuguuccaccgggacagcgacgacgaccagaccgaggagcagcuggacgaguccgaggcccgcuggcggaaggagcgcaucgagcgggagcaguggcuccgcgacauggcccagcagggcaagaucaccgccgaggaggaggaggagaucggggaggacagccaguucaugauccuggccaagaaggugacggcgaaggcccugcagaagaacgccucccggccgauggucauccaggagagcaagucccuccugcgcaaccccuucgaggccauccggcccggcagcgcccagcaggucaagaccggcagccugcucaaccagcccaaggcggugcugcagaagcuggccgcccucuccgaccacaacccgagcgcgccccgcaacucccggaacuucguguuccacacccugagccccgugaaggccgaggccgccaaggaguccagcaagucccagaagauccccgagaaggacagcgacuggcugaccugguccggggccccgauccccggcuucuuccgccucagcuucgacccccacggguga

SEQ ID NO: 28418 - RNA, 2889 nt, Artificial Sequence
  derived and/or modified sequence opt1 from CLSTN1__Homo_sapiens__NP_001289812
augcugcgccggcccgccccggcccucgcgcccgccgcccgccugcugcucgccggccugcugugcgggggcggggugugggccgcgcgggucaacaagcacaagcccuggcucgagcccaccuaccacggcaucgugaccgagaacgacaacacggugcugcuggacccgccccucaucgcccuggacaaggacgcgccccugcgcuucgccgagagcuucgaggucaccgugaccaaggagggggagaucugcggcuucaagauccacggccagaacgugcccuucgacgccgucgugguggacaaguccaccggggagggcgucauccggagcaaggagaagcucgacugcgagcugcagaaggacuacuccuucacgauccaggccuacgacugcgggaagggcccggacgggaccaacgugaagaagucccacaaggccaccgugcacauccaggucaacgacgugaacgaguacgcccccguguucaaggagaaguccuacaaggccaccgucaucgagggcaagcaguacgacagcauccugcgcguggaggcgguggacgccgacugcagcccccaguucagccagaucugcuccuacgagaucaucacgcccgacgucccguucaccguggacaaggacggcuacaucaagaacaccgagaagcucaacuacgggaaggagcaccaguacaagcugaccgugacggccuacgacugcggcaagaagcgggccaccgaggacguccuggugaagaucagcaucaagccgaccugcacccccggguggcagggcuggaacaaccgcaucgaguacgagcccggcacgggggcccucgcgguguuccccaacauccaccuggagaccugcgacgagcccgucgccuccgugcaggccaccgucgagcuggagaccagccacaucggcaaggggugcgaccgggacacguacuccgagaagucccuccaccgccugugcggcgccgccgcggggaccgccgagcugcuccccagccccagcggcucccugaacuggaccaugggccugccgaccgacaacgggcacgacagcgaccagguguucgaguucaacggcacgcaggccgugcggauccccgacggggucguguccgugagccccaaggagcccuucaccaucagcgucuggaugcgccacggcccguucgggcggaagaaggagaccauccucugcuccagcgacaagaccgacaugaaccgccaccacuacucccuguacgugcacggcugccggcugaucuuccucuuccgccaggaccccagcgaggagaagaaguaccggcccgccgaguuccacuggaagcugaaccaggugugcgacgaggaguggcaccacuacguccugaacguggaguuccccuccgugacgcucuacgucgacggcaccagccacgagccguucuccgugaccgaggacuacccccugcaccccagcaagaucgagacccagcugguggucggggccugcuggcagggcggggaccuccacaugacgcaguucuuccgcggcaaccuggcggggcugacccuccgguccggcaagcuggccgacaagaaggugaucgacugccuguacacgugcaaggagggccucgaccuccaggugcuggaggacagcgggcgcggcguccagauccaggcccacccgucccagcuggugcugacccuggagggggaggaccucggcgagcuggacaaggccaugcagcacaucagcuaccugaacucccggcaguuccccacccccggcauccgccgccugaagaucaccagcaccaucaagugcuucaacgaggcgaccugcaucuccgugcccccggucgacggguacgugauggugcuccagcccgaggagcccaagaucagccuguccggcguccaccacuucgcccgggccgccagcgaguucgaguccagcgaggggguguuccuguuccccgagcuccgcaucaucagcaccaucacgcgggagguggagccggagggcgacggggccgaggaccccaccguccaggagucccuggugagcgaggagaucgugcacgaccuggacacgugcgaggucaccguggagggcgaggagcucaaccacgagcaggagucccuggagguggacauggcgcgccugcagcagaagggcaucgaggucagcuccagcgagcucgggaugaccuucaccggcguggacaccauggccuccuacgaggaggugcugcaccuccugcgguaccgcaacuggcacgcccggagccugcuggaccgcaaguucaagcucaucugcuccgagcugaacgggcgguacaucagcaacgaguucaaggucgaggugaacgugauccacaccgccaaccccauggagcacgccaaccacauggcggcccagccccaguucguccacccggagcaccgcuccuucguggaccugagcggccacaaccucgccaacccccaccccuucgccgugguccccuccacggccaccguggugaucgucgugugcgugagcuuccuggucuucaugaucauccuggggguguuccggauccgcgcggcccaccggcgcaccaugcgggaccaggacaccggcaaggagaacgagauggacugggacgacuccgcccucacgaucaccgugaacccgauggagaccuacgaggaccagcacagcuccgaggaggaggaggaggaggaggaggaggaggagagcgaggacggcgaggaggaggacgacaucaccagcgccgaguccgagagcuccgaggaggaggagggggagcagggcgacccccagaacgcgacgcgccagcagcagcuggagugggacgacagcacccuguccuacuga

SEQ ID NO: 28419 - RNA, 2868 nt, Artificial Sequence
  derived and/or modified sequence opt1 from CLSTN2__Homo_sapiens__NP_071414
augcugcccggccgccucugcugggugccgcugcugcucgcccugggggucggcagcggguccggcgggggcggcgacagccggcagcgccggcugcucgccgcgaaggugaacaagcacaagcccuggaucgagaccuccuaccacggggugaucaccgagaacaacgacacggucauccuggacccgccccugguggcccucgacaaggacgccccggugcccuucgccggcgagaucugcgccuucaagauccacgggcaggagcugcccuucgaggcggucgugcugaacaagaccagcggcgaggggcgccuccgggccaagucccccaucgacugcgagcugcagaaggaguacaccuucaucauccaggccuacgacugcggcgccggcccgcacgagaccgcguggaagaagucccacaaggccgugguccacauccaggugaaggacgugaacgaguucgcccccacguucaaggagcccgccuacaaggccgucgugaccgaggggaagaucuacgacagcauccuccagguggaggcgaucgacgaggacugcagcccccaguacucccagaucugcaacuacgagaucgucaccaccgacgugccguucgccaucgaccgcaacggcaacauccggaacacggagaagcugagcuacgacaagcagcaccaguacgagauccuggugaccgccuacgacugcgggcagaagcccgccgcccaggacacccugguccagguggacgugaagcccgucugcaagcccggcuggcaggacuggaccaagcgcaucgaguaccagccgggcuccgggagcaugccccucuuccccuccauccaccuggagacgugcgacggcgcggugagcucccugcagaucgugaccgagcuccagaccaacuacaucgggaagggcugcgaccgggagaccuacagcgagaagucccugcagaagcugugcggggccagcuccggcaucaucgaccuccugcccagcccgagcgccgccacgaacuggaccgccggccugcucgucgacuccagcgagaugaucuucaaguucgacgggcgccagggcgcgaaggugcccgacgggaucguccccaagaaccugaccgaccaguucaccaucacgauguggaugaagcacggccccuccccgggggugcgggccgagaaggagaccauccugugcaacagcgacaagaccgagaugaaccgccaccacuacgcccucuacgugcacaacugccggcuggucuuccugcuccgcaaggacuucgaccaggccgacaccuuccggcccgccgaguuccacuggaagcuggaccagaucugcgacaaggaguggcacuacuacgugaucaacguggaguuccccgucgugacgcuguacauggacggcgcgaccuacgagcccuaccucgugaccaacgacuggccgauccaccccucccacaucgccaugcagcugaccgucggcgccugcuggcagggcggggaggugacgaagccccaguucgcccaguucuuccacgggagccuggcgucccucaccauccgcccgggcaagauggagagccagaaggugaucuccugccugcaggccugcaaggaggggcuggacaucaacagccucgagucccugggccagggcaucaaguaccacuucaaccccagccaguccauccuggucauggagggggacgacaucggcaacaucaaccgggcccuccagaaggugagcuacaucaacucccgccaguuccccaccgccggggugcggcgccugaaggucagcuccaaggugcagugcuucggcgaggacgugugcaucagcauccccgaggucgacgccuacgugauggugcugcaggcgaucgagccgcggaucacccuccgcggcacggaccacuucuggcgccccgccgcccaguucgaguccgcccgcggggucacccuguuccccgacaucaagaucgugagcaccuucgccaagaccgaggcgcccggcgacgugaagacgaccgaccccaagagcgagguccuggaggagaugcugcacaaccucgacuucugcgacauccuggugaucgggggcgaccuggacccccggcaggagugccucgagcugaaccacuccgagcugcaccagcggcaccucgacgccaccaacagcaccgccggguacuccaucuacggcgugggcagcaugucccgcuacgagcagguccugcaccacauccgguaccgcaacuggcggcccgccagccuggaggcccgccgguuccgcaucaagugcuccgagcucaacgggcgguacaccagcaacgaguucaaccuggagguguccauccugcacgaggaccaggugagcgacaaggagcacgucaaccaccucaucgugcagcccccguuccugcaguccgugcaccaccccgagagccgcuccagcauccagcacuccagcgucgugcccuccaucgcgacgguggucaucaucaucagcgugugcaugcugguguucgucguggccaugggcguguaccggguccgcaucgcccaccagcacuucauccaggagaccgaggccgcgaaggagagcgagauggacugggacgacuccgcccucaccaucaccgugaaccccauggagaagcacgaggggccgggccacggggaggacgagacggagggcgaggaggaggaggaggccgaggaggagaugagcuccagcuccggcagcgacgacuccgaggaggaggaggaggaggaggggaugggccgggggcgccacggccagaacggggcccggcaggcccagcuggagugggacgacagcacccugcccuacuga

SEQ ID NO: 28420 - RNA, 711 nt, Artificial Sequence
  derived and/or modified sequence opt1 from CLTA__Homo_sapiens__NP_001070145
auggccgagcuggaccccuucggcgccccggccggggcccccggcgggcccgcccucggcaacgggguggccggcgccggcgaggaggaccccgcggccgccuuccuggcccagcaggagagcgagaucgcggggaucgagaacgacgaggccuucgccauccuggacggcggggccccgggcccccagccccacggggagcccccgggcggccccgacgccgucgacggggugaugaacggcgaguacuaccaggaguccaacgggcccaccgacagcuacgcggccaucucccagguggaccgccuccagagcgagcccgaguccauccggaaguggcgcgaggagcagauggagcggcuggaggcccuggacgccaacagccgcaagcaggaggccgaguggaaggagaaggcgaucaaggagcucgaggagugguacgcccggcaggacgagcagcugcagaagaccaaggccaacaaccgcgucgccgacgaggccuucuacaagcagccguucgcggacgugaucggcuacguggccgccgaggaggccuucgucaacgacaucgacgaguccagccccggcacggagugggagcggguggcccgccugugcgacuucaaccccaaguccagcaagcaggcgaaggacgugucccggaugcgcagcguccucaucucccugaagcaggcgccccuggugcacuga

SEQ ID NO: 28421 - RNA, 5028 nt, Artificial Sequence
  derived and/or modified sequence opt1 from CLTC__Homo_sapiens__NP_004850
auggcccagauccugcccauccgcuuccaggagcaccuccagcugcagaaccuggggaucaaccccgccaacaucggguucagcacccugaccauggaguccgacaaguucaucugcauccgggagaaggugggcgagcaggcccagguggugaucaucgacaugaacgaccccagcaaccccauccgccggcccaucuccgccgacagcgccaucaugaacccggccuccaaggugaucgcccugaaggccgggaagacgcugcagaucuucaacaucgagaugaaguccaagaugaaggcccacaccaugaccgacgacgucaccuucuggaaguggaucucccucaacaccguggcccuggugaccgacaacgccgucuaccacuggagcauggagggcgagucccagcccgugaagauguucgaccgccacagcucccuggcggggugccagaucaucaacuaccggaccgacgccaagcagaaguggcuccugcugaccggcaucagcgcccagcagaaccgcguggucggcgccaugcagcucuacuccguggaccggaaggugagccagcccaucgaggggcacgccgcguccuucgcccaguucaagauggagggcaacgccgaggagagcacgcuguucugcuucgccguccgcgggcaggccggcgggaagcugcacaucaucgaggugggcacgccgcccaccggcaaccagcccuuccccaagaaggcgguggacgucuucuucccgcccgaggcccagaacgacuuccccguggccaugcagaucuccgagaagcacgacguggucuuccucaucaccaaguacggguacauccaccuguacgaccuggagacggggaccugcaucuacaugaaccggaucagcggggagaccaucuucgugaccgcgccccacgaggccacggcgggcaucaucggcgugaaccgcaaggggcagguccucuccgugugcguggaggaggagaacaucauccccuacaucaccaacguccugcagaacccggaccuggcccuccggauggccgugcgcaacaaccuggccggcgccgaggagcuguucgcgcggaaguucaacgcccucuucgcccaggggaacuacagcgaggccgcgaaggucgccgccaacgcccccaagggcauccugcgcacccccgacaccauccggcgcuuccagagcgugcccgcccagccggggcagacgagcccccugcuccaguacuucggcauccugcuggaccagggccagcucaacaaguacgagagccuggagcugugccggcccgugcuccagcaggggcgcaagcagcugcuggagaaguggcucaaggaggacaagcuggagugcuccgaggagcugggcgaccucgucaagagcguggaccccacccuggcgcuguccguguaccuccgggccaacgucccgaacaaggugauccagugcuucgccgagaccggccaggugcagaagaucguccuguacgccaagaaggugggcuacacccccgacuggaucuuccugcuccgcaacgugaugcggaucagccccgaccaggggcagcaguucgcccagaugcugguccaggacgaggagccccuggcggacaucacgcagaucguggacguguucauggaguacaaccucauccagcagugcaccgccuuccugcuggacgcccugaagaacaaccgcccguccgagggcccccuccagacccgccugcuggagaugaaccucaugcacgcgccccaggucgccgacgcgauccugggcaaccagauguucacccacuacgaccgggcccacaucgcccagcugugcgagaaggccgggcuccugcagcgcgcgcuggagcacuucacggaccucuacgacaucaagcgggccguggugcacacccaccuccugaacccggaguggcucgucaacuacuucggcagccuguccguggaggacagccuggagugccuccgcgccaugcuguccgccaacauccggcagaaccugcagaucugcgugcaggucgccagcaaguaccacgagcagcucuccacccagagccugaucgagcuguucgaguccuucaagagcuucgagggccucuucuacuuccugggcuccaucgugaacuucagccaggaccccgacgugcacuucaaguacauccaggcggccugcaagaccgggcagaucaaggaggucgagcgcaucugccgggaguccaacugcuacgaccccgagcgcgugaagaacuuccugaaggaggccaagcucacggaccagcugccccugaucaucgugugcgaccgguucgacuucguccacgaccucgugcuguaccuguaccgcaacaaccuccagaaguacaucgagaucuacgugcagaaggucaacccgagccggcugcccguggugaucggcggccugcucgacgucgacugcagcgaggacgugaucaagaaccugauccuggugguccgcgggcaguucuccaccgacgagcucguggccgagguggagaagcggaaccgccugaagcugcuccugcccuggcuggaggcccggauccacgagggcugcgaggagcccgcgacccacaacgcccucgccaagaucuacaucgacagcaacaacaacccggagcgcuuccugcgggagaaccccuacuacgacucccgcgucguggggaaguacugcgagaagcgggacccccaccuggccugcguggccuacgagcgcggccagugcgaccucgagcugaucaacgucugcaacgagaacagccuguucaagucccucagccgcuaccuggugcggcgcaaggaccccgagcuguggggcuccgugcuccuggagagcaacccguaccggcgcccccugaucgaccaggucgugcagaccgcgcucuccgagacgcaggaccccgaggaggugagcgucaccgugaaggccuucaugaccgccgaccugcccaacgagcugaucgagcuccuggagaagaucgugcuggacaacuccgucuucagcgagcaccggaaccuccagaaccugcugauccucaccgccaucaaggcggaccgcacccgggugauggaguacaucaaccgccuggacaacuacgacgccccggacaucgccaacaucgccaucuccaacgagcuguucgaggaggccuucgcgaucuuccggaaguucgacgucaacacgagcgccguccaggugcucaucgagcacaucgggaaccuggaccgcgccuacgaguucgccgagcggugcaacgagcccgccgucuggucccagcuggcgaaggcccagcuccagaagggcauggugaaggaggccaucgacagcuacaucaaggccgacgaccccuccagcuacauggaggugguccaggccgcgaacaccagcgggaacugggaggagcuggugaaguaccugcagauggcccgcaagaaggcccgggaguccuacguggagaccgagcucaucuucgcccuggccaagaccaaccgccuggcggagcucgaggaguucaucaacggccccaacaacgcccacauccagcaggucggggaccggugcuacgacgagaagauguacgacgccgccaagcugcuguacaacaacgugagcaacuucggccgccucgcguccacgcuggugcaccugggcgaguaccaggccgccgucgacggggcccggaaggccaacagcacccgcaccuggaaggaggugugcuucgcgugcguggacggcaaggaguuccggcucgcccagaugugcgggcugcacaucgucgugcacgccgacgagcuggaggagcucaucaacuacuaccaggaccgcggcuacuucgaggagcugaucaccaugcuggaggccgcccucgggcuggagcgggcgcacaugggcauguucacggagcuggccauccucuacuccaaguucaagccgcagaagaugcgcgagcaccuggagcuguucuggagccgcgugaacauccccaagguccuccgggccgccgagcaggcccaccugugggcggagcugguguuccuguacgacaaguacgaggaguacgacaacgccaucaucaccaugaugaaccaccccaccgacgccuggaaggagggccaguucaaggacaucaucaccaagguggccaacgucgagcucuacuaccgcgcgauccaguucuaccuggaguucaagccccugcuccugaacgaccugcucauggugcuguccccgcggcuggaccacacgcgcgccgugaacuacuucagcaaggucaagcagcucccccuggugaagcccuaccugcgguccgugcagaaccacaacaacaagagcgucaacgagucccucaacaaccuguucaucaccgaggaggacuaccaggcccugcgcaccagcaucgacgccuacgacaacuucgacaacaucucccucgcccagcggcuggagaagcacgagcugaucgaguuccgccggaucgcggccuaccucuucaaggggaacaaccgcuggaagcagagcguggagcugugcaagaaggacucccuguacaaggacgccaugcaguacgccagcgaguccaaggacaccgagcucgccgaggagcugcugcagugguuccuccaggaggagaagcgggagugcuucggcgcgugccuguucacgugcuacgaccugcuccgcccggacgugguccuggagaccgccuggcggcacaacaucauggacuucgccaugcccuacuucauccaggugaugaaggaguaccugaccaagguggacaagcucgacgccagcgagucccugcgcaaggaggaggagcaggccaccgagacgcagcccaucgucuacgggcagccccagcugaugcucaccgcgggcccgagcguggccgugccgccccaggcccccuucggguacggcuacaccgccccgcccuacggccagccccagcccggguucggcuacagcauguga

SEQ ID NO: 28422 - RNA, 4752 nt, Artificial Sequence
  derived and/or modified sequence opt1 from CLTCL1__Homo_sapiens__NP_001826
auggcccagauccugcccgugcgcuuccaggagcacuuccagcuccagaaccugggcaucaacccggccaacaucggguucagcacccugaccauggaguccgacaaguucaucugcauccgggagaaggucggcgagcaggcccaggugacgaucaucgacaugagcgaccccauggcccccauccgccggcccaucuccgccgagagcgccaucaugaacccggccuccaaggugaucgcccucaaggccgggaagacccugcagaucuucaacaucgagaugaaguccaagaugaaggcccacaccauggccgaggaggucaucuucuggaaguggguguccgugaacaccgucgcgcuggugacggagaccgccguguaccacuggagcauggagggcgacucccagcccaugaagauguucgaccgccacaccagccucgucgggugccaggugauccacuaccggaccgacgaguaccagaaguggcugcugcucgugggcaucuccgcccagcagaaccgcgucgugggcgccaugcagcuguacagcguggaccggaaggucucccagcccaucgaggggcacgccgcggccuucgccgaguucaagauggagggcaacgccaagcccgccacgcuguucugcuucgcggugcgcaacccgaccgggggcaagcuccacaucaucgagguggggcagcccgccgccggcaaccagcccuucgucaagaaggccguggacguguucuucccgcccgaggcccagaacgacuuccccgucgcgaugcagaucggcgccaagcacggggugaucuaccugaucaccaaguacggcuaccugcaccucuacgaccuggagagcggggugugcaucugcaugaaccggaucuccgccgacaccaucuucgucacggcgccccacaagcccaccagcggcaucaucggcgugaacaagaaggggcagguccuguccgugugcguggaggaggacaacaucgucaacuacgccaccaacgugcuccagaacccggaccugggccugcgccucgcggugcggagcaaccuggccggggccgagaagcuguucguccgcaaguucaacacccucuucgcccagggcuccuacgcggaggccgccaagguggccgccagcgcgcccaaggggauccugcggacgcgcgagaccgugcagaaguuccagagcauccccgcccaguccggccaggccagcccccugcuccaguacuucggcauccugcuggaccaggggcagcucaacaagcuggagucccuggagcucugccaccugguccugcagcagggccggaagcagcuccuggagaaguggcugaaggaggacaagcucgagugcagcgaggagcugggggaccuggugaagaccaccgacccgaugcucgcccuguccguguaccugcgcgccaacguccccagcaaggugauccagugcuucgcggagacgggccaguuccagaagaucgugcucuacgccaagaaggucggguacacccccgacuggaucuuccugcugcggggcgugaugaagaucucccccgagcagggccuccaguucagccgcaugcuggugcaggacgaggagccgcuggccaacaucucccagaucgucgacaucuucauggagaacagccugauccagcagugcaccuccuuccuccuggacgcccugaagaacaaccggcccgccgaggggcuccugcagaccuggcugcucgagaugaaccuggugcacgcgccccagguggccgacgccauccugggcaacaagauguucacgcacuacgaccgcgcccacaucgcgcagcucugcgagaaggccgggcugcugcagcaggcccucgagcacuacaccgaccuguacgacaucaagcgggccgucgugcacacccaccuccucaaccccgaguggcuggugaacuucuucggcagccuguccgucgaggacagcguggagugccuccacgccaugcuguccgcgaacauccgccagaaccugcagcucugcgugcaggucgccagcaaguaccacgagcagcuggggacccaggcccugguggagcuguucgaguccuucaagagcuacaagggccuguucuacuuccugggcuccaucgugaacuucagccaggacccggacguccaccucaaguacauccaggccgccugcaagacggggcagaucaaggagguggagcgcaucugccgggagagcuccugcuacaaccccgagcgcgugaagaacuuccugaaggaggcgaagcugaccgaccagcucccccugaucaucgucugcgaccgguucggcuucgugcacgaccuggugcucuaccuguaccgcaacaaccugcagcgguacaucgagaucuacguccagaaggugaacccgagccgcacccccgccgugaucgggggccuccuggacgucgacugcuccgaggaggugaucaagcaccugaucauggccgugcggggccaguucagcaccgacgagcucgucgccgagguggagaagcgcaaccggcugaagcugcuccugcccuggcuggagucccagauccaggaggggugcgaggagcccgccacgcacaacgcgcucgccaagaucuacaucgacagcaacaacuccccggagugcuuccugcgcgagaacgccuacuacgacagcuccguggucggccgguacugcgagaagcgcgacccccaccuggccugcguggcguacgagcgggggcagugcgaccucgagcugaucaaggugugcaacgagaacagccuguucaaguccgaggcccgcuaccucgucugccggaaggaccccgagcugugggcccacgugcuggaggagaccaaccccagccgccggcagcucaucgaccaggugguccagaccgcccuguccgagacccgcgacccggaggagaucagcgugacggucaaggccuucaugaccgcggaccugcccaacgagcucaucgagcugcuggagaagaucgugcucgacaacuccguguucagcgagcaccggaaccugcagaaccugcucauccugaccgccaucaaggccgaccgcacccgcgucauggaguacaucucccggcuggacaacuacgacgcccucgacaucgccagcaucgcggugagcuccgcccuguacgaggaggccuucaccguguuccacaaguucgacaugaacgccagcgccauccagguccugaucgagcacaucggcaaccucgaccgcgcguacgaguucgccgagcggugcaacgagcccgccguguggucccagcuggcccaggcccagcugcagaaggaccucgugaaggaggcgaucaacagcuacauccgcggggacgaccccuccagcuaccuggaggucgugcaguccgccagccgguccaacaacugggaggaccuggugaaguuccuccagauggcccgcaagaagggccgggagagcuacaucgagacggagcugaucuucgcccuggcgaagaccucccgcgucagcgagcucgaggacuucaucaacggcccgaacaacgcccacauccagcaggucggggaccggugcuacgaggagggcauguacgaggccgccaagcugcuguacuccaacgugagcaacuucgcccgccucgcguccacccuggugcaccugggggaguaccaggccgccguggacaacagccggaaggccuccagcacccgcacguggaaggaggugugcuucgccugcauggacggccaggaguuccgguucgcgcagcucugcgggcugcacaucgucauccacgccgacgagcuggaggagcucaugugcuacuaccaggaccgcggcuacuucgaggagcugauccugcuccuggaggccgcccugggccucgagcgggcccacauggggauguucaccgagcuggcgauccuguacuccaaguucaagccccagaagaugcuggagcaccucgagcuguucuggagccgcgugaacauccccaaggugcugcgggccgccgagcaggcccaccucugggcggagcuggucuuccuguacgacaaguacgaggaguacgacaacgccgugcucaccaugaugagccaccccaccgaggccuggaaggagggccaguucaaggacaucaucacgaagguggccaacgucgagcugugcuaccgcgcccugcaguucuaccucgacuacaagccgcugcugaucaacgaccuccugcuggugcucagcccccggcuggaccacaccuggaccgugagcuucuucuccaaggcggggcagcugccccucgucaagcccuaccugcgcagcgugcagucccacaacaacaagagcgugaacgaggcccugaaccaccuccugaccgaggaggaggacuaccaggacgccaugcagcacgccgccgagucccgggacgcggagcuggcccagaagcuccugcagugguuccuggaggagggcaagcgcgagugcuucgccgccugccucuucacgugcuacgaccugcugcgcccggacaugguccucgagcuggccuggcggcacaaccugguggaccucgcgaugcccuacuucauccaggugaugcgcgaguaccugagcaaggucgacaagcuggacgcccucgagucccugcggaagcaggaggagcacgugaccgagcccgcgccccugguguucgacuucgacgggcacgaguga

SEQ ID NO: 28423 - RNA, 1242 nt, Artificial Sequence
  derived and/or modified sequence opt1 from CLUAP1__Homo_sapiens__NP_055856
augagcuuccgcgaccugcggaacuucaccgagaugaugcgcgcccucggcuacccccggcacaucuccauggagaacuuccgcaccccgaacuucgggcuggugagcgagguccugcucuggcuggugaagcgguacgagccccagacggacaucccgcccgacguggacaccgagcaggaccgcgucuucuucaucaaggccaucgcgcaguucauggccaccaaggcccacaucaagcugaacaccaagaagcucuaccaggccgacggcuacgccgugaaggagcugcugaagaucacguccgugcucuacaacgcgaugaagaccaaggggauggagggcagcgagaucgucgaggaggacgugaacaaguucaaguucgaccugggguccaagaucgccgaccugaaggccgcccggcagcucgcgagcgagaucaccuccaagggcgccagccuguacgaccugcucggcauggagguggagcugcgcgagaugcggaccgaggccaucgcccgcccccuggagaucaacgagacggagaaggucaugcggaucgccaucaaggagauccucacccaggugcagaagaccaaggaccugcugaacaacguggcguccgacgaggccaaccucgaggccaagaucgagaagcgcaagcuggagcuggagcggaaccgcaagcggcucgagacccugcagagcguccgccccugcuucauggacgaguacgagaagacggaggaggagcugcagaagcaguacgacaccuaccucgagaaguuccagaaccugaccuaccuggagcagcagcucgaggaccaccaccggauggagcaggagcgcuucgaggaggccaagaacacccugugccugauccagaacaagcucaaggaggaggagaagcggcugcugaaguccgggagcaacgacgacuccgacaucgacauccaggaggacgacgagagcgacuccgagcucgaggagcgccggcugcccaagccccagacggccauggagaugcugaugcagggccgcccggggaagcgcaucgugggcaccaugcagggcggggacagcgacgacaacgaggacuccgaggagagcgagaucgacauggaggacgacgacgacgaggacgacgaccucgaggacgaguccaucagccugagccccaccaagcccaaccggcgcgugcggaaguccgagccccuggacgagagcgacaacgacuucuga

SEQ ID NO: 28424 - RNA, 1350 nt, Artificial Sequence
  derived and/or modified sequence opt1 from CLU__Homo_sapiens__NP_001822
augaugaagacccugcuccuguucgugggccugcuccugaccugggagagcgggcagguccugggcgaccagacgguguccgacaacgagcuccaggagaugagcaaccagggguccaaguacgugaacaaggagauccagaacgccgucaacggcgugaagcagaucaagacccugaucgagaagaccaacgaggagcgcaagacccugcucagcaaccuggaggaggccaagaagaagaaggaggacgcgcugaacgagacgcgggaguccgagaccaagcucaaggagcugcccggggugugcaacgagaccaugauggcccugugggaggagugcaagccgugccucaagcagaccugcaugaaguucuacgcccgcgucugccggagcggcuccggccugguggggcgccagcuggaggaguuccucaaccagagcucccccuucuacuucuggaugaacggcgaccggaucgacagccugcuggagaacgaccgccagcagacgcacaugcucgacgugaugcaggaccacuucucccgggccagcuccaucaucgacgagcuguuccaggaccgcuucuucacccgggagccccaggacaccuaccacuaccugcccuucagccucccgcaccgccggccccacuucuucuuccccaagucccgcaucguccggagccugaugcccuucuccccguacgagccccugaacuuccacgccauguuccagcccuuccucgagaugauccacgaggcgcagcaggccauggacauccacuuccacagccccgccuuccagcacccgcccaccgaguucauccgcgagggggacgacgaccggacggugugccgcgagauccggcacaacuccaccggcugccugcgcaugaaggaccagugcgacaagugccgggagauccugagcguggacugcagcaccaacaaccccucccaggccaagcuccgccgggagcuggacgagagccugcaggucgcggagcgccucacccgcaaguacaacgagcugcugaaguccuaccaguggaagaugcucaacacgagcucccugcuggagcagcucaacgagcaguucaacugggugagccggcuggccaaccugacccagggggaggaccaguacuaccuccgcgugaccaccgucgccucccacacgagcgacuccgacgugcccagcggcgugaccgaggucguggugaagcuguucgacuccgacccgaucaccgucaccgugcccguggaggucagccggaagaaccccaaguucauggagacgguggccgagaaggcccugcaggaguaccgcaagaagcaccgggaggaguga

SEQ ID NO: 28425 - RNA, 1557 nt, Artificial Sequence
  derived and/or modified sequence opt1 from CLUL1__Homo_sapiens__NP_001275965
augcgcaccugggacuaccgguggagccuggcccucguggcccagaccggcguccacugcugcaaccuguccagccugcagccccucccgccccgcuucaagcgguucuccugccugagccuguccagcgggugggacuacuccaacagcggcaacaugaagccgccccuccugguguucaucgugugccugcucuggcugaaggacucccacugcgcgcccacguggaaggacaagaccgccaucagcgagaaccugaaguccuucagcgaggucggggagaucgacgccgacgaggaggugaagaaggcccucaccggcaucaagcagaugaagaucaugauggagcgcaaggagaaggagcacaccaaccugauguccacgcugaagaagugccgggaggagaagcaggaggcccucaagcugcugaacgaggugcaggagcaccucgaggaggaggagcgccugugccgggagagccuggcggacuccuggggcgagugccgcagcugccucgagaacaacugcaugcggaucuacacgaccugccagcccuccuggagcuccgucaagaacaagaucgagcgcuucuuccggaagaucuaccaguuccuguuccccuuccacgaggacaacgagaaggaccugcccaucagcgagaagcucaucgaggaggacgcccagcugacccagauggaggacguguucagccagcugaccguggacgucaacucccucuucaaccgcagcuucaacguguuccggcagaugcagcaggaguucgaccagaccuuccagucccacuucaucagcgacaccgaccugaccgagccguacuucuuccccgccuucuccaaggagcccaugacgaaggccgaccuggagcagugcugggacauccccaacuucuuccagcuguucugcaacuucagcguguccaucuacgagagcgucuccgagaccaucaccaagaugcucaaggcgaucgaggaccugccgaagcaggacaaggcccccgaccacgggggccucaucagcaagaugcugcccgggcaggaccgcggccugugcggggagcucgaccagaaccugucccggugcuucaaguuccacgagaagugccagaagugccaggcccaccugagcgaggacugccccgacgugccggcccuccacaccgagcuggacgaggccauccgccuggugaacgucuccaaccagcaguacggccagauccuccagaugacgcggaagcaccuggaggacaccgcguaccugguggagaagaugcgcgggcaguucggcugggugagcgagcucgccaaccaggcccccgagaccgagaucaucuucaacuccauccaggucgugccccggauccacgagggcaacaucagcaagcaggacgagaccaugaugacggaccuguccauccugcccagcuccaacuucacccucaagaucccgcuggaggagagcgccgagagcuccaacuucaucggguacguggucgccaaggcgcugcagcacuucaaggagcacuucaagaccugguga

SEQ ID NO: 28426 - RNA, 1065 nt, Artificial Sequence
  derived and/or modified sequence opt1 from CLVS1__Homo_sapiens__NP_775790
augggccccgugagccugcucccgaaguaccagaagcugaacaccuggaacggggaccuggccaagaugacccaccuccaggccggccugucccccgagacgaucgagaaggcgcgccuggagcucaacgagaaccccgacguccugcaccaggacauccagcagguccgggacaugaucaucacccgccccgacaucggguuccugcggaccgacgacgccuucauccuccgcuuccugcgggcccgcaaguuccaccaggccgacgccuuccggcugcucgcgcaguacuuccaguaccgccagcugaaccuggacauguucaagaacuucaaggccgacgacccgggcaucaagcgggcccucaucgacggguuccccggcgugcuggagaaccgcgaccacuacggccggaagauccugcuccuguucgccgcgaacugggaccagagccgcaacuccuucaccgacauccugcgggccauccuccugagccuggaggugcucaucgaggaccccgagcugcagaucaacggguucauccugaucaucgacugguccaacuucagcuucaagcaggccuccaagcucacgcccagcauccugaagcuggccaucgagggccuccaggacuccuucccggcccgcuucgggggcgugcacuucgugaaccagcccugguacauccacgcgcuguacacccugaucaagcccuuccucaaggacaagacccggaagcgcaucuuccugcacgggaacaaccugaacagccuccaccagcugauccaccccgaguuccugccguccgaguucggcggcacccucccgcccuacgacauggggacgugggcccggacccugcugggccccgacuacagcgacgagaacgacuacacccacaccuccuacaacgccaugcacgucaagcacacgagcuccaaccucgagcgcgagugcagccccaagcugaugaagcggucccagagcgugguggaggccgggacccugaagcacgaggagaagggcgagaacgagaacacccagccccuccuggcccuggacuga

SEQ ID NO: 28427 - RNA, 1023 nt, Artificial Sequence
  derived and/or modified sequence opt1 from CLYBL__Homo_sapiens__NP_996531
auggcccugcgccuccugcggcgcgccgcgcggggcgccgccgccgccgcgcugcuccgccugaaggccagccuggccgccgacaucccccggcucggguacuccagcuccagccaccacaaguacaucccgcgccgggcggugcuguacguccccggcaacgacgagaagaagaucaagaagauccccucccugaacguggacugcgccgugcucgacugcgaggacggggucgccgccaacaagaagaacgaggcccgccugcggaucgugaagacccuggaggacaucgaccucggccccaccgagaagugcgugcgcgucaacagcguguccagcgggcuggcggaggaggaccuggagacgcuccugcagucccgggugcugccgagcucccucaugcugcccaaggucgagagccccgaggagauccagugguucgccgacaaguucuccuuccaccugaagggccgcaagcucgagcagcccaugaaccugaucccguucguggagaccgccaugggccugcucaacuucaaggccgugugcgaggagacccugaaggucgggccccaggugggccuguuccucgacgccguggucuucgggggcgaggacuuccgggcgagcaucggggccaccuccagcaaggagacgcuggacauccuguacgcccgccagaagaucguggugaucgccaaggccuucggccuccaggcgaucgaccuggucuacaucgacuuccgggacggcgccgggcugcuccgccagucccgggagggcgccgccaugggguucaccggcaagcaggucauccaccccaaccagaucgccguggugcaggagcaguucagccccuccccggagaagaucaagugggcggaggagcugaucgccgccuucaaggagcaccagcagcugggcaagggggccuucaccuuccagggcagcaugaucgacaugccccuccugaagcaggcgcagaacaccgugacgcuggccaccagcaucaaggagaaguga

SEQ ID NO: 28428 - RNA, 744 nt, Artificial Sequence
  derived and/or modified sequence opt1 from CMA1__Homo_sapiens__NP_001827
augcugcuccugccccugccccuccugcuguuccuccugugcagccgcgccgaggccggcgagaucaucgggggcaccgagugcaagccccacucccggcccuacauggcguaccuggagaucgugaccagcaacgggcccuccaaguucugcggcggguuccucauccgccggaacuucguccugacggccgcccacugcgccggccgcagcaucaccgugacccugggcgcccacaacaucaccgaggaggaggacacguggcagaagcucgaggugaucaagcaguuccggcacccgaaguacaacaccuccacccugcaccacgacaucaugcugcucaagcugaaggagaaggcgagccugacccucgccgucgggacgcugcccuuccccucccaguucaacuucgugcccccgggccgcaugugccggguggccggguggggccgcaccgggguccugaagcccggcagcgacacccuccaggaggugaagcugcggcugauggacccccaggccugcucccacuuccgcgacuucgaccacaaccuccagcugugcgugggcaacccccggaagaccaagagcgcguucaagggggacuccggcgggccgcugcucugcgccggcgucgcccagggcaucgugagcuacgggcgcuccgacgccaagccgcccgccguguucacgcggaucagccacuaccgccccuggaucaaccagauccugcaggcgaacuga

SEQ ID NO: 28429 - RNA, 1305 nt, Artificial Sequence
  derived and/or modified sequence opt1 from CMAS__Homo_sapiens__NP_061156
auggacagcguggagaagggcgccgccaccuccgucagcaacccccgcgggcggccgucccgcggccggccgcccaagcugcagcgcaacagccgcgggggccaggggcggggcguggagaagccgccccaccucgcggcccugauccuggcccggggcggguccaagggcaucccccucaagaacaucaagcaccuggccggggugccccugaucggcuggguccuccgcgccgcgcuggacagcggggccuuccaguccgugugggugagcaccgaccacgacgagaucgagaacgucgccaagcaguucggcgcccaggugcaccggcgcuccagcgagguguccaaggacagcuccacgagccuggacgcgaucaucgaguuccucaacuaccacaacgaggucgacaucgugggcaacauccaggccaccucccccugccugcaccccaccgaccugcagaagguggccgagaugauccgggaggagggguacgacagcgucuucuccguggugcgccggcaccaguuccgcuggagcgagauccagaagggcguccgggaggugaccgagccccucaaccugaaccccgccaagcgcccccggcgccaggacugggacggggagcuguacgagaacggcuccuucuacuucgccaagcggcaccucaucgagaugggcuaccugcagggcgggaagauggcguacuacgagaugcgcgccgagcacagcguggacaucgacgucgacaucgacuggccgaucgccgagcagcgggugcugcgcuacggguacuucggcaaggagaagcucaaggagaucaagcugcuggugugcaacaucgacgggugccucacgaacggccacaucuacgucagcggcgaccagaaggagaucaucuccuacgacgugaaggacgccaucgggaucagccugcugaagaaguccggcaucgaggugcgccucaucagcgagcgggccugcuccaagcagacccugagcucccugaagcucgacugcaagauggaggucagcguguccgacaagcuggcggucguggacgaguggcgcaaggagauggggcugugcuggaaggagguggccuaccucggcaacgaggucagcgacgaggagugccugaagcggguggggcuguccggcgcccccgccgacgccugcagcaccgcgcagaaggccgugggcuacaucugcaagugcaacgggggccgcggggccauccgggaguucgccgagcacaucugccuccugauggagaaggucaacaacuccugccagaaguga

SEQ ID NO: 28430 - RNA, 321 nt, Artificial Sequence
  derived and/or modified sequence opt1 from CMC1__Homo_sapiens__NP_872329
auggcccuggaccccgccgaccagcaccuccgccacguggagaaggacguccugaucccgaagaucaugcgggagaaggcgaaggagcgcugcagcgagcagguccaggacuucaccaagugcugcaagaacuccggcgugcugaugguggugaagugccggaaggagaacagcgcccucaaggagugccugaccgccuacuacaacgaccccgccuucuacgaggagugcaagauggaguaccugaaggagcgcgaggaguuccggaagacggggauccccaccaagaagcgccuccagaagcugcccaccuccauguga

SEQ ID NO: 28431 - RNA, 240 nt, Artificial Sequence
  derived and/or modified sequence opt1 from CMC2__Homo_sapiens__NP_064573
augcaccccgaccugagcccccaccuccacaccgaggagugcaacgugcugaucaaccugcucaaggagugccacaagaaccacaacauccugaaguucuucggcuacugcaacgacgucgaccgcgagcugcggaagugccucaagaacgaguacguggagaaccgcaccaagucccgggagcacgggaucgccaugcgcaagaagcuguucaacccgcccgaggagagcgagaaguga

SEQ ID NO: 28432 - RNA, 207 nt, Artificial Sequence
  derived and/or modified sequence opt1 from CMC4__Homo_sapiens__NP_001018024
augccccagaaggacccgugccagaagcaggccugcgagauccagaagugccugcaggccaacagcuacauggaguccaagugccaggcggugauccaggagcuccgcaagugcugcgcccaguaccccaagggccggagcgucgugugcuccggguucgagaaggaggaggaggagaaccugacccgcaagagcgccuccaaguga

SEQ ID NO: 28433 - RNA, 2040 nt, Artificial Sequence
  derived and/or modified sequence opt1 from CMIP__Homo_sapiens__NP_085132
augggccaggccgccgagcccaccggguacauggagaacagcguguccuacagcgcgaucgaggacguccagcugcucuccugggagaacgccccgaaguacugccugcagcugaccauccccggcgggacggugcuccugcaggccgccaacagcuaccugcgcgaccagugguuccacucccuccaguggaagaagaagaucuacaaguacaagaaggugcugagcaaccccucccggugggaggucgugcugaaggagauccgcacccucguggacauggcccugaccagcccccugcaggacgacuccaucaaccaggcgccgcucgagaucgucagcaagcugcuguccgagaacaccaaccucacgacccaggagcacgagaacaucaucguggccaucgcgccccugcuggagaacaaccacccgccgcccgaccucugcgaguucuucugcaagcacugccgggagcgcccccggagcaugguggucaucgagguguucacccccgugguccagcgcauccugaagcacaacauggacuucggcaagugcccccggcugcgccucuucacccaggaguacauccuggcccugaacgagcucaacgccgggauggagguggugaagaaguucauccaguccaugcacggccccacgggccacugcccccacccccggguccugcccaaccugguggccgugugccucgccgccaucuacagcugcuacgaggaguucaucaacucccgcgacaacagcccgucccugaaggagauccggaacgggugccagcagcccugcgaccgcaagcccacccugccccuccggcugcugcacccgagccccgaccucgucucccaggaggccacccugagcgaggcgcgccucaagagcgugguggucgccuccagcgagauccacguggagguggagcggaccuccacggccaagcccgcccucaccgccagcgcgggcaacgacuccgagcccaaccugaucgacugccugauggucagcccggccugcuccaccaugagcaucgagcucgggccccaggccgaccgcacccugggcugcuacguggagauccugaagcuccuguccgacuacgacgacuggcggcccagccuggccucccuccugcagcccaucccguuccccaaggaggcccuggcgcacgagaaguucacgaaggagcucaaguacgucauccagcgcuucgccgaggacccccggcaggaggugcacagcugccugcuguccgugcgcgccgggaaggacggcugguuccagcuguacagcccgggcggggucgccugcgacgacgacggcgagcuguucgccuccauggugcacauccugauggggagcugcuacaagaccaagaaguuccugcucucccuggcggagaacaagcugggccccugcaugcuccuggcccugcggggcaaccagaccaugguggagauccucugccugaugcuggaguacaacaucaucgacaacaacgacacccagcuccagaucaucagcacgcuggaguccaccgacgucgggaagcgcauguacgagcagcugugcgaccgccagcgggagcucaaggagcugcagcgcaagggcgggcccacccggcugacccuccccagcaagagcacggacgccgaccuggcccgccugcucuccagcggcuccuucgggaaccuggagaaccugagccucgcguucaccaacgugaccuccgccugcgccgagcaccugaucaagcugccgagccucaagcagcugaaccugugguccacccaguucggcgacgccggccuccggcugcugagcgagcaccucacgaugcuccaggugcugaaccugugcgagacccccgucaccgacgccgggcugcuggcgcucuccagcaugaagucccugugcagccugaacaugaacuccaccaagcucagcgccgacacguacgaggaccugaaggccaagcugcccaaccucaaggagguggacgugcgcuacaccgaggccugguga

SEQ ID NO: 28434 - RNA, 1122 nt, Artificial Sequence
  derived and/or modified sequence opt1 from CMKLR1__Homo_sapiens__NP_001135815
augcgcauggaggacgaggacuacaacaccagcaucuccuacggcgacgaguaccccgacuaccuggacagcaucgugguccucgaggaccuguccccgcuggaggcccgggugacccgcaucuuccucguggucguguacagcaucgugugcuuccuggggauccugggcaacgggcucgucaucaucaucgccacguucaagaugaagaagaccgugaacauggugugguuccugaaccuggcggucgccgacuuccucuucaacguguuccugcccauccacaucaccuacgccgccauggacuaccacuggguguucggcaccgccaugugcaagaucuccaacuuccugcucauccacaacauguucacgagcgucuuccugcugaccaucaucuccagcgaccggugcaucuccgugcuccugcccguguggagccagaaccaccgcuccguccggcuggcguacauggccugcauggugaucugggugcucgccuucuuccugagcucccccagccuggucuuccgcgacaccgccaaccuccacgggaagaucuccugcuucaacaacuucagccuguccaccccgggcagcuccagcuggcccacgcacagccagauggaccccgugggcuacucccggcacaugguggucaccgugacccgcuuccugugcggguuccucgugcccguccugaucaucaccgcgugcuaccugacgaucgugugcaagcuccagcggaaccgccuggccaagaccaagaagccguucaagaucaucgucaccaucaucaucaccuucuuccugugcuggugccccuaccacacgcucaaccugcuggagcuccaccacaccgccaugcccggcagcguguucucccuggggcugccccucgccaccgcccuggcgaucgccaacagcugcaugaacccgauccuguacguguucaugggccaggacuucaagaaguucaaggucgcccucuucucccggcuggugaacgcccugagcgaggacaccgggcacuccagcuaccccucccaccgcagcuucacgaagauguccagcaugaacgagcggaccuccaugaacgagcgcgagaccggcaugcucuga

SEQ ID NO: 28435 - RNA, 1230 nt, Artificial Sequence
  derived and/or modified sequence opt1 from CMPK2__Homo_sapiens__NP_001243406
auggccuucgcccgccggcugcuccgcggcccccugagcgggccgcugcucggccggcgcggggugugcgcgggcgccauggccccgccccggcgcuucguccuggagcugcccgacugcacccucgcccacuucgcccugggggcggacgcccccggcgacgccgacgcccccgacccccggcuggcggcccuccuggggcccccggagcgcuccuacagccugugcgugcccgugacccccgacgccggcugcggcgcccggguccgcgccgcgcggcuccaccagcgccugcugcaccagcuccggcgcgggcccuuccagcggugccagcugcugcgccuccugugcuacugcccgggcgggcaggccggcggcgcccagcagggguuccugcuccgggacccccuggacgaccccgacacgcgccaggcccugcucgagcugcugggcgccugccaggaggcgccccggccgcaccucggggaguucgaggccgacccccgcggccagcuguggcagcggcugugggaggugcaggacggccgccgccuccagguggggugcgcccaggucgugcccgugcccgagccgccccugcaccccgucgugcccgaccugccguccagcguggucuuccccgaccgggaggccgcccgcgcggugcucgaggagugcaccuccuucauccccgaggcccgggccgugcuggaccuggucgaccagugccccaagcagauccagaagggcaaguuccaggugguggccaucgaggggcucgacgccaccggcaagaccacggucacccagagcguggcggacucccugaaggccgugcugcucaagagcccgcccuccugcaucgggcaguggcgcaagaucuucgacgacgagcccaccaucauccggcgcgccuucuacagccugggcaacuacaucgucgccuccgagaucgcgaaggagagcgccaaguccccggugaucguggaccgguacuggcacagcaccgccacguacgccaucgccaccgaggucuccggcgggcugcagcaccucccgcccgcgcaccaccccguguaccaguggcccgaggaccugcugaagcccgaccucauccugcugcucaccgucagccccgaggagcgccugcagcggcugcagggccgcgggauggagaagacccgggaggaggccgagcuggaggccaacuccguguuccgccagaaguga

SEQ ID NO: 28436 - RNA, 786 nt, Artificial Sequence
  derived and/or modified sequence opt1 from CMSS1__Homo_sapiens__NP_001161396
augcacggcgaggcgagcgacggggagggcgagggggacaccgaggugaugcagcaggagaccguccccgugccggugcccuccgagaagacgaagcagcccaaggagugcuuccugauccagcccaaggagcgcaaggagaacaccaccaagacccggaagcgccggaagaagaagaucacggacguccucgccaagagcgagccgaagcccggccugcccgaggaccugcagaagcucaugaaggacuacuacuccagccgccggcuggugaucgagcuggaggagcucaaccugcccgacuccugcuuccugaaggcgaacgaccucacccacagccuguccagcuaccugaaggagaucugcccgaagugggugaagcuccgcaagaaccacuccgagaagaaguccguccugaugcugaucaucugcagcagcgccgugcgggcccucgagcugauccgcuccaugaccgccuuccgcggggacggcaaggugaucaagcuguucgccaagcacaucaagguccaggcccaggugaagcuccuggagaagcgggugguccaccugggcguggggacccccggccggaucaaggagcucgugaagcagggcgggcugaaccugagcccccucaaguuccuggucuucgacuggaacuggcgcgaccagaagcugcggcgcaugauggacauccccgagauccggaaggagguguucgagcuccuggagaugggggugcugucccucugcaagagcgagucccugaagcugggccucuucuga

SEQ ID NO: 28437 - RNA, 549 nt, Artificial Sequence
  derived and/or modified sequence opt1 from CMTM3__Homo_sapiens__NP_853531
auguggcccccggaccccgaccccgaccccgacccggagcccgccggcgggagccgccccggccccgccgugccggggcugcgggcgcuccugcccgcccgcgccuuccugugcucccucaagggccggcugcugcucgccgagagcgggcuguccuucaucaccuucaucugcuacgucgccagcuccgcgagcgccuuccugaccgcgccccuccuggaguuccugcucgcccuguacuuccuguucgccgacgccaugcagcucaacgacaaguggcagggccugugcuggcccaugauggacuuccugcgcugcgugacggccgcccucaucuacuucgccaucuccaucaccgcgaucgccaaguacagcgacggcgccuccaaggccgccgggguguucggcuucuucgcgaccaucgucuucgccaccgacuucuaccugaucuucaacgacguggccaaguuccugaagcagggggacagcgccgacgagacgaccgcccacaagaccgaggaggagaacuccgacagcgacuccgacuga

SEQ ID NO: 28438 - RNA, 378 nt, Artificial Sequence
  derived and/or modified sequence opt1 from CMTM5__Homo_sapiens__NP_001032365
augcugagcgcccgcgaccggcgcgaccggcaccccgaggagggcguggucgccgagcuccagggguucgcgguggacaaggccuuccugaccucccacaagggcauccugcucgagaccgagcuggcccugacgcucaucaucuucaucugcuucaccgccagcaucuccgccuacauggcggccgcccugcuggaguucuucaucacccucgccuuccuguuccuguacgcgacccaguacuaccagcgcuucgaccggaucaacuggccgugccucguguucgggaucauccuggucagcaucuucgccuacgacgccuucaagaucuaccgcacggagauggcccccggcgccucccagggggaccagcaguga

SEQ ID NO: 28439 - RNA, 528 nt, Artificial Sequence
  derived and/or modified sequence opt1 from CMTM7__Homo_sapiens__NP_612419
augagccacggcgccgggcuggugcgcacgaccugcuccagcggcuccgcccucgggcccggcgcgggggccgcccagccgagcgccagcccccuggagggccugcucgaccuguccuacccccggacccacgccgcgcugcucaaggucgcccagauggugacccugcugaucgccuucaucugcgugcgcuccagccucuggaccaacuacuccgccuacagcuacuucgaggucgugaccaucugcgaccugaucaugauccuggcguucuaccucgugcaccuguuccgguucuaccgcguccugacgugcaucuccuggccccucagcgagcugcugcacuaccucaucggcacccugcugcuccugaucgccuccaucguggccgccagcaaguccuacaaccagagcgggcugguggccggcgcgaucuucggguucauggccaccuuccucugcauggccuccaucuggcugagcuacaagaucuccugcgucacccagagcacggacgccgccguguga

SEQ ID NO: 28440 - RNA, 522 nt, Artificial Sequence
  derived and/or modified sequence opt1 from CMTM8__Homo_sapiens__NP_849199
auggaggagccccagcgcgcccggagccacaccgugaccacgaccgccuccagcuucgcggagaacuucuccaccagcuccagcuccuucgccuacgaccgcgaguuccugcggacccucccgggcuuccugaucgucgccgagaucgugcuggggcuccugguguggacgcugaucgccggcaccgaguacuuccgcguccccgccuucgggugggugauguucguggcggucuucuacugggugcucaccguguucuuccugaucaucuacaucaccaugacguacacccggaucccccagguccccuggaccaccgugggccugugcuucaacgggagcgccuucgugcucuaccuguccgccgccgucguggacgcgagcuccgugagcccggagcgcgacucccacaacuucaacagcugggccgccuccagcuucuucgccuuccuggucacgaucugcuacgccggcaacaccuacuucuccuucaucgcguggcggagccgcaccauccaguga

SEQ ID NO: 28441 - RNA, 2508 nt, Artificial Sequence
  derived and/or modified sequence opt1 from CMTR1__Homo_sapiens__NP_055865
augaagcgccggaccgaccccgagugcaccgccccgaucaagaagcagaagaagcgcguggccgagcuggcgcucagccuguccagcacguccgacgacgagccgcccagcuccgucagccacggcgccaaggccuccaccaccagccuguccgggagcgacuccgagaccgagggcaagcagcacagcuccgacagcuucgacgacgccuucaaggccgacucccucguggaggggacgagcucccgguacagcauguacaacuccgugagccagaagcugauggcgaagaugggcuuccgcgagggggagggccugggcaaguacagccaggggcggaaggacaucgucgaggccuccagccagaagggccgccgggggcucggccugacccugcgcggguucgaccaggagcucaacguggacuggcgggacgagcccgagcccuccgccugcgagcaggucagcugguuccccgagugcaccaccgagauccccgacacgcaggagauguccgacuggaugguggugggcaagcgcaagaugaucaucgaggacgagaccgaguucugcggcgaggagcugcugcacagcgugcuccagugcaaguccgucuucgacgugcuggacggggaggagaugcggcgcgcccggacccgcgcgaaccccuacgagaugauccggggcguguucuuccugaaccgcgccgccaugaagauggccaacauggacuucgucuucgaccggauguucaccaacccgcgcgacagcuacgggaagccccucgugaaggaccgggaggccgagcugcuguacuucgcggacgugugcgccggccccggcggguucuccgaguacguccucuggcgcaagaaguggcacgccaagggcuucgggaugacgcugaagggccccaacgacuucaagcuggaggacuucuacagcgccuccagcgagcuguucgagccguacuacggggagggcggcaucgacggggacggcgacaucacccggcccgagaacaucuccgccuuccgcaacuucgugcucgacaacaccgaccgcaagggggugcacuuccugauggcggacggcggguucagcgucgagggccaggagaaccuccaggagauccuguccaagcagcugcuccugugccaguuccugauggcccucagcaucgugcggaccggcgggcacuucaucugcaagacguucgaccuguucacccccuucuccgugggccuggucuaccuccuguacugcugcuucgagcgcgugugccuguucaagcccaucaccagccggccggccaacuccgagcgcuacguggucugcaaggggcucaaggugggcaucgacgacguccgggacuaccuguucgccgugaacaucaagcugaaccagcuccgcaacaccgacagcgacgugaaccuggucgugccccuggaggugaucaagggggaccacgaguucacggacuacaugauccggagcaacgagucccacugcagccuccagaucaaggcccuggcgaagauccacgccuucguccaggacaccacccuguccgagccccgccaggccgagauccggaaggagugccuccgccuguggggcauccccgaccaggcccggguggccccgagcuccagcgaccccaaguccaaguucuucgagcugauccagggcaccgagaucgacaucuucagcuacaagcccacgcuccugaccuccaagacccuggagaagauccgccccguguucgacuaccggugcauggucagcggguccgagcagaaguuccugaucggccucggcaagagccagaucuacaccugggacgggcgccaguccgaccgguggaucaagcuggaccugaagacggagcucccgcgcgacacccugcugagcguggagaucgugcacgagcucaagggcgaggggaaggcgcagcggaagaucuccgccauccacauccuggacguccuggugcucaacggcaccgacgugcgcgagcagcacuucaaccagcggauccagcuggccgagaaguucgucaaggccgugagcaagcccucccgccccgacaugaaccccauccgcgugaaggaggucuaccggcuggaggagauggagaagaucuucgugcgccucgagaugaagaucaucaaggggagcagcggcaccccgaagcuguccuacacggggcgggacgaccgccacuucgugcccaugggccuguacaucguccggaccgugaacgagcccuggaccaugggcuucagcaaguccuucaagaagaaguucuucuacaacaagaagaccaaggacagcacguucgaccucccggcggacuccaucgcccccuuccacaucugcuacuacgggcgccuguucugggaguggggcgacgggauccgggugcacgacagccagaagccccaggaccaggacaagcuguccaaggaggacguccucagcuucauccagaugcaccgcgccuga

SEQ ID NO: 28442 - RNA, 2313 nt, Artificial Sequence
  derived and/or modified sequence opt1 from CMTR2__Homo_sapiens__NP_060818
augagcaagugccgcaagacccccgugcagcagcuggccuccccggccagcuucucccccgacauccucgcggacaucuucgagcuguucgccaagaacuucagcuacggcaagccccugaacaacgaguggcagcuccccgacccguccgagaucuucacgugcgaccacaccgagcugaacgccuuccuggaccucaagaacagccugaacgaggucaagaaccugcucuccgacaagaagcuggacgaguggcacgagcacaccgccuucaccaacaaggccgggaagaucaucagccacgugcggaaguccgugaacgcggagcugugcacccaggccuggugcaaguuccacgagauccucugcagcuucccccugaucccccaggaggccuuccagaacggcaagcugaacucccuccaccugugcgaggcccccggggcguucaucgccagccugaaccacuaccucaagucccaccgcuucccgugccacuggagcugggucgccaacacgcugaaccccuaccacgaggccaacgacgaccugaugaugaucauggacgaccggcucaucgccaacacccugcacuggugguacuucggccccgacaacaccggggacaucaugacccugaaguuccucacgggccugcagaacuucaucuccagcauggcgaccgugcaccuggugaccgccgacggcuccuucgacugccaggggaaccccggcgagcaggaggcccucgucagcucccugcacuacugcgagguggugaccgcccugacgacccucgggaacggcgggagcuucguccugaagauguucaccauguucgagcacugcagcaucaaccugauguaccuccugaacugcugcuucgaccaggugcacguguucaagccggccaccuccaaggcgggcaacagcgaggucuacguggugugccugcacuacaagggccgcgaggccauccacccccuccuguccaagaugacgcugaacuucgggaccgagaugaagcggaaggcccucuucccccaccacgucauccccgacagcuuccugaagcgccacgaggagugcugcguguucuuccacaaguaccagcuggagaccaucuccgagaacauccggcuguucgagugcaugggcaaggccgagcaggagaagcugaacaaccugcgcgacugcgccauccaguacuucaugcagaaguuccagcucaagcaccugagccggaacaacuggcuggugaagaaguccagcaucgggugcuccaccaacacgaagugguucggccagcgcaacaaguacuucaagaccuacaacgagcggaagaugcucgaggcgcugagcuggaaggacaaggucgccaagggcuacuucaacuccugggccgaggagcacgggguguaccacccgggccagagcuccauccuggaggggaccgccagcaaccuggagugccaccucuggcacauccuggagggcaagaagcugcccaaggugaagugcucccccuucugcaacggggagauccucaagacccugaacgaggccaucgagaagucccugggcggcgcguucaaccucgacagcaaguuccgccccaagcagcaguacagcugcuccugccacgucuucagcgaggagcugaucuucagcgagcugugcucccucacggagugccugcaggacgagcaggucguggugccgagcaaccagaucaagugccugcucgugggguucuccacccugcggaacaucaagaugcacaucccccuggagguccgccuccuggagagcgccgagcugaccaccuucuccugcagccuccugcacgacggcgaccccacguaccagcggcuguuccucgacugccugcugcacucccuccgcgagcugcacaccggggacgugaugauccugcccgugcucagcugcuucacccgguucauggccggccugaucuucguccugcacuccugcuuccgcuucaucaccuucgugugcccgacgagcuccgacccccuccggaccugcgccgugcugcugugcgucggguaccaggaccuccccaaccccguguuccgcuaccugcagagcgugaacgagcugcucuccacccugcugaacagcgacuccccgcagcagguccuccaguucgugcccauggaggugcugcugaagggcgcgcuccuggacuuccugugggaccucaacgccgccaucgccaagcggcaccuccacuucaucauccagcgcgagcgcgaggagaucaucaacagccugcagcuccagaacuga

SEQ ID NO: 28443 - RNA, 12210 nt, Artificial Sequence
  derived and/or modified sequence opt1 from CMYA5__Homo_sapiens__NP_705838
auggccagccgcgacagcaaccacgccggcgagagcuuccuggggagcgacggcgacgaggaggcgacccgggagcucgagaccgaggaggagagcgagggggaggaggacgagaccgccgccgagagcgaggaggagcccgacagccgccugagcgaccaggacgaggagggcaagaucaagcaggaguacaucaucagcgaccccagcuucagcauggugaccgugcagcgggaggacagcgggaucaccugggagaccaacagcagccgcagcuccacccccugggccagcgaggagucccagaccagcggcgugugcucccgggagggcagcaccgugaacuccccgcccgggaacguguccuucaucguggacgaggugaagaagguccgcaagcggacccacaagagcaagcacggcucccccagccugcgccggaaggggaaccgcaagcggaacuccuucgagagccaggacgugcccaccaacaagaagggcagcccccugaccagcgccucccaggugcugaccaccgagaaggagaaguccuacaccgggaucuacgacaaggcgcgcaagaagaagaccaccuccaacacgccgcccaucacgggcgccaucuacaaggagcacaagccccugguccuccggcccguguacaucggcaccgugcaguacaagaucaagauguucaacagcgucaaggaggagcugaucccccugcaguucuacgggacccuccccaagggcuacgugaucaaggagauccacuaccgcaaggggaaggacgccuccaucagccuggagcccgaccuggacaacuccggcagcaacaccguguccaagacgcggaagcucgucgcccagagcaucgaggacaaggugaaggagguguucccgcccuggcgcggcgcgcuguccaaggggagcgagagccugacccucauguucucccacgaggaccagaagaagaucuacgccgacagcccccugaacgccaccuccgcccuggagcacaccguccccagcuacuccagcuccggccgggccgagcaggggauccagcuccgccacagccaguccgugccccagcagcccgaggacgaggcgaagccccacgagguggagccgcccagcgucacgcccgacacccccgccaccauguuccugcggaccacgaaggaggagugcgagcuggccucccccggcaccgccgccagcgagaacgacuccagcgugucccccagcuucgcgaacgaggugaagaaggaggacgucuacuccgcccaccacagcaucagccucgaggccgccucccccgggcuggccgcgagcacccaggacggccuggaccccgaccaggagcagcccgaccucaccuccaucgagcgcgccgagcccgugagcgccaagcugacgcccacccaccccuccgucaagggcgagaaggaggagaacaugcuggagcccagcaucucccucagcgagccccugaugcuggaggagccggagaaggaggagaucgagaccucccuccccaucgccaucacccccgagcccgaggacagcaaccugguggaggaggagaucguggagcuggacuaccccgagagcccccucgucuccgagaagcccuucccgccccacaugucccccgagguggagcacaaggaggaggagcugauccugccccuccuggccgcgagcucccccgagcacguggcccugagcgaggaggagcgggaggagaucgccuccgucagcacgggguccgccuucgugagcgaguacagcgugccgcaggaccucaaccacgagcugcaggagcaggagggcgagcccgugccgcccuccaacguggaggcgaucgccgagcacgccgugcugagcgaggaggagaacgaggaguucgaggccuacucccccgccgcggcccccaccagcgaguccagccucucccccagcaccaccgagaagaccuccgagaaccagagcccccuguucuccacggucacccccgaguacauggugcugagcggggacgaggccuccgagagcggcugcuacacccccgacuccaccagcgccuccgaguacagcgugcccucccucgccacgaaggagagccugaagaagaccaucgaccgcaagagcccgcugauccucaagggggucuccgaguacaugauccccagcgaggagaaggaggacaccggcuccuucacccccgcgguggcccccgccagcgagccgucccugagccccuccacgaccgagaagaccagcgagugccagagcccccuccccagcaccgccacguccgagcacguggucccgagcgagggcgaggaccugggguccgagcgcuucacccccgacagcaagcucaucuccaaguacgccgcgccccugaacgccacccaggagagccagaagaagaucaucaacgaggccucccaguucaagcccaagggcaucagcgagcacaccgugcuguccguggacgggaaggaggucaucggcccgagcagccccgaccucgugguggccuccgagcacagcuucccgccccacacgaccgagaugaccuccgagugccaggcgccgccccugagcgccacccccuccgaguacgucgugcugagcgacgaggaggccguggagcucgagcgguacacgcccuccagcaccuccgccagcgaguucuccgucccgcccuacgccacccccgaggcgcaggaggaggagaucgugcaccgcagccugaaccugaagggggccuccagccccaugaaccucuccgaggaggaccaggaggacaucggcccguucagccccgacuccgccuucgugagcgaguucuccuucccgcccuacgccacccaggaggccgagaagcgggaguucgagugcgacagcccgaucugccugacgagccccuccgagcacaccauccugagcgacgaggacaccgaggaggcggagcuguucucccccgacagcgccucccaggucagcaucccgcccuuccgcaucuccgagaccgagaagaacgagcuggagcccgacagccugcucacggccguguccgccagcggcuacuccugcuucagcgaggccgacgaggaggacaucggguccaccgcggccacccccgugagcgagcaguucuccagcucccagaagcagaaggccgagaccuucccgcugaugagcccccuggaggaccucucccugccgcccagcacggacaagagcgagaaggccgagaucaagccggagauccccaccaccuccaccagcgucuccgaguaccugauccucgcgcagaagcagaagacgcaggccuaccuggagcccgagagcgaggaccugauccccucccaccucaccagcgagguggagaagggcgagcgggaggccuccagcuccguggccgccaucccggcggcccugcccgcccagagcuccaucgucaaggaggagaccaagcccgccagcccccacuccgugcugccggacagcgugcccgccaucaagaaggagcaggagcccaccgcggcccucacccugaaggccgccgacgagcagauggcccuguccaagguccgcaaggaggagaucgugcccgacagccaggaggcgacggcccacgugucccaggaccagaagauggagccgcagccgcccaacguccccgagagcgagaugaaguacagcgugcucccggacaugguggacgagcccaagaagggggucaagcccaagcuggugcugaacgugaccuccgagcucgagcagcggaagcugagcaagaacgagcccgaggucaucaagccguacagcccccucaaggagaccagccucuccggccccgaggcccugagcgccgugaagauggagaugaagcacgacuccaagaucaccacgaccccgaucgugcugcacagcgccuccagcggcgucgagaagcaggucgagcacgggccgcccgcgcucgccuucuccgcccugagcgaggagaucaagaaggagaucgagcccuccagcuccaccaccacggccagcgucaccaagcuggacuccaaccucacccgcgcggugaaggaggagauccccaccgacagcucccugaucacgcccguggaccggcccguccugaccaaggugggcaagggggagcucggcagcgggcugcccccgcuggugaccagcgccgacgagcacuccguccucgccgaggaggacaagguggccaucaagggcgccagccccaucgagaccuccagcaagcaccuggcgugguccgaggccgagaaggagaucaaguucgacagccugcccuccgugagcuccaucgccgagcacagcguccucuccgagguggaggccaaggaggugaaggccggccugcccgucaucaagacgagcuccagccagcacuccgacaagagcgaggaggcgcgcguggaggacaagcaggaccuccuguucuccaccgugugcgacagcgagcggcuggucuccagccagaagaagucccugauguccaccagcgaggugcucgagccggagcacgagcugccccugucccucuggggcgagaucaagaagaaggagaccgagcugcccagcucccagaacgugagccccgccuccaagcacaucaucccgaagggcaaggacgaggagacggccagcuccagccccgagcuggagaaccucgccuccgggcuggcccccacccugcuccugcugagcgacgacaagaacaagcccgcggucgagguguccagcaccgcccagggcgacuucccguccgagaagcaggacguggcccucgccgagcugagccuggagcccgagaagaaggacaagccccaccagccccucgagcugccgaacgcgggguccgaguucagcuccgaccugggccgccagagcggcagcaucgggaccaagcaggccaagucccccaucacggagaccgaggacagcguccucgagaagggccccgccgagcugcggucccgcgaggggaaggaggagaaccgggagcugugcgccagcuccaccaugccggccaucagcgagcucuccagccugcugcgcgaggagucccagaacgaggagaucaagcccuucagccccaagaucaucucccucgagagcaaggagcccccggcguccguggccgagggcgggaaccccgaggaguuccagcccuucaccuucagccugaagggccuguccgaggaggugagccaccccgccgacuucaagaagggcgggaaccaggagaucggcccgcugccgcccacggggaaccugaaggcccaggucaugggcgacauccuggacaagcucuccgaggagaccgggcaccccaacagcucccaggugcugcagagcaucaccgagccgagcaagaucgcccccuccgaccugcucguggagcagaagaagaccgagaaggcgcugcacagcgaccagacggucaagcugcccgacguguccaccagcuccgaggacaagcaggaccucggcaucaagcaguucagccugaugcgggagaaccugccccuggagcaguccaagagcuucaugaccaccaagccggccgacgugaaggagacgaagauggaggaguucuucaucucccccaaggacgagaacuggaugcucggcaagcccgagaacgucgccagccagcacgagcagcgcaucgccggguccgugcagcuggacagcuccagcuccaacgagcugcggcccggccagcucaaggccgcggugagcuccaaggaccacacgugcgagguccgcaagcagguccugccgcacagcgccgaggagucccaccugagcagccaggaggccguguccgcccucgacaccagcuccgggaacaccgagacccugagcuccaagagcuacuccagcgaggaggucaagcuggcggaggagcccaagucccucgugcuggccggcaacguggagcgcaacaucgccgagggcaaggagauccacagccugauggaguccgagagccuccugcuggagaaggccaacacggagcucuccuggcccagcaaggaggacucccaggagaagaucaagcugcccccggagcgguucuuccagaagcccgucagcgggcuguccguggagcaggucaagagcgagaccaucagcuccagcgucaagaccgcccacuuccccgcggagggcguggagcccgcccucgggaacgagaaggaggcccaccgcuccaccccgcccuuccccgaggagaagccgcuggaggagagcaagauggugcaguccaaggucaucgacgacgccgacgagggcaagaagcccagccccgaggugaagauccccacgcagcggaagccgaucuccagcauccacgcccgcgagccccagucccccgagagccccgaggugacccagaacccgcccacccagcccaaggucgcgaagcccgaccugccggaggagaaggggaagaagggcaucuccagcuucaaguccuggaugagcucccucuucuucggcagcuccacccccgacaacaagguggccgagcaggaggaccuggagacgcagcccagccccuccguggagaaggccgucaccgugaucgacccggaggggaccauccccaccaacuucaacgucgccgagaagcccgccgaccacagccugagcgaggugaagcucaagacggcggacgagccccggggcacccuggugaaguccggggacggccagaacgucaaggagaaguccaugauccuguccaacguggaggaccuccagcagccgaaguucaucagcgaggugucccgcgaggacuacgggaagaaggagaucagcggcgacuccgaggagaugaacaucaacagcgucgugaccuccgccgacggcgagaaccuggagauccagagcuacucccugaucggggagaagcucgugauggaggaggccaagaccaucgugccgccccacgugacggacagcaagcgggugcagaagcccgccaucgccccgcccuccaaguggaacaucagcaucuucaaggaggagccccgcuccgaccagaagcagaagucccugcuguccuucgacgucguggacaaggugccccagcagcccaagagcgcguccagcaacuucgccagcaagaacaucaccaaggaguccgagaagcccgagagcaucauccuccccgucgaggaguccaagggcagccugaucgacuucuccgaggaccggcugaagaaggagaugcagaacccgaccagccucaagaucuccgaggaggagaccaagcugcgcagcgugucccccacggagaagaaggacaaccuggagaaccggagcuacacccucgccgagaagaaggugcuggccgagaagcagaacuccgucgcgccccuggagcuccgcgacagcaacgagaucgggaagacccagaucacccugggcucccggagcacggagcugaaggaguccaaggccgacgccaugccccagcacuucuaccagaacgaggacuacaacgagcgcccgaagaucaucguggggagcgagaaggagaagggcgaggagaaggagaaccagguguacguccucuccgagggcaagaagcagcaggagcaccagcccuacagcgugaacguggccgaguccaugagccgggagagcgacaucucccuggggcacagccugggcgagacccaguccuucagccucgucaaggccaccuccgugaccgagaaguccgaggcgaugcuggccgaggcccaccccgagauccgcgaggccaaggccguggggacgcagccccacccgcuggaggaguccaagguccucguggagaagaccaagaccuuccugcccguggcgcugagcugccgggacgagaucgagaaccacucccucagccaggagggcaaccugguccuggagaaguccagccgcgacaugcccgaccacuccgaggagaaggagcaguuccgggagagcgagcucuccaagggcgggagcguggacaucaccaaggagacggugaagcagggcuuccaggagaaggccgucgggacccagccccgcccgcuggaggaguccaaggugcugguggagaagaccaagaccuuccuccccgucgugcugagcugccacgacgagaucgagaaccacucccugagccaggagggcaaccucgugcuggagaaguccucccgggacaugcccgaccacagcgaggagaaggagcaguucaaggaguccgagcuguggaagggcgggagcgucgacaucacgaaggaguccaugaaggagggguuccccagcaaggaguccgagcgcacccucgcccgcccguucgacgagaccaagagcuccgagacgccgcccuaccugcugagccccgugaagccgcagacgcucgccuccggggccagccccgagaucaacgcggugaagaagaaggagaugccccgguccgagcugacccccgagcgccacaccguccacaccauccagaccagcaaggacgacacguccgacgugccgaagcagagcgugcuggucuccaagcaccaccucgaggccgccgaggacacccgggugaaggagccccugagcuccgccaagagcaacuacgcgcaguucaucagcaacaccuccgccagcaacgccgacaagaugguguccaacaaggagaugcccaaggagcccgaggacaccuacgccaagggcgaggacuucacggucaccagcaagccggccgggcuguccgaggaccagaagaccgcguucagcaucaucuccgagggcugcgagauccucaacauccacgcccccgccuucaucagcuccaucgaccaggaggagagcgagcagaugcaggacaagcuggaguaccuggaggagaaggccuccuucaagaccaucccccucccggacgacagcgagacgguggccugccacaagacccugaagucccgccuggaggacgagaaggugacgccccucaaggagaacaagcagaaggagacccacaagacgaaggaggagaucagcaccgacuccgagaccgaccugagcuucauccagcccaccauccccuccgaggaggacuacuucgagaaguacacgcugaucgacuacaacaucagcccggaccccgagaagcagaaggcgccccagaagcucaacgucgaggagaagcugagcaaggaggugaccgaggagaccaucuccuuccccgucagcuccguggagagcgcccuggagcacgaguacgaccucgugaagcuggacgaguccuucuacgggccggagaagggccacaacauccugagccaccccgagacccagucccagaacagcgccgaccggaacgucuccaaggacacgaagcgcgacguggacagcaagucccccggcaugccccucuucgaggccgaggagggggugcugagccggacccagaucuucccgaccaccaucaaggucaucgaccccgaguuccuggaggagccgcccgcccucgcguuccuguacaaggaccuguacgaggaggccgugggcgagaagaagaaggaggaggagacggccuccgagggggacagcgugaacuccgaggccagcuucccgucccgcaacagcgacaccgacgacggcaccgggaucuacuucgagaaguacauccucaaggacgacauccugcacgacaccucccugacgcagaaggaccagggccagggccucgaggagaagcgggucgggaaggacgacagcuaccagcccaucgcggccgagggcgagaucugggggaaguucggcaccaucugccgcgagaagucccuggaggagcagaaggggguguacggcgagggcgaguccguggaccacgucgagaccguggggaacguggccaugcagaagaaggcccccaucaccgaggacguccggguggccacgcagaagaucagcuacgcggugcccuucgaggacacccaccacguccuggagcgcgccgacgaggccggcucccacgggaacgaggugggcaacgccagcccggaggugaaccugaacguccccguccagguguccuuccccgaggaggaguucgccagcggcgcgacccacguccaggagaccucccucgaggagcccaagauccuggugccgcccgagcccagcgaggagcggcugcgcaacuccccggugcaggacgaguacgaguucacggagagccuccacaacgaggucgugccccaggacauccuguccgaggagcugagcuccgagagcacccccgaggacgugcucucccaggggaaggagagcuucgagcacaucuccgagaacgaguucgccagcgaggccgagcaguccacccccgccgagcagaaggagcugggcagcgagcggaaggaggaggaccagcugagcuccgaggucgugaccgagaaggcccagaaggagcucaagaagucccagaucgacaccuacugcuacacgugcaagugcccgaucuccgcgaccgacaagguguucgggacccacaaggaccacgaggucagcacccuggacacggccaucuccgccgugaaggugcagcuggccgaguuccucgagaaccugcaggagaagucccugcgcaucgaggccuucgucuccgagaucgagagcuucuucaacaccaucgaggagaacugcuccaagaacgagaagcggcucgaggagcagaacgaggagaugaugaagaaggugcuggcgcaguacgacgagaaggcccagagcuucgaggaggugaagaagaagaagauggaguuccugcacgagcagaugguccacuuccuccaguccauggacaccgccaaggacacccuggagacgaucgugcgcgaggccgaggagcuggacgaggcgguguuccucaccagcuucgaggagaucaacgagcggcugcuguccgccauggagagcaccgccucccucgagaagaugcccgccgccuucagccuguucgagcacuacgacgacuccagcgcgcgcuccgaccagaugcugaagcaggucgccgugccccagcccccgcgccucgagccccaggagcccaacagcgccaccagcacgaccaucgccguguacugguccaugaacaaggaggacgucaucgacagcuuccagguguacugcauggaggagccccaggacgaccaggaggugaacgagcuggucgaggaguaccggcugaccgugaaggaguccuacugcaucuucgaggaccucgagccggaccgcugcuaccaggugugggucauggccgugaacuucaccggcugcagccugcccuccgagcgggcgaucuuccgcacggcccccagcacccccgucauccgggccgaggacugcaccgugugcuggaacaccgccacgauccgcuggcggccgaccacccccgaggccaccgagacguacacccuggaguacugccgccagcacucccccgagggggagggccuccggagcuucuccggcaucaaggggcugcagcugaaggugaaccuccagcccaacgacaacuacuucuucuacguccgcgcgaucaacgccuucggcaccagcgagcaguccgaggccgcccugaucagcacccgggggacgcgcuuccugcuccugcgggagaccgcgcacccggcccugcacaucuccagcuccggcaccgugaucagcuucggggagcgccggcgccucaccgagauccccuccgugcugggcgaggagcugcccagcugcggccagcacuacugggagacgaccgucaccgacugccccgccuaccggcucgggaucugcuccagcagcgccgugcaggccggcgcgcuggggcagggcgagaccuccugguacaugcacugcagcgagccgcagcgcuacacguucuucuacuccgggaucgugagcgacguccacgugaccgagcggcccgcccgcgugggcauccugcucgacuacaacaaccagcggcugaucuucaucaacgccgaguccgagcagcuccucuucaucauccgccaccgcuucaacgagggcguccaccccgccuucgcccuggagaagcccgggaagugcacccugcaccucggcaucgagccgcccgacagcgugcggcacaaguga

SEQ ID NO: 28444 - RNA, 1311 nt, Artificial Sequence
  derived and/or modified sequence opt1 from CNBD1__Homo_sapiens__NP_775809
augcccaugagcucccugcccgccgccauccucagccacaugaccgcgaucaacaacgugcccccgccgccccugcacuccauccccaaccugaagaaguccaagcacaucaacuacggccagcucaacgcccugugccacauccgcgggcagcacagccggagcauguccaacauccugagcgcccacgacaccuucaugaagcaguaccccaaggucuuccuccaccagaagccccgccugcccaagcuguucaagcaggaggagcagcgggagcucaacgagggcaaggaggagucccagcaccagcagcccgacgacagcaacaacaucgccgugcacgugcagcgcgcccacgggggccacauccuguaccggcccaagcgcgcgacggagaaguucgaggaguuccuggccauccucaagaagcugcccauccaccggaccccguacgagcacaagaccgucuggaaguuccugaagaccauccccgaccucacguuccagcugaacgacaagcaccugaagacccucuccaagaccguguucagcgagaccuggcugaagggguccacgguggucgccaacgacggcuucuacgugauccugaagggccucgcccgcccccagaccaacguguacaagaaccugaucgaggggagcgacucccccgacagcuucaucucccagagcuuccacuccuucaucuggagcgaggaguucaagaacagcacccuggcggagauguaccucccguccuacgacagcaugcuguccaaguggagcaccuucggcacgcuggaggucaugccccagaacgaguccgagacccagauguucagcguggugaccgaggacgacugcgagauccucaagauccccgccaagggguacgccaagaucaaggaggagaagaucaagcuggagaacaugcagaagcugaagcucauccggaugugccccuacuacgaggaguggccgacccuguccaucuacgagcugaucgcccuccugaaguggaagaaguucccgcccggccacgucaucguggagagcgggaacaucaucuccuucgugggcuacaucaacagcggcugcugcaacaucuaccgcuccaucaucggguucgucaagcugcggagcaacaaggugaagcgcucccagaagcucguguacaugggcaagcugaaggagaaggagagcuucggggagaucuccguccugcuccaggugcccuucacgugcaccaucaucaccaagaaggagguggagauggccaucaucgaggacaaggaccuguucgucgcguga

SEQ ID NO: 28445 - RNA, 540 nt, Artificial Sequence
  derived and/or modified sequence opt1 from CNBP__Homo_sapiens__NP_001120664
augagcuccaacgagugcuucaagugcggccgcagcgggcacugggcccgggagugccccaccggcgggggccgcgggcggggcaugcgcucccggggccgcgggggcuucaccagcgaccggggguuccaguucguguccagcucccugccggacaucugcuaccgcugcggcgagagcgggcaccucgccaaggacugcgaccugcaggaggacgucgaggcgugcuacaacugcggccggggcgggcacaucgccaaggacugcaaggagcccaagcgcgagcgggagcagugcugcuacaacugcggcaagcccgggcaccuggcccgcgacugcgaccacgccgacgagcagaagugcuacuccugcggcgaguucggccacauccagaaggacugcacgaaggugaagugcuaccggugcggggagaccggccacguggccaucaacugcagcaagaccuccgaggucaacugcuaccgcugcggggagagcggccaccucgcgcgggagugcaccaucgaggccacggccuga

SEQ ID NO: 28446 - RNA, 1524 nt, Artificial Sequence
  derived and/or modified sequence opt1 from CNDP1__Homo_sapiens__NP_116038
auggaccccaagcugggccgcauggccgccagccuccuggcggugcugcuccugcugcucgagcgggggauguucuccagcccguccccgccgcccgcccugcuggagaaggucuuccaguacaucgaccuccaccaggacgaguucgugcagacccugaaggaguggguggccaucgagagcgacuccguccagcccgugccccgcuuccggcaggagcuguuccgcaugauggccguggccgcggacacccuccagcggcugggcgcccgcgucgccagcguggacauggggccccagcagcugcccgacggccagucccuccccaucccgcccgugauccuggccgagcuggggagcgaccccacgaagggcaccgucugcuucuacggccaccucgacgugcagcccgcggaccggggcgacggguggcugaccgaccccuacgugcugaccgaggucgacgggaagcucuacggccgcggggccacggacaacaagggccccgugcuggccuggaucaacgccguguccgccuuccgggcgcuggagcaggaccuccccgucaacaucaaguucaucaucgagggcauggaggaggccgggagcguggcccuggaggagcugguggagaaggagaaggaccgcuucuucuccggcgucgacuacaucgugaucagcgacaaccucuggaucucccagcggaagccggccaucaccuacgggacccgcggcaacagcuacuucaugguggaggucaagugccgggaccaggacuuccacuccggcaccuucgggggcauccugcacgagcccauggccgaccugguggcgcuccuggggagccugguggacuccagcggccacauccucguccccgggaucuacgacgagguggucccccugacggaggaggagaucaacaccuacaaggccauccaccuggaccucgaggaguaccgcaacuccagccggguggagaaguuccuguucgacaccaaggaggagauccugaugcaccucuggcgcuacccgagccuguccauccacggcaucgagggcgccuucgacgagcccgggaccaagacggugauccccggccgggucaucgggaaguucagcauccgccuggugccccacaugaacguguccgccgucgagaagcaggucacccggcaccucgaggacguguucagcaagcgcaacuccagcaacaagauggugguguccaugacccugggccugcacccguggaucgccaacaucgacgacacccaguaccucgcggccaagcgggccauccgcacgguguucgggaccgagcccgacaugauccgcgacggcagcaccauccccaucgccaagauguuccaggagaucguccacaaguccguggugcugaucccccugggcgccgucgacgacggggagcacagccagaacgagaagaucaaccgguggaacuacaucgagggcaccaagcuguucgcggccuucuuccucgagauggcccagcugcacuga

SEQ ID NO: 28447 - RNA, 1176 nt, Artificial Sequence
  derived and/or modified sequence opt1 from CNDP2__Homo_sapiens__NP_001161971
auggccgcccugaccacccucuucaaguacaucgacgagaaccaggaccgcuacaucaagaagcuggcgaaguggguggccauccagagcgucuccgccuggcccgagaagcggggcgagauccgccggaugauggagguggccgccgcggacgugaagcagcucgggggcagcgucgagcugguggacaucgggaagcagaaggagaucccggugaacguccgcuucugccuggagggcauggaggaguccgggagcgagggccuggacgagcucaucuucgcccggaaggacacguucuucaaggacguggacuacgugugcaucuccgacaacuacuggcugggcaagaagaagcccugcaucaccuacgggcugcgcggcaucugcuacuucuucaucgaggucgagugcagcaacaaggaccuccacuccgggguguacggcgggagcgugcacgaggccaugaccgaccugauccugcucaugggcucccuggucgacaagcggggcaacauccugauccccgggaucaacgaggccguggcggccgugaccgaggaggagcacaagcucuacgacgacaucgacuucgacaucgaggaguucgccaaggacgucggcgcccagauccugcugcacagccacaagaaggacauccucaugcaccgcuggcgguaccccucccugagccugcacgggaucgagggcgccuucuccggcagcggggcgaagacggugaucccgcgcaagguggucggcaaguucuccauccggcucgugcccaacaugacccccgagguggucggggagcaggucaccagcuaccugaccaagaaguucgccgagcugcgcucccccaacgaguucaagguguacaugggccacgggggcaagccgugggugagcgacuucucccacccccacuaccucgccggccggcgcgccaugaagacgguguucggggucgagcccgaccugacccgggagggcgggagcauccccgugacccugaccuuccaggaggccacgggcaagaacgugaugcuccugccggucgggagcgcggacgacggcgcccacucccagaacgagaagcugaaccgcuacaacuacaucgagggcaccaagaugcucgccgccuaccuguacgaggugagccagcugaaggacuga

SEQ ID NO: 28448 - RNA, 2280 nt, Artificial Sequence
  derived and/or modified sequence opt1 from CNGA1__Homo_sapiens__NP_001136036
auggagagccgcuccagcccccggcuggagugcuccggcgccaucagcgcccacugcucccuccaccucccggacagcuccgacuuccagcugaucuucguguuccucgucgagaugggguuccaccacgugggccaggcggggcuggagcugcucaucagcuccgaccugcccaccagcgccucccagagcgccggcaucaccgacaugaagcuguccaugaagaacaacaucaucaacacgcagcagagcuucgugaccaugcccaacgucaucgugcccgacaucgagaaggagauccgccggauggagaacggggccugcuccagcuucuccgaggacgacgacagcgccuccaccagcgaggagagcgagaacgagaacccgcacgcgcgcggcuccuucagcuacaagucccuccggaagggcgggcccagccagcgcgagcaguaccugcccggcgccaucgcccuguucaacgugaacaacuccagcaacaaggaccaggagcccgaggagaagaagaagaagaagaaggagaagaaguccaagagcgacgacaagaacgagaacaagaacgacccggagaagaagaagaagaagaaggacaaggagaagaagaagaaggaggagaaguccaaggacaagaaggaggaggagaagaaggaggucguggugaucgaccccagcgggaacaccuacuacaacuggcuguucugcaucacgcugcccgucauguacaacuggaccauggugaucgcccgggcgugcuucgacgagcugcaguccgacuaccucgaguacuggcugauccuggacuacgugagcgacaucgucuaccucaucgacauguucgugcgcacccggaccggcuaccuggagcaggggcugcucgugaaggaggagcugaagcugaucaacaaguacaaguccaaccuccaguucaagcuggacguccugagccucauccccacggaccugcuguacuucaagcucggcuggaacuacccggagauccgccugaaccggcugcuccgcuucucccggauguucgaguucuuccagcgcaccgagacccggaccaacuaccccaacaucuuccgcaucagcaaccuggugauguacaucgugaucaucauccacuggaacgccugcgucuucuacuccaucagcaaggccaucggcuucgggaacgacacguggguguaccccgacaucaacgaccccgaguucggccggcuggcccgcaaguacguguacucccucuacuggagcacccugacccugaccacgaucggggagaccccgccgcccguccgggacagcgaguacguguucguggucguggacuuccucaucggcguccugaucuucgccaccaucgugggcaacaucggguccaugaucagcaacaugaacgcggcccgcgccgaguuccaggcccggaucgacgccaucaagcaguacaugcacuuccgcaacguguccaaggacauggagaagcgcgucaucaagugguucgacuaccuguggaccaacaagaagacgguggacgagaaggaggugcucaaguaccugcccgacaagcugcgggcggagaucgccaucaacguccaccucgacacccugaagaaggugcgcaucuucgccgacugcgaggccggccugcucguggagcugguccugaagcugcagccccagguguacagccccggggacuacaucugcaagaagggcgacaucgggcgggagauguacaucaucaaggagggcaagcucgccguggucgcggacgacggcgugacccaguucgugguccuguccgacgggagcuacuucggcgagaucuccauccugaacaucaaggggagcaaggccggcaaccgccggaccgccaacaucaaguccaucggguacagcgaccucuucugccuguccaaggacgaccugauggaggcccucacggaguaccccgacgccaagaccaugcuggaggagaagggcaagcagauccugaugaaggacggccuccuggaccugaacaucgcgaacgccgggagcgaccccaaggaccucgaggagaaggugacccgcauggagggcuccguggaccugcugcagacccgguucgcccgcauccucgccgaguacgagagcaugcagcagaagcugaagcagcggcugacgaaggucgagaaguuccucaagccgcugaucgacaccgaguucuccagcaucgaggggcccggcgcggaguccgggcccaucgacagcaccuga

SEQ ID NO: 28449 - RNA, 2031 nt, Artificial Sequence
  derived and/or modified sequence opt1 from CNGA3__Homo_sapiens__NP_001073347
auggccaagaucaacacccaguacagccaccccucccgcacccaccugaaggugaagacgagcgaccgggaccucaaccgcgccgagaacggccugucccgggcgcacagcuccagcgaggagaccuccagcguccugcagccggggaucgccauggagacccgcggccucgccgacuccgggcagggcagcuucaccgggcagggcaucgcccggcugucccgccugaucuuccuccugcggcgcugggccgcgcggcacgugcaccaccaggaccagggccccgacagcuuccccgaccgcuuccgcggggccgagcugaaggagguguccagccaggaguccaacgcccaggccaacgucggcagccaggagcccgcggaccgggggcggcgcaagaagacgaagaagaaggacgccaucgugguggacccguccagcaaccucuacuaccgguggcugaccgccaucgcccugcccgucuucuacaacugguaccuccugaucugccgcgccugcuucgacgagcugcaguccgaguaccucaugcuguggcuggugcucgacuacagcgcggacgugcuguacguccuggacgugcucgugcgggcccgcaccggcuuccuggagcaggggcugauggucagcgacaccaaccggcucuggcagcacuacaagacgaccacccaguucaagcuggacgugcugucccucgugcccaccgaccuggccuaccugaaggucggcacgaacuaccccgaggugcgcuucaaccggcuccugaaguucagccgccuguucgaguucuucgaccgcaccgagacccggaccaacuacccgaacauguuccgcaucggcaaccucgugcuguacauccugaucaucauccacuggaacgccugcaucuacuucgccaucuccaaguucaucggguucggcacggacagcugggucuaccccaacaucuccauccccgagcacgggcggcucagccgcaaguacaucuacucccuguacuggagcacccugacccucaccacgaucggcgagacgcccccgcccgugaaggacgaggaguaccuguucguggucguggacuuccuggugggcguccucaucuucgcgaccaucguggggaacgucggcuccaugaucagcaacaugaacgccucccgggccgaguuccaggccaagaucgacagcaucaagcaguacaugcaguuccgcaaggugaccaaggaccuggagacccgggugauccgcugguucgacuaccugugggccaacaagaagaccgucgacgagaaggaggugcucaagucccugcccgacaagcugaaggcggagaucgccaucaacgugcaccucgacacccugaagaagguccggaucuuccaggacugcgaggccgggcugcugguggagcucgugcugaagcugcgccccaccgucuucagcccgggcgacuacaucugcaagaagggggacaucggcaaggagauguacaucaucaacgagggcaagcucgccgugguggccgacgacggggucacgcaguucguggugcuguccgacggcagcuacuucggggagaucuccauccugaacaucaagggcagcaaguccgggaaccggcgcaccgcgaacauccggagcaucggcuacagcgaccucuucugccuguccaaggacgaccugauggaggcccucaccgaguaccccgaggccaagaaggcccuggaggagaagggccgccagauccugaugaaggacaaccucaucgacgaggagcuggcgcgggccggggccgaccccaaggaccuggaggagaaggucgagcagcucggcagcucccuggacacccugcagacgcgcuucgcccggcuccuggccgaguacaacgcgacccagaugaagaugaagcagcgccugagccagcucgagucccaggugaagggcggcggggacaagccccuggccgacggggaggugccgggcgacgccaccaagaccgaggacaagcagcaguga

SEQ ID NO: 28450 - RNA, 900 nt, Artificial Sequence
  derived and/or modified sequence opt1 from CNGB1__Homo_sapiens__NP_001129111
augcugggcugggugcagcgcguccucccccagccgcccgggacgccccggaagaccaagaugcaggaggaggaggagguggagcccgagccggagauggaggccgagguggagcccgagcccaaccccgaggaggccgagaccgagagcgaguccaugccgcccgaggagagcuucaaggaggaggaggucgcgguggccgaccccagcccccaggagaccaaggaggccgcccugaccuccaccaucucccugcgcgcccagggcgcggagaucagcgagaugaacuccccgagccggcgcgugcucacguggcugaugaagggggucgagaaggugaucccccagcccgugcacuccaucaccgaggaccccgcccagauccugggccacgggagcaccggcgacaccggcugcacggacgagccgaacgaggcccucgaggcccaggacacccggcccgggcugcgccugcuccuguggcuggagcagaaccucgagcggguccugccccagcccccgaaguccagcgagguguggcgcgacgagcccgcgguggccaccggcgccgccuccgaccccgcgcccccggggcggccccaggagaugggccccaagcugcaggcccgcgagacccccagccucccgacgcccaucccccugcagccgaaggaggagcccaaggaggcccccgcccccgagccgcagcccgggucccaggcccagaccagcucccugccgcccacccgggaccccgcccgccucgucgcgugggugcugcaccggcuggagauggcccucccccagcccgugcugcacggcaagaucggcgagcaggagcccgacagcccggggaucugcgacguccagacccgcgugaugggcgccgggggccuguga

SEQ ID NO: 28451 - RNA, 2430 nt, Artificial Sequence
  derived and/or modified sequence opt1 from CNGB3__Homo_sapiens__NP_061971
auguucaagagccugaccaaggugaacaaggucaagcccaucggcgagaacaacgagaacgagcaguccagccgccggaacgaggaggggucccacccgagcaaccagucccagcagaccacggcccaggaggagaacaagggcgaggagaagucccucaagaccaaguccacccccgugaccagcgaggagccccacacgaacauccaggacaagcuguccaagaagaacagcuccggggaccugaccaccaaccccgacccgcagaacgccgcggagcccaccggcacggugcccgagcagaaggagauggaccccgggaaggagggcccgaacagcccccagaacaagccgcccgccgcccccgucaucaacgaguacgccgacgcccagcuccacaaccuggugaagcgcaugcggcagcgcaccgcgcuguacaagaagaagcucguggagggcgaccuguccagccccgaggccagcccccagaccgccaagcccaccgccgucccgcccgugaaggagagcgacgacaagcccacggagcacuacuaccggcugcucugguucaaggugaagaagaugccccugaccgaguaccugaagcgcaucaagcucccgaacuccaucgacagcuacaccgaccggcuguaccugcucuggcugcugcucgucacccuggcguacaacuggaacugcugcuucaucccccugcgccucguguuccccuaccagacggccgacaacauccacuacuggcugaucgccgacaucaucugcgacaucaucuaccuguacgacaugcuguucauccagccccggcugcaguucgugcgcgggggcgacaucaucgucgacuccaacgagcugcggaagcacuaccgcaccagcaccaaguuccagcucgacguggccagcaucaucccguucgacaucugcuaccuguucuucggguucaaccccauguuccgggccaaccgcaugcugaaguacaccuccuucuucgaguucaaccaccaccucgagagcaucauggacaaggcguacaucuaccgggugauccgcacgaccggcuaccugcuguucauccuccacaucaacgccugcgucuacuacugggccuccaacuacgaggggaucggcaccacccgguggguguacgacggcgaggggaacgaguaccugcgcugcuacuacugggccgugcggacgcugaucaccaucggcgggcuccccgagccccagacccuguucgagaucgucuuccagcugcucaacuucuucagcggcguguucguguucuccagccugaucggccagaugcgcgacgucaucggggccgcgaccgccaaccagaacuacuuccgggccugcauggacgacacgaucgccuacaugaacaacuacuccaucccgaagcuggugcagaagcgcgugcgcaccugguacgaguacaccugggacagccagcggaugcucgacgaguccgaccugcugaagacccuccccacgaccguccagcuggcccuggcgaucgacgugaacuucagcaucaucuccaaggucgaccucuucaagggcugcgacacccagaugaucuacgacaugcugcugcgccucaagagcgugcucuaccugcccggggacuucgugugcaagaagggcgagaucgggaaggagauguacaucaucaagcacggcgagguccaggugcugggcgggccggacggcaccaaggugcucgucacgcugaaggccggguccguguucggcgagaucagccugcucgccgccgggggcggcaaccggcgcaccgccaacguggucgcgcacggguucgccaaccugcugacccucgacaagaagacccugcaggagauccuggugcacuaccccgacuccgagcggauccucaugaagaaggcccgcgugcugcugaagcagaaggccaagaccgcggaggccacgccgccccggaaggaccucgcccugcuguucccgcccaaggaggagacccccaagcuguucaagacccuccugggcgggaccggcaaggccagccucgcccgccugcugaagcucaagcgggagcaggcggcccagaagaaggagaacuccgagggcggggaggaggagggcaaggagaacgaggacaagcagaaggagaacgaggacaagcagaaggagaacgaggacaaggggaaggagaacgaggacaaggacaagggccgcgagcccgaggagaagccccuggaccggcccgagugcacggccagccccaucgccgucgaggaggagccccacuccgugcgccggaccgugcugccgcgcgggaccagccggcagagccucaucaucuccauggcccccagcgcggagggcggcgaggagguccugaccaucgaggugaaggagaaggccaagcaguga

SEQ ID NO: 28452 - RNA, 483 nt, Artificial Sequence
  derived and/or modified sequence opt1 from CNIH3__Homo_sapiens__NP_689708
auggccuucaccuucgccgcguucugcuacaugcugagccucgugcugugcgccgcccugaucuucuucgccaucuggcacaucaucgccuucgacgagcuccgcaccgacuucaagucccccaucgaccagugcaacccgguccacgcgcgggagcgccugcggaacaucgagcgcaucugcuuccugcuccggaagcuggugcugcccgaguacagcauccacucccucuucugcaucauguuccugugcgcccaggaguggcugacgcucggccugaacgugccccuccuguucuaccacuucuggcgcuacuuccacugccccgccgacagcuccgagcuggccuacgacccgcccgucgugaugaacgcggacacccugagcuacugccagaaggaggccuggugcaagcucgccuucuaccugcuguccuucuucuacuaccucuacugcaugaucuacacccuggugagcuccuga

SEQ ID NO: 28453 - RNA, 2163 nt, Artificial Sequence
  derived and/or modified sequence opt1 from CNKSR1__Homo_sapiens__NP_001284576
auggagcccguggagaccuggaccccgggcaaggucgccacguggcugcgcgggcucgacgacagccugcaggacuaccccuucgaggacuggcagcugcccggcaagaaccuccugcagcugugcccccagucccucgaggcccuggcggugcggagccuggggcaccaggagcucauccugggcgggguggagcagcugcaggcccucuccagccgccugcagaccgagaaccugcagucccucaccgagggccugcugggcgccacccacgacuuccagagcaucguccaggggugccucggcgacugcgccaagacgccgaucgacgugcugugcgccgcgguggagcugcuccacgaggccgacgcccugcuguucuggcucucccgguaccuguucagccaccugaacgacuucuccgccugccaggagauccgcgaccuccuggaggagcugagccagguccuccacgaggacgggcccgcggccgagaaggagggcaccgugcugcggaucugcucccacguggccgggaucugccacaacauccuggucugcugccccaaggagcuccuggagcagaaggccgugcuggagcaggugcagcucgacagcccccugggccuggagauccacaccaccuccaacugccagcacuucgucagccagguggacacgcaggugccgaccgacucccgccuccagauccagcccggcgacgaggucgugcagaucaacgagcagguggucgugcgggaggagcgcgacauggugggguggccccggaagaacaugguccgcgagcugcugcgggagcccgccggccucagccuggugcugaagaagaucccgauccccgagacccccccccagaccccgccccaggugcucgacuccccccaccagcgcagccccucccugagccuggcgccgcucagcccccgggcccccuccgaggacgucuucgccuucgaccugagcuccaaccccagcccggggcccucccccgccuggacggacagcgccucccugggccccgagccgcugcccauccccccggagccccccgcgauccuccccgccggcguggccgggaccccgggccugcccgagagccccgacaagucccccgucgggcgcaagaagagcaagggccuggccacccggcucucccgccggcgcgugagcugccgggagcuggggcgcccggacugcgacggcuggcugcuccugcggaaggcccccggcggguucaugggcccccgcuggcgccggcgcugguucgugcugaaggggcacacccucuacugguaccggcagccccaggacgagaaggcggagggccugaucaacgucuccaacuacagccuggaguccgggcacgaccagaagaagaaguacguguuccagcucacgcacgacguguacaagccguucaucuucgccgccgacacccugaccgaccugagcauguggguccgccaccucaucaccugcaucuccaaguaccagagccccggccgggccccccccccgcgcgaggaggacugcuacuccgagacggaggccgaggaccccgacgacgaggcgggcagccacagcgccucccccagccccgcccaggccggguccccgcugcacggcgacaccagccccgcggccacccccacccagcgguccccccgcacgagcuucgggucccugaccgacagcuccgaggaggcccucgagggcauggugcgggggcugcgccagggcggcgugagccugcucgggcagccgcagccccugacccaggagcaguggcgguccagcuucaugcgccggaaccgcgacccccagcugaacgagcggguccaccgcgugcgggcccuccaguccacccugaaggccaagcugcaggagcuccaggugcuggaggagguccugggcgacccggagcucacgggggagaaguuccgccaguggaaggagcagaaccgggagcuguacagcgagggccugggcgcgugggggguggcccaggccgagggcuccagccacauccucaccuccgacagcaccgagcagagcccccacucccugcccagcgaccccgaggagcacucccaccugugcccgcucaccagcgaguccagccugcgcccccccgaccuguga

SEQ ID NO: 28454 - RNA, 3015 nt, Artificial Sequence
  derived and/or modified sequence opt1 from CNKSR2__Homo_sapiens__NP_001162118
auggcccugaucauggagcccgugagcaagugguccccgagccaggucguggacuggaugaagggccucgacgacugccugcagcaguacaucaagaacuucgagcgcgagaagaucuccggggaccagcugcuccggaucacccaccaggagcuggaggaccugggcgugagccgcaucgggcaccaggagcucauccuggaggccgucgaccugcucugcgcgcugaacuacggccuggagaccgagaaccucaagacgcugucccacaagcugaacgccagcgccaagaaccuccagaacuucaucaccgggcggcgccgguccggccacuacgacggccgcaccagccggaagcugcccaacgacuuccugaccuccgugguggaccucaucggggccgccaagagccugcuggcguggcucgaccgcucccccuucgccgccgucacggacuacagcgugacccggaacaacgugauccagcugugccuggagcucaccaccaucguccagcaggacugcacgguguacgagaccgagaacaagauccugcacgugugcaagacccuguccggcgucugcgaccacaucaucagccucuccagcgacccccuggugucccagagcgcccaccuggaggugauccagcucgcgaacaucaagccguccgaggggcugggcauguacaucaagagcaccuacgacgggcugcacgucaucacgggcaccaccgagaacagccccgccgaccgcugcaagaagauccacgccggcgacgaggugauccaggugaaccaccagaccgucgugggguggcagcucaagaaccuggugaacgcccugcgggaggaccccuccggcgucauccucacgcugaagaagcgcccccagagcaugcugaccuccgccccggcgcuccugaagaacaugcgguggaagccccuggcccuccagccccugaucccccgcagcccgaccuccagcguggccacccccuccagcacgaucuccacccccaccaagcgggacagcuccgcccugcaggaccucuacaucccgcccccgcccgccgagcccuacaucccccgcgacgagaaggggaaccugcccugcgaggaccugcggggccacauggugggcaagcccguccacaaggggagcgagucccccaacagcuuccucgaccaggaguaccgcaagcgguucaacaucguggaggaggacaccguccuguacugcuacgaguacgagaagggccgcuccagcucccaggggcggcgcgagagcacgccgaccuacgagaacucccugcugcgcuacaugagcaacgagaagaucgcgcaggaggaguacauguuccagcggaacagcaagaaggacaccggcaagaaguccaagaagaagggggacaagagcaacucccccacccacuacagccuccugcccucccugcagauggacgcccuccgccaggacaucaugggcacgcccgugccggagaccacccuguaccacaccuuccagcagagcucccugcagcacaagagcaagaagaagaacaagggccccaucgccgggaaguccaagcggcgcaucagcugcaaggaccucggccgcggggacugcgagggcuggcuguggaagaagaaggacgccaaguccuacuucagccagaaguggaagaaguacugguucgugcugaaggacgccucccucuacugguacaucaacgaggaggacgagaaggcggagggguucaucagccugcccgaguucaagaucgaccgggccuccgagugccggaagaaguacgccuucaaggccugccacccgaagaucaagagcuucuacuucgccgcggagcaccuggacgacaugaaccgcuggcucaaccggaucaacaugcugacggccggcuacgccgagcgcgagcggaucaagcaggagcaggacuacugguccgagagcgacaaggaggaggccgacacccccagcacccccaagcaggacagcccgcccccgcccuacgacaccuacccccgcccgcccuccauguccugcgcgagccccuacgucgaggccaagcacucccggcugagcuccacggagaccagccagucccagagcucccacgaggaguuccgccaggaggugaccggcagcuccgccgugagccccauccggaagaccgccucccagcgccggagcuggcaggaccucaucgagacgccccugaccuccagcgggcugcacuaccuccagacccugccccuggaggacuccgucuucagcgacagcgccgcgaucucccccgagcaccgccggcagagcacccuccccacccagaagugccaccuccaggaccacuacggcccguacccccuggccgaguccgagcgcaugcagguccugaacgggaacggcgggaagccccgcagcuucacgcugccccgggacuccggcuucaaccacugcugccugaacgccccggugagcgccugcgacccccaggacgacgugcagccgcccgagguggaggaggaggaggaggaggaggaggaggagggcgaggccgcgggggagaacaucggcgagaaguccgagagccgcgaggagaagcucggggacucccugcaggaccuguaccgggcccucgagcaggccagccugagcccccugggcgagcaccgcaucuccaccaagauggaguacaagcucuccuucaucaagcggugcaacgaccccgugaugaacgagaagcugcaccgccugcggauccucaagagcacccugaaggcccgcgagggcgaggucgccaucaucgacaaggugcuggacaaccccgaccucaccuccaaggaguuccagcaguggaagcagauguaccuggaccuguuccucgacaucugccagaacacgaccagcaacgacccgcuguccaucagcuccgagguggacgucaucaccagcagccuggcgcacacccacuccuacaucgagacgcacguguga

SEQ ID NO: 28455 - RNA, 1668 nt, Artificial Sequence
  derived and/or modified sequence opt1 from CNKSR3__Homo_sapiens__NP_775786
auggagcccgugaccaaguggagccccaagcaggucguggacuggacccgcggccuggacgacugccuccagcaguacgugcacaaguucgagcgggagaagaucaacggggagcagcugcugcagaucucccaccaggaccucgaggagcugggcgucacgcgcaucgggcaccaggagcuggugcucgaggccguggaccugcugugcgcccucaacuacggccuggagaccgacaacaugaagaaccugguccucaagcugcgggcgagcucccacaaccugcagaacuacaucagcucccgccgcaagagccccgccuacgacgggaacaccucccgcaaggcccccaacgaguuccucaccagcgugguggagcugaucggcgccgccaaggcgcugcucgccuggcuggaccgggcccccuucacgggcaucaccgacuucuccgucaccaagaacaagaucauccagcugugccucgaccugaccacgaccgugcagaaggacugcuucguggccgagauggaggacaagguccugaccguggugaagguccucaacgggaucugcgacaagaccauccggagcacgaccgacccggugaugucccagugcgcgugccuggaggaggugcaccuccccaacaucaagcccggcgaggggcugggcauguacaucaagagcaccuacgacgggcugcacgucaucaccggcacgaccgagaacucccccgccgaccggagccagaagauccacgccggcgacgaggugauccaggugaaccagcagaccgucgugggguggcagcugaagaaccucgugaagaagcugcgcgagaacccgaccggcgucgugcugcuccugaagaagcggcccacgggguccuucaacuucacccccgcgccccugaagaaccuccgcuggaagccgccccugguccagaccagcccgccgcccgccaccacgcagucccccgagagcaccauggacaccucccugaagaaggagaaguccgccauccucgaccuguacaucccgccgccgcccgccgugcccuacagcccccgggacgagaacggcagcuucguguacggcgggagcuccaagugcaagcagccccugcccggccccaaggggagcgagucccccaacagcuuccucgaccaggagucccgccggcgccgguucaccaucgccgacagcgaccagcugcccggcuacuccgucgagacgaacauccugcccaccaagaugcgcgagaagacccccagcuacgggaagccccggccccucuccaugcccgccgacggcaacuggaugggcaucguggaccccuucgcccgcccgcgggggcacggccgcaagggggaggacgcgcugugccgcuacuucagcaacgagcggaucccgcccaucaucgaggaguccagcagcccgcccuaccgcuucucccggcccaccacggagcgccaccuggugcggggcgccgacuacauccgcgggucccggugcuacaucaacagcgaccuccacuccagcgccaccauccccuuccaggaggagggcaccaagaagaaguccggcagcagcgccaccaaguccagcuccacggagcccagccugcuggucuccugguucacccgccugaagcuccugacccacuga

SEQ ID NO: 28456 - RNA, 894 nt, Artificial Sequence
  derived and/or modified sequence opt1 from CNN1__Homo_sapiens__NP_001290
augagcuccgcccacuucaaccgcggccccgccuacgggcugagcgcggaggugaagaacaagcucgcccagaaguacgaccaccagcgggagcaggagcugcgcgaguggaucgagggcgucaccgggcggcgcaucggcaacaacuucauggacgggcugaaggacggcaucauccucugcgaguucaucaacaagcugcagccgggcuccgugaagaagaucaacgagagcacccagaacuggcaccagcuggagaacaucgggaacuucaucaaggccaucacgaaguacggcgugaagccccacgacaucuucgaggccaacgaccucuucgagaacaccaaccacacccagguccaguccacccugcuggcccucgcgagcauggccaagacgaaggggaacaaggugaacgugggcgucaaguacgccgagaagcaggagcggaaguucgagcccgggaagcugcgcgagggccggaacaucaucggccugcagauggggaccaacaaguucgccucccagcagggcaugaccgcguacgggacccgccggcaccucuacgaccccaagcugggcacggaccagccgcuggaccaggccaccaucagccuccagaugggcaccaacaagggggccucccaggccggcaugaccgcccccgggacgaagcgccagaucuucgagcccggccuggggauggagcacugcgacacccugaacgugagccuccagaugggcuccaacaagggcgcgagccagcgggggaugaccguguacggccugccccgccaggucuacgacccgaaguacugccugacccccgaguaccccgagcucggggagcccgcccacaaccaccacgcccacaacuacuacaacuccgccuga

SEQ ID NO: 28457 - RNA, 930 nt, Artificial Sequence
  derived and/or modified sequence opt1 from CNN2__Homo_sapiens__NP_004359
augagcuccacccaguucaacaagggccccagcuacgggcuguccgccgaggugaagaaccgccuccugagcaaguacgacccgcagaaggaggccgagcugcggaccuggaucgagggccucacggggcuguccaucggccccgacuuccagaaggggcugaaggacggcaccauccucugcacccugaugaacaagcugcagcccggcagcguccccaagaucaaccgcuccaugcagaacuggcaccagcucgagaaccugagcaacuucaucaaggcgaugguguccuacgggaugaacccgguggaccuguucgaggccaacgaccucuucgagagcggcaacaugacccagguccaggugucccugcuggcccucgccgggaaggccaagacgaagggccugcagagcgggguggacaucggcgucaaguacuccgagaagcaggagcggaacuucgacgacgcgaccaugaaggccggccagugcgugaucgggcugcagaugggcaccaacaagugcgccagccaguccgggaugaccgccuacggcacgcgccggcaccucuacgaccccaagaaccacauccugccgcccauggaccacagcaccaucucccugcagaugggcaccaacaagugcgcgagccagguggggaugaccgcccccggcacgcgccggcacaucuacgacaccaagcucgggaccgacaagugcgacaacuccagcaugagccugcagaugggcuacacccagggggccaaccaguccggccaggucuucggccuggggcgccagaucuacgaccccaaguacugcccccagggcacgguggccgacggggcccccagcggcaccggggacugcccggaccccggcgaggugcccgaguacccgcccuacuaccaggaggaggcgggcuacuga

SEQ ID NO: 28458 - RNA, 2856 nt, Artificial Sequence
  derived and/or modified sequence opt1 from CNNM1__Homo_sapiens__NP_065081
auggccgccgcggccgccgccgccgcggccgugggcguccgccugcgggacugcugcagccgcggggccgugcuccugcuguucuucucccucagcccccggccgcccgccgcggccgccuggcugcugggccuccgccccgaggacaccgccgggggccgggugucccuggagggcgggacccugcgcgccgcggagggcaccagcuuccuccugcgggucuacuuccagcccgggccgcccgccaccgccgcccccgugcccuccccgacccugaacagcggcgagaacgggaccggcgacugggcgccccgccucguguucaucgaggagccgcccgggggcggcggggucgcccccuccgccgugcccacgcggccgcccggcccccagcgcugccgggagcagagcgacugggccuccgacguggagguccuggggccccugcgccccggcggcguggccgggagcgcccucgugcagguccgggugcgcgagcugcggaagggcgaggcggagcgcgggggcgccgggggcggcgggaagcuguucucccucugcgccugggacggccgggccuggcaccaccacggggccgcgggcggguuccugcugcgcgugcggccccgccucuacggcccgggcggggaccugcugccgcccgccuggcuccgggcccugggcgcccugcuccugcuggcgcucagcgcccuguucuccgggcugcgccucagccugcugucccucgaccccgucgagcugcgcgugcugcggaacagcggcuccgccgccgagcaggagcaggcccgccgggugcaggcgguccgcgggcggggcacccaccuccugugcacccugcuccugggccaggccggggccaacgccgcccuggcgggcuggcucuacaccagccugccgcccggguucggcggcacgggggaggacuacuccgaggagggcauccacuuccccuggcugcccgcccucgugugcaccggggccguguuccugggcgccgagaucugccccuacagcgucugcagccgccacgggcuggccaucgcgucccacagcgugugccugacccggcuccugauggccgccgccuuccccgugugcuacccccugggccgccuccuggacugggcgcugcggcaggagaucuccaccuucuacacgcgcgagaagcuccuggagacccugcgggccgccgacccguacagcgaccucgucaaggaggagcugaacaucauccagggcgcccuggagcuccgcaccaagguggucgaggaggugcugacgccccugggggacugcuucaugcuccgguccgacgccgugcuggacuucgcgaccgucagcgagauccugcgcuccggcuacacccggauccccguguacgagggggaccagcgccacaacaucguggacauccucuucgucaaggaccuggccuucguggaccccgacgacugcaccccgcugcucaccgugacgcgguucuacaaccgcccccugcacugcgucuucaacgacacccggcuggacaccgugcucgaggaguucaagaagggcaagagccaccuggccaucgugcagcgcgucaacaacgagggggagggcgaccccuucuacgaggugaugggcaucgugacccuggaggacaucaucgaggagaucaucaaguccgagauccucgacgagacggaccuguacaccgacaaccgcaagaagcagcgggucccccagcgcgagcggaagcgccacgacuucagccuguucaagcucuccgacaccgagaugcgggugaagaucagcccgcagcugcugcucgccacccaccgcuucauggccacggagguggagcccuucaagucccuguaccugagcgagaagauccuccugcggcugcucaagcaccccaacgucauccaggagcugaaguucgacgagaagaacaagaaggcgcccgagcacuaccuguaccagcgcaaccggccgguggacuacuucgugcuccugcugcaggggaaggucgagguggaggugggcaaggaggggcuccgcuucgagaacggcgccuucaccuacuacgggguccccgccaucaugaccaccgccugcuccgacaacgacgugcggaaggugggcagccuggccggcuccagcgucuuccugaaccgcucccccagccggugcagcgggcucaaccgcuccgagagccccaaccgggagcgcuccgacuucggcgggagcaacacgcagcuguacuccagcuccaacaaccuguacaugccggacuacagcgugcacauccucuccgacgugcaguucgucaagaucacccggcagcaguaccagaacgcgcugaccgccugccacauggacagcagcccccagucccccgacauggaggccuucaccgacggcgacuccacgaaggcccccaccacccgcgggaccccgcagacccccaaggacgaccccgcgaucacgcugcucaacaaccggaacagccugcccugcucccgcagcgacggccugcgguccccgagcgaggugguguaccuccgcauggaggagcuggccuucacccaggaggagaugaccgacuucgaggagcacagcacccagcagcugacgcucucccccgccgccguccccacccgcgccgcgagcgacuccgagugcugcaacaucaaccuggacaccgagaccagcccgugcuccagcgacuucgaggagaacgugggcaagaagcugcuccggacgcuguccgggcagaagcgcaagcggagccccgagggcgagcgcaccuccgaggacaacagcaaccugacgccccucaucaccuga

SEQ ID NO: 28459 - RNA, 2628 nt, Artificial Sequence
  derived and/or modified sequence opt1 from CNNM2__Homo_sapiens__NP_060119
augaucggcugcggggccugcgagcccaaggugaagauggccggcgggcaggcggccgccgcccugccgaccuggaagauggccgcgcgccggagccucuccgcccgcggccgggggauccugcaggccgccgcgggccgccugcucccccugcugcuccugagcugcugcugcggcgccgggggcugcgccgccgucggggagaacgaggagaccgugaucaucggccugcggcucgaggacacgaacgacguguccuucauggagggcggggcccugcgcgucagcgagcggacccgcgugaagcugcggguguacggccagaacaucaacaacgagaccuggucccgcaucgcguucaccgagcacgagcggcgccggcacagccccggggagcgcggccucgggggccccgccccgcccgagcccgacuccggcccccagcggugcgggauccgcacgagcgacaucaucauccugccgcacaucauccugaaccggcgcaccuccggcaucaucgagaucgagaucaagccccuccggaagauggagaaguccaagagcuacuaccugugcaccagccuguccacccccgcccucggggccggcgggagcggcuccacgggcggggccgucggcgggaagggcgggagcggcguggcgggccugcccccgccgcccugggccgagaccaccuggaucuaccacgacggggaggacaccaagaugaucgugggcgaggagaagaaguuccugcuccccuucuggcugcaggucaucuucaucucccugcuccugugccugagcgggauguucuccggccucaaccuggggcugauggcccucgaccccauggagcugcgcaucgugcagaacugcggcacggagaaggagaagaacuacgccaagcggaucgagcccgugcgccgccagggcaacuaccugcucugcagccugcugcucgggaacguccuggugaacaccacccugaccauccuccuggacgacaucgccggcagcgggcugguggcggucgugguguccacgaucggcaucgucaucuucggcgagaucgugccccaggccaucugcagccggcacgggcucgccgugggcgccaacaccaucuuccugaccaaguucuucaugaugaugaccuuccccgccuccuacccggucagcaagcugcucgacugcgugcuggggcaggagaucggcacgguguacaaccgcgagaagcugcucgagaugcugcgggucaccgaccccuacaacgaccuggugaaggaggagcugaacaucauccagggggcgcucgagcugcgcaccaagaccgucgaggacgugaugacgccccugcgggacugcuucaugaucaccggcgaggccauccucgacuucaacaccauguccgagaucauggagagcggcuacacccgcauccccguguucgagggggagcgguccaacaucgucgaccugcuguucgugaaggaccucgccuucguggacccggacgacugcacgccccugaagaccaucaccaaguucuacaaccacccccugcacuucgucuucaacgacaccaagcucgacgccaugcuggaggaguucaagaagggcaagagccaccuggcgaucgugcagcgcgugaacaacgagggggagggcgaccccuucuacgagguccucgggaucgugacgcuggaggacgugaucgaggagaucaucaaguccgagauccuggacgagaccgaccucuacaccgacaaccggaccaagaagaaggucgcccaccgcgagcggaagcaggacuucagcgccuucaagcagacggacuccgagaugaaggugaagaucagcccgcagcugcugcucgccaugcaccgcuuccuggccaccgagguggaggcguucucccccagccagauguccgagaagauccugcuccggcugcugaagcaccccaacgucauccaggagcucaaguacgacgagaagaacaagaaggccccggaguacuaccuguaccagcgcaacaagcccguggacuacuucgugcugauccuccagggcaaggucgagguggaggccggcaaggaggggaugaaguucgaggccagcgccuucuccuacuacggcgugauggcgcugaccgccagccccgucccccugucccucagccggaccuucguggugagccgcaccgagcugcuggccgccggguccccgggcgagaacaagagcccgccccggcccugcgggcucaaccacuccgacagccugucccgcagcgaccggaucgacgccgucacgcccacccugggcuccagcaacaaccagcucaacuccagccugcuccagguguacauccccgacuacuccgugcgcgcgcugagcgaccugcaguucgucaagaucucccgccagcaguaccagaacgcccugauggccagccggauggacaagacgccccaguccagcgacuccgagaacaccaagaucgagcucacccugaccgagcugcacgacggccuccccgacgagaccgccaaccugcugaacgagcagaacugcgugacccacagcaaggcgaaccacagccuccacaacgagggggccaucuga

SEQ ID NO: 28460 - RNA, 2328 nt, Artificial Sequence
  derived and/or modified sequence opt1 from CNNM4__Homo_sapiens__NP_064569
auggcccccgugggcgggggcgggcgcccggucggcgggcccgcccggggccgccugcuccuggcggcccccgugcugcucgugcugcugugggcccucggcgcccgggggcagggcagcccccagcaggggaccaucgucggcaugcgccuggccuccugcaacaagagcugcgggaccaacccggacggcaucaucuucguguccgagggcagcacggugaaccugcggcucuacggguacucccugggcaacaucagcuccaaccugaucagcuucaccgaggucgacgacgcggagacccuccacaaguccaccagcugccuggagcugacgaaggaccucguggugcagcagcuggucaacgugucccgcgggaacaccagcggcgugcuggucgugcucaccaaguuccugcggcgcuccgagagcaugaagcuguacgcccucugcacccgggcccagcccgacggccccuggcugaaguggacggacaaggacucccuccuguucaugguggaggagcccgggcgcuuccugccgcuguggcuccacauccugcugaucaccguccuccuggugcugagcggcaucuucuccgggcucaaccugggccugauggcccucgaccccauggagcugcggaucgugcagaacugcgggaccgagaaggagcgccgguacgcgcgcaagaucgagcccauccggcgcaagggcaacuaccugcucugcagccugcugcucggcaacguccuggugaacaccucccugacgauccuccuggacaaccugaucgggagcggccucauggccguggccagcuccaccaucgggaucgucaucuucggcgagauccugccccaggcccugugcagccggcacgggcuggccgugggcgcgaacaccauccuccugaccaaguucuucaugcugcucacguucccgcuguccuuccccaucagcaagcugcucgacuucuuccugggccaggagauccgcaccguguacaaccgggagaagcugauggagaugcucaaggucaccgagcccuacaacgaccuggugaaggaggagcugaacaugauccagggggcccucgagcugcgcaccaagacggucgaggacaucaugacccagcugcaggacugcuucaugauccgguccgacgccauccucgacuucaacaccaugagcgagaucauggaguccggcuacacccgcauccccguguucgaggacgagcagagcaacaucguggacauccuguacgucaaggaccuggccuucguggacccggacgacugcacgccccucaagaccaucacccgcuucuacaaccaccccgugcacuucgucuuccacgacaccaagcuggacgccaugcuggaggaguucaagaaggggaagucccaccucgcgaucgugcagaaggugaacaacgagggcgagggggaccccuucuacgagguccugggccuggugacgcucgaggacgugaucgaggagaucaucaagagcgagauccuggacgaguccgacauguacaccgacaaccggagccgcaagcgggucuccgagaagaacaagcgcgacuucagcgccuucaaggacgccgacaacgagcugaaggugaagaucuccccgcagcuccugcuggccgcccaccgguuccucgcgaccgaggugagccaguucucccccagccugaucuccgagaagauccugcuccgccugcugaaguaccccgacgucauccaggagcucaaguucgacgagcacaacaaguacuacgcccggcacuaccuguacacccgcaacaagcccgccgacuacuucauccugauccuccagggcaagguggagguggaggccgggaaggagaacaugaaguucgagacgggcgccuucagcuacuacgggaccauggcgcugaccagcgucccguccgaccggagccccgcccaccccacgccccugucccgcagcgccucccucagcuacccggaccggaccgacguguccaccgccgcgacccuggccggcagcuccaaccaguucggcagcuccgugcuggggcaguacaucagcgacuucuccguccgcgcccucguggaccugcaguacaucaagaucacccggcagcaguaccagaacggccugcucgccagccgcauggagaacagcccccaguuccccaucgacgggugcaccacgcacauggagaaccuggccgagaaguccgagcugccgguggucgacgagaccaccacccuccugaacgagcggaacucccugcuccacaaggcgagccacgagaacgccaucuga

SEQ ID NO: 28461 - RNA, 7116 nt, Artificial Sequence
  derived and/or modified sequence opt1 from CNOT1__Homo_sapiens__NP_001252541
augaaccuggacagccugucccuggcccugagccagaucuccuaccucguggacaaccugaccaagaagaacuaccgcgccagccagcaggagauccagcacaucgugaaccggcacggccccgaggccgaccgccaccuccugcggugccuguucucccacguggacuucagcggggacggcaaguccagcgggaaggacuuccaccagacccaguuccugauccaggagugcgcccuccugaucaccaagcccaacuucaucuccacccugagcuacgccaucgacaacccccuccacuaccagaagucccugaagcccgcgccccaccuguucgcccagcucagcaaggugcugaagcuguccaagguccaggaggugaucuucggccucgcgcugcugaacagcuccagcuccgaccuccgcggguucgccgcccaguucaucaagcagaagcugcccgaccugcuccggagcuacaucgacgccgacguguccggcaaccaggagggcggguuccaggacaucgccaucgagguccugcaccuccugcugagccaccuccuguucggccagaagggggccuucggcguggggcaggagcagaucgacgccuuccugaagacccugcgccgggacuucccccaggagcgcugccccgugguccuggcgccccugcuguaccccgagaagcgggacauccucauggaccgcauccugcccgacagcggcggcguggccaagaccaugauggaguccagccuggccgacuucaugcaggaggugggguacggcuucugcgccuccaucgaggagugccggaacaucaucguccaguucggggugcgcgaggugacggccgcccaggucgcccgggugcucggcaugauggcccgcacccacagcggccugaccgacgggaucccccugcaguccaucagcgcccccggcuccgggaucuggagcgacggcaaggacaaguccgacggggcccaggcccacaccuggaacguggagguccucaucgacgugcugaaggagcugaaccccagccucaacuucaaggaggugacguacgagcuggaccaccccggcuuccagauccgggacuccaagggccugcacaacgucguguacgggauccagcgcggccucgggauggagguguuccccgucgaccugaucuaccggcccuggaagcacgccgagggccagcugagcuucauccagcacucccugaucaaccccgagaucuucugcuucgccgacuaccccugccacaccguggccaccgacauccucaaggcgccgcccgaggacgacaaccgcgagaucgccaccuggaagucccuggaccugaucgagucccuccugcggcuggccgaggucgggcaguacgagcaggucaagcagcuguucagcuuccccaucaagcacugccccgacaugcuggugcuggcccuccugcagaucaacacguccuggcacacccugcgccacgagcucaucagcacccugaugcccaucuuccugggcaaccaccccaacuccgccaucauccuccacuacgccuggcacggccaggggcagagccccagcauccggcagcugaucaugcacgccauggcggagugguacaugcgcggcgagcaguacgaccaggccaagcugucccgcauccucgacgucgcccaggaccugaaggcccugagcaugcuccugaacgggacccccuucgccuucgugaucgaccuggcggcccucgccucccggcgcgaguaccugaagcuggacaaguggcucacggacaagauccgggagcacggcgagcccuucauccaggccugcaugaccuuccugaagcgccggugccccagcauccucgggggccucgccccggagaaggaccagcccaaguccgcgcagcugccgcccgagacccuggccaccaugcucgccugccugcaggccugcgccggcagcgugucccaggagcugagcgagacgauccucaccauggucgcgaacugcuccaacgugaugaacaaggcccgccagcccccgcccggggugaugcccaagggccggccgcccagcgccuccagccuggacgccaucucccccguccagaucgacccccuggcggggaugaccagccucuccaucggcggcagcgccgcgccccacacccaguccaugcagggguucccgcccaaccugggcagcgccuucagcacgccgcagucccccgccaaggcguucccgccccugagcaccccgaaccagaccaccgccuucuccgggaucggcgggcucagcucccagcugcccgugggcggccuggggacgggcagccucaccgggaucggcaccggggcccugggccugcccgccgugaacaacgaccccuucguccagcgcaagcucggcaccuccgggcugaaccagccgacguuccagcagaccgaccugagccagguguggcccgaggccaaccagcacuucuccaaggagaucgacgacgaggcgaacagcuacuuccagcggaucuacaaccacccgccccacccgaccauguccguggacgagguccucgagaugcugcagcgcuucaaggacagcaccaucaagcgggagcgcgagguguucaacugcaugcugcggaaccucuucgaggaguaccgcuucuucccccaguaccccgacaaggagcugcacaucacggccugccuguucggcgggaucaucgagaagggccucgugaccuacauggcccuggggcuggcccuccgguacguccuggaggcccugcgcaagccguucggcuccaagauguacuacuucggcaucgcggcccucgaccgguucaagaaccgccugaaggacuacccccaguacugccagcaccuggccagcaucucccacuucaugcaguucccccaccaccuccaggaguacaucgaguacgggcagcagagccgggacccgcccgugaagaugcagggcuccaucaccacccccgggagcaucgcccuggcgcaggcccaggcccaggcccaggugcccgccaaggcgccccuggccggccaggucuccaccauggugacgaccagcaccaccacgaccguggccaagaccgucaccgugacgcgccccaccggggugagcuucaagaaggacgugccgcccuccaucaacaccaccaacaucgacacgcuccugguggccaccgaccagaccgagcgcaucguggagcccccggagaacauccaggagaagaucgccuucaucuucaacaaccugagccaguccaacaugacccagaaggucgaggagcucaaggagacggugaaggaggaguucaugcccugggugagccaguaccuggucaugaagcggguguccaucgagcccaacuuccacagccuguacuccaacuuccucgacacccugaagaaccccgaguucaacaagauggugcugaacgagaccuaccgcaacaucaagguccuccugaccagcgacaaggcggccgccaacuucuccgaccggagccugcucaagaaccugggccacuggcugggcaugaucacgcucgccaagaacaagccgauccugcacaccgaccuggacgugaagucccuccugcuggaggccuacgugaaggggcagcaggagcuccuguacgucgugcccuucguggcgaagguccuggagagcuccauccgcagcgugguguuccggccgcccaacccguggaccauggccaucaugaacguccucgccgagcugcaccaggagcacgaccugaagcugaaccucaaguucgagaucgaggugcugugcaagaaccuggcccucgacaucaacgagcugaagcccggcaaccugcucaaggacaaggaccgccugaagaaccuggacgagcagcucuccgcccccaagaaggacgugaagcagcccgaggagcugccgcccaucaccacgaccaccaccagcacgacccccgcgaccaacaccacgugcaccgccaccgugcccccgcagccccaguacuccuaccacgacaucaacgucuacagccuggccgggcucgcgccccacaucacccugaacccgacgaucccccuguuccaggcgcacccccagcucaagcagugcgugcggcaggccaucgagcgcgccguccaggagcuggugcaccccgucguggaccgguccaucaagaucgccaugacgaccugcgagcagaucgugcgcaaggacuucgcccuggacagcgaggagagccggaugcgcaucgcggcccaccacaugaugcggaaccucaccgccggcauggccaugaucacgugccgcgagccgcugcugauguccaucagcaccaaccucaagaacuccuucgccagcgcgcugcggaccgccagcccccagcagcgcgagaugauggaccaggccgccgcccagcuggcgcaggacaacugcgagcucgccugcugcuucauccagaagaccgccgucgagaaggccggccccgagauggacaagcggcuggcgaccgaguucgagcugcgcaagcacgcccggcaggaggggcgccgguacugcgaccccguggugcucacguaccaggccgagcgcaugccggagcagauccgccugaaggucggcgggguggaccccaagcagcuggccguguacgaggaguucgcccggaacguccccggcuuccuccccaccaacgaccugagccagccgaccggguuccuggcgcagcccaugaagcaggccugggccaccgacgacguggcccagaucuacgacaagugcaucacggagcucgagcagcaccuccacgccaucccgcccacccuggcgaugaacccgcaggcccaggcccuccgcucccugcuggagguggucgugcucagccggaacucccgcgacgccaucgccgcgcugggccugcuccagaaggccguggagggccugcuggacgccaccagcggggccgacgcggaccuccugcugcgguaccgcgagugccaccuccugguccugaaggcccuccaggacggccgggccuacgggucccccuggugcaacaagcagaucacccgcugccugaucgagugccgggacgaguacaaguacaacguggaggccguggagcugcucauccgcaaccaccuggucaacaugcagcaguacgaccugcaccucgcccagagcauggagaacggccugaacuacauggcgguggccuucgccaugcagcuggugaagauccuccuggucgacgagcgguccguggcccacgugacggaggccgaccuguuccacaccaucgagacccucaugcgcaucaacgcgcacagccgggggaacgcccccgagggccugccccagcugauggaggucgugcgcuccaacuacgaggccaugaucgaccgggcccacggcgggccgaacuucaugaugcacagcggcaucucccaggccagcgaguacgacgacccgcccgggcuccgcgagaaggcggaguaccugcugcgggagugggugaaccucuaccacuccgccgccgccggccgcgacagcaccaaggccuucagcgcguucgucgggcagaugcaccagcagggcauccugaagacggacgaccugaucacccgguucuuccgccucugcaccgagaugugcguggagaucuccuaccgcgcccaggccgagcagcagcacaaccccgccgcgaacccgaccaugauccgggccaagugcuaccacaaccuggacgccuucgugcgccugaucgcccuccuggucaagcacagcggcgaggccacgaacaccgugaccaagaucaaccugcucaacaaggugcuggggaucgucgugggcgugcugcuccaggaccacgacguccggcaguccgaguuccagcagcugcccuaccaccgcaucuucaucaugcugcuccuggagcugaacgcgcccgagcacgugcucgagaccaucaacuuccagacgcugaccgccuucugcaacaccuuccacauccugcggcccaccaaggccccgggguucguguacgccuggcucgagcugaucagccaccgcaucuucaucgcccggaugcuggcgcacacgccccagcagaagggcuggcccauguacgcccagcuccugaucgaccuguucaaguaccucgccccguuccugcgcaacgucgagcugaccaagcccaugcagauccucuacaagggcacccugcgggugcugcuggugcuccugcacgacuuccccgaguuccugugcgacuaccacuacggguucugcgacgucaucccgcccaacugcauccagcuccgcaaccugauccuguccgccuucccccggaacaugcgccuccccgaccccuucacccccaaccugaagguggacaugcugagcgagaucaacaucgcgccccggauccucacgaacuucaccggcgugaugccgccccaguucaagaaggaccuggacuccuaccugaagacccgcagcccggucaccuuccucuccgaccugcggagcaaccuccagguguccaacgagcccgggaaccgcuacaaccuccagcugaucaacgcgcuggugcucuacgucggcacgcaggccaucgcccacauccacaacaaggggagcacccccuccaugagcaccaucacccacuccgcccacauggacaucuuccagaaccuggcgguggaccuggacaccgagggccgguaccucuuccugaacgccaucgccaaccagcugcgcuaccccaacagccacacgcacuacuucuccugcaccaugcucuaccuguucgccgaggccaacaccgaggcgauccaggagcagaucacccgggugcugcucgagcgccugaucgucaaccggccgcaccccuggggccugcucaucacguucaucgagcugaucaagaaccccgccuucaaguucuggaaccacgaguucgugcacugcgcccccgagaucgagaagcuguuccagagcgucgcccagugcugcauggggcagaagcaggcccagcaggucauggagggcaccggggcguccuga

SEQ ID NO: 28462 - RNA, 1623 nt, Artificial Sequence
  derived and/or modified sequence opt1 from CNOT2__Homo_sapiens__NP_055330
auggugcgcaccgacggccacacccugagcgagaagcggaacuaccaggucacgaacuccauguucggggccagccgcaagaaguucguggagggcguggacuccgacuaccacgacgagaacauguacuacagccaguccagcauguucccccaccgguccgagaaggacaugcucgccagcccguccaccagcgggcagcugucccaguucggcgcgagccuguacgggcagcaguccgcccucggccugcccaugcgcggcaugagcaacaacacgccccagcugaaccggucccucagccaggggacccagcugcccucccacgucaccccgaccaccggcgugcccaccaugagccugcacacgccgcccucccccagccgcgggauccuccccaugaacccccggaacaugaugaaccacagccaggugggccaggggaucggcauccccucccgcaccaacagcauguccagcuccggccuggggagcccgaaccgguccagccccuccaucaucugcaugcccaagcagcagcccagccgccagccguucaccgucaacuccaugagcggcuucgggaugaaccggaaccaggccuucggcaugaacaacucccugagcuccaacaucuucaacggcaccgacgggagcgagaacgugacgggccucgaccuguccgacuuccccgcccuggccgaccgcaaccggcgcgaggggagcggcaaccccacgccccucaucaacccgcuggcggggcgggcccccuacgugggcauggucaccaagcccgccaacgagcagucccaggacuucagcauccacaacgaggacuuccccgcccugccgggcagcuccuacaaggaccccaccagcuccaacgacgacagcaaguccaaccucaacaccagcgggaagaccaccuccagcaccgacggccccaaguuccccggggacaaguccagcacgacccagaacaacaaccagcagaagaagggcauccaggugcugccggacgggcgcgugaccaacaucccccagggcauggucaccgaccaguucggcaugaucgggcugcucacguucauccgggcggccgagaccgaccccggcauggugcaccuggcccugggguccgaccucaccacccugggccugaaccucaacagcccggagaaccuguaccccaaguucgccucccccugggccagcucccccugccgcccgcaggacaucgacuuccacgugcccagcgaguaccugacgaacauccacauccgggacaagcucgcggccaucaagcuggggcgcuacggcgaggaccuccuguucuaccuguacuacaugaacggcggggacguccugcagcuccuggccgccguggagcuguucaaccgggacuggcgcuaccacaaggaggagcgcguguggaucacccgggcccccggcauggagcccaccaugaagaccaacacguacgagcgcgggaccuacuacuucuucgacugccucaacuggcggaaggucgcgaaggaguuccaccuggaguacgacaagcuggaggagcgcccgcaccuccccuccaccuucaacuacaaccccgcccagcaggccuucuga

SEQ ID NO: 28463 - RNA, 2262 nt, Artificial Sequence
  derived and/or modified sequence opt1 from CNOT3__Homo_sapiens__NP_055331
auggccgacaagcgcaagcugcagggcgagaucgaccggugccucaagaaggugagcgagggggucgagcaguucgaggacaucuggcagaagcugcacaacgccgcgaacgccaaccagaaggagaaguacgaggccgaccugaagaaggagaucaagaagcuccagcgccugcgggaccagaucaagaccuggguggccuccaacgagaucaaggacaagcgccagcugaucgacaaccggaagcucaucgagacccagauggagcgcuucaagguggucgagcgggagacgaagaccaaggccuacagcaaggagggccuggggcuggcgcagaagguggaccccgcccagaaggagaaggaggaggugggccaguggcucaccaacaccaucgacacgcugaacaugcaggucgaccaguucgaguccgagguggagagccuguccgugcagacccgcaagaagaagggggacaaggacaagcaggaccggaucgagggccucaagcgccacaucgagaagcaccgguaccacguccgcaugcuggagaccauccugcggaugcucgacaacgacagcauccugguggacgccauccgcaagaucaaggacgacguggaguacuacgucgacuccagccaggacccggacuucgaggagaacgaguuccuguacgacgaccucgaccuggaggacaucccccaggcccugguggcgaccuccccccccagccacucccacauggaggacgagaucuucaaccagagcuccagcacgccgaccuccaccaccagcuccagccccaucccccccuccccggccaacugcacgaccgagaacagcgaggacgacaagaagcggggccgcagcaccgacuccgaggugagccagucccccgccaagaacgggagcaagcccguccacuccaaccagcacccccagagcccggccgugccccccaccuaccccuccggcccgccccccgccgcgagcgcccucuccacgacccccgggaacaacggcgugccggcccccgccgccccccccagcgcgcuggggccgaaggccucccccgcccccagccacaacuccggcacccccgccccguacgcccaggcggucgccccccccgccccgagcggccccuccaccacgcagccccggcccccgagcgugcagcccuccgggggcgggggcggcgggagcggcgggggcggguccagcagcuccagcaacuccagcgccggcggcggggccggcaagcagaacggggcgaccuccuacagcuccguggucgccgacagccccgccgagguggcccuguccagcuccggcgggaacaacgcgagcucccaggcccucggccccccgagcggcccccacaacccccccccguccaccagcaaggagcccuccgccgccgcccccaccggggcgggcgggguggcccccggcagcgggaacaacagcggcggcccgucccugcuggucccccuccccgugaaccccccgagcucccccacgcccagcuucuccgacgccaaggccgccggggcgcugcugaacggccccccgcaguucagcaccgcccccgagaucaaggcccccgagccgcucuccagccugaaguccauggccgagcgcgccgcgaucagcuccgggaucgaggaccccguccccacccugcaccucaccgagcgggacaucauccugagcuccacgagcgcccccccggccuccgcccagcccccccugcagcucagcgaggugaacaucccccugucccugggcgugugcccgcucggccccgucccccugaccaaggagcagcuguaccagcaggcgauggaggaggccgccuggcaccacaugccccacccgagcgacuccgagcgcauccggcaguaccucccccgcaaccccugccccaccccgcccuaccaccaccagaugccccccccgcacagcgacaccguggaguucuaccagcgccugagcacggagacccuguucuucaucuucuacuaccucgaggggaccaaggcccaguaccuggccgcgaaggcccugaagaagcaguccuggcgguuccacaccaaguacaugaugugguuccagcgccacgaggagcccaagacgaucaccgacgaguucgagcagggcaccuacaucuacuucgacuacgagaagugggggcagcggaagaaggagggcuucaccuucgaguaccgcuaccucgaggaccgggaccugcaguga

SEQ ID NO: 28464 - RNA, 1719 nt, Artificial Sequence
  derived and/or modified sequence opt1 from CNOT4__Homo_sapiens__NP_001008226
augagccgcucccccgacgccaaggaggacccgguggagugcccccugugcauggagccccucgagaucgacgacaucaacuucuuccccugcacgugcggcuaccagaucugccgguucugcuggcaccgcauccggaccgacgagaacgggcugugcccggccugccgcaagcccuaccccgaggaccccgcggucuacaagccgcugagccaggaggagcuccagcggaucaagaacgagaagaagcagaagcagaacgagcgcaagcagaagaucuccgagaaccggaagcaccuggccagcgugcgcgugguccagaagaaccugguguucguggucggccucucccagcggcuggccgaccccgaggugcugaagcgccccgaguacuucgggaaguucggcaagauccacaagguggucaucaacaacagcaccuccuacgccgggagccagggccccuccgccagcgcguacgugaccuacauccgguccgaggacgcccuccgcgccauccagugcgugaacaacgucgugguggacggccggacccugaaggccagccuggggaccacgaaguacugcuccuacuuccucaagaacaugcagugcccgaagcccgacugcauguaccugcacgagcugggcgacgaggcggccagcuucaccaaggaggagaugcaggccgggaagcaccaggaguacgagcagaagcuccugcaggagcuguacaagcucaaccccaacuuccugcagcuguccaccggcagcgucgacaagaacaagaacaaggugacgccccuccaguccccgaucgacaagcccagcgacucccugagcaucgggaacggcgacaacagccagcagaucuccaacagcgacacccccagcccgccgcccggccuguccaaguccaaccccgugauccccaucagcuccagcaaccacuccgcccgcagccccuucgagggggccgucaccgagucccagagccucuucuccgacaacuuccggcaccccaaccccauccccagcggccugccgcccuuccccuccagcccgcagaccuccagcgacuggcccaccgcgcccgagccccagucccuguucacgagcgagaccaucccggugagcuccagcaccgacuggcaggccgccuucggguucggcuccagcaagcagcccgaggacgaccucggcuucgaccccuucgacgugacccgcaaggcccuggccgaccugaucgagaaggagcucuccguccaggaccagcccagccuguccccgacgagccugcagaacuccagcucccacaccaccaccgcgaaggggcccggcagcggguuccuccaccccgccgccgccacgaacgccaacucccugaacagcaccuucuccgugcugccccagcgguucccgcaguuccagcagcaccgcgcgguguacaacagcuucuccuuccccggccaggccgcccgguaccccuggauggccuucccccgcaacagcaucaugcaccucaaccacaccgccaacccgaccagcaacuccaacuuccuggaccugaaccucccgccccagcacaacacggggcugggcggcauccccgucgcgggggaggaggaggugaaggucagcaccaugccccuguccaccagcucccacagccuccagcagggccagcagcccaccucccugcacacgaccguggccuga

SEQ ID NO: 28465 - RNA, 1674 nt, Artificial Sequence
  derived and/or modified sequence opt1 from CNOT6__Homo_sapiens__NP_001290170
augcccaaggagaaguacgagccgcccgacccccgccggauguacaccaucaugagcuccgaggaggccgccaacggcaagaagucccacugggcggagcuggagaucagcgggaaggugcgcagccuguccgccagccuguggucccugacccaccucacggcccugcaccugagcgacaacucccucagccggauccccuccgacaucgccaagcugcacaaccuggucuaccucgaccugagcuccaacaagauccgcagccugccggccgagcucggcaacauggugucccugcgggagcugcaccucaacaacaaccugcugcgcgugcuccccuucgagcuggggaagcuguuccagcuccagacccugggccugaaggggaacccccucacccaggacauccugaaccuguaccaggagcccgacggcacccggcgccuccugaacuaccugcucgacaaccugagcggcacggcgaagcggaucaccaccgagcagccgccgccccgcuccuggaucaugcugcaggagcccgaccggacccgccccacggcccucuucagcgucaugugcuacaacgugcugugcgacaaguacgccacccggcagcuguacggguacugccccuccugggcccucaacugggacuaccgcaagaaggcgaucauccaggagauccugagcugcaacgccgacaucgugagccugcaggaggucgagaccgagcaguacuacuccuucuuccucguggagcugaaggagcggggcuacaacggguucuucagccccaagucccgcgcccggaccaugagcgagcaggagcgcaagcacguggacggcugcgccaucuucuucaagacggagaaguucacccugguccagaagcacaccguggaguucaaccagcucgccauggcgaacuccgaggggagcgaggccaugcugaaccgggugaugaccaaggacaacaucggcgucgccgugcugcucgagcugcgcaaggaguccaucgagaugcccagcggcaagccgcaccuggggacggagaagcagcucauccugguggccaacgcccacaugcacugggaccccgaguacuccgacgucaagcuggugcagaccaugauguuccugagcgaggugaagaacaucaucgacaaggcgucccggaaccucaagagcuccguccugggcgaguucgggaccaucccccuggugcucugcgccgaccugaacagccugcccgacuccggcguggucgaguaccucagcaccggcgggguggagacgaaccacaaggacuucaaggagcugcgcuacaacgagucccugaccaacuucagcugccacggcaagaacgggaccaccaacggccgcaucacgcacggguucaagcuccaguccgccuacgagagcggccugaugccguacaccaacuacaccuucgacuucaagggcaucaucgacuacaucuucuacagcaagccccagcugaacacccucgggauccugggcccccuggaccaccacuggcucguggagaacaacaucuccgggugcccccacccgcugauccccagcgaccacuucucccuguucgcccagcucgagcugcugcuccccuuccugccccaggucaacggcauccaccucccggggcggcgcuga

SEQ ID NO: 28466 - RNA, 1668 nt, Artificial Sequence
  derived and/or modified sequence opt1 from CNOT6L__Homo_sapiens__NP_653172
augcgccugaucggcaugcccaaggagaaguacgacccgcccgacccccggcgcaucuacaccaucaugagcgccgaggagguggccaacgggaagaagucccacugggcggagcuggagaucagcggccggguccgcucccugagcaccucccuguggagccucacgcaccugaccgcccugcaccucaacgacaacuaccugucccggaucccgccggacaucgccaagcugcacaaccucguguaccuggaccugagcuccaacaagcuccgcagccugcccgccgagcuggggaacauggugucccuccgggagcugcugcucaacaacaaccugcugcgcguccuccccuacgagcugggccggcuguuccagcuccagacccuggggcugaagggcaacccccucagccaggacauccugaaccuguaccaggacccggacggcacccgcaagcuccugaacuucaugcuggacaaccucgccgugcaccccgagcagcugccgccccggcccuggaucacgcugaaggagcgcgaccagauccuccccuccgcgagcuucaccgugaugugcuacaacguccugugcgacaaguacgccacccggcagcuguacggguacugccccuccugggcccucaacugggaguaccgcaagaagggcaucauggaggagaucgugaacugcgacgccgacaucaucagccugcaggagguggagaccgagcaguacuucacgcuguuccuccccgcgcugaaggagcggggguacgacggcuucuucucccccaagagccgcgccaagaucauguccgagcaggagcggaagcacgucgacgggugcgccaucuucuucaagaccgagaaguucacccuggugcagaagcacaccguggaguucaaccaggucgccauggccaacagcgacggcagcgaggcgaugcucaaccgcgugaugacgaaggacaacaucggcguggccgucgugcuggaggugcacaaggagcuguucggggccggcaugaagcccauccacgccgccgacaagcagcuccugaucgucgcgaacgcccacaugcacugggaccccgaguacuccgacgugaagcugauccagaccaugauguucgugagcgaggucaagaacauccuggagaaggccuccagccggcccggguccccgaccgccgaccccaacagcaucccccucgugcugugcgccgaccugaacucccuccccgacagcggcguggucgaguaccuguccaacggcgggguggcggacaaccacaaggacuucaaggagcugcgcuacaacgagugccucaugaacuucagcugcaacggcaagaacggguccagcgagggccggaucacccacggguuccagcugaaguccgccuacgagaacaaccugaugccguacacgaacuacaccuucgacuucaagggcgucaucgacuacaucuucuacagcaagacccacaugaacgugcucggcgugcuggggccccuggacccccaguggcucgucgagaacaacaucaccggcugcccccacccgcacauccccuccgaccacuucagccugcugacgcagcucgagcugcacccgccccugcucccccuggugaacggggugcaccuccccaaccgccgcuga

SEQ ID NO: 28467 - RNA, 858 nt, Artificial Sequence
  derived and/or modified sequence opt1 from CNOT7__Homo_sapiens__NP_037486
augcccgccgccaccguggaccacagccagcgcaucugcgaggucugggcgugcaaccuggacgaggagaugaagaagauccgccaggugauccggaaguacaacuacguggccauggacaccgaguucccgggcgucguggcccggcccaucggggaguuccgcuccaacgccgacuaccaguaccagcuccugcggugcaacguggaccugcucaagaucauccagcugggccugacguucaugaacgagcagggggaguacccgcccggcaccagcaccuggcaguucaacuucaaguucaaccucaccgaggacauguacgcccaggacuccaucgagcugcugacgaccagcgggauccaguucaagaagcacgaggaggagggcaucgagacccaguacuucgcggagcuccugaugaccuccggcgucgugcugugcgagggggugaaguggcucagcuuccacuccggcuacgacuucggguaccugaucaagauccugacgaacagcaaccuccccgaggaggagcuggacuucuucgagauccugcgccucuucuuccccgucaucuacgacgugaaguaccugaugaaguccugcaagaaccugaagggcgggcuccaggagguggccgagcagcuggagcuggagcggaucggcccccagcaccaggccggcagcgacucccuccugaccgggauggccuucuucaagaugcgcgagauguucuucgaggaccacaucgacgacgcgaaguacugcggccaccuguacgggcucggcagcggcuccagcuacguccagaacgggaccggcaacgccuacgaggaggaggccaacaagcaguccuga

SEQ ID NO: 28468 - RNA, 717 nt, Artificial Sequence
  derived and/or modified sequence opt1 from CNOT8__Homo_sapiens__NP_001288003
augcccgccgcccugguggagaacagccaggucaucugcgaggugugggcguccaaccucgaggaggagaugcgcaagauccgggagaucgugcugagcuacuccuacaucgccauggacaccgaguucccgggcgucguggugcgccccaucggggaguuccggagcuccaucgacuaccaguaccagcugcuccgcugcaacgucgaccugcugaagaucauccagcucggccugaccuucacgaacgagaagggggaguaccccagcggcaucaacaccuggcaguucaacuucaaguucaaccugaccggguacgacuucggcuacauggugaagcuccugaccgacucccggcugcccgaggaggagcacgaguucuuccacauccucaaccuguucuucccgagcaucuacgacgugaaguaccugaugaaguccugcaagaaccucaagggcgggcugcaggaggucgccgaccagcuggaccuccagcgcaucggccggcagcaccaggccgggagcgacucccugcugacgggcauggccuucuuccgcaugaaggagcuguucuucgaggacagcaucgacgacgcgaaguacugcgggcggcucuacggccugggcaccgggguggcccagaagcagaacgaggacguggacuccgcccaggagaagaugagcauccucgccaucaucaacaacaugcagcaguga

SEQ ID NO: 28469 - RNA, 1266 nt, Artificial Sequence
  derived and/or modified sequence opt1 from CNP__Homo_sapiens__NP_149124
augaaccgcggcuucagccggaagucccacaccuuccugcccaagaucuucuuccgcaagaugagcuccagcggggccaaggacaagccggagcuccaguuccccuuccugcaggacgaggacaccguggccacgcugcucgagugcaagacccuguucauccugcggggccuccccggguccggcaagagcacccuggcgcgcgucaucguggacaaguaccgggacgggaccaagaugguguccgccgacgccuacaagaucacgcccggcgcccgcggcgccuucagcgaggaguacaagcggcuggacgaggaccucgcggccuacugccgccggcgcgacauccggauccugguccuggacgacaccaaccacgagcgcgagcggcucgagcagcuguucgagauggccgaccaguaccaguaccagguggugcuggucgagccgaagaccgccuggcgccucgacugcgcgcagcugaaggagaagaaccaguggcagcuguccgccgacgaccucaagaagcugaagcccgggcuggagaaggacuuccucccccuguacuucggcugguuccugaccaagaaguccagcgagacgcuccggaaggccggccagguguuccuggaggagcuggggaaccacaaggccuucaagaaggagcuccgccaguucgugcccggggacgagccgcgggagaagauggaccuggucaccuacuucggcaagcgcccgcccggcgugcugcacugcaccaccaaguucugcgacuacgggaaggcccccggcgcggaggaguacgcccagcaggacgugcucaagaaguccuacagcaaggccuucacgcugaccaucagcgcccuguucgucacccccaagaccacgggggcccggguggagcucuccgagcagcagcugcagcuguggcccagcgacguggacaagcucucccccaccgacaaccugccccgcggcagccgggcgcacaucacccugggcugcgccgccgacgucgaggccgugcagaccgggcucgaccugcuggagauccuccgccaggagaagggcgggucccgcggcgaggaggugggggagcugagccggggcaagcuguacagccucggcaacgggcgcuggaugcugacgcuggccaagaacauggagguccgggcgaucuucaccggcuacuacgggaagggcaagccggugcccacccaggggucccgcaagggcggcgcccuccagagcugcaccaucaucuga

SEQ ID NO: 28470 - RNA, 549 nt, Artificial Sequence
  derived and/or modified sequence opt1 from CNPY2__Homo_sapiens__NP_055070
augaagggcuggggguggcuggcccuccugcugggcgcccuccuggggaccgcgugggcccgccggagccaggaccugcacugcggcgccugccgcgcccucguggacgagcuggagugggagaucgcccaggucgaccccaagaagaccauccagaugggguccuuccggaucaacccggacggcagccaguccgugguggagguccccuacgcgcgcagcgaggcccaccugacggagcuccuggaggagaucugcgaccggaugaaggaguacggcgagcagaucgaccccuccacccaccgcaagaacuacgugcggguggucgggcgcaacggcgagagcuccgagcuggaccuccaggggauccggaucgacagcgacaucuccggcacccugaaguucgccugcgagagcaucguggaggaguacgaggacgagcugaucgaguucuucucccgcgaggccgacaacgugaaggacaagcucugcagcaagcggaccgaccugugcgaccacgcgcugcacaucucccacgacgagcucuga

SEQ ID NO: 28471 - RNA, 837 nt, Artificial Sequence
  derived and/or modified sequence opt1 from CNPY3__Homo_sapiens__NP_006577
auggacagcaugcccgagcccgccucccgcugccugcuccugcugccccuccugcugcuccugcugcuccugcugcccgcccccgagcucggcccgagccaggcgggggccgaggagaacgacugggugcggcugcccuccaagugcgaggucugcaaguacguggccguggagcucaagagcgccuucgaggagaccggcaagaccaaggaggucaucgggacgggcuacgggauccuggaccagaaggccuccggcgugaaguacaccaagagcgaccugcgccugaucgaggugaccgagaccaucugcaagcggcuccuggacuacucccugcacaaggagcgcacgggcagcaaccgguucgcgaaggggauguccgagaccuucgagacccuccacaaccugguccacaagggcgugaagguggucauggacauccccuacgagcuguggaacgagaccagcgccgagguggccgaccucaagaagcagugcgacgugcuggucgaggaguucgaggaggugaucgaggacugguaccgcaaccaccaggaggaggaccugacggaguuccucugcgccaaccacgugcugaaggggaaggacaccuccugccuggcggagcaguggagcggcaagaagggggacaccgccgcccucggcggcaagaaguccaagaagaaguccagccgggccaaggccgccgggggccgcagcuccagcuccaagcagcggaaggagcucgggggccuggagggcgaccccagcccggaggaggacgaggggauccagaaggcgagcccccugacccacuccccgcccgacgagcuguga

SEQ ID NO: 28472 - RNA, 1419 nt, Artificial Sequence
  derived and/or modified sequence opt1 from CNR1__Homo_sapiens__NP_001153731
augaaguccauccuggacggccucgccgacaccaccuuccgcacgaucaccaccgaccugcuguacguggggagcaacgacauccaguacgaggacaucaagggcgacauggccagcaagcucggguacuucccccagaaguucccgcugaccuccuuccggggcagccccuuccaggagaagaugacggcgggggacaacccccagcugguccccgccgaccaggugaacaucaccgaguucuacaacaagucccucagcuccuucaaggagaacgaggagaacauccagugcggcgagaacuucauggacaucgagugcuucauggugcugaacccgagccagcagcuggccaucgccguccucucccugacccugggcaccuucacggugcucgagaaccugcuggugcucugcgucauccugcacagccgcucccugcggugccgccccagcuaccacuucaucgggucccucgccguggcggaccugcugggcagcgugaucuucgucuacuccuucaucgacuuccacguguuccaccggaaggacagccgcaacguguuccucuucaagcucgggggcgucaccgccuccuucaccgccagcguggggucccuguuccugaccgccaucgaccgguacaucagcauccaccgcccccuggcguacaagcggaucgugacgcgccccaaggccgucguggccuucugccugauguggaccaucgccaucgugaucgccguccucccgcugcugggcuggaacugcgagaagcuccagagcgugugcuccgacaucuucccccacaucgacgagaccuaccugauguucuggaucggcgugaccagcguccugcuccuguucaucguguacgcguacauguacauccuguggaaggcccacucccacgccgugcggaugauccagcgcgggacgcagaaguccaucaucauccacaccagcgaggacggcaagguccaggugacccggcccgaccaggcccgcauggacauccggcucgccaagacccugguccugauccucguggugcugaucaucugcugggggccccugcucgcgaucauggucuacgacguguucggcaagaugaacaagcugaucaagacgguguucgccuucugcagcaugcugugccuccugaacuccaccgucaacccgaucaucuacgcccugcgcagcaaggaccuccggcacgccuuccgcuccauguuccccagcugcgagggcaccgcccagccccuggacaacuccaugggggacagcgacugccugcacaagcacgcgaacaacgccgccuccgugcaccgggccgccgagagcugcaucaaguccaccgugaagaucgcgaaggucacgaugagcguguccaccgacaccagcgccgaggcccuguga

SEQ ID NO: 28473 - RNA, 1083 nt, Artificial Sequence
  derived and/or modified sequence opt1 from CNR2__Homo_sapiens__XP_011538931
auggaggagugcugggugaccgagaucgccaacggcagcaaggacgggcuggacuccaaccccaugaaggacuacaugauccucagcggcccgcagaagaccgccgucgcggugcugugcacgcugcucgggcugcuguccgcccucgagaacguggccguccuguaccugauccucagcucccaccagcugcgccggaagcccagcuaccuguucaucggcucccucgccggggccgacuuccuggcgagcgugguguucgccugcuccuucgucaacuuccacguguuccacggcguggacagcaaggccgucuuccugcucaagaucggcuccgugaccaugaccuucaccgccagcguggggucccugcugcucacggcgaucgaccgcuaccugugccugcgguacccgcccagcuacaaggcccuccugacccgcggccgggcccuggucacccucgggaucaugugggugcuguccgcccuggugagcuaccucccccugaugggcuggaccugcugcccccgccccugcuccgagcuguucccccucaucccgaacgacuaccugcugagcuggcuccuguucaucgccuuccuguucuccgggaucaucuacacguacggccacguccucuggaaggcgcaccagcacguggccagccugagcggccaccaggaccgccaggugcccgggauggcccggaugcggcuggacguccgccucgccaagacccugggccuggugcucgccgugcugcugaucugcugguuccccguccucgcgcugauggcccacucccuggccaccacccucagcgaccaggugaagaaggccuucgccuucugcuccaugcugugccugaucaacagcauggugaaccccgucaucuacgcgcugcgguccggggagauccgcagcuccgcccaccacugccucgcccacuggaagaagugcgugcggggccugggcagcgaggccaaggaggaggccccgcgcuccagcgucacggagaccgaggcggacgggaagaucacccccuggcccgacucccgggaccuggaccucagcgacugcuga

SEQ ID NO: 28474 - RNA, 387 nt, Artificial Sequence
  derived and/or modified sequence opt1 from CNRIP1__Homo_sapiens__NP_001104571
augggcgaccugcccgggcucgugcgccugagcaucgcccugcggauccagccgaacgacggccccgucuucuacaagguggacgggcagcgcuucggccagaaccggaccaucaagcuccugaccggguccagcuacaagguggaggucaagaucaagcccuccacgcuccagguggagaacaucagcaucggcggcgugcuggucccccuggagcugaaguccaaggagccggacggggaccgcgugguguacaccggcaccuacgacaccgagggggucacgcccaccaagagcggcgagcggcagcccauccagaucaccaugcccgagugccucgagcagcgcccgcaggagaucucccugaccuacgagugcgaggaguga

SEQ ID NO: 28475 - RNA, 1851 nt, Artificial Sequence
  derived and/or modified sequence opt1 from CNST__Homo_sapiens__NP_001132931
auggacgacagcgacacccccaccuacuaccugcagaucgagccgcaggacggcugccaccccggggacuccguggagcgcagcgucacgugccuccccuccgccagcgacgagaacgagaaccagcuggacggcgacgggcacgagcaccugaccuccagcgacuccgccaugggcaagccccaggugagcgagcaggacucccucaacaacaacgagagcugcacccuguccugcgagguggcggccggggagaaccugcagaacacccucugcgaggccagccgggacgagcaggccuuccugggcaaggacaagaagaucccgggcaagcgcagcccccgguccaagaaggggacggccaagaagaucccgcccggccuguucuccggggacaucgcgccccucaugcaggagaagguccugagcgccgugaccuacgccguggacgacgaggaggccgcggaggucaacgccaacgagcagcccgaggcccccaagcuggugcuccagucccuguucagccugauccgcggcgagguggagcagcucgacucccgggcccugccccugugccuccaccagaucgccgagagcuacuuccaggaggaggacuacgagaaggcgaugaaguucauccagcuggagcgccuguaccacgagcagcuccuggccaaccugagcgccauccaggagcagugggagaccaaguggaagaccguccagccgcacacggugaccgcccuccggaacuccgagaagggguucaacggcgaggacuucgagcgccugaccaagaucugcgccacccaccaggacccccugcucagcaagcacaagaucgcggccguggagaagucccaggagcggaagugcagcacgcagcugcuggucuccgaggaccccaaggagggcggggccaccaccaaggagagcgaguccaagaccugccucggcacggagagcuccaaggagagccagcacaccguggagccccugggguccagcccgugcugccaccagauggacgugcagaccgacucccccagccuguccgucaccgccggcaaggaccacauggaggagcuccugugcagcgccgaggcgacgcuggcccuccacacccaguccagcgagaccgccggcucccccagcgggcccgacagcuccgaggacgccugcgaggacgacagccgccugcagcuggcccagaccgaggcgugccaggacguggcccggaucgagggcaucgccgaggacccgaagguguuccucuccagcaaguccaagacggagccccugaucagccccgggugcgaccgcaucccgcccgcccugaucuccgagggcaaguacagccaggcgcagcggaaggagcuccgccugccccugcgggacgccuccgaggcccuccccaccgaccagcuggagaacaacgagcugaacgagcuccagcagcccgaccugaccgacagcgacgggaaguccccgcaggcccaggccgacagcgacggcuccgagaacguccugugcggcaacaaccagaucagcgaccuggggauccuccugcccgaggugugcauggcgcccgaggagaagggcgacaaggacgaccagcugaacaaggagaccgaggacuaccucaacucccugcuggaggggugccucaaggacacggaggacagccuguccuacgaggacaaccaggacgacgacagcgaccugcuccaggaccugagcccggaggaggccuccuacagccugcaggagaaccuccccuccgacgagagcugccugucccuggacgaccucgccaagcgcaucgagaucgccgaggugaaccagcgguga

SEQ ID NO: 28476 - RNA, 603 nt, Artificial Sequence
  derived and/or modified sequence opt1 from CNTF__Homo_sapiens__NP_000605
auggccuucaccgagcacagcccccugaccccgcaccgccgggaccucugcucccgcagcaucuggcuggcccggaagauccgcuccgaccugacggcgcucaccgagagcuacgugaagcaccagggccugaacaagaacaucaaccuggacuccgccgacgggaugcccgucgccagcaccgaccagugguccgagcucaccgaggccgagcggcugcaggagaaccugcaggccuaccgcacguuccacgugcuccuggcgcggcugcucgaggaccagcagguccacuucacccccaccgagggcgacuuccaccaggccauccacacccugcugcuccagguggccgccuucgcguaccagaucgaggagcugaugauccugcucgaguacaagaucccccgcaacgaggccgacgggaugccgaucaacgugggcgacgggggccuguucgagaagaagcuguggggccucaaggugcugcaggagcugagccaguggacgguccgguccauccacgaccuccgcuucaucagcucccaccagaccgggauccccgcccggggcagccacuacaucgccaacaacaagaagauguga

SEQ ID NO: 28477 - RNA, 1119 nt, Artificial Sequence
  derived and/or modified sequence opt1 from CNTFR__Homo_sapiens__NP_001193940
auggccgcccccgugccgugggcgugcugcgccguccuggccgccgccgcggccgugguguacgcccagcgccacagcccccaggaggcgccccacguccaguacgagcggcucggcuccgacgugacccugcccugcgggaccgccaacugggacgccgccgugacguggcgcgucaacggcaccgaccuggccccggaccuccugaacgggagccagcuggugcuccacggccuggagcuggggcacuccggccucuacgccugcuuccaccgggacagcuggcaccuccgccaccaggugcugcugcacgucggccugccgccccgggagcccgugcuguccugccgcagcaacaccuaccccaagggguucuacugcuccuggcaccuccccacccccacguacauccccaacaccuucaacgugaccguccugcacggcagcaagaucauggugugcgagaaggacccggcgcugaagaaccggugccacauccgcuacaugcaccucuucuccaccaucaaguacaaggugagcaucuccgucagcaacgcccuggggcacaacgccacggccaucaccuucgacgaguucaccaucgugaagcccgacccgcccgagaacguggucgcccggcccgugcccuccaacccccgccggcuggaggugaccuggcagacgcccagcaccuggccggaccccgaguccuucccccucaaguucuuccugcgcuaccggccccugauccucgaccaguggcagcacgucgagcugagcgacggcaccgcgcacaccaucacggacgccuacgccgggaaggaguacaucauccagguggccgccaaggacaacgagaucggcaccugguccgacuggagcguggcggcccacgccaccccguggaccgaggagccccgccaccugacgaccgaggcccaggccgcggagaccaccacguccaccaccagcagccucgccccgccgcccaccacgaagaucugcgaccccggcgagcugggguccggcgggggccccagcgcccccuuccuggucuccgugcccaucacccucgcccuggcggccgccgccgccaccgcgagcucccugcucaucuga

SEQ ID NO: 28478 - RNA, 1176 nt, Artificial Sequence
  derived and/or modified sequence opt1 from CNTLN__Homo_sapiens__NP_001107867
auggccgcccgcagcccgcccagcccccaccccuccccgcccgcgcggcagcugggcccccgcagcccccggguggggcgcggcgccgagguccacgccaugcgguccgaggccuccggguucgccggcgcggcccgcgaggugguggccgacgagagcgacaagaucugggucggggaggagggcuccggcgggcggcgcggccccgggggcgccgcgccggcccacgcgccccuccugagcgcccccauggggucccggcgccuggagggcaucagcguggaggaggccauggugacccggacccagcuccuggaggaggagcuguccagccucaaggaggagcuggcccugugccaggccgacaaggaguucgucuggucccucuggaagcgccuccaggugacgaaccccgaccugacccagguggucagccuggugguggagcgggagaagcagaaguccgaggccaaggaccgcaagguccuggagauccuccaggugaaggacgccaagauccaggaguucgagcagcgggagagcgugcugaagcaggagaucaacgaccuggucaagcgcaagaucgccguggacgaggagaacgcguuccugcggaaggaguucuccgaccucgagaagaaguucaaggacaagagccaggagaucaaggacaccaaggagugcgugcagaacaaggaggagcagaaccgccuggucaucaagaaccuggaggaggagaacaagaagcucuccacccggugcacggaccugcugaacgaccucgagaagcugcgcaagcaggaggcccaccuccggaaggagaaguacagcaccgacgccaagaucaagaccuucgaggacaaccugaucgaggcccgcaaggagguggaggugagccaguccaaguacaacgcccugagccugcagcucuccaacaagcagaccgagcugauccagaaggacauggacaucacgcugguccgcaaggagcuccaggagcugcagaaccuguacaagcagaacagcacccacaccgcgcagcaggccgagcucauccagcagcuccaggugcugaacauggacacccagaaggugcugcggaaccaggaggacguccacacggccgaguccaucagcuaccagaaggugugcuucuacuccgucaucaagauguga

SEQ ID NO: 28479 - RNA, 1884 nt, Artificial Sequence
  derived and/or modified sequence opt1 from CNTN1__Homo_sapiens__NP_001242993
augaagauguggcugcucgugagccaccuggucaucaucuccaucacgaccugccuggccgaguucaccugguaccgccgguacggccacggggugagcgaggaggacaagggcuucgggcccaucuucgaggagcagcccaucaacaccaucuaccccgaggagucccucgagggcaaggugagccugaacugccgcgcccgggcgucccccuuccccgucuacaaguggcgcaugaacaacggggacguggaccugaccagcgaccgguacuccauggugggcggcaaccucgucaucaacaacccggacaagcagaaggacgccgggaucuacuacugccuggccagcaacaacuacggcauggugcgcuccaccgaggccacgcugagcuucggguaccucgaccccuucccgcccgaggagcggcccgaggugcgcgucaaggagggcaaggggauggugcugcugugcgacccgcccuaccacuuccccgacgaccucuccuaccgguggcugcugaacgaguuccccguguucaucaccauggacaagcgccgguucgucagccagaccaacggcaaccucuacaucgccaacguggaggcguccgacaagggcaacuacagcugcuucguguccagccccuccaucaccaagagcgucuucuccaaguucaucccccugauccccaucccggagcgcacgaccaagcccuaccccgccgacaucguggugcaguucaaggacgucuacgcccugauggggcagaacgugacccucgagugcuucgcccugggcaaccccgugccggacauccgguggcgcaagguccuggagcccaugcccagcaccgcggagaucagcacguccggggccgugcucaagaucuucaacauccagcuggaggacgagggcaucuacgagugcgaggccgagaacauccggggcaaggacaagcaccaggcccgcaucuacgugcaggccuuccccgagugggucgagcacaucaacgacaccgagguggacaucgggagcgaccuguacuggccgugcgucgcgaccggcaagcccauccccaccauccgguggcucaagaacggguacgccuaccacaagggcgagcugcgccuguacgacgugacguucgagaacgccgggauguaccagugcaucgccgagaacaccuacggcgccaucuacgcgaacgccgagcucaagauccuggcccuggcccccaccuucgagaugaacccgaugaagaagaagauccucgccgcgaagggcgggcgggugaucaucgagugcaagcccaaggccgcccccaagccgaaguucuccuggagcaagggcaccgaguggcuggucaacuccagccgcauccugaucugggaggacgggucccucgagaucaacaacaucacgcggaacgacggcgggaucuacacgugcuucgccgagaacaaccgcggcaaggccaacagcaccggcacccuggugaucaccgaccccacccgcaucauccuggcgcccaucaacgccgacaucaccgugggggagaacgccaccaugcagugcgccgcguccuucgaccccgcccucgaccugacguucgucuggagcuucaacggcuacgugaucgacuucaacaaggagaacauccacuaccagcggaacuucaugcuggacuccaacggggagcuccugauccgcaacgcccagcugaagcacgccggccgguacacgugcaccgcccagaccaucguggacaacagcuccgcgagcgccgaccucgucgugcgcgggaagaaccggaagggcggcgagaagaacaugguggacuccuuccugccggucugcgccagccugccgcccaccugguga

SEQ ID NO: 28480 - RNA, 3123 nt, Artificial Sequence
  derived and/or modified sequence opt1 from CNTN2__Homo_sapiens__NP_005067
augggcaccgccacccgccggaagccccaccugcuccugguggccgcggucgcccuggugagcuccagcgccugguccagcgcccucgggucccagacgaccuucggcccgguguucgaggaccagccccugagcguccuguuccccgaggaguccaccgaggagcaggugcuccuggccugccgcgcgcgggccagccccccggccaccuaccgcuggaagaugaacgggacggagaugaagcuggagcccggcucccggcaccagcucguggggggcaaccuggucaucaugaaccccaccaaggcccaggacgcgggcguguaccagugccuggccagcaaccccguggggaccgucgugucccgcgaggccauccuccgguucggcuuccugcaggaguucagcaaggaggagcgcgacccggugaaggcccacgagggguggggcgucaugcugcccugcaacccccccgcccacuacccggggcucuccuaccgguggcugcugaacgaguuccccaacuucauccccaccgacggccgccacuucgugagccagacgaccggcaaccucuacaucgcgcggaccaacgccuccgaccuggggaacuacagcugccuggccaccucccacauggacuucagcacgaaguccguguucagcaaguucgcccagcucaaccuggccgcggaggacacccgccuguucgcccccagcaucaaggcccgguucccggccgagaccuacgcccucgucggccagcaggugacccuggagugcuucgcguucgggaaccccgugccccgcaucaaguggcggaaggucgacggcucccugagcccccaguggacgaccgccgagccgacccuccagauccccuccgugagcuucgaggacgagggcaccuacgagugcgaggccgagaacuccaaggggcgcgacacggugcagggccggaucaucguccaggcccagcccgaguggcugaaggugaucagcgacaccgaggccgacaucggguccaaccugcgcuggggcugcgcggccgccgggaagccccggccgaccgugcgcuggcuccggaacggcgagccccuggccagccagaaccgcgucgaggugcuggcgggcgaccuccgcuucuccaagcugagccuggaggacuccgggauguaccagugcgucgccgagaacaagcacggcaccaucuacgccagcgccgagcucgccgugcaggcgcuggcccccgacuuccggcugaaccccgugcgccggcucaucccggccgcccgcgggggcgagauccugauccccugccagccccgggccgcgccgaaggccgucgugcugugguccaaggggacggagauccucgugaacagcucccgcgucaccgugacccccgacggcacccugaucauccggaacaucagccgcuccgacgagggcaaguacacgugcuucgccgagaacuucauggggaaggccaacagcaccggcauccuguccgugcgggacgccaccaagaucacccucgcgcccagcagcgccgacaucaaccugggggacaaccugacgcuccagugccacgccucccacgaccccaccauggaccugaccuucaccuggacgcuggacgacuucccgaucgacuucgacaagcccggcgggcacuaccgccggaccaacgucaaggagaccaucggcgaccugaccauccucaacgcccagcugcgccacggcgggaaguacaccugcauggcgcagacggugguggacagcgccuccaaggaggccaccguccuggugcggggcccccccgggccgcccggcggcguggucgugcgcgacaucggggacaccaccauccagcucagcuggucccggggcuucgacaaccacagccccaucgccaaguacacgcugcaggcccgcacccccccggcggggaaguggaagcaggugcggaccaaccccgccaacaucgagggcaacgccgagaccgcccagguccuggggcucacgcccuggauggacuacgaguuccgcgugaucgccuccaacauccugggcaccggcgagcccagcgggccguccagcaagauccggacccgcgaggcggcccccuccguggcccccagcggccuguccgggggcgggggcgcccccggcgagcucaucgucaacuggaccccgaugagccgcgaguaccagaacggggacggcuucggguaccugcuguccuuccggcgccagggcagcacgcacuggcagaccgcccgggugcccggggcggacgcccaguacuucguguacuccaacgagagcguccgccccuacacccccuucgaggugaagauccggagcuacaaccgccggggcgacggcccggagucccucaccgcccugguguacagcgccgaggaggagccccgcgucgcgcccacgaaggugugggccaaggggguguccagcuccgagaugaacgucaccugggagccggugcagcaggacaugaacggcauccugcucggguacgagauccgguacuggaaggccggcgacaaggaggccgccgcggaccgcgugcggaccgccgggcuggacaccagcgcccgcgucuccggccugcaccccaacacgaaguaccacgugaccgugcgggccuacaaccgcgccggcaccgggcccgcgagccccuccgccaacgccaccacgaugaagccgcccccccggcgccccccgggcaacaucagcuggaccuucuccagcuccagccucuccaucaagugggaccccgucgugcccuuccggaacgagagcgccgugaccggguacaagaugcuguaccagaacgaccugcaccucacccccacgcugcaccugaccggcaagaacuggaucgagaucccgguccccgaggacaucggccacgcccucgugcagauccgcaccaccgggcccggcggggacggcauccccgcggaggugcacaucguccggaacgggggcacguccaugaugguggagaacauggccgugcgcccggccccccaccccggcaccgucaucagccacuccguggccaugcugauccugaucgggagccucgagcuguga

SEQ ID NO: 28481 - RNA, 3087 nt, Artificial Sequence
  derived and/or modified sequence opt1 from CNTN3__Homo_sapiens__NP_065923
augauguuccccuggaagcagcugauccuccugagcuucaucggcugccucgggggcgagcugcugcugcaggggccgguguucaucaaggagcccuccaacagcaucuuccccgucggcuccgaggacaagaagaucacccuccacugcgaggcccgcgggaaccccagcccgcacuaccgguggcagcugaacggcuccgacaucgacaugagcauggagcaccgcuacaagcugaacggcgggaaccucguggugaucaaccccaaccggaacugggacaccggcacguaccagugcuucgccaccaacucccuggggaccaucgucagccgcgaggcgaagcugcaguucgccuaccucgagaacuucaagaccaagaugcgguccacggugagcgugcgcgagggccagggggucgugcugcugugcgggcccccgccccacuccggcgagcucagcuacgccuggaucuucaacgaguaccccuccuucguggaggaggacagccggcgcuucgucucccaggagaccggccaccuguacaucagcaagguggagcccuccgacgugggcaacuacacgugcgucgugaccagcauggugacgaacgcccggguccuggggucccccaccccgcucgugcugcgcagcgacggcgugaugggcgaguacgagcccaagaucgagguccaguuccccgagacccugcccgccgcgaaggggagcaccgugaagcucgagugcuucgcccugggcaacccgaucccccagaucaacuggcggcgcuccgacgggcugcccuucagcuccaagaucaagcuccggaaguucagcggcgugcuggagauccccaacuuccagcaggaggacgccggguccuacgagugcaucgccgagaacagccgcggcaagaacgucgcgcggggccgccugacguacuacgccaagccgcacugggugcagcucaucaaggacguggagaucgccgucgaggacucccuguacugggagugccgggccagcgggaagcccaagcccuccuaccgcuggcugaagaacggcgccgcgcucgugcuggaggagcggacccagaucgagaacggggcccugaccaucagcaaccucuccgucaccgacagcggcauguuccagugcaucgccgagaacaagcacgggcugguguacuccagcgccgagcugaagguggucgccuccgcgcccgacuucagcaagaacccgaugaagaagcucguccagguccaggugggcucccuggugagccuggacugcaagccccgcgccagcccccgggcccucuccagcuggaagaagggcgacguguccgugcaggagcacgagcgcaucagccugcugaacgacgggggccucaagaucgccaacgugaccaaggccgacgcggggaccuacacgugcauggccgagaaccaguucggcaaggccaacgggaccacccaccugguggucaccgagcccacccgcaucacccuggccccguccaacauggacgugagcgugggcgaguccgucauccuccccugccaggugcagcacgacccccugcuggacaucaucuucacgugguacuucaacggcgcccucgcggacuucaagaaggacgggagccacuucgagaaggugggcggguccagcuccggcgaccugaugauccggaacauccagcugaagcacagcggcaaguacgucugcauggugcagaccgggguggacuccgucagcuccgccgccgaccugaucgugcgcggcagcccggggccgcccgagaacgugaaggucgacgagaucaccgacaccacggcccagcucuccuggaaggagggcaaggacaaccacagccccgugaucuccuacagcauccaggcgcggacccccuucagcgugggguggcagaccgucaccacggugcccgaggugaucgacggcaagacccacaccgccaccgucguggagcugaaccccuggguggaguacgaguuccgcgucguggccuccaacaagaucggcgggggcgagcccagccugccguccgagaaggugcggacggaggaggccguccccgaggugccgcccagcgaggugaacgggggcgggggcucccgcagcgagcucgucaucaccugggaccccgugcccgaggagcugcagaacggcgagggguucggcuacguggucgccuuccggccccugggggugaccaccuggauccagaccguggucacgucccccgacaccccgcgcuacguguuccggaacgagagcaucgugcccuacucccccuacgaggucaaggugggcguguacaacaacaagggggagggccccuucagcccggucaccaccguguucuccgcggaggaggagcccacggucgcccccagccagguguccgccaacagccucuccagcuccgagaucgaggugagcuggaacaccauccccuggaagcuguccaacggccaccuccugggguacgagguccgcuacuggaacggcgggggcaaggaggagagcagcuccaagaugaagguggccgggaacgagaccagcgcccggcugcgcggccugaaguccaaccucgcguacuacaccgccgugcgggccuacaacagcgccggcgccgggccguucuccgcgacggucaacgugaccaccaagaagaccccgcccagccagccgcccggcaacguggucuggaacgccacggacaccaaggugcugcugaacugggagcaggucaaggccauggagaacgaguccgaggugaccggguacaagguguucuaccgcaccagcucccagaacaacgugcagguccucaacacgaacaagaccagcgccgagcuggugcugcccaucaaggaggacuacaucaucgaggugaaggcgaccaccgacggcggcgacgggacguccagcgagcagauccggaucccccgcaucaccuccauggacgcccggggcagcaccuccgccaucagcaacguccaccccauguccagcuacaugcccaucguccucuuccugaucguguacgugcugugguga

SEQ ID NO: 28482 - RNA, 3081 nt, Artificial Sequence
  derived and/or modified sequence opt1 from CNTN4__Homo_sapiens__NP_001193884
augcgccugcccugggagcuccuggugcugcagagcuucauccucugccuggccgacgacuccacccugcacggccccaucuucauccaggagcccagccccgucauguucccccucgacuccgaggagaagaaggugaagcugaacugcgaggugaaggggaacccgaagccccacauccgguggaagcugaacggcaccgacgucgacacggggauggacuuccgcuacagcgugguggagggcucccuccugaucaacaaccccaacaagacccaggacgccgggaccuaccagugcaccgcgacgaacagcuucggcaccaucgucucccgggaggccaagcugcaguucgccuaccucgacaacuucaagacccgcacccggagcacgguguccgugcgccggggccaggggaugguccugcugugcgggcccccgccccacagcggcgagcucuccuacgccuggaucuucaacgaguaccccagcuaccaggacaaccgccgguucgugucccaggagaccggcaaccuguacaucgccaagguggagaaguccgacgucgggaacuacacgugcguggugaccaacacggucaccaaccacaaggugcuggggcccccgacgccccucauccugcgcaacgacggcgugaugggcgaguacgagcccaagaucgagguccaguuccccgagaccgugccgaccgcgaagggcgccaccgugaagcuggagugcuucgcccucgggaaccccguccccaccaucaucuggcggcgcgccgacggcaagcccaucgcgcggaaggcccgccggcacaaguccaacggcauccuggagaucccgaacuuccagcaggaggacgccgggcuguacgagugcguggccgagaacagccgcggcaagaacguggcccgggggcagcucaccuucuacgcgcagcccaacuggauccagaagaucaacgacauccacgucgccauggaggagaacguguucugggagugcaaggccaacggccgccccaagcccacguacaaguggcugaagaacggggagccgcugcucacccgggaccgcauccagaucgagcagggcacccugaacaucaccaucgucaaccuguccgacgccggcauguaccagugccucgccgagaacaagcacggggugaucuucagcaacgcggagcuguccgugaucgccgucggccccgacuucagccggacgcugcucaagcgcgugacccuggugaaggucgggggcgagguggugaucgagugcaagcccaaggccagccccaagccggucuacaccuggaagaaggggcgcgacauccugaaggagaacgagcggaucaccaucuccgaggacggcaaccuccgcaucaucaacgugaccaagagcgacgccggcuccuacacgugcaucgccaccaaccacuucgggaccgcgagcuccaccggcaaccugguggucaaggaccccacccgggugauggugcccccgagcuccauggacgucaccgugggggagagcaucgugcugcccugccaggucacccacgaccacucccucgacaucguguucacguggagcuucaacggccaccugaucgacuucgaccgcgacggggaccacuucgagcgggugggcggccaggacuccgccggggaccugaugauccgcaacauccagcucaagcacgccggcaaguacgucugcauggugcagaccagcguggaccggcuguccgccgccgcggaccugaucguccgcgggccgcccggcccgcccgaggccgugaccaucgacgagaucaccgacaccacggcccagcucagcuggcggcccggccccgacaaccacucccccaucaccauguacgugauccaggcccgcacccccuucagcgucggguggcaggcgguguccaccgugcccgagcugaucgacggcaagacguucaccgccaccgucguggggcugaaccccuggguggaguacgaguuccggaccgucgccgccaacgugaucggcaucggggagccgagccgccccuccgagaagcggcgcacggaggaggcccuccccgaggugacccccgcgaacgucagcggcggcgggggcagcaaguccgagcuggugaucaccugggagaccgugccggaggagcugcagaacgggcggggcuucggguacgucguggccuuccgccccuacggcaagaugaucuggaugcugacggugcucgccagcgccgacgccucccgguacgucuuccgcaacgagagcgugcaccccuucucccccuucgaggugaaggucggcguguucaacaacaagggggagggcccguucagccccaccaccguggucuacuccgcggaggaggagcccaccaagcccccggccagcaucuucgcccggucccugagcgccacggacaucgagguguucugggccagcccccuggagaagaaccgcgggcgcauccagggcuacgaggugaaguacuggcggcacgaggacaaggaggagaacgcgcgcaagauccggaccgucgggaaccagaccagcaccaagaucacgaaccucaagggcuccgugcuguaccaccuggccgucaaggccuacaacagcgccggcaccgggcccuccagcgcgaccgugaacgugaccacgcgcaagccgccgcccucccagccgcccggcaacaucaucuggaacagcagcgacuccaagaucauccucaacugggaccaggucaaggcccuggacaacgagagcgaggugaagggguacaaggugcuguaccgguggaaccgccaguccagcaccuccgucaucgagaccaacaagaccagcguggagcucucccugcccuucgacgaggacuacaucaucgagaucaagcccuucagcgacggcggggacggcuccagcuccgagcagauccggauccccaagaucagcaacgccuacgcccgcggcuccggggccagcacguccaacgcgugcacccugagcgccaucuccaccaucaugaucagccucaccgcccgguccagccuguga

SEQ ID NO: 28483 - RNA, 3303 nt, Artificial Sequence
  derived and/or modified sequence opt1 from CNTN5__Homo_sapiens__NP_001230199
auggccagcuccuggaagcugaugcucuuccugagcgugaccaugugccuguccgaguacagcaagucccuccccggccugagcaccuccuacgccgcgcugcuccgcaucaagaagagcuccagcuccagccuguucggguccaagacgcggccgcgcuacagcucccccagccugggcacccucuccgccagcucccccagcuggcugggggccgcccagaacuacuacagccccaucaaccuguaccacuccagcgacgccuucaagcaggacgaguccgucgacuacggcccgguguucgugcaggagcccgacgacaucaucuuccccaccgacagcgacgagaagaaggucgcgcucaacugcgaggugcgggggaaccccgugccguccuaccgcuggcugcggaacggcaccgagaucgaccuggagagcgacuaccgcuacucccucaucgacggcacguucaucaucagcaaccccuccgaggccaaggacagcgggcacuaccagugccuggccaccaacaccgucggcuccauccugagccgggaggccacccuccaguucgcguaccuggggaacuucuccggccgcacgcggagcgccguguccgugcgcgaggggcagggcgucgugcugaugugcagcccccccccgcacucccccgagaucaucuacagcuggguguucaacgaguuccccuccuucgucgccgaggacagccggcgcuucaucagccaggagaccggcaaccucuacaucuccaaggugcagaccagcgacgugggguccuacaucugccuggucaagaacaccgugacgaacgcccgggugcugagccccccgaccccccucacccugcgcaacgacggcgucaugggggaguacgagcccaagaucgaggugcacuuccccuucaccgugacggccgcgaagggcaccaccgucaagauggagugcuucgcccugggcaacccggugcccaccaucacguggaugaaggugaacggguacauccccuccaaggcccggcuccgcaagagccaggccguccuggagauccccaacgugcagcuggacgacgccggcaucuacgagugccgggcggagaacucccgcgggaagaacagcuuccggggccagcuccaggucuacaccuacccgcacuggguggagaagcugaacgacacccagcuggacuccgggagcccccuccgcugggagugcaaggccaccggcaagccccggcccacguaccgcuggcugaagaacggcgugccgcuguccccccagagccgcgucgagauggugaacggggugcucaugauccacaacgucaaccaguccgacgccggcauguaccagugccuggccgagaacaaguacggggccaucuacgcgagcgccgagcugaagauccucgccuccgcccccaccuucgcccugaaccagcugaagaagaccaucaucgugaccaaggaccaggagguggucaucgagugcaagccgcagggcagccccaagcccacgaucuccuggaagaagggggaccgggcggugcgcgagaacaagcggaucgccauccuccccgacggcagccugcgcauccugaacgccagcaaguccgacgagggcaaguacgugugccggggggagaacgucuucggcagcgccgagaucaucgcgucccucagcgugaaggagccgacccgcaucgagcugacccccaagcggaccgagcugacggugggggaguccaucguccucaacugcaaggccauccacgacgccagccuggacgugaccuucuacuggacccugaagggccagcccaucgacuucgaggaggaggggggccacuucgaguccauccgcgcccaggccagcuccgcggaccugaugauccggaacauccuccugaugcacgccggccgcuacgggugccgggugcagaccacggccgacagcgucuccgacgaggccgagcugcucgugcgcggccccccggggccccccggcaucgugaucgucgaggagaucaccgagagcaccgccacccuguccuggagccccgcggccgacaaccacuccccgaucagcuccuacaaccugcaggcccggagccccuucucccucggcuggcagaccgugaagacggugcccgagaucaucaccggggacauggagagcgccauggccgucgaccugaaccccuggguggaguacgaguuccgcguggucgcgaccaacccgaucggcaccggggaccccagcacgcccucccggaugauccgcaccaacgaggccgugcccaagaccgccccgaccaacgugagcggccgguccgggcgccggcacgagcuggucaucgccugggagcccgugagcgaggaguuccagaacggcgagggcuucggguacaucguggcguuccgccccaacggcacgcgcggguggaaggagaagauggucaccuccagcgaggccuccaaguucaucuaccgggacgagagcgugcccccgcucacccccuucgaggugaaggucggcguguacaacaacaagggggacggccccuucucccagaucguggucaucugcagcgccgagggcgagccguccgccgcccccaccgacgugaaggcgacgagcguguccgucagcgagauccugguggccuggaagcacaucaaggagucccuggggcgcccccagggcuucgaggugggguacuggaaggacauggagcaggaggacaccgccgagaccgucaagacccggggcaacgagagcuucgugauccucacggggcuggagggcaacacccuguaccacuucaccgugcgcgccuacaacggcgccggguacggccccccguccagcgaggucuccgcgaccacgaagaagagcccccccagccaggcccccuccaaccuccggugggagcagcaggggagccaggugucccugggcugggagccggugaucccccuggccaacgagagcgaggucgugggguacaaggucuucuaccgccaggagggccacuccaacagccaggugaucgagacccagaagcuccaggccguggucccccugcccgacgccggcguguacaucaucgaggugcgggcguacuccgaggggggcgacgggaccgccagcucccagauccgcgucccgagcuacuccggcggcaagaucaccagcgcccaguccacgcugcacagccucuccaccagcuccagcuccgugacccugcugcucgcccugaugauccccagcaccagcugguga

SEQ ID NO: 28484 - RNA, 2871 nt, Artificial Sequence
  derived and/or modified sequence opt1 from CNTN6__Homo_sapiens__NP_001276010
augagcuaccacuaccgccuggacggcgggucccucgccaucaacagcccccacaccgaccaggacaucggcauguaccagugccuggccaccaaccugcucgggacgauccugucccggaaggcgaagcugcaguucgccuacaucgaggacuucgagaccaagacccgcagcaccguguccguccgggagggccaggggguggugcuccugugcgggcccccgccccacuucggcgaccugagcuacgccuggacguucaacgacaacccccucuacguccaggaggacaaccgccgguucgugucccaggagaccggcaaccuguacaucgccaagguggagcccagcgacgucggcaacuacacgugcuucaucaccaacaaggaggcccagcgcuccgugcaggggccgcccacgccccuggugcagcggaccgacggcgucaugggggaguacgagcccaagaucgaggugcgcuuccccgagaccauccaggcggccaaggacagcuccgugaagcucgagugcuucgcccugggcaaccccguccccgacaucagcuggcggcgccuggacggcuccccgcuccccgggaaggugaaguacagcaagucccaggccauccuggagauccccaacuuccagcaggaggacgagggcuucuacgagugcaucgcgagcaaccugcgggggcgcaaccucgccaagggccagcugaucuucuacgcgcccccggagugggagcagaagauccagaacacccaccuguccaucuacgacaaccuccugugggagugcaaggccagcggcaagcccaaccccugguacaccuggcugaagaacggggagcggcucaaccccgaggagcgcauccagaucgagaacggcacccugaucaucaccaugcugaacguguccgacagcggggucuaccagugcgccgccgagaacaaguaccagaucaucuacgccaacgccgagcuccgggugcuggccagcgccccggacuucuccaagagccccgugaagaagaaguccuucguccaggugggcggggacaucgugaucggcugcaagcccaacgcguucccccgcgccgccaucagcuggaagcggggcaccgagacgcugcgccaguccaagcggaucuuccuccuggaggacgggagccugaagaucuacaacaucacccgcuccgacgccggcagcuacacgugcaucgccaccaaccaguucgggaccgcgaagaacaccggcucccucaucgucaaggagcggaccgugaucaccgugccgcccagcaagauggacgucacggugggggaguccaucguccugcccugccaggugagccacgaccccuccaucgagguggucuucgugugguucuucaacggcgacgugaucgaccugaagaagggcgucgcccacuucgagcgcaucgggggcgagagcgugggggaccucaugauccgcaacauccagcugcaccacuccggcaaguaccugugcaccgugcagaccacccucgagagccuguccgccgucgccgacaucaucgugcgggggccgcccgggcccccggaggacgugcaggucgaggacaucagcuccacgaccagccagcugagcuggcgcgccggccccgacaacaacucccccauccagaucuucaccauccagacccggacgcccuucagcgugggcuggcaggcgguggccaccgucccggagauccucaacggcaagaccuacaacgccaccgugguggggcugucccccugggucgaguacgaguuccgcgugguggccggcaacagcaucggcaucggggagcccuccgagcccagcgagcugcuccggacgaaggcguccgucccggugguggcccccgucaacauccacggcgggggcgggagccgcuccgagcuggugaucaccugggagagcauccccgaggagcugcagaacggcgagggcuucggguacaucaucauguuccggcccgugggcuccaccaccuggagcaaggagaaggucuccagcguggaguccagccgcuucguguaccggaacgaguccaucaucccgcucagccccuucgaggucaagguggggguguacaacaacgagggcgaggggagccuguccaccgucacgaucguguacagcggcgaggacgagccccagcuggcgccccgcggcaccucccugcagagcuucuccgccagcgagauggagguguccuggaacgccaucgccuggaaccggaacaccgggcgcguccucggcuacgaggugcuguacuggaccgacgacagcaaggaguccaugaucgggaagauccgggugagcggcaacgucacgaccaagaacaucaccgggcugaaggccaacaccaucuacuucgccuccgugcgcgccuacaacacggccggcaccggcccgagcuccccgcccgugaacgucaccaccaagaaguccccgcccagccagccgcccgcgaacaucgccuggaagcucacgaacagcaagcugugccugaacugggagcacgugaagaccauggagaacgaguccgaggugcucggguacaagauccuguaccggcagaaccgccagagcaagacccacauccuggagaccaacaacacguccgccgagcuccugguccccuucgaggaggacuaccugaucgagauccggaccgugagcgacggcggggacggcagcuccagcgaggagauccgcauccccaagauguccagccucuccagccgggggauccaguuccuggagcccuccacccacuuccugagcaucgugaucgucaucuuccacugcuucgccauccagccccucaucuga

SEQ ID NO: 28485 - RNA, 4155 nt, Artificial Sequence
  derived and/or modified sequence opt1 from CNTNAP1__Homo_sapiens__NP_003623
augaugcaccuccgccucuucugcauccugcuggccgccgugagcggcgcggagggguggggcuacuacgggugcgacgaggagcucgucggcccccuguacgcccggucccugggggccagcuccuacuacagccuccugaccgccccgcgcuucgcccggcugcacggcaucuccggcuggagcccccgcaucggggaccccaaccccuggcuccagaucgaccugaugaagaagcaccggauccgcgcgguggccacccagggcuccuucaacagcugggacugggugacgcgguacaugcugcucuacggggaccgcgucgacuccuggaccccguucuaccagcggggccacaacagcaccuucuucgggaacgugaacgaguccgccgugguccgccacgaccugcacuuccacuucaccgcccgguacauccgcaucgugccccuggcguggaacccccggggcaagaucggccuccgccuggggcuguacggcugccccuacaaggccgacauccucuacuucgacggggacgacgccaucagcuaccgguucccgcgcggcgugucccggagccugugggacgucuucgccuucuccuucaagacggaggagaaggacggccugcuccugcacgccgagggggcgcagggcgacuacgugacccuggagcucgagggggcccaccuccugcugcacaugagccugggcuccagccccauccagccccgccccgggcacaccaccguguccgccggcggcguccugaacgaccagcacuggcacuacgugcggguggaccgcuucgggcgggacgucaacuucacgcucgacggcuacgugcagcgcuucauccugaacggggacuucgagcgccugaaccucgacaccgagauguucaucggcgggcuggugggcgccgcccggaagaaccuggcguaccgccacaacuuccggggcugcaucgagaacgucaucuucaaccgcgugaacaucgccgaccucgccgugcggcgccacagccggaucaccuucgaggggaaggucgccuuccgcugccuggacccggugccccaccccaucaacuucggcgggccccacaacuucgugcaggucccgggcuucccccggcgcgggcggcuggccgugagcuuccgcuuccggaccugggaccucacgggccugcugcuguucucccgccugggcgacgggcugggccacgucgagcucacccugagcgagggccaggugaacguguccaucgcgcagagcgggcggaagaagcugcaguucgccgccggcuaccgccucaacgacggguucuggcacgaggucaacuucguggcccaggagaaccacgccgugaucuccaucgacgacgucgagggcgcggaggugcgggugagcuacccccugcugauccgcaccgggaccuccuacuucuucggcgggugccccaagccggccagccggugggacugccacuccaaccagacggccuuccacggcugcauggagcugcucaaggucgacggccagcuggugaaccugacccucguggaggggcgccgccugggcuucuacgccgagguccuguucgacacgugcgggaucaccgaccggugcagccccaacaugugcgagcacgacggccgcugcuaccaguccugggacgacuucaucugcuacugcgagcucacgggguacaagggcgagaccugccacacgccccuguacaaggagagcugcgaggcguaccggcuguccggcaagaccagcgggaacuucaccaucgaccccgacggcuccgggccgcucaagcccuucgugguguacugcgacauccgcgagaaccgggccuggaccgucgugcgccacgaccggcuguggaccacccgcgugacgggcagcuccauggagcggcccuuccugggggccauccaguacuggaacgccagcugggaggaggucuccgcccucgcgaacgccagccagcacugcgagcaguggaucgaguucagcugcuacaacucccgccugcugaacaccgccggcggcuaccccuacagcuucuggaucgggcggaacgaggagcagcacuucuacuggggcgggucccagccgggcauccagcgcugcgccugcgggcucgaccggagcugcguggaccccgcccuguacugcaacugcgacgcggaccagccccaguggcgcaccgacaagggccugcucaccuucguggaccaccucccggucacccagguggugaucggcgacaccaaccgguccaccagcgaggcccaguucuuccugcgcccccugcggugcuacggggaccgcaacuccuggaacaccaucagcuuccacacgggcgccgcccugcgguucccgcccauccgcgccaaccacucccuggacgucagcuucuacuuccggaccuccgcgcccagcgggguguuccucgagaacaugggcggccccuacugccaguggcgccgccccuacgugcgggucgagcugaacaccucccgcgacgugguguucgccuucgacgucgggaacggcgacgagaaccugaccgugcacagcgacgacuucgaguucaacgacgacgaguggcaccucgugcgggccgagaucaacgucaagcaggcccgccugcggguggaccaccgccccugggugcugcggccgaugccccuccagaccuacaucuggauggaguacgaccagccccuguacgucggguccgcggagcugaagcgccggcccuucgugggcugccuccgcgccaugcggcugaacggggugacgcugaaccucgagggccgcgccaacgccagcgagggcaccuccccgaacugcaccgggcacugcgcccacccccggcugcccugcuuccacggcgggcgcugcgucgagcgguacagcuacuacacgugcgacugcgaccugaccgcguucgacggccccuacugcaaccacgacaucgggggcuucuucgagccgggcaccuggaugcgcuacaaccuccagagcgcccugcgguccgccgcccgcgaguucagccacaugcugucccggcccgugcccggguacgagcccggcuacaucccgggguacgacacccccggcuacgugcccggguaccacggccccggcuaccgccucccggacuacccccgccccgggcggccgguccccggcuaccgcgggcccguguacaacgugaccggcgaggaggucagcuucuccuucagcacguccagcgcccccgcggugcugcuguacguguccagcuucguccgggacuacauggccgugcucaucaaggacgacggcacccugcagcugcgcuaccagcucgggaccuccccguacguguaccagcugaccacgcggcccgucaccgacggccagccccacagcaucaacaucacccgcguguaccggaaccuguucauccaggucgacuacuucccccucaccgagcagaaguucucccugcugguggacagccagcucgacuccccgaaggcccuguaccuggggcgcgugauggagacgggcgucaucgaccccgagauccagcgguacaacacccccggguucagcggcugccucuccggcgugcgcuucaacaacguggcgccccugaagacccacuuccggaccccgcgccccaugacggccgagcuggccgaggcccuccggguccagggggagcugagcgaguccaacugcggcgccaugccccgccuggugagcgaggugcccccggagcucgaccccugguaccugccgcccgacuuccccuacuaccacgacgaggggugggucgccauccugcucggcuuccugguggcguuccugcuccuggggcuggugggcaugcucguccuguucuaccugcagaaccaccgguacaagggcagcuaccacaccaacgagcccaaggccgcccacgaguaccaccccggguccaagcccccgcuccccaccagcggccccgcccaggugcccaccccgacggccgcgcccaaccaggcccccgccuccgccccggcccccgcgcccacccccgccccggcccccgggccccgcgaccagaaccugccccagauccuggaggagagccgguccgaguga

SEQ ID NO: 28486 - RNA, 3996 nt, Artificial Sequence
  derived and/or modified sequence opt1 from CNTNAP2__Homo_sapiens__NP_054860
augcaggccgcgccccgcgccggcugcggggccgcccugcuccuguggaucgugagcuccugccugugccgggccuggaccgccccgagcaccucccagaagugcgacgagccccucgucagcggccugccccacguggcguucuccagcuccagcuccaucagcggguccuacagccccggcuacgccaagaucaacaagcgcgggggcgccggcgggugguccccgagcgacuccgaccacuaccaguggcuccagguggacuucggcaaccggaagcagaucagcgccaucgcgacgcaggggcgcuacuccagcuccgacugggucacccaguaccggaugcucuacagcgacaccggccgcaacuggaagcccuaccaccaggacgggaacaucugggccuuccccggcaacaucaacagcgacggcguggugcggcacgagcugcagcaccccaucaucgcccgcuacguccggaucgugccgcuggacuggaacggggagggccgcaucgggcuccggaucgagguguacggcugcuccuacugggccgacgucaucaacuucgacggccacguggugcugcccuaccgcuuccggaacaagaagaugaagacccugaaggacgucaucgcccucaacuucaagacgagcgaguccgagggggugauccugcacggcgaggggcagcagggcgacuacaucacccuggagcucaagaaggcgaagcuggugcugagccucaaccugggguccaaccagcugggccccaucuacggccacaccagcgucaugaccgggucccuccuggacgaccaccacuggcacagcguggugaucgagcgccagggccgguccaucaaccugacgcucgaccgcagcaugcagcacuuccggaccaacggggaguucgacuaccuggaccuggacuacgagaucaccuucggcgggauccccuucuccggcaagccgagcuccagcucccgcaagaacuucaagggcugcauggagagcaucaacuacaacggggucaacaucaccgaccucgcccggcgcaagaagcuggagcccuccaacgugggcaaccugagcuucuccugcguggagcccuacacgguccccguguucuucaacgccaccagcuaccucgaggugccggggcggcugaaccaggaccuguucagcgucuccuuccaguuccgcaccuggaaccccaacggccuccugguguucagccacuucgccgacaaccuggggaacgucgagaucgaccucaccgaguccaaggugggcgugcacaucaacaucacgcagaccaagaugagccagaucgacaucuccagcggcuccgggcugaacgacggccaguggcacgagguccgcuuccuggccaaggagaacuucgcgauccucaccaucgacggggacgaggccagcgccgugcggaccaacagcccccuccaggugaagacgggcgagaaguacuucuucggcggguuccugaaccagaugaacaacuccucccacagcguccugcagcccuccuuccagggcugcaugcagcugauccagguggacgaccagcuggugaaccucuacgaggucgcccagcgcaagccggggagcuucgccaacguguccaucgacaugugcgcgaucaucgaccggugcgugcccaaccacugcgagcacggcgggaagugcagccagaccugggacuccuucaagugcacgugcgacgagaccggcuacagcggcgcgaccugccacaacagcaucuacgagcccuccugcgaggccuacaagcaccuggggcagaccagcaacuacuacuggaucgaccccgacggcuccgggccgcugggcccccucaaggucuacugcaacaugaccgaggacaagguguggaccaucgugagccacgaccugcagaugcagacgcccgucgugggguacaaccccgagaaguacuccgugacccagcuggucuacagcgccuccauggaccagaucagcgccaucaccgacuccgccgaguacugcgagcaguacgugagcuacuucugcaagaugucccgccugcucaacaccccggacggcagccccuacacguggugggugggcaaggccaacgagaagcacuacuacuggggcggguccgggcccggcauccagaagugcgccugcgggaucgagcggaacugcaccgacccgaaguacuacugcaacugcgacgccgacuacaagcaguggcgcaaggacgcgggcuuccugagcuacaaggaccaccuccccgucucccaggugguggucggcgacaccgaccggcaggggagcgaggccaagcuguccgugggcccccugcgcugccagggggaccggaacuacuggaacgccgccagcuuccccaacccguccagcuaccugcacuucagcaccuuccagggcgagacguccgccgacaucagcuucuacuucaagacccucacccccuggggcguguuccuggagaacauggggaaggaggacuucaucaagcuggagcucaaguccgcgaccgaggucagcuucuccuucgacgugggcaacgggcccguggagaucgucgugcgcagccccaccccgcugaacgacgaccaguggcaccgggugacggccgagcgcaacgucaagcaggccucccuccagguggaccggcugccccagcagauccgcaaggcccccaccgagggccacacccggcuggagcuguacagccagcuguucgucgggggcgccggcgggcagcagggcuuccuggggugcauccgcucccugcggaugaacggcgugacccucgaccuggaggagcgcgcgaaggugacgagcggguucaucuccggcugcagcggccacugcaccuccuacgggaccaacugcgagaacggcgggaagugccuggagcgguaccacggcuacagcugcgacugcuccaacaccgccuacgacgggacguucugcaacaaggacgugggcgccuucuucgaggagggcauguggcuccgcuacaacuuccaggcccccgccaccaacgcgcgcgacagcuccagccgggucgacaacgccccggaccagcagaacucccaccccgaccuggcccaggaggagauccgcuucagcuucagcaccaccaaggcccccugcauccugcucuacaucuccagcuucacgaccgacuuccuggcggugcuggugaagcccaccgggucccuccagauccgguacaaccugggcgggacccgcgagccguacaacaucgacgucgaccaccggaacauggccaacggccagccccacagcgugaacaucacgcgccacgagaagaccaucuuccugaagcucgaccacuaccccuccgugagcuaccaccuccccuccagcuccgacacccuguucaacagcccgaagucccuguuccuggggaaggucaucgagaccggcaagaucgaccaggagauccacaaguacaacacgcccggcuucaccgggugccugagccgggugcaguucaaccagaucgcgccccucaaggccgcccugcgccagaccaacgccuccgcccacgugcacauccagggcgagcuggucgagagcaacugcggggccagcccccucacccuguccccgauguccagcgccacggaccccuggcaccuggaccaccucgacuccgccagcgcggacuuccccuacaacccgggccagggccaggccauccggaacggggugaaccgcaacagcgccaucaucggcggggugaucgccgucgugaucuucaccauccugugcacccuggucuuccucauccgguacauguuccgccacaagggcaccuaccacacgaacgaggccaagggggcggaguccgccgagagcgccgacgccgcgaucaugaacaacgaccccaacuucaccgagaccaucgacgaguccaagaaggaguggcugaucuga

SEQ ID NO: 28487 - RNA, 3867 nt, Artificial Sequence
  derived and/or modified sequence opt1 from CNTNAP3__Homo_sapiens__NP_387504
auggccagcguggccugggcgguccugaaggugcuccugcugcuccccacccagaccugguccccggugggcgccgggaacccgcccgacugcgacgcgccccuggccagcgcccugccccgcuccagcuucuccagcuccagcgagcucuccagcucccacggccccggguucagccggcugaaccgccgggacggcgccgggggcuggacgccccuggucuccaacaaguaccaguggcuccagaucgaccugggcgagcgcauggaggugaccgccguggccacccagggcggguacgggagcuccgacugggucaccagcuaccugcucauguucuccgacggcgggcggaacuggaagcaguaccgccgggaggagagcaucuggggcuuccccggcaacacgaacgccgacuccguggugcacuaccgccugcagccgcccuucgaggcgcgguuccugcgcuuccucccccuggccuggaacccccgggggcgcaucggcaugcggaucgaggucuacgggugcgccuacaagagcgaggugguguacuucgacggccagagcgcccugcucuaccgccuggacaagaagccgcugaagcccauccgggacgucaucucccucaaguucaaggccaugcagagcaacggcauccugcugcaccgcgaggggcagcacggcaaccacaucacccucgagcugaucaaggggaagcugguguucuuccucaacuccggcaacgcgaagcugcccagcaccaucgcccccgugacccugacgcucgggucccugcuggacgaccagcacuggcacagcguccucaucgagcugcuggacacccaggugaacuucaccguggacaagcacacccaccacuuccaggccaagggcgacuccagcuaccucgaccugaacuucgagaucuccuucggcgggaucccgacgcccggccggagccgcgccuuccggcgcaaguccuuccacgggugccuggagaaccucuacuacaacggcgucgacgugaccgagcuggccaagaagcacaagccccagauccugaugauggggaacgugagcuucuccugcccccagccgcagaccguccccgugaccuuccucagcucccggagcuaccuggcgcugcccggcaacuccggcgaggacaaggugagcgucacguuccaguuccgcaccuggaaccgcgccgggcaccuccuguucggcgagcugcggcgcggguccggcagcuucguccucuuccugaaggacgggaagcugaagcugagccucuuccagcccggccaguccccgcggaacgugaccgccggcgccgggcugaacgacggccaguggcacagcguguccuucagcgccaaguggucccacaugaacguggucguggacgacgacaccgcggugcagccccuggucgccgugcucaucgacagcggggacacguacuacuucggcggcugccuggacaacuccagcggguccggcugcaagagcccccucgggggcuuccaggggugccugcgccugaucaccaucggcgacaaggccguggaccccauccugguccagcagggcgcccucggguccuuccgggaccugcagaucgacagcugcggcaucaccgaccgcugccugccguccuacugcgagcacgggggcgagugcagccaguccugggacaccuucagcugcgacugccucgggacgggcuacaccggcgagaccugccacuccagccuguacgagcagagcugcgaggcccacaagcaccgggggaaccccuccggccuguacuacaucgacgcggacgggagcggcccccucgggccguuccugguguacugcaacaugaccgccgacgccgccuggacggugguccagcacggcggccccgacgcggugacccugcgcggggcccccuccggccacccccggagcgccguguccuucgccuacgccgcgggggccggccagcuccgcagcgccgucaaccuggccgagcggugcgagcagcgccuggcccuccggugcgggaccgcgcgccggccggacucccgcgacggcacgccccugagcuggugggugggccggaccaacgagacccacaccuccuggggcgggagccugcccgacgcccagaagugcacgugcgggcucgagggcaacugcaucgacucccaguacuacugcaacugcgacgccggccgcaacgaguggaccagcgacaccaucgugcugucccagaaggagcaccuccccgucacccagaucgugaugaccgacgccgggcggccgcacagcgaggccgcguacacccugggcccccugcugugccgcggggaccaguccuucuggaacagcgccuccuucaacacggagaccagcuaccuccacuuccccgccuuccacggcgagcugaccgccgacgugugcuucuucuucaagaccacggucuccagcgggguguucauggagaaccugggcaucaccgacuucauccgcaucgagcuccgggcgcccaccgaggugaccuucagcuucgacgucggcaacgggccgugcgaggugacggugcagucccccacccccuucaacgacaaccaguggcaccacguccgcgccgagcggaacgugaagggcgccagccuccagguggaccagcugccccagaagaugcagccggcccccgccgacgggcacguccgccugcagcugaacucccagcuguucaucggcgggaccgcgacccggcagcgcggcuuccucggcugcauccggagccugcagcugaacgggguggcccucgaccuggaggagcgcgccacggugacccccggcgucgagcccgggugcgccggccacugcuccaccuacgggcaccugugccggaacggcggccgcugccgggagaagcgccgcggggugaccugcgacugcgccuucagcgcguacgacggcccguucugcuccaacgagaucagcgccuacuucgccacgggguccagcaugaccuaccacuuccaggagcacuacacccucuccgagaacagcuccagccugguguccagccugcaccgggacgucacccucacgcgggagaugaucacccuguccuuccgcaccacccggacgcccagccugcuccuguacguguccagcuucuacgaggaguaccugagcgugauccucgccaacaacggcucccugcagauccgcuacaagcuggaccggcaccagaaccccgacgccuucaccuucgacuucaagaacauggcggacggccagcuccaccaggucaagaucaaccgcgaggaggccguggugauggucgaggugaaccagagcaccaagaagcaggucauccuguccagcgggaccgaguucaacgccgugaagucccugauccucggcaaggugcuggaggccgcgggggccgaccccgacacgcggcgcgccgccaccagcggcuucaccgggugccuguccgccgugcgcuucggccgggcggccccgcucaaggccgcccugcgccccagcggccccucccgggucaccgugcgcgggcacguggccccgauggcgcggugcgccgccggcgccgccagcgggucccccgcgcgcgagcuggcgccccggcucgccggcggggccggccgcagcggccccgccgacgagggggagccgcuggucaacgccgaccggcgcgacuccgccgugaucggcggggucaucgccguggugaucuucauccugcucugcaucacggccaucgcgauccggaucuaccagcagcgcaagcugcggaaggagaacgagagcaaggucuccaagaaggaggagugcuga

SEQ ID NO: 28488 - RNA, 3927 nt, Artificial Sequence
  derived and/or modified sequence opt1 from CNTNAP4__Homo_sapiens__NP_207837
augggcagcgugaccggggccguccugaagacccuccugcugcucuccacgcagaacuggaaccgcguggaggccggcaacagcuacgacugcgacgacccccugguguccgcgcugccgcaggccagcuucuccagcuccagcgagcucuccagcucccacgggcccggcuucgcccggcugaaccgccgggacggggccggcggcuggagcccccuggucuccaacaaguaccaguggcuccagaucgaccugggggagcgcauggaggugaccgccguggcgacccagggcggguacggcagcuccaacugggucaccagcuaccugcucauguucuccgacagcggguggaacuggaagcaguaccggcaggaggacuccaucuggggcuucagcggcaacgccaacgccgacagcgugguguacuaccgccugcagcccuccaucaaggcccgguuccugcgcuucaucccgcucgaguggaaccccaaggggcggaucggcaugcgcaucgaggucuucgggugcgcguaccggagcgaggugguggaccuggacggcaaguccagccugcucuaccgcuucgaccagaagucccugagccccaucaaggacaucaucucccugaaguucaagacgaugcagagcgacggcauccuccugcaccgggaggggcccaacggcgaccacaucacccugcagcuccgccgggcccgccuguuccugcucaucaacuccggggaggccaagcugccgagcaccuccacccuggucaaccucacgcugggcagccugcucgacgaccagcacuggcacuccgugcugauccagcggcuggggaagcaggucaacuucaccguggacgagcaccgccaccacuuccacgcccggggcgaguucaaccucaugaaccuggacuacgagaucagcuucggcgggauccccgcccccggcaaguccgugagcuucccccaccgcaacuuccacgggugccuggagaaccucuacuacaacggcguggacaucaucgaccuggcgaagcagcagaagccgcagaucaucgccauggggaacgucuccuucagcugcucccagccccagagcaugcccgugaccuuccugagcucccggagcuaccucgcccugcccgacuucuccggcgaggaggaggugagcgccaccuuccaguuccgcacguggaacaaggccggccugcuccuguucuccgagcugcagcucaucagcgggggcauccugcuguuccuguccgacgggaagcucaagagcaaccuguaccagccgggcaagcugcccuccgacaucaccgcgggggucgagcucaacgacggccaguggcacagcgugucccugagcgccaagaagaaccaccuguccguggccgucgacggccagauggccagcgccgcgccccuccuggggcccgagcagaucuacuccggcgggaccuacuacuucggcggcugcccggacaagagcuucggguccaagugcaagagcccccugggcggguuccagggcugcaugcgccucaucagcaucuccgggaagguggucgaccugaucagcgugcagcagggcucccugggcaacuucagcgaccuccagaucgacuccugcgggaucagcgaccggugccugcccaacuacugcgagcacggcggggagugcucccagagcugguccaccuuccacugcaacugcacgaacaccggcuaccgcggggcgaccugccacaacagcaucuacgagcaguccugcgaggccuacaagcaccggggcaacaccagcggcuucuacuacaucgacuccgacgggagcggcccccuggagccguuccuccuguacugcaacaugacggagaccgccuggaccaucauccagcacaacggguccgaccugacccgcgugcggaacacgaaccccgagaaccccuacgccggcuucuucgaguacgucgccagcauggagcagcuccaggccaccaucaaccgcgccgagcacugcgagcaggaguucaccuacuacugcaagaagucccggcuggugaacaagcaggacgggacgccccugagcuggugggugggccgcaccaacgagacccagaccuacuggggcggguccagcccggaccuccagaagugcacgugcggccuggaggggaacugcaucgacagccaguacuacugcaacugcgacgccgaccggaacgaguggaccaacgacaccggccugcucgcguacaaggagcaccuccccgucaccaagaucgugaucaccgacacggggcgccugcacuccgaggccgccuacaagcugggcccccugcugugccagggcgaccggagcuucuggaacuccgccagcuucgacaccgaggccuccuaccuccacuucccgaccuuccacggggagcugagcgcggacguguccuucuucuucaagaccaccgccagcuccggcgucuuccuggagaaccucgggaucgccgacuucauccgcaucgagcugcggagccccacgguggugaccuucuccuucgacgucggcaacggccccuucgagaucagcgugcagucccccacccacuucaacgacaaccaguggcaccacgugcgcgucgagcggaacaugaaggaggccagccuccagguggaccagcugaccccgaagacgcagcccgcccccgcggacgggcacgugcugcugcagcucaacucccagcuguucgucggcgggaccgccacccgccagcggggcuuccuggggugcauccgcagccuccagcugaacggcaugacccuggaccucgaggagcgggcccaggugacgcccgaggugcagccgggcugccgcgggcacugcuccagcuacggcaagcugugccgcaacgggggcaagugccgggagcgccccaucggguucuucugcgacugcaccuucuccgccuacaccggccccuucugcagcaacgagaucagcgccuacuucggcuccgggagcuccgucaucuacaacuuccaggagaacuaccugcucagcaagaacuccagcucccacgcggccagcuuccacggcgacaugaagcugucccgggagaugaucaaguucagcuuccgcaccacgcggacccccucccugcuccuguucgugagcuccuucuacaaggaguaccugagcgugaucaucgccaagaacgggucccuccagauccgcuacaagcugaacaaguaccaggagccggacgucgugaacuucgacuucaagaacauggccgacggccagcugcaccacaucaugaucaaccgggaggaggggguggucuucaucgagaucgacgacaaccgccggcgccaggugcaccucagcuccggcaccgaguucagcgcggugaagucccugguccugggccggauccucgagcacagcgacguggaccaggacaccgcccuggccggggcccagggcuucacggggugccugagcgccgugcagcucucccacgucgcgccccugaaggccgcccugcaccccagccaccccgacccggugaccgugaccggccacgucaccgaguccagcugcauggcccagcccggcacggacgccaccucccgcgagcggacccacagcuucgcggaccacuccgggaccaucgacgaccgcgagccccucgccaacgccaucaagagcgacuccgccgugaucggcgggcugaucgccguggucaucuucauccugcucugcaucacggcgaucgccgugcggaucuaccagcagaagcgccuguacaagcggagcgaggccaagcgcuccgagaacguggacagcgccgaggcgguccugaaguccgagcucaacauccagaacgccgugaacgagaaccagaaggaguacuucuucuga

SEQ ID NO: 28489 - RNA, 3921 nt, Artificial Sequence
  derived and/or modified sequence opt1 from CNTNAP5__Homo_sapiens__NP_570129
auggacagccugccccgccucaccuccgugcugacccuccucuucagcggccuguggcaccuggggcucacggccaccaacuacaacugcgacgacccgcuggccucccugcucagccccauggcguucuccagcuccagcgaccugaccggcacccacucccccgcccagcugaacuggcgggucgggacgggcggguggagccccgccgacuccaacgcccagcaguggcuccagauggaccugggcaaccgcguggagaucaccgccguggcgacccagggccgguacgggagcuccgacugggucaccagcuacucccugauguucagcgacacgggccgcaacuggaagcaguacaagcaggaggacuccaucuggaccuucgccgggaacaugaacgccgacagcguggugcaccacaagcuccugcacuccguccgggcccgcuucgugcgguucgugccgcuggaguggaaccccagcggcaagaucgggaugcgcgucgagguguacggcugcagcuacaaguccgacguggcggacuucgacggccggagcucccuccuguaccgcuucaaccagaagcugaugagcacccucaaggacgucaucucccugaaguucaagagcaugcagggggacggcgugcuguuccacggggagggccagcggggcgaccacaucacccucgagcugcagaaggggcgccuggcccuccaccugaaccugggcgacuccaaggcccggcucagcuccagccugcccuccgccacgcuggggagccuccuggacgaccagcacuggcacuccgugcugaucgagcgcgucggcaagcaggucaacuucaccguggacaagcacacccagcacuuccggaccaagggggagacggacgcccucgacaucgacuacgagcugagcuucggcggcauccccgucccggggaagcccggcaccuuccugaagaagaacuuccacgggugcaucgagaaccucuacuacaacggcgugaacaucaucgaccuggcgaagcgccggaagcaccagaucuacaccgggaacgugaccuucuccugcagcgagccccagaucguccccaucacguucgugaacuccagcggcuccuaccugcuccugccgggcacgccccagaucgacgggcugagcgugagcuuccaguuccgcaccuggaacaaggacggccuccugcuguccaccgagcucagcgagggguccggcacccugcugcugagccucgagggcgggauccugcggcuggucauccagaagaugaccgagcgcguggccgagauccugaccggcuccaaccugaacgacgggcuguggcacagcguguccaucaacgcccggcgcaaccgcaucacccucacgcuggacgacgaggccgccccgcccgcgcccgacagcaccugggugcagaucuacuccggcaacagcuacuacuucgggggcugccccgacaaccugaccgacucccagugccucaaccccaucaaggccuuccagggcugcaugcggcugaucuucaucgacaaccagcccaaggaccugaucagcgugcagcaggggucccucggcaacuucagcgaccugcacaucgaccugugcuccaucaaggaccgcugccucccgaacuacugcgagcacgggggcagcugcucccagagcuggaccacguucuacugcaacugcagcgacaccuccuacaccggggcgaccugccacaacagcaucuacgagcaguccugcgaggucuaccggcaccagggcaacacggccggcuucuucuacaucgacagcgacggguccggcccccuggggccccuccagguguacugcaacaucaccgaggacaagaucuggaccagcgugcagcacaacaacaccgagcugacccgcguccggggcgccaaccccgagaagccguacgccauggcccuggacuacgggggcuccauggagcagcuggaggccgugaucgacggcagcgagcacugcgagcaggagguggccuaccacugccgccggucccgccuccugaacacgcccgacgggacccccuucaccugguggaucggccggagcaacgagcgccaccccuacuggggcggguccccgcccgggguccagcagugcgagugcggccuggacgagagcugccucgacauccagcacuucugcaacugcgacgccgacaaggacgaguggaccaacgacacgggcuuccuguccuucaaggaccaccuccccgugacccagaucgugaucaccgacaccgaccggagcaacuccgaggcggccuggcgcaucgggccgcugcggugcuacggcgaccgccgguucuggaacgccgucagcuucuacacggaggccuccuaccugcacuuccccaccuuccacgcggaguucagcgccgacaucuccuucuucuucaagaccaccgcccugagcgggguguuccucgagaaccugggcaucaaggacuucauccgccuggagaucagcucccccagcgagaucacguucgccaucgacguggggaacggccccgucgagcucguggugcaguccccgagccugcugaacgacaaccaguggcacuacguccgggccgagcgcaaccucaaggagaccucccuccagguggacaaccugccccggagcacccgcgagaccuccgaggagggccacuuccgccugcagcugaacagccagcuguucgucgggggcacguccagccggcagaagggguuccucggcugcauccgcucccugcaccugaacggccagaagauggaccucgaggagcgggcgaaggugaccagcggggugcgccccggcugccccgggcacugcuccagcuacggcuccaucugccacaacgggggcaagugcguggagaagcacaacggcuaccugugcgacugcaccaacagcccguacgaggggcccuucugcaagaaggaggucuccgccguguucgaggccggcaccagcgugacguacauguuccaggagcccuaccccgucaccaagaacaucucccugagcagcuccgccaucuacaccgacagcgccccguccaaggagaacaucgcgcucagcuucgugaccacgcaggcccccucccugcuccuguucaucaacagcuccagccaggacuucguggucgugcugcugugcaagaacgggucccuccaggugcgguaccaccugaacaaggaggagacccacgucuucaccaucgacgccgacaacuucgccaaccgccggaugcaccaccugaagaucaaccgcgagggccgggagcucaccauccagauggaccagcagcugcgccugagcuacaacuucucccccgagguggaguuccgggugauccgcagccucacgcuggggaaggucaccgagaaccugggccucgacuccgagguggccaaggcgaacgccaugggcuucgccgggugcaugagcuccgugcaguacaaccacaucgcgccccugaaggccgcccugcggcacgccaccgucgccccggugaccgugcacggcacgcucaccgagagcuccugcggguucauggucgacagcgacgugaacgccgugaccaccguccacuccagcagcgaccccuucggcaagacggacgagcgcgagccccugaccaacgcggugcgguccgacagcgccgugaucgggggcgucaucgccguggugaucuucaucaucuucugcaucaucggcaucaugacccgcuuccuguaccagcacaagcagucccaccggaccagccagaugaaggagaaggaguaccccgagaaccucgacuccagcuuccgcaacgagaucgaccugcagaacaccgucuccgagugcaagcgggaguacuucaucuga

SEQ ID NO: 28490 - RNA, 6978 nt, Artificial Sequence
  derived and/or modified sequence opt1 from CNTRL__Homo_sapiens__XP_005251736
augaagaagggcagccagcagaagaucuucagcaaggccaagauccccagcagcagccacagccccauccccagcuccaugagcaacaugcgcucccggagccugagcccccugaucgggagcgagacccugcccuuccacuccggcgggcaguggugcgagcaggucgagaucgccgacgagaacaacaugcugcuggacuaccaggaccacaagggcgcggacagccacgccggggugcgcuacaucaccgaggcccugaucaagaagcugacgaagcaggacaaccuggcccugaucaagucccugaaccucagccuguccaaggacggcggcaagaaguucaaguacaucgagaaccuggagaagugcgugaagcuggaggugcugaaccugagcuacaaccugaucgggaagaucgagaagcuggacaagcugcugaagcugcgggagcugaaccuguccuacaacaagaucagcaagaucgagggcaucgagaacaugugcaaccugcagaagcugaaccuggccgggaacgagaucgagcacauccccgucuggcugggcaagaagcugaagucccugcgcgugcugaaccugaaggggaacaagaucuccagccuccaggacaucuccaagcugaagccccugcaggaccucaucagccugauccugguggagaaccccgucgugacccucccccacuaccugcaguucaccaucuuccaccuccggucccucgagagccuggagggccagcccgugaccacgcaggaccgccaggaggcguucgagcgguucucccuggaggaggucgagcgccucgagcgggaccuggagaagaagaugaucgagaccgaggagcucaagagcaagcagacccgcuuccucgaggagaucaagaaccaggacaagcugaacaagucccugaaggaggaggccaugcuccagaagcagagcugcgaggagcugaaguccgaccugaacaccaagaacgagcugcucaagcagaagacgaucgagcugacccgggccugccagaagcaguacgagcuggagcaggagcucgccuucuacaagaucgacgcgaaguucgagccccugaacuacuaccccagcgaguacgccgagaucgacaaggcccccgacgaguccccguacaucggcaagagccgcuacaagcggaacauguucgccaccgaguccuacaucaucgacagcgcccaggcggugcagaucaagaagauggagcccgacgagcagcugcgcaacgaccacaugaaccuccgggggcacacgccccuggacacgcagcuggaggacaaggagaagaagaucuccgccgcccagacccgccucagcgagcugcacgacgagaucgagaaggccgagcagcagauccugcgggccaccgaggaguucaagcagcucgaggaggcgauccagcugaagaagaucuccgaggccggcaaggaccugcucuacaagcagcugagcgggcgccugcagcucgugaacaagcugcggcaggaggcccuggaccucgagcugcagauggagaagcagaagcaggagaucgccggcaagcagaaggagaucaaggaccugcagaucgccaucgacagccucgacuccaaggaccccaagcacagccacaugaaggcgcagaaguccggcaaggagcagcagcuggacaucaugaacaagcaguaccagcagcuggagagccgccucgacgagauccugucccggaucgccaaggagaccgaggagaucaaggaccuggaggagcagcucacggaggggcagaucgccgccaacgaggcccugaagaaggaccuggagggcgucaucagcgggcuccaggaguaccugggcaccaucaaggggcaggcgacccaggcccagaacgagugccgcaagcugcgcgacgagaaggagacccuccugcagcggcugacggagguggagcaggagcgcgaccagcucgagaucguggccauggacgccgagaacaugcggaaggagcuggcggagcuggaguccgcccuccaggagcagcacgaggucaacgccagccugcagcagacccagggcgaccuguccgccuacgaggccgagcucgaggcgcgccugaaccugcgggacgccgaggccaaccagcucaaggaggagcuggagaaggugacccgccugacccagcucgagcagagcgcccugcaggccgagcuggagaaggagcggcaggcgcucaagaacgcccugggcaaggcccaguucuccgaggagaaggagcaggagaacagcgagcugcacgccaagcucaagcaccuccaggacgacaacaaccugcucaagcagcagcugaaggacuuccagaaccaccugaaccacguggucgacgggcucgugcgcccggaggagguggccgcgcgggucgacgagcugcgccggaagcugaagcucggcacgggggagaugaacauccacucccccagcgacgugcugggcaagucccuggccgaccuccagaagcaguucagcgagauccuggcccgcuccaagugggagcgggacgaggcccaggugcgcgagcggaagcugcaggaggagauggcgcuccagcaggagaagcuggccaccgggcaggaggaguuccgccaggccugcgagcgggcccuggaggcccgcaugaacuucgacaagcggcagcacgaggcgcgcauccagcagauggagaacgagauccacuaccuccaggagaaccucaagagcauggaggagauccagggccugaccgaccuccagcugcaggaggccgacgaggagaaggagcgcauccuggcccagcuccgggagcuggagaagaagaagaagcuggaggacgccaagagccaggagcaggucuucggccucgacaaggagcugaagaagcugaagaaggccguggcgaccuccgacaagcucgccacggccgagcugaccaucgccaaggaccagcucaagagccuccacgggaccgucaugaagaucaaccaggagcgcgccgaggagcugcaggaggcggagcgguucucccgcaaggccgcccaggccgcgcgggaccugacccgcgccgaggccgagaucgagcuccugcagaaccugcugcggcagaagggcgagcaguuccgccucgagauggagaagacgggggugggcaccggggccaacagccaggugcuggagaucgagaagcugaacgagaccauggagcggcagcgcaccgagaucgcccggcuccagaacguccuggaccugacgggcuccgacaacaagggcggguucgagaacgugcucgaggagaucgcggagcugcgccgggaggugagcuaccagaacgacuacaucuccagcauggccgaccccuucaagcgccggggcuacugguacuucaugcccccgccgcccuccagcaaggucuccagccacuccagccaggccaccaaggacuccggggugggccugaaguacagcgccuccacccccgugcgcaagccgcggcccggccagcaggacgggaaggagggcagccagccgccgcccgccuccggguacugggucuacagccccauccgcagcggccuccacaagcuguuccccucccgggacgcggacagcgggggcgacucccaggaggagagcgagcuggacgaccaggaggagccgcccuucgugcccccgcccggcuacaugauguacaccgugcuccccgacgggucccccgucccccagggcauggcccuguacgcgcccccgccgccccugccgaacaacagccgcccccucacccccgggacggugguguacggcccgccgcccgccggggcccccauggucuacggcccgcccccgcccaacuucuccauccccuucauccccaugggcgugcugcacugcaacgugcccgagcaccacaaccuggagaacgaggucagccggcucgaggacaucaugcagcaccugaaguccaagaagcgcgaggagcgcuggaugcgggccagcaagcgccaguccgagaaggagauggaggagcugcaccacaacaucgacgaccuccugcaggagaagaagucccuggagugcgagguggaggagcuccaccggaccgugcagaagcgccagcagcagaaggacuucaucgacgggaacgucgagucccugaugaccgagcuggagaucgagaagucccucaagcaccacgaggacaucguggacgagaucgagugcaucgagaagacccugcugaagcggcgcuccgagcuccgggaggccgaccgccugcuggccgaggccgagagcgagcucuccugcacgaaggagaagaccaagaacgccguggagaaguucaccgacgcgaagcggagccugcugcagaccgaguccgacgccgaggagcucgagcgccgggcccaggagacggccgucaaccuggugaaggcggaccagcagcugcgcagccuccaggccgacgccaaggaccuggagcagcacaagaucaagcaggaggagauccugaaggagaucaacaagaucguggccgccaaggacagcgacuuccagugccucuccaagaagaaggagaagcugaccgaggagcugcagaagcuccagaaggacaucgagauggcggagcggaacgaggaccaccaccuccagguccugaaggagagcgaggugcuccugcaggccaagcgcgccgagcuggagaagcucaagucccaggugaccagccagcagcaggagauggccguccuggaccggcagcugggccacaagaaggaggagcuccaccuccugcagggguccauggugcaggccaaggcggaccuccaggaggcccugcgccugggcgagaccgaggugacggagaagugcaaccacauccgggaggucaagagccuccuggaggagcuguccuuccagaagggggagcucaacgugcagaucagcgagcgcaagacccagcugacccugaucaagcaggagaucgagaaggaggaggagaaccuccaggugguccugcggcagauguccaagcacaagaccgagcugaagaacauccucgacaugcugcagcuggagaaccacgagcuccagggccugaagcugcagcacgaccagcgcgugagcgagcucgagaagacccagguggccguccuggaggagaagcuggagcucgagaaccugcagcagaucucccagcagcagaagggcgagaucgaguggcagaagcagcugcucgagcgcgacaagcgggagaucgagcgcaugaccgccgagagccgggcccugcaguccugcguggagugccugagcaaggagaaggaggaccuccaggagaagugcgacaucugggagaagaagcuggcgcagaccaagcgcgugcuggccgccgccgaggagaacuccaagauggagcagagcaaccucgagaagcuggagcugaacguccggaagcuccagcaggagcuggaccagcugaaccgcgacaagcucucccugcacaacgacaucagcgcgaugcagcagcagcugcaggagaagcgggaggccgugaacucccuccaggaggagcuggccaacgugcaggaccaccugaaccucgccaagcaggaccugcugcacaccacgaagcaccaggacguccugcucagcgagcagacccgccugcagaaggacaucagcgagugggccaaccgguucgaggacugccagaaggaggaggagaccaagcagcagcagcuccaggugcuccagaacgagaucgaggagaacaagcugaagcuggugcagcaggagaugauguuccagcgccuccagaaggagcgggaguccgaggagagcaagcuggagaccuccaaggucacgcugaaggagcagcagcaccagcucgagaaggagcugaccgaccagaaguccaagcuggaccaggugcucuccaaggugcuggcggccgaggagcgcguccggacccugcaggaggaggagcgcuggugcgagagccucgagaagacccugucccagacgaagcggcagcugagcgagcgcgagcagcagcucguggagaaguccggggagcugcuggcccuccagaaggaggccgacagcaugcgggccgacuucucccugcugcgcaaccaguuccucaccgagcggaagaaggcggagaagcaggucgccagccugaaggaggcccugaagauccagcgcucccagcucgagaagaaccugcuggagcagaagcaggagaacagcugcauccagaaggagauggccaccaucgagcucguggcccaggacaaccacgagcgggcgcgccgccugaugaaggagcugaaccagaugcaguacgaguacaccgagcucaagaagcagauggccaaccagaaggaccuggagcggcgccagauggagaucuccgacgccaugcggacgcucaagagcgaggugaaggacgagauccgcaccucccucaagaaccugaaccaguuccugcccgagcuccccgccgaccuggaggcgauccuggagcggaacgagaaccucgagggcgagcuggagagccugaaggagaaccuccccuucaccaugaacgaggggcccuucgaggagaagcugaacuucucccagguccacaucauggacgagcacuggcgcggcgaggcccugcgggagaagcuccgccaccgggaggaccgccugaaggcccagcugcggcacugcaugagcaagcaggccgaggugcucaucaaggggaagcgccagaccgagggcacgcugcacagccugcggcgccagguggacgcccucggcgagcuggucaccuccaccagcgcggacuccgccagcucccccagccugucccagcucgagagcucccugaccgaggacagccagcuggggcagaaccaggagaagaacgccuccgcccgguga

SEQ ID NO: 28491 - RNA, 2778 nt, Artificial Sequence
  derived and/or modified sequence opt1 from CNTROB__Homo_sapiens__NP_001032221
auggccaccagcgccgacucccccagcuccccgcugggcgcggaggaccuccugagcgacuccagcgagccgcccgggcugaaccagguguccagcgaggucaccucccagcucuacgccagccugcgccugucccggcaggccgaggccacggcccgcgcgcagcucuaccugcccagcaccuccccgccccacgagggccuggacggguucgcccaggagcucagccggucccugagcgugggccuggagaagaaccucaagaagaaggacggguccaagcacaucuucgagauggagagcgugcgcggccagcugcagaccaugcugcagaccucccgggacacggccuaccgcgacccccucauccccggcgccgggagcgagcggcgcgaggaggacagcuucgacuccgacagcaccgcgacccugcugaacacccggccgcuccaggaccugucccccagcuccagcgcccaggcccuggaggagcuguucccccgcuacacgucccugcggcccggcccgccccugaacccgcccgacuuccaggggcuccgcgacgcccuggacagcgagcacacccggcgcaagcacugcgagcggcacauccagucccugcagacccgcguccucgagcugcagcagcagcuggccguggcgguggccgccgaccggaagaaggacaccaugaucgagcagcucgacaagacgcuggcccgcgucguggagggcuggaaccggcacgaggccgagcgcaccgaggugcugcgggggcuccaggaggagcaccaggcggccgagcugacccgcagcaagcagcaggagaccgucacgcgccuggagcagucccucagcgaggccauggaggcccugaaccgggagcaggaguccgcccgccugcagcagcgggagcgcgagacccucgaggaggagcggcaggcgcucacccugcgccucgaggccgagcagcagcggugcugcgugcugcaggaggagcgcgacgccgcccgggccggccagcugagcgagcaccgcgagcucgagacccugcgggcggcccuggaggaggagcgccagacgugggcccagcaggagcaccagcucaaggagcacuaccaggcccugcaggaggagucccaggcgcagcuggagcgggagaaggagaagucccagcgcgaggcccaggccgccugggagacccagcaccagcuggcccucgugcagagcgagguccggcgccuggagggcgagcuggacaccgcgcggcgcgagcgggacgcccuccagcuggagaugagccuggugcaggcccgcuacgagucccagcgcauccagcucgagagcgagcuggccgugcagcuggagcagcgggucaccgagcgccucgcccaggcgcaggagagcucccugcggcaggccgccagccugcgcgagcaccaccggaagcagcuccaggaccuguccgggcagcaccagcaggagcuggccagccagcucgcccaguucaagguggagauggcggagcgcgaggagcggcagcagcaggucgccgaggacuacgagcugcgccuggcccgggagcaggcccgcgugugcgagcuccaguccggcaaccagcagcuggaggagcagcggguggagcugguggagcgccuccaggcgaugcugcaggcccacugggacgaggccaaccagcugcucagcacgacccugcccccgcccaacccgcccgccccgcccgccgggcccuccagccccggcccccaggagcccgagaaggaggagcggcgcgucuggaccaugccgcccauggcgguggcccugaagcccgugcuccagcagucccgggaggcccgcgacgagcugcccggcgccccgcccguccugugcagcuccagcuccgaccucagccugcugcucgggcccuccuuccagagccagcacuccuuccagccccuggagcccaagcccgaccugaccagcagcacggccggcgcguucuccgcccucggggccuuccaccccgaccaccgggccgagcgccccuuccccgaggaggaccccggccccgacggggagggccugcugaagcagggccugcccccggcccagcucgaggggcugaagaacuuccuccaccagcugcuggagaccgugccccagaacaacgagaaccccagcgucgaccuccugcccccgaaguccggcccccugaccgugcccagcugggaggaggcgccccaggugccgcggaucccgccgcccguccacaagaccaaggugccccucgccauggccuccagccuguuccgcgugcccgagccgcccuccagccacucccaggggagcggccccuccagcgggucccccgagcggggcggcgacgggcugacguucccccgccagcucauggaggucagccagcugcugcgccucuaccaggcccggggcuggggcgcgcugcccgccgaggaccugcuccuguaccugaagcgccucgagcacuccggguacaagcccgggcggaaggaggagggcuucagcggcuggaagcuggacuacggggagugguccggcaccgacgggcgcggcgacaacgugccccggcgcaacaccgacagccggcugggcgagaucccccgcaaggagaucccgucccaggccgugccccggcgccucgccaccgcccccaagacggagaagcccccggcgcggaagaaguccgggcaccccgcccccagcagcaugcgcagccggggcggggucuggcgcuga

SEQ ID NO: 28492 - RNA, 441 nt, Artificial Sequence
  derived and/or modified sequence opt1 from COA1__Homo_sapiens__NP_060694
augauguggcagaaguacgccggcagccgccgguccaugccccugggggcccgcauccucuuccacggcguguucuacgccgggggcuucgcgaucgucuacuaccugauccagaaguuccacagccgggcccuguacuacaagcucgccguggagcagcugcagucccacccggaggcccaggaggcgcuggggccgccccucaacauccacuaccugaagcugaucgaccgcgagaacuucguggacaucgucgacgccaagcucaagauccccgugagcggcuccaagagcgagggccugcuguacgugcacuccagccgcgggggccccuuccagcgguggcaccucgacgaggucuuccuggagcugaaggacgggcagcagauccccguguucaagcucuccggcgagaacggggacgaggugaagaaggaguga

SEQ ID NO: 28493 - RNA, 225 nt, Artificial Sequence
  derived and/or modified sequence opt1 from COA5__Homo_sapiens__NP_001008216
augcccaaguacuacgaggacaagccgcagggcggggccugcgccggccugaaggaggaccucggggcgugccugcugcagagcgacugcgugguccaggagggcaagagcccccgccagugccucaaggagggguacugcaacucccugaaguacgccuucuucgagugcaagcgguccgugcuggacaaccgcgcccgguuccgcggccggaagggcuacuga

SEQ ID NO: 28494 - RNA, 1782 nt, Artificial Sequence
  derived and/or modified sequence opt1 from COASY__Homo_sapiens__NP_001035997
augcgcaccccgcggcugcgcgcccagccccggggcgccguguaccaggcgcccagcccgccgcccgcccccgucgggcucggcuccauggccguguuccgcagcgggcugcuggugcucaccacgccccuggccucccuggcgccccggcucgccagcauccugaccuccgccgcccgccuggucaaccacacccucuacgugcaccuccagcccggcaugagccuggaggggcccgcccagccccaguccagccccgugcaggcgaccuucgagguccuggacuucaucacgcaccuguacgccggcgccgacgugcaccggcaccuggacgugcgcauccuccugaccaacauccggaccaaguccaccuuccugccgccccuccccacgagcguccagaaccuggcccacccgcccgagguggugcugaccgacuuccagacccucgacggcucccaguacaaccccgucaagcagcagcuggugcgcuacgccaccagcugcuacuccugcugcccccggcuggcgagcgugcuccuguacuccgacuacgggaucggcgagguccccguggagccgcuggacgugccccuccccagcacgauccgccccgccuccccggucgccgggagccccaagcagcccgugcggggcuacuaccgcggggccgugggcggcaccuucgaccggcugcacaacgcccacaagguccugcucuccguggcgugcauccuggcccaggagcagcugguggucgggguggccgacaaggaccuccucaagagcaagcugcugcccgagcugcugcagccguacaccgagcgcgucgagcaccucagcgaguuccugguggacaucaagcccucccugaccuucgacgugaucccccuccuggacccguacggccccgccgggagcgaccccucccuggaguuccucgucgugagcgaggagacguaccggggcggcauggccaucaaccgcuuccggcuggagaacgaccuggaggagcucgcgcuguaccagauccagcugcugaaggaccuccgccacaccgagaacgaggaggacaagguguccagcuccagcuuccggcagcgcaugcuggggaaccugcuccggcccccguacgagcgccccgagcugccgaccugccuguacgucaucggccucaccgggaucuccggcagcgggaaguccagcaucgcccagcgccugaagggccugggcgccuucgugaucgacuccgaccaccucgggcaccgggccuacgcccccggcgggcccgcguaccagcccguggucgaggccuucggcacggacauccugcacaaggacgggaucaucaaccgcaaggugcugggcagccggguguucggcaacaagaagcagcucaagauccugaccgacaucauguggcccaucaucgccaagcuggcccgcgaggagauggaccgggcggucgccgaggggaagcgcgugugcgugaucgacgccgccguccuccuggaggccggcuggcagaaccuggugcacgagguguggaccgcggucauccccgagaccgaggccgugcggcgcaucguggagcgggacgggcucuccgaggccgccgcccagagccgccugcagucccagaugagcggccagcagcuggucgagcagucccacguggugcucagcacgcugugggagccgcacaucacccagcggcaggucgagaaggcgugggcccugcuccagaagcgcauccccaagacccaccaggcccuggacuga

SEQ ID NO: 28495 - RNA, 1140 nt, Artificial Sequence
  derived and/or modified sequence opt1 from COBL__Homo_sapiens__NP_001274367
auggacgccccccgcgccagcgcggccaagccgcccaccggccggaagaugaaggcccgcgccccccccccgcccgggaaggccgcgacccugcacgugcacuccgaccagaagcccccccacgacggcgcccucgggagccagcagaaccugguccggaugaaggaggcccugcgcgccuccacgauggacgugaccgugguccucccgagcggccuggagaagcgguccgugcugaacgggagccacgcgaugauggaccuccugguggagcugugccuccagaaccaccugaaccccucccaccacgcccuggagauccgcagcuccgagacccagcagccccucagcuucaagcccaacacccugaucggcacgcugaacguccacaccguguuccucaaggagaaggugccggaggagaaggucaagcccggcccccccaaggugccggagaaguccgugcggcuggucgugaacuaccugcgcacccagaaggccgugguccgggugagccccgaggugccccuccagaacauccugcccgucaucugcgccaagugcgagguguccccggagcacgugguccugcuccgcgacaacaucgccggggaggagcuggagcugagcaagucccucaacgagcugggcaucaaggagcuguacgcgugggacaaccggcgcgagaccuuccggaagagcucccucgggaacgacgagacggacaaggagaagaagaaguuccugggcuucuucaaggugaacaagcgcagcaacuccaaggggugccugaccacccccaacagccccagcaugcacucccggagccucacccugggccccucccugagccucggcuccaucagcgggguguccgucaagagcgagaugaagaagcgccgggccccgcccccccccggcuccgggccgcccgugcaggacaaggccagcgagaaggucucccugggcagccagaucgaccugcagaagaagaagcgccgggcccccgccccgccccccccccagccgcccccccccuccccgcucauccccaaccgcacggaggacaaggaggagaaccggaagagcaccaugguguacugcugcgcguccuuccccacccaggccaagcgcuucuga

SEQ ID NO: 28496 - RNA, 3702 nt, Artificial Sequence
  derived and/or modified sequence opt1 from COBLL1__Homo_sapiens__NP_001265387
augcccccgagcuggagcccccugaugugcggccgcgccgccgaggcggccgccuccucccggacccccgggcgcgagaugggccaggccgugacccggcgccucggggccggcgcgcgggccgcgccccgccgggccauggacgggcgcacgccgcggccccaggacgcccccgcccgccgggagaucgccggcagcuggcgcaagcccaaggccaaggccccgcugccgcccgcggagaccaaguacaccgacgucuccagcgccgccgacuccguggagagcaccgccuucaucauggagcagaaggagaacaugaucgacaaggacguggagcuguccgucgugcuccccggcgacaucaucaagagcacgaccgugcacggguccaagcccaugauggaccugcugaucuuccucugcgcccaguaccaccugaaccccagcuccuacaccaucgaccugcucagcgcggagcagaaccacaucaaguucaagcccaacacccccaucggcaugcuggaggucgagaaggugauccugaagccgaagaugcucgacaagaagaagcccacgcccaucauccccgagaagaccgugcgggucgugaucaacuucaagaagacccagaagaccaucgugcgcgucuccccgcacgccagccugcaggagcuggcccccaucaucugcuccaagugcgaguucgacccccuccacacgcugcugcucaaggacuaccagagccaggagccccuggaccugaccaagucccucaacgaccuggggcugcgggagcucuacgccauggacgugaaccgcgccaccagcgugaccgucuucagcaaguccagccugcaggaguccugccagaucagccagaaccuggacaucaugaaggagaaggagaacaagggcuucuucuccuucuuccagcggagcaagaagaagcgcgaccagacggcguccgccccggccacgccccucgugaacaagcaccggcccaccuucacccgcagcaacaccaucuccaagcccuacaucagcaacacccugccguccgacgcccccaagaagcggcgcgcgccccugccgcccaugcccgccagccaguccgugccccaggaccucgcccacauccaggagcgcccggccagcugcaucgucaaguccaugagcguggacgagaccgacaagucccccugcgaggccgggcgggugcgcgcgggcagccugcagcuguccagcaugagcgccggcaacuccagccuccggcgcaccaagcggaaggcccccagcccgcccuccaagaucccgccccaccaguccgacgagaacagccgcgucacggcccugcagcccguggacggggugccgcccgacuccgccagcgaggcgaacucccccgaggagcugagcucccccgagaccuuccaccccggccucagcucccaggagcagugcaccgcccccaagcugauggaggagaccagcgucuucgagugccccgggacgcccgaggccgccaucaccucccugaccagcggcaucuccagcgacuacagccucgaggagaucgacgagaaggaggagcuguccgaggugccgaaggucgaggccgagaacaucagccccaagucccaggacauccccuucgugagcaccgacaucaucaacacgcugaagaacgaccccgacuccgcgcucggcaacgggagcggcgaguucucccagaacagcauggaggagaagcaggagaccaaguccaccgacgggcaggagccgcacagcguggucuacgacaccuccaacggcaagaaggugguggacagcauccggaaccugaagucccuggggcccaaccaggagaacgucgugcagaacgagaucaucguguaccccgagaacacggaggacaacaugaagaacggcgucaagaagaccgagaucaacguggagggcguggccaagaacaacaacaucgacauggaggucgagcgcccgagcaacuccgaggcccacgagaccgacaccgccaucagcuacaaggagaaccaccucgccgcguccagcgugcccgaccagaagcugaaccagcccuccgccgagaagaccaaggacgccgccauccagacgacccccagcugcaacagcuucgacgggaagcaccaggaccacaaccuguccgacagcaagguggaggagugcguccagaccuccaacaacaacaucagcacccagcacuccugccucagcucccaggacagcgugaacacgucccgggaguuccgcagccagggcacccugaucauccacuccgaggacccgcugaccgugaaggaccccaucugcgcgcacgggaacgacgaccugcucccgcccgucgaccggaucgacaagaacagcaccgccuccuaccugaagaacuacccccuguaccgccaggacuacaaccccaagcccaagcccagcaacgagaucacgcgggaguacaucccgaagaucggcaugaccaccuacaagaucgugccgcccaagucccucgagaucagcaaggacuggcaguccgagaccaucgaguacaaggacgaccaggacaugcacgcccuggggaagaagcacacgcacgagaacgugaaggagaccgccauccagaccgaggacagcgccaucuccgagagccccgaggagccccugcccaaccucaagcccaagcccaaccugcgcaccgagcaccaggucccgagcuccgugagcucccccgacgacgcgauggugagcccccugaagcccgccccgaagaugacgcgggacaccggcaccgcccccuucgcccccaaccucgaggagaucaacaacauccuggaguccaaguucaagagccgcgccuccaacgcgcaggccaagcccagcuccuucuuccugcagaugcagaagcgggucagcggccacuacgugaccuccgccgccgccaagagcgugcacgcggccccgaaccccgcccccaaggagcucacgaacaaggaggccgagcgcgacaugcugccgucccccgagcagacccugagcccccucuccaagaugccccacagcgucccgcagccccugguggagaagaccgacgacgacgugaucgggcaggcgcccgccgaggccagcccgccgcccaucgcccccaagcccgucaccauccccgccucccagguguccacgcagaaccugaagacccucaagaccuucggcgcgccccggcccuacagcagcuccgggcccagcccguucgcccuggccguggucaagcgcucccagagcuucuccaaggagcgcaccgagagccccuccgccagcgcccuggugcagccgcccgcgaacacggaggagggcaagacccacuccgugaacaaguucgucgacaucccccagcucggggugagcgacaaggagaacaacuccgcccacaacgagcagaacagccagauccccacccccaccgacggccccuccuucacggugaugcggcagagcucccugaccuuccagagcuccgacccggagcagaugcgccagagccugcucaccgccauccgguccggcgaggccgccgcgaagcugaagcgcgucaccauccccagcaacacgaucagcgugaacgggcggucccgccugagccacuccaugagccccgacgcccaggacggccacuga

SEQ ID NO: 28497 - RNA, 1653 nt, Artificial Sequence
  derived and/or modified sequence opt1 from COCH__Homo_sapiens__XP_011534841
augagcgccgccuggauccccgcgcugggccucggggugugccugcugcuccugccgggccccgccggguccgagggcgccgcccccaucgccaucacgugcuucacccgcgggcuggacauccggaaggagaaggcggacguccucugccccggcggcugcccgcuggaggaguucagcguguacgggaacaucguguacgccuccgucagcuccaucugcggcgccgccgugcaccgcggggugaucagcaacuccggcgggcccguccggguguacagccugcccggccgcgagaacuacuccagcguggacgcgaacggcauccagucccagaugcucagccggugguccgccagcuucaccgucaccaaggggaaguccagcacccaggaggccaccggccaggccguguccacggcccacccgcccaccgggaagcgccugaagaagacccccgagaagaagaccggcaacaaggacugcaaggcggacaucgccuuccugaucgacggcagcuucaacaucgggcagcggcgcuucaaccuccagaagaacuucgugggcaaggucgcccugaugcuggggaucggcacggaggggccccacgugggccucgugcaggccuccgagcaccccaagaucgaguucuaccugaagaacuucaccagcgccaaggacguccuguucgcgaucaaggaggugggcuuccgcgggggcaacagcaacaccgggaaggcccucaagcacaccgcccagaaguucuucacgguggacgccggcguccggaaggggaucccgaaggugguggucguguucaucgacggcuggcccuccgacgacaucgaggaggccggcaucguggcgcgggaguucggggucaacguguucaucgucagcguggccaagcccauccccgaggagcugggcauggugcaggacgucaccuucguggacaaggccgugugccgcaacaacggguucuucuccuaccacaugccgaacugguucggcaccaccaaguacgucaagccccuggugcagaagcucugcacgcacgagcagaugaugugcagcaagaccugcuacaacuccgugaacaucgccuuccugaucgacgggagcuccagcgucggcgacuccaacuuccggcugaugcucgaguucgugagcaacaucgccaagaccuucgagaucuccgacaucggcgcgaagaucgccgccgugcaguucaccuacgaccagcgcacggaguucagcuucaccgacuacuccaccaaggagaacguccuggccgugauccggaacauccgcuacaugagcgggggcaccgcgacgggggacgccaucuccuucaccgugcggaacgucuucggccccauccgcgagagccccaacaagaacuuccuggugaucgugaccgacggccaguccuacgacgacguccaggggccggccgccgccgcgcacgacgccggcaucaccaucuucagcguggggguggccugggcgccccucgacgaccugaaggacauggccuccaagcccaaggagagccacgccuucuucacgcgggaguucaccggccuggagcccaucgucagcgacgugauccgcgggaucugccgggacuuccucgagucccagcaguga

SEQ ID NO: 28498 - RNA, 2943 nt, Artificial Sequence
  derived and/or modified sequence opt1 from COG1__Homo_sapiens__NP_061184
auggccaccgccgcgaccagccccgcccugaagcgccucgaccugcgggacccggccgcccuguucgagacgcacggcgccgaggagauccgcgggcucgagcgccaggugcgggcggagaucgagcacaagaaggaggagcugcggcagauggucggcgagcgcuaccgggaccugaucgaggccgccgacaccaucgggcagaugcgccggugcgccgugggccucguggacgcggucaaggccaccgaccaguacugcgcccgccugcggcaggccggguccgccgcgccccgcccgccccgggcccagcagccccagcagcccagccaggagaaguucuacuccauggccgcccagaucaagcugcuccuggagauccccgagaagaucuggagcuccauggaggccagccagugccugcacgcgacccagcucuaccugcugugcugccaccuccacucccugcugcagcucgacagcuccagcucccgcuacagccccgugcugucccgguucccgauccugauccgccagguggccgccgccagccacuuccgguccacgauccuccacgagagcaagaugcugcugaagugccagggcgucuccgaccaggccguggcggaggcccucugcagcaucaugcugcuggaggaguccagcccccgccaggcccucaccgacuuccugcuggcccggaaggccaccauccagaagcuccugaaccagccccaccacggcgcggggaucaaggcccagaucugcagccugguggagcuccuggccaccacgcugaagcaggcccacgcgcuguucuacacccugcccgagggccugcucccggaccccgcccugcccugcgggcuccucuucuccacccuggagaccaucacgggccagcaccccgccgggaagggcaccggcguccugcaggaggagaugaagcucugcagcugguucaagcaccucccggccuccaucguggaguuccagcccacccugcgcacccucgcccaccccaucagccaggaguaccugaaggacacgcugcagaaguggauccacaugugcaacgaggacaucaagaacgggaucaccaaccugcucauguacgugaaguccaugaagggccuggcggggauccgggacgccaugugggagcugcucaccaacgagagcaccaaccacuccugggacguccugugccgccgccugcucgagaagccccugcuguucugggaggacaugaugcagcagcuguuccuggaccggcugcagacgcucaccaaggagggcuucgacagcaucuccagcuccagcaaggagcugcugguguccgcccuccaggagcuggagagcuccaccagcaacuccccgagcaacaagcacauccacuucgaguacaacaugucccuguuccucuggagcgagagccccaacgaccugcccuccgacgccgccugggugagcgucgcgaaccgcggccaguucgccuccagcgggcuguccaugaaggcccaggccaucagccccugcgugcagaacuucugcuccgcccucgacagcaagcugaaggugaagcuggacgaccuccuggcguaccugccguccgacgacagcucccuccccaaggacgucagccccacccaggccaaguccagcgccuucgaccgguacgccgacgcgggcacggugcaggagaugcugcgcacccaguccguggccugcaucaagcacaucgucgacugcauccgggccgagcugcagagcaucgaggagggggugcagggccagcaggacgcccucaacuccgccaagcugcacagcgugcuguucauggcgcgccucugccagagccugggggagcugugcccccaccucaagcagugcauccugggcaaguccgagagcuccgagaagccggcccgggaguuccgcgcccugcggaagcagggcaaggucaagacccaggagaucauccccacccaggccaaguggcaggaggugaaggagguccuccugcagcagagcgugaugggguaccaggugugguccagcgccgucgugaaggugcugauccacggcuucacgcagucccuccugcuggacgacgcggggagcguccucgccaccgccaccuccugggacgagcuggagauccaggaggaggccgagagcggcuccagcgugaccuccaagauccgccugcccgcccagccgagcugguacgugcaguccuuccucuucagccugugccaggagaucaaccgggucgggggccacgcgcugcccaaggugacgcuccaggagaugcugaaguccugcauggugcaggucguggccgccuacgagaagcugagcgaggagaagcagaucaagaaggagggcgccuuccccgugacccagaaccgcgcgcuccagcugcuguacgaccuccgguaccugaacaucguccugaccgccaagggggacgaggugaaguccggccgcagcaagcccgacagccggaucgagaaggugaccgaccaccucgaggcccugaucgacccguucgaccuggacgucuucacgccccaccucaacuccaaccugcaccgccuggugcagcggaccagcguccucuucgggcuggugaccggcaccgagaaccagcuggcgccccgcuccagcaccuucaacucccaggagccccacaacauccucccgcuggccagcucccagauccgguucgggcugcucccccugagcaugacguccacccgcaaggccaagagcacccgcaacaucgagaccaaggcccagguggugccgcccgcccgguccacggccggcgaccccaccguccccggcagccuguuccgccagcucguguccgaggaggacaacaccagcgcccccucccuguucaagcugggguggcucagcuccaugaccaaguga

SEQ ID NO: 28499 - RNA, 2214 nt, Artificial Sequence
  derived and/or modified sequence opt1 from COG2__Homo_sapiens__NP_001138508
auggagaagucccgcaugaaccugcccaagggcccggacacccucugcuucgacaaggacgaguucaugaaggaggacuucgacguggaccacuucgucuccgacugccggaagcgcgugcagcuggaggagcugcgggacgaccucgagcuguacuacaagcugcucaagaccgccaugguggagcugaucaacaaggacuacgccgacuucgucaaccugagcacgaaccucguggggauggacaaggcgcugaaccagcuguccgugccccucggccagcugcgcgaggagguccugagccuccgguccagcguguccgaggggauccgcgccguggacgagcggaugagcaagcaggaggacauccgcaagaagaagaugugcguccugcggcugauccaggugauccgcuccguggagaagaucgagaagauccucaacagccaguccagcaaggagaccuccgcccuggaggccagcagcccccugcucaccggccagauccuggagcggaucgccaccgaguucaaccagcugcaguuccacgcgguccagagcaaggggaugccccuccuggacaaggugcgcccgcggaucgccggcaucacggccaugcugcagcagucccucgagggccugcugcucgaggggcugcagaccagcgacguggacaucauccgccacugccugcggaccuacgccaccaucgacaagacgcgcgacgcggaggcccucgucggccaggugcuggugaagcccuacaucgacgaggucaucaucgagcaguucguggagucccaccccaacgggcuccaggugauguacaacaagcugcuggaguucgucccccaccacugccggcugcuccgcgaggugaccggcggggccaucagcagcgagaagggcaacaccgugccgggcuacgacuuccuggucaacuccguguggccccagaucguccaggggcuggaggagaagcuccccagccuguucaaccccggcaacccggacgccuuccacgagaaguacaccaucuccauggacuucgugcggcgccuggagcggcagugcgggagccaggccuccgugaagcgccuccgcgcgcaccccgccuaccacagcuucaacaagaaguggaaccugcccgucuacuuccagauccgguuccgcgagaucgccggcucccuggaggccgcccucacggacgugcuggaggacgcgcccgccgagagcccguacugccugcuggccucccaccggaccuggagcucccuccgccggugcuggagcgacgagauguuccugccccugcucgugcaccgccuguggcggcugacccuccagauccuggcccgcuacuccgucuucgugaacgagcugagccuccggcccaucuccaacgagagccccaaggagaucaagaagccgcuggugaccggcuccaaggagcccagcaucacgcaggggaacaccgaggaccagggcuccgggcccagcgagaccaagcccgucgugagcaucucccgcacccagcugguguacgucguggccgaccucgacaagcugcaggagcagcugccggagcuccuggagaucaucaagcccaagcuggagaugaucggcuucaagaacuucagcuccaucagcgcgcucgaggacucccagagcuccuucagcgccugcgugcccucccugagcuccaagaucauccaggaccugagcgacuccugcuucggguuccucaagagcgcccuggaggucccccggcuguaccgccggacgaacaaggaggugccgaccaccgccuccagcuacguggacuccgcccucaagccccuguuccagcugcagagcggccacaaggacaagcucaagcaggcgaucauccagcaguggcuggagggcacccugagcgaguccacgcacaaguacuacgagaccgucagcgacgugcucaacuccgugaagaagauggaggagagccugaagcgccugaagcaggcccggaagaccacccccgccaacccggucgggcccuccggcgggaugagcgacgacgacaagauccgccuccagcuggcccuggacguggaguaccucggcgagcagauccagaagcuggggcugcaggcguccgacaucaagagcuucuccgcccucgccgagcugguggccgccgcgaaggaccaggccacggccgagcagcccuga

SEQ ID NO: 28500 - RNA, 2487 nt, Artificial Sequence
  derived and/or modified sequence opt1 from COG3__Homo_sapiens__NP_113619
auggccgaggccgcgcugcuccugcugcccgaggccgccgccgagcgcgacgcccgggagaagcucgcgcugugggaccgccggccggacaccaccgcgccccugacggaccgccagaccgacagcgugcucgagcugaaggccgccgccgagaaccugcccgugcccgccgagcucccgaucgaggaccugugcucccugaccagccagucccuccccaucgagcugaccagcguggugcccgaguccacggaggacauccugcucaagggcuucaccagccuggggauggaggaggagcggaucgagaccgcccagcaguucuucuccugguucgccaagcugcagacccagauggaccaggacgagggcacgaaguaccgccagaugcgggacuaccucagcggguuccaggagcagugcgacgccauccugaacgacgucaacuccgcgcugcagcaccucgagagccugcagaagcaguaccuguucguguccaacaagaccggcacccuccacgaggccugcgagcagcugcugaaggagcagagcgagcucguggaccuggccgagaacauccagcagaagcuguccuacuucaacgagcucgagaccaucaacacgaagcugaacagccccacccuguccgucaacagcgacggguucaucccgaugcucgccaagcuggacgacugcaucaccuacaucuccagccaccccaacuucaaggacuaccccaucuaccugcucaaguucaagcagugccuguccaaggcccugcaccucaugaagaccuacacggugaacacccugcagacccugaccagccagcuccugaagcgcgaccccagcuccgugccgaacgcggacaacgccuucacgcuguucuacgucaaguuccgggccgccgcccccaaggugcgcacccucaucgagcagaucgagcugcggagcgagaagauccccgaguaccagcagcugcucaacgacauccaccagugcuaccuggaccagcgcgagcugcugcucggccccuccaucgcgugcaccguggccgagcugaccagccagaacaaccgggaccacugcgcccugguccgcuccggcugcgccuucauggugcacgugugccaggacgagcaccagcucuacaacgaguucuucacgaagccgaccagcaagcuggacgagcugcucgagaagcugugcgucucccuguacgacguguuccggccccucaucauccacgugauccaccuggagacccugagcgagcucugcgggauccugaagaacgagguccuggaggaccacgugcagaacaacgccgagcagcucggcgcguucgccgccggggugaagcagaugcuggaggacguccaggagcgccugguguaccggacccacaucuacauccagacggacaucaccggcuacaagcccgcccccggggaccucgcguacccggacaagcuggugaugauggagcagaucgcccagucccugaaggacgagcagaagaagguccccagcgaggccuccuucagcgacgugcaccucgaggagggcgaguccaacagccugaccaaguccggcagcaccgagucccugaacccccgcccccagacgaccaucagcccggccgaccuccacgggaugugguaccccaccguccggcgcacccuggugugccuguccaagcucuaccggugcaucgaccgcgccguguuccagggccugagccaggaggcgcugagcgccugcauccagucccuccugggggccagcgaguccaucagcaagaacaagacgcagaucgacggccagcuguuccucaucaagcaccuccugauccugcgcgagcagaucgcccccuuccacaccgaguucaccaucaaggagaucucccuggaccugaagaagacccgggacgccgcguucaagauccucaaccccaugaccgucccgcgcuucuuccggcugaacagcaacaacgcccugaucgaguuccuccuggagggcacgcccgagauccgcgagcacuaccuggacuccaagaaggacguggaccggcaccucaagagcgccugcgagcaguucauccagcagcagaccaagcuguucguggagcagcuggaggaguucaugaccaaggucuccgcccucaagaccauggccagccagggcgggcccaaguacacgcugucccagcagccgugggcgcagcccgccaaggugaacgaccuggccgccaccgcguacaagaccaucaagaccaagcuccccgugacgcugcgcagcaugucccuguaccucagcaacaaggacaccgaguucauccuguucaagcccguccggaacaacauccagcaggucuuccagaaguuccacgcccugcucaaggaggaguucuccccggaggacauccagaucaucgccugccccagcauggagcagcugucccugcuccugagcgugagcaaguga

SEQ ID NO: 28501 - RNA, 2307 nt, Artificial Sequence
  derived and/or modified sequence opt1 from COG4__Homo_sapiens__NP_001182068
augggcaccaagauggccgaccuggacagcccgcccaagcucuccggggugcagcagcccagcgagggcgucgggggcgggcgcugcuccgagaucagcgccgagcugauccggucccugaccgagcuccaggagcuggaggcgguguacgagcgccugugcggcgaggagaagguggucgagcgggagcucgacgcccugcuggagcagcagaacacgaucgagagcaagauggugacccuccaccgcaugggccccaaccugcagcugaucgagggggacgccaagcagcucgccggcaugaucaccuucacgugcaaccuggccgagaacguguccagcaagguccggcagcuggaccucgcgaagaaccgccuguaccaggccauccagcgggccgacgacauccuggaccucaaguucugcauggacggggugcagaccgcccugcgcuccgaggacuacgagcaggcggccgcccacacccaccgguaccugugccucgacaagagcgugaucgagcugucccgccagggcaaggaggggagcaugaucgacgccaaccugaagcuccugcaggaggccgagcagcggcugaaggcgaucgucgccgagaaguucgccaucgccaccaaggagggcgaccucccccagguggagcgcuucuucaagaucuucccgcugcugggccuccacgaggaggggcugcggaaguucuccgaguaccugugcaagcaggucgccagcaaggcggaggagaaccuccugauggugcugggcaccgacauguccgaccgccgggccgccgugaucuucgccgacacgcucacccugcuguucgaggggaucgcccgcaucguggagacccaccagcccaucgucgagaccuacuacggccccggccggcucuacacgcugaucaaguaccuccagguggagugcgaccgccagguggagaaggucguggacaaguucaucaagcagcgggacuaccaccagcaguuccgccacgugcagaacaaccugaugcggaacagcaccaccgagaagaucgagccccgcgagcuggacccgauccugaccgaggucacgcucaugaacgcgcgcuccgagcuguaccugcgguuccucaagaagcgcaucagcuccgacuucgaggugggggacagcauggccagcgaggaggugaagcaggagcaccagaagugccuggacaagcugcugaacaacugccuccuguccugcaccaugcaggagcugaucggccucuacgucaccauggaggaguacuucaugcgggagaccgugaacaaggccgucgcccuggacacguacgagaaggggcagcugaccagcuccaugguggacgacguguucuacaucgucaagaagugcaucggccgcgcccucagcuccagcuccaucgacugccugugcgcgaugaucaaccuggccaccaccgagcucgagagcgacuuccgggacgugcugugcaacaagcugcgcaugggguuccccgccacgaccuuccaggacauccagcggggcgugaccuccgccgucaacaucaugcacagcucccuccagcagggcaaguucgacaccaaggggaucgagagcacggacgaggcgaagauguccuuccugagcgacugcaccaagcuguucucccagggcaucgggggcgagcaggcccaggccaaguucgacagcugccucuccgaccuggccgccgugagcaacaaguuccgcgaccugcuccaggaggggcugaccgagcugaacuccaccgcgaucaagccccaggugcagcccuggaucaacagcuucuucagcgucucccacaacaucgaggaggaggaguucaacgacuacgaggccaacgacccgugggugcagcaguucauccucaaccuggagcagcagauggccgaguucaaggccagccugucccccgugaucuacgacagccucacgggccugaugaccucccuggucgccguggagcucgagaaggugguccucaagagcaccuucaaccggcugggcgggcugcaguucgacaaggagcugcgcucccugaucgcguaccucaccacggugaccaccuggaccauccgggacaaguucgcccgccugagccagauggccaccauccugaaccucgagcgggugacggagauccuggacuacuggggccccaacuccgggccccugaccuggcgccucaccccggccgagguccgccaggugcuggcccugcggaucgacuuccggagcgaggacaucaagcgccuccggcuguga

SEQ ID NO: 28502 - RNA, 2583 nt, Artificial Sequence
  derived and/or modified sequence opt1 from COG5__Homo_sapiens__NP_006339
augggcugggucgggggccgccggcgcgacagcgccuccccgcccgggcggagccgcuccgccgcggacgacaucaaccccgcccccgccaacauggagggcgggggcggcagcguggccguggccgggcugggcgcgcggggguccggcgccgccgccgcgaccgugcgcgagcuccugcaggacgggugcuacagcgacuuccugaacgaggacuucgacgucaagaccuacacgucccagagcauccaccaggccgugaucgccgagcagcucgccaagcuggcccagggcaucucccagcuggaccgggagcuccaccuccagguggucgcgcgccacgaggaccugcuggcccaggccaccggcaucgagagccuggagggggugcugcagaugaugcagacccggaucggcgcccuccagggggccguggaccgcaucaaggcgaagaucgucgagcccuacaacaagaucguggcccggaccgcccagcuggcccgccuccagguggccugcgaccugcugcggcgcaucauccggauccugaaccucuccaagcgccugcagggccagcugcagggcgggagccgggagaucacgaaggcggcccagucccucaacgagcuggacuaccugagccagggcaucgaccucuccgggaucgaggucaucgagaacgaccugcuguucaucgcccgcgcccggcucgagguggagaaccaggccaagcgccugcuggagcagggccucgagacccagaacccgacccagguggggaccgcgcugcaggucuucuacaaccugggcacgcucaaggacaccaucaccagcgugguggacggcuacugcgccacccuggaggagaacaucaacuccgcccuggacaucaagguccucacgcagcccagccaguccgccgugcgcgggggccccgggcggagcaccaugcccaccccgggcaacaccgcggcccugcgcgccagcuucuggacgaacauggagaagcugauggaccacaucuacgccgugugcgggcagguccagcaccuccagaaggugcuggccaagaagcgggaccccgugucccacaucugcuucaucgaggagaucgucaaggacggccagcccgagaucuucuacaccuucuggaacagcgugacccaggcgcuguccagccaguuccacauggccaccaacuccagcauguuccucaagcaggccuucgagggcgaguaccccaagcugcugcgccucuacaacgaccuguggaagcggcugcagcaguacucccagcacauccaggggaacuucaacgccagcggcacgaccgaccucuacgucgaccugcagcacauggaggacgacgcccaggacaucuucaucccgaagaagcccgacuacgaccccgagaaggcgcugaaggacucccugcagcccuacgaggccgccuaccucagcaagucccugagccgccuguucgacccgaucaaccucguguucccgcccgggggccggaacccgcccuccagcgacgagcuggacgggaucaucaagaccaucgccuccgagcugaacguggccgcggucgacaccaaccucacgcuggccgugagcaagaacguggccaagaccauccagcuguacuccgucaagagcgagcagcuccuguccacccagggcgacgccagccaggugaucggcccccugaccgaggggcagcgccggaacguggcggucgugaacagccucuacaagcugcaccaguccgugacgaaggucgugagcucccagagcuccuucccccuggccgccgagcagaccaucaucagcgcccucaaggccauccacgcgcugauggagaacgccgugcagccccugcucaccuccgucggcgacgccaucgaggccaucaucaucaccaugcaccaggaggacuucagcgggucccugagcuccagcggcaagcccgacgugcccugcucccuguacaugaaggagcuccagggcuucaucgcccgcgugaugagcgacuacuucaagcacuucgagugccuggacuucgucuucgacaacacggaggcgaucgcccagcgggccguggagcuguucauccgccacgccucccucauccggccccugggggagggcgggaagaugcgccuggccgcggacuucgcccagauggagcucgccgugggccccuucugccggcgcgucagcgaccuggggaaguccuaccggaugcugcgcagcuuccggccgcuccuguuccaggccagcgagcacguggcguccagccccgcccugggcgacgugauccccuucuccaucaucauccaguuccucuucacccgcgccccggccgagcucaagagccccuuccagcgggccgaguggucccacacccgcuucagccaguggcuggacgaccaccccuccgagaaggaccgccugcugcugauccggggcgcgcucgaggccuacguccagagcgugcgcucccgggaggggaaggaguucgcccccguguacccgaucaugguccagcugcugcagaaggccaugagcgcccuccaguga

SEQ ID NO: 28503 - RNA, 1848 nt, Artificial Sequence
  derived and/or modified sequence opt1 from COG6__Homo_sapiens__NP_001138551
auggccgagggcagcggggagguggucgccguguccgcgaccggcgccgccaacgggcugaacaacggcgccgggggcaccagcgccacgaccugcaacccccucucccgcaagcugcacaagauccuggagacccgccucgacaacgacaaggagaugcuggaggcgcugaaggcccucagcaccuucuucguggagaacucccugcgcacgcggcgcaaccugcggggcgacaucgagcgcaagagccucgccaucaacgaggaguucgucuccaucuucaaggaggugaaggaggagcuggagagcaucuccgaggacgugcaggccaugagcaacugcugccaggacaugaccucccggcugcaggcggccaaggagcagacccaggaccucaucgucaagaccacgaagcugcagagcgagucccagaagcuggagauccgcgcccagguggccgacgccuuccucagcaaguuccagcugaccuccgacgagaugagccugcuccgggggacccgcgagggcccgaucaccgaggacuucuucaaggcgcuggggcgggugaagcagauccacaacgacgucaaggugcugcuccgcacgaaccagcagaccgccggccuggagaucauggagcagauggcccugcuccaggagaccgccuacgagcggcuguaccgcugggcccaguccgagugccggacccugacgcaggagagcugcgacgugucccccguccucacccaggcgauggaggcccugcaggaccgccccgugcuguacaaguacacccucgacgaguucgggaccgcccggcgcagcacggugguccggggcuucaucgacgcccugacccgcggcgggcccggcgggaccccgcggcccaucgagaugcacagccacgacccccugcgcuacgugggcgacaugcucgccuggcugcaccaggcgaccgccuccgagaaggagcaccuggaggcccuccugaagcacgugacgacccagggcgucgaggagaacauccaggaggugguggggcacaucaccgagggcgucugccgcccccugaaggugcggaucgagcaggucaucguggccgagccgggggccgugcuccuguacaagaucagcaaccugcucaaguucuaccaccacaccaucuccggcaucgucgggaacagcgcgacggcccugcugaccaccaucgaggagaugcaccuccuguccaagaagaucuucuucaacagccugucccuccacgccagcaagcugauggacaagguggagcugcccccgcccgaccugggccccuccagcgcccucaaccagacccugaugcugcuccgcgaggugcuggcgucccacgacagcuccgucgugccccuggacgcccggcaggccgacuucgugcagguccucagcugcgugcuggacccccugcuccagaugugcacgguguccgccagcaaccugggcaccgccgacauggcgaccuucauggucaacucccuguacaugaugaagaccacgcucgcccuguucgaguucaccgaccgccggcuggagaugcuccaguuccagaucgaggcccaccuggacacccugaucaacgagcaggccagcuacgugcucacccgcguggggcuguccuacaucuacaacaccguccagcagcacaagcccgagcagggcagccuggccaacaugccgaaccucgacagcgugacgcugaaggcggccauggugcaguucgaccgguaccuguccgcccccgacaaccuccugaucccccagcugaacuuccuccugagcgccaccgucaagcggcccccgaacgggcccuga

SEQ ID NO: 28504 - RNA, 2313 nt, Artificial Sequence
  derived and/or modified sequence opt1 from COG7__Homo_sapiens__NP_705831
auggacuucagcaaguuccuggccgacgacuucgacgugaaggaguggaucaacgccgcguuccgcgccggcuccaaggaggccgccagcgggaaggccgacggccacgcggccacccucgucaugaagcugcagcuguucauccaggaggugaaccacgccguggaggagaccucccaccaggcccuccagaacaugcccaagguccugcgggacguggaggcgcugaagcaggaggccagcuuccucaaggagcagaugauccuggugaaggaggacaucaagaaguucgagcaggacacgucccagagcaugcagguccugguggagaucgaccaggugaagucccgcaugcagcucgccgccgagagccugcaggaggccgacaagugguccacccugagcgcggacaucgaggagaccuucaagacccaggacaucgccgucaucuccgccaagcucacggggaugcagaacagccugaugaugcugguggacaccccggacuacuccgagaagugcgugcaccucgaggcccugaagaaccggcuggaggcccucgcgagcccccagaucgucgccgccuucaccucccaggccguggaccagagcaagguguucgucaagguguucaccgagaucgaccgcaugccccagcugcuggccuacuacuacaagugccacaaggugcagcuccuggcggccuggcaggagcugugccaguccgaccucagccuggaccggcagcugacgggccucuacgacgcccugcugggggccuggcacacccagauccagugggccacccaggucuuccagaagccccacgagguggugaugguccuccugauccagacccugggcgcgcucaugccgucccugcccagcugccugagcaacggcguggagcgcgccgggcccgagcaggagcucacgcggcugcuggaguucuacgacgccaccgcccacuucgcgaagggccucgagauggcccugcugccccaccuccacgagcacaaccuggugaaggucaccgagcugguggacgccgucuacgacccguacaagcccuaccagcucaaguacggggacauggaggaguccaaccugcugauccagaugagcgccgugccccucgagcacggcgaggugaucgacugcguccaggagcugucccacagcgugaacaagcuguucgggcuggccuccgcggccguggaccgcugcguccgguucaccaacggccucggcacgugcgggcugcugagcgcccucaagucccuguucgccaaguacgugagcgacuucaccuccacccugcagagcauccgcaagaagugcaagcucgaccacaucccgcccaacucccuguuccaggaggacuggaccgccuuccagaacagcauccggaucaucgcgacgugcggcgagcugcuccgccacugcggggacuucgagcagcagcuggccaaccggauccuguccaccgccggcaaguaccucagcgacuccugcagcccccgcucccuggccggcuuccaggagagcauccugaccgacaagaagaacuccgccaagaaccccuggcaggaguacaacuaccuccagaaggacaaccccgcggaguacgccagccugauggagauccuguacacccucaaggagaaggggagcuccaaccacaaccugcuggccgccccgcgggcggcccucacgcgccugaaccagcaggcccaccagcuggccuucgacagcguguuccuccggaucaagcagcagcugcugcucaucuccaagauggacagcuggaacaccgccggcaucggggagacccugaccgacgagcugcccgcguucucccucacgccccuggaguacaucagcaacaucggccaguacaucaugucccugccccucaaccuggagccguucgucacccaggaggacagcgcccuggagcucgcccugcacgccgggaagcugcccuucccgcccgagcagggcgacgagcuccccgagcuggacaacauggccgacaacuggcugggcuccaucgcgcgcgccaccaugcagaccuacugcgacgccauccuccagauccccgagcugagcccccacuccgccaagcagcuggccacggacaucgacuaccucaucaacgugauggacgcgcuggggcugcagcccagccggacccuccagcacaucgugacccugcugaagacccgcccggaggacuaccggcaggucuccaagggccucccccgccgccuggccacgaccguggccaccaugcggagcgugaacuacuga

SEQ ID NO: 28505 - RNA, 1839 nt, Artificial Sequence
  derived and/or modified sequence opt1 from COG8__Homo_sapiens__NP_115758
auggccaccgccgcgaccauccccagcguggccacggccaccgccgccgcgcugggcgaggucgaggacgaggggcuccuggccucccuguuccgcgaccgguucccggaggcccaguggcgcgagcggcccgacgugggccgcuaccuccgggagcugagcggguccggccuggagcgccuccggcgcgagcccgagcggcuggccgaggagcgcgcgcagcugcuccagcagacccgggaccuggccuucgccaacuacaagaccuucauccgcggggccgagugcacggagcggauccaccgccuguucggcgacguggaggccagccucggccggcugcuggaccgccuccccuccuuccagcagagcugccggaacuucgucaaggaggcggaggagaucuccagcaaccgccggaugaacucccugacccugaaccgccacaccgagauccucgagauccuggagaucccgcagcugauggacacgugcgugcggaacagcuacuacgaggaggcccucgagcuggccgccuacgugcgccgccuggagcggaaguacuccagcauccccgucauccaggggaucgugaacgaggugcgccaguccaugcagcucaugcugagccagcugauccagcagcuccggaccaacauccagcugcccgccugccugcgcgucaucggcuaccuccggcgcauggacguguucaccgaggcggagcugcgggugaaguuccugcaggcccgcgacgccuggcuccgguccauccugaccgccauccccaacgacgacccguacuuccacaucaccaagacgaucgaggccagccgcguccaccuguucgacaucaucacccaguaccgggcgaucuucuccgacgaggacccccuccugccgcccgccaugggggagcacaccgugaacgagagcgccaucuuccacggcugggugcugcagaaggucucccaguuccuccaggugcuggagaccgaccuguaccgcgggaucggcggccaccucgacagccugcuggggcagugcauguacuucggccucagcuucucccgggugggggccgacuuccgcggccagcuggcccccgucuuccagcggguggcgaucagcacguuccagaaggccauccaggagaccguggagaaguuccaggaggagaugaacuccuacaugcugaucagcgcccccgccauccucggcaccuccaacaugcccgcggccguccccgccacccagccggggacgcugcagccgcccauggugcugcuggacuucccgccccucgccugcuuccugaacaacauccugguggccuucaacgaccuccgccugugcugccccgucgcgcuggcccaggacgugaccggcgcccucgaggacgcccuggccaaggucaccaagaucauccuggcguuccaccgggccgaggaggccgccuucagcuccggggagcaggagcuguucgugcaguucugcaccguguuccuggaggaccugguccccuaccucaaccgcugccuccaggugcuguucccgcccgcccagaucgcgcagacgcucggcaucccgcccacccagcugagcaaguacgggaaccugggccacgugaacaucggcgccauccaggagccccucgccuucauccugcccaagcgggagacccuguucacccucgacgaccaggcccuggggcccgagcugacggcgcccgcccccgagccgcccgccgaggagccccgccucgagcccgccggccccgccugccccgagggcgggcgcgcggagacccaggccgagcccccguccgucgggcccuga

SEQ ID NO: 28506 - RNA, 1731 nt, Artificial Sequence
  derived and/or modified sequence opt1 from COIL__Homo_sapiens__NP_004636
auggccgccagcgagaccgugcgccugcggcuccaguucgacuacccgccgcccgcgacgccccacugcaccgccuucuggcugcuggucgaccucaaccgcugccggguggugaccgaccugaucucccugauccgccagcgguucggcuucagcuccggggccuuccucggccuguaccuggagggcgggcuccugcccccggccgagagcgcccgccugguccgggacaacgacugccuccgcgugaagcuggaggagcgcgggguggcggagaacuccgucgugaucagcaacggcgacaucaaccugucccuccggaaggccaagaagcgggccuuccagcuggaggagggcgaggagaccgagcccgacugcaaguacagcaagaagcacuggaagucccgcgagaacaacaacaacaacgagaaggugcuggaccucgagcccaaggccgucaccgaccagacggugagcaagaagaacaagcggaagaacaaggcgaccugcgggaccgugggcgacgacaacgaggaggccaagcgcaagucccccaagaagaaggagaagugcgaguacaagaagaaggccaagaaccccaagagccccaagguccaggccgugaaggacugggccaaccagcggugcuccagccccaagggguccgcgcgcaacagccuggugaaggccaagcggaagggcuccgucagcgugugcuccaaggagagccccagcuccagcuccgagagcgaguccugcgacgagagcaucuccgacgggccgagcaaggugacccuggaggcccgcaacuccagcgagaagcuccccacggagcuguccaaggaggagcccagcaccaagaacaccaccgccgacaagcuggccaucaagcucggcuucucccugacgcccagcaagggcaagaccuccgggaccaccagcuccagcuccgacagcagcgcggaguccgacgaccagugccugaugagcuccagcacgccggagugcgccgccggcuuccucaagaccgucgggcuguucgccggccggggccgccccgggcccggccuguccagccagaccgccggggcggccggcuggcggcgcuccgggagcaacggcggcgggcaggcccccggcgccuccccgagcgugucccuccccgccagccuggggcgcggcugggggcgggaggagaaccuguucuccuggaagggcgcgaagggccgcgggaugcggggccgcgggcggggccgcgggcaccccgugagcugcgucgugaaccgguccaccgacaaccagcgccagcagcagcucaacgacguggucaagaacagcuccacgaucauccagaaccccguggagaccccgaagaaggacuacagccugcugccccuccuggccgccgcgccccaggucggcgagaagaucgccuucaagcugcucgagcugaccagcuccuacagccccgacguguccgacuacaaggagggccggauccugagccacaacccggagacccagcaggucgacaucgagauccucuccagccugcccgcccugcgcgagcccgggaaguucgaccucguguaccacaacgagaacggcgccgaggugguggaguacgccgucacgcaggaguccaagaucaccguguucuggaaggagcugaucgacccgcggcugaucaucgagagccccuccaacaccagcuccaccgagcccgccuga

SEQ ID NO: 28507 - RNA, 2043 nt, Artificial Sequence
  derived and/or modified sequence opt1 from COL10A1__Homo_sapiens__XP_011533735
augcugccccagaucccguuccuccugcuggugagccucaaccugguccacggcguguucuacgccgagcgcuaccagaugcccaccgggaucaagggcccccugcccaacaccaagacgcaguucuucaucccguacaccaucaaguccaaggggaucgccgugcggggcgagcaggggacccccggcccgcccggccccgcggggccccgcggccaccccgggcccagcggcccgcccgggaagcccggcuacggcucccccgggcuccagggcgagccggggcugcccggcccgcccggccccagcgccgucgggaagcccggcgugcccgggcugcccggcaagccgggggagcggggccccuacggccccaagggggacgugggccccgccgggcucccgggcccccgcgggcccccgggcccgcccggcauccccgggcccgccggcaucuccguccccgggaagcccggccagcaggggcccaccggcgccccgggcccccggggguuccccggcgagaagggggcgcccggcgugccgggcaugaacgggcagaagggcgagaugggguacggcgcccccgggcgccccggcgagcggggccugcccgggccgcagggccccacggggcccagcgggcccccgggcgugggcaagcgcggcgagaacgggguccccggccagcccgggaucaagggcgaccggggguuccccggcgagaugggcccgaucgggccgcccggcccccaggggccgcccggcgagcgcgggcccgagggcaucggcaagcccggggccgccggcgcgcccgggcagcccggcauccccggcaccaaggggcugccgggcgcccccgggaucgccggcccgcccgggccgcccggcuucggcaagcccgggcuccccggccugaagggggagcggggccccgccgggcugcccggcggccccggggccaagggcgagcaggggcccgcgggccucccggggaagcccggccugaccggcccgcccgggaacaugggcccccaggggcccaagggcauccccggcucccacgggcugcccggcccgaagggggagaccggccccgccgggcccgccggcuacccgggcgccaagggggagcgcggcagccccggguccgacggcaagcccggguaccccggcaagccgggccucgacgggcccaagggcaaccccgggcugcccggcccgaagggggaccccggcgugggcgggccgcccggccugcccgggcccgugggccccgccggggcgaagggcaugcccggccacaacggggaggccggcccgcgcggggcccccggcauccccggcacgcgggggcccaucggcccgcccgggauccccggcuuccccgggagcaagggcgacccgggcucccccgggccgcccggccccgccgggaucgccaccaagggccucaacgggcccaccgggcccccgggcccgcccggcccccggggccacagcggggagcccggccugcccgggccgcccggcccgcccggcccgcccgggcaggcggucaugcccgagggcuucaucaaggccgggcagcgccccucccugagcggcacgccccucguguccgccaaccagggggugaccggcaugcccgucagcgccuucaccgugauccuguccaaggccuaccccgcgaucggcacccccauccccuucgacaagauccuguacaaccggcagcagcacuacgacccccgcaccgggaucuucacgugccagaucccgggcaucuacuacuucagcuaccacgugcacgucaaggggacccacgugugggugggccucuacaagaacggcacccccgucauguacaccuacgacgaguacacgaagggguaccuggaccaggccuccggcagcgccaucaucgaccugaccgagaacgaccagguguggcuccagcugcccaacgccgagagcaacgggcuguacuccagcgaguacgugcacuccagcuucuccggcuuccucgucgcgcccauguga

SEQ ID NO: 28508 - RNA, 4395 nt, Artificial Sequence
  derived and/or modified sequence opt1 from COL11A1__Homo_sapiens__XP_011539021
auggagcccuggagcagccgcuggaagaccaagcgguggcugugggacuucaccgugacgacccucgcccugaccuuccuguuccaggcccgcgagguccggggcgccgcccccguggacgugcucaaggcccuggacuuccacaacagccccgagggcaucuccaagaccacgggcuucugcaccaaccgcaagaacagcaagggcuccgacaccgccuaccgggucagcaagcaggcccagcuguccgcgcccaccaagcagcuguuccccggcggcacguuccccgaggacuucagcauccuguucaccgugaagcccaagaagggcauccaguccuuccugcucagcaucuacaacgagcacggcauccagcagaucggcguggaggucggccgcucccccguguuccuguucgaggaccacaccggcaagcccgcccccgaggacuacccccuguuccggaccgugaacaucgccgacggcaaguggcaccgcgucgccaucagcguggagaagaagacggugaccaugaucgucgacugcaagaagaagaccaccaagccccucgaccgguccgagcgcgcgaucguggacacgaacggcaucaccguguucggcacccggauccuggacgaggaggucuucgagggcgacauccagcaguuccugaucaccggcgaccccaaggccgccuacgacuacugcgagcacuacagccccgacugcgacuccagcgcccccaaggccgcgcaggcccaggagccccagaucgacgaguacgcccccgaggacaucaucgaguacgacuacgaguacggcgaggccgaguacaaggaggccgaguccgugacggagggccccaccgugaccgaggagaccaucgcgcagacggaggccaacaucgucgacgacuuccaggaguacaacuacggcaccauggagagcuaccagaccgaggcgccccgccacguguccggcaccaacgagcccaaccccguggaggagaucuucacggaggaguaccucaccggggaggacuacgacagccagcggaagaacagcgaggacacccuguacgagaacaaggagaucgacggccgcgacuccgaccugcucgucgacggggaccugggcgaguacgacuucuacgaguacaaggaguacgaggacaagcccaccuccccgcccaacgaggaguucgggcccggcgugcccgccgagacggacaucaccgagaccuccaucaacggccacggggccuacggcgagaaggggcagaagggcgagcccgcgguggucgagcccgggaugcugguggagggcccgcccggccccgccgggcccgccggcaucauggggccgcccggccuccaggggcccaccgggccgcccggcgaccccggggaccgggggccgcccgggcgccccggccugcccggcgccgacgggcugcccgggccgcccgggacgaugcucaugcugcccuuccgguacggcggggacggcagcaagggccccaccaucuccgcccaggaggcgcaggcccaggccauccugcagcaggcccgcaucgcgcuccgggggccgcccggccccauggggcugaccggccgccccgggcccgucggcggccccgggagcuccggcgccaagggggagagcggcgaccccgggccccagggcccccggggcgugcaggggccgcccggccccaccgggaagcccggcaagcgcgggcgccccggcgccgacggcgggcggggcaugcccggggagcccggcgccaagggcgaccgcggguucgacggccugcccgggcuccccggcgacaaggggcaccggggcgagcgcggcccccaggggcccccggggccgcccggggacgacggcaugcggggcgaggacggcgagaucggcccccgcgggcugccgggcgaggccgggccccggggccugcucgggccccgcggcacccccggcgcgccggggcagcccggcauggccgggguggacgggccgcccggcccgaaggggaacaugggcccccagggggagcccggcccgcccgggcagcagggcaaccccggcccccaggggcugcccggcccccaggggcccaucgggccgcccggggagaagggcccccagggcaagcccgggcuggccggccuccccggggccgacggcccgcccgggcaccccggcaaggagggccaguccggggagaagggcgcccuggggccgcccggcccccaggggcccaucggcuaccccggcccccggggcgucaagggcgcggacggggugcgcggccugaagggcagcaagggggagaagggcgaggacggguuccccggcuucaagggggacaugggccucaagggcgaccggggcgaggugggccagaucgggccccgcggcgaggacgggcccgagggcccgaagggccgggccgggcccacgggcgaccccgggcccuccggccaggccggggagaagggcaagcugggcgucccggggcugcccggcuaccccgggcgccagggccccaaggggagcaccggcuucccgggcuuccccggggccaacggcgagaagggggcccggggcguggcgggcaagcccgggccccgcggccagcgggggccgaccggcccccgcgggucccggggcgcccgcggccccaccgggaagccgggccccaaggggacgagcggcggggacgggccgcccggcccgcccggggagcgcggcccccaggggccccagggcccggugggguuccccggccccaaggggccgcccgggccgcccggcaaggacgggcuccccggccaccccggccagcggggcgagaccggcuuccaggggaagaccggcccgcccgggcccggcggcgucguggggccccagggccccaccggggagacgggccccaucggggagcgcggccaccccggcccgcccgggcccccgggcgagcaggggcugcccggcgccgccgggaaggagggcgcgaagggcgaccccgggccccagggcaucuccgggaaggacggcccggccgggcugcggggcuuccccggcgagcgcgggcuccccggcgcccagggggcccccggccugaagggcggggagggcccgcaggggccgcccggccccguggggagcccgggcgagcggggcuccgccgggaccgcgggccccaucgggcugcccggccgccccgggccgcaggggccgcccggccccgccggggagaagggcgccccgggggagaagggcccccaggggcccgccggccgggacggcguccaggggcccgugggccucccggggcccgccggccccgcgggcagccccggggaggacggcgacaagggggagaucggcgagccggggcagaagggcuccaagggcgacaagggggagaacgggccgcccgggccgcccggccugcaggggcccgugggcgcccccggcaucgccgggggcgacggggagccgggcccccgcgggcagcagggcauguucggccagaagggggacgagggcgcccggggguuccccggcccgcccgggcccaucggccugcagggccugcccgggccgcccggcgagaagggggagaacggcgacgucggccccauggggccgcccggcccgcccgggccccgcggcccccaggggcccaacggcgccgacggcccccaggggccgcccggcagcguggggagcgugggcggggucggcgagaagggcgagccgggggaggcgggcaaccccgggccgcccggcgaggccggggugggcggcccgaagggggagcggggcgagaagggggaggccgggccgcccggcgccgcggggccgcccggcgccaaggggccgcccggcgacgacgggccgaagggcaaccccggccccgugggguuccccggcgacccggggccgcccggcgagcccgggcccgccggccaggacggcgucgggggcgacaagggggaggacggcgaccccgggcagcccggcccgcccggccccuccggggaggccgggccgcccgggccgcccggcaagcgcgggccgcccggcgccgcgggcgccgaggggcggcagggcgagaagggggccaagggcgaggccggcgccgaggggccgcccggcaagaccgggcccgugggcccccaggggcccgcgggcaagcccggccccgaggggcuccgcggcaucccggggcccgugggcgagcaggggcugcccggcgccgccggccaggacgggcccccgggccccaugaagcugcccgucaccacguacugcaucgugagcaccggggagaucaagcucccccggcacuccccguucccccaccuccugaacaccaccuga

SEQ ID NO: 28509 - RNA, 873 nt, Artificial Sequence
  derived and/or modified sequence opt1 from COL11A2__Homo_sapiens__NP_001157243
auggagcgcugcagccggugccaccgccugcuccugcugcucccccuggugcugggccucuccgccgccccggggugggcgggcgccccgcccgucgacgugcugcgggcccugcgcuuccccagccucccggacggggugcggcgcgccaagggcaucugccccgccgacgucgcguaccggguggcccgccccgcccagcuguccgcccccacccggcagcuguuccccgggggcuuccccaaggacuucagccuccugaccgugguccgcacgcggcccggccugcaggcgccccuccugacccuguacuccgcccagggggugcgccagcucggccuggagcuggggcggccggugcgcuuccucuacgaggaccagaccggccggccccagccgcccagccagcccgucuuccgcgggcugucccuggccgacggcaaguggcaccggguggccguggccgucaagggccagagcgugacccucaucguggacugcaagaagcgcgucacgcggccccugccccgcuccgcgcggcccgugcuggacacccacggggugaucaucuucggcgcccgcauccucgacgaggaggucuucgagggggacgugcaggagcuggccaucgugccgggcguccaggccgccuacgagagcugcgagcagaaggagcuggagugcgagggcgggcagcgcgagcggccccagaaccagcagccccaccgcgcgcagcggagcccccagcagcagccgucccgccuccaccggccccagaaccaggagccccagucccaggugcgcgagcugggcgagcccccgagcgccgcccacccccgggaggggcgccaccccggcaucuccccgcccuga

SEQ ID NO: 28510 - RNA, 9192 nt, Artificial Sequence
  derived and/or modified sequence opt1 from COL12A1__Homo_sapiens__NP_004361
augcgcagccggcugccgcccgcccucgccgcgcugggcgccgcccugcuccugagcagcaucgaggccgagguggacccgcccagcgaccugaacuucaagaucaucgacgagaacaccgugcacaugagcugggccaagcccguggaccccaucgugggguaccgcaucaccguggaccccaccaccgacggccccaccaaggaguucacccucuccgcgagcacgaccgagacccugcuguccgagcucgugcccgagaccgaguacguggucaccaucaccagcuacgacgagguggaggaguccgugcccgucaucgggcagcugaccauccagaccggcagcuccacgaagcccguggagaagaagcccgggaagaccgagauccagaagugcagcguguccgccuggaccgaccuggucuuccucguggacggcagcugguccgugggccggaacaacuucaaguacauccuggacuucaucgccgcccuggucagcgcguucgacaucggggaggagaagacccgcgugggcgugguccaguacuccagcgacacgcggaccgaguucaaccucaaccaguacuaccagcgcgacgagcugcuggccgccaucaagaagauccccuacaagggcggcaacaccaugaccggggacgccaucgacuaccucgugaagaacacguucaccgaguccgccggcgcgcgggugggcuuccccaaggucgccaucaucaucaccgacggcaagucccaggacgagguggagauccccgcccgcgagcugcggaacgugggcgucgagguguucagccuggggaucaaggccgccgacgcgaaggagcucaagcagaucgccuccacccccagccugaaccacgucuucaacguggccaacuucgacgccaucguggacauccagaacgagaucaucucccaggucugcagcggcguggacgagcagcugggcgagcucguguccggggaggaggucguggagccgcccagcaaccugaucgccauggagguguccagcaaguacgucaagcugaacuggaaccccucccccagccccgugacgggcuacaaggugauccucacccccaugaccgcggggucccgccagcacgcccugagcgucggcccccagaccacgacccuguccgugcgggaccucagcgccgacaccgaguaccagaucuccgugagcgccaugaaggggaugaccuccagcgagcccaucuccaucauggagaagacgcagcccaugaagguccagguggagugcagccgcggcguggacaucaaggccgacaucgucuuccugguggacggcagcuacuccaucgggaucgcgaacuucgugaagguccgggccuuccuggaggugcucgucaagagcuucgagaucucccccaaccgcguccagaucagccuggugcaguacucccgggacccccacaccgaguucacccugaagaaguucaccaagguggaggacaucaucgaggccaucaacacguuccccuaccgcggcgggagcaccaacaccggcaaggccaugaccuacguccgggagaagaucuucgugcccuccaaggggagccgcuccaacgugcccaaggucaugauccucaucaccgacggcaagagcuccgacgcguuccgggaccccgccaucaagcugcgcaacagcgacguggagaucuucgccgugggcgucaaggacgccgugcgguccgagcuggaggccaucgcgagcccgcccgccgagacgcacguguucaccgucgaggacuucgacgccuuccagcgcaucuccuucgagcucacccagagcaucugccugcgcaucgagcaggagcuggccgccaucaagaagaaggcguacgugccgcccaaggaccucuccuucagcgaggugaccagcuacggguucaagacgaacuggucccccgccggcgagaacgucuucagcuaccacaucaccuacaaggaggccgccggggacgacgaggugaccguggucgagcccgccuccagcaccuccguggugcugagcucccugaagcccgagacgcucuaccuggucaacgugaccgcggaguacgaggacggcuucagcaucccccuggccggggaggagaccaccgaggaggugaagggcgcgccccggaaccucaaggucacggacgagaccaccgacuccuucaagaucaccuggacgcaggcccccggccgcgugcugcgguaccgcaucaucuaccggcccguggccggcggcgagagccgcgaggucaccacgccgcccaaccagcggcgccggacccuggagaaccugauccccgacacgaaguacgagguguccgucauccccgaguacuucagcgggcccggcacgccccucaccggcaacgccgccaccgaggaggugcgcgggaacccccgggaccugcgcguguccgaccccacgaccagcaccaugaagcuguccuggagcggcgcccccgggaaggucaagcaguaccucgugaccuacacgcccguggccggcggggagacccaggaggucaccgugcggggcgacaccacgaacaccgugcugcagggccugaaggaggggacccaguacgcgcucuccgucaccgcccuguacgccagcggcgccggggacgcccuguucggcgaggggacgacccucgaggagcgcggcagcccccaggaccuggugaccaaggacaucaccgacaccuccaucggcgcguacuggacgagcgcccccgggauggugcggggcuaccgcgucuccuggaagucccuguacgacgacguggacaccggggagaagaaccuccccgaggacgccauccacaccaugaucgagaaccugcagcccgagaccaaguaccggaucuccguguucgccacguacagcuccggcgagggggagccccugaccggcgacgccaccaccgagcucagccaggacuccaagacgcugaaggucgacgaggagaccgagaacaccaugcgcgugaccuggaagcccgcgcccggcaagguggucaacuaccgggugguguaccgcccccacgggcgcggcaagcagauggucgccaaggugccgcccacggugaccagcaccguccugaagcggcuccagccccagaccacguacgacaucaccgugcugccgaucuacaagaugggggagggcaagcugcgccagggguccggcaccaccgccagccgguucaagagcccccggaaccucaagacgagcgaccccaccauguccagcuuccgggugaccugggagcccgccccgggcgaggucaagggguacaaggugaccuuccaccccacgggcgacgaccgccggcugggggagcugguggucggccccuacgacaacaccguggugcucgaggagcugcgcgcgggcaccaccuacaaggucaacguguucgggauguucgacggcggggaguccagcccccuggugggccaggagaugacgacccucuccgacaccaccgucaugccgauccugagcuccgggauggagugccugacgcgggccgaggccgacaucgugcuccugguggacggcagcuggagcaucggccgcgccaacuuccggaccguccgcuccuucaucagccggaucguggagguguucgacaucgggcccaagcgcguccagaucgcccuggcgcaguacuccggcgacccccggaccgaguggcagcucaacgcccaccgcgacaagaagucccugcugcaggccguggccaaccuccccuacaagggcggcaacacccugacggggauggcccugaacuucauccggcagcagaacuuccgcacccaggcgggcaugcggccgcgcgcccggaagaucggcgugcucaucaccgacgggaagucccaggacgacgucgaggcccccagcaagaagcugaaggacgagggcguggagcuguucgccaucgggaucaagaacgccgacgagguggagcucaagaugaucgcgaccgaccccgacgacacccacgccuacaacgucgccgacuucgagucccugagccgcaucguggacgaccugacgaucaaccucugcaacuccgugaagggccccggggaccuggaggccccgagcaaccuggucaucuccgagcgcacccaccggagcuuccgcguguccuggaccccgcccagcgacuccgucgaccgguacaagguggaguacuaccccgugagcggcggcaagcgccaggaguucuacgucucccggauggagaccagcacggugcucaaggaccugaagcccgagaccgaguacguggucaacguguacuccguggucgaggacgaguacagcgagccccugaaggggaccgagaagacccuccccgugcccguggucagccugaacaucuacgacgugggcccgacgaccaugcacgugcaguggcagcccgucgggggcgccaccggcuacauccuguccuacaagcccgugaaggacaccgagccgacgcgccccaaggaggugcggcucgggcccaccgucaacgacaugcagcugaccgaccuggugcccaacaccgaguacgcggugacgguccaggccgugcuccacgaccugaccagcgagccggugaccguccgcgaggugacccugccccucccccggccccaggaccugaagcugcgcgacgugacgcacuccaccaugaacgucuucugggagccggugcccggcaaggugcggaaguacaucguccgcuacaagacccccgaggaggacgugaaggagguggaggucgaccggagcgagaccuccacgagccucaaggaccuguucucccagacccuguacaccgugagcguguccgccguccacgacgagggggagagcccgcccgugaccgcccaggagacgacccgccccgugcccgcgcccaccaaccucaagaucaccgaggucacguccgagggcuuccgggggaccugggaccacggcgccagcgacgugucccuguaccgcaucaccugggcccccuucggcagcuccgacaagauggagaccauccugaacggggacgagaacacgcucguguucgagaaccugaaccccaacaccaucuacgaggucagcaucaccgccaucuaccccgacgaguccgagagcgacgaccugaucggcuccgagcggacccuccccauccugacgacccaggcccccaagagcgggccccgcaaccuccagguguacaacgcgaccagcaacucccugaccgugaagugggaccccgccagcggccggguccagaaguaccgcaucaccuaccagcccuccacgggggagggcaacgagcagaccaccaccaucggcgggcgccagaacagcguggugcugcagaagcugaagccggacacgcccuacaccaucaccgucuccagccucuaccccgacggcgagggcggccggaugaccgggcgcggcaagacgaagccccugaacaccgugcggaaccugcgcguguacgacccguccaccagcacccucaacguccggugggaccacgccgagggcaacccccgccaguacaagcuguucuacgcccccgccgcgggcggcccggaggagcuggugcccauccccgggaacacgaacuacgccauccuccggaaccugcagcccgacaccuccuacaccgucaccguggugccggucuacacggagggcgacgggggccgcaccagcgacaccggccggacccugaugcgcgggcucgcccggaacguccagguguacaaccccacgcccaacucccuggacguccgcugggaccccgccccgggccccgugcugcaguaccggguggucuacagccccguggacgggacccgccccuccgagagcaucguggucccgggcaacacccggauggugcaccucgagcgccugauccccgacacccuguacuccgugaaccucgucgcccuguacagcgacggcgaggggaaccccucccccgcgcagggccggacgcugccgcgcagcgggccccggaaccugcgcguguucggcgagaccaccaacucccucagcguggccugggaccacgccgacgggcccguccagcaguaccggaucaucuacagccccaccgugggcgacccgaucgacgaguacacgaccgugcccggccgccgcaacaacgucauccugcagccccugcagcccgacaccccguacaagaucaccgugaucgccguguacgaggacggggacggcgggcaccucacgggcaacgggcggaccgucggccugcugccgccccagaacauccacaucuccgacgagugguacacccgcuuccgggugagcugggacccgucccccagccccgugcucggcuacaagaucgucuacaagcccgugggguccaacgagccgauggaggcguucgugggcgagaugaccagcuacacgcugcacaaccugaaccccuccaccaccuacgacgucaacguguacgcccaguacgacagcgggcucuccgugccccugaccgaccagggcaccacgcuguaccucaacgucaccgaccugaagaccuaccagaucgggugggacaccuucugcgugaaguggagcccccaccgcgccgccacguccuaccggcugaagcucagcccggccgacggcacccgcggccaggagaucaccgugcggggguccgagaccagccacugcuucacgggccugucccccgacaccgacuacggggucaccguguucgugcagacccccaaccuggagggccccggggucagcgugaaggagcacacgaccgugaagccgaccgaggcgcccaccgagccgcccacgcccccgccgccgcccaccaucccgcccgcccgcgacgucugcaagggcgccaaggccgacaucguguuccucaccgacgccuccuggagcaucggcgacgacaacuucaacaagguggucaaguucaucuucaacaccgugggcggcuucgacgagaucagccccgcggggauccagguguccuucguccaguacagcgacgaggugaaguccgaguucaagcugaacacguacaacgacaaggcccuggcccucggcgcccugcagaacauccgguaccgcggcgggaacacccggaccggcaaggcccugaccuucaucaaggagaaggugcucacgugggagagcgggaugcgcaagaacguccccaaggugcuggucguggugaccgacggccggucccaggacgaggucaagaaggcggcccuggugauccagcagagcggguucuccguguucgucgugggcguggccgacgucgacuacaacgagcucgccaacaucgcgagcaagcccuccgagcgccacguguucaucguggacgacuucgagagcuucgagaagaucgaggacaaccugaucaccuucgucugcgagaccgccacguccagcugcccccugaucuaccucgacggcuacaccucccccggguucaagaugcuggaggccuacaaccugaccgagaagaacuucgccagcgugcagggcgugucccucgagagcggguccuuccccagcuacuccgccuaccggauccagaagaacgcguucgucaaccagcccaccgccgaccugcaccccaacggccugccgcccagcuacacgaucauccuccuguuccgccugcuccccgagacccccagcgaccccuucgccaucuggcagaucaccgaccgggacuacaagccccaggugggggugaucgccgaccccuccagcaagacccuguccuucuucaacaaggacacgcgcggcgagguccagaccgugaccuucgacaccgaggaggugaagacccuguucuacggcagcuuccacaagguccacaucguggugacguccaagagcgucaagaucuacaucgacugcuacgagaucaucgagaaggacaucaaggaggccgggaacaucaccaccgacggcuacgagauccucgggaagcugcugaagggcgagcggaaguccgcggccuuccagauccagagcuucgacaucgugugcucccccguguggaccagccgcgaccgcugcugcgacaucccgucccggcgcgacgaggggaagugccccgccuuccccaacagcugcacgugcacccaggacuccgucggcccgcccgggccgcccgggcccgccggcgggcccggcgccaagggcccccgcggggagcgcggcaucagcggggcgaucgggccgcccgggccgcggggcgacaucgggccgcccgggccccagggcccgcccgggccccagggccccaacgggcucuccaucccgggcgagcagggccgccaggggaugaagggcgacgccggggagcccggccugcccgggcggaccggcaccccgggccugcccgggccgcccggcccgauggggccgcccggcgaccgcggguucacgggcaaggacggcgccauggggccccggggcccgcccgggccgcccggcagcccgggcucccccggggugaccggccccagcgggaagcccggcaagccgggggaccacggccgccccggccccuccgggcucaagggcgagaagggggaccggggcgacaucgccagccagaacaugaugcgcgccguggcgcggcaggucugcgagcagcugaucagcgggcagaugaaccgcuucaaccagaugcugaaccagauccccaacgacuaccaguccagccggaaccagccggggccgcccggcccgcccgggccgcccggcuccgccggggcccgcggcgagcccgggcccggcggccggcccggguuccccggcaccccggggaugcaggggccgcccggcgagcgcgggcuccccggcgagaagggggagcggggcaccgggagcuccggcccgcgcggccugcccgggccgcccggcccgcagggggagagccggacggggccgcccggguccaccggcagccgcggcccgcccgggccgcccggccgccccgggaacuccggcauccgggggccgcccgggccgcccggcuacugcgacagcucccagugcgccagcauccccuacaacgggcagggcuaccccggguccggcuga

SEQ ID NO: 28511 - RNA, 2154 nt, Artificial Sequence
  derived and/or modified sequence opt1 from COL13A1__Homo_sapiens__NP_001123575
augguggccgagcgcacccacaaggccgcggccaccggcgcccgggggcccggcgagcugggggccccgggcacggucgcccucguggcggcccgcgccgagcggggggcccgccugcccagccccggcuccugcggccugcucacccuggcgcugugcagccucgcccugucccugcucgcccacuuccggaccgccgagcugcaggcccgcgugcugcggcucgaggcggagcgcggggagcagcagauggagaccgccauccugggccgggucaaccagcugcucgacgagaaguggaagcugcacagccgccggcgccgggaggcccccaagacguccccggggugcaacugcccccccggccccccggggcccaccggccgccccggccugcccggggacaagggcgccaucgggaugccgggccgggugggcagccccggggacgccggccucuccaucaucgggccccgcggccccccggggcagcccggcacccggggcuuccccggguuccccggcccgaucgggcuggacggcaagcccgggcaccccggccccaagggcgacauggggcugaccggcccgcccgggcagcccggcccccaggggcagaagggcgagaagggccagugcggggaguacccgcaccgcgagugccucagcuccaugcccgcggcccugcggagcucccagaucaucgcccugaagcuccugccccugcucaacagcgugcgccuggccccgccccccgucaucaagcggcgcacguuccagggcgagcagucccaggccagcauccaggggcccccgggcccccccggccccccggggcccuccggcccccuggggcaccccggccucccggggcccaugggcccccccggccugccggggccccccggccccaagggggacccgggcauccagggguaccacggccgcaagggcgagcgggggaugcccggcaugcccgggaagcacggcgcgaagggggcccccggcaucgccguggccggcaugaagggggagccgggcauccccgggaccaagggcgagaagggggccgagggcagccccggccugccggggcuccugggccagaagggggagaagggcgacgcgggcaacuccaucgggggcgggcgcggcgagcccgggccccccggccugccgggcccccccgggcccaagggcgaggccgggguggacggccaggucgggccgcccggccagcccggcgacaagggggagcggggcgccgccggggagcagggccccgacgggccgaagggcagcaagggcgagcccgggaagggcgagaugguggacuacaacgggaacaucaacgaggcgcuccaggagauccgcacccuggcccugaugggcccccccggccucccggggcagaucggcccccccggggcccccggcaucccggggcagaagggcgagaucggccugcccgggccccccggccacgacggggagaagggcccgcgggggaagcccggcgacaugggcccccccgggccgcagggcccccccgggaaggacggcccgcccggggugaagggcgagaacggccaccccgggucccccggcgagaagggggagaagggcgagaccgggcaggccggcagcccgggcgagaagggggaggccggcgagaaggggaaccccggcgcggagguccccggccugcccgggccggagggcccccccgggcccccgggccuccagggggugcccggccccaagggcgaggccgggcuggacggcgccaagggggagaagggcuuccagggggagaagggcgaccgcggcccccuggggcucccgggcgccagcgggcuggacggccggcccgggccccccggcacgccgggccccaucggggugcccggccccgccgggccgaagggcgagcgcggguccaagggcgaccccggcaugaccgggcccaccggcgcggccgggcugcccggccuccacggcccgcccggggacaagggcaaccggggggagcgcggcaagaaggggagccggggccccaagggcgacaagggggaccagggcgccccggggcuggacgcccccugcccccugggcgaggacgggcugcccguccagggcugcuggaacaaguga

SEQ ID NO: 28512 - RNA, 5343 nt, Artificial Sequence
  derived and/or modified sequence opt1 from COL14A1__Homo_sapiens__XP_005251116
augaagaucuuccagcggaagaugcgguacuggcugcugccgcccuuccuggccaucguguacuucugcaccaucgugcagggccagguggccccgcccacccgccugcgguacaacgugaucagccacgacuccauccagaucagcuggaaggcgccccgcggcaaguucggcggcuacaagcuccuggucacccccaccuccggcgggaagaccaaccagcugaaccuccagaacaccgccacgaaggccaucauccagggccugaugcccgaccagaacuacaccgugcagaucaucgccuacaacaaggacaaggagagcaagcccgcccagggccaguuccggaucaaggaccuggagaagcgcaaggaccccaagccccgggugaaggucguggaccgcgggaacggcucccggcccagcucccccgaggaggugaaguucgucugccagacccccgcgaucgccgacaucgugauccucguggacgggagcugguccaucggccgcuucaacuuccggcugguccgccacuuccuggagaaccucgugaccgccuucgacguggggagcgagaagacgcggaucggccuggcccaguacuccggcgacccccgcaucgaguggcaccugaacgcguucagcaccaaggacgaggucaucgaggccgugcggaaccuccccuacaagggcggcaacacccugaccgggcuggcccucaacuacaucuucgagaacuccuucaagcccgaggccggcagccgcacgggcguguccaagaucgggauccugaucaccgacggcaagagccaggacgacaucaucccgcccucccggaaccugcgcgagagcggggucgagcuguucgccaucggcgugaagaacgcggacgugaacgagcugcaggagaucgccuccgagcccgacagcacccacgucuacaacguggccgaguucgaccugaugcacaccguggucgagagccucacgcggacccugugcucccgcguggaggagcaggaccgggagaucaaggccagcgcccacgcgaucaccgggccgcccaccgagcugaucacguccgaggucaccgcccgcagcuucauggugaacuggacccacgcccccggcaacguggagaaguaccgcgucguguacuaccccacccggggcgggaagcccgacgagguggucguggacggcacgguguccagcaccguccucaagaaccugaugucccugaccgaguaccagaucgccguguucgccaucuacgcgcacaccgccagcgaggggcuccgcggcacggagaccacccuggcccugcccauggccuccgaccuccugcuguacgacgugaccgagaacagcaugcgggucaagugggacgccgugcccggggcguccggcuaccucauccuguacgcgccccucacggagggccucgccggggacgagaaggagaugaagaucggcgagacccacaccgacaucgagcugagcgggcugcuccccaacaccgaguacacggugaccgucuacgccauguucggcgaggaggccuccgaccccgugaccgggcaggagaccacccuggcccugagcccgccccgcaaccuccggaucuccaacgugggcagcaacuccgcccgccugacgugggaccccaccagccggcagaucaacggcuaccgcaucgucuacaacaacgccgacgggaccgagaucaacgagguggagguggaccccaucaccacguucccccugaagggccucacgccccucaccgaguacaccaucgccaucuucuccaucuacgacgaggggcagagcgagccccugacgggcgucuucaccaccgaggaggugcccgcgcagcaguaccuggagaucgacgaggugaccacggacagcuuccgggucaccuggcacccccucuccgccgacgagggccugcacaagcugauguggauccccguguacgggggcaagaccgaggaggugguccucaaggaggagcaggacagccacgugaucgaggggcuggagcccggcaccgaguacgaggugucccugcucgccguccuggacgacgggagcgaguccgagguggugacggccgucggcaccacccuggacagcuucuggaccgagcccgccacgaccaucgugcccaccaccuccgugacgagcgucuuccagaccggcauccgcaaccucguggugggggacgagaccaccuccagccugcgggucaagugggacaucuccgacagcgacgugcagcaguuccgcgugacguacaugaccgcgcagggcgaccccgaggaggaggucaucgggaccgugauggugcccggcucccagaacaaccugcuccugaagccccugcuccccgacaccgaguacaaggucacggugacccccaucuacaccgacggggagggcgugagcgucuccgcccccggcaagacccugccgagcuccgggccccagaaccugcgggugagcgaggagugguacaaccgccuccggaucacgugggacccgcccagcuccccggugaagggcuaccgcaucgucuacaagcccgugagcguccccgggcccacccuggagaccuucgugggcgccgacaucaacaccauccugaucaccaaccuccuguccgggauggacuacaacgugaagaucuucgccagccaggccuccggcuucagcgacgcgcugacgggcauggucaagacccucuuccugggggugaccaaccugcaggccaagcacguggagaugaccucccucugcgcccacuggcagguccaccggcacgccacggcguaccgcguggugaucgagagccugcaggaccggcagaagcaggaguccaccgucggcgggggcaccacccgccacugcuucuacgggcugcagccggacagcgaguacaagaucuccguguacacgaagcuccaggagaucgagggccccagcguguccaucauggagaagacccagagccugcccacccgcccgcccaccuucccgcccacgaucccgcccgccaaggaggucugcaaggccgccaaggccgaccugguguucaugguggacggcuccuggagcaucggggacgagaacuucaacaagaucaucuccuuccucuacagcaccgucggcgcgcugaacaagaucgggaccgacggcacccagguggccauggugcaguucacggacgacccccggaccgaguucaagcugaacgccuacaagaccaaggagacccuccuggacgccaucaagcacaucuccuacaagggcgggaacacgaagaccggcaaggccaucaaguacguccgcgacacccuguucaccgcggagagcgggacgcggcgcggcauccccaaggugaucguggucaucaccgacgggcggagccaggacgacgugaacaagaucucccgcgagaugcagcucgacggcuacagcaucuucgccaucggcguggccgacgccgacuacuccgagcuggucagcaucggguccaagccgagcgcccggcacguguucuucguggacgacuucgacgcguucaagaagaucgaggacgagcugaucaccuucgucugcgagaccgccuccgccacgugccccguggugcacaaggacggcaucgaccucgccggguucaagaugauggagauguucggccuggucgagaaggacuucagcuccguggagggggugagcauggagcccggcaccuucaacgucuuccccugcuaccagcugcacaaggacgcgcucgugucccagccgacccgcuaccugcaccccgagggccugcccagcgacuacaccaucuccuuccucuuccggauccugcccgacacgccgcaggagcccuucgcccugugggagauccucaacaagaacagcgacccccuggugggggucauccuggacaacggcgggaagacccucaccuacuucaacuacgaccaguccggcgacuuccagaccgugacguucgaggggcccgagauccgcaagaucuucuacggcagcuuccacaagcugcacaucguggucuccgagacccuggugaagguggucaucgacugcaagcaggucggcgagaaggccaugaacgccagcgccaacaucaccuccgacgggguggagguccucggcaagauggugcggagccgcgggccgggcggcaacagcgcgcccuuccagcugcagauguucgacaucgugugcuccaccagcugggccaacaccgacaagugcugcgagcugcccgggcuccgggacgacgaguccugccccgaccugccgcacagcugcuccugcagcgagacgaacgaggucgcccugggccccgccgggccgcccggcgggccgggccuccgcggccccaaggggcagcagggcgagcccgggccgaagggccccgacgggccccggggcgagaucggccugcccgggccgcaggggccgcccgggccccagggcccguccgggcugagcauccagggcaugcccggcaugcccggggagaagggcgagaagggggacaccggccuccccgggccgcagggcauccccggcggggugggcucccccgggcgcgacggcagccccggccagcgggggcugccgggcaaggacggguccagcgggccgcccgggcccccgggccccaucggcauccccgggacccccggcgugccggggaucaccggcuccauggggccccagggcgcccuggggccgcccggggucccgggcgcgaagggggagcgcggcgagcggggcgaccuccagagccaggccauggugcgcuccgucgcccgccaggugugcgagcagcugauccagagccacauggcccgcuacacggccauccugaaccagauccccucccacagcuccagcauccgcaccgugcagggcccgcccggcgagcccgggcggcccggcagccccggggcgcccggcgagcaggggccgcccggcacccccggcuucccggggaacgccggcguccccgggacccccggcgagcgcggccucacggggaucaagggcgagaaggggaaccccggcguggggacccagggcccgcgggggccgcccgggcccgccggcccguccggggagagccgccccggcucccccgggcccccgggcagccccggcccccgggggcccccgggccaccugggggugcccggcccccaggggccguccggccagcccggcuacugcgaccccagcuccugcagcgccuacgggguccgcgaccugauccccuacaacgacuaccagcacuga

SEQ ID NO: 28513 - RNA, 4167 nt, Artificial Sequence
  derived and/or modified sequence opt1 from COL15A1__Homo_sapiens__XP_011516516
auggccccccgccggaacaacggccagugcuggugccugcucaugcugcugagcguguccaccccgcuccccgccgucacccagacgcgcggggcgaccgagaccgccagccagggccaccuggaccugacccagcucaucggggugccccugcccuccagcguguccuucgucacgggcuacgggggcuucccggccuacagcuucggccccggggccaacgugggccggcccgcccgcacccugauccccuccaccuucuuccgggacuucgcgaucagcguggucgugaagccguccagcacccgcgggggcgugcucuucgccaucacggacgccuuccagaaggucaucuaccuggggcugcggcucuccggcguggaggacggccaccagcgcaucauccuguacuacaccgagcccgggagccacgugucccaggaggccgcggccuucagcguccccgugaugacccaccgguggaaccgcuucgccaugaucgugcagggcgaggaggucacccugcucgugaacugcgaggagcacucccggauccccuuccagcgcagcucccaggcccuggccuucgagagcuccgcggggaucuucaugggcaacgccggcgccacggggcuggagcgguucaccggcagccuccagcagcugaccgugcacccggacccccgcacccccgaggagcugugcgaccccgaggagagcuccgccagcggggagacguccggccuccaggaggccgacggggucgcggagauccuggaggccgugaccuacacccaggccagcccgaaggaggccaagguggagcccaucaacaccccccccacgccguccagccccuucgaggacauggagcuguccggcgagcccguccccgagggcacccucgagaccaccaacaugagcaucauccagcacuccagcccgaagcagggguccggcgagauccugaacgacacgcuggagggggugcacagcguggacggcgaccccaucaccgacuccgggagcggcgccggcgcguuccucgacaucgccgaggagaagaaccuggccgccaccgccgcggggcuggccgagguccccaucuccaccgccggcgaggccgaggcgagcuccgugcccacggggggcccgacccucagcauguccaccgagaaccccgaggagggggucacccccggcccggacaacgaggagcggcuggccgccacggccgccggcgaggcggaggcccuggccagcaugcccggggagguggaggccagcggcguggcccccggggagcucgaccuguccaugagcgcgcagucccugggcgaggaggccaccgucggccccagcuccgaggacagccucaccaccgccgccgccgcgacggaggugucccugagcaccuucgaggacgaggaggccuccggggugccgaccgacggccuggccccccucaccgccaccauggcgcccgagcgcgccgucacgagcgggcccggcgacgaggaggaccuggccgccgccaccaccgaggagccgcugaucaccgcggggggcgaggaguccggcagccccccccccgacgggccgccccucccccugcccacgguggccccggagcgguggaucacccccgcccagcgcgagcacgugggcaugaaggggcaggccggccccaagggggagaagggcgacgccggcgaggagcugcccgggccgcccgagcccuccggccccgucgggccgaccgcgggcgccgaggccgaggggagcggccucggcuggggguccgacgugggcagcggguccggcgaccugguggggagcgagcagcugcuccggggcccccccggcccgcccgggccccccggccugccggggauccccggcaagcccggcaccgacgucuucauggggcccccgggcagccccggggaggacggccccgccggggagcccggcccgcccggccccgaggggcagcccggcguggacggggccacgggccugccggggaugaagggcgagaagggcgcgcgcgggcccaacggcuccgugggggagaagggcgaccccgggaaccggggccugcccggcccgcccgggaagaagggccaggccgggccccccggcgucaugggcccgcccgggccccccggcccgcccgggcccccgggccccgggugcaccaugggccucggcuucgaggacaccgaggggagcggcuccacccagcugcugaacgagcccaagcucagccgccccacggccgccaucgggcugaagggcgagaagggggaccgcggcccgaagggcgagcgggggauggacggcgcguccaucguggggccccccggcccccgcgggccgcccggccacaucaaggugcugagcaacucccucaucaacaucacccacggcuucaugaacuucagcgacauccccgagcuggucgggcccccgggccccgacgggcugcccggccuccccggguucccgggcccccggggccccaagggggacaccggccugcccggguucccgggccugaagggcgagcagggggagaagggcgagcccggggccauccucaccgaggacaucccccuggagcgccugaugggcaagaagggggagcccggcaugcacggcgccccggggcccaugggccccaaggggcccccgggccacaagggggaguucggccuccccggccggcccgggcgcccgggccugaacgggcugaagggcacgaagggggaccccggcgugaucaugcagggcccccccgggcucccgggcccccccgggcccccgggcccccccggggccgugaucaacaucaagggcgccaucuuccccaucccgguccggccccacugcaagaugcccguggacaccgcgcaccccggcuccccggagcugaucaccuuccacggggugaagggcgagaaggggagcuggggccugcccggcuccaagggggagaagggcgaccagggggcccagggcccccccgggccgccccucgaccuggccuaccugcgccacuuccucaacaaccugaagggcgagaacggcgacaagggguucaagggcgagaagggggagaagggcgacaucaacgggagcuuccugauguccggcccccccggccucccggggaaccccggccccgccgggcagaagggcgagaccgucguggggccgcagggcccccccggcgcccccgggcugccgggcccccccggguucggccggcccggcgacccggggccccccggccccccggggccccccggccccccggcgauccugggggccgccguggcccuccccggcccccccggcccgcccgggcagcccggccugcccgggagccgcaaccuggucacggccuucuccaacauggacgacaugcuccagaaggcgcaccuggugaucgagggcaccuucaucuaccugcgggacagcaccgaguucuucauccgcgugcgggacggguggaagaagcuccagcugggcgagcugaucccgauccccgccgacuccccccccccgcccgcccucagcuccaacccccaccagcugcugccgccccccaaccccaucagcagcgccaacuacgagaagccggcccuccaccuggcggcccugaacaugcccuucuccggcgacauccgcgccgacuuccagugcuucaagcaggcccgggcggccgggcuccugagcaccuaccgcgccuuccuguccagccaccuccaggaccuguccacgaucguccggaaggccgagcgcuacagccugcccaucgugaaccucaagggccaggugcuguucaacaacugggacuccaucuucagcgggcacggcgggcaguucaacaugcacauccccaucuacuccuucgacggccgggacaucaugaccgacccgagcuggccccagaaggucaucuggcacggcuccagcccccacggggugcgccugguggacaacuacugcgaggccuggcgcaccgcggacaccgccgucacgggccucgccuccccccugagcaccgggaagauccuggaccagaaggccuacuccugcgccaaccggcucaucgugcugugcaucgagaacagcuucaugaccgacgcgcgcaaguga

SEQ ID NO: 28514 - RNA, 4692 nt, Artificial Sequence
  derived and/or modified sequence opt1 from COL16A1__Homo_sapiens__XP_011539026
augugggugagcugggcccccggccuguggcuccugggccugugggccaccuucggccacggcgcgaacaccggcgcccagugcccgcccucccagcaggagggccucaagcuggagcacagcuccagccugcccgccaacgucacgggcuucaaccucauccaccgccugucccugaugaagaccagcgccaucaagaagauccggaaccccaagggcccccucauccugcgccugggcgccgcgcccgugacccagcccacccggcgcguguucccccggggccuccccgaggaguucgcccugguccugacgcuccugcugaagaagcacacccaccagaagaccugguaccucuuccaggugaccgacgccaacggcuacccccagaucucccuggaggugaacagccaggagcgcucccuggagcuccgggcccagggccaggacggcgacuucgucagcugcaucuuccccgugccccagcuguucgaccugcgcuggcacaagcucaugcuguccguggcgggccgggucgccagcgugcacguggacugcuccagcgccuccagccagccccugggcccccgccggcccaugcgccccgucggccacguguuccucggccuggacgccgagcagggcaagcccguguccuucgaccugcagcagguccacaucuacugcgaccccgagcucgugcuggaggagggcugcugcgagauccugcccgccggcugcccgcccgagacgagcaaggcgcggcgcgacacccaguccaacgagcucaucgagaucaacccccagagcgaggggaagguguacacccggugcuucugccuggaggagccccagaacagcgaggucgacgcccagcugaccggccgcaucucccagaaggccgagcggggcgccaaggugcaccaggagacggccgcggacgagugcccgcccugcgugcacggcgcccgcgacagcaacgucacccucgcccccuccgggcccaagggcggcaagggggagcggggccugcccgggccgcccggcagcaagggggagaagggcgcccgcggcaacgacugcgugcggaucucccccgacgcgccccugcagugcgccgaggggcccaagggcgagaagggggagagcggcgcccucgggcccuccggccugcccggcagcaccggggagaagggccagaagggggagaagggcgacggcgggaucaagggcgugcccgggaagcccggccgcgacgggcgccccggcgagaucugcgucaucggccccaaggggcagaagggcgaccccggguucgugggccccgaggggcuggccggcgagcccgggccgcccgggcuccccgggccgcccgggaucggccugcccgggacccccggcgaccccggcgggccgcccggccccaagggggacaagggcuccagcgggauccccggcaaggagggccccgggggcaagcccgggaagcccggcgucaagggcgagaagggggaccccugcgaggugugcccgacgcugcccgagggcuuccagaacuucguggggcuccccggcaagcccgggcccaagggcgagcccggcgaccccguccccgcccggggcgacccgggcauccaggggaucaagggcgagaagggggagcccugccuguccugcagcuccguggugggcgcccagcaccuggucagcuccaccggcgcgagcggggacgugggcucccccggguucggccuccccgggcugccgggccgcgccggcgugcccgggcugaagggcgagaaggggaacuucggcgaggccggccccgccgggagccccggcccgcccgggcccgucggccccgcggggaucaagggcgccaagggcgagccgugcgagcccugccccgcccuguccaaccuccaggacggggacgugcggguggucgcccugcccggcccgagcggggagaagggcgagcccgggccgcccggcuucggccugccggggaagcagggcaaggccggggagcgcggccucaaggggcagaagggcgacgcgggcaaccccggggaccccggcaccccggggaccacgggccggcccgggcugagcggcgagcccggcgugcaggggcccgccggcccgaagggggagaagggccagcccggccugcccggggugcagggcccgcccgggcucaagggcguccagggggagcccggcccgcccggccgcggggugcagggcccccagggggagcccggcgcccccgggcugcccggcauccagggccugcccgggccccgggggccgcccgggccgaccggcgagaagggggcccagggcucccccggcgugaagggggccaccggccccgucgggcccccgggcgcgagcguguccgggccgcccggccgcgacggccagcaggggcagaccggccuccgggggacgcccggcgagaagggcccgcgcggggagaagggcgagcccggggagugcagcugccccucccagggcgaccugaucuucagcgggaugccgggcgcccccggccuguggaugggguccagcuggcagcccggcccccaggggccgcccggcauccccgggcccccggggccgcccggcgugcccgggcuccagggcgucccggggaacaacggccugcccgggcagcccggccugaccgccgagcucggcucccugcccaucgagcagcaccuccucaagagcaucugcggggacugcgugcagggccagcgggcccacccgggguaccugguggagaagggcgagaagggcgaccaggggauccccggcguccccgggcuggacaacugcgcccagugcuuccugucccuggagcgcccccgggcggaggaggcccgcggcgacaacagcgagggggacccgggcugcgugggcucccccgggcugcccggcccgcccgggcuccccggccagcggggcgaggagggcccgcccggcaugcgcgggagccccgggccgcccgggcccaucgggccgcccggguuccccggcgccgugggcucccccgggcugcccggccugcagggggagcggggccucaccgggcugaccggcgacaagggcgagcccgggcccccgggccagcccggguaccccggcgccacgggcccgcccgggcugcccggcaucaagggggagcgcggcuacaccgggagcgcgggcgagaagggcgagcccgggccgcccggcuccgaggggcuccccgggccgcccgggcccgccggcccccggggcgagcgcgggccccagggcaacagcggggagaagggcgaccagggguuccagggccagcccggcuucccggggccgcccggcccgcccggguuccccggcaaggucggcagccccgggccgcccggcccccaggccgagaagggguccgagggcauccgcgggcccagcggccugccgggcucccccgggccgcccggcccgcccgggauccagggccccgccgggcuggacggccucgacggcaaggacgggaagcccggccugcggggcgacccgggccccgccgggccgcccggccugaugggcccgcccggguucaagggcaagaccgggcaccccggccuccccgggccgaagggcgacugcggcaagcccgggccgcccggcagcaccgggcgcccgggcgcggagggcgagcccggggccaugggcccccaggggcggccggggccgcccgggcacgugggcccgcccgggccgcccgggcagcccggccccgccgggaucuccgccgugggccugaagggggaccgcggcgccacgggcgagcgggggcuggcgggccuccccgggcagcccggcccgcccgggcaccccgggccgcccggcgagcccgggaccgacggcgccgccgggaaggaggggccgcccggcaagcagggguucuacggcccgcccgggcccaagggcgaccccggggccgccggccagaagggccaggcgggggagaagggccgcgccgggaugcccggcgggcccggcaagagcggcuccauggggcccgucggcccgcccgggcccgccggcgagcgggggcaccccggcgcccccggcccgagcgggucccccggccugcccggggugcccggcagcaugggggacauggugaacuacgacgagaucaagcgcuucauccggcaggagaucaucaagauguucgacgagcgcauggcguacuacaccucccggaugcaguucccgauggagauggccgccgcccccggccgccccggcccgcccgggaaggacggcgcccccgggcggcccggcgcgcccggcagccccgggcugcccggccagaucgggcgcgagggccggcaggggcuccccggcguccgcggccugcccgggaccaagggcgagaagggggacaucggcaucgggaucgccggcgagaacggccugccggggccgcccggcccccaggggccgcccggcuacgggaagaugggcgccacgggccccauggggcagcagggcauccccgggaucccggggccgcccgggccgaugggccagcccggcaaggccgggcacugcaaccccuccgacugcuucggcgccaugcccauggagcagcaguacccgcccaugaagaccaugaaggggcccuucggcuga

SEQ ID NO: 28515 - RNA, 4494 nt, Artificial Sequence
  derived and/or modified sequence opt1 from COL17A1__Homo_sapiens__NP_000485
auggacgugaccaagaagaacaagcgcgacggcaccgaggucacggagcggaucgugaccgagaccgugaccacgcgccugaccagccuccccccgaaggggggcaccuccaacggguacgccaagaccgccagccugggcgggggcucccggcuggagaagcagagccucacgcacggcuccagcggguacaucaacuccaccggcagcacccgcgggcacgcguccaccagcuccuaccggcgcgcccacagccccgccuccacgcugcccaacagccccggcuccaccuucgagcggaagacccacgucacccgccacgccuacgaggggagcuccagcggcaacuccagcccggaguacccccggaaggaguucgccagcuccagcacgcgcggccggucccagacccgcgagagcgagauccgggugcgccugcaguccgcgagccccuccacccgguggaccgagcucgacgacgugaagcgccugcugaaggggagccgguccgccagcgucucccccacgcgcaacagcuccaacacccucccgauccccaagaagggcaccguggagaccaagaucgugacggccagcucccagagcgucuccgggaccuacgacgccaccauccuggacgcgaaccugcccagccacgugugguccagcacccuccccgccggcagcuccaugggcacguaccacaacaacaugaccacccagagcuccagccugcugaacaccaacgccuacuccgccgggagcguguucggcgucccgaacaacauggccuccugcagccccacgcuccaccccgggcuguccaccagcuccagcguguucggcaugcagaacaaccuggcgcccucccucaccacccugagccacgggacgaccaccaccuccaccgccuacggcgugaagaagaacaugccgcagagccccgccgccgucaacacgggcguguccaccagcgccgcgugcaccaccagcgugcaguccgacgaccugcuccacaaggacugcaaguuccugauccuggagaaggacaacacgcccgccaagaaggagauggagcuccugaucaugaccaaggacagcgggaaggucuucaccgccucccccgccagcaucgccgcgaccuccuucagcgaggacacgcugaagaaggagaagcaggccgccuacaacgccgacuccggccucaaggccgaggcgaacggggaccugaagaccgugagcaccaagggcaagaccacgaccgccgacauccacuccuacgggagcuccggcggcgggggcagcgggggcgggggcggcguggggggcgccgggggcggcccgugggggcccgcccccgcguggugccccugcggcuccugcugcagcugguggaaguggcugcucgggcugcugcucaccuggcugcugcuccugggccugcucuucgggcugaucgcccuggccgaggagguccggaagcucaaggcccgcguggacgagcuggagcggauccgccgcuccauccugccguacggcgacagcauggaccggaucgagaaggaccgccuccagggcauggcccccgcggccggggccgaccuggacaagaucggccugcacuccgacagccaggaggagcucuggauguucgugcggaagaagcugaugauggagcaggagaacgggaaccugcgcggcucccccgggcccaagggcgacaugggcagcccggggcccaagggcgaccggggguuccccggcaccccggggauccccggcccccugggccaccccgggccgcagggccccaaggggcagaagggcagcgucggggaccccggcauggagggccccauggggcagcgcggccgggaggggccgaugggcccccgcggcgaggccgggccccccggcuccggggagaagggcgagcggggggccgcgggcgagccgggcccccacgggccccccggcgugccggggagcgucggccccaagggguccagcggcucccccggcccccaggggccgcccggccccguggggcuccagggccugcgcggggaggugggccugcccggcgucaagggggacaagggcccgauggggccccccggcccgaagggcgaccagggggagaagggcccccgggggcucacgggcgagcccgggaugcgcggccugcccggcgccgugggggagccgggcgccaagggggccaugggccccgccgggcccgacggccaccagggcccccggggggagcagggccugaccgggaugccgggcauccgcgggccccccggccccagcggcgacccggggaagcccggccucaccgggccccagggcccccaggggcugccgggcacccccggccggcccgggaucaagggcgagcccggggcgccgggcaagaucgugacguccgagggcagcuccaugcugaccguccccgggccccccggcccgcccggggccaugggcccccccgggccgcccggcgcccccggcccggccgggcccgcgggccuccccgggcaccaggaggugcugaaccugcagggccccccggggccccccggcccccgcggcccgcccgggcccagcauccccggcccgcccgggccccggggccccccgggggagggccuccccggcccccccgggccgcccggcuccuuccugagcaacuccgagaccuuccugagcgggccccccggcccgcccgggccccccggcccgaagggcgaccaggggccccccggcccgcgcgggcaccagggcgagcagggccuccccggguucuccaccagcggcuccagcuccuucgggcugaaccugcagggcccccccgggccgcccggcccccagggccccaagggggacaagggcgacccgggggugcccggcgcccucgggauccccagcggccccagcgagggcggguccagcuccacgauguacgucagcggcccgcccgggccccccggcccgcccgggccccccggcuccaucagcuccagcggccaggagauccagcaguacaucuccgaguacaugcagagcgacuccauccggagcuaccuguccggggugcagggcccgcccgggccccccggcccgcccggccccgugaccaccaucaccggggagacguucgacuacagcgagcuggccucccacgucgugagcuaccuccgcaccuccggcuacggggugagccuguucuccagcagcaucuccagcgaggacauccuggccguccuccagcgcgacgacgugcggcaguaccugcgccaguaccugaugggcccgcgggggccccccggccccccgggcgccuccggggacggcagccuccugucccuggacuacgcggagcucagcucccgcauccugagcuacauguccagcuccgggaucagcaucggccugcccgggccccccggcccgcccggccuccccgggaccuccuacgaggagcugcugagccuccugcggggcuccgaguuccgcgggaucgugggccccccggggccccccggccccccgggcauccccgggaacgucuggagcuccaucagcguggaggaccuguccagcuaccuccacaccgccggccugagcuucauccccgggcccccgggcccccccgggcccccgggcccccggggcccccccgggguguccggcgcccuggccacguacgccgcggagaacagcgacuccuuccgcagcgagcucaucuccuaccugaccagcccggacguccgguccuucaucguggggccccccggcccgcccggcccccaggggcccccgggcgacagccgccugcucuccaccgacgccagccacucccgggggagcuccagcuccagccacuccagcuccgugcgccggggcagcagcuacuccagcuccaugagcaccgggggcggcggggccggcucccugggggccggcggggccuucggcgaggcggccggcgaccgcgggcccuacggcacggacaucgggcccggcgggggcuacggcgccgccgcggaggggggcauguacgccgggaacggcggccugcucggggccgacuucgccggcgaccuggacuacaacgagcuggccguccgggugagcgaguccaugcagcgccaggggcuccugcagggcauggcguacaccgugcaggggcccccgggccagcccggcccccaggggcccccgggcaucagcaaggucuucuccgccuacagcaacgugaccgccgaccugauggacuucuuccagaccuacggggccauccagggcccccccgggcagaagggcgagaugggcacccccgggccgaagggcgaccgggggcccgccggcccccccgggcacccgggcccccccggcccccgcgggcacaagggcgagaagggggacaagggcgaccagguguacgcggggcggcgccggcgccgcuccaucgccgucaagccguga

SEQ ID NO: 28516 - RNA, 4551 nt, Artificial Sequence
  derived and/or modified sequence opt1 from COL18A1__Homo_sapiens__NP_085059
auggcccccuacccgugcggcugccacauccugcuccugcuguucugcugccucgccgcggcccgcgccaaccugcugaaccucaacuggcugugguucaacaacgaggacaccagccacgccgccaccacgauccccgagccccaggggccccugccggugcagcccaccgcggacaccaccacgcacgucaccccccggaacggcuccaccgagcccgccaccgccccggggagccccgagccccccuccgagcuccuggaggacggccaggacacgccgaccagcgccgagucccccgacgcgcccgaggagaacaucgccggggugggcgccgagauccugaacguggccaagggcauccgcagcuucguccagcucuggaacgacaccgugcccaccgagucccuggcccgggcggagacgcuggugcucgagaccccggucgggccccuggcccuggccggccccagcuccaccccccaggagaacgggaccacgcucuggccgagccgcggcauccccuccagccccggggcccacaccaccgaggccggcacccugcccgcgccgacgcccuccccccccagccugggccggccgugggccccccucaccgggcccuccgugccgccccccagcuccgagcgcaucagcgaggaggugggccugcugcagcuccugggggaccccccgccccagcaggucacccagaccgacgaccccgacgugggccuggccuacguguucggccccgacgccaacuccgggcaggucgcccgguaccacuucccgagccucuucuuccgcgacuucagccugcuguuccacauccggcccgcgacggagggccccggggugcucuucgccaucaccgacuccgcccaggccauggugcugcugggcgucaagcucagcggggugcaggacggccaccaggacaucucccugcuguacaccgagcccggcgccgggcagacccacacggcggccagcuuccgccucccggccuucgugggccaguggacccaccuggcccuguccgucgcggggggcuucguggcccucuacguggacugcgaggaguuccagcggaugccccuggcccgcagcucccgggggcuggagcucgagcccggcgccggccuguucgucgcccaggcggggggcgccgaccccgacaaguuccagggggugaucgccgagcugaaggugcgccgggacccgcaggucagccccaugcacugccucgacgaggagggcgacgacuccgacggggccagcggcgacuccggcagcgggcugggcgacgcccgcgagcugcuccgggaggagaccggggcggcccugaagccccgccugcccgccccgccccccgugaccacgcccccgcuggccggcggcuccagcaccgaggacucccggagcgaggaggucgaggagcagaccaccguggccucccucggggcgcagacgcugcccggcagcgacuccgugagcaccugggacgggagcguccgcacccccggcgggcgggugaaggagggcggccugaaggggcagaagggcgagccgggggugcccggcccccccgggcgcgccggcccgcccggcucccccugccuccccgggccgcccggccugcccugccccgucagcccgcuggggcccgccggccccgcccuccagaccgugcccgggccgcagggcccccccggccccccggggcgcgacggcacccccgggcgggacggcgagcccggggaccccggcgaggacggcaagccgggggacacgggcccccagggguuccccggcacccccggcgacguggggccgaagggcgacaagggggaccccggcgucggggagcgcggccccccgggcccccaggggccccccggcccgcccgggcccuccuuccggcacgacaagcugaccuucaucgacauggagggcagcggguucggcggcgaccuggaggcgcuccgcgggccccggggcuucccggggccccccggccccccgggggugcccggccugcccggcgagcccgggcgcuucggcgugaacuccagcgacgucccggggcccgccggccugcccggcgugcccgggcgggagggcccgcccggguuccccggccuccccgggccgcccggcccccccggccgcgaggggccgcccggccggaccgggcagaagggcucccugggggaggccggcgcccccggccacaaggggagcaagggcgccccggggcccgcgggcgcccgcggggaguccggccuggccggcgcccccgggcccgccggcccgcccgggccccccggcccgcccgggccccccggcccgggccuccccgcgggguucgacgacauggagggcagcgggggccccuucugguccacggcccggagcgccgacggcccccaggggccgcccggccugcccgggcugaagggcgaccccggggugccgggccuccccggcgccaagggggaggucggcgccgacggggugcccggcuuccccgggcugccgggccgcgagggcaucgcggggccccagggccccaagggggaccggggcucccgcggggagaagggcgacccgggcaaggacggggugggccagcccgggcugcccggccccccggggccccccggccccgucguguacgugagcgagcaggacggcuccguccucagcgugccggggcccgagggccggcccggguucgccggcuuccccggcccggccgggcccaagggcaaccugggguccaagggcgagcgcgggagccccggccccaagggcgagaagggggagccgggcagcaucuucucccccgacgggggcgcccuggggcccgcgcagaagggcgccaagggcgagcccggguuccggggcccgcccgggcccuacggccgccccggguacaagggcgagaucggcuucccggggcggcccggccgccccgggaugaacggccucaagggcgagaagggggagcccggcgacgccagccugggguucggcaugcgcgggaugccgggcccccccggcccgcccgggccccccggcccgcccgggacccccguguacgacuccaacgucuucgccgagagcucccggcccggcccgcccgggcugcccggcaaccagggccccccggggcccaagggcgccaagggggaggugggcccccccgggccgcccggccaguuccccuucgacuuccuccagcuggaggcggagaugaagggcgagaagggggaccgcggcgacgccgggcagaagggcgagcggggggagcccggcggcgggggcuucuucgggagcucccugccgggcccccccggccccccggggccccgcggcuaccccgggauccccggcccgaagggggagagcauccggggccagcccggccccccggggccccagggcccccccgggaucggcuacgaggggcgccagggcccgcccggcccccccgggccgcccggcccccccuccuucccggggccccaccggcagaccaucagcgugcccggccccccggggccccccggccccccgggcccccccgggaccaugggcgccuccagcgggguccgccucugggccacgcggcaggccaugcugggccaggugcacgaggugcccgagggcuggcugaucuucgucgcggagcaggaggagcucuacgugcgcgugcagaacggguuccggaagguccagcuggaggcccgcaccccgcugccccggggcaccgacaacgagguggccgcccuccagccccccgugguccagcugcacgacuccaacccguacccccgccgggagcacccccacccgaccgcccgccccuggcgggcggacgacauccuggccagccccccccgccucccggagccccagcccuaccccggggccccgcaccacuccagcuacgugcaccugcggcccgcccgccccacgucccccccggcccacagccaccgggacuuccagcccgugcugcaccucgucgcgcugaacuccccccugagcggcgggaugcgcggcauccgcggcgccgacuuccagugcuuccagcaggcccgggccguggggcucgcgggcaccuuccgcgccuuccugagcucccggcugcaggaccucuacagcaucgugcgccgggccgaccgcgccgccguccccaucgugaaccugaaggacgagcugcucuucccguccugggaggcgcuguucagcggguccgagggcccccugaagcccggggcccggaucuucagcuucgacggcaaggacgugcuccgccaccccaccuggccgcagaaguccgucuggcacggcagcgaccccaacgggcggcgccugaccgaguccuacugcgagacguggcggaccgaggcccccagcgccaccggccaggccuccagccugcucgggggccgccugcuggggcaguccgcggccagcugccaccacgccuacaucgugcucugcaucgagaacuccuucaugaccgccagcaaguga

SEQ ID NO: 28517 - RNA, 4395 nt, Artificial Sequence
  derived and/or modified sequence opt1 from COL1A1__Homo_sapiens__NP_000079
auguucagcuucguggaccugcgccuccugcugcuccuggccgccaccgcgcugcucacccacggccaggaggaggggcaggucgagggccaggacgaggacauccccccgaucacgugcgugcagaacgggcugcgguaccacgaccgcgacguguggaagcccgagcccugccggaucugcgucugcgacaacggcaaggugcugugcgacgacgugaucugcgacgagaccaagaacugccccggggccgaggucccggagggcgagugcugccccgugugccccgacggcuccgagagccccaccgaccaggagaccacggggguggagggcccgaagggggacaccggcccccgcgggccccggggccccgccggcccgcccgggcgcgacggcauccccgggcagcccggccucccgggcccccccgggcccccgggcccccccgggcccccgggccuggggggcaacuucgccccccagcuguccuacggcuacgacgagaagagcaccgggggcaucuccguccccgggcccaugggcccgagcgggccccggggccuccccggcccgcccggggcccccggcccccagggguuccagggcccgcccggggagcccggcgagcccggcgcguccgggccgaugggcccccgcgggccccccggcccgcccggcaagaacggggacgacggcgaggccgggaagcccggccggcccggggagcgcggcccgcccggcccccagggggcccggggccugcccgggaccgccggccugccggggaugaagggccaccgcggcuucagcgggcucgacggcgcgaagggggacgccggccccgccgggcccaagggcgagcccggcuccccgggggagaacggcgcccccgggcagaugggcccccgggggcugccgggcgagcgcggccggcccggggcccccggccccgcgggggcccgcggcaacgacggcgccacgggggccgccggcccgcccgggcccaccggccccgcggggccgcccggcuuccccggcgccgugggggccaagggcgaggccgggccccagggcccgcgggggagcgagggcccccagggcgugcgcggggagcccggccccccggggcccgccggcgcggccgggcccgccggcaaccccggcgccgacgggcagccgggcgccaagggggcgaacggcgcccccggcaucgccggggcccccggcuuccccggggcgcggggcccguccgggccccagggccccggcgggcccccgggccccaaggggaacagcggcgagcccggggccccgggcuccaagggcgacaccggggccaagggcgagcccgggcccgucggcgugcaggggcccccgggccccgccggcgaggaggggaagcgcggcgcccggggggagcccggccccaccgggcugccgggcccccccggcgagcgcgggggccccgggagccgcggcuucccgggcgcggacgggguggccggccccaaggggcccgccggcgagcgggggucccccggcccggccggccccaaggggagccccggcgaggccgggcgccccggcgaggcggggcucccgggcgccaagggccugacggggucccccggcagccccgggcccgacggcaagaccgggccgcccggccccgccggccaggacgggcggcccggcccgcccgggcccccgggcgcccgcgggcaggccggcgucaugggcuuccccgggcccaagggcgcggccggggagcccggcaaggccggcgagcggggggugccgggcccccccggggccgugggccccgcggggaaggacggcgaggccggcgcccaggggccgcccggccccgccgggcccgccggcgagcgcggggagcagggcccggcgggcucccccggguuccagggccugcccgggcccgccggcccgcccggggaggccggcaagcccggcgagcaggggguccccggcgaccucggggccccgggccccagcggcgcccggggggagcgcggcuuccccggggagcggggcgugcaggggcccccgggccccgcgggcccccgcggggccaacggcgccccggggaacgacggcgccaagggggacgccggcgcgcccggcgcccccgggagccagggcgcccccgggcugcagggcaugccgggggagcggggcgccgcgggccugcccgggcccaagggcgaccgcggggacgccggccccaagggggccgacggcuccccgggcaaggacggggugcggggccucaccgggcccaucggcccccccggcccggccggggcccccggcgacaagggggagagcggccccuccgggcccgcgggcccgaccggcgcccgcggggcccccggcgaccggggggagcccggccccccggggcccgccggcuucgccggcccccccggggcggacggccagccgggggccaagggcgagcccggggacgccggcgccaagggcgacgccgggccccccggcccggcggggcccgccggccccccgggccccaucgggaacgucggcgcccccggggccaagggcgcccgcgggagcgcgggccccccgggcgccacgggguuccccggcgccgccgggcgggugggcccccccgggccguccggcaacgcgggcccccccgggcccccgggccccgccgggaaggagggcgggaagggcccccgcggcgagaccgggcccgccggccggccgggggaggugggcccccccgggcccccgggccccgccggcgagaaggggagccccggcgccgacgggcccgcgggcgccccgggcacccccgggccccagggcaucgccgggcagcgcggcgucguggggcugcccggccagcgcggcgagcggggguucccgggccugcccgggcccuccggcgagccggggaagcagggccccagcggcgccuccggggagcgcggcccccccgggccgaugggcccccccgggcucgccggccccccgggcgagagcgggcgggagggcgcgcccggggccgagggcucccccggccgcgacgggagccccggcgccaagggggaccggggcgagaccgggccggccggcccccccggcgcccccggggcgccgggcgcccccgggcccgucggccccgccgggaaguccggcgaccgcggcgagacggggccggccggccccgcggggcccgugggccccgugggggcccggggcccggccggcccccaggggccccgcggcgacaagggggagaccggcgagcagggggaccggggcaucaagggccaccgcggguucagcggccugcaggggcccccgggcccccccggcuccccgggggagcagggccccagcggggccuccggccccgccgggccccggggcccgcccggcagcgcgggggcccccggcaaggacgggcugaacggccuccccgggccgaucggcccccccggcccccgcgggcggaccggcgacgccgggccggucggcccccccgggcccccgggcccccccggccccccggggccccccuccgccggcuucgacuucagcuuccugccccagccgccccaggagaaggcccacgacgggggccgcuacuaccgggcggacgacgccaacguggugcgcgaccgggaccuggaggucgacaccacgcucaagagccugucccagcagaucgagaacauccgcagccccgaggggucccggaagaacccggcccgcaccugccgggaccugaagaugugccacagcgacuggaaguccggcgaguacuggaucgaccccaaccagggcugcaaccucgacgccaucaagguguucugcaacauggagaccggggagaccugcguguaccccacgcagcccagcgucgcccagaagaacugguacaucuccaagaacccgaaggacaagcgccacgugugguucggcgagagcaugaccgacggguuccaguucgaguacggcggccagggguccgaccccgcggacguggccauccagcugaccuuccugcgccucaugagcaccgaggccucccagaacaucacguaccacugcaagaacagcgucgccuacauggaccagcagaccggcaaccugaagaaggcgcugcuccugcagggguccaacgagaucgagauccgggccgagggcaacagccgcuucaccuacuccgugaccguggacgggugcacgagccacaccggcgccuggggcaagaccgucaucgaguacaagaccaccaagacgucccggcugcccaucaucgacguggccccccucgacgugggggccccggaccaggaguucggcuucgacgucgggcccgugugcuuccuguga

SEQ ID NO: 28518 - RNA, 4101 nt, Artificial Sequence
  derived and/or modified sequence opt1 from COL1A2__Homo_sapiens__NP_000080
augcugagcuucguggacacccgcacccuccugcugcucgccgucacgcugugccuggcgaccugccagucccuccaggaggagaccgugcggaagggccccgccggcgaccgcggcccccgcggcgagcgcgggccgcccggcccgcccggccgggacggcgaggacgggcccaccggcccgcccgggccgcccggcccgcccggcccgcccggccugggcgggaacuucgccgcccaguacgacggcaagggggugggccugggccccgggcccaugggccucauggggccccgcgggccgcccggggccgccggcgcgcccggcccccagggguuccagggccccgccggggagcccggcgagcccgggcagacgggccccgccggcgcccgggggcccgcgggcccgcccgggaaggccggcgaggacgggcaccccggcaagcccggccgccccggggagcggggcgucguggggccccagggcgcccgcggcuuccccgggacccccggccugcccggguucaagggcauccgggggcacaacggccuggacggccucaaggggcagcccggcgcccccggggugaagggcgagcccggggcccccggcgagaacggcacccccgggcagaccggcgcgcgcgggcugcccggcgagcgggggcgcgucggcgcccccggccccgccggggcccggggcagcgacggguccgugggccccguggggcccgccggccccaucggcagcgcggggccgcccggcuuccccggggcccccggccccaagggcgagaucggggccgucggcaacgccgggcccgccggccccgcggggccccgcggcgaggugggccugcccgggcucuccggccccguggggccgcccggcaaccccggggccaacggccugacgggcgccaagggggccgccggccugcccggggucgcgggcgcccccgggcuccccggcccccggggcauccccgggcccgugggcgccgccggggcgaccggcgcccgcggccuggugggggagcccggcccggccgggagcaagggcgaguccgggaacaagggcgagcccggcagcgccgggccccagggcccgcccgggcccuccggcgaggaggggaagcggggccccaacggcgaggccgggagcgcgggcccgcccgggccgcccggccugcgcgggucccccggcagccggggccuccccggggccgacggccgcgccggggucauggggccgcccgggucccgcggcgccagcggccccgccggggugcggggccccaacggggacgcgggccgccccggcgagcccgggcugaugggcccccgggggcugccgggcucccccgggaacaucggccccgccggcaaggaggggcccgugggccuccccgggaucgacggccgccccgggcccaucggcccggccggcgcccggggcgagcccggcaacaucggguuccccggccccaaggggccgaccggcgaccccggcaagaacggggacaagggccacgccgggcuggcgggcgcccgcggggcccccggccccgacggcaacaacggggcccagggcccgcccgggccccagggcguccagggcgggaagggcgagcaggggcccccggggccgcccggguuccagggccugcccggcccgagcgggcccgcgggcgagguggggaagcccggcgagcgggggcuccacggcgaguucggccugcccgggccggccggcccccgcggggagcgggggccgcccggggaguccggcgccgccggcccgaccgggcccaucggcagccgcgggcccuccggcccgcccggccccgacgggaacaagggcgagcccgggguggucggcgccguggggacggcgggcccgagcggccccagcgggcugcccggcgagcggggcgccgccggcauccccgggggcaagggcgagaagggggagccgggccuccgcggggagaucggcaaccccgggcgggacggcgcccgcggcgcccccggggcggugggcgcccccgggccggccggcgccaccggggaccggggcgaggccggcgcggccgggcccgccggccccgccgggccccgcggcuccccgggcgagcggggcgaggucggccccgcggggcccaacggcuucgccgggcccgccggcgccgccggccagccgggggcgaagggcgagcgcggggccaagggccccaagggggagaacggcguggucggccccaccgggcccgugggcgccgccgggccggccggccccaacgggcccccgggccccgcgggcagccggggcgacggcgggccgcccggcaugaccggcuucccgggggccgccggccgcacggggccgcccggccccuccgggaucagcggcccgcccgggccgcccgggccggccggcaaggaggggcugcgcggcccccggggcgaccagggccccgugggccgcaccggggaggucggcgccguggggcccccgggcuucgcgggggagaagggccccuccggcgaggccgggaccgccgggccgcccgggaccccgggcccccaggggcugcucggcgcccccggcauccuggggcugcccggcagccgcggggagcggggccucccgggcguggccggggcggucggcgagcccgggccccugggcaucgccgggcccccgggcgcccgggggccgcccggggccgugggcuccccgggggugaacggcgcgcccggggaggccggccgcgacggcaaccccgggaacgacggcccgcccgggcgggacggccagcccgggcacaagggcgagcgcggcuaccccgggaacaucggccccgucggggccgccggcgcccccggcccccacgggcccgugggccccgcggggaagcacggcaaccggggcgagacgggcccgagcggccccguggggcccgccggcgccgucgggccccgcggcccguccgggccccagggcauccggggcgacaagggggagcccggcgagaaggggccccgcggccugccggggcucaagggccacaacggccugcaggggcugcccggcaucgccgggcaccacggcgaccagggggcccccggcagcgugggccccgcggggccgcggggccccgccgggcccuccggccccgccggcaaggacgggcgcaccggccacccggggaccgugggccccgccgggauccggggcccccagggccaccaggggccggccgggccgcccgggcccccggggccgcccgggcccccgggcgucagcggcgggggcuacgacuucggguacgacggcgacuucuaccgcgcggaccagccccgguccgcccccagccuccgccccaaggacuacgagguggacgccacccugaagucccugaacaaccagaucgagacgcuccugaccccggaggggagccggaagaaccccgcccggaccugccgggaccugcgccucucccaccccgaguggagcuccggcuacuacuggaucgaccccaaccagggcugcaccauggacgcgaucaagguguacugcgacuucagcacgggggagaccugcauccgcgcccagccggagaacauccccgccaagaacugguaccggagcuccaaggacaagaagcacgucuggcugggcgagaccaucaacgccgggagccaguucgaguacaacguggagggcgugaccuccaaggagauggccacgcagcuggcguucaugcgccugcucgccaacuacgccagccagaacaucaccuaccacugcaagaacuccaucgccuacauggacgaggagaccgggaaccugaagaaggccgucauccugcagggcagcaacgacguggagcucguggcggagggcaacucccgguucaccuacacgguccugguggacgggugcagcaagaagaccaacgaguggggcaagaccaucaucgaguacaagaccaacaagcccucccgccugcccuuccucgacaucgccccgcuggacaucgggggcgccgaccaggaguucuucguggacaucggccccgucugcuucaaguga

SEQ ID NO: 28519 - RNA, 3855 nt, Artificial Sequence
  derived and/or modified sequence opt1 from COL20A1__Homo_sapiens__NP_065933
augagcuccggcgaccccgcccaccuggggcucugccuguggcuguggcucggcgccacccuggggcgcgagcaggugcaggcgagcggccugcuccggcuggccguccugccggaggaccgccuccagaugaaguggcgggaguccgaggggagcggccugggcuaccuggugcaggugaagcccauggccggggacuccgagcaggaggucauccucaccacgaagacccccaaggccaccgugggcgggcugagccccuccaagggcuacacccugcagaucuucgagcucacggggagcggccgcuuccugcuggcccggcgcgaguucgugaucgaggaccucaaguccagcucccuggaccggagcucccagcgcccgcugggcagcggggcgcccgagcccacccccucccacaccggcagcccggaccccgagcaggccuccgagccccaggucgccuucacccccagccaggacccgcggacgcccgccgggccccaguuccgcugccuccccccggugcccgcggacaugguguuccuggucgacggcuccuggagcaucggccacagccacuuccagcaggugaaggacuuccuggccuccgugaucgcccccuucgagaucgggcccgacaagguccaggugggccucacccaguacagcggggacgcccagaccgagugggaccugaacucccugagcaccaaggagcaggugcucgccgcgguccggcgccugcgguacaagggcgggaacacguucaccggccuggcccucacccacgugcugggccagaaccugcagccggccgccgggcuccgccccgaggccgcgaagguggucauccuggugaccgacggcaagucccaggacgacgugcacacggccgcccggguccugaaggaccucggggugaacguguucgccgucggcgugaagaacgccgacgaggcggagcugcgccugcucgccagccccccccgggacaucaccguccacuccgugcuggacuuccugcagcucggggcccuggccggccugcucagccgccugaucugccagcggcugcagggcggguccccgcgccagggccccgccgcggcccccgcccucgacacccugcccgccccgaccagccuggugcugucccaggucacgagcuccagcauccggcucuccuggacccccgcgccccgccacccgcugaaguaccugaucguguggcgcgccagccgggggggcaccccccgcgagguggucguggaggggcccgccgccuccaccgagcuccacaaccuggccagccggacggaguaccugguguccgucuuccccaucuacgagggcggcgugggggagggccuccgcgggcuggugaccaccgcgccgcugccccccccccgggcccucacccuggccgccgucacgccgcgcaccgugcaccugaccuggcagcccagcgccggcgcgacccacuaccucgugcggugcagccccgccucccccaagggcgaggaggaggagcgcgagguccagguggggcggccggaggugcugcuggacggccucgagcccgggcgcgacuacgaggucagcgugcagucccugcggggccccgaggggagcgaggcccgcggcauccgggcccgcacgcccacccuggccccgccccggcaccucggcuucuccgacgugagccacgacgcggcccgcgucuucugggagggggccccccggcccgugcgccuggugcgggucaccuacguguccagcgagggcgggcacuccggccagaccgaggccccggggaacgcgacgagcgccacccugggcccccucuccagcuccaccaccuacaccgugcgcgucacgugccuguaccccggcgggggcagcuccacccugaccgggcgcgugaccacgaagaaggcccccagcccgucccagcucagcaugaccgagcugcccggcgacgccgugcagcuggccugggucgcggccgcccccagcggggugcucguguaccagaucaccuggaccccgcugggcgagggcaaggcccacgagaucuccguccccgggaaccugggcacggccgugcuccccgggcugggccggcacaccgaguacgacgugaccauccuggcguacuaccgcgacggggcccggagcgaccccgucucccuccgcuacaccccgagcacggugucccggagcccccccuccaaccuggcccuggccagcgagacccccgacucccuccaggugagcuggaccccgccccugggccgcguccugcacuacuggcucaccuacgcccccgcguccggccuggggcccgagaagagcguguccgugccgggcgcccggagccacgucacgcugcccgaccuccaggccgccaccaaguaccgcgugcugguguccgcgaucuacgccgccgggcggagcgaggccgucuccgccaccggccagaccgcgugccccgcccugcgccccgacggcagccucccgggguucgaccugaugguggccuucucccugguggagaaggccuacgccagcauccggggcgucgcgauggagcccagcgccuucgggggcacgcccaccuucacccucuucaaggacgcccagcugacccgccggguguccgacguguaccccgccccgcugccccccgagcacacgaucgucuuccucgugcgccugcugcccgagaccccgcgggaggccuucgcgcucuggcagaugaccgccgaggacuuccagccccugcuggggguccuccuggacgccggcaagaagagccugaccuacuuccaccgcgacccccgggccgcccuccaggaggcgacguucgacccccaggaggugcgcaagaucuucuucggcuccuuccacaaggugcacgucgccguggggcggagcaaggugcgccuguacgucgacugccggaagguggccgagcgcccgcugggcgagaugggguccccccccgccgcgggcuucgugacccucgggcgccuggccaaggcccggggcccgcgcagcuccagcgccgccuuccagcugcagaugcuccagaucgucugcuccgacaccugggcggacgaggaccggugcugcgagcugcccgccagccgcgacggcgagaccugccccgccuucguguccgccugcagcugcuccagcgagacgcccgggccgcccggcccccaggggcccccgggccugcccgggcggaacggcacccccggcgagcagggguuccccggcccgcgcgggccccccggcgugaagggcgagaagggggaccacggccuccccgggcugcagggccacccggggcaccagggcauccccggccgggucgggcugcagggccccaaggggaugcgcggccucgaggggaccgccggccugcccggcccgcccgggccccggggcuuccaggggauggcgggcgcccgcgggaccuccggcgagcggggccccccggggacggugggccccaccgggcugcccggccccaagggggagcgcggcgagaagggcgagccgcagagccucgccacccuguaccagcuggugucccaggccagccacgucuccaaguucgacagcuuccacgagaacacccggccccccaugccgauccucgagcagaagcuggagcccgggaccgagccccugggcagccccgggacgcgcuccaaggcccucgugccgggcgaguggggccgggggggccgccaccuggaggggcggggcgagcccggggcggugggccagaugggcagccccgggcagcagggcgccuccacccaggggcugugggaguga

SEQ ID NO: 28520 - RNA, 2874 nt, Artificial Sequence
  derived and/or modified sequence opt1 from COL21A1__Homo_sapiens__NP_110447
auggcccacuacaucaccuuccugugcauggugcucguccugcugcuccagaacagcgugcuggccgaggacggcgaggugcgcuccagcugccggaccgcgcccacggaccuggucuucauccucgacggguccuacagcgugggccccgagaacuucgagaucgugaagaaguggcuggucaacaucaccaagaacuucgacaucgggcccaaguucauccaggugggcgugguccaguacuccgacuaccccgugcuggagaucccccucgggagcuacgacuccggcgagcaccugaccgccgccguggagagcauccuguaccucggcgggaacaccaagacgggcaaggccauccaguucgcccuggacuaccuguucgcgaaguccagccgcuuccucaccaagaucgccgucgugcugaccgacgggaagucccaggacgacgugaaggacgccgcccaggcggcccgggacagcaagaucacccuguucgccaucggcgucggguccgagacggaggacgccgagcuccgcgccaucgcgaacaagccgagcuccaccuacguguucuacguggaggacuacaucgccaucagcaagauccgggaggucaugaagcagaagcugugcgaggaguccgugugccccacccgcauccccguggccgcccgggacgagcgcggcuucgacauccugcucggccuggacgucaacaagaaggugaagaagcggauccagcugagccccaagaagaucaagggguacgaggugaccuccaaggucgaccucagcgagcugacgagcaacguguucccggagggccugccgcccuccuacgucuucgugagcacccagcgcuucaaggugaagaagaucugggaccucuggcggauccugaccaucgacgggcgcccccagaucgccgucacccugaacggcguggacaagauccuccuguucacgaccaccuccgugaucaacggcagccaggucgugaccuucgcgaacccccaggugaagacgcuguucgacgagggguggcaccagauccggcuccuggucaccgagcaggacgugacccuguacaucgacgaccagcagaucgagaacaagccccuccaccccgugcugggcauccugaucaacgggcagacccagaucggcaaguacuccgggaaggaggagacgguccaguucgacgugcagaagcuccgcaucuacugcgaccccgagcagaacaaccgggagaccgccugcgagaucccgggcuucaacggcgagugccugaacgggcccagcgacgugggcuccacccccgcccccugcaucugcccgcccgggaagcccggccugcaggggcccaagggcgacccgggccuccccgggaaccccggcuaccccgggcagccgggccaggacgggaagcccggcuaccagggcaucgccgggacccccggcgucccggggagccccggcauccagggcgcccgcgggcugcccggcuacaagggggagcccggccgggacggggacaagggcgaccgcggccugccgggguuccccggccuccacgggaugcccggcuccaagggggagaugggcgcgaagggcgacaaggggagccccggcuucuacgggaagaagggcgccaagggggagaagggcaacgccggcuucccggggcugcccggccccgccggggagcccggccggcacgggaaggacggccugaugggcuccccgggguucaagggcgaggccgggagccccggcgcgcccggccaggacgggacgcgcggcgagcccgggaucccgggcuuccccgggaaccggggccucaugggccagaagggggagaucggcccgcccgggcagcagggcaagaagggggcccccggcaugcccggccugaugggguccaacggcagccccgggcagcccggcaccccgggguccaagggcagcaagggcgagcccgggauccagggcaugcccggggccuccggccugaagggcgagccgggggccaccggcagccccggggagcccggcuacauggggcugcccggcauccagggcaagaagggggacaagggcaaccagggggagaagggcauccaggggcagaagggcgagaacggccgccaggggaucccgggccagcaggggauccagggccaccacggggcgaagggcgagcgcggcgagaagggggagcccggcgugcgcggggccaucggcuccaagggggagagcggcguggacggccucauggggcccgccggccccaaggggcagccgggcgaccccggcccccaggggcccccgggccuggacgggaagcccggccgggaguucagcgagcaguucauccggcaggucugcaccgacgugauccgcgcccagcugcccgugcuccugcaguccgggcggauccgcaacugcgaccacugccugagccagcacggcucccccggcaucccggggccgcccggccccaucgggcccgagggcccccgggggcuccccggccugcccggccgcgacggggucccgggccuggugggggugcccggccggcccgggguccgcggccucaagggccugcccgggcggaacggcgagaaggggagccagggcuucggguacccgggcgagcagggcccgcccgggccgcccggccccgaggggccgcccggcaucuccaaggagggcccgcccggggaccccggccugcccgggaaggacggcgaccacgggaagcccggcauccagggccagcccgggccgcccggcaucugcgaccccagccucugcuucuccgugaucgcccgccgggaccccuuccgcaaggggcccaacuacuga

SEQ ID NO: 28521 - RNA, 4881 nt, Artificial Sequence
  derived and/or modified sequence opt1 from COL22A1__Homo_sapiens__NP_690848
auggccggccugcgcgggaacgccguggcgggccuccuguggaugcugcuccuguggagcgggggcgggggcugccaggcccagcgggccggcugcaaguccguccacuacgaccugguguuccuccuggacaccagcuccagcguggggaaggaggacuucgagaagguccgccaguggguggccaaccugguggacaccuucgaggucggccccgaccggacgcgcgugggggugguccgguacuccgaccgcccgaccaccgccuucgagcucggccuguucgggagccaggaggaggugaaggcggccgcccggcgccuggccuaccacggcggcaacaccaacacgggggacgcgcuccgguacaucaccgcccgcuccuucagcccccacgccggcgggcggccccgcgaccgggccuacaagcagguggccauccugcugaccgacggccgcucccaggaccucguccuggacgcggccgccgccgcccaccgggcgggcauccgcaucuucgccgugggggugggcgaggcccugaaggaggagcucgaggagaucgccagcgagcccaaguccgcccacgucuuccacgugagcgacuucaacgcgaucgacaagauccgggggaagcugcgccggcgccugugcgagaacgugcucugcccguccguccggguggagggcgaccgcuucaagcacaccaacgggggcacgaaggagaucaccggcuucgaccugauggaccuguucagcgugaaggagauccucgggaagcgcgagaacggcgcccaguccagcuacguccggaugggguccuuccccguggugcagagcaccgaggacgucuucccccagggccugcccgacgaguacgccuucgugaccacguuccgcuuccggaagaccucccgcaaggaggacugguacaucuggcaggucaucgaccaguacagcaucccgcaggugagcauccggcuggacggggagaacaaggccguggaguacaacgccgucggcgcgaugaaggacgccgugcgcguggucuuccggggcucccgcgugaacgaccucuucgaccgggacuggcacaagauggcccugagcauccaggcccagaacgugucccugcacaucgacugcgcgcucguccagacccugcccaucgaggagcgcgagaacaucgacauccaggggaagaccgugaucggcaagcggcuguacgacagcgugcccaucgacuucgaccuccagcgcaucgucaucuacugcgacucccggcacgccgagcuggagacgugcugcgacauccccagcgggccgugccaggugaccguggucaccgagcccccccccccgccccccccccagcgcccgcccacccccggcuccgagcagaucggguuccugaagacgaucaacugcagcugccccgccggcgagaagggcgagauggggguggccggcccgauggggcuccccggccccaagggcgacaucggggccaucggccccgugggggcgccgggccccaagggggagaagggcgacgucggcaucgggcccuucggccagggggagaagggcgagaaggggucccugggccugccgggcccccccgggcgggacggcagcaaggggaugcgcggcgagcccggggagcucggcgagccgggccugcccggggaggugggcaugcgggggccccagggccccccggggcugcccggcccccccggccgcgugggggccccgggccuccagggggagcggggcgagaagggcacccgcggggagaagggcgagcgcgggcuggacggcuuccccgggaagcccggcgacaccggccagcaggggcggcccggcccguccggggucgccggcccccagggggagaagggcgacgugggccccgccgggcccccgggcgugcccgggagcgucgugcagcaggagggccugaagggggagcagggcgcccccggcccccgcgggcaccagggcgcgccggggccccccggcgcccggggcccgaucgggcccgagggccgcgacgggccccccggccuccaggggcugcggggcaagaagggcgacauggggccgcccggcauccccgggcugcucggccugcaggggcccccgggcccccccggcgugcccgggccgcccggccccgggggcucccccgggcugccgggcgagaucggcuuccccgggaagcccggccccccggggcccaccggcccccccgggaaggacggcccgaacggcccccccgggcccccgggcacgaagggggagcccggcgagcgcggcgaggacgggcugcccggcaagccggggcuccggggcgagaucggggagcagggccuggccggccgccccggggagaagggcgaggccgggcugcccggcgcccccggguucccgggcguccggggcgagaagggggaccagggcgagaagggggagcucggccugcccgggcugaagggcgaccgcggcgagaagggggaggcgggccccgccgggcccccgggccuccccgggaccaccagccuguucaccccccacccccggaugccgggcgagcagggccccaagggggagaagggcgaccccgggcugcccggcgagccgggccuccaggggcgccccggcgagcuggggccccagggccccacggggccgcccggcgccaagggccaggagggggcccacggcgcgcccggggccgccggcaaccccggggccccgggccacgugggcgcccccgggcccuccggccccccggggagcgugggcgcgcccgggcugcggggcacccccggcaaggacggggagcgcggcgagaagggggccgccggcgaggagggcuccccggggcccgucggcccccggggggaccccggcgccccggggcuccccggcccccccggcaaggggaaggacggcgagccggggcugcgcggcagccccgggcugcccggcccccucggcaccaaggccgcgugcgggaaggugcggggcuccgagaacugcgcccuggggggccagugcgugaagggggaccgcggcgccccgggcauccccgggagccccggcagccggggggaccccggcaucggggucgccggcccgcccggccccuccgggcccccgggcgacaaggggagccccggcucccgcggccugcccggguuccccggcccgcaggggcccgccggccgggacggggcgcccggcaacccgggcgagcgcgggccccccggcaagcccgggcucagcucccugcugagcccgggcgacaucaaccuccuggccaaggacgugugcaacgacugcccccccgggcccccgggccugcccggccuccccggguucaagggcgacaagggggugcccggcaagccggggcgcgagggcaccgagggcaagaagggggaggccggcccccccgggcugcccggcccgcccggcaucgccgggccccagggcucccagggggagcggggcgcggacggggaggucggccagaagggcgaccaggggcaccccggcgugccgggguucaugggcccccccgggaaccccggcccgcccggcgccgacgggaucgccggcgccgccgggccccccggcauccaggggagcccgggcaaggagggcccccccgggccgcagggccccuccgggcugcccggcauccccggggaggagggcaaggagggccgcgacgggaagccgggcccccccggggagcccggcaaggcgggcgagccggggcuccccggccccgagggggcccggggccccccgggguucaagggccacacgggcgacagcggggcccccggcccccgcggggaguccggcgccauggggcugcccggccaggagggccugccggggaaggacggcgacaccgggcccaccggcccccaggggccccagggcccgcggggcccccccgggaagaacggcagccccggguccccgggcgagcccggccccagcgggacccccggccagaagggguccaagggcgagaacgggagcccgggccuccccggcuuccuggggccccgcggcccgcccggggagcccggcgagaagggggugcccggcaaggagggcgucccggggaagcccggcgagcccggguucaagggcgagcggggggaccccggcaucaagggcgacaaggggccgcccggcgggaagggccagcccggggaccccggcaucccgggccacaaggggcacacgggccugauggggccccagggccuccccggcgagaacgggcccgugggcccgcccgggccccccggccagccgggguuccccggccugcgcggcgagucccccagcauggagacccugcggcgccucauccaggaggagcuggggaagcagcuggagacccggcucgccuaccugcuggcgcagaugcccccggccuacaugaagagcucccagggccgccccgggccccccggcccgcccgggaaggacggccuccccggccgggccgggccgaugggcgagcccgggcgccccggccaggggggccuggagggccccagcgggccgaucggccccaagggggagcggggcgccaagggggaccccggcgcccccggcguggggcugcgcggcgagauggggccgcccggcauccccggccagcccggggagccgggcuacgcgaaggacgggcuccccggcauccccgggccccagggcgagaccggcccggccgggcaccccggccugcccgggcccccgggcccccccgggcagugcgaccccucccagugcgccuacuucgccagccuggccgcgcggccgggcaacgucaagggccccuga

SEQ ID NO: 28522 - RNA, 1623 nt, Artificial Sequence
  derived and/or modified sequence opt1 from COL23A1__Homo_sapiens__NP_775736
augggccccggggagcgcgccggcgggggcggggacgccggcaagggcaacgcggccgggggcgggggcgggggccggagcgccaccaccgccggcucccgcgccgugagcgcgcugugccuccugcuguccgucgggagcgccgccgccugccuccugcugggcgugcaggcggccgcccuccaggggcggguggccgcccuggaggaggagcgcgagcugcuccggcgcgcgggcccgcccggcgcccuggacgccugggccgagccccaccuggagcggcuccugcgcgagaagcuggacgggcucgccaagauccggacggcgcgcgaggcccccuccgagugcgucugcccgcccggcccgcccgggcggcgcggcaagcccgggcggcgcggcgaccccggcccgcccgggcagagcggccgggacggguaccccggcccccuggggcuggacggcaagcccggccuccccgggccgaagggcgagaagggggcccccggcgacuucgggccccgcggcgaccagggccaggacggggccgccgggcccccgggcccgcccggcccgcccggcgcgcgggggccgcccggcgacaccgggaaggacggcccccgcggggcccagggccccgccggccccaagggggagcccggccaggacggggagaugggccccaaggggccgcccggccccaagggcgagcccggggugcccggcaagaagggggacgacggcacccccucccagcccgggccgcccggccccaagggcgagcccgggagcaugggcccgcgcggggagaacggcguggacggggcccccggccccaagggcgagcccgggcaccggggcaccgacggggccgcgggcccgcggggcgcccccgggcugaagggcgagcagggggacacggucgugaucgacuacgacggccgcauccuggacgcccucaaggggccgcccggcccccagggcccgcccgggccgcccggcauccccggggccaagggcgagcuggggcugcccggcgcgcccggcaucgacggggagaagggccccaaggggcagaagggcgaccccggggagcccggcccggccggccucaagggggaggccggcgagauggggcuguccggccugcccggcgccgacgggcucaagggcgagaagggggagagcgccuccgacagccugcaggagucccuggcgcagcucaucguggagcccgggcccccgggcccgcccggcccgcccggccccauggggcugcagggcauccaggggcccaagggccuggacggggccaagggcgagaagggcgccagcggggagcgcggccccuccgggcuccccggccccgucgggccgcccggccugaucggccugcccgggaccaagggcgagaaggggcggcccggcgagcccgggcucgacggcuuccccggcccgcgcggggagaagggcgaccggagcgagcgcggggagaagggcgagcggggcgugcccgggcgcaagggcgugaaggggcagaagggcgagcccgggcccccgggccuggaccagcccugccccgucggcccggacgggcugcccgugcccggcugcuggcacaaguga

SEQ ID NO: 28523 - RNA, 5091 nt, Artificial Sequence
  derived and/or modified sequence opt1 from COL24A1__Homo_sapiens__XP_011539493
augcaccuccgcgcccaccggacccgccggggcaaggugagccccaccgccaagaccaagagccugcuccacuucaucguccugugcguggcggggguggucgugcacgcccaggagcagggcaucgacauccuccaccagcuggggcugggcgggaaggacgugcggcacagcucccccgccaccgccguccccagcgccuccacgccccucccccagggcgugcaccugaccgagagcggcgugaucuucaagaacgacgcguacaucgagacgcccuucgucaagauccugcccgugaaccucgggcagcccuucaccauccugaccggccugcagucccaccgggugaacaacgccuuccucuucagcauccgcaacaagaaccggcugcagcuggggguccagcuccugcccaagaagcugguggugcacauccgcggcaagcagcccgccgucuucaacuacuccgugcacgacgagcaguggcacagcuucgccaucaccauccggaaccaguccgugagcauguucgucgagugcgggaagaaguacuucuccacggagaccauccccgaggugcagaccuucgacagcaacuccguguucacccucggcagcaugaacaacaacuccauccacuucgagggcaucgucugccagcuggacaucauccccagcgcggaggccuccgccgacuacugccgcuacgugaagcagcagugccggcaggccgacaaguaccagcccgagacgagcaucccgugcaccacccugauccccaccaagauccccgagcacuccccgccgcccaagcuguucgccgagaaggugcuguccgaggacacguucaccgagggcaagagcauccccaacaucaucaagaacgacuccgagaccgucuacaagcgccaggagcaccagaucagccggucccagcugagcucccuccagagcggcaacguguccgcggucgaccugaccaaccacgggauccaggccaaggagaugaucacggaggaggacacccagaccaacuucagccuguccgugaccacgcaccgcaucagcgaggccaagaugaacaccaaggagaaguucuccagccuccugaacauguccgacaacaucacccagcacgacgaccgggugaccggccugagccucuucaagaagaugcccuccauccugccccagaucaagcaggacacgaucaccaaccugaagaaggccaucaccgccaaccuccacaccaacgagcugauggagaugcagcccauccugaacacgagccuccaccgcgucaccaacgagcccuccguggacaaccaccuggaccugcggaaggagggcgaguucuaccccgacgcgaccuaccccaucgagaacagcuacgagaccgagcucuacgacuacuacuacuacgaggaccugaacacgaugcuggagauggaguaccuccgcgggcccaagggcgacaccgggccgcccggcccgcccgggcccgccggcaucccgggccccagcgggaagcggggcccccgcgggauccccggcccgcacgggaaccccggccugcccggccugcccgggccgaagggccccaagggggaccccggcuucucccccgggcagccggugcccggcgagaagggcgaccaggggcucagcggccugauggggccgcccggcaugcagggcgacaaggggcugaagggccacccggggcuccccggccugcccggggagcagggcauccccggcuucgccgggaacaucggcuccccgggguaccccggccggcaggggcuggccggccccgagggcaaccccgggccgaagggcgcccagggguucaucggcagccccggggaggcgggccagcugggccccgagggggagcgcggcaucccggggauccgcggcaagaagggguucaagggccggcagggcuuccccggggacuucggcgaccgcgggcccgccggccucgacggcucccccgggcuggucggcgggaccggcccgcccggguuccccggccugcggggcagcguggggcccgugggcccgaucgggcccgccggcauccccgggcccaugggccucuccggcaacaaggggcugccgggcaucaagggggacaagggcgagcaggggaccgccggcgagcugggcgagcccggguaccccggcgacaagggggccgucggccuccccggcccgcccgggaugcgcggcaagagcgggcccuccggccagaccggggaccccggccugcagggcccgagcgggccgcccggccccgagggguucccgggcgacaucgggauccccggccagaacggccccgaggggcccaagggccugcucgggaaccggggcccgcccgggcccccgggccugaagggcacgcagggggaggagggccccaucggggcguucggcgagcuggggccccgcggcaagcccggccagaagggguacgccggcgagccggggcccgagggccucaagggcgaggugggggaccagggcaacaucgggaagaucggcgagaccgggcccgugggccugcccggcgaggucgggaugaccggcuccaucggggagaagggcgagcgggggagcccgggcccccugggcccccagggggagaagggcgugaugggguaccccggcccgcccggggugcccggccccaucggcccgcucgggcugcccggcucccgcgggcccgacggccugcucggggagcagggcauccagggcgccaagggggagaagggcgaccaggggaagcggggcccccacggccugaucgggaagaccggcaacccgggggagcgcggcuuccaggggaagcccggccugcagggccuccccgggagcacgggcgaccgggggcugcccggcgagccggggcugcgcggccuccagggcgacgucgggccgcccggcgagauggggauggagggcccgcccgggaccgagggcgaguccggccugcagggggagcccggcgccaagggggacgugggcaccgcgggcagcgugggcggcaccggggagcccggccugcggggcgagcccggcgcccccggcgaggaggggcuccagggcaaggacgggcugaagggcguccccgggggccgcggccugcccggggaggacggcgagaagggggagaugggccucccggggaucaucggcccccugggccgguccgggcagacgggccugcccgggcccgagggcaucguggggaucccgggccagcgcggccggcccgggaagaagggcgacaaggggcagaucggccccaccggcgagguggggagccgcggcccgcccgggaagaucggcaagagcgggcccaagggcgcccggggcacccgcggggccgucggccaccucgggcugaugggccccgacggggagcccggcauccccggcuaccgcgggcaccagggccagcccgggcccuccggccugcccgggccgaagggcgagaagggcuaccccggggaggacagcaccgugcucgggccgcccgggccgcggggcgagcccggccccgugggggaccagggcgagcgcggggagccgggcgccgagggguacaagggccacgucggcgugcccgggcugcggggcgcgacggggcagcaggggccgcccggggagccgggcgaccagggcgagcaggggcugaagggcgagcgcggguccgagggcaacaaggggaagaagggcgcccccggccccagcgggaagcccggcaucccggggcuccagggccugcuggggcccaagggcauccagggcuaccacggggccgacggcaucuccgggaaccccggcaagaucggcccgcccgggaagcagggccuccccgggauccggggcgggcccggccgcaccggccuggccggggcccccggcccgcccggggugaagggcagcuccgggcugcccggcagccccggcauccaggggcccaagggcgagcaggggcuccccggccagcccgggauccagggcaagcggggccaccgcggggcgcagggcgaccaggggcccugcggcgacccgggccugaaggggcagcccggcgaguacgggguccagggccugaccggguuccagggcuuccccggccccaaggggccggagggcgacgccgggaucgugggcaucuccgggcccaagggccccaucggccaccgggggaacaccggcccgcucgggcgcgagggcaucaucgggcccacgggccggaccggcccccgcggggagaagggcuuccgcggggagaccggcccccaggggccgcgcggccagcccgggccgcccgggccgcccggcgcccccgggccccggaagcagauggacaucaacgccgccauccaggcgcugaucgagagcaacaccgcccugcagauggaguccuaccagaacacggaggugacccucaucgaccacagcgaggagaucuucaagacccugaacuaccuguccaaccuccugcacagcaucaagaacccgcugggcacccgcgacaaccccgcccggaucugcaaggaccuccugaacugcgagcagaaggucuccgacggcaaguacuggaucgaccccaaccuggggugccccagcgacgccaucgagguguucugcaacuucuccgcgggcgggcagacgugccucccgcccgugagcgucaccaagcuggaguucggcguggggaaggugcagaugaacuuccugcaccuccuguccagcgaggccacccacaucaucaccauccacugccugaacacgccccgcuggaccagcacccagaccuccggccccggccucccgaucggguucaagggcuggaacgggcagaucuucaaggucaacacgcugcuggagcccaaggugcucagcgacgacugcaagauccaggacggcuccuggcacaaggccaccuuccuguuccacacccaggagcccaaccagcugcccgugaucgagguccagaagcucccgcaccugaagaccgagcggaaguacuacaucgacagcuccagcgugugcuuccuguga

SEQ ID NO: 28524 - RNA, 1938 nt, Artificial Sequence
  derived and/or modified sequence opt1 from COL25A1__Homo_sapiens__NP_001243003
augcugcucaagaagcacgccggcaaggggggcgggcgcgagccccggagcgaggacccgacccccgccgagcagcacugcgcgcgcaccaugccccccugcgccgugcuggccgcccugcucuccgucguggccguggucagcugccuguaccugggcgugaagacgaacgaccuccaggcgcggaucgccgcccuggaguccgccaagggggcgccgagcauccaccugcuccccgacacccuggaccaccugaagaccauggugcaggagaaggucgagcgccuccuggcccagaaguccuacgagcacauggccaagauccggaucgcccgcgaggcccccagcgagugcaacugccccgcgggcccgcccggcaagcgggggaagcgcggccggcgcggggaguccggcccccccgggcagccgggcccccagggcccccccgggccgaagggcgacaagggggagcagggcgaccagggcccccgggggcugcccggcuuccccaccguggccgcccuccacagcaaccagauccugacggugaagggggaccagggccaggccgggccgcccggcccccccggcccgcccgggccccgcggccccccgggggacaccggcaaggacgggccccggggcaugcccggcgucccgggggagcccggcaagcccggggagcagggccugauggggccccucggcccgcccggccagaagggguccaucggcgcccccgggauccccggcaugaacggccagaagggggagccgggccugcccggggcggugggccagaacgggauccccggccccaagggcgagccgggggagcagggcgagaagggggacgccggcgagaacgggcccaagggcgacaccggcgagaagggggaccccggcagcuccgccgccgggaucaagggcgagcccggggagagcggccgcccgggccagaagggggagcccggccugcccgggcuccccggccugccggggaucaagggcgagcccggcuucaucgggccccagggcgagcccgggcugccgggccuccccggcaccaagggggagcggggcgaggccgggcccccgggccgcggggagcggggcgagcccggcgcgcccgggcccaagggcgaccgcggggagaagggcgacuccggggcccagggcccgcggggcccccccgggcagaagggcgaccagggggccacggagaucaucgacuacaacggcaaccugcacgaggcccugcaggggcccccgggcccccccggcccccaggggcuccagggcccgaagggggagcagggcagccccggcauccccgggauggacggcgagcaggggcugaagggcuccaagggggacaugggcgaccccggcaugaccggggagaagggcgggaucggccugccggggcuccccggcgccaacggcaugaagggggagaagggcgacagcgggaugcccggcccccaggggccguccaucaucggcccccccggccccccggggccccacggcccccccgggccgaugggcccccacgggcugcccggcccgaagggcgagcccgggcugaacggcgugaaggggcucaagggcgagcccggccagaagggggaccgcggcccccuggggcugccgggcgcgagcgggcucgacggcaagcccggcucccgggggaccgacggccccauggggccccacggcccggccgggcccaagggcgagcgcggcgagaagggggccaugggcgagcccgggccccgcggcccguacgggcugcccggcuuccccggcccccggggggagaagggcgaccugggggagaagggcgagaaggucaccagcccgagccagcacgugcccugccucauccugcugcuccuguccgcccugcucuucagccugugcgacuccaucuga

SEQ ID NO: 28525 - RNA, 1326 nt, Artificial Sequence
  derived and/or modified sequence opt1 from COL26A1__Homo_sapiens__NP_001265492
augaagcuggcccuccugcugcccugggccugcugcugccucugcggcagcgcgcuggccaccggguuccuguacccguucuccgccgccgcccuccagcagcacggcuaccccgagcccggggcgggcagccccggguccggcuacgccagccgccggcacuggugccaccacaccgugacgcgcaccgucuccugccaggugcagaacggcagcgagaccgugguccagcggguguaccaguccugccgcuggccggggcccugcgccaaccuggugagcuaccggacccugauccgccccacguaccgggucuccuaccgcaccgugaccgugcucgaguggcggugcugccccggcuucaccgggagcaacugcgacgaggagugcaugaacugcacgcgccuguccgacaugagcgagcggcugaccacccucgaggccaagguccugcugcucgaggcggccgagcgcccguccagccccgacaacgaccugcccgcccccgaguccaccccgcccacguggaacgaggacuuccugcccgacgccaucccccucgcccacccggugccccggcagcgccggcccaccggccccgcggggccgcccggccagaccggcccgcccgggcccgccggcccgcccgggagcaagggcgaccgcggccagaccggggagaagggccccgccgggccgcccggccugcuggggccgcccggcccccggggccuccccggggagaugggccgccccgggccgcccggcccgcccgggcccgccggcaaccccggccccucccccaacagcccccagggggcccuguacucccugcagccgcccacggacaaggacaacggcgacagccggcucgcgagcgccaucguggacaccguccuggccggggugcccggcccccgcgggccgcccgggccgcccggcccgcccgggccccggggcccgcccgggccgcccggcacccccggcucccaggggcuggccggcgagcgcgggaccgugggccccagcggggagcccggcgucaagggcgaggagggggagaaggccgcgacggccgagggcgagggggugcagcagcuccgcgaggcccugaagauccuggccgagcgggugcucauccuggagcacaugaucggcauccacgacccccuggccucccccgagggcggcagcggccaggacgcggcccuccgcgccaaccugaagaugaagcgcgggggcgcccagcccgacgggguccuggcggcccuccugggccccgaccccgggcagaaguccguggaccaggccagcucccggaaguga

SEQ ID NO: 28526 - RNA, 5583 nt, Artificial Sequence
  derived and/or modified sequence opt1 from COL27A1__Homo_sapiens__NP_116277
augggcgccggcuccgcccgcggcgcgcgggggaccgccgccgccgccgccgcccgcggcgggggcuuccuguucuccuggauccuggugagcuucgccugccaccuggccuccacccagggcgcgcccgaggacgucgacauccugcagcggcucgggcugagcuggaccaaggccggcucccccgcgccgcccggggugauccccuuccagagcggcuucaucuucacccagcgcgcccggcugcaggcccccaccgggaccgugauccccgcggcccucggcaccgagcuggcccugguccucucccugugcagccaccgcgugaaccacgccuuccuguucgccgugcggucccagaagcgcaagcuccagcugggccugcaguuccuccccgggaagaccgucgugcaccugggcagccggcgcuccguggcguucgaccuggacaugcacgacgggcgguggcaccaccucgcccuggagcugcgcggccggaccgucacccucgugaccgccugcggccagcgccgggugcccguccugcugccguuccaccgcgaccccgcccucgaccccgggggcagcuuccuguucgggaagaugaacccccacgccgugcaguucgagggcgcgcugugccaguucuccaucuaccccgugacccaggucgcccacaacuacugcacccaccuccggaagcagugcgggcaggccgacaccuaccagagcccccugggcccccuguucucccaggacagcggccgccccuucacguuccaguccgaccucgcccugcuggggcucgagaaccugaccaccgccacccccgcgcugggcagccuccccgccgggcggggcccccgcgggacgguggcccccgccacccccaccaagccccagcggaccucccccacgaacccccaccagcacauggcggugggcggccccgcccagacgccccuccugcccgccaagcucagcgccagcaacgcccuggaccccaugcugcccgcguccgucgggggcagcacccgcacgccccgccccgccgccgcccagcccucccagaagaucacggccaccaagauccccaagagccuccccaccaagcccuccgcgcccagcaccuccaucgugcccaucaagagcccccaccccacgcagaagaccgcccccuccagcuucaccaaguccgcccugcccacccagaagcaggucccgcccacgagccggcccguccccgcccgcgugucccggcccgccgagaagcccauccagcgcaaccccgggaugccccggccgcccccgcccagcacccgcccccugccgcccaccaccuccagcuccaagaagcccauccccacgcucgcgcggaccgaggccaagaucaccagccacgccuccaagcccgccagcgcgcgcaccagcacccacaagcccccgcccuucacggcccuguccagcucccccgcccccacccccggcagcacccgguccacccgcccgcccgccacgauggugccgcccaccagcgggaccuccacgccccggacggcccccgcgguccccacccccggcagcgcccccaccggcuccaagaagcccaucgggagcgaggccuccaagaaggccggccccaagagcagcccccgcaagcccgugccccugcggcccgggaaggccgcgcgcgacgucccccucagcgaccugaccacgcggcccuccccgcgccagccccagcccagccagcagaccacccccgcccuggugcuggccccggcccaguuccucuccagcagcccccggcccaccuccagcggcuacuccaucuuccaccuggccggcagcacgccguucccccugcucauggggccgcccggcccgaagggggacugcggccugcccgggccgcccggccugccgggccuccccgggauccccggcgcgcgcgggccccggggcccgcccgggcccuacggcaaccccggccugccggggccgcccggcgccaaggggcagaagggcgaccccgggcuguccccgggcaaggcccacgacggcgccaagggggacaugggccuccccgggcugagcggcaaccccgggcccccgggccgcaagggccacaagggguaccccggccccgcggggcaccccggcgagcagggccagccggggcccgagggcucccccggggccaagggcuacccggggcgccagggccugcccggccccgugggggaccccggcccgaaggggagccggggcuacaucgggcuccccggccuguucggccugcccggguccgacggcgagcgcgggcuccccggcgucccggggaagcggggcaagaugggcaugcccggguuccccggcguguucggggagcgcggcccgcccggccuggacgggaaccccggcgagcuggggcuccccggcccgcccggggugcccggccugaucggcgaccuggggguccucggccccaucggguaccccggccccaaggggaugaagggccugaugggcagcgugggggagcccggccugaagggggacaagggcgagcagggggugcccggcgucuccggcgaccccggguuccagggcgacaaggggagccagggccuccccggguuccccggcgcccggggcaagcccgggccgcugggcaaggugggggacaagggcuccaucggcuuccccgggccgcccggcccggagggguuccccggcgacaucgggccgcccggcgacaacggcccggaggggaugaagggcaagcccggggcccgcggccugcccgggccccggggccagcucggcccggagggggacgagggccccauggggccgcccggcgcccccgggcuggagggccagcccggccgcaagggguuccccggccggcccgggcuggacggcgugaagggggagccgggcgaccccggccgccccgggcccgucggcgagcagggguucaugggcuucaucggccucgugggggagccgggcaucgugggggagaagggcgaccgggggaugauggggccgcccggcguccccgggccgaagggcagcauggggcaccccggcaugcccgggggcaugggcaccccgggggagcccggcccccaggggcccccgggcucccgcgggccgcccggcaugcggggcgcgaaggggcgccggggcccccgcgggccggacggccccgccggcgagcaggggagccggggccugaaggggccgcccggcccgcaggggcgccccggccggcccggccagcaggggguggccggcgagcgcgggcaccugggcucccggggguuccccggcaucccgggccccagcgggccgcccggcaccaaggggcucccgggcgagcccgggccccagggcccccagggcccgaucgggccgcccggcgagauggggcccaagggcccgcccggggccgugggcgagcccggccugccgggggaggccggcaugaagggggaccugggcccccucggcacccccggggagcagggccugaucgggcagcgcggcgagcccgggcuggagggcgacuccggcccgauggggcccgacggccucaagggggaccgcggcgaccccgggcccgacggcgagcacggcgagaaggggcaggagggccugaugggggaggacggcccgcccgggccgcccggcgucacgggcgugcgggggccggagggcaagagcgggaagcagggcgagaagggccgcaccggggcgaagggcgccaagggguaccagggccagcugggggagaugggcgugcccggcgaccccgggcccccgggcacccccgggcccaagggcagccgggggucccucggccccaccggcgccccggggcgcaugggcgcccagggggagcccggccuggccggguacgacggccacaagggcaucgucgggccccugggcccgcccgggcccaagggcgagaagggggagcagggcgaggacggcaaggcggaggggccgcccggcccgcccggggaccggggccccgugggcgaccgcggggaccggggcgagcccggggaccccggcuaccccgggcaggagggcgugcagggccuccgcgggaagcccggccagcaggggcagccgggccaccccgggccccggggcuggcccggcccgaaggggagcaagggcgccgaggggcccaagggcaagcaggggaaggccggcgcccccggccgccggggcgugcagggccugcaggggcugcccggcccgcgcggcgugguggggcggcagggccucgaggggaucgccggccccgacgggcugcccggccgcgacggccaggcggggcagcagggcgagcagggggacgacggcgaccccgggccgaugggccccgccggcaagcgggggaaccccggcgucgccgggcugcccggcgcccaggggccgcccggcuucaagggcgaguccgggcuccccggccagcuggggcccccgggcaagcgcgggacggagggccggaccggccugcccgggaaccagggcgagcccgggagcaagggccagccgggcgacuccggggagaugggcuuccccgggauggcgggccucuucgggcccaagggcccgcccggcgacaucggguucaagggcauccaggggccccgcgggccgcccgggcugaugggcaaggagggcaucguggggccccugggcauccucgggcccagcggccugcccgggcccaagggcgacaagggcucccggggcgacuggggccugcaggggccgcgcgggccgcccgggccccgcggccggccggggccgcccgggcccccgggcgggcccauccagcuccagcaggacgaccugggcgccgccuuccagaccuggauggacaccagcggcgcccugcgccccgaguccuacagcuaccccgaccggcucgugcuggaccagggcggcgagaucuucaagacgcugcacuaccucuccaaccugauccagagcaucaagaccccgcuggggaccaaggagaaccccgcccgcgucugccgggaccucauggacugcgagcagaagaugguggacggcaccuacuggguggaccccaaccuggggugcuccagcgacacgaucgaggucuccugcaacuucacccacggcggccagaccugccugaagcccaucaccgcgagcaagguggaguucgccaucucccgcgugcagaugaacuuccuccaccuccugagcuccgaggucacgcagcacaucaccauccacugccucaacaugaccguguggcaggaggggaccggccagaccccggccaagcaggccgugcgguuccgcgccuggaacgggcagaucuucgaggcgggcgggcaguuccggcccgaggucagcauggacggcugcaaggugcaggacggccgcuggcaccagacgcuguucaccuuccggacccaggacccccagcagcugccgaucaucagcguggacaaccugccgcccgccuccagcgggaagcaguaccgccuggaggucggccccgccugcuuccuguga

SEQ ID NO: 28527 - RNA, 3378 nt, Artificial Sequence
  derived and/or modified sequence opt1 from COL28A1__Homo_sapiens__XP_011513662
auguggaaccgcuacuucguguucuaccugcuccugcugagcgccuucaccucccagaccgucagcggccagcggaagaaggggcccaaguccaaccuccuggcccgcaagagcgacgugcagggcuccaucugcuucaucgacaucguguucaucgucgacagcuccgagagcuccaagaucgcgcuguucgacaagcagaaggacuucguggacagccucuccgacaagaucuuccagcugacgccggggcggagccuggaguacgacaucaagcucgccgcccugcaguucuccagcuccgugcagaucgacccgcccuucagcuccuggaaggaccugcagaccuucaagcagaaggucaagagcaugaaccucaucggccaggggaccuucuccuacuacgccaucagcaacgccacccgccugcugaagcgggagggccgcaaggacggcgugaaggugguccuccugaugacggacgggaucgaccaccccaagaaccccgacgugcagagcaucuccgaggacgcgcggaucagcggcaucuccuucaucaccaucgcccugagcaccguggucaacgaggccaagcuccgccugaucuccggggacagcuccagcgagcccacccugcuccuguccgaccccacgcugguggacaagauccaggaccggcucgacauccuguucgagaagaagugcgagcgcaagaucugcgagugcgagaagggcgaccccggggacccgggcccgcccggcacccacgggaaccccggcaucaagggggagcggggccccaagggcaaccccgggaacgcccagaagggcgaggcgggggagcgcggccccgggggcauccccggcuacaagggggacaagggcgagcgcggggagugcggcaagccggggaucaagggcgacaagggcagccccgggcccuacggccccaaggggccgcggggcauccaggggaucaccggcccgcccggcgaccccgggcccaagggcuuccaggggaacaagggcgagcccggcccgcccgggcccuacggcucccccggggcccccggcaucgggcagcagggcaucaagggcgagcgggggcaggagggccgcccgggggcccccggccccaucggggugggcgagcccggccagccggggccccggggccccgagggggugcccggcgagcgcgggcugccgggcgagggcuuccccgggcccaagggcgagaaggggagcgagggccccaccgggccgcagggccuccagggccuguccaucaagggggagaagggcgacaucgggcccgugggcccccagggccccauggggaucccgggcaucgggagccagggcgagcaggggauccagggccccaucggcccgcccgggccccagggccccgccgggcagggccugcccggguccaagggcgaggugggccagauggggcccacgggcccgcgggggcccgucggcaucggggugcagggccccaagggcgagccggggagcaucggccuccccgggcagcccggcgugcccggcgaggacggggccgcgggcaagaagggggaggccggccugccgggggcccgcggccccgagggcccgcccgggaagggccagcccgggcccaagggcgacgaggggaagaagggcuccaagggcaaccaggggcagcggggccugcccgggcccgagggcccgaagggggagcccggcaucaugggccccuucgggaugcccggcaccagcaucccggggccgcccggccccaagggggaccgcggcggccccgggauccccggcuucaagggggagcccggccucuccauccgcggccccaaggggguccagggcccgcgggggcccgugggcgcccccgggcugaagggcgacggcuaccccggggugccgggcccccgcgggcugcccggcccgcccgggcccaugggccuccggggcgucggggacaccggcgccaagggggagcccggcgugcgcgggccgcccggccccagcggcccccgcggggucggcacccaggggccgaagggcgacacggggcagaagggccugcccggcccgcccgggccgcccggcuacgggagccagggcaucaagggcgagcaggggccccagggcuuccccgggcccaagggcaccauggggcacggccugcccggccagaagggggagcacggcgagcgcggggacgugggcaagaagggggacaagggcgagaucggcgagcccgggucccccggcaagcaggggcuccagggcccgaagggggaccugggccugaccaaggaggagaucaucaagcucaucaccgagaucugcggcugcgggcccaagugcaaggagacgccccuggagcugguguucgucaucgacagcuccgagagcgugggccccgagaacuuccagaucaucaagaacuucgugaagaccauggcggaccgggucgcccucgaccuggccaccgcccggaucgggaucaucaacuacucccacaagguggagaagguggccaaccugaagcaguucagcuccaaggacgacuucaagcucgcggucgacaacaugcaguaccugggcgagggcaccuacacggccaccgcccugcaggccgccaacgacauguucgaggacgcgcggccgggggugaagaagguggcccuggucaucaccgacggccagaccgacagccgcgacaaggagaagcucacggagguggugaagaacgccuccgacaccaacgucgagaucuucgugaucgggguggucaagaagaacgaccccaacuucgagaucuuccacaaggagaugaaccugaucgccaccgaccccgagcacguguaccaguucgacgacuucuucacccugcaggacacgcucaagcagaagcuguuccagaagaucugcgaggacuucgacagcuaccuggugcagaucuucggcuccagcagcccccagccgggguucggcauguccggcgaggagcucuccgagagcacccccgagccccagaaggagaucuccgagagccugagcgucacccgggaccaggacgaggacgacaaggcgccggagcccaccugggccgacgaccugcccgccacgaccuccagcgaggccaccaccacgccccgcccgcuccuguccacccccguggacggggccgaggacccccggugccuggaggcgcucaagcccggcaacugcggggaguacgugguccgcugguacuacgacaagcaggucaacagcugcgcccgguucugguucuccggcugcaacgggagcggcaaccgcuucaacuccgagaaggagugccaggagaccugcauccagggcuga

SEQ ID NO: 28528 - RNA, 4464 nt, Artificial Sequence
  derived and/or modified sequence opt1 from COL2A1__Homo_sapiens__NP_001835
augauccgccugggcgccccccagacccucgugcugcugacccuccuggucgccgcggugcugcggugccaggggcaggacgugcaggaggccggcagcugcguccaggacgggcagcgcuacaacgacaaggacguguggaagccggagcccugccggaucugcgugugcgacacgggcaccguccucugcgacgacaucaucugcgaggacgugaaggacugccugucccccgagauccccuucggggagugcugcccgaucugccccaccgaccuggccaccgccagcggccagcccggccccaaggggcagaagggcgagccgggggacaucaaggacaucgugggccccaaggggccccccggcccgcagggccccgccggggagcagggcccccgcggggaccggggcgacaagggcgagaagggggcgcccggcccgcgcgggcgggacggcgagcccgggacgcccggcaaccccggcccgcccgggccccccggcccgcccgggccccccggccucgggggcaacuucgccgcccagauggccggcggguucgacgagaaggcgggcggggcccagcugggcgucaugcaggggccgaugggccccaugggcccccgcgggccgcccggccccgccggggcccccggcccgcagggcuuccaggggaaccccggcgagcccggggagcccggcguguccgggccgaugggcccccggggcccccccgggccgcccggcaagcccggggacgacggcgaggccgggaagcccggcaaggcgggcgagcgcgggccgcccggcccccagggggcccggggcuuccccgggaccccgggccugcccggcgugaaggggcaccgcggcuaccccgggcucgacggcgccaagggggaggccggcgcccccggcgucaagggggagagcggcuccccgggggagaacggcagccccggccccauggggccgcggggccugcccggggagcgcggccggaccgggcccgcgggcgccgccggcgcccgcgggaacgacggccagcccgggccggccggcccccccgggcccgugggcccggcgggcgggcccggcuuccccggggcccccggcgccaagggggaggccggcccgaccggcgcccgggggcccgagggcgcgcaggggccccgcggcgagcccggcacgccggggucccccggccccgccggggccagcggcaaccccgggaccgacggcaucccgggcgccaagggguccgcgggcgcccccgggaucgccggcgcccccggguuccccggcccgcggggcccccccgggccccagggcgccaccgggccgcugggccccaaggggcagaccggcgagcccggcaucgcgggguucaagggcgagcaggggccgaagggcgagcccgggcccgccggcccccagggcgccccggggcccgccggcgaggaggggaagcgcggcgcccggggcgagcccgggggcguggggcccaucggcccgcccggggagcgcggcgcgcccggcaaccgcggguuccccggccaggacgggcucgccggcccgaagggggcccccggcgagcggggccccagcgggcuggccggccccaagggggccaacggcgacccggggcgccccggcgagcccggccugcccggggcgcggggccucacggggcgcccgggcgacgccgggccccagggcaaggucggccccuccggggcccccggcgaggacgggcggccgggcccccccggcccccagggggcccgcggccagccgggggugaugggcuuccccgggcccaagggcgcgaacggcgagccggggaaggccggcgagaaggggcugcccggcgcccccgggcugcggggccuccccggcaaggacggggagaccggcgccgccgggccgcccggccccgcggggcccgccggcgagcgcggcgagcagggggccccgggccccagcggguuccagggccugcccggccccccggggccccccggcgaggggggcaagcccggggaccagggcgugccgggcgaggccggggcccccggccuggucgggccccggggcgagcgcggguuccccggcgagcggggcuccccgggggcgcagggccuccaggggccccgcggccugcccgggacccccggcaccgacggcccgaagggggccagcggccccgccgggcccccgggcgcccaggggccccccggccugcagggcaugcccggggagcggggcgccgcggggaucgccggcccgaagggcgaccgcggggacgugggcgagaaggggcccgagggcgcccccgggaaggacggcggccgggggcucacgggccccaucgggccgcccggccccgccggggcgaacggcgagaagggcgagguggggcccccgggccccgccggguccgccggcgcccgcggggcccccggcgagcggggcgagaccgggcccccgggccccgcgggguucgccggcccccccggcgccgacgggcagccgggcgccaagggggagcagggcgaggccgggcagaagggcgacgcgggcgcccccgggccccagggccccagcggggccccgggcccccaggggcccaccggcgucaccggccccaagggggcccgcggcgcccaggggccgcccggcgcgacgggguuccccggcgccgccggccggguggggccgcccggcuccaacgggaaccccggccccccggggccccccggccccagcggcaaggacgggccgaagggcgcccgcggggacuccggcccccccggccgcgccggggagcccggccugcaggggccggcgggcccccccggggagaagggcgagcccggcgacgacgggccgagcggcgccgaggggccccccggcccccaggggcuggccggccagcggggcaucguggggcucccgggccagcgcggggagcggggcuuccccgggcugcccggccccagcggcgagccggggaagcagggcgcccccggggcguccggcgaccgcggcccccccgggccggucggcccccccgggcugaccggcccggccggggagcccggccgggagggcagccccggggccgacggccccccggggcgcgacggcgccgccggggugaagggcgaccggggcgagaccggggcggucggcgcccccggggcccccggccccccggggucccccggccccgccggccccaccgggaagcagggcgaccgcggggaggccggcgcgcaggggccgaugggccccagcggccccgccggggcccggggcauccaggggccccagggcccgcgcggcgacaagggggaggccggcgagcccggggagcggggccucaaggggcaccgcggcuucacgggccugcaggggcugcccggccccccggggcccuccggcgaccagggggccagcggccccgcgggccccuccgggccgcggggcccccccgggcccgugggcccgagcgggaaggacggcgccaacggcauccccgggcccaucggcccgcccgggccccgcggccgguccggggagaccggccccgccggcccgcccgggaaccccggccccccggggccccccggccccccgggccccgggaucgacaugagcgccuucgcgggccucgggccccgcgagaagggccccgacccgcugcaguacaugcgggccgaccaggccgccgggggccugcgccagcacgacgccgagguggacgcgacccucaagucccugaacaaccagaucgagagcauccggucccccgagggcagccgcaagaaccccgcccggaccugccgcgaccugaagcucugccaccccgaguggaaguccggggacuacuggaucgacccgaaccagggcugcacgcuggacgccaugaaggucuucugcaacauggagaccggggagaccugcguguaccccaaccccgccaacgugcccaagaagaacugguggagcuccaagagcaaggagaagaagcacaucugguucggcgagaccaucaacgggggcuuccacuucuccuacggcgacgacaaccuggccccgaacacggcgaacguccagaugaccuuccuccgccugcugagcaccgaggggagccagaacaucaccuaccacugcaagaacuccaucgccuaccucgacgaggccgccggcaaccugaagaaggcccugcugauccaggggagcaacgacguggagauccgggcggagggcaacucccgcuucacguacaccgcccucaaggacgggugcaccaagcacaccggcaaguggggcaagaccgugaucgaguaccggagccagaagacgucccgccugcccaucaucgacaucgcccccauggacaucgggggcccggagcaggaguucggggucgacaucggccccgugugcuuccuguga

SEQ ID NO: 28529 - RNA, 4401 nt, Artificial Sequence
  derived and/or modified sequence opt1 from COL3A1__Homo_sapiens__NP_000081
augaugagcuucgugcagaagggcuccuggcugcuccuggcccugcuccaccccaccaucauccuggcccagcaggaggcggucgaggggggcugcagccaccuggggcaguccuacgccgaccgcgacguguggaagccggagcccugccagaucugcgugugcgacagcggcuccguccucugcgacgacaucaucugcgacgaccaggagcuggacugccccaaccccgagaucccguucggggagugcugcgccgugugcccccagccccccaccgccccgacgcggccccccaacggccagggcccccaggggccgaagggcgaccccgggccccccggcaucccggggcgcaacggcgaccccggcauccccgggcagcccggcagcccggggucccccggcccccccggcaucugcgagagcugcccgaccgggccccagaacuacuccccccaguacgacagcuacgacgugaaguccggcgucgccguggggggccuggcgggguaccccggcccggccggcccccccgggccgcccggcccccccgggaccagcggccacccggggucccccggcagccccggcuaccaggggcccccgggcgagcccgggcaggccggccccuccgggcccccgggcccccccggcgccaucgggcccagcggcccggcggggaaggacggcgaguccggccggcccgggcgccccggcgagcgggggcuccccggcccgcccgggaucaagggccccgccggcauccccggguucccgggcaugaaggggcaccgcggcuucgacgggcggaacggcgagaagggcgagaccggggcccccggccugaagggggagaacggccugcccggggagaacggcgccccgggccccauggggccccgcggcgcccccggggagcggggccgcccggggcuccccggcgcggccggcgcccgggggaacgacggcgcccgcgggagcgacggccagcccggccccccggggccccccggcacggccggguuccccggcuccccgggggcgaagggcgaggugggccccgccgggagccccggcagcaacggggcccccggccagcggggggagccgggcccccagggccacgccggggcccagggcccccccgggccgcccggcaucaacgggucccccggcggcaagggggagaugggccccgcggggaucccgggcgcccccggccugaugggggcccgcggcccccccgggccggccggcgccaacggggcgcccggccugcggggcggggccggcgagcccgggaagaacggcgccaagggggagccgggcccccgcggcgagcggggggaggccggcauccccgggguccccggcgcgaagggggaggacggcaaggacggcagcccgggggagcccggcgccaacgggcuccccggcgccgccggggagcgcggcgcccccggcuuccgggggccggcgggccccaacgggauccccggcgagaagggccccgccggggagcgcggcgccccggggcccgccggcccccggggggccgcgggcgagcccggccgcgacggggugccgggcgggcccggcaugcgcgggaugcccggcucccccggcgggccgggcagcgacgggaagcccggcccccccgggucccagggcgagagcggccggccggggccccccggccccuccgggccgcgcggccagcccggggugaugggcuuccccggcccgaaggggaacgacggcgcccccgggaagaacggcgagcggggcgggcccggcgggcccggcccgcaggggccccccggcaagaacggcgagaccgggccccagggcccgcccgggcccaccggccccgggggcgacaagggcgacaccgggccgcccggcccccaggggcugcagggccugcccgggacgggcggcccgcccggggagaacggcaagcccggggagcccggcccgaagggcgacgccggggcccccggcgcccccgggggcaagggggacgcgggcgcccccggcgagcgcgggccgcccggccucgccggggcccccggccugcgggggggcgcgggcccgcccgggcccgagggcgggaagggcgccgccgggcccccgggcccccccggcgccgccgggacccccggccugcaggggaugccgggcgagcgcgggggccucggcagccccgggcccaagggcgacaagggggagcccggcggcccgggggcggacggcguccccgggaaggacggcccccgggggcccaccggcccgaucggcccccccgggcccgccggccagccgggggacaagggcgaggggggcgcccccggccugcccgggaucgccggcccccgcggguccccgggcgagcggggggagaccggcccccccggccccgccggguucccgggcgcgcccgggcagaacggcgagcccggcgggaagggcgagcgcggggccccgggcgagaagggggagggcggcccccccgggguggccggccccccggggggcagcgggcccgccggcccccccggcccgcagggggugaagggcgagcgggggucccccggcgggcccggcgccgcgggcuuccccggggcccgcggccugccggggccccccggcagcaacgggaaccccggcccgcccggccccuccgggagccccggcaaggacgggccgcccggccccgccggcaacacgggggcccccggcuccccgggggucagcggccccaagggggacgcgggccagcccggcgagaaggggucccccggcgcccaggggccgcccggcgcccccgggccgcucggcaucgccggcaucaccggggcccggggccuggcggggccccccggcaugcccgggccgcgcggcagccccggcccccagggggugaagggcgaguccgggaagcccggcgccaacggccugagcggggagcggggcccgcccgggccccagggccuccccgggcuggccggcaccgccggcgagccggggcgcgacggcaaccccgggagcgacggccugcccgggcgggacggcucccccggcgggaagggcgaccgcggggagaacggcagcccgggggcccccggcgcgcccggccaccccgggccgcccggccccguggggcccgccggcaaguccggggaccggggcgagagcggcccggccgggcccgccggcgcccccgggcccgcgggcucccgcggcgccccggggccccagggcccccgcggggacaagggcgagaccggggagcggggcgccgccggcaucaaggggcaccgcggcuucccggggaaccccggcgcccccgggagccccggcccggcgggccagcagggggccaucggcucccccgggcccgccggcccccgggggccggucggccccagcggcccccccgggaaggacggcacguccgggcacccgggccccaucgggccccccggcccgcgcggcaaccggggggagcgcggcagcgaggggucccccggccaccccggccagcccgggccgcccggcccccccggggccccgggccccugcugcgggggcgugggcgcggccgccaucgccgggaucggcggggagaaggccggcggguucgcgcccuacuacggcgacgagccgauggacuucaagaucaacaccgacgagaucaugaccagccucaaguccgugaacggccagaucgagagccugaucucccccgacgggagccggaagaaccccgcccgcaacugccgggaccugaaguucugccaccccgagcucaaguccggcgaguacugggucgacccgaaccaggggugcaagcuggacgccaucaagguguucugcaacauggagaccggcgagacgugcaucagcgccaacccccugaacgugccccgcaagcacugguggaccgacagcuccgccgagaagaagcacgucugguucggggagagcauggacggcggcuuccaguucuccuacgggaaccccgagcucccggaggacgugcuggacguccagcuggcguuccuccggcugcugagcucccgcgccagccagaacaucaccuaccacugcaagaacuccaucgccuacauggaccaggccagcggcaacgugaagaaggcccucaagcugaugggguccaacgagggcgaguucaaggcggagggcaacagcaaguucaccuacacggugcuggaggacgggugcaccaagcacaccggcgagugguccaagaccgucuucgaguaccggacgcgcaaggccgugcggcuccccaucguggacaucgcccccuacgacaucgggggccccgaccaggaguucggggucgacgugggcccggugugcuuccuguga

SEQ ID NO: 28530 - RNA, 1560 nt, Artificial Sequence
  derived and/or modified sequence opt1 from COL4A1__Homo_sapiens__NP_001290039
augggcccccgccugagcguguggcuccugcugcucccggccgcccugcugcuccacgaggagcacucccgggcggccgccaaggggggcugcgccgggagcggcugcgggaagugcgacugccacggcgucaagggccagaagggggagcgcggccugcccgggcugcagggcgugaucggguuccccggcaugcagggccccgaggggccgcagggcccccccgggcagaagggcgacaccggcgagcccgggcucccgggcaccaaggggacgcggggcccccccggggccuccggcuaccccggcaacccggggcugcccggcauccccgggcaggacggccccccggggccccccggcauccccggcugcaacgggaccaagggcgagcgcgggccgcugggcccccccgggcuccccggcuucgcgggcaacccggggccccccggccugcccgggaugaagggcgacccgggcgagauccuggggcacgugcccggcaugcuccugaagggggagcggggcuuccccgggaucccgggcacccccggcccccccgggcugccgggccuccaggggcccgucggcccccccggguucaccggcccgcccggcccccccgggccgcccggcccccccggggagaagggccagauggggcugagcuuccagggcccgaagggcgacaagggggaccagggcguguccgggccccccggcgugcccgggcaggcccagguccaggagaagggcgacuucgccacgaagggcgagaaggggcagaagggcgagccgggguuccagggcaugcccggcgugggggagaagggcgagcccgggaagcccggcccgcgcgggaagcccggcaaggacggcgacaagggggagaagggcagccccggguucccgggcgagcccggguaccccggccugaucggccggcaggggccccagggcgagaagggggaggccggcccgcccgggccccccggcaucgugaucggcaccgggccgcucggcgagaagggggagcgcggcuaccccggcacccccgggccccggggcgagccggggcccaagggcuuccccgggcugcccggccagccgggcccccccgggcugcccgucccgggccaggcgggggcccccggcuuccccggggagcgcggcgagaagggcgaccggggguuccccggcaccucccucccggggcccagcggccgcgacgggcugcccggccccccgggcucccccgggcccccgggccagcccggguacacgaacggcaucguggagugccagcccgggcccccgggcgaccagggcccccccgggauccccggccagccgggguucaucggcgagaucggcgagaaggggcagaagggcgagagcugccugaucugcgacaucgacggguaccggggcccccccgggccccagggcccgcccggcgagaucggguuccccggccagcccggggccaagggcgaccgcgggcucccgggccgggacggcguggccggggucccccugcuguuccagauccacaaguga

SEQ ID NO: 28531 - RNA, 5139 nt, Artificial Sequence
  derived and/or modified sequence opt1 from COL4A2__Homo_sapiens__NP_001837
augggccgcgaccagcgggccguggccggccccgcgcugcgccgguggcuccugcugggcaccgucaccgugggcuuccucgcccaguccgugcuggccggcgucaagaaguucgacgugcccugcggcggccgcgacugcuccggcggcugccagugcuaccccgagaagggcggccggggccagcccggccccgugggcccccagggcuacaacggcccgcccggccugcagggcuuccccggccuccagggccgcaagggggacaagggcgagcggggcgcccccggcgucacggggcccaagggcgacgugggcgcccgcggggugagcggcuuccccggggcggacggcauccccgggcaccccggccagggcgggccccggggccgccccggguacgacggcugcaacgggacccagggcgacuccggcccccaggggccgcccggcagcgagggguucaccgggccgcccggcccccaggggcccaagggccagaagggggagcccuacgcccugcccaaggaggagcgggaccgcuaccggggcgagcccggggagcccggccuggucggcuuccaggggccgcccggccgccccgggcacgugggccagauggggcccgugggcgcccccggccggcccgggccgcccggcccgcccgggcccaagggccagcaggggaaccgcggccucggcuucuacggggucaagggcgagaagggggacgugggccagcccgggcccaacggcauccccuccgacacccugcaccccaucaucgcccccacgggcgugaccuuccaccccgaccaguacaagggggagaagggcagcgagggggagcccggcauccggggcaucucccugaagggggaggagggcaucaugggguuccccggccuccgcggguaccccggccugagcggcgagaaggggucccccggccagaaggggagccggggccuggacggguaccagggccccgacggcccccgcgggcccaagggcgaggcgggggaccccggcccgcccgggcuccccgccuacagcccccaccccagccuggccaagggcgcccggggcgaccccggguuccccggcgcccagggggagcccggcucccagggcgagcccggggaccccggccugcccgggccgcccggccucagcaucggggacggcgaccagcgccgcggccugcccggggagaugggccccaagggguucaucggcgacccggggauccccgcgcuguacggcgggccgcccgggccggacggcaagcgggggccgcccggcccgcccgggcuccccgggccgcccggccccgacggguuccuguucggccugaagggggccaagggccgcgccggguuccccggccuccccggcucccccggggcccggggcccgaagggguggaagggcgacgccggcgagugccgcugcaccgagggggacgaggcgaucaagggccugcccgggcugcccggccccaagggguucgccggcaucaacggcgagccggggcggaagggcgaccgcggggaccccggccagcacgggcuccccggcuucccgggccugaaggggguccccggcaacaucggggcccccggccccaagggggccaagggcgacagccggaccaucacgaccaagggcgagcgcgggcagccgggcgugcccggggugcccggcaugaagggggacgacggcucccccggccgggacgggcuggacggcuucccggggcuccccggcccgcccggcgacgggaucaagggcccgcccggggaccccggcuaccccgggauccccggcaccaagggcacccccggggagauggggccgcccgggcugggccugccggggcucaagggccagcgcggcuuccccggggacgccggccugcccgggcccccgggcuuccuggggccgcccggccccgcgggcacgcccgggcagaucgacugcgacaccgacgucaagcgggccgugggcggggaccgccaggaggccauccagcccggcugcaucggcgggcccaagggccucccggggcugcccgggccgcccgggccgaccggcgccaagggccugcgggggauccccggcuucgccggggcggacggcgggcccggcccccgcggccucccgggggacgccggccgggagggguuccccgggccgcccggguucaucggcccgcgcggcagcaagggggccgugggccugcccgggcccgacggcucccccgggccgaucggccugcccggccccgacgggcccccgggcgagcgggggcuccccggcgagguccugggcgcccagcccgggccccgcggcgacgcgggggugccgggccagcccgggcugaagggccuccccggcgaccgggggccgcccggcuuccgcgggagccagggcaugcccgggaugcccggccugaagggccagccggggcugcccggccccagcgggcagcccggccucuacgggccgcccggccugcacggcuuccccggggcccccggccaggaggggccgcugggccugcccggcauccccgggcgcgagggccuccccggggaccggggcgacccgggggacaccggcgcccccggccccguggggaugaagggccuguccggggaccgcggcgacgccggguucacgggcgagcagggccaccccgggagcccgggcuucaaggggaucgacggcaugcccgggacccccggccugaagggcgaccgggggucccccggcauggacggguuccagggcaugccggggcucaagggccgccccggcuuccccgggagcaagggcgaggccggguucuucggcauccccggccugaaggggcuggcgggcgagccgggguucaagggcucccggggcgaccccggcccgcccgggcccccgcccgucauccucccggggaugaaggacaucaagggcgagaagggggacgagggccccauggggcugaagggcuaccugggcgccaaggggauccagggcaugcccgggauccccggccucagcgggaucccgggccugcccggccgccccgggcacaucaagggcgugaagggggacaucggcguccccggcaucccggggcugcccggcuuccccgggguggccgggcccccgggcaucaccggcuuccccggcuucaucgggucccggggcgacaagggggcccccggccgcgccgggcucuacggcgagaucggcgcgaccggggacuucggcgacaucggggacacgaucaaccugcccggccggccggggcugaagggcgagcgcggcaccaccgggauccccggccucaagggguucuucggcgagaaggggaccgagggcgacaucggcuuccccgggaucacgggcgugaccgggguccagggcccgcccggccugaaggggcagaccggcuuccccgggcugaccgggccgcccgggagccagggcgagcucggccggaucgggcugcccggcgggaagggcgacgacggguggcccggcgcccccggccugccgggguuccccggccuccgcgggauccggggccugcacgggcugcccggcacgaagggcuuccccggguccccgggcagcgacauccacggggaccccggcuuccccgggcccccgggcgagcgcggcgaccccggggaggccaacacccuccccggccccgugggggugccgggccagaagggcgaccagggggcccccggcgagcgggggccgcccggcuccccggggcugcagggcuuccccggcaucaccccgcccagcaacaucuccggggcccccggcgacaagggggcgcccggcaucuucgggcugaagggcuaccgcggcccgcccgggccgcccggcagcgccgcccuccccggguccaagggcgacaccgggaaccccggcgcccccggcacgcccgggaccaagggcugggcgggggacagcggcccccagggccggccgggggucuucggccugcccggggagaagggcccccgcggggagcagggcuucaugggcaacaccgggcccaccggcgccgugggggaccggggcccgaaggggcccaagggcgaccccggcuuccccggggccccgggcacggugggggcccccggcaucgccgggaucccccagaagaucgcgguccagcccggcaccgugggcccgcaggggcgccgggggccgcccggggcccccggcgagauggggccgcaggggccgcccggcgagcccggguuccgcggcgccccggggaaggccggcccccagggccgcgggggcguguccgccguccccggguuccggggcgacgaggggcccaucggccaccagggcccgaucgggcaggagggcgcgcccgggcgccccggcagcccggggcugcccggcaugcccggccgguccgugagcaucggguaccuccuggugaagcacagccagaccgaccaggagcccaugugcccggucggcaugaacaagcugugguccggguacagccuccuguacuucgagggccaggagaaggcccacaaccaggaccuggggcucgccggcuccugccuggcccgcuucagcaccaugcccuuccuguacugcaaccccggcgacgugugcuacuacgccucccggaacgacaagagcuacuggcucuccaccacggcgccccugccgaugaugcccguggccgaggacgagaucaagcccuacaucagccgcugcuccgucugcgaggcccccgccaucgcgaucgccgugcacagccaggacguguccaucccgcacugccccgccggguggcggagccuguggaucggcuacuccuuccucaugcacaccgccgccggggacgagggcggcgggcagagccuggucucccccggcagcugccuggaggacuuccgcgcgacccccuucaucgagugcaacgggggccgggggaccugccacuacuacgccaacaaguacuccuucuggcucacgaccaucccggagcagagcuuccagggcagccccuccgccgacacccugaaggccggccugauccgcacccacaucagccggugccaggugugcaugaagaaccucuga

SEQ ID NO: 28532 - RNA, 2259 nt, Artificial Sequence
  derived and/or modified sequence opt1 from COL4A3BP__Homo_sapiens__NP_001123577
augcagcacagcugcauccccaccccgcccucccccuucagcgcgcccccggccuuccugcccguggucacccgcgagucccggcgcggccucagcuccgggggcagcgcggggcggaacgccggcgugacggccaccgccgccgcggccgacggguggaagggccgccugcccagcccccuggugcuccugccgcggagcgcccgcugccaggcccggcgccggcgcggcgggcggaccuccagccugcuccugcugccgcccacccccgagcgcgcccucuucgccucccccagccccgaccccagcccccggggccugggggccuccuccggcgccgccgagggggcgggcgccggccugcuccuggggugccgcgccagcauguccgacaaccagagcuggaacuccagcggcagcgaggaggacccggagacggaguccgggccgcccgucgagcggugcggcgugcugagcaaguggaccaacuacauccacggcuggcaggaccgcugggugguccucaagaacaacgcccuguccuacuacaagagcgaggacgagaccgaguacgggugccggggcuccaucugccugagcaaggccgugaucacgccccacgacuucgacgagugccgcuucgacaucuccgugaacgacagcgucugguaccuccgggcgcaggaccccgaccaccgccagcaguggaucgacgccaucgagcagcacaagaccgaguccggguacggcagcgaguccagccugcggcgccacggguccauggugagccugguguccggcgccagcggcuacuccgccaccagcaccuccagcuucaagaaggggcacagccuccgcgagaagcuggccgagauggagaccuuccgggacauccugugccgccaggucgacacgcuccagaaguacuucgacgcgugcgccgacgccguguccaaggacgagcugcagcgggacaagguggucgaggacgacgaggacgacuuccccaccacccgcagcgacggcgacuuccugcacuccaccaacgggaacaaggagaagcuguucccccacgugacgcccaagggcaucaacgggaucgacuucaagggcgaggccaucaccuucaaggccaccaccgcgggcauccucgccacgcugagccacugcaucgagcucauggugaagcgggaggacuccuggcagaagcgccuggacaaggagaccgagaagaagcggcgcaccgaggaggccuacaagaacgccaugaccgagcugaagaagaagucccacuucgggggcccggacuacgaggaggggcccaacucccucaucaacgaggaggaguucuucgacgcggucgaggccgcccuggaccggcaggacaagaucgaggagcagagccaguccgagaaggugcgccugcacuggcccacgagccuccccuccggcgacgccuucagcuccguggggacccaccgguucguccagaagccguacagccgcuccagcuccaugagcagcaucgaccugguguccgccagcgacgacgugcaccgguucuccagccaggucgaggagauggugcagaaccacaugaccuacucccugcaggacgucggcggcgacgcgaacuggcagcucgugguggaggagggggagaugaaggucuaccgccgggagguggaggagaacggcaucgugcuggacccccugaaggccacccacgccgucaagggggugacgggccacgaggugugcaacuacuucuggaacgucgacgugcgcaacgacugggagaccaccaucgagaacuuccacguggucgagacccucgccgacaacgccaucaucaucuaccagacgcacaagcggguguggcccgcgagccagcgcgacgugcuguaccuguccgucauccggaagaucccggcccucaccgagaacgaccccgagaccuggaucgugugcaacuucagcguggaccacgacuccgcgccccugaacaaccgcugcguccgcgccaagaucaacguggccaugaucugccagacccuggugagcccgcccgagggcaaccaggagaucucccgggacaacauccucugcaagaucacguacgucgccaacgugaaccccgggggcugggcccccgccagcgugcugcgcgccgucgcgaagcgggaguaccccaaguuccugaagcgcuucaccuccuacgugcaggagaagaccgccgggaagccgauccuguucuga

SEQ ID NO: 28533 - RNA, 5013 nt, Artificial Sequence
  derived and/or modified sequence opt1 from COL4A3__Homo_sapiens__NP_000082
augagcgcccgcaccgcgccccggccccaggugcugcuccugccccugcuccugguccugcucgcggccgcccccgccgccuccaagggcugcgugugcaaggacaagggccagugcuucugcgacggcgccaagggcgagaagggcgagaagggcuuccccggcccgcccggcagccccggccagaagggcuucaccggccccgagggccugcccggcccccagggccccaagggcuuccccgggcugcccggccucacgggguccaagggcgugcgcggcaucagcgggcugcccggcuucuccgggagccccggccugcccgggacccccggcaacaccggccccuacgggcucgucggcgugcccgggugcuccggcagcaagggggagcagggcuuccccggccugcccgggacccugggcuaccccgggauccccggcgccgccgggcucaagggccagaagggcgcccccgccaaggaggaggacaucgagcuggacgccaagggggacccgggccugcccggggcccccggcccccagggccuccccgggccgcccggcuucccggggcccguggggccgcccgggccgcccggcuucuucggcuuccccggggccaugggcccccgggggccgaagggccacaugggggagcgcgucaucggccacaagggcgagcggggcgugaagggccugacggggccgcccggcccgcccgggaccgugaucgucacccugaccggccccgacaaccgcacggaccucaagggcgagaagggggacaagggcgccaugggggagcccggcccgcccgggcccuccggccugcccggcgagagcuacggguccgagaagggcgcgcccggggaccccggccugcagggcaagcccgggaaggacggcgugcccggguuccccggcagcgagggggugaagggcaaccggggcuuccccgggcucaugggcgaggacgggaucaagggccagaagggggacaucgggccgcccggcuuccgcgggccgaccgaguacuacgacaccuaccaggagaagggcgacgaggggacccccgggccgcccgggccgcggggcgcccgcggcccccaggggcccuccggcccgcccgggguccccggcagccccggcuccagccggcccgggcugcgcggcgcccccggguggcccggccugaagggguccaagggcgagcggggccgccccgggaaggacgccaugggcacgcccgggagcccgggcugcgccgggucccccggccuccccggcagccccgggccgcccgggccgcccggggacaucguguuccggaagggcccgcccggggaccacggccugcccggcuaccuggggagccccggcaucccggggguggacggccccaagggggagcccggccuccugugcacccagugcccguacauccccgggccgcccgggcugccgggccuccccgggcugcacggcgucaagggcauccccgggcgccagggcgcggccgggcugaagggcucccccgggagcccgggcaacaccggccuccccggguuccccggcuuccccggggcccagggcgacccggggcugaagggcgagaagggcgagacccugcagcccgagggccaggugggcgugcccggggaccccggccuccgggggcagccgggccgcaagggccuggacgggauccccggcacgcccggggucaagggccugcccgggccgaagggcgagcucgcccuguccggcgagaagggggaccaggggccgcccggggaccccggcagcccgggcucccccgggcccgccggccccgcggggccgcccggcuacgggccccagggcgagccgggccugcaggggacccagggcgugcccggggcccccggcccgcccggggaggccggcccccggggcgagcucagcguguccacccccguccccgggccgcccgggccgcccgggccgcccggccaccccgggccccagggcccgcccggcauccccgggagccugggcaagugcggggaccccggccugcccggccccgacggggagcccggcauccccgggaucggcuucccggggccgcccggccccaagggcgaccagggguuccccggcaccaaggggucccucggcugccccgggaagaugggcgagcccggccugccggggaagcccggccugcccggggccaagggcgagcccgccguggcgaugcccggcggccccggcacgcccggguuccccggcgagcgcgggaacagcggcgagcacggggagaucggccugccgggccuccccgggcugcccggcacccccgggaacgagggccuggacggcccgcggggcgaccccggccagcccgggcccccgggcgagcaggggccgcccggccgcugcaucgagggcccccgcggggcccagggccuccccgggcugaacggccugaaggggcagcagggccggcgcggcaagaccgggcccaagggcgaccccgggauccccggccucgaccgguccggguucccgggcgagaccggcagccccgggauccccggccaccagggggagaugggcccgcugggccagcgcggguaccccggcaaccccgggauccugggcccgcccggggaggacggcgugaucggcaugaugggguuccccggcgccaucgggccgcccggcccgcccgggaaccccggcacgcccggccagcgggggucccccggcauccccggggucaagggccagcgcgggacccccggcgccaagggcgagcagggggacaagggcaaccccgggccgagcgagaucucccacgugaucggcgacaagggggagcccggccucaagggcuucgcggggaaccccggcgagaaggggaaccggggcguccccggcaugccggggcugaagggccugaaggggcuccccggccccgccgggcccccgggcccccgcggcgaccuggggagcaccggcaaccccggggagcccggccugcgggggaucccgggcuccaugggcaacauggggaugcccggcagcaaggggaagcgcggcacccucggguuccccggccgggccggccgcccggggcugcccggcauccacgggcugcagggcgacaagggcgagcccggguacuccgagggcacgcggcccgggccgcccggccccaccggggaccccggccucccgggcgacauggggaagaagggcgagauggggcagcccgggccgcccgggcaccugggcccggccggccccgagggggcccccggcagccccgggagcccgggccugcccgggaagcccggcccccacggcgaccucggguucaagggcaucaaggggcugcugggcccgcccgggauccgcgggccgcccggccucccgggguuccccggcucccccgggcccaugggcauccggggcgaccaggggcgcgacggcaucccggggcccgcgggcgagaagggggagaccggccugcugcgggcgccgcccggcccccgcgggaaccccggcgcccagggggccaagggcgaccggggcgcccccggcuuccccggccuccccgggcgcaagggcgcgaugggggacgccggcccccgcgggcccaccggcaucgagggcuucccggggccgcccggccugcccggggccaucaucccgggccagacggggaaccgggggccgcccggcagccgcgggucccccggcgccccggggccgcccggcccgcccggcagccacgugaucgggaucaagggcgacaagggguccaugggccaccccgggcccaagggcccgcccggcaccgccggggacauggggccgcccgggcggcugggcgcgcccgggacccccggccuccccggcccccgcggggaccccggcuuccagggguuccccggcgugaagggggagaagggcaaccccggcuuccuggggagcaucggcccgcccgggcccaucggccccaagggcccgcccgggguccggggcgaccccgggacccugaagaucaucucccuccccggcagccccgggccgcccggcacgcccggcgagcccgggaugcagggcgagcccgggccgcccggcccgcccgggaaccugggccccugcggcccccgcgggaagcccggcaaggacgggaagcccggcacccccgggcccgccggcgagaagggcaacaagggguccaagggcgagcccgggcccgccggcagcgacgggcugcccggccucaagggcaagcggggcgacuccggcagccccgccaccuggaccacccgcggguucguguucacgcggcacucccagaccaccgcgaucccgagcugccccgagggcaccgugccccuguacuccggcuucagcuuccuguucguccaggggaaccagcgcgcccacggccaggaccucgggacgcugggcuccugccugcagcgguucaccaccaugcccuuccucuucugcaacgugaacgacgugugcaacuucgccagccgcaacgacuacagcuacuggcuguccaccccggcccugaugcccaugaacauggcccccaucacggggcgggcgcucgagcccuacaucagccgcugcaccgucugcgagggcccggccaucgccaucgccgugcacucccagaccaccgacaucccgcccugcccccacggcuggaucagccuguggaagggguucuccuucaucauguucacgagcgccggcuccgaggggaccggccaggcgcuggccagcccgggguccugccucgaggaguuccgggccagccccuuccuggagugccacggccgcgggaccugcaacuacuacuccaacagcuacuccuucuggcuggccagccucaaccccgagcggauguuccgcaagcccaucccguccaccgugaaggccggggagcuggagaagaucaucagccggugccaggucugcaugaagaagcgccacuga

SEQ ID NO: 28534 - RNA, 5073 nt, Artificial Sequence
  derived and/or modified sequence opt1 from COL4A4__Homo_sapiens__XP_005246338
auguggagccugcacaucgugcucaugcgcugcuccuuccggcugaccaagagccuggccaccggccccuggucccucauccugauccuguucagcguccaguacguguacggguccggcaagaaguacaucgggccgugcggcgggcgcgacugcagcgugugccacugcguccccgagaagggcucccggggcccccccgggccgcccggcccccaggggcccaucggcccgcucggggcccccggccccaucggccugagcggggagaagggcaugcgcggggaccggggccccccgggcgcggccggggacaagggcgacaaggggcccacgggcgugcccggguuccccggccuggacggcaucccggggcaccccggcccccccgggccgcgcggcaagcccgggauguccggccacaacggcagccggggggaccccggcuuccccgggggccgcggggcccucggcccgggcgggccccugggccaccccggggagaagggcgagaagggcaacuccguguucauccugggggccgucaagggcauccagggggaccggggcgaccccgggcucccgggccugcccggcagcuggggggccggcgggcccgcgggcccgaccggguaccccggcgagcccggccugguggggcccccgggccagcccgggcgccccggccucaaggggaaccccggcgugggcgucaaggggcagaugggcgacccgggggaggugggccagcaggggucccccggccccacccugcugguggagcccccggacuucugccucuacaagggcgagaaggggaucaagggcauccccgggauggucggccugcccggccccccggggcggaagggcgagagcgggaucggcgccaagggggagaagggcauccccggcuuccccgggccccgcggcgacccgggguccuacggcagccccggguuccccggccugaagggcgagcucgggcuggugggcgaccccgggcuguucggccucaucgggccgaagggcgaccccggcaaccgggggcaccccggcccgcccggggugcuggucacccccccccugccgcucaagggcccccccggcgaccccggguucccgggccgcuacggggagacgggcgacguggggccccccggccccccgggccugcuggggcggcccggcgaggccugcgccgggaugaucggcccccccgggccgcagggcuuccccggccuccccgggcugcccggcgaggcggggaucccgggccgccccgacuccgcccccgggaagcccggcaagccgggcagccccgggcugcccggcgcccccgggcuccagggccugccgggguccagcgugaucuacugcagcgucggcaaccccggcccccaggggaucaagggcaagguggggccgcccggcggccgggggcccaagggcgagaaggggaacgagggccugugcgccugcgagcccgggccgaugggcccccccggccccccggggcuccccggccgccagggguccaagggcgaccuggggcugcccggcuggcucggcaccaagggggaccccggcccgcccggggccgagggcccccccgggcugccgggcaagcacggcgcgagcgggccccccggcaacaagggggccaagggcgacaugguggucucccgggugaaggggcacaagggcgagcgcggccccgacgggccgcccggcuuccccgggcagcccggcagccacggccgggacgggcacgccggcgagaagggggacccgggcccccccggggaccacgaggacgccacccccggcggcaagggguucccgggcccccuggggcccccgggcaaggccgggcccgugggcccccccggccucggguucccgggcccccccggggagcgcggccaccccggggucccgggccaccccggcgugcgcgggcccgacggccugaaggggcagaagggcgacaccaucuccugcaacgucacguaccccggccggcacgggccgcccggcuucgacgggccccccggcccgaagggguuccccggcccccagggcgcgcccgggcugagcggcuccgacgggcacaagggccgcccggggacccccggcaccgccgagauccccggccccccgggguuccggggcgacaugggggaccccggcuucgggggcgagaagggcagcucccccguggggccgcccggcccccccgggagcccgggcgugaacgggcagaagggcauccccggcgaccccgccuucgggcaccucggccccccggggaagcgcggccuguccggcguccccgggaucaagggcccccggggggaccccggcugcccgggggccgagggccccgccggcauccccggguuccugggccucaaggggcccaagggccgcgaggggcacgcgggcuucccgggcgugcccgggccccccggccacagcugcgagcggggggccccgggcauccccgggcagcccggccugcccggcuacccggggucccccggcgcccccgggggcaagggccagcccggggacgugggcccgcccgggcccgccggcaugaaggggcugccgggccugcccggccgccccggggcccacggccccccggggcuccccggcauccccgggcccuucggcgacgacggccugccggggccccccggccccaaggggccgcggggccugcccggguuccccggcuuccccggcgagcgcgggaagccgggcgcggaggggugccccggcgccaagggggagcccggcgagaagggcaugagcgggcuccccggcgaccgggggcugcgcggcgccaagggcgccaucgggccgcccggcgacgagggggagauggcgaucaucucccagaagggcacccccggggagcccggcccgcccggcgacgacggguuccccggcgagcggggggacaagggcacgcccgggaugcagggccgccggggcgagccggggcgcuacggcccccccggguuccaccggggcgagccgggggagaagggccagcccggcccccccgggccgcccggcccccccgggagcaccggccugcgcggcuucaucggguucccgggccuccccggggaccagggcgagcccgggucccccggcccgcccggcuucagcgggaucgacggcgcccgggggcccaagggcaacaagggggaccccgccucccacuucggcccgcccggccccaagggggagcccggcagcccggggugccccggccacuucggggccagcggcgagcagggccugcccgggauccagggcccccgcggguccccgggccgccccgggccccccggcagcuccggcccgcccgggugccccggcgaccacgggaugccgggccugcggggccagcccggggagaugggcgaccccgggccccgcggccuccagggggacccgggcauccccggcccccccgggaucaagggcccgagcgggucccccggccugaacgggcugcacggccucaagggccagaaggggaccaagggcgccagcgggcugcacgacgucggcccccccgggccggugggcauccccggccugaagggggagcggggcgaccccgggucccccggcaucagcccgcccgggccccgcggcaagaagggccccccggggccccccggcuccagcgggcccccgggccccgcgggcgccaccgggcgggcccccaaggacaucccggaccccggcccccccggggaccagggcccgcccgggcccgacggcccccgcggcgccccggggccccccggccuccccggguccguggaccugcugcggggcgagccgggggacugcggccuccccggcccccccgggccgcccggcccccccgggccgcccggcuacaagggguuccccggcugcgacggcaaggacgggcagaagggccccgucggguucccgggcccccagggcccccacggguuccccggcccgcccggggagaagggccugcccgggccgcccggccgcaagggccccacggggcugcccggcccgcggggggagcccggcccccccgccgacguggacgacugcccgcgcauccccgggcuccccggcgcgcccggcaugcgggggccggagggcgccauggggcugcccggcaugcgcgggcccagcggccccggcugcaagggggagccgggccuggacgggcggcgcggcguggacgggguccccggcucccccggccccccggggcggaagggcgacaccggggaggacggcuaccccggcgggcccggccccccggggcccaucggcgaccccgggcccaagggcuucggcccgggguaccucggcggguuccugcuggugcuccacagccagaccgaccaggagcccaccugcccccugggcaugccgcgccuguggacgggguacucccuccuguaccuggagggccaggagaaggcccacaaccaggaccucggccuggccgggagcugccugcccguguucuccacccuccccuucgccuacugcaacauccaccaggucugccacuacgcgcagcggaacgaccgcagcuacuggcuggccagcgccgccccccugccgaugaugccccucuccgaggaggcgauccggcccuacgugagccgcugcgccgugugcgaggcccccgcccaggccgucgcggugcacucccaggaccagagcaucccgcccugcccccagaccuggcggucccuguggaucggcuacagcuuccugaugcacaccggggccggcgaccaggggggcggccaggcccucaugucccccgggagcugccuggaggacuuccgcgccgccccguuccuggagugccagggccgccaggggacgugccacuucuucgcgaacaaguacuccuucuggcucaccaccgugaaggccgaccugcaguucagcuccgcccccgcccccgacacccugaaggagagccaggcccagcggcagaagaucucccgcugccaggucugcgugaaguacagcuga

SEQ ID NO: 28535 - RNA, 5058 nt, Artificial Sequence
  derived and/or modified sequence opt1 from COL4A5__Homo_sapiens__NP_000486
augaagcugcgcggcgugagccucgccgccgggcuguuccugcucgcgcugucccuguggggccagcccgccgaggccgccgccugcuacgggugcagcccgggcuccaagugcgacugcagcgggaucaagggcgagaagggcgagcggggguuccccggccucgaggggcaccccggccugcccggguucccgggccccgagggcccccccgggccgcgcggccagaagggggacgacggcauccccggcccccccgggccgaagggcauccgggggccccccggccugcccggguucccgggcacccccggccuccccgggaugcccggccacgacggggcgccgggcccccaggggauccccggcugcaacggcaccaagggggagcgcggcuuccccggguccccgggcuuccccgggcugcagggcccccccggcccgcccgggauccccggcaugaagggggagccgggcagcaucaucauguccagccugcccggccccaaggggaaccccggcuacccggggccccccggcauccaggggcuccccggcccgacgggcauccccgggcccaucggccccccggggccccccggccugauggggcccccgggcccccccggccugcccgggccgaagggcaacauggggcucaacuuccagggccccaagggggagaagggcgagcagggccugcaggggccccccggcccgcccgggcagaucuccgagcagaagcggcccaucgacgucgaguuccagaagggcgaccaggggcugccgggcgaccgcggcccccccgggcccccgggcauccgggggccccccggccccccgggcggggagaagggcgagaagggggagcagggcgagcccgggaagcgcggcaagcccggcaaggacggggagaacggccagcccgggaucccgggccuccccggggaccccggcuaccccggcgagccggggcgggacggcgagaaggggcagaagggcgacaccgggccccccggccccccgggccuggugaucccccgccccgggaccggcaucaccaucggggagaagggcaacaucggccugcccgggcucccgggcgagaagggggagcggggcuuccccgggauccagggcccccccggccugccggggccccccggcgccgccgugauggggccgcccggcccccccggguucccgggcgagcgcggccagaagggggacgagggcccccccgggaucagcauccccggcccgcccgggcuggacggccagcccggcgcccccgggcucccgggcccccccgggcccgcgggcccgcacaucccccccuccgacgagaucugcgagcccgggccgcccggcccccccggcagcccgggggacaagggccugcagggggagcagggcgucaagggcgacaagggggacacgugcuucaacugcaucggcaccgggaucuccggcccccccgggcagcccggccugccgggccuccccgggcccccgggcagccugggguuccccggccagaagggggagaagggccaggccggcgccaccgggcccaagggccugcccgggaucccgggcgcccccggggcccccggcuuccccggcuccaagggggagccgggcgacauccucaccuuccccgggaugaagggcgacaagggggagcugggcagccccggcgcgcccgggcugccgggccuccccgggacgcccggccaggacggccugcccgggcugccgggccccaagggggagcccggcgggaucaccuucaagggcgagcggggccccccggggaaccccggccuccccgggcugcccggcaacaucgggccgaugggcccccccggcuucgggccgcccggccccgugggggagaagggcauccaggggguggccggcaaccccggccagccggggauccccggccccaagggggaccccggccagaccaucacccagccgggcaagcccgggcugcccggcaaccccgggcgcgacggcgacgucgggcucccgggcgaccccggccugcccgggcagcccggccugccggggauccccggcuccaagggggagcccggcauccccggcaucgggcucccgggcccccccgggcccaagggcuucccggggauccccggcccccccggcgccccggggacgcccggccggaucgggcuggagggccccccggggccccccggcuuccccggcccgaagggggagcccggcuucgcccugcccgggcccccgggcccccccggccuccccggguucaagggcgcccuggggccgaagggcgaccgcggguuccccggcccccccggcccgcccgggcggaccggccuggacgggcuccccggccccaagggggacgugggcccgaacggccagcccgggcccaugggccccccggggcugcccggcaucggggugcagggcccccccggcccgcccgggauccccggcccgaucgggcagcccggccugcacggcauccccggggagaagggcgaccccgggccgcccggccuggacguccccgggcccccgggcgagcgcggcagccccgggauccccggcgcgcccgggccgaucggcccccccgggucccccggccucccgggcaaggccggggccagcggcuuccccgggaccaagggcgagauggggaugaugggcccccccggcccgcccgggccccugggcauccccgggcggagcggcgugccggggcugaagggcgacgacggccuccaggggcagcccggccugcccgggcccaccggcgagaagggcuccaagggggagccgggccugcccgggcccccgggccccauggaccccaaccuccuggggagcaagggcgagaagggcgagcccgggcugccgggcauccccgggguguccggccccaagggguaccagggccuccccggcgacccggggcagcccggccugagcgggcagcccggccugcccgggccgcccggccccaagggcaaccccgggcucccgggccagcccgggcugaucggcccccccggccugaaggggacgaucggcgacaugggguucccgggcccccagggggucgagggcccccccggcccguccggggugcccggccagcccgggagcccgggccuccccgggcagaagggcgacaagggcgaccccgggaucuccagcaucggccugcccgggcugccgggccccaagggggagcccggccuccccggcuacccggggaaccccggcaucaagggguccgugggcgaccccgggcugcccggccugccgggcacccccggggccaagggccagcccgggcuccccggcuucccgggcacccccgggccccccggcccgaaggggaucagcggcccccccgggaaccccggccugccgggcgagcccgggcccgucggcgggggcgggcaccccggccagccgggcccccccggggagaagggcaagccggggcaggacggcauccccgggcccgccggccagaagggcgagcccgggcagccgggcuucgggaaccccggcccccccgggcugccgggccucuccggccagaagggggacggcgggcugcccggcauccccggcaaccccgggcugccgggccccaagggggagcccggcuuccacggguuccccggcgugcagggcccgcccgggccccccggcagcccggggcccgcgcucgagggccccaaggggaaccccggcccgcagggcccccccgggcgccccggccugccggggcccgagggccccccggggcugcccggcaacggcgggaucaagggcgagaaggggaaccccggccagcccggccucccggggcugcccggccugaagggggaccagggcccccccgggcuccagggcaacccgggccggcccgggcugaacggcaugaagggggaccccggccugcccggggugccgggcuuccccggcaugaaggggcccuccggcguccccgggagcgccggcccggagggggagcccggccucaucggcccccccgggccgcccggccugcccgggcccuccggccagagcaucaucaucaagggggacgccggcccgcccggcauccccgggcagccgggccugaaggggcuccccggcccccagggcccccaggggcugccgggccccaccgggccccccggcgacccggggcgcaacggccugcccggcuucgacggggccggcgggcgcaagggcgaccccgggcuccccggccagccgggcacgcgggggcuggacggcccccccgggcccgacggccugcaggggccgcccggcccccccggcaccuccagcguggcccacggguuccucaucacccgccacucccagaccacggacgcgccgcagugcccccagggcacccugcagguguacgagggguucagccugcucuacguccagggcaacaagcgggcccacggccaggaccuggggaccgccggcagcugccugcgccgguucuccaccaugcccuucauguucugcaacaucaacaacgugugcaacuucgccagccgcaacgacuacuccuacuggcucagcacgcccgagccgaugcccauguccaugcagccccugaaggggcagagcauccagcccuucaucucccggugcgcggugugcgaggccccggccgucgugaucgccguccacagccagaccauccagaucccccacugcccccagggcugggacucccuguggaucggguacagcuucaugaugcacaccuccgccggcgcggagggcagcgggcaggcccucgccuccccgggcagcugccuggaggaguuccgcuccgcccccuucaucgagugccacgggcggggcaccugcaacuacuacgccaacagcuacuccuucuggcuggcgacgguggacgugagcgacauguucagcaagccccaguccgagacccucaaggccggggaccugcgcacccggaucagccgcugccaggucugcaugaagcggaccuga

SEQ ID NO: 28536 - RNA, 5001 nt, Artificial Sequence
  derived and/or modified sequence opt1 from COL4A6__Homo_sapiens__NP_001274688
augcaccccggccuguggcuccugcuggugacccucugccugaccgaggagcuggccgccgcgggcgagaaguccuacggcaagcccugcggcggccaggacugcuccggcagcugccagugcuuccccgagaagggcgcccgcggccggcccggccccaucggcauccagggccccacgggcccccagggguucaccggcuccaccggccucagcgggcugaagggcgagcgcggguuccccggccugcucggccccuacgggccgaagggcgacaaggggcccaugggcgugcccggguuccugggcaucaacggcauccccgggcacccgggccagcccgggccccgggggccgcccgggcuggacggcugcaacggcacccagggggccgugggcuuccccgggcccgacggcuaccccgggcuccugggcccgcccggccugcccgggcagaagggcuccaagggggaccccgugcucgcccccggcagcuucaagggcaugaagggggaccccggccugcccgggcuggacggcaucacggggccccagggcgccccgggcuuccccggggcggucggccccgccgggccgcccggccuccaggggccgcccggcccgcccggcccccuggggcccgacggcaacauggggcugggcuuccagggggagaagggcgugaagggcgacguggggcucccgggccccgccgggccgccgcccuccaccggcgagcuggaguucaugggguuccccaagggcaagaagggcagcaagggggagcccggccccaagggguuccccggcaucuccgggccgcccggguuccccggccuggggaccaccggcgagaagggggagaagggcgagaagggcaucccggggcuccccggcccccgcgggcccaugggcagcgaggggguccagggcccgcccggccagcaggggaagaagggcacgcugggguuccccggccugaacggguuccagggcaucgagggccagaagggggacaucggccucccggggcccgacguguucaucgacaucgacggcgccgugaucuccggcaaccccggggaccccggcgucccggggcugcccggccugaagggggacgagggcauccagggccuccgggggcccagcggcgugcccgggcugccggcgcuguccggcgugcccggggcccucggcccccagggcuuccccgggcugaagggcgaccaggggaacccgggccgcaccaccaucggggccgccggccugcccggccgggacgggcuccccggcccgcccgggccgcccggcccgcccagccccgaguucgagaccgagacgcugcacaacaaggaguccggguuccccggccugcgcggcgagcaggggcccaagggcaaccucgggcugaagggcaucaagggcgacagcggguucugcgccugcgacggcgggguccccaacaccgggccgcccggggagcccggcccgcccggccccugggggcugaucggccucccggggcugaagggcgcgcggggcgaccgcggcuccggcggggcccagggccccgccggggcccccggccugguggggccccucggcccgagcggccccaaggggaagaagggcgagcccauccuguccaccauccaggggaugcccggcgaccggggcgacagcggcagccagggcuuccgcggggugaucggcgagcccgggaaggacggcguccccggccugcccgggcuccccggccugccgggggacggcgggcagggcuuccccggcgagaaggggcugcccggccugcccggggagaagggccacccggggccgcccggccuccccggcaacgggcugcccggccugcccgggccccggggccuccccggggacaagggcaaggacggccugccggggcagcagggccugcccggguccaagggcaucacccuccccugcaucauccccggcagcuacgggccguccggcuuccccgggacgcccggcuucccggggcccaagggcagccgcggccugcccgggacccccggccagccgggguccagcggcuccaagggggagcccggcagccccggccuggugcaccuccccgagcugccgggguuccccggcccccgcggggagaagggccugcccggguucccgggccuccccggcaaggacgggcugcccggcaugaucgggucccccggccugccggggagcaagggcgccaccggcgacaucuucggggcggagaacggcgcccccggggagcagggccuccagggccugaccgggcacaagggcuuccugggggacuccggccuccccgggcugaagggcgugcacggcaagcccgggcugcucggcccgaagggggagcggggcagccccgggacgcccggccaggucggccagcccgggaccccgggcuccagcgggcccuacggcaucaaggggaaguccggccugcccggcgccccgggguuccccggcaucagcgggcaccccggcaagaagggcacccgggggaagaagggcccgcccggguccaucgugaagaagggccugcccgggcucaagggccugcccggcaaccccgggcuggugggccucaaggggagccccggcucccccggggucgccggccugcccgcccugagcggccccaagggggagaagggcagcgugggguucgugggcuucccggggauccccggccuccccggcauccccgggacccgcggccugaaggggaucccgggcuccacggggaagaugggccccagcggccgggcggggacccccggcgagaagggggaccgcggcaaccccggcccggucgggauccccagcccccggcgccccaugagcaaccuguggcucaagggcgacaaggggucccagggcagcgccggguccaacggcuucccgggcccccgcggggacaagggcgaggccgggcggcccgggccgcccgggcugcccggcgcccccggccugcccgggaucaucaagggcgugagcgggaagcccgggccgcccggguucaugggcauccgcggccucccggggcugaagggcuccagcgggaucaccggcuuccccggcaugcccggggaguccggcagccaggggauccggggcucccccgggcugccgggcgccagcggccuccccgggcugaagggcgacaacgggcagaccgucgagaucuccggcagccccgggcccaagggccagccgggcgaguccggguucaagggcacgaaggggcgcgacggccugaucgggaacaucggcuuccccggcaacaagggggaggacggcaaggugggggugagcggcgacgucgggcuccccggcgcgcccggcuucccggggguggccggcaugcggggcgagcccggccugcccggcagcuccgggcaccagggcgccaucgggccccugggcagcccggggcucaucggccccaagggccccuccaucaccggggugcccggcccggccgggcugcccggccccaagggggagaagggcuaccccggcaucgggaucggcgcgccggggaagcccggccugcgcgggcagaagggcgaccggggcuuccccgggcuccagggcccggccgggcugcccggcgcccccgggaucagccugcccucccucaucgccggccagccgggcgaccccgggcgccccggccuggacggggagcggggccgccccggcccggccgggccgcccggcccgcccgggcccagcuccaaccagggcgacaccggggaccccggcuuccccggcauccccgggcccaagggccccaagggggaccagggcauccccggguucagcggccugccgggcgagcucgggcugaagggcaugcgcggggagcccggcuucauggggacccccggcaaggucgggcccccgggcgaccccggcuuccccgggaugaagggcaaggcgggcccccggggguccagcggccugcagggggacccgggccagacgcccaccgccgaggccguccaggugcccccggggccccucggccugcccggcaucgacgggauccccggccugaccggggacccgggcgcccaggggcccgucggccuccagggcuccaaggggcugcccggcauccccgggaaggacggcccgagcgggcugcccgggccgcccggcgcccucggggacccgggccugcccgggcugcaggggccgcccggguucgagggcgcgccgggccagcaggggcccuucggcaugcccgggaugcccggccaguccaugcgggugggcuacacccucgugaagcacagccaguccgagcaggucccgcccugccccaucgggaugagccagcugugggugggcuacucccuccuguucguggaggggcaggagaaggcccacaaccaggaccugggcuucgccgggagcugccugccccgcuucuccacgaugccguucaucuacugcaacaucaacgaggucugccacuacgcccggcgcaacgacaagagcuacuggcucagcaccaccgcccccauccccaugaugccggugucccagacccagaucccccaguacaucagccggugcuccgugugcgaggcgcccagccaggccaucgccguccacucccaggacaucaccaucccccagugcccgcugggcuggcgcagccuguggaucggcuacuccuuccucaugcacacggccgcgggggccgagggcgggggccagagccuggugucccccgggagcugccuggaggacuuccgggccacccccuucaucgagugcuccggcgcccgcgggaccugccacuacuucgccaacaaguacagcuucuggcucaccacgguggaggagcgccagcaguucggggagcugcccgucuccgagacccugaaggcgggccagcuccacacccgggugagccgcugccaggugugcaugaagucccuguga

SEQ ID NO: 28537 - RNA, 5517 nt, Artificial Sequence
  derived and/or modified sequence opt1 from COL5A1__Homo_sapiens__NP_000084
auggacgugcacacccgcuggaaggcccggagcgcccugcgccccggcgcgccccugcucccgccccugcuccugcugcuccugugggcgcccccgcccucccgggccgcccagcccgccgaccugcucaagguccuggacuuccacaaccugcccgacgggaucaccaagacgaccggcuucugcgcgacccgccggagcuccaagggccccgacguggccuaccgcgugaccaaggacgcccagcucagcgcccccacgaagcagcuguaccccgcguccgccuuccccgaggacuucagcauccugaccaccgucaaggccaagaagggcucccaggccuuccucgugagcaucuacaacgagcagggcauccagcagaucggccuggagcugggccggucccccguguuccucuacgaggaccacaccggcaagcccggccccgaggacuacccccuguuccgcggcaucaaccugagcgacggcaaguggcaccggaucgcccucuccguccacaagaagaacgugacccugauccuggacugcaagaagaagaccaccaaguuccucgaccgcagcgaccaccccaugaucgacaucaacggcaucaucguguucggcacccggauccuggacgaggaggucuucgagggcgacauccagcagcuccuguucguguccgaccaccgcgcggccuacgacuacugcgagcacuacagccccgacugcgacacggccgugcccgacacgccccagucccaggaccccaaccccgacgaguacuacaccgagggcgacggcgagggcgagaccuacuacuacgaguaccccuacuacgaggaccccgaggaccugggcaaggagcccacgcccagcaagaagcccgucgaggccgccaaggagaccaccgaggugcccgaggagcugacccccacgcccaccgaggccgcccccaugcccgagaccuccgagggcgccggcaaggaggaggacgugggcaucggcgacuacgacuacguccccagcgaggacuacuacacccccucccccuacgacgaccucacguacggcgagggcgaggagaaccccgaccagcccaccgaccccggcgccggcgccgagauccccaccagcaccgcggacacgagcaacuccagcaaccccgcgcccccgcccggcgagggcgccgacgaccuggagggcgaguucaccgaggagaccauccggaaccuggacgagaacuacuacgaccccuacuacgaccccaccuccagccccuccgagaucggccccgggaugcccgccaaccaggacacgaucuacgagggcaucggcgggccccgcggcgagaaggggcagaagggcgagcccgccaucaucgagcccgggaugcucaucgagggcccgcccggccccgaggggcccgcgggccugcccgggccgcccggcaccaugggccccaccggccaggugggcgaccccggggagcgggggccgcccgggcgccccggccugcccggcgccgacgggcuccccggcccgcccgggaccaugcugaugcugcccuuccgguucggcgggggcggcgacgccgggagcaagggccccaugguguccgcccaggagagccaggcgcaggccauccuccagcaggcccgccuggcccugcgggggcccgccggccccauggggcucacgggccgccccggccccgucgggccgcccggcuccgggggccugaagggggagcccggcgacgugggcccccaggggccccggggcgugcaggggccgcccggccccgcgggcaagcccgggcgccgcggccgggccgggagcgacggcgcccgcgggaugcccggccagaccggccccaagggggaccggggcuucgacgggcuggccggccuccccggggagaagggccaccgcggcgaccccgggcccuccgggccgcccgggccgcccggcgacgacggggagcggggcgacgacggcgaggucgggccccgcggccugcccggggagcccggcccccggggccugcucgggcccaagggcccgcccgggccgcccggcccgcccggggugaccggcauggacggccagcccgggcccaagggcaacguggggccccagggcgagcccgggccgcccggccagcagggcaaccccggggcccagggccugcccgggccccagggcgccaucgggccgcccggcgagaagggcccgcuggggaagcccggccugcccgggaugcccggcgccgacgggccgcccggccaccccggcaaggaggggccgcccggcgagaagggcggccaggggccgcccgggccgcagggccccaucggguaccccggcccccgcggggucaagggcgccgacggcauccgggggcucaagggcaccaagggggagaagggcgaggacggguucccgggcuucaagggcgacauggggaucaagggcgaccgcggggagaucgggccgcccgggccccggggcgaggacggcccggaggggcccaagggccgcgggggccccaacggggaccccggcccgcuggggccgcccggggagaagggcaagcugggggugcccggccucccgggcuaccccgggcggcagggccccaaggggagcaucggcuuccccggguucccgggcgccaacggcgagaagggcggccgcgggacccccggcaagcccgggccgcggggccagcgcggccccacggggccccggggcgagcgcgggccccggggcaucaccgggaagccgggccccaagggcaacuccgggggcgacgggcccgccggcccgcccggcgagcgcgggcccaacggcccccaggggcccaccggcuuccccgggcccaaggggccgcccggcccgcccgggaaggacggccugcccgggcaccccggccagcgcggggagaccggcuuccagggcaagacggggccgcccgggccgcccggggucgugggcccgcaggggcccaccggcgagaccggccccaugggggagcggggccaccccgggccgcccggcccgcccggggagcagggccugcccggccucgcggggaaggagggcaccaagggggaccccggccccgccggccugcccgggaaggacgggccgcccgggcugcgcggcuuccccggggaccggggccucccgggccccgugggggcccugggccugaaggggaacgaggggccgcccgggccgcccggccccgccggcagccccggggagcgcggcccggcgggggccgccggccccaucgggauccccggccggcccggcccgcaggggccgcccggccccgccggggagaagggcgccccgggcgagaaggggccccagggccccgcggggcgcgacggccuccaggggcccgucggccugccgggccccgccgggcccgugggcccgcccggggaggacggcgacaagggggagaucggcgagcccggccagaagggguccaagggcgacaagggggagcaggggcccccgggccccacgggcccccagggccccaucgggcagccgggccccagcggggccgacggcgagcccgggccccggggccagcagggccuguucgggcagaagggcgacgaggggccgcgcggcuuccccgggccgcccgggccggugggccuccaggggcugcccgggccgcccggggagaagggcgagaccggcgacgucgggcagaugggcccgcccgggccgcccggcccgcgggggcccuccggcgcccccggcgccgacgggccccagggcccgcccgggggcaucgggaaccccggcgcggugggcgagaagggggagccgggcgaggccggggagcccggccugcccggcgagggcggcccgcccgggcccaagggcgagcgcggggagaagggcgagagcggccccuccggggccgccggcccgcccgggcccaaggggccgcccggggacgacggccccaagggcagccccgggcccgugggcuuccccggggaccccgggccgcccggggagcccggcccggccggccaggacgggccgcccggcgacaagggggacgacggcgagcccgggcagaccggcagcccgggccccaccggggagcccggcccguccgggccgcccggcaagcggggcccgcccgggcccgcgggccccgaggggcgccagggcgagaagggggccaagggcgaggccggccucgaggggccgcccggcaagacggggcccaucggcccccagggggcccccggcaagcccggccccgacgggcugcggggcauccccgggcccgucggcgagcaggggcugccgggcagccccggccccgacgggcccccgggccccauggggccgcccggccuccccgggcugaagggcgacuccggccccaagggggagaagggccaccccgggcugaucggccucaucgggcccccgggcgagcagggcgagaagggggaccgcggccugcccgggccccagggcagcuccggcccgaagggggagcagggcaucaccgggcccagcggccccaucgggcccccggggccgcccggccugcccgggccgcccggccccaagggggcgaagggcuccagcgggcccaccggcccgaagggcgaggccgggcaccccgggccgcccgggccgcccgggccgcccggcgaggugauccagccgcuccccauccaggccucccggacccgccggaacaucgacgccagccagcugcuggacgacgggaacggcgagaacuacguggacuacgccgacgggauggaggagaucuucggcucccucaacagccugaagcuggagaucgagcagaugaagcgcccccucgggacgcagcagaaccccgcgcggaccugcaaggaccugcagcugugccacccggacuuccccgacggcgaguacugggucgaccccaaccagggcugcucccgcgacagcuucaagguguacugcaacuucaccgccgggggcuccacgugcguguuccccgacaagaaguccgagggggcccggaucaccagcuggccgaaggagaaccccggcagcugguucagcgaguucaagcgcgggaagcuccuguccuacgucgacgccgagggcaaccccgugggcgugguccagaugaccuuccugcgccuccugagcgccuccgcgcaccagaacgugaccuaccacugcuaccagagcguggccuggcaggacgccgccaccggguccuacgacaaggcccugcgguuccucggcagcaacgacgaggagauguccuacgacaacaacccguacauccgcgcgcuggucgacgggugcgccacgaagaagggcuaccagaagaccgugcuggagaucgacacccccaagguggagcagguccccaucguggacaucauguucaacgacuucggggaggccagccagaaguucggcuucgaggugggccccgccugcuucaugggguga

SEQ ID NO: 28538 - RNA, 4500 nt, Artificial Sequence
  derived and/or modified sequence opt1 from COL5A2__Homo_sapiens__NP_000384
augauggccaacugggccgaggcgcgcccccugcugauccugaucgugcugcucggccaguucgucagcaucaaggcccaggaggaggacgaggacgagggcuacggcgaggagaucgccugcacccagaacggccagauguaccugaaccgggacaucuggaagcccgcccccugccagaucugcgugugcgacaacggcgccauccugugcgacaagaucgagugccaggacgugcucgacugcgcggaccccgucacgccgcccggcgagugcugccccgugugcagccagacgcccggcggcggcaacaccaacuucggccgcggccggaagggccagaagggcgagcccggccuggugcccgucgugaccggcauccgcggccggcccggccccgccggcccgcccggcagccagggcccccgcggggagcggggccccaaggggcgccccggcccccgggggccccagggcaucgacggcgagcccggggugcccggccagcccggggcccccgggccgcccgggcaccccucccaccccggccccgacggccugagccgccccuucuccgcccagauggcggggcucgacgagaaguccggccuggggucccaggucggccugaugcccgggagcgugggccccgugggcccccgggggccccagggccuccaggggcagcagggcggcgccgggcccaccgggccgcccggggagcccggcgaccccgggcccaugggccccaucggcucccgcgggcccgagggcccgcccgggaagcccggcgaggacggggagcccggccggaacggcaaccccggggaggucggcuucgccgggagccccggcgcccgcggguuccccggcgcccccggccugcccgggcugaagggccaccgggggcacaagggccucgaggggcccaagggcgaggugggcgcgcccggguccaagggcgaggccgggccgaccggccccaugggcgccauggggccccugggcccccgcgggaugccgggcgagcgggggcgccugggcccccagggcgcccccgggcagcggggcgcccacgggaugccgggcaagcccgggcccaugggcccccucggcaucccggggagcuccggcuuccccgggaaccccggcaugaagggggaggcgggccccaccggcgcccgcgggccggagggcccccaggggcagcggggcgagaccgggccgcccgggccggugggcagccccgggcugcccggcgccaucgggaccgacggcacgcccggcgccaaggggccgaccggcucccccgggaccagcgggccgcccggguccgccggcccgcccggcagccccgggccccagggcuccaccgggccgcagggcauccgcgggcagcccggcgaccccggcguccccggguucaagggcgaggcggggccgaagggcgagcccgggccccacggcauccagggcccgaucgggccgcccggcgaggaggggaagcgcggcccccggggcgacccggggacgguggggccgcccgggcccgugggcgagcgcggggcccccggcaaccggggcuuccccgggagcgacggccugcccgggcccaagggcgcccagggggagcgcggcccggucggcagcuccgggcccaagggcagccagggggaccccggccggcccggggagccgggccuccccggcgcccgcgggcugaccggcaaccccggggugcagggccccgaggggaagcugggcccgcucggcgcccccggggaggacggccggcccgggcccccgggcuccaucggcauccgcgggcagcccggcagcauggggcugcccggccccaagggguccagcggcgacccgggcaagcccggggaggcgggcaacgccggggugcccggccagcggggcgccccgggcaaggacggcgaggucgggcccuccggccccguggggcccccgggccuggccggggagcgcggcgagcaggggccgcccgggcccaccggcuuccaggggcucccggggccgcccggcccgcccggggagggcgggaagcccggcgaccagggggugcccggcgaccccggcgcggucgggccccugggcccccgcggggagcggggcaaccccggggagcggggcgagcccggcaucaccgggcugccgggcgagaaggggauggccggcgggcacggccccgacggccccaaggggagccccggcccguccgggacgcccggcgacaccgggcccccgggccuccagggcaugcccggggagcgcggcaucgccgggacccccggccccaagggcgaccgcgggggcaucggggagaagggcgccgaggggaccgccggcaacgacggcgcgcgggggcugccgggcccccuggggccgcccggcccggccgggcccacgggcgagaagggcgagcccgggccccggggccucguggggccgcccggcagccgcgggaaccccggcucccggggcgagaacgggcccaccggcgccgucggguucgccggcccgcagggccccgacgggcagcccggcgugaagggggagcccggcgagccggggcagaagggcgacgccggcagccccgggccccagggccuggcggggucccccggcccgcacgggcccaacggcgugcccggccugaagggcggccgcgggacccagggcccgcccggggccaccggcuuccccggcagcgccgggcgcgucggcccgcccgggcccgccggcgcccccgggcccgcgggcccccucggcgagcccgggaaggaggggccgcccgggcugcggggcgaccccggcucccacgggcgcgugggcgaccgggggcccgccgggccgcccgggggcccgggcgacaagggggaccccggcgaggacgggcagcccggccccgacgggccgcccggccccgccggcacgaccgggcagcgcggcaucguggggaugcccggccagcggggcgagcgcggcaugccgggccugcccgggcccgccggcacccccgggaaggucggcccgaccggcgcgacgggggacaaggggccgcccgggcccgugggcccgcccgggagcaacggccccgugggcgagccggggcccgagggccccgccgggaacgacggcacccccgggcgggacggcgccgucggcgagcgcggggaccggggcgacccggggcccgccggccuccccgggucccagggcgcccccggcaccccggggcccgugggcgcgcccggggacgccggccagcgcggggaccccggcagccggggcccgaucgggccgcccggccgcgccgggaagcggggccugcccggcccgcaggggccccgcggcgacaagggggaccacggcgaccggggcgaccgcggccagaagggccaccggggguucaccggccugcaggggcuccccggcccgcccgggcccaacggcgagcagggcuccgccgggauccccggccccuucgggccccgcgggccgcccgggcccgugggcccgagcggcaaggaggggaaccccggcccccuggggccgaucgggccgcccgggguccggggcagcgugggcgaggccgggcccgagggcccgcccggggagcccggcccgcccggcccgcccgggccgcccggccaccugacggcggcccucggggacaucaugggccacuacgacgaguccaugcccgacccccugcccgaguucaccgaggaccaggccgcccccgacgacaagaacaagaccgaccccggggugcacgccacccucaagagccucuccagccagaucgagacgaugcgcucccccgacggcagcaagaagcaccccgcgcggaccugcgacgaccugaagcugugccacuccgccaagcagagcggcgaguacuggaucgacccgaaccagggguccgucgaggacgccaucaagguguacugcaacauggagaccggcgagaccugcaucagcgccaaccccuccagcgugccccgcaagaccuggugggcguccaagagccccgacaacaagccggucugguacgggcuggacaugaaccgcggcucccaguucgccuacggggaccaccagagccccaacacggccaucacccagaugaccuuccuccggcugcuguccaaggaggccagccagaacaucaccuacaucugcaagaacagcgugggcuacauggacgaccaggccaagaaccucaagaaggcggugguccugaagggcgccaacgaccuggacaucaaggccgaggggaacauccgcuuccgguacaucgugcuccaggacacgugcuccaagcgcaacggcaacguggggaagaccgucuucgaguaccggacccagaacguggcccgccugcccaucaucgaccuggccccgguggacgucggcgggaccgaccaggaguucggcguggagaucggccccgugugcuucgucuga

SEQ ID NO: 28539 - RNA, 5238 nt, Artificial Sequence
  derived and/or modified sequence opt1 from COL5A3__Homo_sapiens__NP_056534
augggcaaccgccgggaccuggggcagccccgcgccggccucugccugcugcucgccgcgcugcagcugcucccggggacccaggccgaccccguggacguccugaaggcccugggcgugcaggggggccaggccggcgugcccgaggggcccggcuucugcccgcagcggacccccgagggggaccgcgccuuccggaucggccaggcgagcacgcucgggauccccaccugggagcuguuccccgagggccacuucccggagaacuucucccugcucaucacccugcgcggccagcccgccaaccagagcguccugcucuccaucuacgacgagcggggggcccgccagcugggccuggcccucgggcccgcgcugggccugcucggcgaccccuuccggccgcugccccagcaggugaaccugaccgacgggcgcuggcaccggguggccgucagcaucgacggcgagauggugacgcucguggccgacugcgaggcccagccccccguccuggggcacggcccgcgcuucaucuccaucgccgggcugaccgugcucggcacccaggaccugggcgagaagaccuucgagggggacauccaggagcugcucaucagccccgacccccaggcggccuuccaggccugcgagcgguaccugcccgacugcgacaaccuggccccggccgcgacgguggccccccagggcgagcccgagaccccccgcccgcggcgcaaggggaagggcaaggggcggaagaagggccgcggccggaaggggaagggccgcaagaagaacaaggagaucuggaccuccagccccccccccgacuccgccgagaaccagaccagcacggacaucccgaagaccgagacccccgcccccaaccucccgcccacccccacgccccuggucgugaccuccaccgugaccacggggcugaacgccaccauccucgagcggagccuggacccggacuccggcaccgagcuggggacccucgagacgaaggcggcccgcgaggacgaggagggcgacgacagcaccaugggccccgacuuccgcgccgccgaguaccccucccggacccaguuccagaucuuccccggggccggcgagaagggggcgaagggcgagccggccgucaucgagaagggccagcaguucgaggggccccccggcgcccccgggccgcagggcgugguggggcccagcggcccccccggcccgcccggguuccccggcgaccccgggccgcccggccccgccgggcugcccggcaucccgggcaucgacgggauccgcggcccccccgggaccgucaucaugaugccguuccaguucgcgggcggguccuucaagggcccccccgugagcuuccagcaggcccaggcccaggccgugcugcagcagacgcagcucuccaugaagggccccccggggcccgucggccugaccgggcggcccggccccguggggcugccgggccaccccggccucaagggggaggagggcgccgaggggccccagggcccccgcggccugcaggggccgcacggcccccccgggcgggugggcaagauggggcgccccggcgcggacggcgcccgggggcugccgggcgacaccgggcccaagggcgaccgcggguucgacggccuccccggccugcccggggagaagggccagcggggggacuucggccacgucgggcagccgggcccccccggcgaggacggggagcgcggcgccgaggggcccccgggccccaccggccaggccggggagcccggcccccgggggcugcugggcccgcgcgggagccccggccccacgggccggccgggggugaccggcaucgacggggcccccggcgcgaaggggaacgucggcccccccggcgagccggggccccccggccagcaggggaaccacggcagccaggggcuccccggcccgcagggccugaucgggacccccggcgagaaggggccccccggcaacccggggauccccggccugcccggcuccgacgggccccucggccacccggggcacgagggccccaccggcgagaagggggcccagggcccccccgggagcgccggcccgcccggguaccccggcccccgcggcgugaaggggacguccggcaaccgggggcugcagggcgagaagggggagaagggcgaggacggcuucccgggguucaagggcgacguggggcugaagggcgaccaggggaagcccggcgcccccggcccccgcggggaggacggcccggaggggcccaagggccaggccgggcaggcgggcgaggagggccccccggggagcgccggcgagaaggggaagcucggcguccccggccugcccggguaccccggccggccggggcccaagggcuccaucggguuccccggcccccugggcccgaucggggagaagggcaagagcgggaagaccggccagcccgggcucgagggcgagcgcggcccccccgggucccggggcgagcgcgggcagccgggcgccaccgggcagcccggccccaagggcgacguggggcaggacggcgcccccgggaucccgggcgagaagggccugcccgggcugcagggcccccccggguucccgggccccaaggggccccccggccaccagggcaaggacgggcgcccgggccaccccgggcagcggggcgagcucggguuccagggccagaccggccccccggggcccgcgggcgugcuggggccccagggcaagaccggggaggucggcccccugggcgagcgcgggccgcccggcccccccgggccgcccggcgagcaggggcuccccggccuggagggccgggagggggccaagggcgagcuggggcccccgggcccccucggcaaggaggggcccgccggccugcgcggguuccccggcccgaaggggggccccggcgaccccgggcccacgggccugaagggggacaagggcccgcccgggcccgugggcgccaacggcagccccggggagcggggcccgcucgggcccgccggcgggaucggccugcccggccaguccgggagcgagggccccguggggccggcgggcaagaagggcucccgcggggagcggggcccccccgggccgaccggcaaggacgggauccccggcccccugggcccccucgggccgcccggcgccgccgggcccagcggcgaggagggggacaagggcgacgucggcgcccccgggcacaagggcuccaagggggacaagggcgacgccgggccgcccggccagcccggcauccgcgggcccgcgggccacccggggccccccggcgccgacggggcccagggccggcgcggccccccggggcuguucggccagaagggggacgacggcgugcggggcuucgugggggucaucggcccccccgggcugcagggccuccccgggccgcccggcgagaagggcgaggugggggacgugggcagcauggggccccacggcgcccccgggccgcgcggcccccagggccccaccggguccgagggcacccccgggcugccgggcggggucggccagcccggcgccgugggggagaagggcgagcggggggacgcgggcgaccccggcccgcccggggcccccggcauccccgggccgaagggcgacaucggggagaagggcgacagcggccccuccggggccgccggcccccccgggaagaagggcccgcccggggaggacggcgcgaagggcagcguggggcccacgggccugcccggggaccucggcccgcccggggaccccggcgucuccggcaucgacgggagccccggcgagaagggggacccgggcgacguggggggccccggcccccccggggccagcggcgagccgggggcccccggcccccccggcaagcgcgggccguccggccacauggggcgggagggccgcgagggggagaagggcgccaagggcgagcccgggcccgacggccccccggggcggaccggccccaugggggcccgcggccccccgggccggguggggcccgagggccugcgcgggauccccggccccgucggggagccgggccugcucggcgcgcccgggcagaugggcccccccgggccgcugggccccagcgggcugcccggccucaagggcgacaccgggcccaagggcgagaaggggcacaucggccugaucggccugaucgggccgcccggcgaggccggggagaagggcgaccaggggcuccccggcgugcagggccccccggggcccaagggcgaccccgggcccccgggccccaucgggucccugggccaccccggccccccggggguggccggcccccuggggcagaagggcagcaaggggucccccggcagcaugggcccgcggggggacaccggccccgccgggccccccggcccgcccggcgcccccgcggagcuccacgggcugcgccgccggcgccgguucguccccgugccgcugcccguggucgagggcgggcucgaggaggugcuggccucccugacgagccucucccuggagcuggagcagcuccgccggccccccggcaccgccgagcgcccggggcuggugugccacgagcugcaccggaaccacccccaccuccccgacggcgaguacuggaucgaccccaaccagggcugcgcccgcgacagcuuccgggucuucugcaacuucaccgccgggggcgagaccugccuguacccggacaagaaguucgagaucgugaagcuggcguccuggagcaaggagaagcccgggggcugguacuccacguuccgccgggggaagaaguucagcuacguggacgccgacggcucccccgucaacguggugcagcucaacuuccugaagcugcucagcgccaccgcccgccagaacuucaccuacuccugccagaacgccgcggccuggcuggacgaggccaccggcgacuacagccacagcgcccgguuccuggggacgaacggcgaggagcucuccuucaaccagaccaccgcggccaccgucagcgugccccaggacgggugccgccugcggaagggccagacgaagacccuguucgaguucuccagcucccgcgccggguuccucccgcugugggacguggccgccaccgacuucggccagaccaaccagaaguucggcuucgagcuggggcccgucugcuucagcuccuga

SEQ ID NO: 28540 - RNA, 3087 nt, Artificial Sequence
  derived and/or modified sequence opt1 from COL6A1__Homo_sapiens__NP_001839
augcgcgccgcccgggcgcugcucccccugcugcuccaggccugcuggaccgccgcccaggacgagccggagacgccccgcgccguggcguuccaggacugccccgucgaccuguucuucgugcuggacaccagcgaguccguggcccuccggcugaagcccuacggcgcccuggucgacaaggucaagagcuucaccaagcgcuucaucgacaaccuccgggaccgcuacuaccggugcgaccgcaaccugguguggaacgccggggcgcugcacuacuccgacgagguggagaucauccagggccucacccggaugcccgggggccgcgacgcccucaagagcuccguggacgccgugaaguacuucgggaagggcaccuacacggacugcgccaucaagaagggccuggagcagcugcuggucgggggcagccaccugaaggagaacaaguaccucaucguggugaccgacgggcacccccuggagggcuacaaggagcccugcgggggccuggaggacgccgucaacgaggcgaagcaccucggcgugaagguguucuccgucgccaucacccccgaccaccuggagccgcggcugagcaucaucgccaccgaccacacguaccgccggaacuucaccgccgccgacugggggcagucccgcgacgcggaggaggccaucagccagaccaucgacaccaucguggacaugaucaagaacaacguggagcaggucugcugcuccuucgagugccagcccgcccggggcccgcccgggcuccgcggcgacccgggcuucgagggggagcggggcaagcccgggcugcccggcgagaagggggaggccggcgaccccggccgcccgggggaccugggccccgugggguaccagggcaugaagggggagaagggcagccggggcgagaaggggucccgcggccccaagggguacaagggcgagaaggggaagcggggcaucgacggcguggacggggucaagggcgagaugggguaccccggccucccgggcugcaaggggagccccggcuucgacgggauccagggcccgcccgggcccaagggcgaccccggcgccuucgggcugaagggcgagaagggggagcccggcgcggacggggaggccggccgccccggcuccagcgggccguccggcgacgaggggcagcccggcgagcccgggccgcccggcgagaagggcgaggccggggacgagggcaaccccgggcccgacggcgccccgggggagcgcggcggccccggggagcggggcccccgcgggacgcccggcacccggggcccgcgcggggaccccggcgaggccgggccccagggcgaccaggggcgggagggccccgugggcgugccgggggaccccggcgaggcggggcccaucggccccaagggguaccgcggcgacgagggcccgcccgggagcgagggcgcccgcggggcccccggccccgccgggccgcccggcgaccccggccugaugggggagcggggcgaggacgggcccgcgggcaacggcaccgagggguucccgggcuuccccggguaccccggcaaccgcggggccccgggcaucaacggcaccaagggguaccccggccucaagggggacgagggcgaggccggggaccccggcgacgacaacaacgacaucgcgccccggggcgucaagggggccaagggcuaccgggggccggagggcccccaggggccgcccggccaccagggcccgcccgggcccgacgagugcgagauccuggacaucaucaugaagaugugcuccugcugcgagugcaagugcggccccaucgaccuccuguucgugcuggacagcagcgaguccaucgggcugcagaacuucgagaucgccaaggacuucgucgugaaggugaucgaccgccucagccgggacgagcuggucaaguucgagcccggccaguccuacgccgggguggugcaguacagccacucccagaugcaggagcacgucagccugcgcucccccagcauccggaacgugcaggagcucaaggaggccaucaagucccugcaguggauggccggcggcacguucaccggggaggcccugcaguacacccgcgaccagcuccugccgcccagccccaacaaccggaucgcgcuggugaucaccgacggccgcuccgacacgcagcgggacaccaccccgcucaacguccugugcagccccgggauccaggugguguccgucggcaucaaggacguguucgacuucauccccggcagcgaccagcugaacgugaucuccugccaggggcucgcccccagccagggccgccccgggcugucccuggucaaggagaacuacgccgagcugcucgaggacgccuuccugaagaacgugaccgcccagaucugcaucgacaagaagugccccgacuacacgugccccaucaccuucagcuccccggcggacaucaccauccugcucgacggcagcgccagcguggggucccacaacuucgacaccacgaagcgcuucgccaagcggcuggccgagcgcuuccugaccgcgggccggaccgaccccgcccacgacguccgcguggccgugguccaguacagcggcaccgggcagcagcggcccgagcgcgccucccuccaguuccugcagaacuacacggcccuggcgagcgccguggacgccauggacuucaucaacgacgccaccgacgugaacgacgcccucggcuacgucacccgguucuaccgcgaggcguccagcggggccgccaagaagcggcugcuccuguucuccgacggcaacagccagggggccacccccgccgcgaucgagaaggccgugcaggaggcccagcgcgccggcaucgagaucuucguggucguggugggccggcaggucaacgagccgcacauccgcgugcuggugacggggaagaccgcggaguacgacgucgccuacggcgagucccaccuguuccgggugcccagcuaccaggcccuccugcgcgggguguuccaccagaccgucucccggaagguggcccugggcuga

SEQ ID NO: 28541 - RNA, 2757 nt, Artificial Sequence
  derived and/or modified sequence opt1 from COL6A2__Homo_sapiens__NP_478054
augcugcaggggaccugcagcgugcuccugcugugggggauccucggcgccauccaggcccagcagcaggaggucaucucccccgacaccacggagcgcaacaacaacugcccggagaagaccgacugccccauccacguguacuucgugcuggacaccagcgaguccgucaccaugcagagccccacggacauccuccuguuccacaugaagcaguucgugccccaguucaucucccagcugcagaacgaguucuaccuggaccagguggcgcucagcuggcgguacgggggccugcacuucuccgaccaggucgagguguucagcccgcccggguccgaccgcgccagcuucaucaagaaccugcagggcaucuccagcuuccggcgcggcaccuucaccgacugcgcccucgccaacaugaccgagcagauccggcaggaccgcuccaaggggacggugcacuucgccgucgugaucaccgacggccacgugaccgggagccccugcggcgggaucaagcugcaggcggagcgggcccgcgaggagggcauccggcuguucgccgucgcccccaaccagaaccucaaggagcagggccugcgcgacaucgcguccaccccgcacgagcuguaccggaacgacuacgccacgaugcuccccgacagcaccgagaucgaccaggacaccaucaaccgcaucaucaaggugaugaagcacgaggccuacggggagugcuacaagguguccugccuggagauccccggccccagcgggccgaagggcuaccggggccagaagggggccaagggcaacaugggggagcccggcgagcccgggcagaagggccgccagggcgaccccgggaucgagggcccgaucggguuccccggccccaaggggguccccggcuucaagggcgagaagggggaguucggcgccgacgggcggaagggcgcgccggggcuggccggcaagaacggcaccgacgggcagaagggcaagcucgggcgcaucggcccgcccggcugcaagggggaccccggcaaccgggggcccgacggcuaccccggggaggccggcucccccggcgagcgcggggaccagggcgggaagggcgaccccgggcggccgggccgccggggcccgcccggggagaucggcgccaaggggagcaagggcuaccaggggaacagcggcgcccccggcucccccggggugaagggcgcgaagggcggccccgggccccgcggcccgaagggcgagcccgggcgccggggcgaccccgggacgaagggcagccccggcuccgacgggccgaagggcgagaagggggaccccggccccgaggggccccgcggccuggccggcgagguggggaacaagggcgccaagggggaccggggccugccggggccccgcggcccccagggcgcccucggggagcccggcaagcaggggagccggggcgacccgggggacgccggcccccgcggcgacuccgggcagcccggccccaagggggacccgggccggcccggcuucagcuaccccgggccccgcggcgcgccgggggagaagggcgagcccgggccccggggcccggagggcgggcgcggcgacuucgggcugaagggcgagcccgggcggaagggcgagaagggcgagcccgccgaccccgggccgcccggcgagcccgggccccgcggcccgcgcgggguccccggccccgagggcgagcccgggccgcccggcgaccccgggcugaccgagugcgacgugaugaccuacgugcgggagaccugcggcugcugcgacugcgagaagcggugcggggcccucgacgucguguucgugaucgacuccagcgaguccaucggcuacacgaacuucacccuggagaagaacuucgucaucaacguggucaaccgccugggcgccaucgccaaggaccccaagagcgagaccgggacccgggugggcgugguccaguacucccacgaggggacguucgaggcgauccagcucgacgacgagcgcaucgacagccuguccagcuucaaggaggccgugaagaaccuggaguggaucgccggcggcaccuggaccccguccgcccucaaguucgcguacgaccggcugaucaaggagagccgccgccagaagacccggguguucgccgucgugaucacggacgggcgccacgacccccgggacgacgaccugaaccuccgcgcccugugcgaccgggacgugaccgucaccgccaucggcaucggggacauguuccacgagaagcacgaguccgagaaccuguacagcaucgccugcgacaagccccagcagguccgcaacaugacccucuucuccgaccugguggcggagaaguucaucgacgacauggaggacgugcugugccccgacccgcagaucgugugccccgaccuccccugccagacggacgcccccuggccgggcggggagccgcccgugaccuuccugcggaccgaggagggccccgacgccaccuucccccgcacgaucccccugauccagcagcuccugaacgccaccgagcugacccaggaccccgccgcguacagccagcucgucgccgugcugguguacaccgccgagcgggccaaguucgccaccggcgucgagcgccaggacuggauggagcuguucaucgacacguucaagcuggugcaccgggacaucgugggggacccggagaccgcgcucgcccugugcuga

SEQ ID NO: 28542 - RNA, 9534 nt, Artificial Sequence
  derived and/or modified sequence opt1 from COL6A3__Homo_sapiens__NP_004360
augcggaagcaccggcaccucccccucguggccgucuucugccuguuccugagcggcuucccgaccacccacgcccagcagcagcaggccgacgugaagaacggggccgccgccgacaucaucuuccugguggacagcagcuggacgaucggcgaggagcacuuccagcuggugcgcgaguuccuguacgacguggugaagucccuggccgucggggagaacgacuuccacuucgcgcuggugcaguucaacggcaacccccacaccgaguuccugcugaacaccuaccggaccaagcaggaggugcugagccacaucuccaacaugagcuacaucgggggcacgaaccagaccggcaaggggcuggaguacaucaugcagucccaccugaccaaggccgccggcagccgcgccggggacggcgucccccaggugaucgugguccugaccgacgggcacuccaaggacggccuggcccugcccagcgccgagcugaaguccgccgacgugaacguguucgccaucggcgucgaggacgccgacgagggggcgcugaaggagaucgccagcgagccccugaacaugcacauguucaaccuggagaacuucacgucccugcacgacaucgugggcaaccucgugagcugcguccacuccagcgugucccccgagcgggccggggacaccgagacccugaaggacaucaccgcccaggacagcgccgacaucaucuuccugaucgacggcuccaacaacacgggcagcgugaacuucgcggucauccucgacuuccuggugaaccugcucgagaagcugcccaucgggacccagcagauccgcgugggcgucgugcaguucagcgacgagccccggaccauguucucccuggacaccuacagcacgaaggcccagguccucggggccgugaaggcccugggcuucgccgggggcgagcuggcgaacaucggccucgcccuggacuucguggucgagaaccacuucacccgcgccgggggcucccggguggaggagggggugccccagguccuggugcucaucagcgccggccccuccagcgacgagauccgcuacgggguggucgcccugaagcaggcguccguguucagcuucggccugggcgcccaggccgccucccgggcggagcuccagcacaucgccaccgacgacaaccugguguucaccguccccgaguuccgcagcuucggggaccugcaggagaagcuccugcccuacaucgugggcguggcccagcggcacaucguccugaagccgcccacgaucgugacccaggugaucgaggucaacaagcgcgacaucguguuccucguggacggguccagcgcccugggccuggccaacuucaacgcgauccgggacuucaucgccaaggucauccagcgccucgagaucgggcaggaccugauccagguggccguggcccaguacgccgacaccguccggcccgaguucuacuucaacacccaccccacgaagcgcgaggugaucaccgcggugcggaagaugaagccccuggacggcuccgcccuguacaccggcagcgcccucgacuucguccgcaacaaccuguucaccuccagcgccggguaccgggccgcggagggcauccccaagcugcucgugcugaucacgggcgggaagucccuggacgagaucagccagcccgcccaggagcucaagcgcuccagcaucauggccuucgccaucggcaacaagggggcggaccaggccgagcuggaggagaucgccuucgacagcucccugguguucauccccgccgaguuccgcgccgcgccccuccagggcaugcugcccgggcugcucgcgccccugcggacccugagcggcacccccgagguccacuccaacaagcgcgacaucaucuuccuccuggacgggagcgccaacgugggcaagaccaacuuccccuacgugcgggacuucgucaugaaccuggugaacucccucgacaucggcaacgacaacauccgcguggggcugguccaguucagcgacacgcccgugaccgaguucucccugaacaccuaccagaccaagagcgacauccucggccaccuccggcagcugcagcuccagggcggguccgggcugaacacgggcagcgcccuguccuacguguacgccaaccacuucaccgaggcgggcgggagccgcauccgggagcacgucccccagcuccugcugcuccugaccgccggccaguccgaggacagcuaccugcaggccgccaacgcccucacccgcgcggggauccugaccuucugcgugggcgccucccaggccaacaaggccgagcuggagcagaucgcguucaaccccagccucguguaccugauggacgacuucuccagccugcccgcccucccccagcagcugauccagccccugacgaccuacgucagcgggggcguggaggaggugccccucgcccagcccgaguccaagcgggacauccuguuccuguucgacggcagcgccaaccucgucgggcaguuccccguggugcgcgacuuccuguacaagaucaucgacgagcugaacgucaagcccgagggcacccggaucgccguggcgcaguacuccgacgacgugaaggucgagagccgcuucgacgagcaccaguccaagcccgagauccucaaccuggugaagcggaugaagaucaagaccgggaaggcccugaaccucggcuacgcccuggacuacgcccagcgcuacaucuucgucaagagcgccgggucccggaucgaggacggcgugcugcaguuccucgugcugcuggucgcgggccgcagcuccgaccggguggacgggcccgccagcaaccucaagcaguccggcgugguccccuucaucuuccaggccaagaacgccgaccccgccgagcuggagcagaucgugcugagcccggcguucauccucgccgccgagucccugcccaagaucggggaccugcacccccagaucgugaaccuccucaagagcguccacaacggcgcccccgccccgguguccggcgagaaggacguggucuuccugcucgacgggagcgagggcgugcgcuccggguucccccugcugaaggaguucgugcagcgggucguggagagccucgacgugggccaggaccgcguccgcguggcggugguccaguacuccgaccggacgcgccccgaguucuaccugaacagcuacaugaacaagcaggacguggugaacgccguccggcagcugacccuccucgggggccccaccccgaacaccggcgccgcccuggaguucgugcuccgcaacauccuggugagcuccgcggggagccggaucacggagggcgucccccagcugcucaucgugcugaccgccgaccgcuccggggacgacgugcggaaccccagcgucguggugaagcgcggcggggccguccccaucggcaucggcaucgggaacgccgacaucaccgagaugcagaccaucuccuucaucccggacuucgccguggcgauccccacguuccggcagcugggcaccgugcagcaggucaucagcgagcgcgugacccagcucacccgggaggagcugucccgccugcagcccgugcuccagccccugccgagccccggggucggcgggaagcgggacgugguguuccugaucgacggcucccagagcgccggccccgaguuccaguacguccgcacgcucaucgagcggcugguggacuaccuggacgugggguucgacaccacccgcgucgccgugauccaguucuccgacgacccgaagguggaguuccuccugaacgcccacagcuccaaggacgagguccagaacgccgugcagcggcugcgccccaagggcgggcggcagaucaacgugggcaacgcgcucgaguacgucagccgcaacaucuucaagcggccccugggcucccgcaucgaggagggggugccccaguuccugguccugaucagcuccggcaagagcgacgacgagguggacgacccggccguggagcucaagcaguucggggucgcccccuucaccaucgcccgcaacgccgaccaggaggagcuggugaagaucucccugagccccgaguacguguucagcgucuccacguuccgggagcuccccagccuggagcagaagcugcucaccccgaucaccacccugacguccgagcagauccagaagcugcucgcgagcacccgcuacccgccgcccgccguggaguccgacgccgccgacaucguguuccugaucgacagcuccgagggcguccggccggacggguucgcgcacauccgcgacuucgugagccggaucgugcgccggcugaacaucggccccuccaagguccgcgugggcgugguccaguucagcaacgacguguuccccgaguucuaccucaagaccuaccggucccaggcccccgugcuggacgccauccgccggcugcgccuccgcgggggcagcccgcugaacaccgggaaggcccuggaguucgucgcccgcaaccucuucgugaaguccgcgggcagccggaucgaggacggggugccccagcaccugguccuggugcucggcggcaagucccaggacgacgugagccgcuucgcccaggucauccgguccagcgggaucgugucccugggcgugggggaccgcaacaucgaccggacggagcugcagaccaucaccaacgacccccgccucgucuucaccgugcgcgaguuccgggagcugcccaacaucgaggagcgcaucaugaacagcuucggcccgagcgccgccacgcccgcgccgcccgggguggacaccccgccgcccucccggcccgagaagaagaaggcggacaucgucuuccugcucgacggcagcaucaacuuccgccgggacuccuuccaggaggugcugcgcuucgugagcgagaucgucgacaccguguacgaggacggcgacuccauccagguggggcugguccaguacaacagcgacccgaccgacgaguucuuccucaaggacuucuccacgaagcggcagaucaucgacgccaucaacaaggugguguacaagggcgggcgccacgccaacaccaaggucggccuggagcaccuccgggugaaccacuucgugcccgaggccgggagccgccucgaccagcgggucccccagaucgccuucgugaucaccggcggcaaguccguggaggacgcgcaggacgucagccuggcccugacccagcgcggggugaagguguucgccgucggcgugcggaacaucgacuccgaggagguggggaagaucgccagcaacuccgcgaccgccuuccgcgucggcaacgugcaggagcucagcgagcuguccgagcagguccuggagacgcuccacgacgccaugcacgagacccugugcccgggcgugaccgacgccgccaaggcgugcaaccuggacgugauccucggguucgacggcagccgggaccagaacgucuucguggcccagaagggguucgaguccaagguggacgccauccugaaccgcaucagccagaugcaccgggucuccugcagcggcgggcgcagccccaccgugcggguguccgucguggccaacacgcccagcggccccguggaggccuucgacuucgacgaguaccagccggagaugcuggagaaguuccgcaacaugcggucccagcaccccuacguccucaccgaggacacccugaagguguaccugaacaaguuccgccagagcucccccgacagcgugaaggucgugauccacuucaccgacggcgcggacggggaccucgccgaccugcaccgcgccuccgagaaccugcggcaggagggcgugcgcgcccucauccuggucgggcuggagcggguggugaaccucgagcgccugaugcaccuggaguucggccggggguucauguacgaccgcccccuccggcugaaccugcucgaccuggacuacgagcuggccgagcagcucgacaacaucgcggagaaggccugcugcggcgucccgugcaagugcagcggccagcgcggggaccggggccccaucggguccaucggccccaaggggauccccggcgaggacggcuaccgcggguacccgggcgacgagggcggccccggggagcgggggccgcccggcgugaacgggacgcagggcuuccaggggugcccgggccagcgcggcgugaaggggagccggggcuuccccggggagaagggcgaggucggggagaucggccuggacggccuggacggggaggacggcgacaaggggcuccccggcuccagcggggagaagggcaaccccggccgccggggcgacaaggggccgcgcggggagaagggcgagcgcggggacgugggcauccgcggcgaccccgggaaccccggccaggacucccaggagcgggggcccaagggcgagaccggcgaccuggggccgaugggcgugcccgggcgcgacggcguccccgggggccccggcgagaccgggaagaacggcggguucggccgccgggggccgcccggcgccaagggcaacaagggcggccccgggcagccgggcuucgagggggagcagggcacccgcggcgcccaggggcccgccggccccgcggggcccccgggccugaucggggagcagggcaucagcggcccccggggguccggcggggccgccggcgcccccggcgagcgcgggcggacgggcccccucgggcgcaagggcgagccgggggagcccggccccaagggcgggaucggcaaccgggggccccgcggcgagaccggggacgacggccgggacggcguggggagcgagggccgccgggggaagaagggcgagcgcggguucccgggcuaccccggccccaaggggaaccccggcgagccggggcugaacggcaccaccggccccaaggggauccggggccgccgggggaacuccgggccgcccgggaucgugggccagaagggcgacccgggguaccccggccccgcggggcccaagggcaaccgcggggacagcaucgaccagugcgcccugauccaguccaucaaggacaagugcccgugcugcuacggcccccucgagugccccgucuucccgacggagcuggccuucgcccuggacaccagcgagggcgugaaccaggacaccuucgggcggaugcgcgacgugguccucagcaucgugaacgaccugaccaucgccgaguccaacugcccccggggcgcgcgcguggccgucgugacguacaacaacgaggugaccaccgagauccgguucgccgacagcaagcgcaaguccguccugcucgacaagaucaagaaccuccagguggcccugaccagcaagcagcagucccucgagacggccaugagcuucguggcgcgcaacaccuucaagcggguccgcaacggguuccugaugcggaagguggccguguucuucuccaacacccccacccgcgccagcccccagcugcgggaggccguccucaagcuguccgacgccggcaucacgccgcuguuccucacccgccaggaggaccggcagcugaucaacgcgcugcagaucaacaacaccgccguggggcacgcccucgugcugcccgccggccgcgaccugaccgacuuccucgagaacguccugacgugccacgugugccuggacaucugcaacaucgaccccagcugcggcuucggguccuggcggcccagcuuccgcgaccggcgcgcggccggcuccgacguggacaucgacauggccuucauccucgacagcgccgagaccaccacccuguuccaguucaacgagaugaagaaguacaucgccuaccugguccggcagcucgacauguccccggaccccaaggcgagccagcacuucgcccgcguggccgucgugcagcacgcccccuccgagagcguggacaacgccagcaugcccccggucaagguggaguucucccugacggacuacgggagcaaggagaagcugguggacuuccugucccggggcaugacccagcuccaggggacccgcgcgcugggcagcgccaucgaguacaccaucgagaacgucuucgaguccgcccccaacccccgggaccugaagaucguggugcucaugcugaccggcgagguccccgagcagcagcuggaggaggcccagcgcgugauccuccaggccaagugcaagggguacuucuucgugguccugggcaucgggcggaaggugaacaucaaggagguguacacguucgcgagcgagccgaacgacgucuucuucaagcugguggacaaguccaccgagcucaacgaggagccccugaugcgcuucggccgccugcuccccagcuucguguccagcgagaacgccuucuaccugucccccgacauccggaagcagugcgacugguuccagggcgaccagccgaccaagaaccuggucaaguucgggcacaagcaggucaacgugcccaacaacgucaccagcucccccacgagcaaccccgugaccaccaccaagccggugacgaccaccaagcccgucaccacgaccaccaagcccgugaccacgaccaccaagcccgugaccaucaucaaccagccguccgucaagcccgccgccgcgaagcccgccccggccaagcccguggccgccaagcccguggcgacgaagauggccaccguccggccgcccguggccgugaagcccgccaccgccgcgaagcccgucgccgccaagcccgccgccgugcggccgcccgcggccgccgccgccaagcccguggcgaccaagcccgaggucccccgcccccaggccgccaagcccgccgcgacgaagcccgccaccaccaagccgauggugaagaugagccgggaggugcaggucuucgagaucaccgagaacuccgccaagcuccacugggagcgcgccgagccgcccggccccuacuucuacgaccugacggugaccagcgcccacgaccagucccuggugcucaagcagaaccugaccgucaccgaccgggugaucgggggccugcucgcggggcagacguaccacguggccgucgugugcuaccugcgcagccaggugcgggccaccuaccacggcagcuucuccaccaagaagucccagccgccgccgccccagccggcccgcuccgccagcuccagcaccaucaaccugauggucuccacggagccccucgcgcugaccgagaccgacaucugcaagcugcccaaggacgagggcacgugccgggacuucauccucaagugguacuacgaccccaacaccaagagcugcgcccgcuucugguacgggggcugcgggggcaacgagaacaaguucgggucccagaaggagugcgagaaggugugcgccccggugcuggccaagcccggcgucaucagcgugaugggcaccuga

SEQ ID NO: 28543 - RNA, 7845 nt, Artificial Sequence
  derived and/or modified sequence opt1 from COL6A5__Homo_sapiens__NP_001265227
augaagauccugcugaucaucuucgugcugaucaucuggacggagacccuggccgaccagagccccggccccgggcccguguacgccgacgugguguuccuggucgacagcagcgaccaccugggccccaagagcuuccccuucgugaagacguucaucaacaagaugaucaacagccugcccaucgaggcgaacaaguaccgcguggcccuggcccaguacuccgacgaguuccacagcgaguuccaccuguccaccuucaaggggcggagccccaugcugaaccaccucaagaagaacuuccaguucaucggcgggucccugcagaucggcaaggcccugcaggaggcccaccgcaccuacuucagcgcgcccaucaacggccgggaccgcaagcaguucccgcccauccucgucgugcuggccuccgccgagagcgaggacgagguggaggaggccuccaaggcgcugcagaaggacggggucaagaucaucagcgugggcgugcagaaggccuccgaggagaaccucaaggccauggccaccagccacuuccacuucaaccugcggacgauccgcgaccuguccaccuucagccagaacaugacccagaucaucaaggacgucaccaaguacaaggagggggccguggacgcggacaugcagguccacuuccccaucuccugccagaaggacagccucgccgaccuggucuuccugguggacgagagccucggcaccgggggcaaccugcggcaccuccagaccuuccucgagaacaucaccuccagcauggacgugaaggagaacugcaugcgccugggccugauguccuacagcaacuccgccaagaccaucagcuuccucaaguccagcacgacccaguccgaguuccagcagcagaucaagaaccugagcauccaggucgggaaguccaacaccggcgccgccaucgaccagaugcggcgcgacggguucagcgaguccuacggcagccggcgcgcgcagggcgugccccagaucgccgugcuggucacccaccggcccuccgacgacgaggugcacgacgccgcccucaaccugcgccuggaggacgugaacgucuucgcccucagcauccagggggcgaacaacacgcagcuggaggagaucguguccuacccgcccgagcagaccaucagcacccugaaguccuacgccgaccucgagaccuacagcacgaaguuccugaagaagcugcagaacgagaucuggagccagaucuccaccuacgccgagcagcggaaccucgacaagaccggcugcgucgacaccaaggaggccgacauccacuuccugaucgacgggagcuccagcauccaggagaagcaguucgagcagaucaagcgcuucaugcuggaggugacggagauguucuccaucggccccgacaaggugcgggucgggguggugcaguacagcgacgacaccgaggucgaguucuacaucaccgacuacuccaacgacaucgaccuccgcaaggccaucuucaacaucaagcagcugaccggcggcacguacaccgggaaggcgcuggacuacauccuccagaucaucaagaacggcaugaaggaccggaugagcaaggugcccugcuaccugaucgugcugaccgacgggauguccaccgaccgcgucguggagccggccaagcggcuccgcgccgagcagaucacggugcacgccgucggcaucggggcggccaacaagaucgagcugcaggagaucgccggcaaggaggagcgcgugagcuucggccagaacuucgacgcccugaaguccaucaagaacgaggugguccgggagaucugcgccgagaaggggugcgaggacaugaaggcggacaucauguuccugguggacagcuccuggagcaucggcaacgagaacuuccgcaagaugaagaucuucaugaagaaccuccugaccaagauccagaucggggccgacaagacccagaucggcgugguccaguucuccgacaagaccaaggaggaguuccagcugaaccgguacuucacgcagcaggagaucagcgacgccaucgaccgcaugucccucaucaacgaggggacccugaccggcaaggcccugaacuucgugggccaguacuucacccacagcaagggggcccggcucggcgcgaagaaguuccugauccugaucaccgacgggguggcccaggacgacguccgcgaccccgcccggauccuccgcggcaaggacgugacgaucuucagcgugggcgucuacaacgccaaccggucccagcuggaggagaucagcggggacuccagccugguguuccacguggagaacuucgaccaccucaaggcccuggagcgcaagcugaucuuccgggucugcgcgcuccacgacugcaagcgcaucacccugcuggacgugguguucguccucgaccacuccggcagcaucaagaagcaguaccaggaccacaugaucaaccugaccauccaccuggugaagaaggccgacguggggcgggaccgcguccaguucggcgcccucaaguacuccgaccagcccaacauccuguucuaccugaacaccuacagcaaccgguccgccaucaucgagaaccuccgcaagcggcgcgacaccgggggcaacaccuacaccgcgaaggcccugaagcacgccaacgcccuguucaccgaggagcacggcagccggaucaagcagaacgugaagcagaugcucaucgugaucacggacggggagucccacgaccacgaccagcugaacgacaccgcccuggagcuccgcaacaagggcaucaccaucuucgcggucggggugggcaaggccaaccagaaggagcuggaggggauggccggcaacaagaacaacaccaucuacguggacaacuucgacaagcugaaggacgucuucacgcucgugcaggagcgcaugugcaccgaggcccccgaggugugccaccuccaggaggccgacgucaucuuccugugcgacggcagcgaccggguguccaacagcgacuucgugaccaugaccacguuccucuccgaccugaucgacaacuucgacauccagagccagcgcaugaagaucgggauggcgcaguucggcuccaacuaccagagcaucaucgagcugaagaacucccucaccaagacccaguggaagacccagauccagaacgucagcaagagcgggggcuucccgcggaucgacuucgcccugaagaagguguccaacauguucaaccugcacgccgggggccgccggaacgccggcgugccccagacgcucgucgugaucaccagcggggacccccgcuacgacguggccgacgcggucaagacccugaaggaccugggcaucugcgugcucguccuggggaucggcgacguguacaaggagcaccuccugcccaucaccgggaacuccgagaagaucaucacguuccaggacuucgacaagcugaagaacguggacgucaagaagcggaucauccgcgagaucugccagagcugcggcaagaccaacugcuucauggacaucguggugggcuucgacaucuccacccacguccaggggcagccgcuguuccagggccacccccagcuggagagcuaccugcccgggauccuggaggacaucuccagcaucaagggcguguccugcggcgccgggaccgaggcccaggugagccucgccuucaaggucaacuccgaccagggcuuccccgcgaaguuccagaucuaccagaaggccguguucgacagccugcuccaggugaacgucuccgggccgacgcaccucaacgcccaguuccugcggagccugugggacaccuucaaggacaaguccgccagccgcggccaggugcuccugaucuucuccgacgggcugcagagcgaguccaacaucaugcucgagaaccagagcgaccggcugcgcgaggccggccuggacgcgcuccugguggucagccugaacaccaccgcccaccacgaguucuccagcuucgaguucggcaagcgguucgacuaccgcacgcaccucaccaucgggaugcgggagcugggcaagaagcugucccaguaccucgggaacaucgccgagcggacgugcugcugcaccuucugcaagugccccggcauccccgggccgcacggcacgcggggccugcaggccaugaaggggagccagggccugaaggggucccgcggccaccgcggggaggacggcaaccccggcgugcgcggggacaccggcccccagggggacaagggcaucgccggcugccccggggcguggggccagaaggggcucaagggcuucagcgggccgaagggcggccacggggacgacggcaucgacgggcuggacggcgaggaggggugccacggcuuccccggcaucaagggggagaagggcgaccccgggucccagggcagccccgggucccggggcgccccgggccaguacggggagaagggcuuccccggggaccccggcaaccccgggcagaacaacaacaucaagggccagaagggcagcaagggggagcagggccgccaggggcgcuccggccagaagggcgugcaggggagcccguccagccggggcucccgcgggcgggagggccagcgcgggcugcggggcgucagcggcgagcccgggaaccccggccccaccgggacccucggcgccgaggggcugcagggcccgcagggcucccaggggaaccccggccgcaagggggagaagggcagccaggggcagaagggcccccagggcucccccgggcugaugggcgccaaggggagcaccggccggccggggcuccugggcaagaagggcgagcccgggcugcccggcgaccucgggcccgugggccagacgggccagcgcgggcggcagggcgacagcgggaucccgggcuacgggcagaugggccgcaagggcgugaaggggccccggggcuuccccggggacgccggccagaagggggacaucggcaacccgggcauccccgggggccccgggcccaagggcuuccgcgggcuggcgcugaccgucggccucaagggcgaggaggggucccggggccugccggggccgcccggccagcgcggcaucaaggggauggccggccagcccguguacagccagugcgaccugauccgguuccuccgcgagcacuccccgugcuggaaggagaagugccccgccuaccccaccgagcugguguucgcccuggacaacagcuacgacgucaccgaggaguccuucaacaagacgcgggacaucaucaccagcaucgugaacgaccucaacauccgcgagaacaacugccccgugggggcccgggucgcgaugguguccuacaacagcggcaccuccuaccugauccgcuggagcgacuacaaccgcaagaagcagcugcugcagcagcucucccagaucaaguaccaggacaccacggagccgcgggacguggggaacgccaugcgcuucgucacccggaacguguucaagcgcaccuacgccggcgccaacgugcggcgcgucgcgguguucuucagcaacggccagaccgccucccggagcuccaucaucacggccaccauggaguucagcgcccuggacaucucccccaccguguucgccuucgacgagcgcgucuuccuggaggcguucggguucgacaacaccggcacguuccaggugauccccgugcccccgaacggggagaaccagacccucgagcggcugcgccggugcgcccugugcuacgacaagugcuuccccaacgccugcauccgcgaggccuuccuccccgaggacagcuacauggacgucguguuccugaucgacaacucccggaacaucgccaaggacgaguucaaggcggugaaggcccuggucagcagcgugaucgacaacuucaacaucgccuccgacccccucaucagcgacuccggcgaccgcaucgcccugcugagcuacuccccgugggagagcucccggcgcaagauggggaccgugaagaccgaguucgacuucaucacguacgacaaccagcuccugaugaagaaccacauccagaccagcuuccagcagcugaacggcgaggccaccaucggccgggcgcuccuguggaccacggagaaccuguuccccgagacccccuaccuccgcaagcacaaggucaucuucgugguguccgccggggagaacuacgagcggaaggaguucgucaagaugauggcccugcgcgccaagugccagggcuacgugaucuucgugaucagccugggguccacccggaaggacgacauggaggagcucgcgagcuacccccuggaccagcaccugauccagcucggccgcauccacaagccggaccugaacuacaucgccaaguuccugaagcccuuccucuacuccguccgccggggguucaaccaguacccgccgcccaugcuggaggacgccugccgccugaucaaccucggcggcgagaacauccagaacgacggguuccaguucgugaccgagcugcaggaggacuuccugggcgggaacggcuucaucgggcaggagcucaacagcggccgggagucccccuucgucaagacggaggacaacggcagcgacuaccugguguaccugcccucccagauguucgagccccagaagcucaugaucaacuacgagaaggaccagaaguccgccgagaucgccucccugaccagcgggcacgagaacuacggccgcaaggaggagcccgaccacaccuacgagcccggggacgugagccugcaggaguacuacauggacgucgcguuccucaucgacgccucccagcgggugggcagcgacgaguucaaggaggugaaggccuucaucaccuccguccuggacuacuuccacaucgcccccacgccgcugaccagcacccucggcgaccgcguggccgugcuguccuacuccccgcccggguacaugcccaacaccgaggagugcccggucuaccuggaguucgaccucgugacguacaacuccauccaccagaugaagcaccaccuccaggacagccagcagcugaacggcgacguguucaucgggcacgcgcuccaguggaccaucgacaacgucuucgugggcacccccaaccugcggaagaacaaggugaucuucgucaucuccgccggggagaccaacagccuggacaaggacgugcuccgcaacgugucccugcgggccaagugccagggcuacagcaucuucgucuucuccuucggccccaagcacaacgacaaggagcuggaggagcucgccagccacccccuggaccaccaccuggugcagcucgggcgcacccacaagccggacuggaacuacaucaucaaguucgugaagcccuucguccaccugauccggcgcgccaucaacaaguaccccacggaggacaugaaggcgaccugcgugaacaugaccucccccaacccggagaacggcgggaccgagaacacggugcugcuccugcccggcaucuacgagaucaagaccgagaacggggaccuguucgacgaguucgacagccaggcccagcaccuccugguccugggcaacaaccacuccagcggcagcgagaccgccaccgaccucaugcagaagcuguaccuccuguucuccacggagaagcuggccaugaaggacaaggagaaggcgcaccuggaggagaucagcgcccucgugguggacaagcagcaggagaaggaggacggggaggacacccgguccagcuga

SEQ ID NO: 28544 - RNA, 8835 nt, Artificial Sequence
  derived and/or modified sequence opt1 from COL7A1__Homo_sapiens__NP_000085
augacccugcgccuccugguggccgcccugugcgccggcauccucgccgaggcgccccgcguccgcgcccagcaccgggagcgcgugaccugcacccggcuguacgccgcggacaucguguuccugcucgacgggagcuccagcaucggccgcuccaacuuccgggagguccgcagcuuccuggagggccuggugcuccccuucuccggcgccgccuccgcccagggcgugcgguucgcgaccguccaguacuccgacgacccccgcaccgaguucggccuggacgcccugggcagcggcggcgacgugauccgggccauccgcgagcucuccuacaagggcggcaacacccggacgggcgccgccauccugcacguggcggaccacgucuuccugccccagcucgcccgccccggcgugcccaaggugugcauccugaucaccgacggcaagagccaggaccuggucgacaccgccgcccagcggcucaagggccagggcgugaagcuguucgccgugggcaucaagaacgcggaccccgaggagcugaagcgcgucgccucccagcccaccagcgacuucuucuucuucgugaacgacuucuccauccuccggacccugcugccccucgugagccgccgggucugcaccaccgccggcggcgugcccgugacccggccgcccgacgacuccacgagcgcgccccgggaccugguccuguccgagcccagcucccagagccuccgcgugcaguggaccgccgcgagcggccccgugaccggcuacaagguccaguacacgccccucacgggccugggccagccccuccccuccgagcgccaggaggugaacguccccgccggggagaccagcgugcggcugcgcggccugcggccccucaccgaguaccaggugaccgucaucgcccuguacgccaacuccaucggcgaggccgugagcgggacggcgcgcaccaccgcccuggagggccccgagcucaccauccagaacacgaccgcccacucccugcugguggccuggcggagcguccccggggcgaccggcuaccgcgugaccuggcgggugcucuccgggggccccacgcagcagcaggagcugggccccgggcagggcagcguccugcuccgcgaccuggagcccgggaccgacuacgaggugaccguguccacccuguucggccggagcgucgggcccgccacgucccucauggcccgcaccgacgccagcguggagcagacccugcggcccgugauccugggccccaccuccauccuccugagcuggaaccugguccccgaggcccgcggcuaccggcuggaguggcgccgggagacggggcucgagccgccccagaagguggugcugcccuccgacgucacccgcuaccagcuggacggccuccagcccgggaccgaguaccggcugacccuguacacccuccuggagggccacgagguggcgacgcccgccaccgugguccccaccggccccgagcugcccgugagccccgugaccgaccuccaggccacggagcugcccgggcagcgcguccggguguccuggagccccgugcccggcgccacccaguaccgcaucaucguccgcuccacccaggggguggagcggacccuggugcuccccggcagccagacggccuucgaccuggacgacguccaggcggggcugagcuacaccgugcgcguguccgcccgggucggcccccgcgagggcagcgccuccgugcucaccgugcggcgcgagcccgagacgccccuggccguccccgggcugcgggugguggucagcgacgccacccgcgugcggguggcguggggccccguccccggggccuccggcuuccgcaucagcugguccaccgggagcggccccgaguccagccagacccugccgcccgacuccaccgccacggacaucaccggccugcagcccgggaccaccuaccagguggccgugagcguccugcggggccgcgaggaggggcccgcggccgugaucguggcccggacggacccccucggccccguccgcaccgugcacgugacccaggccuccagcuccagcgucaccaucacguggacccgggugcccggggccaccggcuaccgcgucuccuggcacagcgcgcacggccccgagaagucccagcugguguccggggaggccaccguggccgagcuggacggccucgagcccgacacggaguacaccguccacgugcgggcccacguggccggggucgacggcccgcccgcgagcguggugguccgcaccgcccccgagcccguggggcgggugucccgccugcagauccugaacgccagcuccgacguccuccggaucaccugggugggcgugacgggcgccaccgccuaccgccuggcgugggggcgcagcgagggcgggcccaugcggcaccagauccugcccggcaacaccgacuccgccgagauccgcggccucgagggcggcgucagcuacuccgugcgggugaccgcccuggucggggaccgcgagggcacgcccgugagcaucguggucaccacgccgcccgaggccccgcccgcgcuggggacccuccacguggugcagcggggcgagcacucccugcgccugcggugggagcccgucccccgcgcccagggcuuccuccugcacuggcagcccgagggcggccaggagcagagccgggugcuggggcccgagcucuccagcuaccaccuggacggccuggagcccgccacccaguaccgcgugcggcucuccguccuggggcccgccggcgagggccccagcgccgaggugacggcgcgcaccgagagcccccgggugcccagcaucgagcugcgcgucguggacaccuccaucgacagcgugacccucgccuggacgcccgucagccgggccuccagcuacauccuguccuggcgcccccugcgggggcccggccaggaggugcccgggagcccccagacccuccccggcaucuccagcucccagcgcgugaccgggcuggagcccggcgucagcuacaucuucucccugacccccgugcucgacggcgugcgggggcccgaggccagcgucacgcagacccccgugugcccccgcggccuggccgacguggucuuccugccccacgcgacccaggacaacgcccaccgcgccgaggccacccggcgcgugcucgagcggcuggugcuggcccucgggccccugggcccccaggcgguccaggugggccugcucuccuacagccaccgccccagcccccuguucccccugaacgggagccacgaccucggcaucauccugcagcggauccgcgacaugcccuacauggaccccuccgggaacaaccugggcacggccguggucaccgcccaccgguacaugcucgcccccgacgcccccgggcgccggcagcacgugcccggcgugaugguccugcugguggacgagccccuccgcggcgacaucuucagccccauccgggaggcgcaggccuccgggcugaacgucgugaugcugggcauggccggggccgaccccgagcagcuccgccggcuggcgcccggcauggacagcgugcagaccuucuucgccgucgacgacgggcccucccuggaccaggccgugagcggccucgccaccgcccugugccaggcgagcuucacgacccagccccgccccgagcccugccccguguacugccccaagggccagaagggggagccgggcgagauggggcugcggggccaggucgggccgcccggcgaccccggccucccggggcgcaccggcgcccccgggccccagggcccgcccggguccgccaccgccaagggcgagcggggcuuccccggggccgacggccgccccgggagccccggccgggcgggcaaccccgggacgcccggcgcccccgggcugaagggcuccccggggcugcccggcccccgcggcgaccccggggagcggggcccgcgcgggcccaagggcgagcccggggcccccggccaggugaucggcggggagggcccggggcuccccggccgcaagggggaccccggccccagcggcccgcccgggccccggggcccccugggggacccgggcccccgcgggccgcccggccugccgggcaccgccaugaagggggacaagggcgaccggggcgagcgcgggccgcccggcccgggggagggcgggaucgcccccggcgagcccgggcuccccggccugccgggcucccccgggccccagggccccguggggccgcccggcaagaagggggagaagggcgacagcgaggacggcgcgcccgggcugcccggccagccggggucccccggcgagcaggggccccggggcccgcccggcgccaucgggcccaagggcgaccgcggguuccccggcccccucggcgaggccggggagaagggcgagcgggggccgcccggccccgccgggagccgcggccugcccggcgucgcggggcggcccggcgccaaggggcccgaggggccgcccgggccgaccggccgccagggcgagaagggggagcccggccggcccggggacccggccguggugggccccgccgucgccgggcccaagggcgagaagggcgacguggggcccgcgggcccgcgcggggccaccggcgugcagggggagcgggggccgcccggccugguccuccccggggacccgggccccaagggggaccccggcgaccgcggccccaucgggcugacgggccgggccgggccgcccggcgacuccgggccgcccggcgagaagggcgacccggggcgccccgggccgcccgggccggugggcccccgggggcgcgacggcgaggugggcgagaagggggacgaggggccgcccggggacccgggccugcccgggaaggccggcgagcggggccuccgcggggcccccggcguccgcgggcccgugggcgagaagggcgaccagggggacccgggcgaggacgggcggaacggcagccccggguccagcggccccaagggcgaccgcggggagccggggccgcccgggcccccgggccggcugguggacaccgggcccggcgcgcgcgagaagggcgagcccggggaccggggccaggaggggccccgcggcccgaagggggaccccggccugcccggcgcccccggggagcggggcaucgagggguuccgcggcccgcccgggccccagggcgaccccggcguccgggggccggccggcgagaagggggaccgcgggccgcccggccuggacgggcgguccggccucgacgggaagcccggcgccgccgggccgagcggccccaacggcgcggccgggaaggccggcgaccccgggcgcgacggccugcccgggcugcggggcgagcagggccucccggggcccuccgggccgcccgggcugccgggcaagcccggggaggacggcaagcccggccugaacgggaagaacggcgagccgggggaccccggcgaggacggccgcaagggggagaagggcgacagcggggccuccggccgggaggggcgcgacggccccaagggcgagcggggcgcccccggcauccucgggccgcaggggccgcccgggcugcccggcccgguggggccgcccgggcagggcuuccccggggugccgggcgggaccggccccaagggcgaccgcggggagaccggcagcaagggggagcagggccugcccggggagcggggccuccgcggcgagcccggguccgucccgaacguggaccggcugcuggagacggccggcaucaaggccagcgcccuccgcgagaucguggagaccugggacgagagcuccgggagcuuccugcccguccccgagcgccggcgcggccccaagggcgacuccggggagcagggcccgcccgggaaggagggccccaucggguuccccggcgagcggggccugaagggggaccgcggcgacccggggccccagggcccgcccgggcucgcccugggcgagcgggggccgcccgggcccagcggccuggcgggggagcccggcaagcccgggauccccggccuccccggccgcgccgggggcgugggggaggccggccggccgggggagcgcggcgagcggggcgagaagggggagcgcggcgagcaggggcgggacgggccgcccggccugcccgggaccccggggccgcccgggcccccgggccccaagguguccgucgacgagcccgggcccggccugagcggcgagcaggggccgcccggccucaagggggccaagggcgagcccggguccaacggcgaccagggccccaagggggaccgcggcgugccggggaucaagggcgaccggggcgagcccggcccccgcggccaggacgggaaccccggccugccgggggagcggggcauggccggccccgaggggaagcccggccugcaggggccgcgcggcccgcccgggcccgugggcggccacggggaccccgggccgcccggggcgcccggccucgccgggccggccggcccccagggccccagcgggcugaagggcgagcccggggagaccggcccgcccgggcggggccugacgggccccaccggggccgucggccuccccgggccgcccggccccuccgggcuggugggcccccagggcagcccggggcugcccggccaggugggggagaccggcaagcccggcgcccccgggcgcgacggcgcguccgggaaggacggcgaccgggggagcccgggcguccccggcucccccgggcuccccggcccgguggggcccaagggcgagcccgggccgaccggcgcccccggccaggccguggucgggcugcccggcgccaagggggagaagggcgcccccgggggccuggcgggcgaccucgugggggagccgggcgccaagggggaccgcggccugcccggcccccgcggggagaagggcgaggccgggcgggccggcgagcccggggacccgggcgaggacggccagaagggggcgcccggccccaagggguucaagggcgaccccggggugggcgucccgggcagccccgggccgcccggcccgcccggggugaagggcgaccuggggcuccccggccugcccggcgccccggggguggucggcuuccccgggcagacgggcccccgcggggagaugggccagcccggcccguccggggagcggggccuggccgggccgcccggccgcgagggcaucccggggccccucgggccgcccgggccgcccggcagcguggggccgcccggcgccuccggccugaagggggacaagggcgacccgggggugggccugcccgggccccggggcgagcgcggcgagcccgggauccggggcgaggacgggcgcccgggccaggaggggccccggggccucaccgggccgcccgggagccgcggcgagcgcggggagaagggcgacgucggcuccgccgggcugaagggcgacaagggggacagcgcggugauccugggcccgcccgggccccggggcgccaagggcgacaugggggagcggggcccccgcgggcucgacggcgacaaggggccccggggcgacaacggcgaccccggggacaagggcagcaagggggagcccggcgacaagggguccgccggccugcccggccugcgcgggcuccugggcccgcaggggcagcccggcgccgccgggauccccggcgaccccggcagcccggggaaggacggcgugcccgggauccggggcgagaagggcgacgucggguucaugggcccccgcgggcugaagggcgagcggggcgucaagggcgcgugcggccucgacggggagaagggcgacaagggggaggccggcccgcccgggcgccccggccuggccggccacaagggggagaugggcgagcccggggucccgggccaguccggggcccccggcaaggagggccugaucgggcccaagggcgaccggggguucgacggccagcccggcccgaagggggaccagggcgagaagggggagcgcggcacccccgggaucggcggcuuccccgggcccagcggcaacgacggguccgccggcccgcccgggccgcccggcagcgugggcccgcgcgggcccgagggccuccaggggcagaagggcgagcgggggccgcccggcgagcgcguggucggcgcgccgggggugcccggcgcccccggggagcggggcgagcaggggcgccccggcccggccggcccccggggcgagaagggcgaggccgcgcugaccgaggacgacauccgcggguucgugcggcaggagaugucccagcacugcgccugccagggccaguucaucgccagcggcucccgcccccugcccagcuacgccgccgacaccgcggggucccagcuccacgccgucccggugcugcgggugagccacgccgaggaggaggagcgcgugccgcccgaggacgacgaguacuccgaguacagcgaguacuccguggaggaguaccaggacccggaggcccccugggacagcgacgaccccugcucccugccccucgacgagggcagcugcacggccuacacccugcggugguaccaccgcgcggugaccggguccaccgaggccugccacccguucgucuacggcgggugcggcggcaacgccaaccgguucgggacgcgcgaggccugcgagcggcgcugcccgccccggguggugcagagccagggcaccgggaccgcccaggacuga

SEQ ID NO: 28545 - RNA, 2235 nt, Artificial Sequence
  derived and/or modified sequence opt1 from COL8A1__Homo_sapiens__NP_065084
auggccgugcugcccggcccgcuccagcugcuggggguccuccugaccaucagccuguccagcauccgccucauccaggccggcgcguacuacgggaucaagccccugcccccccagaucccgccccagaugcccccccagaucccgcaguaccagccccugggccagcaggugccccacaugccccucgccaaggacgggcuggccaugggcaaggagaugccgcaccugcaguacggcaaggaguacccccaccucccccaguacaugaaggagauccagcccgccccgcggauggggaaggaggccgugcccaagaagggcaaggagaucccccuggcgucccugcgcggggagcagggcccccggggggagccgggcccccgcggcccccccgggccgcccggccuccccgggcacggcauccccggcaucaaggggaagccgggcccccagggguaccccggcgucgggaagccgggcaugcccggcaugcccgggaagcccggcgccauggggaugccgggcgccaagggggagaucggccagaagggcgagaucgggcccaugggcauccccgggccccagggcccgcccgggccccacggccugcccggcaucgggaagccgggcgggcccggccugcccggccagcccgggccgaagggcgaccgggggcccaagggccuccccgggccccagggccugcgcggcccgaagggggacaagggcuucgggaugcccggcgcccccggggugaagggccccccgggcaugcacgggccccccggcccgguggggcugcccggcgucgggaagcccggcgugaccggcuuccccgggccgcagggcccccucgggaagcccggcgcgcccggggagccgggcccccagggccccaucggggugcccggcguccaggggccgcccggcauccccggcaucgggaagcccggccaggacgggaucccgggccagcccggguuccccggcggcaagggggagcagggccugcccgggcugccgggcccccccgggcuccccggcaucggcaagccgggguuccccggccccaagggggaccggggcauggggggcgugcccggcgcccuggggccgcgcggcgagaaggggcccaucggcgcccccggcaucgggggcccgcccggggagcccggccugcccgggaucccgggccccaugggcccccccggggccaucggcuucccggggcccaagggcgaggggggcaucgugggcccccaggggcccccgggccccaagggggagcccggccuccagggguuccccggcaagccgggcuuccugggggaggucggcccccccgggaugcggggccugcccgggccgaucggccccaagggcgaggccgggcagaagggcgugcccgggcuccccggcgugccgggccugcuggggcccaagggcgagcccgggauccccggcgaccaggggcuccagggcccgcccggcauccccgggaucggcgggccgagcggccccaucgggccccccggcaucccgggccccaagggggagcccggccugcccgggccgcccggcuuccccgggaucggcaagcccggcgucgcggggcugcacggcccgcccgggaagcccggcgcccucgggccccagggccagccgggccugcccgggccccccggcccgcccgggccccccggcccgcccgccgugaugcccccgacgccccccccccagggcgaguaccugccggacauggggcucggcaucgacggggugaagcccccccacgccuacggcgccaagaaggggaagaacggcggccccgcguacgagaugccggccuucaccgccgagcugaccgcccccuucccccccgucggggccccggugaaguucaacaagcugcucuacaacggccgccagaacuacaacccccagaccgggaucuucacgugcgaggugcccggcgucuacuacuucgcguaccacgugcacugcaaggggggcaacgugugggucgcccuguucaagaacaacgagcccgugauguacaccuacgacgaguacaagaagggcuuccuggaccaggccuccgggagcgccguccuccugcugcggccgggcgaccgcguguuccuccagaugcccuccgagcaggccgcggggcuguacgccggccaguacgugcacagcuccuucagcggguaccugcuguaccccauguga

SEQ ID NO: 28546 - RNA, 1917 nt, Artificial Sequence
  derived and/or modified sequence opt1 from COL8A2__Homo_sapiens__NP_001281276
augccccugccgcuccugcccauggaccugaagggcgagcccgggcccccgggcaagcccgggccccgcggccccccggggccccccggcuuccccggcaagccggggaugggcaagcccgggcuccacggccagcccgggcccgccggcccgcccggcuucagccggauggggaaggccggcccccccgggcugccgggcaaggugggcccccccgggcagcccggccugcgcggggagccgggcauccggggggaccagggccuccgcggcccccccgggcccccgggccugcccgggcccuccggcaucaccaucccggggaagcccggcgcgcagggcguccccgggcccccgggcuuccagggggagcccggcccccagggggagcccggcccgcccggcgaccgggggcugaagggcgacaacggggugggccagcccggccuccccggggccccgggccaggggggcgcccccgggccccccggccugccgggccccgccgggcugggcaagcccgggcucgacggccugcccggggccccgggcgacaagggcgagagcgggccccccggcgugcccgggccgcgcggcgagcccggggcggucggccccaagggcccgcccgggguggacggcguggggguccccggcgccgccgggcugcccggcccgcagggccccuccggggccaagggcgagcccgggacccggggccccccgggccucaucgggcccacgggcuacgggaugcccggccugcccgggccgaagggcgaccgcggccccgcgggggugcccggccugcucggggaccggggcgagcccggggaggacggcgagccgggcgagcaggggccccagggccuggggggcccccccgggcugccgggcagcgccggccuccccgggcgccggggcccccccgggccgaagggcgaggccggccccgggggcccccccggggugccgggcauccgcggggaccagggccccuccggccuggccgggaagcccggcgucccgggggagcggggccugcccggggcccacggcccccccggcccgaccgggcccaagggcgagcccggguucaccggccgccccgggggcccgggcguggcgggggcccucggccagaagggggaccugggccugcccgggcagcccggccuccggggccccagcgggaucccgggccugcaggggcccgccggccccaucggcccccaggggcugccgggccucaagggggagcccggccugcccgggcccccgggcgagggccgcgccggggagcccggcaccgccgggcccacgggccccccgggggugcccggcucccccggcaucaccgggcccccgggcccccccgggccgcccggcccccccggggcgccgggcgccuucgacgagaccggcaucgccgggcugcaccuccccaacggcggggucgagggcgccgugcuggggaagggcggcaagccccaguucgggcugggcgagcucagcgcccacgcgacccccgccuucacggccgugcugaccuccccguuccccgccagcgggaugcccgucaaguucgaccggacccuguacaacggccacuccggcuacaaccccgccaccgggaucuucacgugcccggugggcgggguguacuacuucgcguaccacguccacgugaagggcaccaacgugugggucgcccucuacaagaacaacgugcccgccaccuacaccuacgacgaguacaagaagggguaccuggaccaggccagcggcggcgcggugcugcagcuccgccccaacgaccaggucugggugcagaugcccuccgaccaggccaacgggcuguacagcacggaguacauccacuccagcuucuccggcuuccugcucugcccgaccuga

SEQ ID NO: 28547 - RNA, 2766 nt, Artificial Sequence
  derived and/or modified sequence opt1 from COL9A1__Homo_sapiens__NP_001842
augaagaccugcuggaagauccccguguucuucuucgucugcagcuuccuggagccgugggccuccgccgcggugaagcgccggccccgcuuccccgugaacagcaacuccaacggcgggaacgagcucugccccaagauccggaucggccaggacgaccugccgggguucgaccugaucagccaguuccaggucgacaaggccgccucccgccgggccauccagcgcguggugggcagcgccacccuccaggucgcguacaagcuggggaacaacguggacuuccggauccccacgcgcaaccuguaccccuccggccuccccgaggaguacagcuuccugaccaccuuccggaugaccggcuccacgcugaagaagaacuggaacaucuggcagauccaggacagcuccgggaaggagcaggucggcaucaagaucaacgggcagacccagagcgucguguucuccuacaagggccucgacgggagccugcagaccgccgccuucuccaaccugagcucccucuucgacagccaguggcacaagaucaugaucggcguggagcgcuccagcgccacccuguucgucgacugcaaccggaucgagagccugccgaucaagccccgcggccccaucgacaucgacggguucgcggugcucggcaagcuggccgacaacccccagguguccgucccguucgagcugcaguggaugcucauccacugcgacccccugcggccccgccgggagacgugccacgagcugcccgcccgcaucaccccgagccagaccaccgacgagcgggggccgcccggcgagcagggcccgcccgggccgcccggcccgcccggggugcccggcaucgacgggaucgacggcgaccgcggccccaaggggccgcccggcccgcccgggcccgccggcgagcccgggaagcccggcgcccccggcaagcccgggacgcccggcgcggacgggcucaccggccccgacgggucccccggcagcaucggcuccaaggggcagaagggcgagcccggggugcccggcagccggggcuuccccgggcgcggcauccccgggccgcccggcccgcccgggaccgccggccugcccggcgagcuggggcgggugggccccgugggggaccccggccgccgcgggcccccgggcccgcccggcccgcccgggccccggggcaccaucggguuccacgacggcgacccccucugccccaacgccugcccgcccgggcgcuccggcuaccccggccugcccgggaugcggggccacaagggggccaagggcgagaucggggagcccggccgccagggccacaagggggaggagggcgaccagggggagcugggcgaggugggcgcccaggggccgcccggcgcgcaggggcuccggggcaucacggggaucgucggcgacaagggcgagaagggggcccgcggccuggacggggagcccggcccccaggggcugcccggcgcccccggcgaccaggggcagcggggcccgcccggggaggccggccccaagggggaccgcggcgccgagggcgcgcgggggauccccggccucccggggcccaagggcgacaccggccugcccgggguggacggccgcgacgggauccccggcaugccggggaccaagggcgagcccggcaagcccgggcccccgggcgacgccgggcugcagggccuccccggggugcccggcauccccggcgccaagggggucgccggcgagaaggggagcaccggcgccccggggaagcccggccagaugggcaacuccgggaagcccggccagcaggggccgcccggcgagguggggccccggggcccccagggccugccggggagccgcggcgagcuggggcccgucggcucccccggccuccccgggaagcugggcagccugggguccccgggccuccccgggcugcccgggcccccgggccugcccggcaugaagggcgaccgcgggguggugggcgagcccgggcccaagggcgagcagggcgcgagcggggaggagggcgaggccggggagcggggcgagcucggggacaucggccugccgggccccaagggguccgccggcaaccccggggagcccggccugcgggggccggagggcagccgcggccuccccggggucgagggcccccgggggcccccgggcccccgcggcgugcagggggagcagggcgccacggggcugcccggcgugcaggggcccccgggccgggcgcccaccgaccagcacaucaagcaggucugcaugcgcgugauccaggagcacuucgccgagauggccgccucccugaagcgccccgacagcggcgccaccgggcucccgggccggcccgggccgcccggcccgcccgggccgcccggcgagaacggcuuccccgggcagaugggcauccgcgggcugcccggcaucaaggggccgcccggcgcgcugggccugcgggggcccaagggcgaccucggggagaagggcgagcgcggcccgcccgggcggggccccaacgggcugcccggcgccaucgggcugcccggcgaccccggccccgccuccuacgggcgcaacggccgggacggggagcgcggcccgcccgggguggccggcauccccggcguccccgggccgcccgggccgcccggccuccccggcuucugcgagcccgccagcugcaccaugcaggcggggcagcgggccuucaacaagggccccgaccccuga

SEQ ID NO: 28548 - RNA, 1215 nt, Artificial Sequence
  derived and/or modified sequence opt1 from COL9A2__Homo_sapiens__XP_011539020
auggccgccgcgaccgccagcccccgcucccugcucgugcugcugcaggucguggugcucgcccuggcccagauccggggcccgcccggggagcgcggcccgcccgggccgcccggcccgcccgggguccccggcagcgacggcaucgacggggacaacggcccgcccgggaaggccggcccgcccgggcccaagggcgagcccggcaaggcggggcccgacggccccgacgggaagcccggcaucgacggccugaccggggccaagggcgagcccgggcccaugggcaucccgggggugaagggccagcccggccuccccgggcccccgggccugcccgggcccggcuucgccgggcccccgggcccgcccggccccguggggcugcccggcgagaucgggauccggggccccaagggggaccccggccccgacggccccuccgggccgcccggcccgcccgggaagcccggccgccccggcacgauccaggggcucgagggcagcgccgacuuccuggugcgggacgagugccccaccaacugcccgcccgggaugaagggcccgcccgggcugcagggcgugaagggccacgcggggaagcgcggcauccucggggaccccggccaccaggggaagcccggccccaagggcgacgugggggccuccggcgagcaggggauccccggcccgcccgggccccagggcauccggggcuaccccgggauggccggccccaagggggagaccggcccccacggguacaagggcauggucggcgccaucggggccaccggcccgcccggggaggagggcccccgcgggcccccgggccgggcgggcgagaagggggacgagggcagccccgggauccgcggcccccagggcaucacggggcccaagggcgccaccgggccgcccggcaucaacgggaaggacggcacccccggcacccccgggaugaagggcuccgccgggcaggccggccagccggggagccccggccaccagggccuggccacgcccgggcccggccggcaggcgauccugugcgccccgcuccugugccaccacugcgggaacgugcagcuguccagcuccugccgcggcuggaccuucugcugcagcgcccccaccggcgggggcaaccucgacugggggugggaggccaagcagcagguccacggcgcccccuccugccaggggcggaacuga

SEQ ID NO: 28549 - RNA, 2055 nt, Artificial Sequence
  derived and/or modified sequence opt1 from COL9A3__Homo_sapiens__NP_001844
auggccggcccccgcgccugcgcgccgcugcuccugcugcuccugcugggggagcuccuggccgccgccggcgcccagcggguggggcugcccggcccccccgggccgcccggcccccccggcaagccggggcaggacggcaucgacggggaggcgggcccccccgggcuccccggcccgcccggccccaagggggcccccggcaagccggggaagcccggcgaggccggccugcccgggcugcccggcgucgacgggcucaccggccgcgacgggccgcccggccccaagggcgcccccggggagcggggcagccuggggccgcccggcccccccgggcugggcggcaaggggcucccgggcccccccggggaggcgggcguguccgggccgcccggcggcaucgggcugcgcggcccccccgggccgagcggccugcccggccuccccgggcccccgggcccccccgggcccccgggccaccccggggugcugcccgagggcgccaccgaccugcagugccccuccaucugcccgcccggcccccccgggccgcccggcaugcccggguucaagggccccacgggguacaagggcgagcagggcgaggucgggaaggacggcgagaagggggacccgggcccccccgggccggccggccuccccggcagcguggggcugcagggcccccgggggcugcgcggccuccccgggccgcugggcccccccggcgaccgggggcccaucggcuuccgcgggccgcccggcauccccggcgcccccgggaaggccggcgaccggggggagcgcggcccggagggguuccggggccccaagggcgaccuggggcgccccggccccaaggggaccccgggcguggcggggcccuccggcgagcccggcaugcccgggaaggacggccagaacggggucccgggccucgacgggcagaagggcgaggccggccggaacggggcccccggcgagaaggggcccaacggccugcccggccugccggggcgcgccggcagcaagggggagaagggcgagcgggggcgcgccggcgagcucggcgaggcggggcccuccggcgagcccggggugcccggcgacgccgggaugccgggcgagcggggcgaggccgggcaccgcggcagcgccggggcccugggcccccaggggcccccgggcgcgcccggcgugcggggguuccagggccagaagggguccaugggcgaccccgggcugcccggcccgcagggccuccgcggggacgucggcgaccgggggcccggcggcgccgccgggcccaagggcgaccaggggaucgccggcagcgacgggcugcccggcgacaagggcgagcuggggccguccggccucguggggcccaagggcgagagcgggucccgcggcgagcugggccccaaggggacccagggccccaacgggaccagcggcgugcagggggucccgggcccccccggcccccuggggcuccagggcgugccgggggugcccggcaucacggggaagcccggcguccccggcaaggaggccuccgagcagcgcauccgggagcugugcgggggcaugaucagcgagcagaucgcgcagcuggccgcccaccuccgcaagccgcuggcccccggguccaucggccggcccggccccgcggggccgcccggcccccccgggccgcccggcagcaucgggcaccccggcgcccgcggcccgcccggguaccggggccccaccggggagcugggcgaccccgggccgcgcggcaaccagggcgaccggggggacaagggcgccgccggggccggccucgacgggcccgagggcgaccagggcccccaggggccccagggcgugccggggaccuccaaggacggccaggacggcgcgcccggggagcccggccccccgggggaccccggccugcccggggccaucggcgcccagggcacccccgggaucugcgacacgagcgccugccagggcgccgugcuggggggcgucggggagaagagcggcucccgcagcuccuga

SEQ ID NO: 28550 - RNA, 375 nt, Artificial Sequence
  derived and/or modified sequence opt1 from COLCA1__Homo_sapiens__NP_001289574
auggagagcugcuccguggcccaggccggcguccugaccagccccuucauguggcgcuggaccgggauggcgggcgcccucuccgcccuggacaacacgaucgaggacgacgccgacgaccagcugccgugcggggagggccggcccgggugggugcgcggcgagcuccugggcagccagggggugugcaaggacuccaaggaccuguucguccccaccagcuccagccucuacggcugcuucugcguggggcugguguccggcauggccaucagcguccugcuccuggcguccgacuuccggaagcuggacuucagccgccccgagccgugcuucgagaaggaggccucccucugguucguggcccagcacuga

SEQ ID NO: 28551 - RNA, 465 nt, Artificial Sequence
  derived and/or modified sequence opt1 from COLCA2__Homo_sapiens__NP_001258386
augcaccccgagccgcugcucaacagcacccaguccgcgccccaccacuuccccgacagcuuccaggccacccccuucugcuucaaccagucccugaucccgggcagccccuccaacagcuccauccugagcgggucccucgacuacagcuacucccccgugcagcugcccagcuacgccccggagaacuacaacucccccgccagccuggacacgcggaccugcggcuacccgcccgaggaccacuccuaccagcaccucagcucccacgcccaguacagcugcuucuccagcgccaccaccagcaucugcuacugcgccuccugcgaggcggaggaccuggacgcccugcaggccgccgaguacuucuaccccagcacggacugcgucgacuucgcgcccuccgccgccgccaccagcgacuucuacaagcgcgagaccaacugcgacaucugcuacuccuga

SEQ ID NO: 28552 - RNA, 834 nt, Artificial Sequence
  derived and/or modified sequence opt1 from COLEC10__Homo_sapiens__NP_006429
augaacggcuucgccagccugcuccgccggaaccaguucauccugcugguccucuuccugcugcagauccagucccucgggcuggacaucgacagccgccccaccgccgaggugugcgcgacccacacgaucuccccgggccccaagggggacgacggcgagaagggggaccccggcgaggagggcaagcacgggaaggugggccggauggggcccaagggcaucaagggggagcugggcgacaugggcgaccaggggaacaucggcaagaccgggccgaucggcaagaagggcgacaagggggagaagggccuccuggggauccccggcgagaaggggaaggccggcaccgugugcgacugcggccgcuaccggaaguucgucgggcagcuggacaucagcaucgcccgccucaagaccuccaugaaguucgugaagaacgugaucgccggcauccgggagacggaggagaaguucuacuacaucguccaggaggagaagaacuaccgcgagagccugacccacugccggauccgcgggggcaugcuggccaugcccaaggacgaggcggccaacacccucaucgccgacuacguggccaaguccggguucuuccggguguucaucggcgucaacgaccuggagcgcgagggccaguacauguucaccgacaacacgccccugcagaacuacagcaacuggaacgagggggagccguccgaccccuacggccacgaggacugcguggagaugcucagcuccgggcgguggaacgacaccgagugccaccugaccauguacuucgugugcgaguucaucaagaagaagaaguga

SEQ ID NO: 28553 - RNA, 744 nt, Artificial Sequence
  derived and/or modified sequence opt1 from COLEC11__Homo_sapiens__NP_001242912
augcgcggcaaccuggcccucguggggguccugaucagccuggccuuccucucccugcugcccagcggccacccgcagcccgcgggggacgacgccugcuccgugcagauccucgugcccggccugaagggggacgccggcgagaagggcgacaagggggcccccggccggccggggcgcgucggccccaccggggagaagggcgagaagggcgacagcggggacaucggcccgcccgggcccaacggcgagcccggccugcccugcgagugcucccagcuccggaaggccaucggggagauggacaaccaggugagccagcugaccuccgagcugaaguucaucaagaacgcgguggccggcguccgcgagacggagagcaagaucuaccuccuggugaaggaggagaagcgguacgccgacgcccagcuguccugccaggggcgcggcgggacccucagcaugcccaaggacgaggcggccaacggccugauggccgccuaccuggcccaggcgggccucgcccggguguucaucgggaucaacgaccuggagaaggagggcgccuucgucuacuccgaccacagcccgaugcgcaccuucaacaaguggcgguccggggagcccaacaacgccuacgacgaggaggacugcguggagaugguggccagcggcggguggaacgacgucgcgugccacaccacgauguacuucaugugcgaguucgacaaggagaacauguga

SEQ ID NO: 28554 - RNA, 2229 nt, Artificial Sequence
  derived and/or modified sequence opt1 from COLEC12__Homo_sapiens__NP_569057
augaaggacgacuucgccgaggaggaggaggugcagagcuucggcuacaagcgcuucgggauccaggagggcacccagugcaccaagugcaagaacaacugggcccugaaguucuccaucauccuccuguacauccugugcgcgcuccugacgaucaccgucgccauccugggguacaaggugguggagaagauggacaacgucaccggcgggauggagaccagccggcagacguacgacgacaagcucaccgccguggaguccgaccugaagaagcugggcgaccagaccggcaagaaggccaucagcaccaacuccgagcucagcacguuccgcuccgacauccuggaccugcggcagcagcuccgcgagaucaccgagaagaccagcaagaacaaggacacccuggagaagcugcaggccuccggggacgcgcucguggaccggcagagccagcugaaggagacgcuggagaacaacuccuuccucaucaccaccgucaacaagacccugcaggccuacaacggcuacgugacgaaccugcagcaggacaccagcgugcuccaggggaaccugcagaaccagauguacucccacaacgucgugaucaugaaccugaacaaccucaaccugacccaggugcagcagcgcaaccugaucaccaaccuccagcggagcgucgacgacacgucccaggccauccagcgcaucaagaacgacuuccagaaccugcagcaggucuuccugcaggccaagaaggacaccgacuggcucaaggagaaggugcagagccugcagacccuggcggccaacaacuccgcccucgccaaggccaacaacgacacccuggaggacaugaacagccagcugaacuccuucacgggccagauggagaacaucaccaccaucagccaggcgaacgagcagaaccucaaggaccugcaggaccugcacaaggacgccgagaaccggaccgccaucaaguucaaccagcucgaggagcgcuuccagcuguucgagacggacaucgugaacaucaucagcaacaucuccuacaccgcccaccaccuccggacccugaccagcaaccugaacgaggugcgcacgaccugcaccgacacccugacgaagcacaccgacgaccucaccucccugaacaacacccuggccaacauccggcucgacagcgugucccugcgcaugcagcaggaccugaugcggagccgccuggacaccgaggucgcgaaccucuccgugaucauggaggagaugaagcugguggacagcaagcacgggcagcugaucaagaacuucacgauccuccaggggcccccgggcccccggggcccccgcggcgaccgggggucccaggggcccccgggccccaccggcaacaagggccagaagggggagaagggcgagcccgggcccccgggccccgccggcgagcgcgggcccaucggccccgccgggccgcccggcgagcgcgggggcaagggcagcaaggggucccagggccccaaggggagccggggcucccccgggaagccgggcccccagggccccagcggggaccccggcccgcccgggccgcccggcaaggagggccugcccgggccccagggcccgcccggguuccagggccugcaggggaccgucggcgagcccggcgugcccgggccccgcggccucccggggcugcccggcgugcccgggaugcccggcccgaagggcccgcccgggccgcccggccccuccggggccgucgugccccuggcccuccagaacgagcccacccccgcgcccgaggacaacggcugcccgccccacuggaagaacuucacggacaagugcuacuacuucagcgucgagaaggagaucuucgaggacgccaagcuguucugcgaggacaaguccagccaccugguguucaucaacacccgggaggagcagcaguggaucaagaagcagaugguggggcgcgagucccacuggaucggccucaccgacagcgagcgggagaacgaguggaaguggcuggacggcaccagccccgacuacaagaacuggaaggccgggcagcccgacaacuggggccacgggcacggccccggggaggacugcgccggccugaucuacgccggccaguggaacgacuuccagugcgaggacgucaacaacuucaucugcgagaaggaccgcgagacggugcucuccagcgcgcuguga

SEQ ID NO: 28555 - RNA, 1665 nt, Artificial Sequence
  derived and/or modified sequence opt1 from COLGALT2__Homo_sapiens__NP_001290349
auggccgcccgccccgcggccacccuggccuggagccuccugcugcucuccagcgcccugcugcgggagggcugccgcgcccgguucguggcggagcgcgacuccgaggacgacggggaggagccggucguguuccccgagagcccccuccagucccccaccgugcuggucgccgugcuggcccggaacgccgcgcacacgcucccgcacuuccugggcugccuggagcgccucgacuaccccaagagccggauggccaucugggccgccaccgaccacaacguggacaacaccaccgagaucuuccgcgaguggcugaagaacguccagcggcuguaccacuacguggaguggcgccccauggacgagcccgaguccuacccggacgagaucgggcccaagcacuggcccacgagccgguucgcccacgugaugaagcuccgccaggcggcccugcggaccgcccgcgagaagugguccgacuacauccuguucaucgacgucgacaacuuccucaccaacccccagacccugaaccugcucaucgccgagaacaagacgaucguggccccgaugcuggagagccggggccuguacuccaacuucuggugcgggaucacccccaagggcuucuacaagcgcacccccgacuacgugcagauccgggaguggaagcgcaccggcugcuuccccgucccgauggugcacagcacguuccucaucgaccugcggaaggaggcguccgacaagcugaccuucuacccgccccaccaggacuacaccuggaccuucgacgacaucaucguguucgccuucagcucccgccaggccgggauccagauguaccucugcaaccgggagcacuacggcuaccugcccaucccccugaagccccaccagacgcuccaggaggacaucgagaaccugauccacguccagaucgaggccaugaucgaccgcccgcccauggagcccagccaguacguguccgugguccccaaguaccccgacaagaugggguucgacgagaucuucaugaucaaccugaagcgccggaaggaccgccgggaccgcaugcuccggacccuguacgagcaggagaucgaggugaagaucguggaggccgucgacggcaaggcgcugaacaccagccagcucaaggcccugaacaucgagaugcugcccggguaccgcgacccguacuccagccggccccucacccgcggcgagaucggcugcuuccugagccacuacuccguguggaaggaggugaucgaccgggagcuggagaagacgcucgucaucgaggacgacgugcgcuucgagcaccaguucaagaagaagcugaugaagcugauggacaacaucgaccaggcccagcucgacugggagcugaucuacaucgggcggaagcgcaugcaggucaaggagcccgagaaggccgugccgaacguggccaaccuggucgaggcggacuacagcuacuggacccucggcuacgugaucucccuggagggggcccagaagcuggugggcgccaaccccuucggcaagaugcugcccgucgacgaguuccuccccgugauguacaacaagcacccggugcugcugagcagcccccacugccaccucuuccagacccuguccgacgacugccagcgguga

SEQ ID NO: 28556 - RNA, 1368 nt, Artificial Sequence
  derived and/or modified sequence opt1 from COLQ__Homo_sapiens__NP_005668
auggugguccugaaccccaugacccucggcaucuaccugcagcuguucuuccucagcaucgugucccagccgaccuucaucaacagcgugcugcccaucuccgccgcccugcccagccucgaccagaagaagcgcgggggccacaaggcgugcugccugcugacgcccccgcccccgccccucuucccgccgcccuucuuccgcgggggccggagcccccugcugucccccgacaugaagaaccucaugcuggagcuggagaccucccagagccccugcaugcaggggucccucggcagccccgggcccccgggcccccagggcccgcccgggcugcccggcaagaccgggcccaagggcgagaagggcgagcuggggcggcccggccgcaaggggcggcccggcccgcccggcguccccgggaugcccggcccgaucggguggcccggccccgaggggccccgcggcgagaagggcgaccucgggaugaugggccugcccgggucccggggccccauggggagcaagggcuaccccggcucccgcggggagaagggcagccgcggggagaagggcgaccuggggccgaagggcgagaagggcuuccccggguuccccggcaugcucgggcagaagggcgagaugggccccaagggggagccgggcaucgccgggcaccggggccccaccgggcggcccggcaagcgcggcaagcaggggcagaagggcgacuccggggugauggggcccccgggcaagcccggccccagcggccagcccgggcggccgggcccgcccgggcccccgcccgccggccagcugaucauggggcccaagggcgagcgcggcuuccccgggccgcccggccggugccugugcgggcccacgaugaacgugaacaaccccuccuacggcgagagcgucuacgggcccuccagcccccgcgugcccgugaucuucgucgugaacaaccaggaggagcucgagcggcugaacacccagaacgccaucgccuuccgccgggaccagcgcagccuguacuucaaggacucccucggcuggcugccgauccagcugacccccuucuaccccguggacuacaccgcggaccagcacggcacgugcggggacggccuccugcagcccggggaggagugcgacgacggcaacagcgacgucggcgacgacugcauccggugccaccgcgccuacugcggggacggccaccgccacgaggggguggaggacugcgacggcuccgacuucggguaccugaccugcgagaccuaccucccgggcagcuacggcgaccugcagugcacccaguacugcuacaucgacuccacgcccugccgguacuucaccuga

SEQ ID NO: 28557 - RNA, 609 nt, Artificial Sequence
  derived and/or modified sequence opt1 from COMMD10__Homo_sapiens__NP_057228
auggccgugcccgccgcgcugauccuccgcgagagcccguccaugaagaaggccgucagccugaucaacgccaucgacaccggccgguucccccgccugcucacccggauccugcagaagcugcaccucaaggccgaguccagcuucuccgaggaggaggaggagaagcugcaggccgcguucagccuggagaagcaggaccuccaccuggugcuggagacgaucuccuucauccucgagcaggccguguaccacaacgucaagcccgccgcccugcagcagcagcuggagaacauccaccuccgccaggacaaggcggaggccuucgugaacaccuggagcuccauggggcaggagaccguggagaaguuccggcagcgcauccuggcccccugcaagcuggagaccgucggcuggcagcucaaccugcagauggcccacagcgcccaggcgaagcugaaguccccgcaggccgugcuccagcugggggugaacaacgaggacagcaagucccuggagaagguccucguggaguucagccacaaggagcuguucgacuucuacaacaagcuggagacgauccaggcccagcucgacucccugaccuga

SEQ ID NO: 28558 - RNA, 573 nt, Artificial Sequence
  derived and/or modified sequence opt1 from COMMD1__Homo_sapiens__NP_689729
auggccgccggcgagcuggagggcgggaagccccucagcgggcugcugaacgcgcucgcccaggacaccuuccacggcuacccggggaucaccgaggagcugcugcgcucccagcucuaccccgaggugccgcccgaggaguuccggcccuuccuggccaagaugcgcggcauccucaagagcaucgccuccgccgacauggacuucaaccagcuggaggcguuccugacggcccagaccaagaagcagggcgggaucaccagcgaccaggccgccgucaucuccaaguucuggaagucccacaagaccaagauccgggagagccugaugaaccagagccgcuggaacuccggccuccgggggcugagcuggcgcguggacggcaagucccagagccggcacuccgcgcagauccacacgcccguggccaucaucgagcuggagcucgggaaguacggccaggagagcgaguuccugugccuggaguucgacgaggucaaggugaaccagauccucaagacccuguccgagguggaggagagcaucuccacccugaucagccagcccaacuga

SEQ ID NO: 28559 - RNA, 1410 nt, Artificial Sequence
  derived and/or modified sequence opt1 from COMMD3-BMI1__Homo_sapiens__NP_001190991
auggagcugagcgaguccgugcagaagggcuuccagaugcucgccgacccccgcagcuucgacuccaacgccuucacccugcugcuccgggcggccuuccagagccugcuggacgcccaggccgacgaggccguccucgaccacccggaccugaagcacaucgaccccguggugcugaagcacugccacgcggccgccgccaccuacauccucgaggcggggaagcaccgcgccgacaaguccacgcugagcaccuaccuggaggacugcaaguucgaccgggagcgcaucgagcuguucugcaccgaguaccagaacaacaagaacucccuggagauccugcucggccggacccugaucccccaccccauccagcgccugguccucguggccgccuggaacaacuaccggaucuucuaccaggccgagaugcaccgcacgacccggaucaagaucaccgagcugaacccgcaccugaugugcgugcucugcgggggcuacuucaucgacgcgaccacgaucaucgagugccugcacagcuucugcaagaccugcaucguccgcuaccuggagaccuccaaguacugccccaucugcgacguccaggugcacaagacccggccccuccugaacauccgcagcgacaagacgcugcaggacaucguguacaagcucgugcccgggcuguucaagaacgagaugaagcggcgccgggacuucuacgccgcccacccguccgccgacgccgcgaacggcagcaacgaggaccgcggcgagguggccgacgaggacaagcggaucaucaccgacgacgagaucaucucccugagcaucgaguucuucgaccagaaccgccucgaccggaaggucaacaaggacaaggagaaguccaaggaggaggugaacgacaagcgcuaccugcggugccccgccgccaugaccgugaugcaccuccgcaaguuccuccgcagcaagauggacauccccaacaccuuccagaucgacgucauguacgaggaggagccccugaaggacuacuacacgcugauggacaucgccuacaucuacaccuggcggcgcaacgggccgcucccccugaaguaccgggugcgcccgaccugcaagcggaugaagaucucccaccagcgcgacggccugaccaacgcgggggagcucgagagcgacuccggcagcgacaaggccaacagccccgccgggggcauccccuccacgagcuccugccugcccagccccuccacccccgugcagagcccgcacccccaguucccccacaucuccagcaccaugaacggcaccuccaacagccccuccgggaaccaccagagcuccuucgccaaccggccgcgcaagagcuccgucaacggcagcuccgccacgagcuccggguga

SEQ ID NO: 28560 - RNA, 675 nt, Artificial Sequence
  derived and/or modified sequence opt1 from COMMD5__Homo_sapiens__NP_054785
augagcgccgugggcgccgcgacccccuaccugcaccacccgggggacucccacagcggccgcgucuccuuccucggggcccagcugccgcccgagguggccgccauggcccggcugcucggcgaccuggaccgcagcaccuuccggaagcugcucaaguucguggucuccagccugcagggggaggacugccgcgaggcggugcagcggcugggcguguccgccaaccuccccgaggagcagcugggcgcccugcucgccgggaugcacacgcugcugcagcaggcgcuccgccugccgcccaccagccugaagcccgacaccuuccgggaccagcuccaggagcugugcaucccccaggaccuggucggcgaccucgccuccgugguguucgggagccagcgcccccugcuggacuccgucgcccagcagcagggcgccuggcucccccacguggccgacuuccgguggcgcguggacgucgcgaucagcaccuccgcccuggcccggagccugcagcccuccgugcucaugcagcugaagcugagcgacggguccgccuaccgcuucgaggugcccacggccaaguuccaggagcuccgguacagcgucgcgcuggugcugaaggagauggccgaccucgagaagcgcugcgagcggcgccugcaggacuga

SEQ ID NO: 28561 - RNA, 600 nt, Artificial Sequence
  derived and/or modified sequence opt1 from COMMD7__Homo_sapiens__NP_001092809
augggccgccugcacugcaccgaggaccccgugccggaggccgucgggggcgacaugcagcagcucaaccagcugggggcccaguucagcgcgcugaccgagguccucuuccacuuccugacggagcccaaggagguggagcgguuccuggcccagcucuccgaguucgccaccaccaaccagaucagccugggcucccugcgcagcaucgugaagucccuccugcuggugcccaacggggcccucaagaagucccugaccgccaagcagguccaggcggacuucaucacgcugggccucagcgaggagaaggccaccuacuucagcgagaaguggaagcagaacgcccccacccuggcccggugggcgaucggccagacccugaugaucaaccagcucaucgacauggaguggaaguucggggugacguccggcagcuccgagcuggagaagguggggagcaucuuccugcagcucaagcugguggucaagaagggcaaccagaccgagaacguguacaucgagcugacccucccgcaguucuacuccuuccugcacgagauggagcgcgugcggaccagcauggagugcuucugcuga

SEQ ID NO: 28562 - RNA, 2274 nt, Artificial Sequence
  derived and/or modified sequence opt1 from COMP__Homo_sapiens__NP_000086
auggugcccgacaccgccugcguccugcuccugacccuggccgcgcucggcgccagcgggcagggccaguccccgcuggggagcgaccugggcccccagaugcuccgcgagcugcaggagacgaacgccgcccugcaggacgugcgggagcuccugcgccagcagguccgggagaucaccuuccugaagaacaccgugauggagugcgacgccugcgggaugcagcaguccgugcgcaccggccuccccagcgugcggccccugcugcacugcgcgccgggcuucugcuuccccggggucgccugcauccagacggaguccggcgcccgcugcgggcccugccccgccggcuucaccgggaacggcagccacugcaccgacgugaacgagugcaacgcgcacccgugcuucccccgggugcgcugcaucaacaccucccccggcuuccggugcgaggccugcccgccgggguacagcggccccacgcaccagggggucggccucgccuucgccaaggccaacaagcaggucugcaccgacaucaacgagugcgagaccggccagcacaacugcgugcccaacuccgugugcaucaacacccgcgggagcuuccagugcggccccugccagccgggguucgugggcgaccaggcguccgggugccagcggcgcgcccagcgguucugccccgacggcagccccuccgagugccacgagcacgccgacugcgugcuggagcgcgacggcagccgguccugcgucugcgccguggggugggccggcaacgggauccugugcggccgcgacacggaccucgacggguuccccgacgagaagcugcggugcccggagcgccagugccggaaggacaacugcgugaccguccccaacagcggccaggaggacguggaccgcgacggcaucggggacgcgugcgaccccgacgccgacggcgacggggugcccaacgagaaggacaacugcccgcugguccggaaccccgaccagcgcaacaccgacgaggacaaguggggcgacgccugcgacaacugccgcucccagaagaacgacgaccagaaggacaccgaccaggacgggcggggcgacgccugcgacgacgacaucgacggcgaccgcauccggaaccaggccgacaacugcccccgcgugcccaacagcgaccagaaggacuccgacggggacggcaucggggacgcgugcgacaacugcccgcagaaguccaaccccgaccaggccgacguggaccacgacuucgucggcgacgccugcgacagcgaccaggaccaggacggcgacgggcaccaggacagccgggacaacugccccacggugccgaacagcgcccaggaggacuccgaccacgacggccagggggacgccugcgacgacgacgacgacaacgacggcguccccgacagccgcgacaacugccggcucgugcccaaccccgggcaggaggacgcggaccgcgacggcgugggcgacgucugccaggacgacuucgacgccgacaaggugguggacaagaucgacgucugcccggagaacgccgaggugacccugaccgacuuccgggccuuccagaccgugguccuggaccccgagggggacgcgcagaucgaccccaacuggguggugcucaaccagggccgcgagaucguccagacgaugaacuccgaccccgggcuggccgugggcuacaccgccuucaacgggguggacuucgagggcaccuuccacgucaacaccgugacggacgacgacuacgccggcuucaucuucggguaccaggacagcuccagcuucuacguggucauguggaagcagauggagcagaccuacuggcaggccaacccguuccgggcgguggccgagcccggcauccagcugaaggccgugaaguccagcaccgggcccggcgagcagcuccgcaacgcccuguggcacaccggggacacggagucccagguccggcugcucuggaaggacccccgcaacgugggcuggaaggacaagaaguccuaccggugguuccugcagcaccgcccccaggugggcuacauccggguccgcuucuacgaggggcccgagcugguggccgacagcaacgugguccucgacaccaccaugcggggcgggcgccugggcguguucugcuucagccaggagaacaucaucugggcgaaccugcgcuaccggugcaacgacaccauccccgaggacuacgagacgcaccagcuccgccaggccuga

SEQ ID NO: 28563 - RNA, 816 nt, Artificial Sequence
  derived and/or modified sequence opt1 from COMT__Homo_sapiens__NP_001128634
augcccgaggccccgccccugcuccuggccgcggugcugcucggccugguccugcucguggugcugcugcuccugcugcgccacuggggguggggccucugccugaucggguggaacgaguucauccugcagcccauccacaaccuccugaugggcgacaccaaggagcagcggauccugaaccacguccuccagcacgccgagcccgggaacgcccagagcgugcuggaggccaucgacaccuacugcgagcagaaggagugggccaugaacgugggcgacaagaagggcaagaucgucgacgcggugauccaggagcaccagccguccgugcugcucgagcugggggccuacugcggcuacagcgccguccgcauggcccggcugcucucccccggggcgcgccugaucacgaucgagaucaaccccgacugcgccgccaucacccagcggaugguggacuucgccggcgugaaggacaaggucacccugguggugggggccagccaggacaucaucccccagcucaagaagaaguacgacgucgacacccuggacaugguguuccuggaccacuggaaggaccgcuaccucccggacacgcugcugcucgaggagugcggccugcugcggaagggcaccgugcuccuggcggacaacgucaucugccccggggcccccgacuuccuggcccacgugcgcggcuccagcugcuucgagugcacccacuaccaguccuuccucgaguaccgggagguggucgacgggcuggagaaggccaucuacaagggccccggcagcgaggccgggccguga

SEQ ID NO: 28564 - RNA, 3702 nt, Artificial Sequence
  derived and/or modified sequence opt1 from COPA__Homo_sapiens__NP_001091868
augcugaccaaguucgagaccaagagcgcccgcgugaagggccucuccuuccaccccaagcggccguggauccugacgagccugcacaacggggucauccagcucugggacuaccgcaugugcacccugaucgacaaguucgacgagcacgacggccccgugcgggggaucgacuuccacaagcagcagccccuguucguguccggcggggacgacuacaagaucaaggucuggaacuacaagcuccgccggugccuguucacccugcucggccaccuggacuacauccgcaccacguucuuccaccacgaguaccccuggauccugagcgccuccgacgaccagaccauccggguguggaacuggcagagccggaccugcgugugcguccucaccggccacaaccacuacgugaugugcgcgcaguuccacccgacggaggaccugguggucuccgccagccuggaccagaccgugcgggugugggacaucuccgggcuccgcaagaagaaccugagccccggcgccgucgaguccgacgugcgggggaucaccggcguggaccuguucgggaccacggacgccgucgugaagcacgugcucgagggccacgaccgcggcgucaacugggccgcguuccaccccaccaugccccugaucgugagcggggccgacgaccgccaggugaagaucuggcgcaugaacgaguccaaggccugggaggucgacacgugccggggccacuacaacaacgugagcugcgccguguuccacccgcgccaggagcugauccucuccaacagcgaggacaaguccauccgggucugggacaugagcaagcgcaccggggugcagaccuuccggcgcgaccacgaccgguucuggguccuggcggcccaccccaaccugaaccucuucgccgccggccacgacggcgggaugaucguguucaagcuggagcgcgagcgccccgccuacgcggugcacggcaacaugcugcacuacgucaaggaccgguuccuccgccagcuggacuucaacuccagcaaggacguggccgugaugcagcugcggagcggguccaaguuccccgucuucaacaugagcuacaacccggccgagaacgccgugcuccugugcacccgcgccuccaaccuggagaacagcaccuacgaccucuacaccauccccaaggacgcggacucccagaaccccgacgcccccgagggcaagcggagcuccgggcugacggccgugugggucgcccgcaaccgguucgccgugcuggaccgcaugcacagccuccugaucaagaaccugaagaacgagaucaccaagaaggugcaggucccgaacugcgacgagaucuucuacgcgggcaccggcaaccuccugcugcgggacgccgacuccaucacccucuucgacgugcagcagaagcgcacgcuggccagcgugaagaucuccaaggucaaguacgugaucuggagcgccgacaugucccacguggcccugcucgcgaagcacgagcacagcugcccccugccccugaccgccaucgucaucugcaaccggaagcucgacgcccugugcaacauccacgagaacauccgcgugaaguccggggccugggacgagagcggcguguucaucuacaccaccuccaaccacaucaaguacgcggucacgaccggggaccacggcaucauccggacccuggaccugcccaucuacgugacccgcgugaaggggaacaacgucuacugccucgaccgggagugccgcccgcgggugcugacgaucgaccccaccgaguucaaguucaagcuggcccucaucaaccgcaaguacgacgaggugcugcacaugguccggaacgccaagcuggugggccagagcaucaucgccuaccuccagaagaagggcuaccccgagguggcccugcacuucgucaaggacgagaagacccgcuucucccuggcgcucgagugcgggaacaucgagaucgcccuggaggccgccaaggcccuggacgacaagaacugcugggagaagcucggcgagguggcgcugcugcaggggaaccaccagaucguggagaugugcuaccagcgcaccaagaacuucgacaagcucagcuuccuguaccugaucacgggcaaccucgagaagcugcggaagaugaugaagaucgccgagauccgcaaggacaugagcgggcacuaccagaacgcccuguaccucggcgacgucuccgagcgggugcgcauccugaagaacugcggccagaagucccuggccuaccucaccgccgcgacccacgggcuggacgaggaggccgagagccugaaggagaccuucgaccccgagaaggagaccaucccggacaucgaccccaacgccaagcuccugcagccgcccgcccccaucaugccccuggacacgaacuggccccuccugaccgugagcaagggcuucuucgaggggaccaucgcguccaagggcaagggcggggcccuggccgccgacaucgacaucgacaccgucggcacggagggguggggcgaggacgccgagcuccagcuggacgaggacggguucguggaggcgaccgagggccugggcgacgacgcccucgggaagggccaggaggagggcggcgggugggacguggaggaggaccuggagcugccgcccgagcucgacaucagccccggggccgccggcggggccgaggacggcuucuucgugcccccgaccaaggggaccucccccacgcagaucuggugcaacaacagccagcugcccgucgaccacauccuggcgggcuccuucgagaccgccaugcggcuccugcacgaccaggugggggucauccaguucggccccuacaagcagcuguuccuccagaccuacgcccgcggccggaccacguaccaggcccugccgugccugcccagcauguacggguaccccaaccgcaacuggaaggacgccggccucaagaacggggugcccgcggugggccugaagcugaacgaccucauccagcggcugcagcugugcuaccagcucaccaccgucgggaaguucgaggaggccguggagaaguuccgcuccauccugcugagcgugccgcuccuggucguggacaacaagcaggagaucgccgaggcccagcagcugaucaccaucugccgggaguacaucgugggccucuccgucgagacggagcgcaagaagcugcccaaggagacccuggagcagcagaagcggaucugcgagauggcggccuacuucacccacagcaaccuccagcccgugcacaugauccugguccugcgcaccgcccucaaccuguucuucaagcugaagaacuucaagacggccgccaccuucgcgcggcgccuccuggagcugggccccaagccggagguggcccagcagacccggaagauccucuccgccugcgagaagaaccccaccgacgccuaccagcugaacuacgacaugcacaaccccuucgacaucugcgccgcgagcuaccgccccaucuaccgggggaagccgguggagaagugcccccuguccggcgccugcuacagccccgaguucaaggggcagaucugccgcgucacgaccgugaccgagaucggcaaggacgugaucggccuccggaucagcccccugcaguuccgcuga

SEQ ID NO: 28565 - RNA, 2862 nt, Artificial Sequence
  derived and/or modified sequence opt1 from COPB1__Homo_sapiens__NP_057535
augaccgccgccgagaacgugugcuacacccugaucaacguccccauggacagcgagccgcccuccgagaucagccucaagaacgaccuggagaagggcgacgugaaguccaagacggaggcgcugaagaaggugaucaucaugauccucaacggggagaagcugcccggccugcucaugaccaucauccgcuucguccugccccugcaggaccacaccaucaagaagcuccugcugguguucugggagaucgugccgaagaccacgcccgacgggcggcuccugcacgagaugauccuggucugcgacgccuaccgcaaggaccuccagcaccccaacgaguucauccggggcagcacccugcgcuuccugugcaagcucaaggaggccgagcugcuggagccccucaugccggccauccgggccugccuggagcaccgccacuccuacgugcggcgcaacgcggugcuggccaucuacaccaucuaccggaacuucgagcaccucauccccgacgcccccgagcugauccacgacuuccuggucaacgagaaggacgccagcugcaagcgcaacgcguucaugaugcucauccacgccgaccaggaccgggcccuggacuaccuguccacgugcaucgaccaggugcagaccuucggggacauccuccagcuggugaucgucgagcugaucuacaaggugugccacgccaaccccagcgagcgcgcccgguucauccgcugcaucuacaaccuccugcaguccagcuccccggcggugaaguacgaggccgccggcacccuggucacccucagcuccgcccccaccgccaucaaggcggccgcccagugcuacaucgaccugaucaucaaggagagcgacaacaacgugaagcugaucgugcucgaccggcugaucgagcugaaggagcaccccgcccacgagcgcguccuccaggaccuggugauggacauccugcgggugcucuccacgcccgaccuggagguccgcaagaagacccugcagcucgcccuggaccuggugagcucccggaacguggaggagcuggucaucgugcucaagaaggaggucaucaagaccaacaacgugagcgagcacgaggacaccgacaaguaccgccagcugcuggugcggacgcuccacuccugcagcguccgcuucccggacauggcggccaacgugauccccgugcugauggaguuccugagcgacaacaacgaggccgccgccgcggacguccucgaguucgugcgcgaggccauccagcgguucgacaaccugcgcaugcugaucguggagaagaugcucgaggucuuccacgccaucaaguccgugaagaucuaccggggcgcccuguggauccugggggaguacugcagcaccaaggaggacauccaguccgugaugaccgagauccgccggagccucggcgagauccccaucgucgaguccgagaucaagaaggaggcgggggagcugaagcccgaggaggagaucaccgugggcccggugcagaagcuggucacggagauggggaccuacgccacccagagcgcccucuccagcucccgccccaccaagaaggaggaggaccggccgccccugcgcggcuuccugcucgacggcgacuucuucguggccgccagccuggcgacgacccugaccaagaucgcccuccgguacguggcccugguccaggagaagaagaagcagaacuccuucguggccgaggccaugcugcucauggcgaccauccugcaccugggcaagagcucccuccccaagaagcccaucacggacgacgacguggaccgcaucagccugugccugaagguccucuccgagugcagcccccugaugaacgacaucuucaacaaggagugccggcagucccugagccacaugcucuccgccaagcuggaggaggagaagcugagccagaagaaggagagcgagaagcgcaacgugaccgugcagcccgacgacccgaucuccuucaugcagcucaccgccaagaacgagaugaacugcaaggaggaccaguuccagcugagccugcucgccgccauggggaacacccagcggaaggaggcggccgacccccuggccuccaagcugaacaaggucacgcagcucaccggguucagcgaccccguguacgccgaggcguacgugcacgucaaccaguacgacaucgugcuggacgugcuggucgugaaccagaccuccgacacccuccagaacugcacgcuggagcuggccacccucggcgaccugaagcugguggagaagccgagcccccucacccuggcgccccacgacuucgccaacaucaaggccaacgucaagguggccuccaccgagaacggcaucaucuucgggaacaucguguacgacgucagcggcgccgccuccgaccgcaacugcguggugcugagcgacauccacaucgacaucauggacuacauccagcccgcgaccugcacggacgccgaguuccggcagaugugggccgaguucgagugggagaacaaggucaccgugaacaccaacaugguggaccucaacgacuaccugcagcacauccugaaguccaccaacaugaagugccucacgccggagaaggcccugagcggguacugcggcuucauggccgccaaccuguacgcccgcuccaucuucggggaggacgcgcucgccaacgucagcaucgagaagcccauccaccagggccccgacgccgccgugaccggccacauccggauccgcgcgaagucccaggggauggcccugagccugggcgacaagaucaaccucucccagaagaagaccagcaucuga

SEQ ID NO: 28566 - RNA, 2721 nt, Artificial Sequence
  derived and/or modified sequence opt1 from COPB2__Homo_sapiens__NP_004757
augccccugcgccucgacaucaagcggaagcugaccgcccgcagcgaccgggucaagagcguggaccugcacccgaccgagcccuggaugcucgccagccuguacaacggcuccgugugcguguggaaccacgagacgcagacccuggucaagaccuucgaggugugcgaccuccccgugcgcgcggccaaguucgucgcccggaagaacuggguggugaccggggccgacgacaugcagauccgcgucuucaacuacaacacgcuggagcgggugcacauguucgaggcccacagcgacuacauccgcugcaucgcggugcaccccacccagccguucauccugaccuccagcgacgacaugcucaucaagcugugggacugggacaagaagugguccugcagccaggucuucgagggccacacccacuacgugaugcagaucgugaucaaccccaaggacaacaaccaguucgccuccgccagccuggaccggacgaucaaggucuggcagcucggguccagcucccccaacuucacccuggagggccacgagaagggggugaacugcaucgacuacuacagcggcggcgacaagcccuaccugaucuccggggccgacgaccgccucgugaagaucugggacuaccagaacaagaccugcguccagacccuggagggccacgcgcagaacgugagcugcgccuccuuccacccggagcugcccaucaucaucacggggagcgaggacggcaccgugcggaucuggcacuccagcaccuaccgccucgagagcacccugaacuacgggauggagcgggucuggugcguggccucccugcgcggcagcaacaacguggcccucggcuacgacgagggguccaucaucgucaagcugggccgggaggagcccgccaugagcauggacgcgaacgggaagaucaucugggccaagcacuccgaggugcagcaggccaaccugaaggccaugggcgacgccgagaucaaggacggcgagcgccucccccuggcggucaaggacauggggagcugcgagaucuacccgcagacgauccagcacaaccccaacggccgguucgugguggucugcggggacggcgaguacaucaucuacaccgccauggcccugcgcaacaaguccuucgggagcgcccaggaguucgccugggcgcacgacuccagcgaguacgccauccgggaguccaacagcaucgugaagaucuucaagaacuucaaggagaagaaguccuucaagcccgacuucggcgccgagagcaucuacggcggguuccuccugggcgugcgcuccgucaacgggcuggccuucuacgacugggacaacaccgagcucauccggcgcaucgagauccagcccaagcacaucuucuggagcgacuccggcgagcuggugugcaucgccaccgaggagagcuucuucauccugaaguaccucuccgagaaggugcuggcggcccaggagacgcacgagggggucaccgaggacggcaucgaggacgccuucgaggugcugggcgagauccaggagaucgugaagaccgggcucugggucggcgacugcuucaucuacaccagcagcgugaaccgccugaacuacuacgucgggggcgagaucgugacgaucgcccaccuggaccggaccauguaccuccugggguacaucccgaaggacaaccgccuguaccucggcgacaaggagcugaacaucaucuccuacagccugcucguguccgugcuggaguaccagaccgcggucaugcggcgcgacuucagcauggccgacaaggugcugcccaccauccccaaggagcagcggacgcgcguggcccacuuccucgagaagcagggcuucaagcagcaggcccugaccgucuccaccgaccccgagcaccgguucgagcuggcccugcagcucggggagcugaagaucgcguaccagcuggccguggaggccgagagcgagcagaaguggaagcagcucgccgagcuggccaucuccaagugccaguucggccuggcgcaggagugccuccaccacgcccaggacuacgggggccugcugcuccuggccaccgccagcggcaacgccaacauggugaacaagcuggcggagggggccgagcgcgacggcaagaacaacgucgccuucauguccuacuuccuccaggggaagguggacgccugccuggagcugcucauccggacgggccgccugccggaggcggccuuccuggcccggaccuaccuccccagccaggugucccgcgucgugaagcuguggcgggagaaccugagcaaggugaaccagaaggccgccgagucccucgcggaccccaccgaguacgagaaccuguuccccgggcugaaggaggccuucgucguggaggagugggugaaggagacccacgccgaccucuggccggccaagcaguacccccuggucacgcccaacgaggagcgcaacgugauggaggagggcaaggacuuccagcccagccgguccaccgcccagcaggagcuggacggcaagccggcgagccccacccccgugaucgucgccucccacaccgccaacaaggaggagaagucccuccuggagcuggagguggaccucgacaaccuggagcuggaggacaucgacaccacggacaucaaccucgacgaggacauccuggacgacuga

SEQ ID NO: 28567 - RNA, 927 nt, Artificial Sequence
  derived and/or modified sequence opt1 from COPE__Homo_sapiens__NP_009194
auggcgcccccggcccccggccccgccagcgggggcuccggggagguggacgagcuguucgacgucaagaacgccuucuacaucggcagcuaccagcagugcaucaacgaggcccagcgcgugaagcucuccagccccgagcgggacguggagcgcgacgucuuccuguaccgggccuaccuggcccagcgcaaguucgggguggugcucgacgagaucaagccguccagcgcgcccgagcugcaggccguccggauguucgccgacuaccuggcccacgagucccgccgggacagcaucguggcggagcucgaccgcgagaugucccggagcguggacgucaccaacaccacguuccugcugauggccgccuccaucuaccuccacgaccagaaccccgacgccgcccugcgcgcgcugcaccagggcgacagccucgagugcaccgccaugaccgugcagauccugcugaagcucgaccggcuggaccuggcccgcaaggagcucaagcggaugcaggaccuggacgaggacgccacccugacgcagcucgccaccgcgugggugucccuggccaccggcggggagaagcugcaggacgccuacuacaucuuccaggagauggccgacaagugcagccccacccuccugcugcucaacggccaggccgcgugccacauggcccaggggcgcugggaggccgccgagggccugcugcaggaggcccucgacaaggacuccggguacccggagacgcuggucaaccugaucgugcucagccagcaccugggcaagccgcccgaggugaccaaccgguaccugucccagcucaaggacgcgcaccgcagccaccccuucaucaaggaguaccaggccaaggagaacgacuucgaccggcugguccugcaguacgcccccuccgccuga

SEQ ID NO: 28568 - RNA, 2181 nt, Artificial Sequence
  derived and/or modified sequence opt1 from COPG2__Homo_sapiens__NP_001276962
augaucaagaaguucgacaagaaggacgaggagagcggcuccgggagcaaccccuuccagcaccuggagaaguccgccgugcuccaggaggcccgcaucuucaacgagaccccgaucaacccccggcgcugccugcacauccugaccaagauccucuaccugcugaaccagggcgagcacuucgggacgaccgaggcgaccgaggccuucuucgccaugacccggcuguuccagagcaacgaccagacgcugcgccggaugugcuaccugaccaucaaggagauggccaccaucuccgaggacgucaucaucgugaccagcucccucacgaaggacaugaccggcaaggaggacguguaccgcgggcccgccauccgggcgcugugccgcaucaccgacggcaccaugcugcaggccaucgagcgguacaugaagcaggccaucgucgacaaggugagcuccgugagcuccagcgcccucgucuccagccugcacaugaugaagaucuccuacgacguggugaagcgcuggaucaacgaggcgcaggaggccgccagcuccgacaacaucaugguccaguaccacgcccugggcgugcucuaccaccuccggaagaacgaccgccuggccgugagcaagaugcucaacaaguucacgaaguccgggcugaagucccaguucgcguacugcaugcugauccggaucgccagccgccuccugaaggagaccgaggacggccacgagagcccccuguucgacuucaucgagagcugccuccggaacaagcacgagauggucaucuacgaggccgccuccgccaucauccaccucccgaacugcaccgcgcgcgagcuggcccccgccgugagcgugcugcagcuguucugcuccagccccaagcccgcccugcgguacgccgcgguccgcacccucaacaagguggccaugaagcacccguccgccgugacggccugcaaccuggaccuggagaaccucaucaccgacagcaaccgguccaucgccacccuggcgaucaccacgcugcucaagaccgggagcgaguccagcgucgaccgccugaugaagcagaucuccagcuucguguccgagaucagcgacgaguucaagguggucguggugcaggccaucuccgcccugugccagaaguacccccggaagcacagcgucaugaugaccuuccucuccaacaugcugcgcgacgacggcggguucgaguacaagcgcgccaucguggacugcaucaucagcaucgucgaggagaaccccgagagcaaggaggcgggccuggcccaccucugcgaguucaucgaggacugcgagcacaccgugcuggccacgaagauccugcaccuccugggcaaggaggggccccggaccccggugcccuccaaguacauccgcuucaucuucaaccgggucgugcuggagaacgaggccgugcgcgccgcggccgucagcgcccucgccaaguucggcgcccagaacgagucccugcugcccagcauccuggugcuccugcagcggugcaugauggacaccgacgacgaggugcgcgaccgggcgaccuucuaccugaacguccuccagcagcgccagauggcccugaacgccacguacaucuucaacgggcugaccguguccgugcccggcauggagaaggcccuccaccaguacacccuggagccgagcgagaagcccuucgacaugaaguccaucccccuggccauggcgcccgucuucgagcagaaggccgagaucacccucguggccacgaagccggagaagcuggcccccagccggcaggacaucuuccaggagcagcuggcggccauccccgaguuccucaacaucggcccccuguucaaguccagcgagccggugcagcugaccgaggccgagaccgaguacuucguccgcugcaucaagcacauguucaccaaccacaucguguuccaguucgacugcacgaacacccucaacgaccagcugcuggagaaggugaccguccagauggagcccuccgacagcuacgaggugcucuccugcauccccgcccccagccugccguacaaccagcccgggaucugcuacacccuggugcggcuccccgacgacgacccgaccgccggcacgaacccccagaagggcggggacaccuga

SEQ ID NO: 28569 - RNA, 555 nt, Artificial Sequence
  derived and/or modified sequence opt1 from COPRS__Homo_sapiens__NP_060875
auggaccugcaggccgccggcgcccaggcccagggggccgccgagcccagccgcggcccgccccuccccuccgcccgcggggcgccgcccagccccgaggccggcuucgccaccgccgaccacuccagccaggagcgggagaccgagaaggcgauggaccggcuggcccgcgggacgcaguccauccccaacgacagccccgcccggggcgagggcacccacuccgaggaggagggguucgccauggacgaggaggacagcgacggcgagcugaacaccugggagcucuccgaggggaccaacugcccgcccaaggagcagcccggcgaccuguucaacgaggacugggacagcgagcugaaggccgaccaggggaaccccuacgacgcggacgacauccaggaguccaucagccaggagcucaagcccugggugugcugcgcgccccagggcgacaugaucuacgaccccuccuggcaccacccgccgccccugauccccuacuacagcaagauggucuucgagacgggccaguucgacgacgccgaggacuga

SEQ ID NO: 28570 - RNA, 1353 nt, Artificial Sequence
  derived and/or modified sequence opt1 from COPS2__Homo_sapiens__NP_001137359
augagcgacauggaggacgacuucaugugcgacgacgaggaggacuacgaccuggaguacuccgaggacagcaacuccgagcccaacguggaccucgagaaccaguacuacaacagcaaggcccugaaggaggacgacccgaaggccgcgcuguccagcuuccagaagguccucgagcuggagggcgagaagggggaguggggcuucaaggcccugaagcagaugaucaagaucaacuucaagcucaccaacuuccccgagaugaugaaccgcuacaagcagcugcugaccuacauccgguccgccgugacgcgcaacuacagcgagaaguccaucaacagcauccucgacuacaucuccaccagcaagcagaacuccgacuuccugugccagauggaccugcuccaggaguucuacgagaccacccuggaggcccugaaggacgccaagaacgaccggcucugguucaagacgaacaccaagcuggggaagcuguaccucgagcgcgaggaguacggcaagcugcagaagauccugcggcagcuccaccagagcugccagaccgacgacggggaggacgaccugaagaagggcacccagcugcucgagaucuacgcgcuggagauccagauguacacggcccagaagaacaacaagaagcugaaggcccucuacgagcagucccugcacaucaagagcgccaucccccacccccugaucaugggcgugauccgcgagugcgggggcaagaugcaccuccgggagggggaguucgagaaggcgcacaccgacuucuucgaggccuucaagaacuacgacgaguccggcagcccgcgccggacgaccugccugaaguaccugguccucgccaacaugcugaugaaguccgggaucaaccccuucgacagccaggaggccaagcccuacaagaacgaccccgagauccuggccaugaccaaccucgugagcgcguaccagaacaacgacaucaccgaguucgagaagauccugaagaccaaccacuccaacaucauggacgacccguucauccgcgagcacaucgaggagcugcuccggaacauccgcacccaggugcugaucaagcugaucaagcccuacacgcggauccacauccccuucaucagcaaggagcucaacaucgacgucgccgacguggagucccugcuggugcagugcauccucgacaacaccauccacggccgcaucgaccaggucaaccagcugcuggagcucgaccaccagaagcggggcggggcccgcuacaccgcccuggacaaguggaccaaccagcugaacagccugaaccaggccgugguguccaagcucgcguga

SEQ ID NO: 28571 - RNA, 1212 nt, Artificial Sequence
  derived and/or modified sequence opt1 from COPS3__Homo_sapiens__NP_001186054
augacccagcugugcgagcucaucaacaagagcggcgagcugcuggccaagaaccucucccaccuggacaccgugcugggggcccucgacguccaggagcacagccugggcgugcuggcgguccucuucgugaaguucuccaugcccagcgugccggacuucgagacgcuguucucccaggugcagcuguucaucagcacgugcaacggggagcacauccgcuacgccaccgacaccuucgccggccucugccaccagcugaccaacgcccuggucgagcggaagcagccccuccgcgggaucggcauccugaagcaggccaucgacaagaugcagaugaacaccaaccagcugaccuccauccacgcggaccucugccagcugugccugcucgccaagugcuucaagcccgcccugcccuaccuggacguggacaugauggacaucugcaaggagaacggcgccuacgacgcgaagcacuuccucugcuacuacuacuacgggggcaugaucuacaccgggcugaagaacuucgagcgggcccuguacuucuacgagcaggccaucacgaccccggccauggccgugagccacaucaugcucgaguccuacaagaaguacauccuggucagccugauccuccugggcaaggugcagcagcugcccaaguacaccucccagaucguggggcgcuucaucaagccccucagcaacgcguaccacgagcuggcccaggucuacuccaccaacaaccccagcgagcugcggaaccucgugaacaagcacuccgagacguucacccgcgacaacaacaugggccuggugaagcagugccugagcucccucuacaagaagaacauccagcggcugaccaagaccuuccugacgcucagccugcaggacauggccucccgcguccagcugagcggcccgcaggaggccgagaaguacgugcuccacaugaucgaggacggggagaucuucgccagcaucaaccagaaggacggcaugguguccuuccacgacaaccccgagaaguacaacaaccccgcgaugcugcacaacaucgaccaggagaugcugaagugcaucgagcucgacgagcggcugaaggccauggaccaggagaucaccgucaacccccaguucgugcagaaguccauggggagccaggaggacgacagcggcaacaagccguccagcuacuccuga

SEQ ID NO: 28572 - RNA, 1059 nt, Artificial Sequence
  derived and/or modified sequence opt1 from COPS4__Homo_sapiens__NP_001244935
auggccgccgcggugcgccaggaccuggcccagcucaugaacagcuccggcagccacaaggaccuggccgggaaguaccggcagauccuggagaaggccauccagcucuccggcgccgagcagcuggaggcgcugaaggccuucgucgaggccauggugaacgagaacgugagccucgucaucucccgccagcugcugaccgacuucugcacccaccuccccaaccugccggacagcacggccaaggagaucuaccacuucacccuggagaagauccagccccgggugaucuccuucgaggagcaggucgcgagcauccgccagcaccucgccuccaucuacgagaaggaggaggacuggcggaacgccgcccaggugcugguggggaucccccuggagaccggccagaagcaguacaacguggacuacaagcucgagaccuaccugaagaucgcccgccuguaccucgaggacgacgaccccguccaggcggaggccuacaucaaccgggccagccugcugcagaacgaguccacgaacgagcagcuccagauccacuacaaggugugcuacgcccgcgugcuggacuaccggcgcaaguucaucgaggccgcgcagcgguacaacgagcugagcuacaagaccaucguccacgaguccgagcgccucgaggcccugaagcacgcccugcacugcaccauccucgccagcgccgggcagcagcggucccgcaugcuggcgacccuguucaaggacgagcggugccagcagcucgccgccuacggcauccuggagaagauguaccuggaccgcaucauccggggcaaccagcuccaggaguucgccgccaugcugaugccgcaccagaaggcgacgaccgccgacgggagcuccauccuggaccgcgccgugaucgagcacaaccuccugagcgccuccaagcuguacaacaacaucaccuucgaggagcucggcgcgcugcuggagauccccgccgccaagcacgagaagcccugccagcgggggaucagccgcagcaaccacuucguguccaaguga

SEQ ID NO: 28573 - RNA, 1005 nt, Artificial Sequence
  derived and/or modified sequence opt1 from COPS5__Homo_sapiens__NP_006828
auggccgccagcggcuccgggauggcgcagaagaccugggagcuggccaacaacaugcaggaggcccagagcaucgacgagaucuacaaguacgacaagaagcagcagcaggagauccucgccgccaagcccuggaccaaggaccaccacuacuucaaguacugcaagaucuccgcgcuggcccugcucaagauggugaugcacgcccgcagcggcgggaaccuggaggucaugggccugaugcucgggaagguggacggcgagacgaugaucaucauggacuccuucgcccugccgguggagggcaccgagacccgggucaacgcgcaggccgccgccuacgaguacauggccgcguacaucgagaacgccaagcaggucgggcgccuggagaacgccaucggcugguaccacagccaccccggguacggcugcuggcucuccgggaucgacgugagcacccagaugcugaaccagcaguuccaggagcccuucguggccguggugaucgaccccacgcggaccaucuccgccggcaaggucaaccugggcgcguuccgcaccuacccgaagggguacaagccgcccgacgagggccccagcgaguaccagaccaucccccucaacaagaucgaggacuucggggugcacugcaagcaguacuacgcccuggagguguccuacuucaagagcucccuggaccggaagcuccuggagcugcucuggaacaaguacugggucaacacgcugagcuccagcucccugcucaccaacgccgacuacaccaccggccagguguucgaccugagcgagaagcuggagcaguccgaggcccagcucggccgcgggagcuucaugcugggccuggagacgcacgaccgcaagagcgaggacaagcucgccaaggcgacccgggacuccugcaagaccaccaucgaggccauccacgggcugaugagccaggugaucaaggacaagcuguucaaccagaucaacaucuccuga

SEQ ID NO: 28574 - RNA, 984 nt, Artificial Sequence
  derived and/or modified sequence opt1 from COPS6__Homo_sapiens__NP_006824
auggccgccgcggccgccgccgccgcggccaccaacggcaccgggggcagcuccgggauggagguggacgccgccgucgugcccagcgugauggcgugcggcgucacgggguccgugagcguggcccugcacccgcucgucauccugaacaucuccgaccacuggauccgcaugcggagccaggagggccgccccguccaggugaucggcgcccugaucgggaagcaggagggccggaacaucgaggugaugaacuccuucgagcuccugagccacaccguggaggagaagaucaucaucgacaaggaguacuacuacaccaaggaggagcaguucaagcaggucuucaaggagcuggaguuccucgggugguacaccacgggcgggccgcccgaccccuccgacauccacgugcacaagcaggucugcgagaucaucgagagcccccuguuccugaagcucaaccccaugaccaagcacaccgaccugcccguguccguguucgagagcgugaucgacaucaucaacggcgaggccaccaugcuguucgccgagcucacguacacccuggcgaccgaggaggccgagcgcaucggcguggaccacgucgcccggaugaccgccacgggguccggcgagaacagcaccguggccgagcaccugaucgcgcagcacuccgccaucaagaugcuccacagccgcgugaagcugauccuggaguacgucaaggccuccgaggccggggaggugccguucaaccacgagauccuccgggaggccuacgcgcugugccacugccugcccgugcucagcaccgacaaguucaagaccgacuucuacgaccagugcaacgacgucggccugauggccuaccugggcacgaucaccaagaccugcaacaccaugaaccaguucgugaacaaguucaacguccucuacgaccgccaggggaucggccggcgcaugcgggggcuguucuucuga

SEQ ID NO: 28575 - RNA, 828 nt, Artificial Sequence
  derived and/or modified sequence opt1 from COPS7A__Homo_sapiens__XP_005253752
augagcgccgaggugaaggucaccggccagaaccaggagcaguuccugcuccuggccaaguccgcgaagggggccgcccuggccacccucauccaccaggugcuggaggcccccggcguguacgucuucggggagcugcucgacaugccgaacgugcgcgagcuggcggagagcgacuucgccuccacguuccggcugcucaccguguucgccuacggcaccuacgccgacuaccuggcggaggcccgcaaccugccgccccucaccgaggcccagaagaacaagcugcggcaccugagcgucgugacgcucgccgccaaggugaagugcauccccuacgcgguccugcuggaggcccucgcccugcgcaacgugcggcagcuggaggaccucgugaucgaggccgucuacgccgacgugcugcgcgggucccuggaccagcggaaccagcgccucgagguggacuacagcaucggccgggacauccagcgccaggaccuguccgcgaucgcccggacccugcaggaguggugcgucggcugcgagguggugcucagcgggaucgaggagcaggucucccgcgccaaccagcacaaggagcagcagcugggccugaagcagcagaucgagagcgagguggccaaccucaagaagaccaucaaggugaccacggccgcggccgccgccgccaccucccaggaccccgagcagcaccugaccgagcugcgggagcccgcgcccgggaccaaccagcgccagcccagcaagaaggccuccaagggcaaggggcuccggggcagcgccaagaucugguccaagagcaacuga

SEQ ID NO: 28576 - RNA, 630 nt, Artificial Sequence
  derived and/or modified sequence opt1 from COPS8__Homo_sapiens__NP_006701
augcccguggccgucauggccgagagcgcguucuccuucaagaagcugcucgaccagugcgagaaccaggagcuggaggcccccggcgggaucgccaccccgcccguguacggccagcugcucgcccuguaccugcuccacaacgacaugaacaacgcccgcuaccuguggaagcggaucccgcccgcgaucaagagcgccaacuccgagcucgggggcaucuggagcguggggcagcgcaucuggcagcgggacuuccccggcaucuacaccacgaucaacgcccaccagugguccgagaccguccagcccaucauggaggcccugcgcgacgcgacccggcgccgggccuucgcccuggugagccaggccuacaccuccaucaucgccgacgacuucgcggccuucgugggccugcccgucgaggaggccgugaaggggauccucgagcagggcuggcaggccgacagcacgacccgcauggugcugccccggaagcccgucgccggggcgcuggacguguccuucaacaaguucaucccccucagcgagcccgccccggugccgcccauccccaacgagcagcagcuggcccgccugaccgacuacgucgccuuccucgagaacuga

SEQ ID NO: 28577 - RNA, 633 nt, Artificial Sequence
  derived and/or modified sequence opt1 from COPZ2__Homo_sapiens__NP_057513
augcagcgccccgaggccuggccgcggccccaccccggcgagggggccgcggccgcccaggccggcgggcccgccccgcccgcgcgcgccggcgagcccagcgggcugcggcuccaggagcccucccuguacaccaucaaggccguguucauccuggacaacgacggccgccggcuccuggccaaguacuacgacgacaccuucccgagcaugaaggagcagauggucuucgagaagaacguguucaacaagacgucccgcaccgagagcgagaucgcguucuucggcgggaugaccaucguguacaagaacuccaucgaccuguuccucuacgucgugggcagcuccuacgagaacgagcugaugcugaugagcgugcugaccugccucuucgagucccugaaccacaugcuccggaagaacgucgagaagcgcuggcugcuggagaacauggacggggccuuccucgugcuggacgagaucguggacggcggggucauccuggagagcgacccccagcaggucauccagaaggugaacuuccgggccgacgacggcggccucacggagcaguccguggcccaggugcugcagagcgccaaggagcagaucaaguggucccugcucaaguga

SEQ ID NO: 28578 - RNA, 1266 nt, Artificial Sequence
  derived and/or modified sequence opt1 from COQ2__Homo_sapiens__NP_056512
augacccccaucagccaggugcgcaugcggaagggcuccgcccacaccgccgcgcagccggggcgccugggccuccaccccgccggggccacggcccacgccugccggggcaugaccagcauccgcgcgcggcccgggcugaccuccgccaugcugggcagccgcgccgccggcuucgcgcgggggcuccgcgccgucgcccuggccuggcugcccggcuggcgggggcgcuccuucgcccucgcgcgggccgccggcgccccgcacgggggcgaccugcagccgcccgccugccccgagccccgcggccggcagcugagccucuccgcggccgccgugguggacagcgcgccccgcccccugcagcccuaccugcggcucaugcgccuggacaagccgaucgggaccuggcugcucuaccugcccugcacgugguccaucggccuggccgccgagcccgggugcuuccccgacugguacaugcucagccuguucggcaccggcgccauccugaugcgcggggccggcugcaccaucaacgacaugugggaccaggacuacgacaagaaggucacccggacggccaaccggccgaucgccgcgggggacaucuccaccuuccagagcuucguguuccucggcgggcagcugacccuggcccucggcgugcugcugugccucaacuacuacuccaucgcccugggcgccgggagccugcuccuggucaucaccuacccccugaugaagcgcaucuccuacuggccccagcucgcgcugggccugacguucaacuggggcgcccuccugggguggagcgccaucaagggguccugcgaccccagcgugugccugccgcucuacuucuccggcgugauguggacccugaucuacgacaccaucuacgcccaccaggacaagcgggacgacguccugaucggccucaagagcaccgcccugcgcuucggggagaacacgaagcccuggcugagcggcuucuccguggcgaugcucggggcccugagccuggugggcgucaacuccgggcagaccgcccccuacuacgccgcccucggcgcggugggcgcccaccugacccaccagaucuacacccuggacauccaccgccccgaggacugcuggaacaaguucaucagcaaccggacgcuggggcucaucguguuccugggcaucguccuggggaaccucuggaaggagaagaagaccgacaagaccaagaagggcaucgagaacaagaucgagaacuga

SEQ ID NO: 28579 - RNA, 1110 nt, Artificial Sequence
  derived and/or modified sequence opt1 from COQ3__Homo_sapiens__NP_059117
auguggagcggccgcaagcugggguccagcggcgggugguuccuccgggugcugggccccgggggcugcaacaccaaggccgcccgcccgcugaucuccagcgcggucuacgugaagaaccagcucuccggcacccugcagaucaagcccgggguguucaacgaguaccggacgaucugguucaagagcuaccgcaccaucuucuccugccugaaccggaucaagagcuuccgcuaccccugggcccggcucuacuccaccagccagaccacggucgacuccggcgaggugaagaccuuccuggcccuggcccacaaguggugggacgagcaggggguguacgcgccccuccacagcaugaacgaccugcgcgucccguucauccgggacaaccugcucaagaccauccccaaccaccagcccggcaagccccugcuggggaugaagauccucgacgugggcugcggcgggggccugcugaccgagccgcucgggcgccugggcgccuccgugaucggcaucgaccccgucgacgagaacaucaagacggcccagugccacaagagcuucgaccccgugcuggacaagcggaucgaguaccgcgugugcucccucgaggagaucgucgaggagaccgccgagaccuucgacgccgugguggcgagcgaggucguggagcacgugaucgaccuggagaccuuccugcagugcugcugccagguccucaagcccgggggcucccuguucaucacgaccaucaacaagacccagcugagcuacgcccucgggaucguguucuccgagcagaucgccagcaucgugccgaagggcacccacacgugggagaaguucgucagccccgagacccuggaguccauccuggagagcaacgggcucuccgugcagaccguggucggcaugcuguacaaccccuucagcggcuacuggcacugguccgagaacaccagccugaacuacgccgccuacgcggugaagucccggguccaggagcaccccgccagcgccgaguucgugcucaagggggagacggaggagcugcaggccaacgccugcaccaacccggcggugcacgagaagcugaagaaguga

SEQ ID NO: 28580 - RNA, 798 nt, Artificial Sequence
  derived and/or modified sequence opt1 from COQ4__Homo_sapiens__NP_057119
auggccacccugcuccgccccgugcugcggcgccugugcggccuccccgggcugcagcggcccgccgcggagaugccccugcgcgcccggagcgacggcgccgggccccucuacucccaccaccucccgaccagcccccugcagaaggcccugcuggccgcgggcuccgccgccauggcccuguacaaccccuaccgccacgacauggucgcggugcucggggagacgaccggccaccggacccugaaggugcugcgcgaccagaugcggcgcgaccccgagggcgcccagauccuccaggagcggccgcgcaucagcaccuccacgcuggaccuggggaagcuccagagccugcccgagggcucccuggggcgggaguaccuccgcuuccuggacgucaaccgggugagccccgacacccgcgcccccacccgguucguggacgacgaggagcuggccuacgucauccagcgcuaccgggaggugcacgacaugcuccacacccugcugggcaugccgacgaacauccucggggagaucguggucaagugguucgaggccgugcagaccggccugcccaugugcauccugggcgcguucuucgggcccauccgccucggcgcccagucccuccaggugcuggucagcgagcugauccccugggccgugcagaacgggcggcgcgccccgugcgugcugaaccuguacuacgagcgccggugggagcagucccuccgcgcccugcgggaggagcugggcaucaccgcgccgcccaugcacguccagggccucgccuga

SEQ ID NO: 28581 - RNA, 984 nt, Artificial Sequence
  derived and/or modified sequence opt1 from COQ5__Homo_sapiens__NP_115690
auggccgcccccggcagcugcgcgcugugguccuacugcgggcgcggcuggagccgggccaugcgcgggugccagcuccugggccugcgguccagcuggccgggggaccuccuguccgcccgccugcucagccaggagaagcgggccgccgagacccacuucggcuucgagaccguguccgaggaggagaagggcgggaaggucuaccagguguucgagagcguggcgaagaaguacgacgucaugaacgacaugaugucccugggcauccaccgcguguggaaggaccugcuccuguggaagaugcacccccugcccgggacgcagcuccuggacguggccggcgggaccggcgacaucgccuuccgguuccugaacuacguccagagccagcaccagcgcaagcagaagcggcagcuccgcgcccagcagaaccuguccugggaggagaucgcgaaggaguaccagaacgaggaggacagccugggcgggucccgggugguggucugcgacaucaacaaggagaugcucaaggugggcaagcagaaggcccuggcccagggguaccgcgccggccuggccugggugcucggcgacgcggaggagcugcccuucgacgacgacaaguucgacaucuacaccaucgccuucgggauccggaacgucacccacaucgaccaggcccugcaggaggcccaccgcgugcucaagccgggcgggcgguuccugugccuggaguucagccaggugaacaacccccucaucucccgccuguacgaccuguacagcuuccaggucauccccgugcucggcgaggugaucgccggggacuggaaguccuaccaguaccuggucgagagcauccggcgcuuccccucccaggaggaguucaaggacaugaucgaggacgcgggcuuccacaaggugacguacgagagccugaccagcggcaucguggccauccacuccggguucaagcucuga

SEQ ID NO: 28582 - RNA, 1407 nt, Artificial Sequence
  derived and/or modified sequence opt1 from COQ6__Homo_sapiens__NP_872282
auggccgcccgccuggugagccggugcggcgcgguccgcgccgcgccccacuccgggccgcucgugagcuggcggcgcugguccggcgccagcaccgacaccguguacgacgucgugguguccgggggcgggcuggucggcgccgccauggccugcgcccugggcuacgacauccacuuccacgacaagaagauccuccugcuggaggccgggcccaagaaggugcucgagaagcugagcgagacguacuccaaccgggugagcuccaucagccccggcuccgcgacccugcucagcuccuucggggccugggaccacaucugcaacaugcgcuaccgggccuuccgccggaugcaggucugggacgccugcagcgaggcccugaucauguucgacaaggacaaccuggacgacaugggcuacaucguggagaacgacgugaucaugcacgcgcucaccaagcagcuggaggccgucuccgaccgcgugaccgugcuguaccggagcaaggccauccgcuacacguggcccugcccguuccccauggccgacuccagccccuggguccacaucacccucggggacggcuccaccuuccagaccaagcugcugaucggcgccgacgggcacaacagcggcgugcggcaggcgguggggauccagaacgucagcuggaacuacgaccaguccgccgugguggccacgcuccaccugagcgaggccaccgagaacaacgucgccuggcagcgcuuccugcccuccggcccgaucgcgcuccugccccugagcgacacccucuccagccuggugugguccaccagccacgagcacgccgccgagcugguguccauggacgaggagaaguucgucgacgccgugaacagcgccuucugguccgacgcggaccacacggacuucaucgacaccgccggcgccaugcuccaguacgccgucagccugcugaagcccaccaagguguccgcgcggcagcucccgcccagcguggcccgcgucgacgccaagucccgggugcuguucccccuggggcucggccacgccgccgaguacgugcgcccccgggucgcgcugaucggggacgccgcccaccgcgugcacccccuggccggccagggggugaacaugggcuucggcgacaucagcucccucgcccaccaccugagcaccgcggccuucaacgggaaggaccugggcuccgucagccaccucacgggguacgagaccgagcggcagcgccacaacaccgcccugcuggccgccaccgaccuccugaagcgccuguacagcacguccgcgagcccgcucgugcugcugcggaccuggggccuccaggccaccaacgccgugagcccccugaaggagcagaucauggccuucgcguccaaguga

SEQ ID NO: 28583 - RNA, 540 nt, Artificial Sequence
  derived and/or modified sequence opt1 from COQ7__Homo_sapiens__NP_001177912
augacccuggacaacaucagccgcgccgccguggaccggaucauccgcgucgaccacgcgggcgaguacggggccaaccggaucuacgccggccagauggccgugcucgggcgcaccuccgugggccccgucauccagaagaugugggaccaggagaaggaccaccugaagaaguucaacgagcugauggugacguuccgggugcgcccgaccguccucaugccccuguggaacgugcugggguucgcccucggcgcgggcaccgcccugcuggggaaggagggcgccauggccugcaccguggcggucgaggagagcaucgcccaccacuacaacaaccagauccggacgcucauggaggaggaccccgagaaguacgaggagcugcugcagcucaucaagaaguuccgcgacgaggagcuggagcaccacgacaucgggcuggaccacgacgccgagcucgcccccgccuacgcggugcugaaguccaucauccaggccggcugccggguggccaucuaccugagcgagcgccucuga

SEQ ID NO: 28584 - RNA, 957 nt, Artificial Sequence
  derived and/or modified sequence opt1 from COQ9__Homo_sapiens__NP_064708
auggccgccgcggccgugagcggcgcccuggggcgcgccggcuggcggcuccugcagcugcgcugccuccccgucgcccggugccgccaggcgcuggugccgcgggccuuccacgccuccgccguggggcugcgcagcuccgacgagcagaagcagcagccgcccaacagcuucucccagcagcacagcgagacccagggcgcggagaagcccgaccccgaguccagccacuccccgccccgguacaccgaccagggcggggaggaggaggaggacuacgagagcgaggagcagcuccagcaccgcauccugacggccgcccuggaguucguccccgcccacggcuggaccgccgaggcgaucgccgagggggcccagucccucggccugagcuccgccgccgcgagcauguucgggaaggacggcuccgagcugauccuccacuucgugacccagugcaacacccggcugacgcgcgugcuggaggaggagcagaagcucguccagcuggggcaggccgagaagcggaagaccgaccaguuccugcgcgacgccguggagacccggcuccgcaugcugauccccuacaucgagcacuggccccgggcccugagcauccucaugcugccccacaacauccccuccagccugucccuccugaccagcaugguggacgacauguggcacuacgccggcgaccagagcacggacuucaacugguacacccgccgggcgaugcuggccgccaucuacaacaccaccgagcucgucaugaugcaggacuccagcccggacuucgaggacacguggcgcuuccuggagaaccgggugaacgacgccaugaacaugggccacaccgccaagcaggucaaguccaccggggaggcgcuggugcagggccucaugggggccgccgugacccugaagaaccugacgggccucaaccagcgccgguga

SEQ ID NO: 28585 - RNA, 3129 nt, Artificial Sequence
  derived and/or modified sequence opt1 from CORIN__Homo_sapiens__NP_006578
augaagcagagccccgcccuggccccggaggagcgcugccggcgcgcgggcucccccaagcccgugcuccgggccgacgacaacaacauggggaacggcugcagccagaagcuggccaccgccaaccugcuccgcuuccugcugcucguccugauccccugcaucugcgcccuggugcuccugcuggugauccuccuguccuacgucgggacccugcagaagguguacuucaagagcaacggcuccgagccgcucgugacggacggggagauccagggcagcgacgucauccugaccaacaccaucuacaaccaguccaccguggugagcacggcgcaccccgaccagcacguccccgccuggaccaccgacgccucccugcccggcgaccagagccaccggaacaccuccgccugcaugaacaucacgcacagccagugccagaugcucccguaccacgcgacccugaccccgcugcucuccguggugcgcaacauggagauggagaaguuccugaaguucuucaccuaccugcaccggcucagcugcuaccagcacaucaugcuguucgggugcacgcuggccuuccccgagugcaucaucgacggcgacgacucccacgggcuccugcccugccgcagcuucugcgaggccgccaaggagggcugcgaguccguccuggggauggugaacuacagcuggccggacuuccuccggugcucccaguuccgcaaccagaccgagagcagcaacgugucccggaucugcuucagcccccagcaggagaacggcaagcagcugcugugcggccgcggggagaacuuccucugcgccuccggcaucugcauccccgggaagcugcagugcaacggcuacaacgacugcgacgacuggagcgacgaggcgcacugcaacugcuccgagaaccuguuccacugccacaccggcaagugccucaacuacagccuggucugcgacggguacgacgacugcggcgaccuguccgacgagcagaacugcgacugcaaccccaccacggagcaccggugcggggacggccgcugcaucgccauggagugggugugcgacggggaccacgacugcguggacaagagcgacgaggucaacugcuccugccacagccagggccucguggagugccggaacggccagugcaucccguccaccuuccagugcgacggggacgaggacugcaaggacggcagcgacgaggagaacugcuccgugauccagaccagcugccaggagggggaccagcgcugccuguacaaccccugccuggacuccugcggcgggagcucccucugcgaccccaacaacagccugaacaacugcucccagugcgagcccaucacccuggagcucugcaugaaccugccguacaacagcacgagcuaccccaacuacuucggccaccggacccagaaggaggccuccaucagcugggaguccagccuguuccccgcccucguccagaccaacugcuacaaguaccugauguucuucuccugcaccauccuggugcccaagugcgacgugaacacgggcgagcacaucccgcccugccgcgcccugugcgagcacagcaaggagcggugcgaguccguccucgggaucgugggccugcaguggcccgaggacaccgacugcagccaguuccccgaggagaacuccgacaaccagaccugccugaugccggacgaguacgucgaggagugcagccccucccacuucaagugccgcagcgggcagugcgugcucgcgucccggcgcugcgacggccaggccgacugcgacgacgacagcgacgaggagaacugcgggugcaaggagcgcgaccugugggagugccccuccaacaagcagugccugaagcacaccgugaucugcgacggcuucccggacugccccgacuacauggacgagaagaacugcagcuucugccaggacgacgagcucgagugcgccaaccacgccugcgucucccgggaccuguggugcgacggcgaggccgacugcagcgacagcuccgacgagugggacugcgugacgcugagcaucaacgugaacuccagcuccuuccucaugguccaccgcgcggccaccgagcaccacgugugcgccgacggguggcaggagauccugagccagcuggccugcaagcagaugggccucggggagcccuccgugaccaagcugauccaggagcaggagaaggagccccgguggcugacccuccacagcaacugggagucccugaacggcacgacccugcacgagcuccuggucaacggccagagcugcgagucccgcagcaagaucucccugcucugcaccaagcaggacugcgggcggcgcccggccgcgcggaugaacaagcgcauccugggcgggcggaccagccgccccggccgguggcccuggcagugcucccugcagagcgagcccuccgggcacaucugcggcugcgugcucaucgccaagaagugggugcugacggucgcccacugcuucgagggccgcgagaacgccgcgguguggaaggugguccuggggaucaacaaccucgaccacccgagcguguucaugcagacccgguucgugaagaccaucauccugcacccccgcuacucccgggccgucguggacuacgacaucagcaucguggagcugagcgaggacaucuccgagaccggcuacguccgccccgugugccuccccaacccggagcaguggcuggagcccgacaccuacugcuacaucacgggguggggccacauggggaacaagaugcccuucaagcugcaggagggcgaggugcggaucaucagccucgagcacugccaguccuacuucgacaugaagaccaucaccacccgcaugaucugcgccggcuacgagagcgggacggucgacuccugcaugggcgacagcgggggcccccuggugugcgagaagcccgggggccgguggacccuguucggccucaccuccugggggagcgugugcuucuccaagguccugggccccgggguguacagcaacguguccuacuucgucgaguggaucaagcgccagaucuacauccagaccuuccugcucaacuga

SEQ ID NO: 28586 - RNA, 1386 nt, Artificial Sequence
  derived and/or modified sequence opt1 from CORO1A__Homo_sapiens__XP_011544016
augagccgccaggugguccgguccagcaaguuccgccacguguucggccagcccgccaaggccgaccagugcuacgaggacgugcgggucucccagaccaccugggacagcggguucugcgcggugaacccgaaguucguggcccugaucugcgaggccuccggcgggggcgccuuccucguccugccccuggggaagacgggccgcguggacaagaacgcccccaccgugugcggccacaccgcgcccguccucgacaucgccuggugcccgcacaacgacaacgugaucgccagcggguccgaggacugcaccgugauggucugggagauccccgacggcgggcugaugcugccccuccgggagcccguggugacgcuggagggccacaccaagcgcgucgggaucguggccuggcacaccaccgcgcagaacgugcugcucagcgccggcugcgacaacgucaucauggugugggacgugggcacgggggccgccaugcugacccugggcccggagguccaccccgacaccaucuacuccguggacuggagccgggacgggggccucaucugcaccuccugccgcgacaagcgggugcgcaucaucgagccccggaagggcacggucguggccgagaaggaccgcccccacgaggggacccggccgguccgcgcgguguucgugagcgagggcaagauccugaccaccggguucucccggaugagcgagcgccaggucgcccugugggacacgaagcaccucgaggagccccugucccugcaggagcucgacaccagcuccggcgugcugcugcccuucuucgaccccgacaccaacaucguguaccucugcgggaagggcgacagcuccauccgguacuucgagaucaccagcgaggccccguuccugcacuaccugagcauguucuccagcaaggagucccagcgcggcaugggguacaugcccaagcggggccucgaggucaacaagugcgagaucgcccgcuucuacaagcugcacgagcggcgcugcgagcccaucgccaugacggugccccgcaagagcgaccuguuccaggaggaccucuacccgcccaccgcggggcccgaccccgcccugaccgccgaggaguggcugggcgggcgggacgccggcccgcuccugaucucccugaaggacggcuacgugccgcccaagagccgcgagcuccgggucaaccgcgggcuggacaccggccggcgccgggccgcgcccgaggccuccgggacgcccagcuccgacgccgugagccgccuggaggaggagaugcggaagcuccaggccaccgugcaggagcugcagaagcgccuggaccggcucgaggagaccguccaggccaaguga

SEQ ID NO: 28587 - RNA, 1470 nt, Artificial Sequence
  derived and/or modified sequence opt1 from CORO1B__Homo_sapiens__NP_001018080
augagcuuccgcaaggugguccggcaguccaaguuccgccacguguucggccagcccgugaagaacgaccagugcuacgaggacauccgggucagccgcgugaccugggacuccaccuucugcgccgugaacccgaaguuccuggccgucaucguggaggcgagcgggggcggggccuuccucgugcugccccuguccaagacgggccggaucgacaaggccuaccccaccgucugcgggcacaccggccccgugcucgacaucgacuggugcccgcacaacgacgaggugaucgccagcggcuccgaggacugcaccgucaugguguggcagauccccgagaacgggcugacgagcccccugaccgagcccguggucgugcucgagggccacaccaagcgcguggggaucaucgccuggcacccgaccgcgcggaacguccugcuguccgccggcugcgacaacguggugcucaucuggaacgucgggacggccgaggagcuguaccgccuggacagccuccaccccgaccugaucuacaacguguccuggaaccacaacggcagccuguucugcuccgccugcaaggacaagagcgugcggaucaucgacccccgccggggcacccucgucgcggagcgcgagaaggcccacgagggggcccggcccaugcgcgccaucuuccuggccgacggcaagguguucaccaccggguucucccggaugagcgagcgccagcuggcgcucugggacccggagaaccuggaggagcccauggcccugcaggagcucgacuccagcaacggcgcccugcugcccuucuacgaccccgacacguccgucguguacgugugcggcaagggggacagcagcauccgguacuucgagaucaccgaggagccgcccuacauccacuuccucaacaccuucaccuccaaggagccccagcgcggcauggggagcaugcccaagcggggccuggaggucuccaagugcgagaucgcccgcuucuacaagcugcacgagcggaagugcgagccgaucgugaugacggugccccgcaagagcgaccucuuccaggacgaccuguaccccgacaccgccgggcccgaggcggcccuggaggccgaggagugggucuccggccgcgacgccgacccgauccucaucagccugcgggaggccuacgugcccuccaagcagcgcgaccugaagaucagccggcgcaacgugcucuccgacagccggcccgcgauggcccccggcuccagccaccugggggccccggccuccaccaccacggccgcggacgccacccccagcggcucccuggcccgcgccggggaggcgggcaagcucgaggaggucaugcaggagcugcgggcccugcgcgcccucgugaaggagcagggggaccggaucugccgccuggaggagcagcugggccggauggagaacggcgacgccuga

SEQ ID NO: 28588 - RNA, 1584 nt, Artificial Sequence
  derived and/or modified sequence opt1 from CORO1C__Homo_sapiens__NP_001098707
auguacggccccgggagccagcugggcaaguccgggaacaacagcugggccaaggagcgcggcugcuccaucgccugccaggggagccucaccuccgcgcggcugcacgccccgagcaucggcgagcgcccccugucccacaugcgguggaaggacaccaugcgccgggugguccgccagagcaaguuccggcacguguucggccaggccgugaagaacgaccagugcuacgacgacauccgcgucucccgggugacgugggacagcuccuucugcgccgugaacccccgcuucgucgccaucaucaucgaggcgagcgggggcggggccuuccucgugcugccccugcacaagaccggccggaucgacaaguccuacccgaccgugugcgggcacaccggccccguccucgacaucgacuggugcccccacaacgaccaggugaucgccagcggcuccgaggacugcacggugauggucuggcagauccccgagaacgggcugacccugagccucaccgagccgguggugauccuggagggccacuccaagcgcgucgggaucguggccuggcaccccaccgcgcggaacgugcugcucagcgccggcugcgacaacgccaucaucaucuggaacgucggcacgggggaggcccugaucaaccuggacgacaugcacuccgacaugaucuacaacgugagcuggaaccgcaacggcagccucaucugcaccgccuccaaggacaagaaggugcgggucaucgacccccgcaagcaggagaucguggcggagaaggagaaggcccacgagggggcccggcccaugcgcgccaucuuccuggccgacggcaacguguucaccaccggguucagccggauguccgagcgccagcuggcgcucuggaacccgaagaacaugcaggagcccaucgcccugcacgagauggacacgagcaacggcguccugcuccccuucuacgaccccgacaccuccaucaucuaccugugcggcaagggggacagcuccauccgguacuucgagaucaccgacgagagcccguacgugcacuaccugaacaccuucuccagcaaggagccccagcgcggcaugggguacaugcccaagcgcggccucgacgucaacaagugcgagaucgcccgguucuucaagcugcacgagcgcaagugcgagcccaucaucaugacggugccgcggaaguccgaccuguuccaggacgaccucuaccccgacaccgccgggcccgaggccgcgcuggaggccgaggagugguucgagggcaagaacgccgaccccauccugaucagccucaagcacggcuacaucccggggaagaaccgcgaccugaagguggucaagaagaacauccuggacuccaagcccaccgccaacaagaagugcgaccucaucagcauccccaagaagaccacggacaccgccuccgugcagaacgaggcgaagcuggacgagauccugaaggagaucaagagcaucaaggacaccaucugcaaccaggacgagcggaucuccaagcucgagcagcagauggccaagaucgccgccuga

SEQ ID NO: 28589 - RNA, 1578 nt, Artificial Sequence
  derived and/or modified sequence opt1 from CORO2A__Homo_sapiens__XP_011517288
augagcuggcacccccaguaccgcuccagcaaguuccggcacguguucggcaagcccgccuccaaggagaacugcuacgacagcguccccaucacccgcuccgugcacgacaaccacuucugcgccgugaacccccacuucaucgcggucgugaccgagugcgccgggggcggggccuuccuggugaucccccuccaccagacgggcaagcuggacccgcacuaccccaaggucugcgggcaccggggcaacgugcuggacgugaaguggaaccccuucgacgacuucgagaucgccagcugcuccgaggacgccaccaucaagaucuggagcauccccaagcagcuccugacccgcaaccugaccgcguaccggaaggagcucgucggccacgcccgccggguggggcugguggaguggcacccgacggccgccaacauccuguucuccgcgggcuacgacuacaaggucaugaucuggaaccucgacaccaaggagagcgugaucaccucccccaugagcaccaucuccugccaccaggacgugauccugagcauguccuucaacacgaacgggagccugcucgccacgaccugcaaggaccgcaagauccgggucaucgacccccgcgccggcaccgugcugcaggaggccuccuacaaggggcaccgggccagcaaggugcuguuccucggcaaccugaagaagcugauguccaccggcaccagccgcuggaacaaccggcaggucgcgcucugggaccaggacaaccugagcgugccccugauggaggaggaccucgacggguccagcggcgugcuguucccguucuacgacgccgacaccuccaugcuguacgucguggggaagggcgacggcaacauccgcuacuacgaggugagcgccgacaagccccaccucuccuaccugaccgaguaccggagcuacaacccccagaaggggaucggcgucaugcccaagcgcgggcuggacguguccagcugcgagaucuuccgguucuacaagcucaucacgaccaagucccugaucgagccgaucagcaugaucgucccccgccgguccgagagcuaccaggaggacaucuacccgcccaccgccggcgcccagcccucccugaccgcgcaggaguggcucagcgggaugaaccgcgaccccauccuggugucccugcggcccggcagcgagcuccugcgcccccacccgcugcccgccgagcgccccaucuucaacuccauggcccccgccagcccgcggcuccugaaccagacggagaagcuggccgcggaggacggcuggcgcuccagcagccuccuggaggagaagaugccccggugggccgccgagcaccgccuggaggagaagaagaccuggcucaccaacggguucgacguguucgagugcccgccgcccaagaccgagaacgagcugcugcagauguucuaccggcagcaggaggagauccgccggcuccgcgagcugcugacgcagcgggagguccaggccaagcagcucgagcuggagaucaagaaccugcgcaugggcuccgagcagcuguga

SEQ ID NO: 28590 - RNA, 1428 nt, Artificial Sequence
  derived and/or modified sequence opt1 from CORO2B__Homo_sapiens__NP_001177385
augagcuggcgcccccaguaccgguccagcaaguuccgcaacguguacggcaaggucgccaaccgggagcacugcuucgacgggaucccgaucaccaagaacgugcacgacaaccacuucugcgccgugaacacccgcuuccuggcgaucgucacggaguccgccggcgggggcagcuuccucgugaucccccuggagcagaccgggcggaucgagcccaacuaccccaaggugugcggccaccagggcaacguccuggacaucaaguggaacccguucaucgacaacaucaucgccuccugcagcgaggacaccuccgugcgcaucugggagauccccgagggcgggcucaagcggaacaugaccgaggcccugcuggagcuccacgggcacagccgccgggugggccuggucgaguggcaccccacgaccaacaacauccuguucuccgccggguacgacuacaaggugcucaucuggaaccuggacgugggcgagcccgucaagaugaucgacugccacaccgacgugauccugugcaugagcuucaacaccgacggcucccuccugacgacgaccugcaaggacaagaagcugcgcgugaucgagccgcggagcgggcgcguccuccaggaggcgaacugcaagaaccaccgggugaaccgcguggucuuccugggcaacaugaagcggcugcucaccaccggggugucccgcuggaacacccggcagaucgcccugugggaccaggaggaccugagcaugccccucaucgaggaggagaucgacggccuguccggccuccuguuccccuucuacgacgccgacacccacaugcuguaccuggccgggaagggcgacgggaacauccgcuacuacgagaucagcaccgagaagcccuaccucuccuaccugauggaguuccggagcccggcgccccagaagggccugggggugaugcccaagcacggccucgacgucuccgccugcgagguguuccgcuucuacaagcuggugacgcugaagggccucaucgagcccaucagcaugaucgucccgcggcgcagcgacuccuaccaggaggacaucuaccccaugacccccgggaccgagcccgcccugaccccggacgaguggcugggcgggaucaaccgcgaccccgugcucaugagccugaaggagggcuacaagaaguccagcaagauggucuucaaggcccccaucaaggagaagaaguccgugguggucaacgggaucgaccugcucgagaacgugcccccgcggacggagaacgagcugcugcgcauguucuuccggcagcaggacgagauccgccggcucaaggaggagcuggcccagaaggacauccgcauccggcagcugcagcucgagcugaagaaccugcgcaacagccccaagaacugcuga

SEQ ID NO: 28591 - RNA, 1419 nt, Artificial Sequence
  derived and/or modified sequence opt1 from CORO6__Homo_sapiens__NP_116243
augagccgccgggugguccgccaguccaaguuccggcacguguucggccaggccgccaaggcggaccaggccuacgaggacauccgcgugagcaaggucaccugggacuccagcuucugcgccgugaaccccaaguuccuggccaucaucguggaggccgggggcgggggcgcguucaucguccucccgcuggccaagaccgggcggguggacaagaacuacccccuggugacgggccacaccgcccccguccucgacaucgacuggugcccccacaacgacaacgugaucgccuccgcgagcgacgacaccaccaucaugguguggcagaucccggacuacacgcccaugcgcaacaucaccgagcccaucaucacccuggagggccacuccaagcgggucgggauccugagcuggcaccccaccgcccgcaacgugcuccuguccgccggcggggacaacgugaucaucaucuggaacgucggcacgggggaggugcugcucagccuggacgacaugcacccggacgugauccacuccgucugcuggaacagcaacggcucccugcucgccacgaccugcaaggacaagacccugcggaucaucgacccccgcaagggccaggugguggccgagcgguucgcggcccacgaggggaugcgccccaugcgggccgucuucacccgccagggccacaucuucaccaccggguucacccggaugagccagcgcgagcugggccucugggaccccaacaacuucgaggagccgguggcccugcaggagauggacacguccaacggcgugcugcuccccuucuacgaccccgacagcuccaucgucuaccugugcgggaagggcgacagcuccauccgguacuucgagaucaccgacgagcccccguucgugcacuaccugaacaccuucagcagcaaggagccccagcgcgggaugggcuucaugcccaagcgggggcucgacgucuccaagugcgagaucgcccgcuucuacaagcugcacgagcggaagugcgagcccaucaucaugaccgugccgcgcaagagcgaccuguuccaggacgaccucuaccccgacacgcccggccccgagccggcgcuggaggccgacgaguggcuguccggccaggacgccgagcccgugcucaucagccugcgcgacggguacgucccgcccaagcaccgggagcugcgcgugaccaagcggaacauccucgacgugcgcccgcccuccggcccccggcgcagccaguccgccagcgacgcgccccugucccagcagcacacccuggagacccuccuggaggagaucaaggcccugcgggagcgcguccaggcccaggagcagcggaucacggcccucgagaacaugcugugcgagcugguggacgggaccgacuga

SEQ ID NO: 28592 - RNA, 2523 nt, Artificial Sequence
  derived and/or modified sequence opt1 from CORO7__Homo_sapiens__NP_001188402
augaaccgcuuccgggugagcaaguuccgccacaccgaggcccggcccccgcgccgggaguccuggaucagcgacauccgcgccggcaccgcgcccuccugccggaaccacaucaagagcuccugcagccugaucgccuucaacuccgaccgccccgggguccucggcaucgugccccugcaggggcagggcgaggacaagcggcgcguggcccaccuggggugccacagcgagcucgccgcccacggcgaccugguccaguccgcgguguggagccgggacggcgcccugguggggacggccugcaaggacaagcagcuccgcaucuucgacccgcggaccaagccccgcgccucccagagcacccaggcgcacgagaacucccgggacagccgccuggccuggaugggcaccugggagcaccuggucuccacgggguucaaccagaugcgggagcgcgaggugaagcucugggacacccgguucuucagcuccgcccuggccagccugacccucgacaccucccugggcugccuggugccccuccuggaccccgacagcgggcugcucguccuggccggcaagggcgagcgccagcuguacugcuacgagguggugccgcagcagcccgcgcucagccccgucacgcagugcgugcuggaguccgugcugcgcggggccgcccucgucccccggcaggcccuggccgugaugagcugcgaggugcugcgcguccuccagcuguccgacaccgcgaucgugccgaucggcuaccacgugccccggaaggccgucgaguuccacgaggaccuguuccccgacaccgccgggugcgugcccgccaccgacccgcacagcuggugggccggcgacaaccagcagguccagaaggugucccucaaccccgcgugccgcccccaccccagcuucacguccugccuggugccgcccgccgagccccugcccgacaccgcccagccggccgucauggagacccccgugggcgacgccgacgcgagcgagggguucuccagcccgcccuccagccucaccucccccagcacgcccuccagccugggccccucccugagcuccaccagcgggaucggcaccagcccgucccuccggagccugcagucccugcucgggcccagcuccaaguuccgccacgcccagggcaccgugcugcaccgggacagccacaucacgaaccugaagggccucaaccugaccacccccggggaguccgacggcuucugcgccaacaagcugcgcgucgccgugccccuccugagcuccgggggccagguggcgguccuggagcuccggaagccggggcgccugcccgacaccgcccugcccacgcugcagaacggcgccgccgugaccgaccucgccugggaccccuucgacccgcaccggcuggcgguggccggcgaggacgcccgcauccggcuguggcgcguccccgccgaggggcucgaggaggugcugaccacccccgagacggugcugaccggccacaccgagaagaucugcagccuccgguuccacccccuggccgcgaacguccuggccuccagcuccuacgaccucaccgugcgcaucugggaccugcaggccggggccgaccggcugaagcuccagggccaccaggaccagaucuucagccuggccugguccccggacgggcagcagcuggcgacggugugcaaggacggccgcguccggguguaccgcccccggagcggccccgagccccuccaggaggggccgggccccaagggcgggcgcggcgcccgcaucgugugggucugcgacgggcggugccugcugguguccggcuucgacagccagagcgagcgccagcuccugcuguacgaggccgaggcccucgccgggggcccccuggcggugcuggggcucgacgucgcccccuccacccugcugccgagcuacgaccccgacaccggccucgugcugcugaccggcaagggggacacgcggguguuccucuacgagcugcugcccgagucccccuucuuccucgagugcaacagcuucaccuccccggacccccacaagggccugguccugcuccccaagaccgagugcgacgugcgcgagguggagcugaugcggugccugcgccuccggcagagcucccuggagccggucgccuuccgccugccccgggugcgcaaggaguucuuccaggacgacguguuccccgacaccgccgucaucugggagcccgugcucagcgcggaggccuggcugcagggggccaacggccagccguggcugcucucccugcagccgcccgacaugagccccgugucccaggcgccccgggaggcccccgcccgccgggcccccagcuccgcccaguaccuggaggagaaguccgaccagcagaagaaggaggagcuccugaacgccauggucgccaagcuggggaaccgcgaggacccccucccgcaggacagcuucgagggcguggacgaggacgagugggacuga

SEQ ID NO: 28593 - RNA, 3147 nt, Artificial Sequence
  derived and/or modified sequence opt1 from CORO7-PAM16__Homo_sapiens__NP_001188408
augaaccgcuuccgggugagcaaguuccgccacaccgaggcccggcccccgcgccgggaguccuggaucagcgacauccgcgccggcaccgcgcccuccugccggaaccacaucaagagcuccugcagccugaucgccuucaacuccgaccgccccgggguccucggcaucgugccccugcaggggcagggcgaggacaagcggcgcguggcccaccuggggugccacagcgaccucgucacggaccuggacuucuccccguucgacgacuuccugcucgccaccggcagcgccgaccggaccgugaagcuguggcgccugcccggccccgggcaggcgcuccccuccgccccgggcgugguccuggggcccgaggaccugcccguggaggugcuccaguuccaccccaccagcgacggcauccuggucuccgccgccgggacgaccgugaaggugugggacgcggccaagcagcagccgcugaccgagcucgccgcccacggcgaccugguccagagcgccguguggucccgggacggcgcgcugguggggaccgccugcaaggacaagcagcuccgcaucuucgacccccggacgaagccccgcgccagccaguccacccaggcccacgagaacagccgggacucccgccuggccuggaugggcaccugggagcaccuggucagcaccggguucaaccagaugcgggagcgcgaggugaagcucugggacacgcgguucuucagcuccgcgcuggccagccugacccucgacaccucccugggcugccuggugccccuccuggacccggacagcggccugcucguccuggccgggaagggcgagcgccagcuguacugcuacgagguggugccccagcagcccgcccucucccccgucacccagugcgugcuggagagcgugcugcgcggggccgcgcucgucccgcggcaggcccuggccgugauguccugcgagguccugcgcgugcuccagcugagcgacacggccaucgugcccaucggcuaccacgucccccggaaggccguggaguuccacgaggaccuguuccccgacaccgcggggugcgugccggccaccgacccccacuccuggugggccggcgacaaccagcagguccagaaggugagccucaaccccgccugccgcccccacccguccuucaccagcugccuggugccgcccgcggagccccugcccgacacggcccagcccgccgucauggagacccccgugggcgacgccgacgccuccgagggguucagcuccccgcccagcucccucaccagccccuccacccccagcagccugggcccgucccugagcuccacgagcgggaucggcaccucccccagccuccggucccugcagagccugcuggggcccuccagcaaguuccgccacgcgcagggcaccgugcuccaccgggacucccacaucaccaaccugaagggccugaaccucacgacccccggggagagcgacggcuucugcgccaacaagcugcgcgucgccgugccgcugcucuccagcgggggccagguggccguccuggagcugcggaagcccgggcgccuccccgacaccgcccugcccacccugcagaacggcgcggccgugacggaccucgccugggacccguucgacccccaccggcuggccguggccggcgaggacgcgcgcauccggcuguggcgcguccccgccgaggggcucgaggaggugcugaccacccccgagaccgugcugacgggccacaccgagaagaucugcucccuccgguuccacccgcuggccgccaacguccuggcgagcuccagcuacgaccucaccgugcgcaucugggaccugcaggccggggccgaccggcugaagcuccagggccaccaggaccagaucuucagccuggccuggucccccgacggccagcagcuggccaccgugugcaaggacgggcgcguccggguguaccgcccccgcagcggccccgagccgcuccaggaggggcccggccccaagggcgggcggggcgcgcgcaucgugugggucugcgacgggcggugccugcugguguccggcuucgacagccaguccgagcgccagcuccugcuguacgaggccgaggcccucgccgggggcccgcuggccgugcuggggcucgacgucgcgcccagcacccugcugcccuccuacgaccccgacacgggccucgugcugcugaccggcaagggggacacccggguguuccucuacgagcugcugccggagagccccuucuuccucgagugcaacuccuucaccagccccgacccccacaagggccugguccugcucccgaagacggagugcgacgugcgcgagguggagcugaugcggugccugcgccuccggcaguccagccuggagcccgucgccuuccgccugccccgggugcgcaaggaguucuuccaggacgacguguuccccgacaccgccgucaucugggagccggugcucuccgccgaggccuggcugcagggggcgaacggccagcccuggcugcucagccugcagccgcccgacaugucccccgugagccaggcgccccgggaggcccccgcccgccgggcccccuccagcgcccaguaccuggaggagaaguccgaccagcagaagaaggaggagcuccugaacgccauggucgccaagcuggggaaccgcgaggacccgcucccccaggacagcuucgagggcguggacgaggacgagugggccaaguaccuggcgcagaucaucgugaugggcguccaggugguggggcgggccuucgcccgcgcccugcggcaggaguucgccgcgagccgcgccgccgccgacgcccggggccgcgcggggcaccgcuccgccgccgccagcaaccucuccggccugagccugcaggaggcccagcagauccucaacgucuccaagcugagccccgaggaggugcagaagaacuacgagcaccuguucaaggugaacgacaaguccgucgggggcagcuucuaccuccaguccaaggugguccgggcgaaggagcgccuggacgaggagcugaagauccaggcccaggaggaccgggagaagggccagaugccccacaccuga

SEQ ID NO: 28594 - RNA, 429 nt, Artificial Sequence
  derived and/or modified sequence opt1 from COTL1__Homo_sapiens__NP_066972
auggccaccaagaucgacaaggaggccugccgcgcggccuacaaccuggugcgggacgacggcagcgccgucaucugggugaccuucaaguacgacggguccacgaucgugcccggcgagcagggggccgaguaccagcacuucauccagcagugcaccgacgacguccgccucuucgccuucgugcgguucaccaccggcgacgcgaugagcaagcgcuccaaguucgcccugaucacguggaucggggagaacgugagcggccugcagcgggccaagaccggcaccgacaagacccucgucaaggagguggugcagaacuucgccaaggaguucgucaucuccgaccgcaaggagcuggaggaggacuucaucaagagcgagcugaagaaggccgggggcgcgaacuacgacgcccagacggaguga

SEQ ID NO: 28595 - RNA, 720 nt, Artificial Sequence
  derived and/or modified sequence opt1 from COX10__Homo_sapiens__XP_005256515
auggccgccagcccccacacccuguccagccgccuccugaccggcugcgucgggggcuccgugugguaccuggagcggcgcacgauccaggacagcccgcacaaguuccuccaccuccugcggaacgugaacaagcaguggaucaccuuccagcacuucuccuuccugaagcgcauguacgugacccagcugaaccggagccacaaccagcagguccgccccaagcccgagcccguggcguccccguuccuggagaagaccagcuccgggcaggccaaggccgagaucuacgagaugcggccccucagcccgcccucccugagccugucccgcaagcccaacgagaaggagcucaucgagcuggagcccgacagcgugaucgaggacuccaucgacgucggcaaggagacgaaggaggagaagcgguggaaggagaugaagcuccagguguacgaccugcccgggauccuggcccgccugagcaagaucaagcucaccgcccugguggucuccaccaccgcggccggcuucgcccuggcccccggcccguucgacuggcccugcuuccuccugacgagcguggggaccggccuggcguccugcgccgccaacagcaucaaccaguucuucgaggugcccuucgacagcaacaugaaccggaccaagaaccgcccccucguccgggggcagauccgccaguccuucuucagcuccuucuga

SEQ ID NO: 28596 - RNA, 693 nt, Artificial Sequence
  derived and/or modified sequence opt1 from COX11__Homo_sapiens__NP_001156333
augggcgggcuguggcgccccggcuggcggugcgugccguucugcggguggcgcuggauccaccccggcagccccacccgggccgccgagcgcgucgagcccuuccuccggccggagugguccgggaccggcggcgcggagcgcgggcugcgguggcugggcacguggaagcgcugcagccuccgggcccgccaccccgcccugcagccgccccggcgccccaaguccagcaaccccuucacccgggcccaggaggaggagcgccggcgccagaacaagaccacccugacguacguggccgcgguggccgucgggaugcucggcgccuccuacgccgcggugccccuguaccggcuguacugccagaccaccgggcucggcggcagcgccguggccgggcacgccuccgacaagaucgagaacaugguccccgugaaggaccgcaucaucaagaucagcuucaacgccgacgugcacgcgucccugcaguggaacuuccggccgcagcagaccgagaucuacgucgugcccggcgagacggcccuggccuucuaccgcgccaagaaccccaccgacaagcccgugaucgggaucagcaccuacaacaucgucccguucgaggccggccaguacuucaacaagauccaggugcucuccagccggcugcaguccugcaccgagagcacguucuga

SEQ ID NO: 28597 - RNA, 174 nt, Artificial Sequence
  derived and/or modified sequence opt1 from COX14__Homo_sapiens__NP_001244062
augcccaccggcaagcagcuggccgacaucggguacaagaccuucagcacguccaugaugcuccugaccguguacggcggguaccugugcagcguccgcguguaccacuacuuccaguggcggcgcgcccagcggcaggcggccgaggagcagaagaccuccggcaucauguga

SEQ ID NO: 28598 - RNA, 1167 nt, Artificial Sequence
  derived and/or modified sequence opt1 from COX15__Homo_sapiens__NP_004367
augcagcgccuccuguucccgccccugcgggcccugaagggccgccaguaccucccccugcuggcgccccgggccgcgccccgcgcccagugcgacugcauccggcgcccgcuccggcccgggcaguacagcaccaucuccgagguggcccugcagagcggccgcgggaccgucucccugcccagcaaggccgccgagcggguggugggccgcuggcuccuggucugcuccgggacgguggccggcgccgugauccugggcggggucacccggcucaccgagagcggccuguccaugguggacuggcaccugaucaaggagaugaagcccccgaccagccaggaggagugggaggccgaguuccagcgcuaccagcaguuccccgaguucaagauccucaaccacgacaugacgcugaccgaguucaaguucaucugguacauggaguacucccaccggaugugggggcgccuggugggccucgucuacauccugcccgcggccuacuucuggcggaagggguggcugagccgcggcaugaagggccgggugcucgcccugugcgggcuggugugcuuccagggccuccuggggugguacauggucaaguccggccuggaggagaaguccgacagccacgacaucccccgcgugagccaguaccggcucgccgcccaccugggcuccgcgcuggugcucuacugcgccagccuguggaccucccugagccuccugcugccgccccacaagcuccccgagacccaccagcugcugcagcuccgccgguucgcccacgggacggccggccuggucuuccugaccgcccucuccggggcguucguggccggccuggacgccgggcugguguacaacagcuuccccaagaugggcgagagcuggaucccggaggaccucuucaccuucucccccauccugcgcaacgucuucgagaaccccaccauggugcaguucgaccaccgcauccugggcaucacgagcgugaccgccaucaccguccucuacuuccugucccggcgcaucccccugccgcggcgcaccaagauggccgcggugacgcugcucgcccuggccuacacccaggggcccgugcuguucaacuucaccuucaagaucagcgaccucgacgagggcauccggaacaucuga

SEQ ID NO: 28599 - RNA, 321 nt, Artificial Sequence
  derived and/or modified sequence opt1 from COX16__Homo_sapiens__NP_057552
auguucgcccccgccgugaugcgcgcguuccggaagaacaagacccugggcuacggggugccgaugcuccugcugaucgugggcgggagcuucggccuccgcgaguucucccagauccgguacgacgccgucaagagcaagauggaccccgagcuggagaagaagcugaaggagaacaagaucucccucgagagcgaguacgagaagaucaaggacuccaaguucgacgacuggaagaacauccgcgggccccggcccugggaggacccggaccugcugcagggccgcaaccccgagagccucaagaccaagacgaccuga

SEQ ID NO: 28600 - RNA, 192 nt, Artificial Sequence
  derived and/or modified sequence opt1 from COX17__Homo_sapiens__NP_005685
augcccggccugguggacagcaacccggccccgcccgagucccaggagaagaagccccucaagcccugcugcgccugccccgagaccaagaaggcgcgcgacgccugcaucaucgagaagggggaggagcacugcggccaccugaucgaggcccacaaggagugcaugcgggcccugggguucaagaucuga

SEQ ID NO: 28601 - RNA, 1005 nt, Artificial Sequence
  derived and/or modified sequence opt1 from COX18__Homo_sapiens__NP_001284661
augcugugccgccucggcgggcgguggcugcgcccccugccggcccuccagcugugggcccgggaccugccccucgcgcccgugcccaccagcggcgccaagcgcccgacccugcccgucugggccguggcccccguguccgccguccacgcgaacgggugguacgaggcccuggccgccagcucccccgugcggguggcggaggagguccuccugggcgugcacgccgccacggggcugccgugguggggcagcauccuccuguccaccguggcccugcgcggcgccgucacccucccccuggcggccuaccagcacuacauccuggccaagguggagaaccuccagcccgagaucaagaccaucgcccggcaccugaaccaggagguggccguccgcgcgaaccagcugggguggagcaagcgggacgcccgccucacguaccugaagaacaugcggcgccugaucuccgagcucuacgugcgggacaacugccaccccuucaaggccaccgugcuggucuggauccagcugccgauguggaucuucaugagcuucgcccuccgcaaccuguccaccggcgccgcgcacagcgaggccggguucuccgugcaggagcagcuggccaccggcgggauccucugguuccccgaccugacggcccccgacagcaccuggauccugcccaucuccgugggcgucaucaaccuccugaucguggagaucugcgcccugcagaagaucggcaugagccgguuccagaccuacaucaccuacuucgugcgcgcgauguccguccucaugaucccgaucgccgccacggugcccagcuccaucgugcuguacuggcugugcagcuccuucgucgggcucagccagaaccugcugcuccggagccccggcuuccgccagcugugccggauccccuccaccaagagcgacuccgagaccccguacaaggacaucuucgccgcguucaacaccaaguucaucagccgcaaguga

SEQ ID NO: 28602 - RNA, 273 nt, Artificial Sequence
  derived and/or modified sequence opt1 from COX19__Homo_sapiens__NP_001026788
augagcaccgccaugaacuucgggaccaaguccuuccagccccgcccgcccgacaaggggagcuucccccuggaccaccucggcgagugcaaguccuucaaggagaaguucaugaagugccugcacaacaacaacuucgagaacgcccugugccggaaggagagcaaggaguaccucgagugccgcauggagcggaagcugaugcugcaggagccccucgagaagcugggguucggcgaccugacguccggcaagagcgaggcgaagaaguga

SEQ ID NO: 28603 - RNA, 510 nt, Artificial Sequence
  derived and/or modified sequence opt1 from COX4I1__Homo_sapiens__NP_001852
augcuggccacccgcguguucagccucgucggcaagcgggccaucuccaccagcgugugcgugcgcgcgcacgaguccgucgucaagagcgaggacuucucccugcccgccuacauggaccggcgcgaccacccgcugcccgagguggcccacgugaagcaccucagcgccucccagaaggcccugaaggagaaggagaaggcgagcugguccagccuguccauggacgagaagguggagcucuaccggaucaaguucaaggagagcuucgccgagaugaaccgcggguccaacgaguggaagacgguggucggcggggccauguucuucaucggcuucaccgcccuggugaucauguggcagaagcacuacguguacgggccccugccccagagcuucgacaaggagugggucgcgaagcagaccaagcggaugcucgacaugaaggugaacccgauccagggccuggccuccaagugggacuacgagaagaacgaguggaagaaguga

SEQ ID NO: 28604 - RNA, 516 nt, Artificial Sequence
  derived and/or modified sequence opt1 from COX4I2__Homo_sapiens__NP_115998
augcugccccgcgccgccuggagccucgugcugcggaagggcgggggcgggcgccggggcaugcacuccagcgaggggaccacccgcggcggcgggaagauguccccguacacgaacugcuacgcgcagcgguacuaccccaugcccgaggagcccuucugcaccgagcugaacgccgaggagcaggcccucaaggagaaggagaagggcagcuggacccagcugacccacgccgagaaggucgcccuguaccgccuccaguucaacgagacguucgcggagaugaaccggcgcuccaacgaguggaagaccgugauggggugcguguucuucuucaucggcuucgccgcccuggucaucugguggcagcggguguacguguucccgcccaagcccaucacccugaccgacgagcgcaaggcccagcagcuccagcggaugcuggacaugaaggucaaccccgugcaggggcuggcgagccgcugggacuacgagaagaagcaguggaagaaguga

SEQ ID NO: 28605 - RNA, 453 nt, Artificial Sequence
  derived and/or modified sequence opt1 from COX5A__Homo_sapiens__NP_004246
augcugggcgccgcccuccgccggugcgcgguggccgccaccacccgcgccgacccccgggggcugcugcacagcgcccgcacgccgggccccgcggucgccauccaguccgugcggugcuacagccacgggucccaggagaccgacgaggaguucgacgcccgcugggugaccuacuucaacaagcccgacaucgacgccugggagcuccggaagggcaucaacacccuggucacguacgacauggugcccgagccgaagaucaucgacgcggcccugcgcgccugccggcgccucaacgacuucgccagcaccgugcggauccuggaggucgugaaggacaaggccgggccccacaaggagaucuaccccuacgugauccaggagcugcgccccacccucaacgagcugggcaucuccaccccggaggagcugggccucgacaaggucuga

SEQ ID NO: 28606 - RNA, 390 nt, Artificial Sequence
  derived and/or modified sequence opt1 from COX5B__Homo_sapiens__NP_001853
auggccagccgccugcuccggggcgccgggacccuggcggcccaggcccugcgcgcccggggccccuccggggccgcggccaugcgcagcauggccuccggcgggggcgugccgaccgacgaggagcaggccacgggccucgagcgggagaucaugcuggcggccaagaaggggcuggaccccuacaacguccucgcccccaagggcgccagcgggacccgcgaggaccccaaccuggugccguccaucagcaacaagcggaucgugggcugcaucugcgaggaggacaacaccuccgucgugugguucuggcugcacaagggggaggcccagcgcugcccccggugcggcgcgcacuacaagcucgugccccagcagcuggcccacuga

SEQ ID NO: 28607 - RNA, 330 nt, Artificial Sequence
  derived and/or modified sequence opt1 from COX6A1__Homo_sapiens__NP_004364
auggccguggucggcgugagcagcgugagccgccugcucgggcggucccgcccccagcugggccggccgaugagcuccggggcccacggcgaggaggggagcgcgcgcauguggaagacccugaccuucuucgucgcccuccccggcguggccguguccaugcugaacgucuaccugaagucccaccacggcgagcacgagcggcccgaguucaucgccuacccccaccuccgcauccggacgaagccguuccccuggggcgacgggaaccacacccuguuccacaacccccacgugaacccccugccgaccggguacgaggacgaguga

SEQ ID NO: 28608 - RNA, 294 nt, Artificial Sequence
  derived and/or modified sequence opt1 from COX6A2__Homo_sapiens__NP_005196
auggcccugccccuccgcccgcugacccggggccuggccagcgcggccaagggcgggcacgggggcgccggggcccgcaccuggcggcuccugacguucgugcuggcccuccccuccgucgcgcugugcaccuucaacagcuaccugcacuccggccaccgcccccggcccgaguuccgcccguaccagcaccuccggauccgcaccaagcccuaccccuggggcgacgggaaccacacccuguuccacaacagccacgugaacccccugccgacgggcuacgagcaccccuga

SEQ ID NO: 28609 - RNA, 261 nt, Artificial Sequence
  derived and/or modified sequence opt1 from COX6B1__Homo_sapiens__NP_001854
auggccgaggacauggagaccaagaucaagaacuacaagaccgcccccuucgacagccgcuucccgaaccagaaccagacgcggaacugcuggcagaacuaccuggacuuccaccgcugccagaaggcgaugaccgccaagggcggggacaucuccgugugcgagugguaccagcgggucuaccagagccucugccccaccuccugggugaccgacugggacgagcagcgcgccgagggcacguuccccgggaagaucuga

SEQ ID NO: 28610 - RNA, 228 nt, Artificial Sequence
  derived and/or modified sequence opt1 from COX6C__Homo_sapiens__NP_004365
auggcccccgaggugcugccgaagccccgcaugcggggccuccuggcccgccggcugcgcaaccacauggcggucgccuucgugcucagccuggggguggccgcccuguacaaguuccgggucgccgaccagcgcaagaaggcguacgccgacuucuaccggaacuacgacgugaugaaggacuucgaggagaugcgcaaggccggcaucuuccaguccgugaaguga

SEQ ID NO: 28611 - RNA, 240 nt, Artificial Sequence
  derived and/or modified sequence opt1 from COX7A1__Homo_sapiens__NP_001855
augcaggcccugcgcgugagccaggcccucauccgguccuucagcuccaccgcgcgcaaccgguuccagaaccgcguccgggagaagcagaagcuguuccaggaggacaacgacaucccccuguaccucaagggcgggaucguggacaacauccuguaccgcgugaccaugacgcugugccucggcgggaccgucuacagccuguacucccugggcugggccagcuucccgcggaacuga

SEQ ID NO: 28612 - RNA, 348 nt, Artificial Sequence
  derived and/or modified sequence opt1 from COX7A2__Homo_sapiens__XP_011533748
augcacacccaggacagcgagguggugcccgugccggccuggcccuucucccugguggucuucagcugcggcgggugcugguccgugaccgccaagaugcuccgcaaccugcuggcgcuccggcagaucggccagcgcacgaucagcaccgccucccggcgccacuucaagaacaaggugcccgagaagcagaagcuguuccaggaggacgacgagaucccccuguaccucaagggcggggucgccgacgcccugcuguaccgggccaccaugauccucaccgucgggggcacggcguacgccaucuacgagcuggccguggccagcuucccgaagaagcaggaguga

SEQ ID NO: 28613 - RNA, 345 nt, Artificial Sequence
  derived and/or modified sequence opt1 from COX7A2L__Homo_sapiens__NP_001305965
auguacuacaaguucagcggcuucacccagaagcuggccggggccugggcguccgaggccuacagcccccagggccucaagccgguggucuccaccgaggccccgcccaucaucuucgccacgcccaccaagcugaccagcgacuccaccguguacgacuacgccgggaagaacaaggugcccgagcugcagaaguucuuccagaaggcggacggcguccccguguaccucaagcgcgggcugcccgaccagaugcuguaccggacgaccauggcccucaccgugggcggcaccaucuacugccugaucgcccuguacauggccagccagcccaagaacaaguga

SEQ ID NO: 28614 - RNA, 246 nt, Artificial Sequence
  derived and/or modified sequence opt1 from COX7B2__Homo_sapiens__XP_005248113
augauguucccccuggcccgcaacgcccucagcucccugaagauccagagcauccugcaguccauggcgcggcacagccacgugaagcacuccccggacuuccacgacaaguacggcaacgccguccucgccagcgggaccgccuucugcguggccaccuggguguucacggcgacccagaucggcaucgaguggaaccugucccccgucgggcgcgugacccccaaggaguggaagcaccaguga

SEQ ID NO: 28615 - RNA, 243 nt, Artificial Sequence
  derived and/or modified sequence opt1 from COX7B__Homo_sapiens__NP_001857
auguucccccuggugaaguccgcccucaaccgccugcagguccggagcauccagcagaccauggcccgccagagccaccagaagcggaccccggacuuccacgacaaguacggcaacgcggugcuggccuccggggccacguucugcaucgugaccuggaccuacgucgccacccaggugggcaucgaguggaaccucagccccguggggcgcgucacgcccaaggaguggcggaaccaguga

SEQ ID NO: 28616 - RNA, 192 nt, Artificial Sequence
  derived and/or modified sequence opt1 from COX7C__Homo_sapiens__NP_001858
augcugggccagagcauccgccgguucaccaccuccgugguccgccggagccacuacgaggaggggcccggcaagaaccucccguucuccguggagaacaaguggagccugcuggccaagaugugccucuacuucggguccgccuucgcgacgcccuuccuggugguccgccaccagcugcucaagaccuga

SEQ ID NO: 28617 - RNA, 210 nt, Artificial Sequence
  derived and/or modified sequence opt1 from COX8A__Homo_sapiens__NP_004065
augagcgugcugacgccccuccugcugcgcggccucaccggguccgcccggcgccugccggucccccgggccaagauccacagccugccgcccgagggcaagcucgggaucauggagcuggcggugggccugaccuccugcuucgugaccuuccuccugcccgccggguggauccugagccaccucgagaccuaccgccggcccgaguga

SEQ ID NO: 28618 - RNA, 1260 nt, Artificial Sequence
  derived and/or modified sequence opt1 from CPA1__Homo_sapiens__NP_001859
augcgcggccugcucgugcugagcguccugcucggggccguguucggcaaggaggacuucguggggcaccagguccugcggaucuccguggccgacgaggcccaggugcagaaggucaaggagcuggaggaccucgagcaccuccagcuggacuucuggcgcggccccgcgcacccggggagccccaucgacgugcgggugcccuuccccuccauccaggccgucaagaucuuccuggagagccacggcaucuccuacgagaccaugaucgaggacgugcagagccugcuggacgaggagcaggagcagauguucgccuuccgcucccgggcccgcagcaccgacacguucaacuacgcgaccuaccacacccucgaggagaucuacgacuuccuggaccugcucguggccgagaacccgcaccuggucuccaagauccagaucggcaacaccuacgaggggcggcccaucuacgugcugaaguucagcacgggcggguccaagcgccccgccaucuggaucgacaccggcauccacagccgggagugggugacccaggccuccggggucugguucgcgaagaagaucacccaggacuacggccaggacgccgccuucacggccauccucgacacccuggacaucuuccuggagaucgugaccaaccccgacggcuucgccuucacccacagcacgaaccgcauguggcggaagacccgcucccacaccgcggggagccucugcaucggcguggacccgaaccggaacugggacgccggguucggccuguccggcgccagcuccaaccccugcagcgagaccuaccacgggaaguucgccaacagcgaggucgaggugaaguccaucguggacuucgucaaggaccacggcaacaucaaggccuucaucagcauccacuccuacagccagcugcucauguaccccuacggguacaagacggagcccgugccggaccaggacgagcuggaccagcuguccaaggcggccgugaccgcccucgccagccuguacggcaccaaguucaacuacggguccaucaucaaggccaucuaccaggcgagcggcuccaccaucgacuggacguacagccagggcaucaaguacuccuucaccuucgagcugcgcgacaccgggcgguacggcuuccuccugcccgccagccagaucauccccaccgccaaggagacguggcuggcccuccugaccaucauggagcacacccugaaccaccccuacuga

SEQ ID NO: 28619 - RNA, 1260 nt, Artificial Sequence
  derived and/or modified sequence opt1 from CPA2__Homo_sapiens__NP_001860
auggccaugcgccugauccucuucuucggcgcccuguucgggcacaucuacugccuggagaccuucgugggcgaccagguccucgagaucgugcccagcaacgaggagcagaucaagaaccugcugcagcucgaggcgcaggagcaccuccagcuggacuucuggaaguccccgaccacgcccggggagaccgcccacgugcggguccccuucgugaacgugcaggccgucaagguguuccucgagagccagggcaucgccuacuccaucaugaucgaggacgugcagguccugcuggacaaggagaacgaggagaugcuguucaaccgccggcgcgagcggagcgggaacuucaacuucggcgccuaccacacccuggaggagaucucccaggagauggacaaccugguggcggagcaccccggccucgugagcaaggucaacaucggguccagcuucgagaaccgcccgaugaacgugcugaaguucuccaccggcggggacaagcccgccaucuggcuggacgccggcauccacgcccgggagugggugacgcaggcgaccgcccucuggaccgccaacaagaucgucagcgacuacgggaaggaccccuccaucaccagcauccuggacgcccuggacaucuuccuccugcccgugacgaacccggacggcuacguguucucccagaccaagaaccgcauguggcggaagacccgcagcaaggucuccggcagccugugcguggggguggaccccaaccggaacugggacgccggcuucgggggccccggcgcguccagcaaccccugcuccgacagcuaccacgggccgagcgccaacuccgaggucgaggucaagagcaucguggacuucaucaagucccacggcaaggugaaggccuucaucacccuccacagcuacucccagcugcugauguuccccuacggguacaagugcacgaagcucgacgacuucgacgagcugagcgagguggcccagaaggccgcgcagucccugcgcagccuccacggcaccaaguacaaggucgggcccaucugcuccgugaucuaccaggccagcggcggcuccaucgacuggagcuacgacuacgggaucaaguacuccuucgccuucgagcugcgggacaccggccgcuacggguuccugcuccccgcccggcagauccugccgaccgccgaggagacguggcugggccucaaggcgaucauggagcacgugcgcgaccaccccuacuga

SEQ ID NO: 28620 - RNA, 1254 nt, Artificial Sequence
  derived and/or modified sequence opt1 from CPA3__Homo_sapiens__NP_001861
augcgccugauccuccccgugggccugaucgccaccacccuggccaucgcgccgguccgguucgaccgcgagaagguguuccgggugaagccccaggacgagaagcaggccgacaucaucaaggaccucgccaagacgaacgagcuggacuucugguaccccggggccacccaccacgucgccgcgaacaugaugguggacuuccgcgugagcgagaaggagucccaggccauccagagcgcccuggaccagaacaagaugcacuacgagauccucauccacgaccugcaggaggagaucgagaagcaguucgacgucaaggaggacauccccggccggcacuccuacgccaaguacaacaacugggagaagaucguggcguggaccgagaagaugauggacaaguacccggagauggugagccgcaucaagaucggguccaccgucgaggacaacccccuguacgugcucaagaucggcgagaagaacgagcggcgcaaggccaucuucacggacugcgggauccacgcccgggagugggugagccccgccuucugccagugguucgucuaccaggccaccaagaccuacggccgcaacaagaucaugaccaagcugcuggaccggaugaacuucuacauccuccccguguucaacguggacggcuacaucugguccuggacgaagaaccgcauguggcggaagaaccgcagcaagaaccagaacuccaagugcaucgggaccgaccugaaccggaacuucaacgcgagcuggaacuccaucccgaacaccaacgaccccugcgccgacaacuaccgcggcagcgcccccgaguccgagaaggagaccaaggccgucacgaacuucauccggagccaccugaacgagaucaagguguacaucaccuuccacuccuacagccagaugcuccuguuccccuacggguacaccuccaagcugccgcccaaccacgaggaccucgccaagguggcgaagaucggcaccgacguccugagcacgcgcuacgagacccgguacaucuacgggcccaucgaguccaccaucuaccccaucagcggcagcucccuggacugggccuacgaccucggcaucaagcacaccuucgccuucgagcugcgcgacaaggggaaguucggcuuccugcucccggagagccggaucaagcccacgugccgcgagaccaugcuggccgugaaguucaucgccaaguacauccugaagcacaccuccuga

SEQ ID NO: 28621 - RNA, 1167 nt, Artificial Sequence
  derived and/or modified sequence opt1 from CPA4__Homo_sapiens__NP_001156918
augcgcuggauccuguucaucggcgcccucaucgggagcuccaucugcggccaggagaaguucuucggggaccaggugcugcggaucaacguccgcaacggcgacgagaucagcaagcugucccagcucgugaacagcaacaaccugaagcugaacuucuggaagucccccagcuccuucaaccggccgguggacguccucgugcccagcgugucccugcaggccuucaagagcuuccugcgcucccaggggcucgaguacgcggucaccaucgaggaccugcagaucuaccacgagauggacaacaucgccgccgacuuccccgaccuggcccggcgcgugaagaucggccacagcuucgagaaccggcccauguacgugcucaaguucuccaccggcaaggggguccgccggccggccguguggcugaacgcgggcauccacagccgcgaguggaucucccaggccacggccaucuggaccgcccggaagaucgugagcgacuaccagcgcgaccccgcgaucaccuccauccuggagaagauggacaucuuccuccugcccgucgccaaccccgacggguacguguacacccagacgcagaaccggcuguggcgcaagacccggagccgcaacccgggcuccagcugcaucggggccgaccccaaccggaacuggaacgccagcuucgccggcaagggcgcguccgacaaccccugcagcgagguguaccacgggccccacgccaacuccgaggucgaggucaagagcgugguggacuucauccagaagcacggcaacuucaagggguucaucgaccuccacuccuacagccagcugcugauguacccguacggcuacuccgugaagaaggcccccgacgccgaggagcucgacaagguggcccgccuggcggccaaggcccuggccagcgucuccggcaccgaguaccagguggggccgaccugcacgaccguguaccccgccagcggcuccagcaucgacugggcguacgacaacgggaucaaguucgccuucaccuucgagcuccgggacaccggcacguacggguuccugcugcccgccaaccagaucauccccaccgccgaggagaccuggcucggccugaagaccaucauggagcacguccgcgacaaccuguacuga

SEQ ID NO: 28622 - RNA, 1314 nt, Artificial Sequence
  derived and/or modified sequence opt1 from CPA6__Homo_sapiens__NP_065094
augaagugccugggcaagcgccgggggcaggccgccgcguuccucccccugugcuggcuguuccucaagauccugcagccgggccacagccaccuguacaacaaccgcuacgccggggacaaggugauccgguucauccccaagaccgaggaggaggccuacgcccucaagaagaucuccuaccagcugaaggucgaccuguggcagcccagcuccaucagcuacguguccgagggcaccgugacggacguccacaucccccagaacgggagccgcgcccuccuggcguuccugcaggaggccaacauccaguacaaggugcucaucgaggaccugcagaagacccuggagaagggcuccagccuccacacccagcggaaccgccggucccugagcggcuacaacuacgagguguaccacucccuggaggagauccagaacuggaugcaccaccucaacaagacccacagcgggcugauccacauguucuccaucggccgcagcuacgaggggcggucccuguucauccucaagcugggccgccggagccgccugaagcgggccgucuggaucgacugcgggauccacgcccgcgaguggaucggcccggcguucugccagugguucgugaaggaggcccuccugacguacaaguccgaccccgccaugcggaagaugcugaaccaccucuacuucuacaucaugcccguguucaacgucgacggcuaccacuucagcuggaccaacgaccgcuucuggcggaagacccgcucccggaacagccgcuuccggugccgcgggguggacgccaaccgcaacuggaaggugaaguggugcgacgagggcgccagcaugcaccccugcgacgacaccuacugcgggccguuccccgaguccgagcccgaggucaaggcgguggccaacuuccugcggaagcaccgcaagcacauccgggccuaccugagcuuccacgccuacgcccagaugcuccuguaccccuacuccuacaaguacgcgacgaucccgaacuuccgcugcguggagagcgccgccuacaaggccgucaacgcccugcaguccguguacggcgugcgguaccgcuacggccccgcgagcaccacccucuacgucuccagcggguccagcauggacugggccuacaagaacggcauccccuacgccuucgccuucgagcugcgggacaccggguacuucggcuuccugcuccccgagaugcugaucaagccgacgugcaccgagaccaugcuggccgugaagaacaucaccaugcaccuccugaagaagugccccuga

SEQ ID NO: 28623 - RNA, 5799 nt, Artificial Sequence
  derived and/or modified sequence opt1 from CPAMD8__Homo_sapiens__NP_056507
auggcccccggcgcccugcgcgggggcugcgagcagcgggcccccgggggcggggcccgcaccgccgcccucgggcccuggcccuggcccucccccggccccgcccccucccccggggcggccccgccccggagccgcaagauguccggcgcccugcuguggccccuccugccccugcuccugcugcuccugagcgcccgggacggggugcgcgccgcccagccgcaggcccccggcuaccugaucgccgcccccuccguguuccgggccgggguggaggaggugaucagcgucaccaucuucaacagcccccgggaggugaccgugcaggcccagcucgucgcccagggcgagccgguggugcagagccagggcgccauccuggacaaggggaccaucaagcugaagguccccaccggccuccgggggcaggcccugcugaagguguggggccgcggcuggcaggcggaggaggggccccucuuccacaaccagaccuccgugaccgucgacggccgcggggccagcguguucauccagaccgacaagcccguguaccgcccgcagcaccggguccugaucuccaucuucaccgugagccccaaccugcgccccgugaacgagaagcucgaggccuacauccuggacccccggggcucccgcaugaucgaguggcggcaccugaagccguucugcugcgggaucaccaacaugagcuucccccucuccgaccagcccguccugggcgagugguucaucuucguggagaugcagggccacgccuacaacaagagcuucgaggugcagaaguacguccugcccaaguucgagcuccugaucgacccgccccgcuacauccaggaccuggacgccugcgagacggggaccgugcgggcgcgcuacaccuucggcaagcccguggccggggcccucaugaucaacaugaccgucaacggcgugggguacuacucccacgaggucggccggccggugcugcgcacgaccaagauccugggcagccgcgacuucgacaucugcgugcgggacaugauccccgccgacguccccgagcacuuccgcgggcggguguccaucugggccauggugaccagcgucgacggcagccagcaggucgcguucgacgacuccacccccgugcagcgccagcucgucgacauccgguacagcaaggacacgcgcaagcaguucaagccggggcuggccuacgugggcaagguggagcuguccuaccccgacgggagccccgccgagggcgucaccgugcagaucaaggccgagcucacccccaaggacaacaucuacaccuccgagguggucagccagcggggccuggugggguucgagaucccguccauccccacgagcgcgcagcacguguggcuggagaccaaggucauggcccucaacggcaagcccgugggggcccaguaccugcccuccuaccugagccucggcuccugguacagcccgucccagugcuaccugcagcugcagccgcccagccacccccuccaggugggcgaggaggccuacuucuccgucaagagcacgugcccgugcaacuucacccuguacuacgagguggccgcgcgcgggaacaucgugcuguccggccagcagcccgcccacaccacccagcagcggagcaagcgcgccgcccccgcccucgagaagcccauccggcugacccaccuguccgagaccgagccgccgcccgcgcccgaggccgaggucgacgugugcgugacgagccugcaccucgccgucaccccgagcauggugccccuggggcgccugcucguguucuacguccgggagaacggcgaggggguggccgacucccugcaguucgccguggagaccuucuucgagaaccaggucagcgugaccuacuccgcgaacgagacgcagcccggcgagguggucgaccugcgcauccgggccgcccgcggcagcugcgugugcguggccgcggucgacaaguccguguaccuccugcggagcggguuccgccugaccccggcccagguguuccaggagcucgaggacuacgacgucuccgacagcuucggcgugucccgggaggacgggcccuucuggugggccggccugaccgcccagcgccgccggcgcagcuccguguuccccuggcccugggggaucaccaaggacagcggcuucgccuucacggagaccggccuggucgugaugaccgaccgggugucccucaaccaccgccaggacgggggccuguacaccgacgaggcggucccggccuuccagccccacaccgggagccugguggccguggcccccucccggcacccgccccgcacggagaagcggaagcgcaccuucuuccccgagaccuggaucuggcacugccucaacaucagcgaccccuccggcgaggggacccugagcgucaaggugcccgacagcaucacguccugggucggcgaggccguggcgcugagcaccucccagggccucgggaucgccgagcccagccugcugaagaccuucaagcccuucuucguggacuucaugcuccccgcccugaucauccggggcgagcaggucaagaucccccuguccguguacaacuacauggggaccugcgccgagguguacaugaagcucagcgucccgaagggcauccaguucguggggcaccccggcaagcgccacgugacgaagaagaugugcgucgcccccggcgaggcggagcccaucuggguggugcuguccuucagcgaccuggggcucaacaacaucaccgccaaggcccuggccuacggcgacaccaacugcugccgggacgggcgcuccagcaagcacccggaggagaaccacgcggaccggcgcguccccaucggcguggaccacgugcggcgcuccgucaugguggaggccgagggcgugccccgggccuacaccuacagcgccuucuucugccccuccgagcgcguccacaucagcacgccgaacaaguacgaguuccaguacgugcagcggccccugcgccucacccgguucgacguggccguccgcgcgcacaacgacgcccgcguggcccuguccagcgggccccaggacaccgccggcaugaucgagaucgugcucgggggccaccagaacacccgguccuggaucagcacguccaagaugggggagcccgucgccagcgcgcacaccgccaagauccucagcugggacgaguuccgcaccuucuggaucuccuggcggggcggccugauccagguggggcacggcccggagcccagcaacgaguccgugaucgucgccuggacccugccccgcccgcccgaggugcaguucaucggguucagcacgggcuggggguccaugggcgaguuccggaucuggcgcaagauggagguggacgagagcuacuccgaggccuucacccucggcgucccccacggggccauccccggcagcgagcgggcgaccgccuccaucaucggggacgugaugggcccgacccugaaccaccugaacaaccuccugcgccugcccuucgggugcggcgagcagaacaugauccacuucgcccccaacguguucguccucaaguaccugcagaagacgcagcagcugagccccgagguggagcgggagaccaccgacuaccucgugcagggcuaccagcgccagcugaccuacaagcggcaggacggguccuacagcgccuucggcgagcgcgacgccuccgggagcauguggcugacggcguucguccucaaguccuucgcccaggcccggagcuucaucuucguggacccgcgcgagcuggccgcggccaaguccuggaucauccagcagcagcaggccgacggcagcuuccuggccgugggccggguccucaacaaggacauccagggcggcauccacgggaccgugccccugaccgccuacguggucguggcgcugcucgagaccggcacggccuccgaggaggagcgcgggagcaccgacaaggcccggcacuuccuggagagcgccgcgccccuggcgauggaccccuacuccugcgcccucaccaccuacgcccugacgcugcuccgcagcccggccgcccccgaggcgcugcggaagcugcgcucccucgccaucaugcgcgacggcgugacccacuggagccuguccaacagcugggacgucgacaagggcaccuuccuguccuucagcgaccgggugucccagagcguggucuccgccgagguggagaugaccgccuacgcgcuccugaccuacacgcugcucggggacguggccgccgcccugcccgucgugaaguggcugagccagcagcgcaacgcccucggcggguucuccagcacccaggacacgugcgucgcgcugcaggcccuggccgaguacgccauccucuccuacgccggcgggaucaaccugaccgugagccuggcguccacgaaccucgacuaccaggagaccuucgagcugcaccggaccaaccagaaggugcugcagaccgccgccauccccagccucccgacgggccuguucgucuccgccaagggcgacgggugcugccugaugcagaucgacgugaccuacaacgugcccgaccccgucgccaagcccgcguuccagcuccuggugagccugcaggagccggaggcccagggccggcccccgcccaugcccgccagcgccgcggaggggucccgcggcgacuggccgcccgccgacgacgacgaccccgccgccgaccagcaccaccaggaguacaaggugaugcucgaggucugcacccgcuggcugcacgccgggagcuccaacauggcggugcuggaggugccgcuccugagcggcuuccgggccgacaucgagucccuggagcagcuccugcuggacaagcacaugggcaugaagcgcuacgaggucgccgggcggcgcgugcuguucuacuucgacgagauccccagccggugccugaccugcgugcgcuuccgggcccugcgcgagugcgucgugggccggacguccgcccugcccgugagcgucuacgacuacuacgagccggcguucgaggccacccgcuucuacaacguguccacccacagcccccucgcccgggagcugugcgccgggcccgccugcaacgagguggagcgcgcgcccgcccggggcccggggugguuccccggcgaguccggccccgccgucgcccccgaggagggggccgcgaucgcccgcugcggcugcgaccacgacugcggggcccagggcaacccggugugcggcagcgacgggguggucuacgccuccgcgugccggcugcgcgaggccgccugccgccaggccgcgccccucgagcccgcgcccccgagcugcugcgcccuggagcagcggcugcccgccuccagcuccagcaccuacggcgacgaccucgccuccguggcccccgggccccugcagcaggacgugaagcugaacggcgcggggcucgaggucgaggacagcgacccggagcccgagggcgaggccgaggaccgcgugacggccggcccccggcccccggugagcuccgggaaccuggagagcuccacccagagcgccucccccuuccaccgcuggggccagacccccgcgccccagcggcacagcgggcgcgucgugggcgcgcaccggccggggcugcucucccccguguucgucuacagccccgccuuccaguccggcggcgaggaggggcuguggaugagcaacacgugcacgcugcgcuga

SEQ ID NO: 28624 - RNA, 1254 nt, Artificial Sequence
  derived and/or modified sequence opt1 from CPB1__Homo_sapiens__NP_001862
augcuggcccuccuggugcuggucaccguggcccucgcgagcgcccaccacggcggggagcacuucgagggcgagaagguguuccgcgucaacguggaggacgagaaccacaucaacaucauccgggagcuggccuccaccacgcagaucgacuucuggaagcccgacagcgugacccagaucaagccgcacuccaccgucgacuuccgcgugaaggccgaggacaccgugacggucgagaacgugcugaagcagaacgagcuccaguacaaggugcugaucagcaaccugcggaacgucguggaggcccaguucgacucccgcgugcgggcgaccgggcacagcuacgagaaguacaacaagugggagaccaucgaggccuggacccagcaggucgccacggagaaccccgcccucaucucccgcagcgugaucggcaccaccuucgaggggcgggcgaucuaccugcugaaggugggcaaggccggccagaacaagcccgccaucuucauggacugcggguuccacgcccgcgaguggaucucccccgccuucugccagugguucguccgggaggcggugcgcaccuacggccgggagauccaggugacggagcuccuggacaagcuggacuucuacguccucccggugcugaacaucgacggguacaucuacaccuggaccaagagccgcuucuggcggaagacccgcuccacgcacaccggcagcuccugcaucgggaccgaccccaaccggaacuucgacgccggcuggugcgagaucggcgccagccgcaaccccugcgacgagaccuacugcgggcccgccgccgaguccgagaaggagacgaaggcgcuggccgacuucauccggaacaagcucagcuccaucaaggccuaccugaccauccacagcuacucccagaugaugaucuacccguacagcuacgccuacaagcugggcgagaacaacgccgagcucaacgcgcuggccaaggccaccgugaaggagcuggccagccuccacgggaccaaguacacguacggccccggcgccaccaccaucuaccccgcggccgggggcuccgacgacugggccuacgaccaggggauccgcuacagcuucaccuucgagcugcgggacacgggccgcuacggguuccugcuccccgagucccagauccgggcgaccugcgaggagaccuuccuggccaucaaguacgucgccagcuacgugcuggagcaccucuacuga

SEQ ID NO: 28625 - RNA, 1161 nt, Artificial Sequence
  derived and/or modified sequence opt1 from CPB2__Homo_sapiens__NP_001265470
augaagcugugcagccucgccgugcugguccccaucgugcuguucugcgagcagcacguguucgccuuccaguccggccagguccucgcggcccugccgcgcaccagccggcagguccaggugcugcagaaccucaccacgaccuacgagaucgugcuguggcagcccgugaccgccgaccugaucgugaagaagaagcagguccacuucuucgugaacgccuccgacguggacaacgucaaggcccaccucaacgugagcgggauccccugcuccgugcugcuggcggacgucgaggaccucauccagcagcagaucagcaacgacaccgugagcccccgcgccuccgccuccuacuacgagcaguaccacagccugaacgagaucuacuccuggaucgaguucaucacggagcggcacccggacaugcugaccaagauccacaucggcagcuccuucgagaaguacccccucuacgugcugaaggucagcgggaaggagcaggccgcgaagaacgccaucuggaucgacugcggcauccacgcccgcgaguggaucucccccgccuucugccugugguucaucgggcacaaccggauguggcgcaagaaccggagcuucuacgccaacaaccacugcaucggcaccgaccucaaccgcaacuucgcguccaagcacuggugcgaggagggcgccagcuccagcagcugcuccgagaccuacugcgggcuguaccccgagagcgagccggaggugaaggccguggccuccuuccugcggcgcaacaucaaccagaucaaggccuacaucagcaugcacuccuacagccagcacaucgucuuccccuacuccuacacgcggagcaaguccaaggaccacgaggagcucagccugguggcguccgaggccgugcgcgccaucgagaagaucagcaagaacacccgguacacccacggccacggguccgagacccuguaccucgcccccggcgggggcgacgacuggaucuacgaccugggcaucaaguacagcuucacgaucgagcugcgcgacaccgggaccuacggcuuccuccugcccgagcgguacaucaagccgaccugccgcgaggccuucgcggccgucuccaagaucgccuggcacgugauccggaacgucuga

SEQ ID NO: 28626 - RNA, 3402 nt, Artificial Sequence
  derived and/or modified sequence opt1 from CPD__Homo_sapiens__NP_001186704
augcgcuucgugcugagcggcaaccuccacgggggcuccgucguggccagcuaccccuucgacgacuccccggagcacaaggccaccgggaucuacagcaagaccuccgacgacgagguguucaaguaccuggcgaaggccuacgccagcaaccaccccaucaugaagacgggcgagccccacugccccggggacgaggacgagaccuucaaggacggcaucaccaacggcgcccacugguacgacgucgagggcgggaugcaggacuacaacuacgugugggccaacugcuucgagaucacccuggagcucuccugcugcaaguacccgcccgcgagccagcugcggcaggagugggagaacaaccgcgagucccugaucacgcucaucgagaaggugcacaucggggucaagggcuucgugaaggacagcaucaccggguccggccuggagaacgccaccaucagcguggccggcaucaaccacaacaucaccacggggcgguucggcgacuucuaccgccugcucguccccgggaccuacaaccugaccguggugcugaccggcuacaugccccucacggucaccaacgugguggucaaggagggcccggccaccgagguggacuucucccugcggcccaccgugacgagcgucauccccgacaccaccgaggcgguguccaccgccagcacgguggccauccccaacauccuguccgggaccagcuccagcuaccagccgauccagcccaaggacuuccaccaccaccacuuccccgacauggagaucuuccuccgccgguucgccaacgaguaccccaacaucacccgccuguacagccugggcaaguccgucgagagccgggagcucuacgugauggagaucuccgacaacccgggggugcacgagcccggcgagcccgaguucaaguacaucgggaacaugcacggcaacgaggucgugggccgcgagcugcugcucaaccugaucgaguaccugugcaagaacuucgggaccgaccccgaggucacggaccucgugcacaacacccggauccaccugaugccgagcaugaaccccgacggcuacgagaagucccaggagggggacagcaucuccgugaucggccgcaacaacagcaacaacuucgaccugaaccggaacuuccccgaccaguucguccagaucaccgaccccacccagccggagacgaucgccgugauguccuggaugaaguccuaccccuucgugcucagcgcgaaccugcacgggggcagccuggucgugaacuaccccuucgacgacgacgagcagggccucgccaccuacuccaagagccccgacgacgccguguuccagcagaucgcccuguccuacagcaaggagaacucccagauguuccaggggcgcccgugcaagaacauguaccccaacgaguacuucccccacggcaucaccaacggggccagcugguacaacgucccgggcgggaugcaggacuggaacuaccugcagaccaacugcuucgaggugacgaucgagcucggcugcgugaaguacccccuggagaaggagcugcccaacuucugggagcagaaccggcgcucccucauccaguucaugaagcagguccaccagggcgugcggggguucgugcuggacgcgaccgacggccgcgggauccugaacgccaccaucagcgucgccgagaucaaccaccccgugaccacguacaagaccggcgacuacuggcggcuccuggugccgggcaccuacaagaucaccgccagcgcccgcggguacaaccccgucaccaagaacgugacggugaaguccgagggcgcgauccaggucaacuucacccuggugcggagcuccaccgacagcaacaacgaguccaagaaggggaagggcgccagcuccagcaccaacgacgccuccgaccccacgaccaaggaguucgagacccucaucaaggaccugagcgccgagaacgggcuggagucccucaugcugcgcagcuccagcaaccuggcccucgcgcuguaccgcuaccacuccuacaaggaccugagcgaguuccugcggggccucgugaugaacuacccccacaucaccaaccugacgaaccugggccaguccaccgaguaccgccacaucuggagccucgagaucagcaacaagccgaacgucuccgagcccgaggagcccaagauccgguucguggccgggauccacggcaacgcccccguggggaccgagcugcugcucgcccuggcggaguuccugugccucaacuacaagaagaacccggccgucacccagcugguggaccgcacgcggaucgugaucguccccagccugaaccccgacggccgcgagcgggcccaggagaaggacugcaccuccaagaucgggcagaccaacgcccgcggcaaggaccucgacaccgacuucacgaacaacgccagccagcccgagaccaaggcgaucaucgagaaccugauccagaagcaggacuucucccugagcguggcccucgacggcggguccaugcuggugaccuacccguacgacaagcccguccagaccguggagaacaaggagacgcugaagcaccucgccagccuguacgccaacaaccaccccuccaugcacaugggccagcccagcugcccgaacaaguccgacgagaacauccccgggggcgugaugcgcggggccgaguggcacagccaccugggcuccaugaaggacuacagcgucaccuacggccacugccccgagaucaccguguacaccuccugcugcuacuuccccagcgcggcccggcucccgucccugugggccgacaacaagcggagccugcucuccaugcugguggagguccacaagggggugcacggcuucgugaaggacaagacggggaagcccaucagcaaggccgucaucgugcugaacgagggcaucaaggugcagaccaaggagggcggguacuuccacguccuccuggcccccggcgugcacaacaucaucgcgaucgccgacggguaccagcagcagcacagccagguguucguccaccacgacgccgccuccagcguggugaucgucuucgacaccgacaaccgcaucuucggccugccgcgggagcucguggucaccguguccggggcgacgaugagcgcccugauccugaccgccugcaucaucuggugcaucugcuccaucaagagcaaccgccacaaggacggcuuccaccggcuccgccagcaccacgacgaguacgaggacgagauccggaugauguccaccggcagcaagaagucccugcugagccacgaguuccaggacgagaccgacacggaggaggagacccucuacuccagcaagcacuga

SEQ ID NO: 28627 - RNA, 1476 nt, Artificial Sequence
  derived and/or modified sequence opt1 from CPEB1__Homo_sapiens__NP_001073001
augcuguuccccaccagcgcccaggaguccagccgcggccucccggacgccaacgaccugugccuggggcuccagucccugagccugaccggcugggaccggcccugguccacgcaggacagcgacuccagcgcgcaguccagcacccacuccgugcucagcaugcugcacaacccccuggggaacguccucggcaagcccccgcuguccuuccugccccucgacccccuggggagcgaccugguggacaaguuccccgccccguccgugcgcggcagccggcucgacacccgccccauccuggacucccggagcuccagccccagcgacuccgacaccagcggcuucuccagcggguccgaccaccugagcgaccucaucuccagccugcgcaucagcccgccccugcccuuccucagccuguccggcgggggcccccgggacccccugaagaugggggucggcagccgcauggaccaggagcaggccgcccucgccgcggugacgccgucccccaccagcgccuccaagcgguggcccggcgccagcguguggcccuccugggaccugcuggaggccccgaaggaccccuucagcaucgagcgcgaggcgcggcuccaccgccaggccgccgccgucaacgaggcgaccugcaccugguccgggcagcugccgccccggaacuacaagaaccccaucuacagcugcaagguguuccugggcggggugcccugggacaucacggaggccggccucgucaacaccuuccgcguguucggcagccuguccguggaguggcccgggaaggacggcaagcacccccggugcccgcccaaggggaacaugcccaagggcuacgucuaccugguguucgagcucgagaaguccgugcgcucccugcugcaggccugcagccacgacccgcucucccccgacgggcugagcgaguacuacuucaagauguccagccggcgcaugcggugcaaggagguccaggugauccccugggugcuggccgacuccaacuucguccgcagccccucccagcggcucgacccgagccgcaccguguucgugggcgcccugcacggcaugcugaacgccgaggcgcucgccgccauccugaacgaccuguucgggggcgucguguacgccgggaucgacaccgacaagcacaaguaccccaucggcuccgggcgcgugacguucaacaaccagcggagcuaccucaaggccgucuccgcggccuucguggagaucaagaccaccaaguucaccaagaagguccagaucgaccccuaccuggaggacagccugugccacaucugcuccagccagcccggcccguucuucugccgcgaccaggugugcuucaaguacuucugccggagcugcuggcacuggcgccacuccauggagggccuccggcaccacagcccccugaugcgcaaccagaagaaccgggacuccagcuga

SEQ ID NO: 28628 - RNA, 2055 nt, Artificial Sequence
  derived and/or modified sequence opt1 from CPEB3__Homo_sapiens__NP_001171608
augcaggacgaccugcucauggacaagagcaagacccagccccagccgcagcagcagcagcgccagcagcagcagccccagcccgaguccagcguguccgaggcccccagcaccccgcuguccagcgagacgcccaagcccgaggagaacuccgccguccccgcgcugagcccggccgccgccccccccgcccccaacggcccggacaagaugcagauggaguccccccuccugcccgggcugagcuuccaccagcccccgcagcagcccccccccccgcaggagcccgcggcccccggcgccucccucagccccuccuucgggagcaccugguccaccggcaccacgaacgccguggaggacagcuucuuccaggggaucaccccggugaacggcaccaugcuguuccagaacuucccccaccacgucaaccccguguucggcgggaccuucuccccccagaucggccuggcgcagacgcagcaccaccagcagccgccccccccggcccccgccccccagcccgcccagccggcccagcccccccaggcgcagcccccgcagcagcggcgcagccccgccucccccagccaggcccccuacgcccagcggagcgccgcggccgccuacgggcaccagccgaucaugaccuccaagcccagcuccagcuccgccguggccgcggccgccgccgccgcggccgccagcuccgccagcuccagcuggaacacccaccaguccgucaacgcggccuggagcgcccccuccaaccccuggggcgggcuccaggccggccgcgacccgcggcgcgccgugggcgugggggucggcgugggggugggcguccccagcccccugaaccccaucuccccgcugaagaagcccuucagcuccaacgugaucgcgccccccaaguucccgcgggccgccccccucaccagcaaguccuggauggaggacaacgccuuccgcacggacaacggcaacaaccugcugcccuuccaggaccggagccgcccguacgacaccuucaaccuccacagccuggagaacucccugauggacaugauccggaccgaccacgagccccucaaggggcgcaugggcaucaacuuccaccaccccgggaccgacaacaucauggcccugaacagccgguccagccuguuccccuucgaggacgcguuccucgacgacucccacggcgaccaggcccugagcuccgggcugagcuccccgacgcgcugccagaacggcgagcggguggagcgcuacagccggaaggucuucgugggcgggcucccccccgacaucgacgaggacgagaucaccgccuccuuccgccgguucggcccccugguggucgacuggccgcacaaggccgagagcaaguccuacuucccccccaagggguacgccuuccugcucuuccaggaggagagcuccgugcaggcgcugaucgacgccugccuggaggaggacggcaagcucuaccugugcgugagcucccccaccaucaaggacaagccgguccagauccgccccuggaaccugagcgacagcgacuucgugauggacgggucccagccccucgacccccggaagaccaucuucgugggcggcgucccgcgcccccugcgcgccguggagcuggccaugaucauggaccggcucuacgggggcgucugcuacgcggggaucgacacggaccccgagcugaaguaccccaagggcgccgggcgcguggccuucagcaaccagcaguccuacaucgccgccaucagcgcgcgguucgugcagcugcagcacaacgacaucgacaagcgcgucgaggugaagccguacgugcucgacgaccagaugugcgacgagugccagggcacccggugcggcgggaaguucgcccccuucuucugcgccaacgucaccugccugcaguacuacugcgaguacugcugggccuccauccacagccgcgccggccgggaguuccacaagccccuggugaaggaggggggcgaccgcccccggcacgugccguuccgcugguccuga

SEQ ID NO: 28629 - RNA, 2190 nt, Artificial Sequence
  derived and/or modified sequence opt1 from CPEB4__Homo_sapiens__NP_085130
augggcgacuacggguucggcgugcugguccagagcaacaccgggaacaaguccgccuuccccgugcgcuuccacccgcaccuccagccgccccaccaccaccagaacgccacccccagccccgcggccuucaucaacaacaacacggccgccaacggcuccagcgccggguccgcguggcuguuccccgcccccgccacccacaacauccaggacgagauccugggcagcgagaaggccaagucccagcagcaggagcagcaggacccccucgagaagcagcagcugagcccgucccccggccaggaggcggggauccugcccgagaccgagaaggccaagagcgaggagaaccagggcgacaacuccagcgagaacgggaacggcaaggagaagauccggaucgagucccccgugcucaccggguucgacuaccaggaggccacgggccugggcaccagcacccagccgcugaccuccagcgccuccagccucacgggguucuccaacuggagcgccgcgaucgcccccagcuccagcaccaucaucaacgaggacgccuccuucuuccaccagggcgggguccccgccgccagcgcgaacaacggcgcccugcuguuccagaacuucccccaccacguguccccgggcuucgggggcagcuucagcccccagaucgggccccucucccagcaccacccccaccacccgcacuuccagcaccaccacucccagcaccagcagcagcgccggagccccgccagcccccacccgccgcccuucacccaccgcaacgccgccuucaaccagcugccccaccuggcgaacaaccucaacaagccgcccucccccugguccagcuaccagucccccagccccacccccuccagcuccuggagccccggcgggggcggcuacgggggcuggggcgggagccaggggcgggaccaccgccggggccugaacggcgggaucacgccccugaacuccaucagcccgcucaagaagaacuucgccuccaaccacauccagcugcagaaguacgcccgccccagcuccgccuucgcccccaagagcuggauggaggacucccugaaccgggcggacaacaucuuccccuucccggaccgcccccggaccuucgacaugcacagccucgaguccagccugaucgacaucaugcgcgccgagaacgacaccaucaagggccggcugaacuacuccuaccccgggagcgacuccagccuccugaucaacgcccgcaccuacggccggcgccgggggcaguccagccuguuccccauggaggacggcuuccucgacgacggccgcggggaccagccgcugcacuccggccuggggagcccccacugcuucagccaccagaacggcgagcggguggagcgcuacucccggaaggucuucgugggcgggcucccgcccgacaucgacgaggacgagaucacggccagcuuccgccgcuucggcccccugaucguggacuggccccacaaggcggaguccaagagcuacuucccgcccaagggguacgccuuccuccuguuccaggacgaguccagcguccaggcccugaucgacgccugcaucgaggaggacggcaagcuguaccucugcguguccagccccaccaucaaggacaagcccgugcagauccggcccuggaaccuguccgacagcgacuucgucauggacgggucccagccccuggacccgcgcaagaccaucuucgugggcggcgugccccggccccuccgcgccgucgagcuggcgaugaucauggaccggcuguacgggggcgugugcuacgccgggaucgacaccgacccggagcucaaguaccccaagggcgccgggcgcguggccuucagcaaccagcaguccuacaucgccgcgaucagcgcccgguucguccagcugcagcacggcgagaucgacaagcgcguggaggugaagcccuacguccuggacgaccagcucugcgacgagugccagggcgcccggugcgggggcaaguucgcccccuucuucugcgccaacgugacgugccugcaguacuacugcgaguacugcugggcggccauccacucccgcgccgggcgggaguuccacaagccgcuggugaaggagggcggggaccgcccccggcacaucagcuuccgcuggaacuga

SEQ ID NO: 28630 - RNA, 2352 nt, Artificial Sequence
  derived and/or modified sequence opt1 from CPED1__Homo_sapiens__NP_001099003
auggugugccgccccgucuucccgugccggcgccgguucugcccccgccccuuccuggugggccucguggucgccaucugccuguucuaccagacccugacccuccgggggagccgcaagcugacggccgcggcccccggcgccgugccgcacaccuccaccgagacccaggccagccggugcaagaagggguucucccaggacaagcagugcuuccugcucagcggcaacgcccaggagacgcgcaaggugaaggaguccauggagacccacuucgggagccacggccggcgcgcgauccuguaccggccgcccuucuacuccaagaccgagcugcagcuccaccagcacauccugacccagcacggcuacacggucgugaucgccgaggagcgccugaacgccgggcucggccccgggcugcuggagcagggcgaccucgggagcugggaccugcugaucugccucuccagcaagaaggccgagggcacccccugcaucuccaaggaggugaugugccagcugggccugcaccagaaggcgaaccggcuccccgagauccagcagccccugugccgcaaggaggggcugugccagaucguccggcgcuuccccgagcuccagcugccggugagccccuccgugugccuggaccagggcaugcagcucaagcccagcaccuccagccaccuccugaagaccgucaagccccggguguggaagccgggggacuggucccgcgagcagcucaacgagacgaccgugcuggcgccccacgagaccaucuuccgggccgaggaccugagcgucauccucaaggccuacgugcuggugaccucccugacgccccuccgcgccuucauccacagcaccggcaccgucuggaacccgcccaagaagaagcgguucaccgugaagcugcagacguucuucgagaccuuccugcgcgccagcagcccccagcaggccuucgacaucaugaaggaggccaucggcaagcuccugcuggccgccgagguguucuccgagaccuccacccucgggcccaagacguuccaccgcugccgguucugcuuccagcugcugaccuucgacaucggcuacgggagcuucauguaccccgucgugcuccaggugcacgagcaccugaacuuccaggacuacgacaacauggacuucgaggaccagaacaccgaggaguuccugcucaacgacaccuucaacuuccuguucccgaacgaguccagccuguccaucuucagcgagaucuuccagcgccuguaccgguccgacgucuucaagggcgagaacuaccagaaggagcucaaccagugccugagccuggaggagaucaacuccaucaugacguucaucaaggagcucgggagccugggccaguuccagcugcuguuccccuccaccacccccggcauccagagccugaugcacgaguucuacgacguggcgaaccccgucgggaacccgggcuccgugcugacccaguacuggagccuccugaacguguucgagcaguuccaguucaugaacaagaagacgcagccccacccccuggaguggaacuccuucaccgaggacaagaacaucgagaagccgcagguccccuucgacgccaucgagaacaagaaggccgccgugccccagaucaagaacgagaacaaggagauccacugcagcgacgacgagaacacccccugccacaucaagcagaucuucacccacccgcaccucgagcugaaccccgacuuccaccccaagaucaaggacuacuacugcgaggugcccuucgacgucgugacggugaccaucggggucgagaccccgaagugccugugcaaggugcaccucuacgagcaggccggccccuccuucgcgagcuacccccuggggcugggcaugaacaagaucagcaucuucguggucgacgagucccccgcccacggcgagacccucaucaccuacaagcugacgaucuaccgcgaggaccggccgagccugccccucuucgaggccuucaccgccugcggguucgugcaggacugcggccugcugauccaccccgaggagaccugcgggcuccagcccaucuccagcgacuacaucgaggccauccugcaguccgagcugaagcgcugcccgagcggcgacaugaaggggcaguggaucgugcccugccucuccugcagcgacaaccggaccugcgacuggcgcgagaucacguggcagccccacaacugccaguacggcguccugaccaagccccagcugcagcagugccucggcgggcggaagcugggcguggacgugcagcgcgucccgcggucccgcaacuga

SEQ ID NO: 28631 - RNA, 1431 nt, Artificial Sequence
  derived and/or modified sequence opt1 from CPE__Homo_sapiens__NP_001864
auggccggccgcgggggcagcgcccugcucgcgcugugcggggcccuggccgccugcggcuggcuccugggggccgaggcgcaggagcccggcgccccggccgccggcaugcggcgccggcgccggcugcagcaggaggacgggaucuccuucgaguaccaccgcuaccccgagcuccgggaggcgcuggugagcgucuggcugcagugcaccgccaucucccgcaucuacaccgugggccggagcuucgaggggcgcgagcuccuggugaucgagcuguccgacaaccccggcguccacgagcccggggagccggaguucaaguacaucggcaacaugcacggcaacgaggccguggggcgggagcuccugaucuuccuggcccaguaccucugcaacgaguaccagaagggcaacgagacgaucgugaaccugauccacagcacccgcauccacaucaugcccucccugaaccccgacggguucgagaaggccgcgagccagcccggcgagcucaaggacugguucgucggccgguccaacgcccaggggaucgaccugaaccgcaacuucccggaccuggaccggaucguguacgugaacgagaaggagggcgggcccaacaaccaccuccugaagaacaugaagaagaucgucgaccagaacaccaagcuggcccccgagaccaaggccgugauccacuggaucauggacauccccuucgugcucagcgccaaccugcacggcggggaccuggucgcgaacuacccguacgacgagacgcgcuccggcagcgcccacgaguacuccagcucccccgacgacgccaucuuccagagccucgcccgggccuacuccagcuucaaccccgcgauguccgaccccaaccgcccgcccugccggaagaacgacgacgacagcagcuucguggacggcaccaccaacgggggcgccugguacuccgugcccgggggcaugcaggacuucaacuaccugagcuccaacugcuucgagaucaccgucgagcugagcugcgagaaguucccgcccgaggagacgcucaagaccuacugggaggacaacaagaacucccugaucagcuaccuggagcagauccaccgcggggugaagggcuucgugcgggaccuccagggcaaccccaucgccaacgccaccaucuccgucgaggggaucgaccacgacgugaccagcgccaaggacggcgacuacuggcgccugcugauccccgggaacuacaagcucacggcguccgcccccggcuaccuggccaucaccaagaagguggccgucccguacagccccgcggccgggguggacuucgagcuggaguccuucagcgagcgcaaggaggaggagaaggaggagcucauggagugguggaagaugauguccgagacccugaacuucuga

SEQ ID NO: 28632 - RNA, 3198 nt, Artificial Sequence
  derived and/or modified sequence opt1 from CP__Homo_sapiens__NP_000087
augaagauccugauccucggcaucuuccuguuccugugcagcacccccgccugggccaaggagaagcacuacuacaucgggaucaucgagaccacgugggacuacgcguccgaccacggcgagaagaagcucaucagcguggacaccgagcacuccaacaucuaccugcagaacgggccggaccgcaucggccggcuguacaagaaggcccucuaccugcaguacaccgacgagaccuuccgcacgaccaucgagaagcccgucuggcugggguuccucggccccaucaucaaggccgagaccggcgacaagguguacgugcaccugaagaaccuggccagccggcccuacaccuuccacucccacgggaucacguacuacaaggagcacgagggcgccaucuacccggacaacaccaccgacuuccagcgcgcggacgacaaggucuaccccggggagcaguacaccuacaugcuccuggccacggaggagcagagccccggcgagggggacggcaacugcgugacccggaucuaccacucccacaucgacgcccccaaggacaucgccagcggccugaucgggccgcucaucaucugcaagaaggacucccuggacaaggagaaggagaagcacaucgaccgcgaguucguggucauguucagcgugguggacgagaacuucuccugguaccuggaggacaacaucaagaccuacugcagcgagcccgagaaggucgacaaggacaacgaggacuuccaggaguccaaccggauguacagcgugaacggcuacaccuucgggucccuccccggccugagcaugugcgcggaggaccgcgugaagugguaccuguucggcauggggaacgaggucgacgugcacgccgccuucuuccacggccaggcccucacgaacaagaacuaccggaucgacaccaucaaccuguuccccgccacccuguucgacgcguacaugguggcccagaacccgggggaguggaugcucuccugccagaaccugaaccaccugaaggccggccuccaggccuucuuccagguccaggagugcaacaagagcuccagcaaggacaacauccgcgggaagcacgugcggcacuacuacaucgccgcggaggagaucaucuggaacuacgcccccagcggcaucgacaucuucaccaaggagaaccugacggcccccggcuccgacagcgccguguucuucgagcaggggaccacccgcaucggcggguccuacaagaagcuggucuaccgggaguacaccgacgccagcuucacgaaccgcaaggagcggggccccgaggaggagcaccucgggauccugggcccggugaucugggcggaggugggcgacaccauccgcgucaccuuccacaacaagggggccuacccccuguccaucgagcccaucggcgugcgguucaacaagaacaacgaggggaccuacuacagccccaacuacaacccgcagucccgcagcgugccgcccuccgccagccacgucgcccccacggagaccuucaccuacgaguggaccgugcccaaggaggucggccccacgaacgccgaccccgugugccucgcgaagauguacuacuccgccguggaccccaccaaggacaucuucaccgggcugaucggcccgaugaagaucugcaagaagggcagccugcacgccaacgggcggcagaaggacgucgacaaggaguucuaccucuuccccaccguguucgacgagaacgagucccugcugcucgaggacaacauccgcauguucacgaccgcccccgaccagguggacaaggaggacgaggacuuccaggagagcaacaagaugcacuccaugaacggcuucauguacgggaaccagccgggccugaccaugugcaagggcgacagcgucgugugguaccuguucuccgcggggaacgaggccgacgugcacggcaucuacuucagcgggaacaccuaccucuggcggggcgagcgccgcgacaccgccaaccuguucccccagacgucccugacccuccacauguggcccgacaccgaggggaccuucaacgucgagugccugacgaccgaccacuacaccggcggcaugaagcagaaguacaccgugaaccagugccggcgccagagcgaggacagcacguucuaccugggggagcggaccuacuacaucgccgccguggaggucgagugggacuacagcccccagcgcgagugggagaaggagcuccaccaccuccaggagcagaacguguccaacgcguuccuggacaagggcgaguucuacaucggguccaaguacaagaagguggucuaccggcaguacaccgacagcaccuuccgcgugccgguggagcggaaggccgaggaggagcaccugggcauccuggggccccagcugcacgccgacgucggcgacaaggugaagaucaucuucaagaacauggccacgcgccccuacuccauccacgcccacggcgugcagaccgagagcuccaccgucacccccacgcugccgggggagacccucaccuacguguggaagauccccgagcggagcggcgcggggaccgaggacuccgccugcauccccugggccuacuacagcacgguggaccaggucaaggaccuguacuccggccugaucgggccccucaucgugugccgccggccguaccugaagguguucaacccccgccggaagcuggaguucgcccuccuguuccuggucuucgacgagaacgagagcugguaccucgacgacaacaucaagaccuacuccgaccaccccgagaaggugaacaaggacgacgaggaguucaucgagagcaacaagaugcacgccaucaacggccgcauguucggcaaccugcaggggcugaccaugcacgugggcgacgaggucaacugguaccucauggggaugggcaacgagaucgaccugcacaccgugcacuuccacgggcacuccuuccaguacaagcaccggggcguguacagcuccgacgucuucgacaucuuccccggcacguaccagacccuggagauguucccgcgcacccccgggaucuggcuccugcacugccacgugaccgaccacauccacgcgggcauggagacgaccuacaccgugcugcagaacgaggacaccaagagcggguga

SEQ ID NO: 28633 - RNA, 405 nt, Artificial Sequence
  derived and/or modified sequence opt1 from CPLX1__Homo_sapiens__NP_006642
auggaguucgugaugaagcaggcccugggcggggccaccaaggacaugggcaagaugcucgggggcgacgaggagaaggaccccgacgcggccaagaaggaggaggagcgccaggaggcccugcggcaggccgaggaggagcgcaaggccaaguacgcgaagauggaggccgagcgggaggccguccgccaggggauccgggacaaguacggcaucaagaagaaggaggagcgcgaggccgaggcgcaggccgccauggaggccaacagcgagggcucccugacccggccgaagaaggccaucccgcccgggugcggcgacgagguggaggaggaggacgagagcauccucgacacggugaucaaguaccugcccgggccccugcaggacaugcucaagaaguga

SEQ ID NO: 28634 - RNA, 405 nt, Artificial Sequence
  derived and/or modified sequence opt1 from CPLX2__Homo_sapiens__XP_011532721
auggacuucgugaugaagcaggcccugggcggggccaccaaggacaugggcaagaugcucgggggcgaggaggagaaggaccccgacgcgcagaagaaggaggaggagcgccaggaggcccugcggcagcaggaggaggagcgcaaggccaagcacgcccggauggaggccgagcgcgagaagguccggcagcagauccgcgacaaguacgggcugaagaagaaggaggagaaggaggcggaggagaaggccgcccucgagcagccgugcgagggcagccugacccggcccaagaaggccauccccgcgggcugcggggacgaggaggaggaggaggaggaguccauccuggacacggugcucaaguaccugcccggcccgcugcaggacauguucaagaaguga

SEQ ID NO: 28635 - RNA, 477 nt, Artificial Sequence
  derived and/or modified sequence opt1 from CPLX3__Homo_sapiens__NP_001025176
auggccuucauggugaagaccauggucggcgggcagcugaagaaccucaccggcagccucgggggcggggaggacaagggcgacggcgacaaguccgccgcggaggcccaggggaugagccgcgaggaguacgaggaguaccagaagcagcugguggaggagaagauggagcgggacgcccaguucacgcagcgcaaggccgagcgggccacccugcgcucccacuuccgggacaaguaccgccugcccaagaacgagaccgacgagagccagauccagauggcgggcggggacguggagcugccgcgggagcucgccaagaugaucgaggaggacaccgaggaggaggaggagaaggccuccguccugggccagcuggccagccuccccgggcugaaccugggcucccucaaggacaaggcgcaggccacgcugggcgaccugaagcagagcgccgagaagugccacgugauguga

SEQ ID NO: 28636 - RNA, 483 nt, Artificial Sequence
  derived and/or modified sequence opt1 from CPLX4__Homo_sapiens__NP_857637
auggccuuccugaugaaguccaugaucagcaaccaggugaagaaccucggcuucgggggcgggagcgaggagaacaaggaggagggcggggccuccgaccccgcggccgcccagggcaugacccgcgaggaguacgaggaguaccagaagcagaugaucgaggagaagauggagcgggacgccgccuucacccagaagaaggcggagcgcgccugccugcggguccaccuccgcgagaaguaccggcugcccaagagcgagauggacgagaaccagauccagauggccggcgacgacguggaccugccggaggaccugcgcaagaugguggacgaggaccaggaggaggaggaggacaaggacuccauccucgggcagauccagaaccugcagaacauggaccuggacacgaucaaggagaaggcccaggcgaccuucaccgagaucaagcagaccgccgagcagaagugcagcgucauguga

SEQ ID NO: 28637 - RNA, 1332 nt, Artificial Sequence
  derived and/or modified sequence opt1 from CPM__Homo_sapiens__NP_001005502
auggacuuccccugccuguggcucggccugcugcucccgcugguggccgcccuggacuucaacuaccaccgccaggaggggauggaggcguuccucaagaccgucgcccagaacuacagcuccgugacccaccuccacagcaucggcaaguccgugaaggggcggaaccuguggguccugguggugggccgcuuccccaaggagcaccggaucgggauccccgaguucaaguacgucgccaacaugcacggcgacgagacggugggccgcgagcugcugcuccaccugaucgacuaccuggugaccagcgacgggaaggaccccgagaucaccaaccucaucaacuccacccggauccacaucaugccgagcaugaaccccgacggcuucgaggccgucaagaagcccgacugcuacuacuccaucgggcgcgagaacuacaaccaguacgaccugaaccggaacuuccccgacgccuucgaguacaacaacgugagccgccagccggagacgguggcggucaugaaguggcugaagaccgagaccuucgugcucuccgccaaccugcacggcggggcccugguggccagcuaccccuucgacaacggcguccaggcgaccggcgcccucuacucccggagccugacgcccgacgacgacguguuccaguaccuggcccacaccuacgccucccgcaaccccaacaugaagaagggggacgagugcaagaacaagaugaacuucccgaacggcgugaccaacggguacagcugguacccccuccagggcggcaugcaggacuacaacuacaucugggcccagugcuucgagaucacccuggagcuguccugcugcaaguacccccgggaggagaagcuccccagcuucuggaacaacaacaaggcgucccugaucgaguacaucaagcagguccaccugggggugaagggccagguguucgaccagaacgggaacccgcuccccaacgucaucguggaggugcaggaccgcaagcacaucugccccuaccggacgaacaaguacggcgaguacuaccugcugcuccugcccgggagcuacaucaucaacgucaccgugccgggccacgacccccacaucaccaaggucaucauccccgagaagucccagaacuucagcgcccugaagaaggacauccuccugcccuuccagggccagcuggacagcaucccgguguccaaccccagcugccccaugaucccccucuaccgcaaccugccggaccacuccgccgccaccaagcccagccuguuccucuuccuggugucccugcuccacaucuucuucaaguga

SEQ ID NO: 28638 - RNA, 1419 nt, Artificial Sequence
  derived and/or modified sequence opt1 from CPN1__Homo_sapiens__XP_011537601
augagcgaccugcucuccguguuccugcaccuccugcugcuguucaagcucgucgcccccgugaccuuccgccaccaccgguacgacgaccuggugcgcacccuguacaagguccagaacgagugcccgggcaucacgcggguguacagcaucgggcgcuccguggagggccggcaccucuacguccuggaguucagcgaccaccccgggauccacgagccccuggagcccgaggugaaguacgugggcaacaugcacgggaacgaggcccucggccgcgagcugaugcugcagcucuccgaguuccugugcgaggaguuccggaaccgcaaccagcggaucguccagcugauccaggacacccgcauccacauccucccgagcaugaaccccgacggcuacgagguggcggccgcccaggggcccaacaagcccggcuaccugguggggcggaacaacgccaacggcgucgaccugaaccgcaacuucccggaccucaacaccuacaucuacuacaacgagaaguacgggggccccaaccaccaccucccccugcccgacaacuggaagucccagccgcagcuggcccugcaccggcagccccuggcgagcucccagguggagcccgagacccgcgccgugauccgguggaugcacagcuucaacuucguccucuccgccaaccugcacggcggggccgugguggcgaacuaccccuacgacaagagcuucgagcaccgcguccggggcgugcgccggacggccuccaccccgacccccgacgacaagcuguuccagaagcucgccaagguguacagcuacgcccacggguggauguuccagggcuggaacugcggcgacuacuuccccgacgggaucaccaacggcgccuccugguacagccuguccaaggggaugcaggacuucaacuaccugcacacgaacugcuucgagaucacccucgagcugagcugcgacaaguucccgcccgaggaggagcugcagcgcgaguggcucggcaaccgggaggcgcugauccaguuccuggagcagguccaccaggggaucaagggcauggugcucgacgagaacuacaacaaccuggccaacgccgugaucuccgucagcggcaucaaccacgacgugaccagcggggaccacggcgacuacuuccgccugcuccugcccgggaucuacaccgucuccgccacggcccccggcuacgaccccgagaccgugaccgugaccgucgggccggcggagcccacgcuggugaacuuccaccucaagcgcagcaucccccaggugucccccguccggcgcgccccgagccggcgccacggcgugcgggccaaggugcagccccaggcccgcaagaaggagauggagaugcggcagcugcagcgcggccccgccuga

SEQ ID NO: 28639 - RNA, 1638 nt, Artificial Sequence
  derived and/or modified sequence opt1 from CPN2__Homo_sapiens__NP_001278917
augcugcccggcgccuggcuccuguggaccagccugcuccugcuggcccgcccggcgcagcccugccccauggggugcgacugcuucgugcaggaggucuucugcuccgacgaggagcucgccaccgugccccuggacaucccgcccuacacgaagaacaucaucuucguggagaccagcuucaccacccuggagacgcgggccuucggcuccaaccccaaccucaccaaggucguguuccugaacacccagcugugccaguuccgccccgacgccuucgggggccucccgcggcuggaggaccuggaggugaccgggagcuccuuccucaaccugagcacgaacaucuucuccaaccugaccagccucggcaagcugacccugaacuucaacaugcucgaggcccugcccgagggccuguuccagcaccucgcggcccuggagucccugcaccuccaggggaaccagcugcaggcccugccccgccggcuguuccagccccugacccaccugaagacgcucaaccuggcccagaaccugcucgcgcagcugccggaggagcuguuccacccccucaccagccugcagacccugaagcucuccaacaacgcccugagcggccugccccagggggucuucggcaagcucgggucccugcaggagcuguuccucgacagcaacaacaucuccgagcugcccccgcaggucuucagccagcuguucugccuggagcgccucuggcugcagcggaacgccaucacccaccucccccucuccaucuucgccagccugggcaaccugacguuccucucccugcaguggaacaugcugcgcgugcuccccgccggccuguucgcgcacacccccugccugguggggcucagccugacccacaaccagcuggagaccguggccgagggcacguucgcccaccucagcaaccugcggucccugaugcucagcuacaacgccaucacccaccucccggccgggaucuuccgcgaccuggaggagcuggugaagcuguaccugggcuccaacaaccucaccgcgcugcaccccgcccuguuccagaaccucagcaagcuggagcugcucucccugagcaagaaccagcugaccacgcuccccgagggcaucuucgacaccaacuacaaccuguucaaccuggcccuccacgggaaccccuggcagugcgacugccaccuggccuaccuguucaacuggcuccagcaguacaccgaccggcugcugaacauccagaccuacugcgccggcccggcguaccucaaggggcaggucgugcccgcccugaacgagaagcagcuggugugccccgucacgcgcgaccaccucggcuuccaggugaccuggcccgacgaguccaaggccgggggcagcugggaccuggccgugcaggagcgggccgcgcgcucccagugcaccuacagcaacccggagggcaccgucgugcuggccugcgaccaggcccagugccgguggcucaacgugcagcugagcccccagcaggggucccugggccuccaguacaacgccucccaggagugggaccugcgcagcuccugcgggagccugcggcucacggucuccaucgaggcgcgcgccgccggccccuga

SEQ ID NO: 28640 - RNA, 1611 nt, Artificial Sequence
  derived and/or modified sequence opt1 from CPNE1__Homo_sapiens__NP_001185792
auggcccacugcgugacccucguccagcucagcaucuccugcgaccaccugaucgacaaggacaucggcagcaaguccgacccccugugcgugcuccugcaggacgucgggggcgggagcugggccgagcugggccgcaccgagcgggugcgcaacugcuccagcccggaguucuccaagacgcuccagcuggaguaccgguucgagaccgugcagaagcugcgcuucgggaucuacgacaucgacaacaagacccccgagcuccgggacgacgacuuccugggcggcgccgagugcagccuggggcagaucguguccagccagguccucacccugccccugaugcucaagcccggcaagccggccgggcgcggcacgaucaccguguccgcccaggagcugaaggacaaccggguggucaccauggagguggaggcccgcaaccuggacaagaaggacuuccucggcaagagcgaccccuuccuggaguucuuccggcagggggacggcaaguggcaccugguguaccgcuccgaggucaucaagaacaaccucaaccccaccuggaagcgguucagcgugcccgugcagcacuucugcgggggcaacccguccacgcccauccagguccagugcagcgacuacgacuccgacgggagccacgaccugaucggcaccuuccacaccucccuggcccagcuccaggcggugcccgccgaguucgagugcauccaccccgagaagcagcagaagaagaaguccuacaagaacagcggcaccauccgcgugaagaucugccgggucgagacggaguacagcuuccuggacuacgugaugggcgggugccagaucaacuucaccgugggggucgacuucaccggcagcaacggggacccguccagccccgacucccugcacuaccucagccccaccggcgugaacgaguaccugauggcccugugguccgugggcagcgucgugcaggacuacgacuccgacaagcuguuccccgccuucggguucggcgcgcaggucccgcccgacuggcaggucagccacgaguucgcccucaacuucaaccccuccaaccccuacugcgccgggauccagggcaucguggacgccuaccgccaggcccugccccaggugcggcucuacgggccgacgaacuucgcgcccaucaucaaccacguggcccgcuucgccgcccaggccgcgcaccagggcaccgccagcuacuucaugcugcugcuccugaccgacggcgccgugaccgacgucgaggccacgcgggaggccguggugcgcgcguccaaccugcccaugagcgucaucaucgugggggugggcggggccgacuucgaggccauggagcagcucgacgccgacggcgggccgcugcacacccgguccggccaggccgcggcccgcgacaucguccaguucgugcccuaccggcgcuuccagaacgcgccccgcgaggcccuggcccagaccgugcucgccgagguccccacccagcuggugagcuacuuccgggcccagggcugggccccgcugaagccccugcccccguccgccaaggaccccgcgcaggcgccccaggccuga

SEQ ID NO: 28641 - RNA, 1647 nt, Artificial Sequence
  derived and/or modified sequence opt1 from CPNE2__Homo_sapiens__NP_689940
auggcccacauccccagcggcggggccccggcggccggcgccgcccccauggggccccaguacugcgugugcaagguggagcuguccgugagcggccagaaccuccuggaccgcgacgugaccuccaagagcgaccccuucugcguccuguucaccgagaacaacgggcgguggaucgaguacgaccgcacggagaccgccaucaacaaccucaacccggcguucuccaagaaguucgugcuggacuaccacuucgaggaggugcagaagcugaaguucgcccucuucgaccaggacaagagcuccaugcggcuggacgagcacgacuuccugggccaguucagcugcucccucggcaccaucgucagcuccaagaagaucacccgcccccugcugcuccugaacgacaagcccgccgggaagggccugaucacgaucgccgcgcaggagcucagcgacaaccgggugaucacccugucccuggccgggcgccggcucgacaagaaggaccuguucggcaagagcgaccccuuccuggaguucuacaagccgggggacgacggcaaguggaugcucgugcaccgcaccgaggucaucaaguacacccuggaccccguguggaagcccuucacggugccccuggucucccucugcgacggcgacauggagaagccgauccaggugaugugcuacgacuacgacaacgacgggggccacgacuucaucggggaguuccagaccagcgugucccagaugugcgaggcccgggacagcgucccccuggaguucgagugcaucaaccccaagaagcagcgcaagaagaagaacuacaagaacuccggcaucaucauccugcggagcugcaagaucaaccgcgacuacagcuuccucgacuacauccugggcgggugccagcugauguucaccgugggcaucgacuucaccgccuccaacgggaacccccucgacccgagcucccugcacuacaucaaccccaugggcacgaacgaguaccugagcgccaucugggcgguggggcagaucauccaggacuacgacuccgacaagauguuccccgcccucggcuucggcgcccagcugcccccggacuggaaggucagccacgaguucgccaucaacuucaaccccaccaaccccuucugcuccgggguggacggcaucgcccaggcguacagcgccugccugccccacauccgguucuacgggccgaccaacuucucccccaucgugaaccacgucgcccgcuucgccgcccaggcgacccagcagcggacggccacccaguacuucauccuccugaucaucaccgacggcgugaucagcgacauggaggagacccgccacgccgugguccaggccuccaagcugcccaugagcaucaucaucgugggggucggcaacgccgacuucgcggccauggaguuccucgacggcgacucccggaugcugcgcagccacacgggggaggaggccgcccgggacaucgugcaguucgugcccuuccgcgaguuccggaacgcggccaaggagacccuggccaaggccguccucgccgagcugccgcagcaggucgugcaguacuucaagcacaagaaccugccgcccaccaacuccgagcccgcguga

SEQ ID NO: 28642 - RNA, 1614 nt, Artificial Sequence
  derived and/or modified sequence opt1 from CPNE3__Homo_sapiens__NP_003900
auggccgcccagugcgugaccaaggucgcgcugaacgugagcugcgccaaccuccuggacaaggacaucggcuccaagagcgacccccugugcguccucuuccugaacaccuccgggcagcagugguacgagguggagcgcacggagcggaucaagaacugccugaacccgcaguucagcaagaccuucaucaucgacuacuacuucgagguggugcagaagcucaaguucggcgucuacgacaucgacaacaagaccaucgagcuguccgacgacgacuuccugggggagugcgagugcacccucggccagaucgugagcuccaagaagcugacgcgcccccuggugaugaagaccgggcggcccgccggcaagggcagcaucaccaucuccgccgaggagaucaaggacaaccgcgucguccucuucgagauggaggcccggaagcuggacaacaaggaccuguucggcaagagcgaccccuaccucgaguuccacaagcagaccuccgacgggaacuggcugauggugcaccgcacggagguggugaagaacaaccugaacccgguguggcggcccuucaagaucagccucaacucccugugcuacggggacauggacaagaccaucaaggucgagugcuacgacuacgacaacgacggcagccacgaccugaucgggaccuuccagaccacgaugaccaagcucaaggaggcgucccgcagcucccccguggaguucgagugcaucaacgagaagaagcggcagaagaagaaguccuacaagaacagcggcgugaucagcgucaagcagugcgagaucaccguggagugcaccuuccuggacuacaucaugggcgggugccagcugaacuucacggugggcgucgacuucaccgggagcaacggcgacccccgcuccccggacagccuccacuacaucucccccaacggcgugaacgaguaccugaccgcccuguggagcguggggcucgucauccaggacuacgacgccgacaagauguuccccgccuucggcuucggggcgcagaucccgccccaguggcaggucucccacgaguuccccaugaacuucaaccccagcaaccccuacugcaacggcauccaggggaucguggaggccuaccgguccugccugccgcagaucaagcuguacggccccaccaacuucagccccaucaucaaccacguggcccgcuucgccgccgcggccacgcagcagcagaccgccucccaguacuucgugcuccugaucaucaccgacggcgucaucaccgaccuggacgagacgcggcaggccaucgugaacgccagccgccuccccauguccaucaucaucgugggggucggcggggcggacuucagcgccauggaguuccuggacggcgacgggggcucccugcggagcccgcucggcgagguggccauccgcgacaucgugcaguucguccccuuccggcaguuccagaacgcccccaaggaggcccuggcgcagugcgugcuggccgagaucccccagcaggucgugggguacuucaacaccuacaagcuccugccgcccaagaaccccgccaccaagcagcagaagcaguga

SEQ ID NO: 28643 - RNA, 1728 nt, Artificial Sequence
  derived and/or modified sequence opt1 from CPNE4__Homo_sapiens__NP_001276041
auggccguggagcccagcuccagcgaguccaucaagcgccgggccggccgccggaugaagaagaugagcaacaucuacgaguccgcggccaacacccuggggaucuucaacagcccgugccucaccaaggucgagcugcgcguggccugcaagggcaucuccgaccgggacgcccugagcaagcccgaccccugcgugauccucaagaugcagucccacgggcagugguucgaggucgaccgcacggaggugauccggaccugcaucaaccccguguacagcaagcuguucaccgucgacuucuacuucgaggaggugcagcgccugcgguucgaggugcacgacaucuccagcaaccacaacggccucaaggaggccgacuuccucgggggcauggagugcacccugggccagaucgucucccagcgcaagcugagcaagucccugcugaagcacgggaacacggcgggcaagagcuccaucaccgugaucgccgaggagcucagcgggaacgacgacuacguggagcuggccuucaacgcccggaagcuggacgacaaggacuucuucuccaagagcgacccguuccucgagaucuuccgcaugaacgacgacgcgacccagcagcugguccaccggaccgagguggugaugaacaaccugagccccgccuggaaguccuucaaggucagcgugaacucccucugcagcggcgaccccgaccgccggcugaagugcaucgugugggacugggacuccaacgggaagcacgacuucaucggcgaguucacgagcaccuucaaggagaugcgcggcgccauggaggggaagcagguccagugggagugcaucaaccccaaguacaaggccaagaagaagaacuacaagaacuccggcaccgugauccugaaccucugcaagauccacaagaugcacagcuuccuggacuacaucaugggcgggugccagauccaguucaccguggccaucgacuucacggcguccaacggcgacccgcggaacagcugcucccugcacuacauccaccccuaccagcccaacgaguaccucaaggcccuggucgccgugggggagaucugccaggacuacgacagcgacaagauguuccccgccuucggcuucggggcccgcaucccgcccgaguacaccgugucccacgacuucgcgaucaacuucaacgaggacaaccccgagugcgccggcauccagggggucguggaggccuaccagagcugccugcccaagcuccagcuguacggcccgaccaacaucgcccccaucauccagaaggucgccaaguccgcgagcgaggagaccaacacgaaggaggccucccaguacuucauccugcucauccugaccgacggcgugaucaccgacauggccgacacccgggaggccaucgugcacgccagccaccuccccauguccgucaucaucgugggggugggcaacgcggacuucagcgacaugcagaugcuggacggggacgacggcauccugcgcagccccaagggggagccgguccugcgggacaucgugcaguucgugcccuuccgcaacuucaagcacgccucccccgccgcccucgccaagagcguccuggcggaggugcccaaccagguggucgacuacuacaacggcaagggcaucaagccgaagugcuccagcgagauguacgaguccagccgcacgcuggcccccuga

SEQ ID NO: 28644 - RNA, 1902 nt, Artificial Sequence
  derived and/or modified sequence opt1 from CPNE7__Homo_sapiens__NP_055242
augagcgccggcuccgagcgcggggccgcggccacccccggcgggcugccggcccccugcgccagcaagguggagcuccggcuguccugccgccaccuccuggaccgggacccccugaccaagagcgaccccuccgucgcccugcuccagcaggcgcagggccaguggguccagguggggcgcacggagguggugcggagcucccugcacccgguguucagcaaggucuucaccguggacuacuacuucgaggaggugcagcgccugcgguucgaggucuacgacacccacggccccuccggcuucagcugccaggaggacgacuuccucgggggcauggagugcacccuggggcagcccgcccagaaguggcugcuccagguggugaugcgcgucuccguggacgugcugggccccgccgggcacugcgccaagcacuuccugugcugcacggagagcucccaccucgcgcggaccggcccgagcuuccugcugcgcuacgacgaccucugccugcccugggccaccgccggcgccguccggugguggaccugccgcgggggccacacgcagggguggcagaucguggcccagaagaaggugacccggccccugcuccugaaguucggccgcaacgcgggcaaguccaccaucaccgucaucgccgaggacaucagcgggaacaacggcuacguggagcuguccuuccgggcccgcaagcucgacgacaaggaccuguucagcaaguccgaccccuuccuggagcucuaccgggugaacgacgaccaggggcugcagcuggucuaccgcacggagguggugaagaacaaccucaacccggucugggaggccuucaaggugagccugagcucccugugcagcugcgaggagacccggccccucaagugccuggucugggacuacgacucccgcggcaagcacgacuucaucggggaguucagcaccaccuucgaggagaugcagaaggccuucgaggagggccaggcgcagugggacugcgugaaccccaaguacaagcagaagcggcgcuccuacaagaacagcggcguggucgugcuggccgaccucaaguuccaccgcguguacuccuuccuggacuacaucaugggcgggugccagauccacuucacggucgccaucgacuucaccgccagcaacggggacccccggaacuccugcagccugcacuacaucaacccguaccagcccaacgaguaccucaaggcccugguguccgugggcgagaucugccaggacuacgacagcgacaagcgcuucuccgcgcugggguucggcgcccggaucccgcccaaguacgaggucagccacgacuucgccaucaacuucaaccccgaggacgacgagugcgagggcauccagggggugguggaggccuaccagaacugccucccccgcguccagcuguacggccccaccaacguggcccccaucaucuccaagguggcgcgggucgccgccgccgaggagagcaccgggaaggcgucccaguacuacauccugcucauccugacggacggcguggugaccgacauggccgacacccgcgaggccaucguccgggccagccgccugccgauguccaucaucaucgugggggugggcaacgccgacuucaccgacaugcagguccucgacggcgacgacggggugcugcggagcccccgcggcgagcccgcgcugcgggacaucgugcaguucguccccuuccgcgagcugaagaacgccagcccggccgcccucgccaagugcgugcuggcggaggugcccaagcaggucguggaguacuacucccaccgggggcugcccccgcgcagccucggcgugcccgccggcgaggccucccccgggugcacgcccuga

SEQ ID NO: 28645 - RNA, 1695 nt, Artificial Sequence
  derived and/or modified sequence opt1 from CPNE8__Homo_sapiens__NP_705898
auggacagccgcuacaacuccaccgccggcaucggggaccugaaccagcucagcgccgcgauccccgccacccggguggaggucuccgugagcugccgcaaccugcuggaccgggacacguucuccaagagcgaccccaucugcgugcucuacguccagggcguggggaacaaggaguggcgcgaguucggccggaccgaggugaucgacaacacccugaaccccgacuucguccgcaaguucauccuggacuacuucuucgaggagcgggagaaccuccgcuucgaccuguacgacguggacuccaagagccccaaccuguccaagcacgacuuccucggccagguguucugcacccugggggagaucgucggcagccaggggucccggcuggagaagcccaucgugggcaucccggggaagaagugcggcacgaucauccucaccgccgaggagcugaacugcugccgcgacgccgugcugaugcaguucugcgccaacaagcucgacaagaaggacuucuucggcaagagcgaccccuuccuggucuucuaccgguccaacgaggacgggagcuucaccaucugccacaagaccgagguggugaagaacacgcugaaccccgucuggcaggcguucaagaucuccgugcgcgcccucugcaacggcgacuacgaccggaccaucaagguggaggucuacgacugggaccgcgacgggagccacgacuucaucggcgaguucaccaccuccuaccgggagcugagccgcgggcagucccaguucaacguguacgagguggucaaccccaagaagaagggcaagaagaagaaguacacgaacagcggcaccgugacccugcucagcuuccugguggagaccgaggucuccuuccuggacuacaucaagggcgggacgcagaucaacuucaccguggccaucgacuucaccgccagcaacgggaacccggcgcagcccaccucccuccacuacaugaaccccuaccagcugaacgccuacggcauggcccugaaggccgucggggagaucgugcaggacuacgacagcgacaagauguuccccgcccucggcuucggcgcgaagcugccgcccgacgggcggaucucccacgaguucgcccugaacggcaacccccagaaccccuacugcgacgggaucgagggcgugauggaggccuacuaccgcagccucaaguccguccagcuguacgggccgacgaacuucgcccccgugaucaaccacguggcccgguacgcgagcuccgucaaggacggcagccaguacuucgugcugcucaucgugaccgacggcgucaucuccgacauggcccagaccaaggagagcaucgugaacgccuccaagcugcccaugagcaucaucaucgugggggucggccccgccgaguucgacgccaugguggagcuggacggggacgacgugcgcgucuccagccggggcaaguacgcggagcgcgacaucgugcaguucgugccguuccgcgacuacaucgaccgguccgggaaccacauccucagcauggcccgccuggccaaggacguccuggccgagauccccgagcaguuccucuccuacaugcgggcccgcggcaucaagcccagccccgcgccgccgcccuacaccccgcccacgcacgugcugcagacccagaucuga

SEQ ID NO: 28646 - RNA, 1125 nt, Artificial Sequence
  derived and/or modified sequence opt1 from CPO__Homo_sapiens__XP_011508929
augaagccccugcucgagacccuguaccugcucggcaugcuggugcccgggggccugggguacgaccgcagccucgcccagcaccggcaggagaucgucgacaaguccgugagccccuggucccuggagaccuacagcuacaacaucuaccaccccaugggcgagaucuacgaguggaugcgcgagaucuccgagaaguacaaggagguggucacgcagcacuuccugggggugaccuacgagacccaccccauguacuaccucaagaucagccagccguccggcaaccccaagaagaucaucuggauggacugcggcauccacgcccgggaguggaucgcgcccgccuucugccagugguucgugaaggagauccugcagaaccacaaggacaacagcuccauccgcaagcugcuccggaaccuggacuucuacguccugcccgugcucaacaucgacggguacaucuacaccuggacgaccgaccgccuguggcgcaagagccgguccccgcacaacaacgggaccugcuucggcaccgaccugaaccggaacuucaacgccagcuggugcuccaucggcgccagccgcaacugccaggaccagacguucugcgggaccggccccguguccgagcccgagaccaaggccgucgcgagcuucaucgaguccaagaaggacgacauccucugcuuccugaccaugcacagcuacggccagcugauccucacgcccuacggguacaccaagaacaaguccagcaaccacccggagaugauccaggugggccagaaggccgccaacgcccugaaggcgaaguacgggaccaacuaccgggugggcagcuccgccgacauccuguacgccagcuccggcagcucccgcgacugggcccgggacaucgggauccccuucagcuacaccuucgagcuccgcgacuccggcacguacggguucguccugcccgaggcccagauccagccgaccugcgaggagaccauggaggcggugcugagcgugcucgacgacgucuacgccaagcacuggcacuccgacagcgccggccgggugaccuccgccacgaugcugcuggggcuccuggugagcugcaugucccugcucuga

SEQ ID NO: 28647 - RNA, 1365 nt, Artificial Sequence
  derived and/or modified sequence opt1 from CPOX__Homo_sapiens__NP_000088
auggcccugcagcucggccgccugagcuccgggcccugcuggcugguggcccggggcgggugcggcgggccgcgcgcguggagccagugcggcggcgggggccuccgggccuggucccagcgcagcgccgccgggcgggucugccgcccgcccggccccgccgggaccgagcagucccggggccugggccacgggagcaccucccgcggcgggcccugggugggcacgggccuggcggccgcccucgccgggcuggugggccuggcgaccgccgccuucgggcacguccagcgggccgagaugcuccccaagaccagcggcacccgcgccacgucccuggggcggcccgaggaggaggaggacgagcuggcgcaccgcugcagcuccuucauggcgcccccggugaccgaccucggcgagcugcggcgccggcccggcgacaugaagaccaagauggagcugcucauccuggagacccaggcccaggugugccaggcccuggcccaggucgacgggggcgccaacuucagcguggaccgcugggagcggaaggagggcgggggcgggaucuccugcgugcuccaggacggcugcgucuucgagaaggccggggugagcaucuccgugguccacggcaaccugagcgaggaggccgccaagcagaugcgcucccgggggaaggugcugaagacgaaggacggcaagcuccccuucugcgccaugggggugagcuccgucauccaccccaagaacccgcacgcgcccaccauccacuucaacuaccgcuacuucgagguggaggaggccgacggcaacaagcaguggugguucggcgggggcugcgaccugacccccaccuaccugaaccaggaggacgccgugcacuuccaccggacgcucaaggaggccugcgaccagcacgggcccgaccuguacccgaaguucaagaaguggugcgacgacuacuucuucaucgcccaccgcggcgagcgccggggcaucgggggcaucuucuucgacgaccuggacagccccagcaaggaggaggucuuccgcuucgugcaguccugcgcgcgggccgugguccccagcuacaucccccucgugaagaagcacugcgacgacuccuucaccccgcaggagaagcuguggcagcagcugcgccgggggcgcuacguggaguucaaccuccuguacgaccggggcaccaaguucgggcuguucacccccggcagccgcaucgaguccauccucaugagccugccccugacggcccggugggaguacaugcacucccccagcgagaacuccaaggaggccgagauccucgagguccugcgccacccgcgggacugggugcgcuga

SEQ ID NO: 28648 - RNA, 519 nt, Artificial Sequence
  derived and/or modified sequence opt1 from CPPED1__Homo_sapiens__NP_001092925
augagcgccgccgaggcgggcgggguguuccaccgcgcccggggccgcacccuggccgccuuccccgccgagaaggaguccgaguggaaggggccguucuacuucauccucggcgcggacccccaguucgggcugaucaaggccuggagcaccggcgacugcgacaacggcggggacgagugggagcaggagauccggcugacggagcaggccguccaggccaucaacaagcucaaccccaagcccaaguucuucgugcugugcggcgaccugauccacgcgaugccgggggugaaggucguguucuccggccacuaccaccgcaacgccgggggcaccuaccagaaccucgacaugguggucagcuccgccaucggcugccagcuggggcgggacccccacggccugcgcgugguggucgugaccgccgagaagaucgugcaccgguacuacagccucgacgagcuguccgagaaggggaucgaggacgaccugauggaccucaucaagaagaaguga

SEQ ID NO: 28649 - RNA, 1419 nt, Artificial Sequence
  derived and/or modified sequence opt1 from CPQ__Homo_sapiens__NP_057218
augaaguuccugaucuucgccuucuucggcggggugcaccuccugagccugugcuccggcaaggccaucugcaagaacgggaucagcaagcgcaccuucgaggagaucaaggaggagaucgcguccugcggcgacgucgccaaggccaucaucaaccucgccguguacgggaaggcccagaaccggagcuacgagcgccuggcgcugcucguggacaccgucggcccccggcuguccggcagcaagaaccuggagaaggccauccagaucauguaccagaaccuccagcaggacgggcuggagaaggugcaccuggagccggugcgcaucccccacugggagcggggcgaggaguccgccgucaugcucgagccccgcauccacaagaucgccauccuggggcugggcagcuccaucgggacgcccccggagggcaucaccgcggaggugcucguggucaccagcuucgacgagcugcagcggcgcgccuccgaggcccggggcaagaucgugguguacaaccagcccuacaucaacuacagccgcaccguccaguaccggacgcagggggccguggaggccgcgaaggugggcgcccuggccucccucauccgcagcgucgccuccuucagcaucuacagcccccacaccgggauccaggaguaccaggacggcgugcccaagaucccgaccgccugcaucaccguggaggacgcggagaugaugucccggauggccucccacggcaucaagaucgucauccagcugaagaugggggccaagacguaccccgacaccgacagcuucaacaccguggccgagaucaccggcagcaaguaccccgagcaggucgugcugguguccgggcaccucgacagcugggacgugggccagggggccauggacgacggcggcggggcguucaucuccugggaggcccugagccugaucaaggaccucggccugcgccccaagcggacgcugcgccucguccuguggaccgccgaggagcagggcggggugggggccuuccaguacuaccagcugcacaaggucaacaucuccaacuacagccucgugauggaguccgacgccggcaccuuccugccgaccggccugcaguucacggggagcgagaaggcgcgggccaucauggaggaggugaugucccuccugcagccccugaacaucacccagguccucagccacggcgaggggaccgacaucaacuucuggauccaggccggcgugcccggggccucccugcuggacgaccucuacaaguacuucuucuuccaccacagccacggcgacaccaugacggugauggaccccaagcagaugaacgucgcggccgccgugugggccguggucuccuacgugguggccgacauggaggagaugcugccgcgcagcuga

SEQ ID NO: 28650 - RNA, 4521 nt, Artificial Sequence
  derived and/or modified sequence opt1 from CPS1__Homo_sapiens__NP_001116105
augccccagaucaucaagaugacccgcauccugaccgccuucaaggugguccggacgcucaagaccggcuucggguucaccaacgugaccgcccaccagaaguggaaguucagccgcccgggcauccggcugcuguccgugaaggcgcagacggcccacaucguccucgaggacgggaccaagaugaagggcuacagcuucgggcaccccuccagcguggccggcgagguggucuucaacaccggccucgggggcuaccccgaggccaucaccgaccccgccuacaaggggcagauccugacgauggcgaacccgaucaucggcaacgggggcgcccccgacaccaccgcccuggacgagcugggccuguccaaguaccucgagagcaacgggaucaagguguccggccugcuggugcucgacuacagcaaggacuacaaccacuggcuggccaccaagucccuggggcaguggcuccaggaggagaagguccccgcgaucuacggcguggacacgcgcaugcugaccaagaucauccgggacaagggcaccaugcuggggaagaucgaguucgagggccagcccguggacuucgucgacccgaacaagcagaaccucaucgccgaggugagcaccaaggacgugaaggucuacgggaagggcaaccccacgaaggugguggccgucgacugcgggaucaagaacaacgugauccgccugcuggugaagcggggcgccgagguccaccucgugcccuggaaccacgacuucaccaagauggaguacgacggcauccugaucgccgggggccccgggaacccggcgcuggccgagccccucauccagaacgugcgcaagauccuggaguccgaccggaaggagccccuguucggcaucagcaccgggaaccucaucaccggccuggccgccggcgccaagacguacaagauguccauggcgaaccgcgggcagaaccagcccguccugaacaucaccaacaagcaggccuucaucaccgcccagaaccacggcuacgcccucgacaacacccugccggccggguggaagccccuguucgugaacgucaacgaccagacgaacgagggcaucaugcacgagagcaagcccuucuucgcggugcaguuccaccccgaggugaccccggggcccaucgacaccgaguaccucuucgacuccuucuucagccugaucaagaagggcaaggccaccacgaucaccuccguccugcccaagcccgcccucguggccagccggguggaggucuccaaggugcugauccugggcagcgggggccucagcaucgggcaggccggcgaguucgacuacuccggcagccaggcggugaaggccaugaaggaggagaacgucaagaccgugcugaugaacccgaacaucgccuccgugcagaccaacgaggucgggcugaagcaggccgacacgguguacuuccuccccaucacgccccaguucgugaccgaggucaucaaggcggagcagcccgacggccugauccuggggaugggcgggcagaccgcccucaacugcggcguggagcuguucaagcgcggcgugcugaaggaguacggggucaaggugcucggcaccagcguggaguccaucauggccaccgaggaccggcagcuguucagcgacaagcugaacgagaucaacgagaagaucgccccguccuucgccgucgagagcaucgaggacgcgcugaaggccgccgacaccaucggguaccccgugaugauccgcuccgccuacgcccucggcgggcugggcagcggcaucugccccaaccgggagacccugauggaccucuccaccaaggcguucgccaugacgaaccagauccugguggagaaguccgucaccggguggaaggagaucgaguacgagguggugcgcgacgccgacgacaacugcgucaccgugugcaacauggagaacguggacgccaugggcguccacaccggggacagcgugguggucgccccggcgcagacgcugagcaacgccgaguuccagaugcuccggcgcaccuccaucaacguggugcggcaccugggcaucgucggggagugcaacauccaguucgcccugcaccccaccagcauggaguacugcaucaucgaggugaacgcccgccucucccggagcuccgcgcuggccagcaaggccaccggcuacccccuggccuucaucgccgcgaagaucgcccucggcaucccccugccggagaucaagaacguggucagcgggaagacguccgccugcuucgagcccagccuggacuacauggugaccaagaucccccgcugggaccucgaccgcuuccacggcaccuccagccggaucggguccagcaugaaguccgugggcgaggucauggccaucgggcgcaccuucgaggagagcuuccagaaggcccugcggaugugccaccccuccaucgagggcuucacgccgcgccugcccaugaacaaggaguggcccagcaaccucgaccugcggaaggagcuguccgagcccagcuccacccgcaucuacgcgaucgccaaggccaucgacgacaacaugagccucgacgagaucgagaagcugaccuacaucgacaagugguuccuguacaagaugcgggacauccucaacauggagaagacccugaagggccugaacuccgagagcaugacggaggagacccucaagcgcgccaaggagaucggguucuccgacaagcagaucagcaagugccugggccugaccgaggcccagacccgggagcuccgccugaagaagaacauccacccgugggugaagcagaucgacacgcuggcggccgaguaccccagcgugaccaacuaccucuacgucaccuacaacgggcaggagcacgacgugaacuucgacgaccacggcaugauggugcugggcugcgggcccuaccacaucggcuccagcgucgaguucgacuggugcgccguguccagcauccggacccugcgccagcucgggaagaagacgguggucgugaacugcaaccccgagaccgucuccaccgacuucgacgagugcgacaagcuguacuucgaggagcugagccucgagcggauccuggacaucuaccaccaggaggccugcggcgggugcaucaucuccgugggcggccagaucccgaacaaccuggcggugccccucuacaagaacggggucaagaucaugggcaccagcccccugcagaucgaccgcgccgaggaccgguccaucuucagcgccgugcuggacgagcucaagguggcccaggcccccuggaaggcggucaacacgcugaacgaggcccuggaguucgccaaguccguggacuacccgugccuccugcgccccagcuacgugcuguccgggagcgccaugaacgucguguucuccgaggacgagaugaagaaguuccucgaggaggccacccgggugagccaggagcaccccgucgugcugaccaaguucguggagggcgcgcgcgaggucgagauggacgccguggggaaggacggccgggugaucucccacgccaucagcgagcacgucgaggacgccggcgugcacuccggggacgccacccugaugcuccccacgcagaccaucagccagggcgcgaucgagaaggugaaggacgccacccgcaagaucgccaaggccuucgccaucagcgggccguucaacguccaguuccuggugaagggcaacgacgugcuggucaucgagugcaaccuccgcgcgucccggagcuuccccuucguguccaagacccuggggguggacuucaucgacgucgccacgaaggugaugaucggcgagaacguggacgagaagcaccuccccacccuggaccacccgaucauccccgccgacuacgucgccaucaaggcgcccauguucagcuggccccgccugcgggacgccgacccgauccugcgcugcgagauggccuccaccggcgagguggccugcuucggggagggcauccacaccgccuuccucaaggcgaugcugagcaccggguucaagaucccccagaagggcauccugaucggcauccagcaguccuuccggccccgcuuccucgggguggccgagcagcugcacaacgagggcuucaagcuguucgccacggaggccaccagcgacuggcucaacgccaacaacguccccgcgaccccgguggccuggcccucccaggaggggcagaaccccagccuguccagcauccggaagcugauccgcgacggcuccaucgaccucgugaucaaccugcccaacaacaacaccaaguucguccacgacaacuacgugauccggcgcacggccguggacagcgggaucccgcugcucaccaacuuccaggucaccaagcuguucgccgaggccgugcagaagucccggaagguggacagcaagucccuguuccacuaccgccaguacagcgcgggcaaggccgccuga

SEQ ID NO: 28651 - RNA, 4332 nt, Artificial Sequence
  derived and/or modified sequence opt1 from CPSF1__Homo_sapiens__NP_037423
auguacgccguguacaagcaggcccacccgcccaccggccuggaguucagcauguacugcaacuucuucaacaacuccgagcgcaaccucgucguggcggggaccagccagcuguacguguaccggcugaaccgcgacgccgaggcccucacgaagaacgaccgguccaccgagggcaaggcccaccgcgagaagcuggagcuggccgcgagcuucuccuucuucgggaacgucaugagcauggccuccgugcagcucgccggcgccaagcgggacgcgcugcugcucagcuucaaggacgccaagcuguccguggucgaguacgaccccgggacccacgaccugaagacccucagccugcacuacuucgaggagcccgagcugcgcgacggcuucgugcagaacgugcacacgccccggguccgcguggacccggacggccggugcgccgccaugcucguguacgggacccgccuggucgugcugcccuuccggcgcgagucccucgccgaggagcacgagggccuggugggggagggccagcggagcuccuuccugcccagcuacaucaucgacguccgcgcgcucgacgagaagcugcugaacaucaucgaccuccaguuccugcacggguacuacgagcccacccugcucauccuguucgagccgaaccagaccuggcccggccggguggccgugcgccaggacacgugcuccaucgucgccaucagccugaacaucacccagaaggugcaccccgugaucuggucccucaccagccugcccuucgacugcacccaggcccuggccgucccgaagcccaucggcggggugguggucuucgcggugaacucccuccuguaccugaaccagagcgucccgcccuacggcguggcccucaacagccugacgaccgggaccaccgccuucccccugcggacgcaggagggcgugcgcaucacccucgacugcgcccaggccaccuucaucuccuacgacaagauggucaucagccugaagggcggggagaucuacgugcugacccucaucacggacggcaugcgguccgugcgcgcguuccacuucgacaaggccgccgccagcguccugaccaccuccauggugaccauggagcccggguaccuguuccucggcagccggcuggggaacucccugcuccugaaguacacggagaagcugcaggagccgcccgccagcgcggugcgcgaggccgccgacaaggaggagccgcccuccaagaagaagcgcgucgacgccaccgcgggcuggagcgccgccggcaaguccgugccccaggacgagguggacgagaucgaggucuacgggagcgaggcccaguccggcacccagcuggccaccuacagcuucgaggugugcgacuccauccucaacaucgggcccugcgcgaacgccgccgugggcgagcccgccuuccugagcgaggaguuccagaacucccccgagcccgaccuggagaucgucgugugcagcgggcacggcaagaacggcgcccucuccgugcugcagaaguccauccggccccaggucgugacgaccuucgagcugccggggugcuacgacauguggaccgugaucgcgcccguccgcaaggaggaggaggacaaccccaagggcgaggggaccgagcaggagccgagcacgacccccgaggccgacgacgacggccggcgccacggguuccucauccugagccgggaggacagcaccaugauccugcagaccggccaggagaucauggagcucgacacguccggcuucgccacccaggggcccaccguguucgccggcaacaucggggacaaccgcuacaucgugcaggucagcccccugggcauccggcugcucgagggcgugaaccagcugcacuucaucccgguggaccugggggcccccaucguccagugcgcgguggccgaccccuacguggucaucauguccgccgagggccacgugaccauguuccuccucaagagcgacuccuacgggggccgccaccaccggcuggcccugcacaagcccccgcugcaccaccagagcaaggugaucacccugugccucuaccgcgaccuguccgggauguucacgaccgagagccggcugggcggcgcgcgcgacgagcucgggggccgguccgggcccgaggccgagggccuggggagcgagaccucccccaccgucgacgacgaggaggagaugcuguacggcgacagcggcucccucuucagccccuccaaggaggaggcccgccggagcagccagccgcccgccgaccgcgaccccgcccccuuccgggcggagccgacgcacuggugccugcuggugcgcgagaacgggaccauggagaucuaccagcuccccgacuggcggcugguguuccuggucaagaacuuccccgugggccagcgcgugcucgucgacuccagcuucgggcagcccaccacccagggcgaggcccgccgggaggaggccacgcgccagggggagcugccgcuggugaaggaggugcuccuggucgcccugggcucccggcagagccgccccuaccuccuggugcacguggaccaggagcugcucaucuacgaggccuucccccacgacucccagcugggccaggggaaccugaagguccgguucaagaaggugccccacaacaucaacuuccgcgagaagaagccgaagcccagcaagaagaaggcggagggcgggggcgccgaggagggggccggcgcccggggccgcguggcccgguuccgcuacuucgaggacaucuacggguacuccggcgucuucaucugcgggcccagcccgcacuggcuccuggugaccggccggggcgcgcugcgccuccaccccauggccaucgacgggcccguggacuccuucgcccccuuccacaacgucaacugcccgcggggcuuccuguacuucaaccgccagggggagcugcggaucagcgugcuccccgccuaccuguccuacgacgcgcccuggcccguccgcaagaucccgcugcggugcaccgcccacuacguggccuaccacguggagagcaaggucuacgccguggccaccuccacgaacacccccugcgcgcgcaucccccggaugaccggcgaggagaaggaguucgagaccaucgagcgcgacgagcgguacauccacccccagcaggaggccuucagcauccagcucaucuccccggugagcugggaggccauccccaacgcccgcaucgagcugcaggagugggagcacgucacgugcaugaagaccgugucccugcgcagcgaggagaccguguccgggcucaagggcuacgucgccgcggggaccugccugaugcagggcgaggaggugacgugccggggccgcauccugaucauggacgugaucgaggucgugcccgagcccgggcagccgcucaccaagaacaaguucaaggugcuguacgagaaggagcagaagggccccgucaccgcccugugccacugcaacgggcaccucgugagcgccaucggccagaagaucuuccuguggagccugcgggccuccgagcucaccggcauggccuucaucgacacgcagcuguacauccaccagaugaucagcgugaagaacuucauccuggcggccgacgucaugaaguccaucagccuccugcgcuaccaggaggaguccaagacccugagccucgugucccgggacgccaagccccuggagguguacagcgucgacuucaugguggacaacgcccagcugggguuccucguguccgaccgcgaccggaaccugauggucuacauguaccugcccgaggccaaggagagcuucggcgggaugcgccuccugcggcgcgcggacuuccacgugggcgcccacgugaacaccuucuggcggaccccgugccgcggggccacggagggccuguccaagaaguccgucgugugggagaacaagcacaucaccugguucgccacccucgacggcgggaucggccugcugcuccccaugcaggagaagaccuaccggcgccugcugaugcuccagaacgcgcugacgaccaugcugccccaccacgccgggcucaacccccgggccuuccgcaugcugcacguggaccggcgcacccugcagaacgccguccggaacgugcucgacggcgagcugcugaaccgcuaccuguaccucagcaccauggagcgcagcgagcuggccaagaagaucggcacgaccccggacaucauccuggacgaccuccuggagaccgaccgggugaccgcgcacuucuga

SEQ ID NO: 28652 - RNA, 2349 nt, Artificial Sequence
  derived and/or modified sequence opt1 from CPSF2__Homo_sapiens__NP_059133
augaccagcaucaucaagcugaccacgcucuccggcgugcaggaggagagcgcccugugcuaccugcuccaggucgacgaguuccgcuuccugcuggacugcgggugggacgagcacuucuccauggacaucaucgacagccuccggaagcacgugcaccagaucgacgccgugcugcugucccaccccgacccgcuccaccugggcgcgcugcccuacgccgucgggaagcucggccugaacugcgccaucuacgccaccauccccguguacaagauggggcagauguucauguacgaccuguaccagagccgccacaacaccgaggacuucacccucuucacgcuggacgacguggacgccgcguucgacaagauccagcagcugaaguucucccagaucgucaaccucaagggcaagggccacgggcugagcaucacgccccugccggccggccacaugaucgggggcaccaucuggaagaucgugaaggacggggaggaggagaucguguacgccgucgacuucaaccacaagcgggagauccaccucaacggcugcucccuggagaugcugagccgccccucccuccugaucaccgacagcuucaacgccaccuacgugcagccccggcgcaagcagcgggacgagcagcugcucaccaacgugcuggagacccugcgcggcgacgggaacguccucaucgcgguggacaccgccggccgggugcuggagcuggcccagcuccuggaccagaucuggcgcacgaaggacgccgggcugggcgucuacucccucgcccugcugaacaacgugagcuacaacguggucgaguucuccaagagccagguggaguggauguccgacaagcucaugcggugcuucgaggacaagcgcaacaaccccuuccaguuccggcaccugagccugugccacggccucuccgaccuggcgcgcgugccgagccccaaggucgugcuggccagccagcccgaccucgagugcggguucucccgggaccuguucauccaguggugccaggaccccaagaacagcaucauccugaccuaccgcaccaccccgggcacgcucgcccgguuccugaucgacaaccccuccgagaagaucaccgagaucgagcugcgcaagcgggugaagcuggaggggaaggagcucgaggaguaccuggagaaggagaagcugaagaaggaggccgccaagaagcucgagcagagcaaggaggcggacaucgacuccagcgacgaguccgacaucgaggaggacaucgaccagcccagcgcccacaagaccaagcacgaccugaugaugaagggcgaggggucccgcaagggcagcuucuucaagcaggccaagaaguccuaccccauguucccggcccccgaggagcggaucaagugggacgaguacggcgagaucaucaagcccgaggacuuccugguccccgagcuccaggccaccgaggaggagaaguccaagcuggagagcgggcugacgaacggcgacgagccgauggaccaggaccucagcgacgugcccaccaagugcaucuccaccaccgagagcaucgagaucaaggcgcgcgucacguacaucgacuacgaggggcgcuccgacggcgacagcaucaagaagaucaucaaccagaugaagccccggcagcugaucaucgugcacgggcccccggaggccucccaggaccuggccgagugcugccgcgccuucggcggcaaggacaucaagguguacaugcccaagcuccacgagaccgucgacgccaccagcgagacccacaucuaccaggugcggcugaaggacagccugguguccagccuccaguucugcaaggcgaaggacgccgagcuggccuggaucgacgggguccuggacaugcgcguguccaagguggacacgggcgucauccucgaggagggggagcugaaggacgacggcgaggacagcgagaugcaggucgaggcccccuccgacagcuccgugaucgcgcagcagaaggccaugaagucccuguucggggacgacgagaaggagaccggcgaggagagcgagaucauccccacccucgagccgcugccgccccacgaggugcccggccaccagagcguguucaugaacgagccccggcuguccgacuucaagcagguccuccugcgcgaggggauccaggccgaguucgugggcggggugcuggugugcaacaaccaggucgccgugcggcgcaccgagacgggccggaucggccucgaggggugccugugccaggacuucuaccgcauccgggaccugcucuacgagcaguacgccaucguguga

SEQ ID NO: 28653 - RNA, 2055 nt, Artificial Sequence
  derived and/or modified sequence opt1 from CPSF3__Homo_sapiens__NP_057291
augagcgccauccccgccgaggaguccgaccagcugcucauccgcccgcugggcgcggggcaggaggugggccggagcugcaucauccuggaguucaaggggcgcaagaucaugcucgacugcggcauccaccccgggcuggagggcauggacgcccugcccuacaucgaccucaucgaccccgccgagaucgaccugcugcucaucucccacuuccaccuggaccacugcggcgcccugccgugguuccuccagaagaccagcuucaaggggcggaccuucaugacgcacgccaccaaggcgaucuaccgcuggcugcuguccgacuacgucaaggugagcaacaucuccgccgacgacaugcucuacaccgagaccgaccuggaggagagcauggacaagaucgagacgaucaacuuccacgaggugaaggaggucgccggcaucaaguucuggugcuaccacgccgggcacgugcugggcgcggccauguucaugaucgagaucgccggggugaagcuccuguacaccggcgacuucucccggcaggaggaccgccaccugauggccgccgagauccccaacaucaagcccgacauccucaucaucgagagcaccuacggcacccacauccacgagaagcgggaggagcgcgaggcgcgguucugcaacacgguccacgacaucgugaaccgcgggggccgggggcugauccccguguucgcccugggccgcgcccaggagcuccugcugauccucgacgaguacuggcagaaccacccggagcugcacgacauccccaucuacuacgccuccagccuggccaagaagugcauggcggucuaccagaccuacgugaacgccaugaacgacaagauccggaagcagaucaacaucaacaaccccuucguguucaagcacaucuccaaccucaagagcauggaccacuucgacgacaucggccccuccgucgugauggccagcccggggaugaugcaguccggccugagccgcgagcuguucgaguccuggugcaccgacaagcggaacggggugaucaucgccggcuacugcgucgaggggacccucgccaagcacaucaugagcgagcccgaggagaucacgaccaugagcggccagaagcugccccugaagauguccguggacuacaucagcuucuccgcgcacaccgacuaccagcagaccagcgaguucauccgcgcccucaagcccccgcacgugauccugguccacggcgagcagaacgagauggcccggcugaaggccgcccucauccgcgaguacgaggacaacgacgaggugcacaucgaggugcacaacccccggaacacggaggcggucacccugaacuuccgcggggagaagcuggccaaggugaugggcuuccucgccgacaagaagcccgagcaggggcagcggguguccggcauccuggucaagcgcaacuucaacuaccacauccugagccccugcgaccucuccaacuacaccgaccuggccaugagcaccgugaagcagacgcaggcgaucccguacaccgggcccuucaaccugcucugcuaccagcugcagaagcugaccggcgacgucgaggagcuggagauccaggagaagcccgcccucaagguguucaagaacaucaccgugauccaggagcccggcauggucgugcuggaguggcuggccaacccguccaacgacauguacgccgacacggugaccaccgucauccucgaggugcagagcaaccccaagauccgcaagggggccgugcagaaggucuccaagaagcuggagaugcacguguacagcaagcggcuggagaucaugcuccaggacaucuucggcgaggacugcguguccgucaaggacgacagcauccuguccgugaccguggacgggaagacggcgaaccugaaccucgagacccgcaccgucgagugcgaggagggcagcgaggacgacgagucccugcgggagaugguggagcuggccgcccagcgccucuacgaggcccugacccccgugcacuga

SEQ ID NO: 28654 - RNA, 1983 nt, Artificial Sequence
  derived and/or modified sequence opt1 from CPSF3L__Homo_sapiens__XP_011539949
augcccgagauccgcgugaccccgcugggcgccugccccguccucagcuggaaccuggugcugccgcccgggcggggcucccgcgcccccagcuccaccgacacgcggaccggguuccacgugcucccccacggcccccuggggugcggccccgucauccugaugugcggcgcgggguucggccacuucgaguggcucgccgggggcggggccggccaggacgugggccgcagcugcauccugguguccaucgccgggaagaacgucaugcuggacugcggcaugcacaugggguucaacgacgaccggcgcuucccggacuucagcuacaucacccagaacggccggcucaccgacuuccuggacugcgugaucaucucccacuuccaccuggaccacugcggcgcccuccccuacuucagcgagauggugggguacgacggccccaucuacaugacgcaccccacccaggcgaucugcccgauccugcuggaggacuaccgcaagaucgccgucgacaagaagggggaggccaacuucuucaccucccagaugaucaaggacugcaugaagaaggugguggccguccaccuccaccagaccguccagguggacgacgagcuggagaucaaggcguacuacgccggccacgugcugggggccgccauguuccagaucaaggugggcagcgaguccguggucuacacgggcgacuacaacaugacccccgaccggcaccucggggccgcguggaucgacaagugccgccccaaccugcugaucaccgagagcaccuacgccacgaccauccgggacuccaagcgcugccgggagcgcgacuuccucaagaaggugcacgagaccguggagcggggcgggaagguccugauccccguguucgcccugggccgcgcccaggagcucugcauccugcuggagaccuucugggagcggaugaaccucaaggugccgaucuacuucagcacggggcugaccgagaaggccaaccacuacuacaagcuguucauccccuggaccaaccagaagauccgcaagaccuucguccagcggaacauguucgaguucaagcacaucaaggcguucgaccgcgccuucgccgacaaccccggccccaugguggucuucgccacgccgggcaugcuccacgccgggcagucccugcagaucuuccggaagugggcgggcaacgagaagaacauggugaucaugcccggguacugcgugcagggcaccgucgggcacaagauccugagcggccagcgcaagcucgagauggagggccgccaggugcuggaggugaagaugcaggucgaguacauguccuucagcgcccacgccgacgccaaggggaucaugcagcuggugggccaggccgagcccgaguccgugcuccugguccacggggaggcgaagaagauggaguuccugaagcagaagaucgagcaggagcuccgggugaacugcuacaugcccgccaacggcgagaccgugacccugccgacgagccccagcauccccgucggcaucucccuggggcuccugaagcgcgagauggcccagggccugcuccccgaggccaagaagccgcggcugcugcacgggacccucaucaugaaggacagcaacuuccgccugguguccagcgagcaggcgcugaaggagcugggccucgccgagcaccagcugcgguucacgugccgcgugcaccuccacgacacccggaaggagcaggagaccgcccugcgcgucuacucccaccugaaguccgugcugaaggaccacugcgugcagcaccuccccgacgggagcgucaccguggagagcgugcugcugcaggccgccgcgcccuccgaggacccgggcaccaagguccuccuggugagcuggaccuaccaggacgaggagcugggcuccuuccucacgagccugcugaagaaggggcucccccaggcccccuccuga

SEQ ID NO: 28655 - RNA, 735 nt, Artificial Sequence
  derived and/or modified sequence opt1 from CPSF4__Homo_sapiens__NP_001075028
augcaggagaucaucgccagcguggaccacaucaaguucgaccuggagaucgccgucgagcagcagcucggcgcgcagccccugccguuccccgggauggacaaguccggcgccgccgugugcgaguucuuccugaaggccgccugcgggaagggcgggaugugccccuuccgccacaucagcggcgagaagaccguggucugcaagcacuggcuccggggccugugcaagaagggggaccagugcgaguuccugcacgaguacgacaugaccaagaugcccgagugcuacuucuacuccaaguucggcgagugcagcaacaaggagugcccguuccuccacaucgaccccgaguccaagaucaaggacugccccugguacgaccgcggguucugcaagcacggcccccugugccggcaccgccacacccggcgcgugaucugcgugaacuaccuggucggguucugcccggagggccccagcugcaaguucaugcacccccgguucgagcuccccaugggcaccaccgagcagccgccccugccccagcagacccagcccccggcgaagcagcgcacgccccaggugaucggggugaugcagucccagaacagcuccgccggcaaccgggggccccgcccccuggagcaggucacgugcuacaagugcggcgagaagggccacuacgccaaccggugcaccaaggggcaccucgccuuccugagcggccaguga

SEQ ID NO: 28656 - RNA, 1767 nt, Artificial Sequence
  derived and/or modified sequence opt1 from CPSF6__Homo_sapiens__NP_001287876
auggccgacggcguggaccacaucgacaucuacgccgacgucggggaggaguucaaccaggaggcggaguacggcgggcacgaccagaucgaccuguacgacgacgugaucagccccuccgccaacaacggcgacgccccggaggaccgcgacuacauggacacccucccccccaccgugggggacgacgucggcaagggcgccgcccccaacgugguguacacguacaccgggaagcggaucgcgcuguacaucggcaaccugaccugguggaccacggacgaggaccucaccgaggccguccacagccugggggugaacgacauccuggagaucaaguucuucgagaaccgcgccaacggccaguccaagggguucgcccucgugggcgucggcagcgaggcguccagcaagaagcugauggaccugcucccgaagcgggagcugcacgggcagaaccccguggugacccccugcaacaagcaguuccugucccaguucgagaugcagagccgcaagaccacgcaguccggccagaugagcggggagggcaaggccggccccccggggggcuccagccgggccgccuucccccaggggggccgcgggcggggccgcuuccccggcgccguccccgggggcgaccgguucccggggcccgcgggccccgggggccccccgccccccuuccccggcaaccucaucaagcaccuggugaaggggacccgcccgcuguuccucgagacccggauccccuggcacaugggccacuccaucgaggagauccccaucuucgggcugaaggccggccagacccccccgcgccccccccuggggcccccgggcccccccggcccgcccgggccccccccgcccggccaggugcucccccccccgcuggccgggccccccaaccggggcgaccgccccccgccccccguccuguuccccggccagccguucgggcagcccccccucggcccccugccgcccgggccccccccgcccgugcccggcuacgggccgccccccggccccccgcccccccagcagggccccccgcccccccccgggccguuccccccccggcccccgggcccccuggggcccccccucacgcuggccccgcccccccaccugcccggcccgccccccggggcccccccgcccgcgccccacgugaacccggccuucuuccccccccccaccaacagcggcaugccgaccuccgacagccgcggccccccccccaccgacccguacgggcggcccccccccuacgaccgcggcgacuacgggccgcccggccgggagauggacacggcccgcaccccccucuccgaggccgaguucgaggagaucaugaaccggaaccgcgccaucagcuccagcgcgaucagccgcgccgucuccgacgccagcgccggggacuacggcuccgccaucgagacccuggugaccgcgaucagccugaucaagcaguccaaggugagcgccgacgaccggugcaagguccucaucuccagccugcaggacugccugcacggcaucgaguccaagagcuacggguccggcagccgccgggagcgcucccgggagcgcgaccacagccggucccgcgagaagagccggcgccacaagucccggagccgcgaccggcacgacgacuacuaccgcgagcggucccgcgagcgggagcgccaccgggaccgcgaccgcgaccgggaccgcgagcgggaccgcgagcgggaguaccgccaccgguga

SEQ ID NO: 28657 - RNA, 1416 nt, Artificial Sequence
  derived and/or modified sequence opt1 from CPSF7__Homo_sapiens__NP_001129512
augagcgagggcguggaccugaucgacaucuacgccgacgaggaguucaaccaggaccccgaguucaacaacaccgaccagaucgaccucuacgacgacguccugaccgccacgucccagccgagcgacgaccgcuccagcuccaccgagcccccccccccggugcggcaggagcccagccccaagcccaacaacaagaccccggcgauccuguacaccuacuccgggcuccgcaaccggcgcgccgccguguacgucggcagcuucuccugguggacgaccgaccagcagcugauccaggugauccggagcaucgggguguacgacgucguggagcugaaguucgccgagaaccgcgccaacggccaguccaagggguacgcggagguggucguggccagcgagaacuccgugcacaagcuccuggagcugcuccccggcaagguccugaacggcgagaagguggacgugcggcccgccacccgccagaaccugagccaguucgaggcccaggcgcggaagcgcgagugcguccgggugccccgcgggggcaucccgccccgggcccacucccgcgacagcuccgacagcgccgacgggcgggccacccccuccgagaaccucgugcccagcagcgcccgcgucgacaagccgcccuccgugcugcccuacuucaaccggcccccgagcgcgcugccccucaugggccugccccccccgcccaucccccccccgcccccccuguccagcuccuucggggugccgcccccccccccgggcauccacuaccagcaccucaugcccccccccccgcgccugcccccccaccuggccguccccccgcccggcgccaucccccccgcccuccaccugaacccggccuucuuccccccccccaacgcgacgguggggccgccccccgacaccuacaugaaggccagcgcccccuacaaccaccacggcucccgggacagcgggccgccccccuccaccgugagcgaggccgaguucgaggacaucaugaagcgcaaccgggccaucuccagcuccgcgaucagcaaggccgucuccggcgccagcgccggcgacuacuccgacgccaucgagacccugcucacggcgaucgccgugaucaagcagagccgcgucgccaacgacgagcgcugccgggugcugaucuccagccugaaggacugccuccacgggaucgaggccaagagcuacuccgugggcgcgagcggguccagcucccgcaagcggcaccgcagccgggagcgcuccccgagccggucccgcgagagcucccggcgccaccgggaccugcugcacaacgaggaccgccacgacgacuacuuccaggagcggaaccgcgagcacgagcggcaccgcgaccgggagcgcgaccggcaccacuga

SEQ ID NO: 28658 - RNA, 2418 nt, Artificial Sequence
  derived and/or modified sequence opt1 from CPT1A__Homo_sapiens__XP_005273819
augcagcaccugagcuccgaggcccucagcaccgagcugagcccccagcugggcaccgccgggcucgaccugccgacggagcgcuacucccugaagauggcggaggcccaccaggccguggccuuccaguucaccgucacccccgacggcaucgaccuccggcugucccacgaggcccugcgccagaucuaccucagcgggcugcacuccuggaagaagaaguucauccgguucaagaacggcaucaucaccgggguguaccccgcgagccccuccagcuggcugaucguggucgugggcgugaugacgaccauguacgccaagaucgacccgucccucggcaucaucgccaagaucaaccgcacccuggagaccgccaacugcaugagcucccagacgaagaacgucgugagcggggugcuguucggcaccgggcucugggucgcgcugaucgugaccaugcgguacucccugaaggugcuccugagcuaccacggcuggauguucaccgagcacgggaagaugucccgcgccacgaagaucuggaugggcauggucaagaucuucagcggccggaagcccaugcuguacuccuuccagaccagccucccccgccugcccgugccggccgugaaggacaccgucaaccgguaccugcagagcgugcgcccccucaugaaggaggaggacuucaagcggaugaccgcccuggcccaggacuucgcgguggggcugggcccccgccuccagugguaccugaagcugaaguccuggugggccacgaacuacgucagcgacuggugggaggaguacaucuaccuccgggggcgcggcccccugauggugaacuccaacuacuacgccauggaccugcucuacauccugccgacccacauccaggccgcccgggcgggcaacgccauccacgccauccugcucuaccgccggaagcuggaccgcgaggagaucaagcccauccggcugcucgggagcaccaucccccugugcuccgcccagugggagcgcauguucaacaccagccggauccccggcgaggagacggacaccauccagcacaugcgcgacuccaagcacaucguggucuaccaccgcgggcgguacuucaagguguggcuguaccacgacggccgccuccugaagccgcgggagauggagcagcagaugcagcgcauccuggacaacaccagcgagccccagcccggggaggcccggcucgcggcccugaccgccggcgaccgcgugcccugggcccggugccgccaggccuacuucggccgggggaagaacaagcagucccuggacgcggucgagaaggccgccuucuucgugacgcucgacgagaccgaggagggcuaccgcagcgaggacccggacaccuccauggacagcuacgccaagucccugcugcacgggcggugcuacgaccgcugguucgacaagagcuucaccuucgucguguucaagaacggcaagauggggcugaacgcggagcacuccugggccgacgcccccaucguggcccaccucugggaguacgucaugagcaucgacucccugcagcugggcuacgccgaggacggccacugcaagggggacaucaaccccaacauccccuacccgacgcggcuccagugggacauccccggcgagugccaggaggugaucgagaccagccugaacaccgcgaaccugcucgccaacgacguggacuuccacuccuuccccuucgucgccuucgggaagggcaucaucaagaagugccgcaccagccccgacgccuucgugcagcuggcccugcagcucgcgcacuacaaggacauggggaaguucugccugacguacgaggccagcaugacccggcuguuccgcgagggccggaccgagaccgugcgcuccugcacgaccgagagcugcgacuucguccgggccaugguggacccggcccagaccguggagcagcgccucaagcuguucaagcuggccuccgagaagcaccagcacauguaccgccucgcgaugaccggcagcgggaucgaccggcaccuguucugccuguacgucguguccaaguaccucgccguggagagccccuuccugaaggagguccuguccgagcccuggcgccucagcaccucccagacgccgcagcagcaggucgagcuguucgaccuggagaacaaccccgaguacgugagcuccggcgggggcuucggccccguggccgacgacggguacggcgugagcuacauccucgugggggagaaccugaucaacuuccacaucuccagcaaguucuccugccccgagaccgacagccaccgguucggccgccaccugaaggaggccaugaccgacaucaucacccucuucgggcuguccagcaacagcaagaaguga

SEQ ID NO: 28659 - RNA, 2217 nt, Artificial Sequence
  derived and/or modified sequence opt1 from CPT1B__Homo_sapiens__NP_001138606
auggccgaggcccaccaggcgguggccuuccaguucaccgucacccccgacggcguggacuuccgccugagccgggaggcccucaagcacguguaccuguccgggaucaacagcuggaagaagcgccugauccggaucaagaacggcauccuccgcggggucuacccgggcucccccacgagcuggcugguggugaucauggccaccgucggguccagcuucugcaacguggacaucucccugggccucgugagcugcauccagcggugccugccccagggcugcgggcccuaccagaccccgcagacccgcgcccugcucuccauggcgaucuucagcacgggcgucugggugaccgggaucuucuucuuccggcagacccugaagcugcuccugugcuaccacggcuggauguucgagaugcacgggaagaccuccaaccugacgcgcaucugggccuaccucgagagcgugcggccccugcuggacgacgaggaguacuaccgcauggagcuccuggccaaggaguuccaggacaagaccgcgccccggcugcagaaguaccucguccugaaguccuggugggcgagcaacuacguguccgacuggugggaggaguacaucuaccugcgcggccggagcccccucauggugaacuccaacuacuacgucauggaccuggugcugaucaagaacaccgacgugcaggccgcccgccucggcaacaucauccacgccaugaucauguaccggcgcaagcuggaccgggaggagaucaagccggucauggcccuggggaucgugcccaugugcagcuaccagauggagcgcauguucaacaccacgcggauccccggcaaggacaccgacgugcuccagcaccuguccgacagccgccacgucgcgguguaccacaaggggcgguucuucaagcuguggcucuacgagggcgcccgccugcugaagccccaggaccucgagaugcaguuccagcgcauccuggacgacccgagcccgccccagcccggcgaggagaagcuggccgcccucaccgccgggggccggguggagugggcgcaggcccgccaggccuucuucuccagcgggaagaacaaggccgcccuggaggcgaucgagcgggccgccuucuucgucgcccuggacgaggaguccuacagcuacgaccccgaggacgaggccucccucagccuguacggcaaggcgcugcuccacgggaacugcuacaaccgcugguucgacaaguccuucacccugaucagcuucaagaacggccagcugggccucaacgccgagcacgccugggccgacgcgcccaucaucgggcaccugugggaguucgugcugggcacggacuccuuccaccugggguacaccgagaccggccacugccucgggaagcccaaccccgcccuggccccgcccacccggcugcagugggacauccccaagcagugccaggccgucaucgagagcuccuaccagguggccaaggcgcucgccgacgacguggagcuguacugcuuccaguuccugcccuucggcaagggccucaucaagaagugccgcacgagcccggacgccuucguccagaucgcccugcagcuggcccacuuccgggaccgcgggaaguucugccucaccuacgaggcguccaugacccggauguuccgcgagggccggaccgagacggugcgcagcugcaccuccgagagcaccgccuucgugcaggccaugauggaggggucccacaccaaggccgaccugcgggaccuguuccagaaggccgcgaagaagcaccagaacauguaccgccucgccaugacgggcgccgggaucgaccggcaccuguucugccuguaccucgucagcaaguaccugggcguguccagccccuuccuggccgaggugcucagcgagcccuggcgccuguccaccagccagaucccccagucccagauccggauguucgacccggagcagcaccccaaccaccugggcgccgggggcggguucggccccgucgccgacgacggcuacggggugagcuacaugaucgccggcgagaacaccaucuucuuccacaucuccagcaaguucuccagcuccgagaccaacgcccagcgcuucgggaaccacauccggaaggcccuccuggacaucgcggaccuguuccaggugccgaaggccuacagcuga

SEQ ID NO: 28660 - RNA, 2379 nt, Artificial Sequence
  derived and/or modified sequence opt1 from CPT1C__Homo_sapiens__NP_001129524
auggccgaggcccaccaggcggugggcuuccgccccagccugaccuccgacggggccgaggucgagcucagcgccccggugcugcaggagaucuaccuguccggccuccggagcuggaagcgccaccugucccgguucuggaacgacuuccugaccgggguguuccccgccagcccccucuccuggcuguuccuguucagcgccauccagcucgcgugguuccugcagcuggaccccucccucggccugauggagaagaucaaggagcugcucccggacuggggcgggcagcaccacggccugcgcgggguccuggccgccgcccucuucgcgagcugccuguggggcgcccugaucuucacgcuccacguggcccugcggcugcuccuguccuaccacggguggcugcucgagccccacggcgccaugagcucccccaccaagaccuggcuggcccuggugcgcaucuucagcgggcggcaccccaugcuguucuccuaccagcgcagccugccgcggcagcccguccccuccgugcaggacaccgugcgcaaguaccuggagagcguccggcccauccucuccgacgaggacuucgacuggacggcggugcuggcccaggaguuccugcgccuccaggccagccugcugcagugguaccuccggcucaagagcuggugggccuccaacuacgugagcgacuggugggaggaguucgucuaccugcgcucccggaacccgcucauggugaacagcaacuacuacaugauggccgcgcgcgccggcaacgccgugcacgcccugcugcucuaccggcaccgccugaaccggcaggagaucccgcccacccugcucaugggcaugcgcccccugugcuccgcccaguacgagaagaucuucaacaccacccggauccccgggguccagaaggacuacauccgccaccuccacgacagccagcacguggcgguguuccaccgcggccgguucuuccgcauggggacgcacucccggaacagccugcugagcccccgcgcccuggagcagcaguuccagcggauccuggacgaccccagccccgccugcccgcacgaggagcaccucgccgcccugaccgcggcgccccgcggcaccugggcccagguccggaccucccugaagacgcaggccgccgaggcccucgaggccguggagggcgccgccuucuucgugagccuggacgcggagcccgccgggcugacccgcgaggaccccgccgccucccucgacgccuacgcgcacgcccugcuggccggccgggggcacgaccgcugguucgacaagagcuucacccucaucgucuucuccaacggcaagcuggggcugagcguggagcacuccugggccgacugcccgaucagcggccacaugugggaguucacccucgccacggagugcuuccagcugggcuacuccaccgacgggcacugcaagggccaccccgaccccacccugccccagccgcagcggcuccagugggaccugcccgaccagauccacagcagcaucucccuggcgcuccgcggggccaagauccugagcgagaacguggacugccacgucgugcccuucucccuguucggcaagagcuucauccggcgcugccaccucuccagcgacuccuucauccagaucgcccugcagcuggcccacuuccgggaccgcgggcaguucugccucaccuacgagagcgcgaugacgcggcuguuccuggagggccgcaccgagaccguccgguccugcacccgcgaggccugcaacuucgugcgcgccauggaggacaaggagaagacggacccgcagugccucgcccuguuccggguggccgucgacaagcaccaggcgcugcucaaggccgccaugagcggccaggggguggaccgccaccuguucgcccuguacaucgugucccgguuccuccaccuccagagccccuuccugacccagguccacuccgagcaguggcagcugagcaccucccagauccccgugcagcagaugcaccuguucgacgugcacaacuaccccgacuacgucagcuccggcgggggcuucgggccggccgacgaccacggcuacggcgugagcuacaucuucaugggggacggcaugaucaccuuccacaucagcuccaagaaguccuccacgaagaccgacagccaccgccuggggcagcacaucgaggacgcgcuccuggacguggccucccuguuccaggccggccagcacuucaagcggcgcuuccggggcagcgggaaggagaacucccgccaccggugcggcuuccucagccgccagaccggggccuccaaggccagcaugaccuccacggacuucuga

SEQ ID NO: 28661 - RNA, 1431 nt, Artificial Sequence
  derived and/or modified sequence opt1 from CPVL__Homo_sapiens__XP_011513739
auggugggcgccauguggaaggucaucgugagccuggugcuccugaugcccgggccgugcgacggccuguuccgcucccucuaccggagcgucuccaugccgcccaagggggacagcggccagccccuguuccugacccccuacaucgaggccgggaagauccagaagggccgcgagcucucccuggugggccccuuccccgggcugaacaugaaguccuacgcgggcuuccucaccgugaacaagacguacaacagcaaccuguucuucugguucuuccccgcccagauccagccggaggacgcccccgucgugcuguggcuccagggcgggcccgggggcagcuccauguucggccuguucguggagcacgggcccuacgucgugaccagcaacaugacccugcgggaccgcgacuucccguggaccacgacccucuccaugcuguacaucgacaaccccgugggcaccggguucagcuucaccgacgacacgcacggcuacgccgucaacgaggacgacguggcccgggaccuguacuccgcgcucauccaguucuuccagaucuuccccgaguacaagaacaacgacuucuacgugaccggcgagagcuacgccgggaaguacguccccgccaucgcccaccugauccacucccugaacccggugcgcgaggugaagaucaaccucaacggcaucgcgaucggggacggcuacagcgaccccgaguccaucaucgggggcuacgccgaguuccuguaccagaucggccugcucgacgagaagcagaagaaguacuuccagaagcagugccacgagugcaucgagcacauccggaagcagaacugguucgaggccuucgagauccuggacaagcugcucgacggggaccugaccagcgaccccuccuacuuccagaacgucaccggcugcagcaacuacuacaacuuccugcgcugcacggagcccgaggaccagcucuacuacgugaaguuccugagccugccggaggugcggcaggccauccacgucgggaaccagaccuucaacgacggcaccaucguggagaaguaccuccgcgaggacaccgugcaguccgucaagcccuggcugacggagaucaugaacaacuacaaggugcugaucuacaacgggcagcucgacaucaucgucgccgcggcccugaccgagcggagccugaugggcauggacuggaagggcucccaggaguacaagaaggccgagaagaagguguggaagaucuucaagagcgacuccgagguggccggguacauccgccaggccggcgacuuccaccaggucaucauccgcgggggcgggcacauccuccccuacgaccagccccugcgggcguucgacaugaucaaccgguucaucuacggcaagggcugggacccguacgugggguga

SEQ ID NO: 28662 - RNA, 906 nt, Artificial Sequence
  derived and/or modified sequence opt1 from CPXCR1__Homo_sapiens__NP_001171700
augagcucccccaccaaggagggcagcgacaccgccgggaacgcccacaagaacuccgagaacgagccgcccaacgacugcagcacggacaucgagucccccagcgcggaccccaacaugaucuaccagguggagaccaacccgaucaaccgcgagcccggcaccgccaccucccaggaggacgucgugccccaggccgccgagaacagcgagcuggagacggagauccagaaggaccagcgggaggaggaccucaaggaggagcugcugcuccugcagacccccaucccgcgcaagcuggugucccacaagccccucaacgaccggagccgcucccacagcgggaaggucgagaugaaggccaacaacuuccccaucaaccacaagacccgguuccgccuguccaccagcuggcgggugcccuucaucaacucccacgagauccgcagcaugauccugcaccuccugugcgaccgguacuucucccaggcggccggcugccagaacacgaugugggugaagcgcaaguacaucgccugccuguaccacccgaacagcuucacccaccacgagcgggccaucaccuuccgccggcccucccgcguccacuacuaccggccccucaccgagcgcaugacgagcgggaaguucugcaagagcaccgacaccaagggcaagugccgguuccgcgcgaucgugcgguccgugcuguucgucagccagauccagaucgaguccaucuucaacaucaagggcuucguggacauccugaccuacauccacacgaugaacgugaugaucaccaacaccaacaacggguggaaguacuucugccccaucugcggccgccucuucaacaccuacagcgagcugcggcagcacuccugcagcuccagcgggaacuga

SEQ ID NO: 28663 - RNA, 1959 nt, Artificial Sequence
  derived and/or modified sequence opt1 from CPZ__Homo_sapiens__NP_001014447
augcccccgcccccgccccugcuccugcugaccgugcucgucguggccgccgcgcgccccggcugcgaguucgagcggaaccccgccggggagugccaccgcccgcccgccgccgacagcgcgaccugcguggaccugcagcugcggacgugcuccgacgccgccuacaaccacaccaccuuccccaaccuccugcagcaccgcagcugggaggucguggaggccuccagcgaguacauccugcucuccgugcugcaccagcugcucgagggccagugcaaccccgaccugcggcugcucgggugcgccguccuggcgccccgcugcgagggcgggugggugcggcgccccugccggcacaucugcgagggccugcgcgaggugugccagccggccuucgacgccaucgacauggccuggcccuacuuccucgacugccaccgguacuucacccgcgaggacgagggcugcuacgacccccuggagaagcugcgcgggggccucgaggccgacgaggcgcugcccagcgggcugccgcccacguucauccgguucucccaccacagcuacgcccagaugguccgggugcuccgccggaccgccucccgcugcgcccacguggcccggaccuacagcaucggccgcuccuucgacgggcgggagcugcuggucaucgaguucagcucccgccccggccagcacgagcucauggagcccgaggugaagcugaucggcaacauccacgggaacgagguggcgggccgcgagaugcugaucuaccucgcccaguaccugugcagcgaguaccugcucgggaacccgcggauccagcgccugcugaacaccacgcggauccaccuccugcccuccaugaaccccgacggcuacgaggucgccgccgccgagggcgcgggguacaacggcuggaccagcgggcgccagaacgcccagaaccuggaccucaaccggaacuuccccgaccugaccuccgaguacuaccgccuggccgagacccggggcgcccgcagcgaccacaucccgaucccccagcacuacuggugggggaagguggcccccgagacgaaggcgaucaugaaguggaugcagaccauccccuucgugcucuccgccagccugcacggcggcgaccuggucgugagcuacccguucgacuucuccaagcacccccaggaggagaagauguucagccccaccccggacgagaagauguucaagcuccugucccgggccuacgccgacgugcaccccaugaugauggaccgcagcgagaaccggugcgggggcaacuuccugaagcgcggguccaucaucaacggcgcggacugguacagcuucaccgggggcauguccgacuucaacuaccuccacacgaacugcuucgagaucaccgucgagcugggcugcgugaaguucccgcccgaggaggcccuguacacccuguggcagcacaacaaggagagccuccugaacuucguggagaccguccaccgggggaucaagggcguggucacggacaaguucgggaagcccgugaagaacgcccgcaucuccgugaagggcauccggcacgacaucaccaccgcccccgacggggacuacuggcgccugcucccgcccggcauccacaucgucaucgcccaggcgcccggcuacgccaaggugaucaagaaggugaucauccccgcccggaugaagcgcgccgggcgggucgacuucauccugcagccccugggcauggggcccaagaacuucauccacggccuccgccgcaccggcccgcacgacccccucgggggcgccagcucccugggggaggcgacggagcccgacccccugcgggcccgccggcagccgagcgccgacggcuccaagcccuggugguggagcuacuucaccucccugagcacccaccgcccccgguggcugcucaaguacuga

SEQ ID NO: 28664 - RNA, 6120 nt, Artificial Sequence
  derived and/or modified sequence opt1 from CR1__Homo_sapiens__NP_000564
augggcgccagcuccccccgcagcccggagcccguggggccccccgccccgggccugcccuucugcugcgggggcucccuccuggcggucguggugcugcucgcccugcccgucgccugggggcagugcaacgcccccgaguggcugccguucgcccggcccaccaaccucaccgacgaguucgaguuccccaucggcacguaccugaacuacgagugccgccccggcuacagcgggcggccguucuccaucaucugccugaagaacagcguguggaccggcgcgaaggaccgcugccggcgcaaguccugccggaacccccccgaccccgugaacgggaugguccacgugaucaagggcauccaguucgggagccagaucaaguacuccugcaccaagggcuaccgccucaucggcagcuccagcgccaccugcaucaucuccggggacacggugaucugggacaacgagaccccgaucugcgaccggauccccugcggccugccccccaccaucaccaacggggacuucaucagcacgaaccgcgagaacuuccacuacggcuccgucgugaccuaccggugcaacccgggcagcgggggccgcaagguguucgagcuggucggggagcccuccaucuacugcaccagcaacgacgaccaggugggcaucugguccgggcccgccccccagugcaucaucccgaacaagugcaccccccccaacguggagaacggcauccucgucagcgacaaccggagccuguucucccugaacgaggugguggaguuccgcugccagcccggcuucgucaugaaggggccgcggcgcgugaagugccaggcccucaacaagugggagcccgagcugcccagcugcucccgggugugccagccgccccccgacguccugcacgcggagcgcacgcagcgggacaaggacaacuucagccccggccaggagguguucuacuccugcgagccgggguacgaccuccgcggcgccgccagcaugcggugcaccccccagggggacuggucccccgccgcccccaccugcgaggugaagagcugcgacgacuucaugggccagcugcugaacggccgcguccucuucccggugaaccugcagcugggggcgaaggucgacuucgugugcgacgagggcuuccagcucaagggguccagcgccuccuacugcgugcuggccggcauggagagccuguggaacuccagcguccccgugugcgagcagaucuucugccccucccccccggugauccccaacgggcgccacaccggcaagccccucgaggucuuccccuucggcaagacggugaacuacaccugcgacccgcaccccgaccgggggaccagcuucgaccugaucggcgaguccaccauccgcugcacgagcgacccccaggggaacggcgugugguccagccccgccccgcggugcggcauccuggggcacugccaggcccccgaccacuuccucuucgcgaagcugaagacccagaccaacgccagcgacuuccccaucggcaccucccugaaguacgagugccgccccgaguacuacgggcggccguucagcaucacgugccucgacaaccuggucugguccagccccaaggacgugugcaagcgcaaguccugcaagacccccccggaccccgugaacggcaugguccacgugaucaccgacauccagguggggagccggaucaacuacuccugcaccacgggccaccgccugaucggccacagcuccgccgagugcauccucagcgggaacgccgcccacugguccaccaagccccccaucugccagcggaucccgugcggccugccccccaccaucgcgaacggggacuucaucagcaccaaccgcgagaacuuccacuacggcuccgucgugacguaccggugcaaccccgggagcggcggccgcaagguguucgagcuggucggggagccguccaucuacugcaccagcaacgacgaccaggugggcaucugguccgggcccgccccccagugcaucauccccaacaagugcaccccgcccaacguggagaacggcauccucgucagcgacaaccggagccuguucucccugaacgaggugguggaguuccgcugccagcccggguucgucaugaagggcccccggcgcgugaagugccaggcccucaacaagugggagccggagcugcccagcugcucccgggugugccagccccccccggacguccugcacgccgagcgcacccagcgggacaaggacaacuucagccccggccaggagguguucuacuccugcgagcccggguacgaccuccgcggcgccgcgagcaugcgcugcacgccccagggggacugguccccggccgcccccaccugcgaggugaagagcugcgacgacuucaugggccagcugcugaacgggcggguccucuuccccgugaaccugcagcugggcgccaagguggacuucgucugcgacgagggcuuccagcugaagggguccagcgcguccuacugcgugcucgccggcauggagagccuguggaacuccagcgugcccgucugcgagcagaucuucugcccguccccccccgugaucccgaacgggcgccacaccggcaagccccuggagguguuccccuucggcaaggccgucaacuacaccugcgacccccacccggaccgggggaccagcuucgaccucaucggcgaguccacgauccgcugcaccagcgacccccaggggaacggcgugugguccagccccgccccccggugcgggauccugggccacugccaggccccggaccacuuccuguucgcgaagcucaagacccagaccaacgccagcgacuuccccaucggcacgucccugaaguacgagugccgccccgaguacuacgggcggcccuucagcaucaccugccuggacaaccucgugugguccagcccgaaggacgucugcaagcgcaaguccugcaagaccccccccgaccccgugaacggcauggugcacgucaucaccgacauccagguggggagccggaucaacuacuccugcacgaccggccaccgccugaucgggcacagcuccgccgagugcauccugagcggcaacaccgcccacugguccaccaagccgcccaucugccagcggauccccugcggccuccccccgacgaucgccaacggggacuucaucagcaccaaccgcgagaacuuccacuacggcuccguggucaccuaccggugcaaccuggggagccgcggccggaagguguucgagcuggugggggagcccuccaucuacugcaccagcaacgacgaccaggucggcaucugguccggccccgcgccccagugcaucaucccgaacaagugcacgccccccaacguggagaacgggauccucgucagcgacaaccgcucccuguucagccugaacgaggugguggaguuccggugccagcccggcuucgucaugaaggggccgcgccgggugaagugccaggcccucaacaagugggagcccgagcugcccagcugcucccgcgugugccagccgccccccgagauccugcacggcgagcacacccccagccaccaggacaacuucuccccgggccaggaggucuucuacagcugcgagcccggguacgaccuccggggcgccgccucccugcacugcaccccccagggggacuggagccccgaggccccgcgcugcgcggugaaguccugcgacgacuuccugggccagcucccccacgggcgcgugcuguucccccugaaccuccagcugggcgccaaggucagcuucgugugcgacgagggcuuccggcugaagggguccagcgugucccacugcguccucgugggcaugcgcagccuguggaacaacuccgugcccgucugcgagcacaucuucugcccgaacccccccgccauccugaacgggcggcacaccggcacgcccagcggggacaucccguacggcaaggagaucuccuacaccugcgacccccaccccgaccgcggcaugaccuucaaccucaucggggagagcaccauccggugcacguccgacccccacggcaacgggguguggagcuccccggccccccgcugcgagcugagcgugcgggcgggccacugcaagacccccgagcaguuccccuucgccagcccgaccauccccaucaacgacuucgaguuccccgucgggaccucccugaacuacgagugccgcccgggcuacuucggcaagauguucagcaucuccugccucgagaaccugguguggagcuccguggaggacaacugccggcgcaagagcugcgggcccccccccgagccguucaacggcaugguccacaucaacacggacacccaguucggguccaccgugaacuacagcugcaacgagggcuuccggcugaucgggucccccagcaccacgugccucguguccggcaacaacgucaccugggacaagaaggcccccaucugcgagaucaucagcugcgagcccccgcccaccaucuccaacggcgacuucuacagcaacaaccgcaccuccuuccacaacgggacgguggugaccuaccagugccacaccggccccgacggggagcagcuguucgagcuggucggcgagcggagcaucuacugcaccuccaaggacgaccaggugggcguguggagcucccccccgccccgcugcaucagcaccaacaagugcacggcccccgaggucgagaacgccauccgggugcccgggaaccgcagcuucuucacccucaccgagaucauccgguuccgcugccagccgggcuucgugauggucgggucccacaccgugcagugccagacgaacggccggugggggcccaagcugccccacugcagccgcgugugccagcccccgcccgagauccugcacggcgagcacacccucucccaccaggacaacuucagccccggccaggaggucuucuacuccugcgagcccagcuacgaccugcgcggggcggccucccugcacugcaccccgcagggcgacuggagccccgaggccccccggugcaccgugaaguccugcgacgacuuccucgggcagcugccccacggccgcgugcugcucccgcugaaccugcagcucggggccaaggucagcuucgugugcgacgagggcuuccggcugaagggccgcuccgccagccacugcgugcuggcggggaugaaggcccucuggaacuccagcguccccgugugcgagcagaucuucugccccaacccgcccgccauccugaacggccggcacacggggacccccuucggcgacauccccuacgggaaggagaucuccuacgccugcgacacccacccggaccgcggcaugaccuucaaccugaucggcgagagcuccauccggugcacgagcgacccccaggggaacggcgugugguccagccccgccccccgcugcgagcucagcgucccggcggccugcccccacccccccaagauccagaacgggcacuacaucggcgggcacgugucccuguaccugccgggcaugaccaucagcuacaucugcgaccccggcuaccuccugguggggaagggcuucaucuucugcaccgaccaggggaucuggucccagcuggaccacuacugcaaggaggucaacugcagcuucccccucuucaugaacggcaucuccaaggagcuggagaugaagaagguguaccacuacggcgacuacgugacccugaagugcgaggacggguacacgcucgagggcagccccuggucccagugccaggccgacgaccggugggacccgccccuggccaagugcaccagccgcacccacgacgcgcugaucgucgggacccucuccggcacgaucuucuucauccugcugaucaucuuccucagcuggaucauccugaagcaccggaaggggaacaacgcccacgagaaccccaaggagguggccauccaccugcacucccagggcggcagcuccguccacccccgcacccuccagaccaacgaggagaacagccgggugcugccguga

SEQ ID NO: 28665 - RNA, 3279 nt, Artificial Sequence
  derived and/or modified sequence opt1 from CR2__Homo_sapiens__NP_001006659
augggcgccgccgggcugcucggcguguuccuggcgcuggucgcccccggggugcucggcaucagcugcggguccccgccccccauccugaacggccgcaucagcuacuacuccacccccaucgccgugggcaccgucauccgguacagcugcuccgggacguuccgccugaucggcgagaagagccuccugugcaucaccaaggacaagguggacgggaccugggacaagccggcccccaagugcgaguacuucaacaaguacuccagcugccccgagcccaucgugccgggcggguacaagauccggggcuccacccccuaccgccacggcgacagcgucacguucgccugcaagaccaacuucuccaugaacgggaacaagagcguguggugccaggcgaacaacauguggggccccacccggcugcccaccugcguguccgucuucccgcucgagugccccgcccugcccaugauccacaacgggcaccacacgagcgagaacgugggcuccaucgcccccggccugagcgugaccuacuccugcgagagcggguaccuccuggucggcgagaagaucaucaacugccuguccagcgggaaguggagcgccgugccgcccaccugcgaggaggcgcgcugcaagucccucggccgguuccccaacgggaaggugaaggagcccccgauccugcgcgucggcgugaccgccaacuucuucugcgacgagggcuaccggcugcaggggccccccagcucccgcugcgugaucgccggccagggggucgccuggacgaagaugcccgugugcgaggagaucuucugcccgagccccccccccauccucaacggccggcacaucgggaacucccuggccaacgugagcuacggcuccaucgucaccuacaccugcgacccggaccccgaggagggcgugaacuucauccugaucggggagagcacccuccgcugcacgguggacucccagaagaccggcaccuggagcgggcccgcgccgcggugcgagcuguccaccagcgccguccagugcccccacccccagauccugcgcggccggaugguguccgggcagaaggaccgcuacacguacaacgacaccgucaucuucgccugcauguucggcuucacccucaagggcagcaagcagauccggugcaacgcccaggggaccugggagcccuccgccccggugugcgagaaggagugccaggcgccccccaacauccugaacggccagaaggaggaccgccacauggugcgguucgaccccgggacgagcaucaaguacuccugcaacccgggcuacguccuggugggcgaggagagcauccagugcaccuccgaggggguguggaccccccccgucccccagugcaagguggccgccugcgaggccaccggccgccagcuccugacgaagccgcagcaccaguucgugcggcccgacgucaacagcagcugcggggagggcuacaagcuguccgggagcguguaccaggagugccagggcaccauccccugguucauggagauccgccucugcaaggagaucaccugccccccgccccccgugaucuacaacggcgcccacaccggguccagccuggaggacuuccccuacggcacgaccgucaccuacaccugcaacccggggcccgagcgcggcguggaguucucccugaucggggagagcacgauccggugcaccuccaacgaccaggagcgcggcaccuggagcggccccgcgccccucugcaagcugucccugcucgccgugcagugcagccacguccacaucgccaacggguacaagaucuccggcaaggaggccccguacuucuacaacgacaccgugaccuucaagugcuacagcggguucacgcugaagggcuccagccagauccggugcaaggccgacaacaccugggaccccgagauccccgugugcgagaaggggugccaguccccgcccggccugcaccacggccgccacaccgggggcaacaccgucuucuucgugagcgggaugacgguggacuacaccugcgaccccggcuaccuccuggucgggaacaaguccauccacugcaugcccagcggcaacuggagcccguccgcgccccggugcgaggagaccugccagcacgugcgccagagccugcaggagcuccccgccggcucccggguggagcuggucaacaccagcugccaggacggguaccagcugacgggccacgccuaccagaugugccaggacgccgagaacgggaucugguucaagaagaucccccucugcaaggugauccacugccacccgccccccgugaucgucaacggcaagcacaccggcaugauggcggagaacuuccuguacgggaacgagguguccuacgagugcgaccagggcuucuaccugcucggggagaagaagcugcagugccgcagcgacuccaagggccacgggagcugguccggccccagcccgcagugccugcgguccccccccgugacccgcugccccaacccggaggucaagcacggcuacaagcugaacaagacccacagcgccuacucccacaacgacaucguguacguggacugcaaccccggguucaucaugaacggcagccgggucauccgcugccacacggacaacaccugggugcccggggugcccaccugcaucaagaaggccuucaucggcugcccgcccccccccaagaccccgaacgggaaccacacgggcggcaacaucgcccgguucucccccgggaugagcauccucuacuccugcgaccagggcuaccugcuggucggggaggcccuccugcugugcacccacgagggcaccuggagccagcccgcgccccacugcaaggaggugaacugcuccagcccggccgacauggacgggauccagaagggccucgagccccgcaagauguaccaguacggcgccguggucacccuggagugcgaggacggguacaugcuggagggcagcccccagucccagugccagagcgaccaccaguggaacccgccccucgccgugugccggucccgcagccuggcccccgugcugugcgggaucgcggccggccucauccugcugacguuccucaucgucaucacccuguacgugaucuccaagcaccgggcccgcaacuacuacaccgacaccagccagaaggaggccuuccaccuggaggcccgggagguguacuccgucgaccccuacaacccggcgagcuga

SEQ ID NO: 28666 - RNA, 414 nt, Artificial Sequence
  derived and/or modified sequence opt1 from CRABP1__Homo_sapiens__NP_004369
augcccaacuucgccggcaccuggaagaugcgcagcuccgagaacuucgacgagcugcucaaggcccugggggugaacgcgaugcugcggaaggucgccguggccgccgccagcaagccgcacguggagauccgccaggacggcgaccaguucuacaucaagaccuccacgaccguccggaccaccgagaucaacuucaaggugggggagggcuucgaggaggagacgguggacgggcgcaagugccggagccucgcgaccugggagaacgagaacaagauccacugcacccagacccugcuggagggcgacggccccaagacguacuggacccgcgagcucgccaacgacgagcugauccugaccuucggggccgacgacgucgugugcacccggaucuacgugcgcgaguga

SEQ ID NO: 28667 - RNA, 417 nt, Artificial Sequence
  derived and/or modified sequence opt1 from CRABP2__Homo_sapiens__NP_001186652
augcccaacuucagcggcaacuggaagaucauccgcuccgagaacuucgaggagcugcucaaggugcugggggucaacgugaugcugcggaagaucgccguggccgcggccagcaagccggccgucgagaucaagcaggagggcgacaccuucuacaucaagaccuccacgaccgugcgcaccaccgagaucaacuucaaggugggggaggaguucgaggagcagacggucgacggccggcccugcaagagccucgugaagugggaguccgagaacaagauggugugcgagcagaagcugcugaagggggagggccccaagaccagcuggacccgcgagcucaccaacgacggcgagcugauccugacgaugaccgccgacgacgucgugugcacccggguguacguccgcgaguga

SEQ ID NO: 28668 - RNA, 2196 nt, Artificial Sequence
  derived and/or modified sequence opt1 from CRACR2A__Homo_sapiens__NP_001138430
auggccgcccccgacggccgcguggucagccggccgcagcgccuggggcagggcuccgggcagggccccaaggggagcggcgcgugccuccacccccuggacucccuggagcagaaggagacccaggagcagaccagcggccagcucgugaugcugcggaaggcccaggaguucuuccagacgugcgacgccgaggggaagggcuucaucgcccgcaaggacaugcagcggcugcacaaggagcucccccugucccuggaggagcucgaggacguguucgacgcccuggacgcggacgggaacggcuaccugaccccgcaggaguucaccaccggguucagccacuucuucuucucccagaacaaccccagccaggaggacgccggcgagcaggucgcccagcgccacgaggagaagguguaccucucccggggcgacgaggaccugggggacaugggcgaggacgaggaggcccaguuccgcaugcugauggaccggcucggggcgcagaaggugcuggaggacgagagcgacgucaagcagcuguggcuccagcugaagaaggaggagccccaccuccuguccaacuucgaggacuuccugacgcgcaucaucagccagcugcaggaggcccacgaggagaagaacgagcucgagugcgcccugaagcggaagaucgccgccuacgacgaggagauccagcaccuguacgaggagauggagcagcagaucaaguccgagaaggagcaguuccuccugaaggacaccgagcgcuuccaggcgcggagccaggagcuggagcagaagcuccugugcaaggagcaggagcuggagcagcucacccagaagcagaagcgccuggagggccagugcaccgcccugcaccacgacaagcacgagacgaaggccgagaacaccaagcucaagcugaccaaccaggagcuggcccgggagcucgagcgcaccuccugggagcugcaggacgcccagcagcagcuggagagccuccagcaggaggcgugcaagcugcaccaggagaaggagauggagguguaccgggugacggagucccugcagcgcgagaaggccggccuccugaagcagcuggacuuccuccgggagcgcaacaagcaccuccgggacgagcgcgacaucugcuuccagaagaacaaggccgccaaggccaacaccgcggccagccgcgccuccuggaagaagcggagcgggagcgucaucggcaaguacguggacucccgcgggauccugcggagccaguccgaggaggaggaggagguguucggcaucccccgccggagcucccuggggcugagcggcuacccgcugaccgaggaggagcccggcaccggggagcccggccccgggggcccguacccccgcccccugcggcgcaucaucuccgucgaggaggacccccucccgcagcugcuggacgggggcuucgagcagccccucagcaagugcuccgaggaggaggaggugagcgaccagggcgugcaggggcagauccccgaggcgcccccgcugaagcugacgcccaccagcccccggggccagcccgucgggaaggaggcccucugcaaggaggaguccuccccgagcgcccccgaccgccuguucaagaucguguucgugggcaacuccgccgucgggaagaccagcuuccugcggcgcuucugcgaggaccgguucucccccggcauggccgccaccgugggcaucgacuaccgcgugaagacgcucaacgucgacaacagccagguggcgcugcagcugugggacaccgccgggcaggagcgguaccgcugcaucacccagcaguucuuccggaaggccgacggcgugaucgucauguacgaccucaccgacaagcaguccuuccugagcgugcgccgguggcugagcuccgucgaggaggccgugggggaccgcgugcccguccuccugcugggcaacaagcucgacaacgagaaggagcgcgaggugccgcggggccugggggagcagcuggccacggagaacaaccucaucuucuacgagugcagcgcguacuccggccacaacaccaaggagagccugcugcaccucgcccgcuuccugaaggagcaggaggacaccgugcgggaggacaccauccaggucgggcaccccgccaagaagaaguccugcugcggcuga

SEQ ID NO: 28669 - RNA, 600 nt, Artificial Sequence
  derived and/or modified sequence opt1 from CRADD__Homo_sapiens__NP_003796
auggaggcccgcgacaagcagguccugcggagccuccgccuggagcugggcgccgaggugcucguggaggggcuggugcugcaguaccucuaccaggagggcauccugaccgagaaccacauccaggagaucaacgcgcagaccacggggcugcggaagaccaugcuccugcuggacauccuccccucccgcggcccgaaggccuucgacaccuuccuggacagccugcaggaguuccccuggguccgggagaagcucaagaaggcccgcgaggaggccaugaccgaccugcccgccggggaccggcugacgggcauccccucccacauccucaacagcuccccgagcgaccgccagaucaaccagcuggcgcagcggcugggccccgagugggagcccauggugcucucccuggggcugagccagaccgacaucuaccgcugcaaggccaaccacccccacaacgugcagucccaggucguggaggccuucauccgguggcgccagcgguucggcaagcaggccaccuuccagagccuccacaacgggcugcgcgcgguggaggucgacccgucccugcuccugcacaugcuggaguga

SEQ ID NO: 28670 - RNA, 3810 nt, Artificial Sequence
  derived and/or modified sequence opt1 from CRAMP1L__Homo_sapiens__NP_065876
augaccgugaagcugggcgacgggggcagcggggaggacggccucaagaagcuggggaagcgcgccgccgacgaggagucccuggagggcgagggcgcggggggcgccgacgccgccgaggagagcuccgggaccaagcgggacgagaagacgccccgcgccggcgcggacgggccgcccgccccccccggcgccccgcaggcccccagccccccccagggcuccccgcaggaccagcaccacuuccuccggagcuccguccgcccccagagcaagcggccccgcaaggaccccccguccgcgguggggagcggcaacgccgggggcuccggcccccgggggaagggcgccgaggggggcgggagcuccagcggcaacguguccggcgucgcccccgccgcgcccgccgggggcagccgcuccagcucccggaaccuggggagcagcggcggggagaaggaggagggcaagaaggugcgccggcagugggaguccuggagcaccgaggacaagaacaccuucuucgagggccuguacgagcacgggaaggacuucgaggccauccagaacaacaucgcccucaaguacaagaagaagggcaagccggccuccauggugaagaacaaggagcagguccgccacuucuacuaccggaccuggcacaagaucacgaaguacaucgacuucgaccacguguucagccgcgggcugaagaaguccagccaggagcuguacggccucaucugcuacggggagcugcggaagaagaucggcggcugcauggacgacaagaacgcgaccaagcugaacgagcucauccaggugggggccaccaccguccgcuacaagggccggaaccugcgcaucaaggcccccaugugccgggcccugaagaagcucugcgaccccgacgggcuguccgacgaggaggaccagaagcccgugcgccugccgcucaaggugcccaucgagcugcagccccggaacaaccacgccugggcgcgcguccagagccuggcccagaacccccgccuccggaugaucguggagcugcaccgcaagguguccagccugaucgaguuccucaagcagaagugggcccugcacgagguccgggugcgcaagacgcuggaggagcggcagcuccaggacuccugcagcgccccgaugcaggagaaggugacccugcaccuguuccccggcgagaacugcacccucaccccccugcccggcgucgcccgcguggugcacuccaaggcguucugcacgguccacuggcaggaggggggccggugcaagcagagcgccaaggacgcccacgugcugccgcccgcccagauccucgggauccaguccggccaggggaccgcgcgcggccaggugaagugcccccggagcggcgccgaggggaagggcgucgggcgcccgccccccgccgccgacgcccugcaguccagcggcgaguccagccccgagagcgcgccgggggagggcgccgcccugucccucagcucccccgacgcccccgaccggcccccgccccgccaccaggacaccggccccugccuggagaagacccccgccgaggggcgggacagcccgacgcgcgagcccggcgcgcugcccugcgccugcgggcagcuccccgaccuggaggacgagcugucccuccuggacccgcugccccgguaccucaagagcugccaggaccugaucgugcccgagcagugccgcugcgccgacacccggcccggcuccgagcagccgccccuggggggcgccgccagccccgagguccucgcgcccguguccaaggaggccgccgaccuggccccgaccggccccagcccccgcccggggcccggccugcugcucgacgugugcaccaaggaccuggcggacgcccccgccgaggagcugcaggagaaggggucccccgccggcccgccccccagccaggggcagcccgccgcgcggccgcccaaggagguccccgccucccgccucgcccagcagcugcgcgaggagggcuggaaccugcagacgagcgagucccucacccuggccgagguguaccugaugaugggcaagcccagcaagcuccagcuggaguacgacuggcuggggccgggccggcaggacccccgccccgggucccuccccaccgcccugcacaagcagcggcugcucagcugccugcugaagcucaucagcaccgaggugaacccgaagcuggcgcuggaggccaacacgaucuccaccgccagcguccgccccgcccaggaggagcaguccaugaccccccccggcaagguggugaccgucagcucccggagcccgcgcugcccccggaaccaggccucccuccgcagcuccaagacguucccccccagcuccgcgccgugcagcuccggccugcggaaccccccccgcccccugcucgugccggggcccagcuccaccggcagcaacgacuccgacgggggccuguucgccgugcccaccacccugccgcccaacagccggcacgggaagcucuucucccccagcaaggaggccgagcugacguuccgccagcaccugaacagcaucuccaugcagagcgacuucuuccuccccaagccgcggaagcugcgcaaccggcaccugcgcaagccccucgucgugcagcggacccugcugccccgccccuccgagaaccagagccacaacgugugcuccuucagcauccucuccaacagcuccgucaccggccggggcagcuuccgcccgauccaguccagccugaccaaggccgcgcugucccggcccaucgugcccaaggugcuccccccgcaggccacgagccaccuggccuccgccaucgaccuggccgcgaccagcgccgggauccucuccggcaacccccugcccgcccuggacaccgaggggcucagcggcaucuccccccugagcagcgacgaggucaccggggccaucuccggccaggacagcaccggcacgcaccaggacggggacacccugccgaccgugggcggguccgaccccuucgugagcauccccucccgccccgagcaggagccggucgccgacagcuuccagggcuccagcgugcucucccugagcgagcugcccaaggcgccccuccagaacgggcuguccaucccccugagcuccagcgaguccagcuccacccgccucagcccgcccgacguguccgcccugcuggacaucagccuccccggccccccggaggacgcccugagccagggcgagcccgccacgcacaucuccgacagcaucaucgagaucgccaucuccagcgggcaguacggcgagggggucccccuguccccggcgaagcucaacggcagcgacuccagcaagucccugcccagccccuccagcuccccccagccgcacuggaucgccagccccacccacgacccccagugguaccccuccgacagcaccgacuccagccuguccagccucuucgccagcuucaucuccccggagaagagccggaagaugcugcccacccccaucggcacgaacuccgggaccagccugcucggccccucccugcuggacgggaacagccgcgacuccuucgugagccggucccucgccgacguggccgaggucguggacagccagcuggugugcaugaugaacgagaacuccaucgacuacaucagccgcuucaacgaccuggcgcaggagcucuccaucgccgagccgggccggcgcgaggcccuguucgacgggggcggcgggggccccgccgucagcgaccugucccaguga

SEQ ID NO: 28671 - RNA, 1881 nt, Artificial Sequence
  derived and/or modified sequence opt1 from CRAT__Homo_sapiens__NP_000746
augcuggccuucgccgcgcgcaccguggucaagccccucggcuuccugaagccguucagccugaugaaggccuccagccgguucaaggcccaccaggacgcccucccccgccugcccgugcccccgcugcagcagucccucgaccacuaccugaaggcccugcagcccaucgugagcgaggaggagugggcgcacaccaagcagcucgucgacgaguuccaggccuccgggggcgugggggagcggcugcagaagggccuggagcgccgggcccgcaagacggagaacuggcucagcgagugguggcugaagaccgccuaccugcaguaccggcagcccguggucaucuacuccagccccggggugaugcucccgaagcaggacuucguggaccugcagggccagcugcgcuucgcggccaagcucaucgagggcguccuggacuucaaggugaugaucgacaacgagacccugcccguggaguaccucgggggcaagccccugugcaugaaccaguacuaccagauccuguccagcugccggguccccgggccgaagcaggacaccguguccaacuucagcaagacgaagaagccgcccacccacaucaccgugguccacaacuaccaguucuucgagcucgacguguaccacuccgacggcacgccccugaccgccgaccagaucuucgugcagcuggagaagaucuggaacagcucccuccagaccaacaaggagcccgucgggauccugaccagcaaccaccgcaacuccugggccaaggccuacaacacccugaucaaggacaaggugaaccgggacagcgugcgcuccauccagaaguccaucuucacggucugccucgacgcgaccaugccccgggugagcgaggacguguaccgcagccacgucgccggccagaugcugcacggcgggggcagccggcugaacuccgggaaccgcugguucgacaagacccuccaguucaucguggccgaggacggcagcugcggccuggucuacgagcacgccgccgcggaggggccgcccaucgugacccugcucgacuacgugaucgaguacacgaagaagcccgagcugguccggucccccauggugccccugcccaugccgaagaagcuccgcuucaacaucacccccgagaucaagagcgacaucgagaaggccaagcagaaccuguccaucaugauccaggaccuggacaucaccgugauggucuuccaccacuucggcaaggacuuccccaagagcgagaagcucucccccgacgccuucauccagauggcccugcagcuggccuacuaccggaucuacgggcaggcgugcgccaccuacgagagcgccucccuccgcauguuccaccugggccggacggacaccauccgcagcgccuccauggacagccugaccuucgugaaggccauggacgacuccagcgugaccgagcaccagaaggucgagcuccugcgcaaggcggugcaggcccaccggggguacacggaccgcgccauccggggcgaggccuucgaccgccaccuccugggccugaagcugcaggcgaucgaggaccugguguccaugccggacaucuucauggacaccagcuacgccaucgccaugcacuuccaccucuccaccagccagguccccgccaagaccgacugcgugauguucuucgggcccguggucccggacggcuacggggugugcuacaaccccauggaggcccacaucaacuucagccuguccgcguacaacagcugcgccgagacgaacgccgcccggcuggcccacuaccucgagaaggcgcugcuggacaugcgcgcccuccugcagucccacccccgggccaagcuguga

SEQ ID NO: 28672 - RNA, 3885 nt, Artificial Sequence
  derived and/or modified sequence opt1 from CRB1__Homo_sapiens__NP_001180569
auggcccugaagaacaucaacuaccuccugaucuucuaccugagcuucucccuccugaucuacaucaagaacagcuucugcaacaagaacaacacccgcugccuguccaacagcugccagaacaacuccacgugcaaggacuucagcaaggacaacgacugcuccugcagcgacaccgccaacaaccucgacaaggacugcgacaacaugaaggaccccugcuucuccaaccccugccagggcagcgcgaccugcgugaacacccccggggagcgguccuuccugugcaagugcccgcccggcuacagcgggaccaucugcgagacgaccaucggcuccugcgggaagaacagcugccagcacggcggcaucugccaccaggaccccaucuaccccgucugcaucugccccgccggguacgccggccgcuucugcgagaucgaccacgacgagugcgccuccagccccugccagaacggggccgugugccaggacggcaucgacggguacuccugcuucugcgugccgggcuaccagggccggcacugcgaccuggaggucgacgagugcgcgagcgaccccugcaagaacgaggcgaccugccucaacgagaucgggcgcuacacgugcaucugcccccacaacuacuccggcuacaccggggcccagugcgagaucgaccugaacgagugcaacagcaaccccugccagagcaacggcgagugcguggagcuguccagcgagaagcaguacggccggaucaccgggcucccguccagcuucuccuaccacgaggccagcggcuacgugugcaucugccagcccggguucaccggcauccacugcgaggaggacgucaacgagugcuccagcaaccccugccagaacggcgggaccugcgagaaccugcccgggaacuacacgugccacugcccguucgacaaccugucccgcaccuucuacggcggccgggacugcagcgacauccuccuggggugcacccaccagcagugccugaacaacgggaccugcaucccccacuuccaggacggccagcacggcuucuccugccucugccccagcggcuacacggggucccugugcgagaucgccaccacccugagcuucgagggcgacggguuccucugggugaaguccggcagcgugaccacgaagggguccgucugcaacaucgcccugcgcuuccagaccgugcagcccauggcccugcuccuguuccggagcaaccgcgacguguucgucaagcuggagcuccuguccggcuacauccaccugagcauccaggugaacaaccagagcaaggugcuccuguucaucucccacaacaccagcgacggcgaguggcacuucgucgaggugaucuucgccgaggccgugacccugacgcucaucgacgacuccugcaaggagaagugcaucgcgaaggccccgacgccccuggagagcgaccaguccaucugcgccuuccagaacagcuuccucgggggccugcccgucgggaugaccuccaacggcguggcccugcugaacuucuacaacaugcccagcaccccguccuucgugggcugccuccaggacaucaagaucgacuggaaccacaucacccuggagaacaucagcuccgggagcucccugaacgucaaggccggcugcgugcggaaggacuggugcgagagccagcccugccagucccgcgggcggugcaucaaccucuggcugagcuaccagugcgacugccaccgccccuacgagggccccaacugccugcgggaguacguggcggggcgcuucggccaggacgacuccaccggcuacgucaucuucacccucgacgagagcuacggggacaccaucagccuguccauguucgugcggacgcugcagccgagcggccuccugcuggcccuggagaacuccaccuaccaguacauccgcgucuggcucgagcgggggcgccuggccaugcugacccccaacagccccaagcucguggugaaguucguccugaacgacggcaacgugcaccugaucucccucaagaucaagccguacaagaucgagcuguaccagagcucccagaaccugggguucaucagcgccuccaccuggaagaucgagaagggcgacgugaucuacaucggcgggcuccccgacaagcaggagacggagcugaacggcggguucuucaagggcugcauccaggacguccggcugaacaaccagaaccucgaguucuuccccaaccccaccaacaacgccagccugaacccggugcuggugaacgucacccaggggugcgcgggcgacaacuccugcaagagcaaccccugccacaacggcggggugugccacucccgcugggacgacuucagcugcuccugccccgcccucaccagcggcaaggccugcgaggaggugcaguggugcggguucucccccugcccgcacggcgcccagugccagcccguccugcagggguucgagugcaucgccaacgcgguguucaacggccagagcggccagauccuguuccgcuccaacgggaacaucacccgggagcucacgaacaucaccuucggcuuccgcacccgggacgccaacgugaucauccugcacgccgagaaggagcccgaguuccugaacaucagcauccaggacagccgccucuucuuccagcugcaguccgggaacagcuucuacaugcugucccucaccagccugcaguccgucaacgacggcacguggcacgaggugacccugagcaugaccgacccccucucccagaccagccgguggcagauggagguggacaacgagacgccguucgucaccuccaccaucgccaccggcagccugaacuuccugaaggacaacacggacaucuacgugggggaccgcgcgaucgacaacaucaagggccuccaggggugccuguccaccaucgagaucggcgggaucuaccugagcuacuucgagaacgugcacggcuucaucaacaagccccaggaggagcaguuccucaagaucuccaccaacagcgucgugaccggcugccugcagcugaacgugugcaacuccaaccccugccuccacgggggcaacugcgaggacaucuacagcuccuaccacugcagcugcccccuggggugguccggcaagcacugcgagcugaacaucgacgagugcuucagcaacccgugcauccacgggaacugcagcgaccgggucgccgccuaccacugcacgugcgagcccggcuacaccggcgugaacugcgagguggacaucgacaacugccagucccaccagugcgccaacggggcgaccugcaucagccacaccaacggcuacuccugccucugcuucgggaacuucacgggcaaguucugccgccagagccggcugcccuccaccgucugcgggaacgagaagaccaaccugaccugcuacaacggcggcaacugcacggaguuccagaccgagcucaagugcaugugccgccccggguucaccggcgaguggugcgagaaggacaucgacgagugcgccagcgacccgugcgugaacgggggccugugccaggaccugcucaacaaguuccagugccugugcgacguggccuucgccggcgagcggugcgaggucgaccuggccgacgaccucaucuccgacaucuucaccacgaucgggagcgugaccguggcccugcugcucauccugcugcucgcgaucgucgccuccguggugaccagcaacaagcgcgccacccagggcacguacucccccagccggcaggagaaggaggggucccgcgucgagauguggaaccugaugccgccgcccgccauggagcggcugaucuga

SEQ ID NO: 28673 - RNA, 3858 nt, Artificial Sequence
  derived and/or modified sequence opt1 from CRB2__Homo_sapiens__NP_775960
auggcccuggcccgccccggcaccccggacccccaggcgcucgccagcgugcugcugcuccugcugugggcccccgcccucucccugcuggccgggaccguccccagcgagccgcccuccgcgugcgccagcgaccccugcgcccccggcacggagugccaggccaccgaguccgggggcuacaccugcgggccgauggagccccggggcugcgcgacccagcccugccaccacggcgcccucugcgugccccaggggccggaccccacgggcuuccgcugcuacugcgugcccggguuccagggcccccggugcgagcuggacaucgacgagugcgccagccgcccgugccaccacggggccaccugccggaaccuggccgaccgcuacgagugccacugcccccucggcuacgcgggcgucaccugcgagauggagguggacgagugcgccuccgcccccugccugcacgggggcagcugccuggacggggugggcuccuuccggugcgucugcgcccccggcuacgggggcacccgcugccagcucgaccuggacgagugccagagccagccgugcgcccacgggggcacgugccacgaccuggugaacggguuccggugcgacugcgcgggcaccggcuacgaggggacccacugcgagcgcgaggugcucgagugcgccuccgcccccugcgagcacaacgccagcugccuggagggccugggguccuuccggugccucugcuggcccggcuacagcggggagcugugcgaggucgacgaggacgagugcgccuccagccccugccagcacggcggccgcugccugcagcgguccgacccggcgcucuacgggggcgugcaggccgccuuccccggggccuucagcuuccgccacgccgcgggcuuccugugccacugcccccccggguucgagggcgccgacugcggcguggaggucgacgagugcgccucccggccgugccugaacgggggccacugccaggaccuccccaacggguuccagugccacugccccgacggcuacgccggcccgaccugcgaggaggacguggacgagugccugagcgaccccugccugcacgggggcacgugcagcgacaccguggcgggguacaucugccgcugccccgagaccuggggcgggcgggacugcuccguccagcucaccggcugccagggccacacgugcccccuggccgccaccugcaucccgaucuucgagagcggggugcacuccuacgugugccacugcccccccggcacccacgggcccuucugcggccagaacaccacguucagcgucauggccggguccccgauccaggccagcgugcccgcgggcggcccccuggggcucgcccugcgcuuccggaccacccugcccgccggcacccucgccacgcgcaacgacaccaaggagucccuggagcuggcccucguggcggccacccugcaggccacccuguggagcuacuccacgaccguccucgugcugcggcugccggaccucgcccugaacgacgggcacuggcaccagguggaggucgugcugcaccucgccacccuggagcugcgccuguggcacgagggcugccccgcgcgccucugcgucgccagcgggcccguggcccuggccuccaccgcgagcgccacgccccugccggccggcaucuccagcgcccagcucggcgacgccaccuucgcggggugccugcaggacgugcgggucgacggccaccugcuccugcccgaggaccugggggagaacgugcuccugggcugcgagcgccgggagcagugccgcccccugcccugcgugcacgggggcuccugcgucgaccucuggacccacuuccggugcgacugcgcccgcccgcaccggggccccaccugcgccgacgagauccccgccgccacguucgggcugggcggggcgcccagcuccgccagcuuccugcuccaggagcugccgggccccaaccugaccguguccuuccuccugcgcacccgggagagcgccggccugcuccugcaguucgccaacgacagcgccgcggggcugaccguguuccucuccgagggccgcauccgggccgagguccccgggagcccggccguggugcugcccggccgcugggacgacgggcugcggcaccucgucaugcuguccuucggccccgaccagcugcaggaccucggccagcacgugcacguggggggccgccugcuggccgcggacagccagcccugggggggcccguuccgggggugccuccaggaccugcgccuggacggcugccaccuccccuucuucccccugccccuggacaacuccagccagccguccgagcucggcgggcggcagagcuggaaccugaccgccggcugcgucuccgaggacaugugcagccccgaccccugcuucaacgggggcacgugccuggugaccuggaacgacuuccacugcaccugccccgccaacuucaccgggccgacgugcgcccagcagcucuggugccccggccagcccugccugcccccggccaccugcgaggaggugcccgacggcuucgucugcguggcggaggccaccuuccgcgaggggccccccgccgccuucuccggccacaacgccagcuccgggcggcugcucggcggccugagccuggcguuccgcacccgcgacuccgaggccuggcuccugcgggccgccgccggggcgcuggagggcguguggcucgccguccgcaacgggagccuggccggcggggugcggggcggccacgggcugccgggcgccgugcuccccauccccgggccccgcgucgccgacggcgcguggcaccgggugcgccuggccauggagcggccggccgccacgaccucccgcuggcugcucuggcuggacggggcggccacccccguggcccugcggggccucgccagcgaccugggcuuccugcaggggcccggcgccguccgcauccuccuggcggagaacuucaccgggugccugggccggguggcccucgggggccugccccugccgcucgcccgcccccggcccggcgccgccccgggggcgcgcgagcacuucgccagcuggcccggcacgcccgcccccauccuggggugccggggcgccccggugugcgcccccucccccugccugcacgacggggcgugccgcgaccucuucgacgccuucgccugcgccugcggccccggcugggaggggccgcggugcgaggcgcacgucgaccccugccacagcgcccccugcgcccgcggccggugccacacccaccccgacgggcgcuucgagugccggugcccgcccggcuucggcgggccccgcugccgccugcccgugccguccaaggagugcagccugaacgugaccugccucgacggcucccccugcgaggggggcagccccgccgccaacugcuccugccuggaggggcuggcgggccagcggugccagguccccacccucccgugcgaggccaaccccugccugaacggcgggacgugccgcgccgccggcggggugagcgagugcaucugcaacgcccgguucuccggccaguucugcgagguggcgaaggggcugccccucccccugccguucccccugcucgaggucgccgugcccgccgccugcgccugccugcugcuccugcugcucggccugcugagcggcauccucgcggcccgcaagcggcgccaguccgaggggaccuacagccccucccagcaggagguggccggcgcccggcuggagauggacagcguccugaaggugccgcccgaggagcgccugaucuga

SEQ ID NO: 28674 - RNA, 372 nt, Artificial Sequence
  derived and/or modified sequence opt1 from CRB3__Homo_sapiens__NP_777377
auggccaaccccggccuggggcuccugcuggcccucggccugccguuccugcucgcgcgcugggggcgggccuggggccagauccagaccaccagcgccaacgagaacuccacggugcugcccagcuccaccagcuccagcuccgacgggaaccugcgccccgaggccaucaccgccaucaucgucguguucagccuccuggcggcccugcuccuggccgugggccuggcccuccugguccggaagcugcgcgagaagcggcagaccgagggcacguaccgccccuccagcgaggagcaguucucccacgcggccgaggcccgggccccgcaggacagcaaggagaccgugcaggggugccuccccaucuga

SEQ ID NO: 28675 - RNA, 1326 nt, Artificial Sequence
  derived and/or modified sequence opt1 from CRBN__Homo_sapiens__NP_001166953
auggccggcgagggggaccagcaggacgccgcgcacaacaugggcaaccaccucccccuccugccggagagcgaggaggaggacgagauggagguggaggaccaggacuccaaggaggccaagaagcccaacaucaucaacuucgacaccagccugcccaccucccacacguaccucggggccgacauggaggaguuccacggccgcacccugcacgacgacgacagcugccaggucauccccgugcugccccaggugaugaugauccucaucccggggcagacccugccccugcagcuguuccacccccaggaggucuccauggugcggaaccugauccagaaggaccgcaccuucgccgugcuggccuacagcaacguccaggagcgggaggcgcaguucggcacgaccgccgagaucuacgccuaccgcgaggagcaggacuucggcaucgagaucgugaaggugaaggccaucgggcggcagcgcuucaagguccucgagcugcggacccaguccgacggcauccagcaggcgaaggugcagauccugccggagugcgugcuccccagcaccauguccgccguccagcuggagagccugaacaagugccagaucuuccccuccaagcccgugagccgcgaggaccagugcuccuacaagugguggcagaaguaccagaagcggaaguuccacugcgccaaccucacgagcuggccgcgcuggcuguacucccuguacgacgccgagacccucauggaccggaucaagaagcagcugcgcgagugggacgagaaccugaaggacgacagccuccccuccaaccccaucgacuucagcuaccggguggccgcgugccugcccaucgacgacguccugcgcauccagcuccugaagaucggguccgccauccagcggcugcgcugcgagcucgacaucaugaacaagugcaccagccugugcugcaagcagugccaggagaccgagaucacgaccaagaacgagaucuucagccugucccucugcggcccgauggccgccuacgugaacccccacggguacgugcacgagacccugaccgucuacaaggccugcaaccugaaccucaucggccggcccagcacggagcacuccugguuccccggcuacgcguggaccguggcccagugcaagaucugcgccagccacaucggguggaaguucaccgccaccaagaaggacauguccccgcagaaguucuggggccugacgcgcagcgcccugcuccccaccauccccgacaccgaggacgagaucucccccgacaaggugauccugugccuguga

SEQ ID NO: 28676 - RNA, 348 nt, Artificial Sequence
  derived and/or modified sequence opt1 from CRCP__Homo_sapiens__NP_001035737
auggaggugaaggacgccaacagcgcccugcucuccaacuacgagacccugaaguacaucagcaagacccccugccgccaccaguccccggagaucguccgggaguuccugacggcgcucaagagccacaagcugaccaaggccgagaagcugcagcuccugaaccaccgccccgugaccgccguggagauccagcugauggucgaggaguccgaggagcggcucaccgaggagcagaucgaggcccugcugcacacggugaccagcauccuccccgccgagcccgaggcggagcagaagaagaacaccaacuccaacguggccauggacgaggaggacccggccuga

SEQ ID NO: 28677 - RNA, 300 nt, Artificial Sequence
  derived and/or modified sequence opt1 from CRCT1__Homo_sapiens__NP_061933
augagcucccagcagagcgccguguccgccaagggcuucagcaagggguccagccagggccccgcgccgugccccgcccccgcccccaccccggcccccgccuccagcuccagcugcugcggguccggccgcgggugcugcggcgacagcggcugcugcggguccagcuccaccagcugcugcugcuucccccggcgccggcgccggcagcgcuccagcggcugcugcugcugcgggggcgggucccagcggagccagcgcagcaacaaccgguccagcggcugcugcuccggcugcuga

SEQ ID NO: 28678 - RNA, 1026 nt, Artificial Sequence
  derived and/or modified sequence opt1 from CREB1__Homo_sapiens__XP_011508947
augaccauggagagcggcgccgagaaccagcaguccggggacgccgcggugaccgaggccgagaaccagcagaugacgguccaggcccagccccagaucgccacccuggcccaggugagcaugccggcggcccacgccaccuccagcgcccccaccgugacgcucguccagcugcccaacggccagaccguccaggugcacggggugauccaggcggcccagcccuccgugauccagagcccccaggugcagaccguccaguccagcugcaaggaccugaagcgccucuucuccggcacccagaucagcacgaucgccgaguccgaggacagccaggaguccguggacagcgugaccgacucccagaagcggcgcgagauccugagccggcgcccguccuaccggaagauccugaacgaccucagcuccgacgcccccggggucccccgcaucgaggaggagaaguccgaggaggagaccagcgccccggcgaucaccacggugaccgugcccacccccaucuaccagaccagcagcggccaguacaucgccaucacgcagggcggggccauccagcuggccaacaacggcaccgacgggguccagggccugcagacccucaccaugacgaacgccgcggccacccagcccgggaccaccauccugcaguacgcccagacgaccgacggccagcagauccuggugccguccaaccagguggucgugcaggccgccagcggcgacgugcagaccuaccagauccggaccgcgcccacguccaccaucgcccccggggucgugauggccagcucccccgcccucccgacccagcccgccgaggaggcggcccgcaagcgggaggugcgccugaugaagaaccgggaggccgcccgcgagugccggcgcaagaagaaggaguacgucaagugccuggagaaccggguggcgguccucgagaaccagaacaagacccugaucgaggagcugaaggcccucaaggaccuguacugccacaagagcgacuga

SEQ ID NO: 28679 - RNA, 1116 nt, Artificial Sequence
  derived and/or modified sequence opt1 from CREB3__Homo_sapiens__NP_006359
auggagcuggagcucgacgccggcgaccaggaccugcuggccuuccuccuggaggagagcggggaccugggcaccgcgcccgacgaggccgugcgcgccccgcucgacugggcccugccccuguccgagguccccagcgacugggagguggacgaccuccugugcucccugcucagcccgcccgccucccugaacauccugagcuccagcaaccccugccucgugcaccacgaccacaccuacucccugccccgggagacggucagcauggaccuggaguccgagagcugccgcaaggaggggacccagaugacgccccagcacauggaggagcucgcggagcaggagaucgcccggcuggugcugaccgacgaggagaagucccuccuggagaaggagggccugauccucccggagacccugccccugaccaagaccgaggagcagauccucaagcgcgugcggcgcaagauccggaacaagcgcagcgcccaggagucccggcgcaagaagaaggucuacgucgggggccuggagagccgggugcugaaguacaccgcccagaacauggagcuccagaacaaggugcagcugcuggaggagcagaaccucucccugcuggaccagcuccgcaagcugcaggcgauggugaucgagaucagcaacaagacguccagcagcuccacgugcauccuggugcuccuggucagcuucugccugcuccuggugcccgccauguacuccagcgacacccggggcucccugcccgccgagcacggggugcucagccgccagcugcgggcccugccguccgaggaccccuaccagcucgagcugcccgcccugcagagcgagguccccaaggacuccacccaccaguggcuggacggcagcgacugcgugcuccaggcgccggggaacaccuccugccugcugcacuacaugccccaggcccccagcgccgagcccccgcucgaguggcccuuccccgaccuguucuccgagccccugugccgcggcccgauccucccccugcaggccaaccugacccggaagggcggguggcuccccaccggcagccccuccgugauccugcaggaccgcuacagcggguga

SEQ ID NO: 28680 - RNA, 1560 nt, Artificial Sequence
  derived and/or modified sequence opt1 from CREB3L1__Homo_sapiens__NP_443086
auggacgccgugcuggagcccuucccggccgaccgccucuuccccggcagcuccuuccuggaccugggggaccucaacgagagcgacuuccugaacaacgcgcacuuccccgagcaccuggaccacuucaccgagaacauggaggacuucuccaacgaccucuucagcuccuucuucgacgaccccguccuggacgagaaguccccgcugcucgacauggagcuggacagccccacccccggcauccaggccgagcacagcuacucccugagcggggacuccgcgccccagagcccgcucgugcccaucaagauggaggacacgacccaggacgccgagcacggcgccugggcccuggggcacaagcugugcuccaucauggugaagcaggagcagagccccgagcuccccgucgacccgcuggccgcccccuccgccauggcggccgccgccgccauggcgaccacgccccugcucggccugagcccccugucccggcucccgaucccccaccaggcccccggcgagaugacccagcugcccgugaucaaggccgagccgcuggaggugaaccaguuccucaaggucacccccgaggaccuggugcagaugccgcccaccccgcccagcucccacgggagcgacagcgacggcucccagagcccccgcucccugccgcccagcucccccgugcggcccauggcccgcagcuccaccgccaucagcacgagcccccuccugaccgcgccccacaagcugcaggggaccuccggcccccuccugcugaccgaggaggagaagcggacgcucaucgccgagggguaccccaucccgaccaagcugccccugaccaaggccgaggagaaggcccucaagcgcguccggcgcaagaucaagaacaagaucuccgcccaggagagccggcgcaagaagaaggaguacguggagugccuggagaagaagguggagaccuucacguccgagaacaacgagcuguggaagaaggucgagacccucgagaacgcgaaccggacccugcugcagcagcuccagaagcugcagacccuggugacgaacaagaucagccgccccuacaagauggccgccacccagaccgggaccugccucaugguggccgcccugugcuucguccuggugcucggcucccuggugcccugccugccggaguucagcuccggcagccagacggucaaggaggacccccuggcggccgacggcguguacaccgccucccagaugcccagccggagccuccuguucuacgacgacggggccggccugugggaggacggccgcuccacccuccugcccauggagccgcccgacgggugggagaucaaccccggcgggcccgcggagcagcggccgcgcgaccaccuccagcacgaccaccuggacagcacccacgagacgaccaaguaccuguccgaggccuggcccaaggacggcgggaacggcaccagccccgacuucucccacagcaaggagugguuccacgaccgggaccugggccccaacaccacgaucaagcucuccuga

SEQ ID NO: 28681 - RNA, 747 nt, Artificial Sequence
  derived and/or modified sequence opt1 from CREB3L2__Homo_sapiens__NP_001240704
auggaggugcuggagagcggcgagcaggggguccuccagugggaccgcaagcuguccgagcugagcgagcccggcgacggggaggcccucauguaccacacccacuucuccgagcugcuggacgaguucagccagaacgugcucggccagcugcugaacgacccguuccucuccgagaaguccgugagcauggaggucgagcccagccccaccucccccgccccgcugauccaggcggagcacagcuacucccugugcgaggagccccgggcccagagccccuucacgcacaucaccaccuccgacagcuucaacgacgacgagguggaguccgagaagugguaccucagcaccgacuuccccuccacgagcaucaagaccgagccggugaccgacgagcccccgcccgggcugguccccuccgugacccugacgaucaccgccaucagcacgccccucgagaaggaggagccgccccuggagaugaacaccggcguggacagcuccugccagaccaucauccccaagaucaagcuggagccccacgaggucgaccaguuccucaacuucagccccaaggagggccuguccgcccugcccgugagccucugggugauggacauggucuccgggagcaccgagcgcgaguacggcgagcgggccgggaugucccuguaccaccgcugcugcagcuggcuguacgagaucgcccucuuccugaagaacaagaacuucgcguccaaguga

SEQ ID NO: 28682 - RNA, 1383 nt, Artificial Sequence
  derived and/or modified sequence opt1 from CREB3L3__Homo_sapiens__NP_001258924
augaacaccgaccuggccgccggcaagauggcgagcgccgccugcuccauggaccccaucgacagcuucgagcuccuggaccuccuguucgaccgccaggacgggauccugcggcacguggagcugggcgagggguggggccacgucaaggaccaggugcucccgaaccccgacuccgacgacuuccugagcuccauccuggggagcggcgacucccuccccagcagcccccugugguccccggagggcuccgacagcgggaucuccgaggaccugcccagcgacccccaggacacgcccccgcgcuccggccccgccaccagccccgccgggugccaccccgcgcagccgggcaaggggcccugccucuccuaccaccccggcaacagcugcuccaccaccacccccggcccggugauccagguccccgaggccagcgugacgaucgaccuggagauguggagccccgggggccggaucugcgccgagaagcccgccgacccgguggaccugagcccccgcugcaaccucaccgucaaggaccugcugcucuccggguccagcggcgaccugcagcagcaccaccugggcgcguccuaccuccugcggcccggggccggccacugccaggagcuggugcucaccgaggacgagaagaagcugcuggccaaggaggggaucacccuccccacgcagcugccgcugaccaaguacgaggagcgcgugcucaagaagauccggcgcaagauccggaacaagcagagcgcccaggagucccgcaagaagaagaaggaguacaucgacggccuggagacccggaugagcgccugcaccgcgcagaaccaggagcugcagcgcaagguccuccaccuggagaagcagaaccugucccuccuggagcagcugaagaagcuccaggccaucguggugcagagcacguccaagagcgcccagaccgggaccugcgucgccgugcugcugcucuccuucgcccugaucauccugcccagcaucucccccuucggccccaacaagaccgagagcccgggcgacuucgcgcccgugcgggucuucucccgcacgcuccacaacgacgccgccagccggguggccgccgacgcggugcccggguccgaggccccgggcccccgccccgaggccgacaccacccgggaggagagccccgggagcccgggcgccgacuggggguuccaggacaccgccaaccugacgaacuccaccgaggagcuggacaacgcgacccucguccugcgcaacgccaccgagggccugggccagguggcccugcucgacuggguggcccccgggcccagcacgggcuccgggcgggcgggccuggaggccgccggggacgagcuguga

SEQ ID NO: 28683 - RNA, 1188 nt, Artificial Sequence
  derived and/or modified sequence opt1 from CREB3L4__Homo_sapiens__NP_001242908
auggaccugggcauccccgaccuccuggacgccuggcuggagccgcccgaggacaucuucagcaccggguccgugcucgagcugggccugcacugcccgcccccggagguccccgugacccgccuccaggagcaggggcugcagggcuggaaguccgggggcgaccggggcugcgggcugcaggagagcgagcccgaggacuuccucaagcuguucaucgaccccaacgagguguacugcagcgaggccuccccgggcagcgacuccgggaucagcgaggaccccugccaccccgacuccccgcccgcgccccgcgccacgagcucccccaugcuguacgaggucguguacgaggccggcgcccucgagcggaugcagggggagaccggccccaacgugggccugaucagcauccagcuggaccaguggucccccgccuucaugguccccgacagcugcaugguguccgagcuccccuucgacgcgcacgcccacauccugccccgcgccgggaccguggccccgguccccugcaccacgcugcuccccugccagacccuguuccugaccgacgaggagaagcggcuccugggccaggagggggugagccugcccucccaccucccgcugaccaaggcggaggagcgcgugcugaagaagguccggcgcaagauccggaacaagcagagcgcccaggacucccgccggcgcaagaaggaguacaucgacggccucgagagccggguggccgccugcagcgcccagaaccaggagcugcagaagaaggugcaggagcuggagcgccacaacaucucccucgucgcgcagcugcggcagcugcagacgcucaucgcccagaccagcaacaaggccgcccagaccuccacgugcgugcugauccuccuguucagccuggcccugaucauccuccccuccuucagccccuuccagucccgccccgaggcgggcagcgaggacuaccagccgcacggggugaccucccggaacauccugacccacaaggacgucaccgagaaccuggagacccaggugguggagagccgccuccgggagccgcccggcgccaaggacgccaacggguccacgcgcacccugcuggagaagaugggcgggaagccccggcccagcggccgcauccgcuccguccuccacgccgacgagauguga

SEQ ID NO: 28684 - RNA, 1110 nt, Artificial Sequence
  derived and/or modified sequence opt1 from CREB5__Homo_sapiens__NP_001011666
auguucugcaccagcggcgggaacuccgccagcgugauguccaugcgccccgucccgggcagccuguccagccuccugcaccuccacaaccggcagcgccagcccaugcccgccuccaugcccgggacccugccgaaccccacgaugcccggcagcuccgcggugcugaugcccauggagcggcagaugagcgugaacuccagcaucauggggaugcagggcccgaaccuguccaaccccugcgccagcccccagguccagcccaugcacuccgaggccaagaugcgccucaaggccgcccugacccaccacccggcggccaugagcaacggcaacaugaacaccauggggcacaugauggagaugaugggcucccggcaggaccagacgccccaccaccacaugcacagccacccccaccagcaccagacccugcccccgcaccaccccuacccccaccagcaccagcaccccgcccaccacccgcacccccagccccaccaccagcagaaccacccccaccaccacucccacagccaccuccacgcccacccggcgcaccaccagaccagcccccacccgccccugcacaccgggaaccaggcccaggugucccccgccacccagcagaugcagcccacgcagaccauccagcccccgcagcccaccggcgggcgccggcgccggguggucgacgaggaccccgacgagcgccggcgcaaguuccuggagcggaaccgcgccgccgcgacccggugccgccagaagcggaaggugugggugaugagccucgagaagaaggccgaggagcugacgcagaccaacaugcagcugcagaacgaggucuccaugcucaagaacgagguggcccagcugaagcagcugcuccugacccacaaggacugccccaucaccgccaugcagaaggagagccagggcuaccuguccccggagagcuccccgcccgccagccccgugcccgcgugcucccagcagcaggucauccagcacaacacgaucaccaccagcuccagcguguccgagguggucggcagcuccacccucagccagcugacgacccaccgcaccgaccugaaccccauccucuga

SEQ ID NO: 28685 - RNA, 7215 nt, Artificial Sequence
  derived and/or modified sequence opt1 from CREBBP__Homo_sapiens__NP_001073315
auggccgagaaccugcucgacgggccgcccaaccccaagcgcgccaagcugagcucccccggguucagcgcgaacgacuccaccgacuucggcucccuguucgaccucgagaacgaccugcccgacgagcugauccccaacgggggcgagcucgggcugcugaacuccggcaaccucgugcccgacgccgccuccaagcacaagcagcuguccgagcugcuccggggcggguccggcuccuccaucaaccccgggaucggcaacguguccgccagcucccccgugcagcaggggcugggcggccaggcccaggggcagcccaacagcgcgaacauggccucccugagcgccaugggcaagagcccccugagccagggggacuccagcgcccccagccugcccaagcaggcggccuccaccagcggccccacccccgccgccucccaggcccugaacccccaggcgcagaagcaggucggccucgccaccagcucccccgccaccagccagaccgggcccggcaucugcaugaacgccaacuucaaccagacccaccccgggcugcugaacuccaacagcggccacucccucaucaaccaggccagccaggggcaggcgcaggucaugaacggcucccugggcgccgccgggcgcggccggggcgccggcaugcccuaccccacccccgccaugcagggggcgagcuccagcgugcuggccgagacccucacccaggugagcccccagaugaccggccacgccggccugaacaccgcccaggccgggggcauggcgaagauggggaucaccggcaacaccagccccuucgggcagcccuucucccaggccggcggccagcccaugggggccaccggcgucaacccccagcuggccagcaagcaguccauggugaacagccuccccaccuuccccaccgacaucaagaacaccagcgugaccaacguccccaacaugucccagaugcagaccagcguggggaucgugcccacccaggcgaucgccaccggccccacggccgacccggagaagcgcaagcugauccagcagcagcugguccuccugcugcacgcccacaagugccagcggcgcgagcaggccaacggcgaggugcgggcgugcucccucccccacugccgcaccaugaagaacgugcugaaccacaugacccacugccaggccgggaaggccugccaggccauccugggcagccccgccuccgggauccagaacaccaucggcagcgucgggacgggccagcagaacgcgaccucccucagcaaccccaaccccaucgaccccuccagcaugcagcgggccuacgccgcccugggccugcccuacaugaaccagccccagacccagcuccagccccaggugcccgggcagcagcccgcccagccccagacccaccagcagaugcgcacgcugaacccgcugggcaacaaccccaugaacauccccgccggcgggaucaccaccgaccagcagcccccgaaccucaucuccgagagcgcccugcccaccucccugggggccacgaacccccucaugaacgacgggagcaacuccggcaacaucgggacccugagcaccauccccaccgccgcgccgcccuccagcacgggcgugcggaagggguggcacgagcacgucacccaggaccugcgcagccaccucgugcacaagcuggugcaggccaucuuccccacccccgacccggccgcccugaaggaccggcgcauggagaaccuggucgccuacgcgaagaagguggagggcgacauguacgaguccgccaacagccgggacgaguacuaccaccuccuggccgagaagaucuacaagauccagaaggagcuggaggagaagcgccggucccgccuccacaagcaggggauccugggcaaccagcccgcccugcccgccccgggcgcgcagccgcccgugaucccccaggcccagcccguccggcccccgaacgggccccucagccugccggugaaccgcaugcaggucucccagggcaugaacagcuucaaccccaugucccuggggaacgugcagcucccccaggcccccaugggcccgcgggccgccagccccaugaaccacuccgugcagaugaacagcaugggguccguccccggcauggcgaucagccccucccgcaugccgcagccgcccaacaugaugggcgcccacaccaacaacaugauggcccaggcccccgcgcagagccaguuccugccccagaaccaguuccccuccagcuccggggccaugagcgugggcauggggcagccgcccgcccagaccggcgugucccagggccaggucccgggggccgcccugcccaacccccucaacaugcugggcccccaggcgagccagcugccgugcccgcccgugacgcagagcccgcuccaccccacgccgccgcccgccuccaccgccgccgggaugcccagccugcagcacaccacgccgcccggcaugaccccgccccagcccgccgcgcccacccagcccuccacccccgugagcuccagcgggcagacgcccacccccaccccgggcuccguccccagcgccacccagacgcaguccacccccaccgugcaggccgccgcccaggcccaggugacgccccagccgcagacgcccguccagccgcccagcguggccaccccgcaguccagccagcagcagcccacccccgugcacgcccagcccccgggcacgccccugucccaggccgccgcgagcaucgacaaccgcguccccacgccguccagcguggccuccgccgagaccaacagccagcagcccgggcccgacgugcccguccucgagaugaagaccgagacccaggccgaggacacggagccggaccccggcgaguccaagggggagccccggagcgagaugauggaggaggaccugcagggcgcgagccaggugaaggaggagaccgacaucgccgagcagaaguccgagcccauggagguggacgagaagaagccggaggucaagguggaggugaaggaggaggaggagagcuccagcaacgggaccgccucccagagcaccucccccagccagccccgcaagaagaucuucaagcccgaggagcugcggcaggcccucaugccgacgcuggaggcccuguaccgccaggaccccgagucccuccccuuccggcagcccgucgacccgcagcugcugggcauccccgacuacuucgacaucgugaagaaccccauggaccucagcaccaucaagcgcaagcuggacaccggccaguaccaggagcccuggcaguacguggacgacgucuggcugauguucaacaacgcguggcucuacaaccggaagaccucccgcguguacaaguucugcagcaagcuggccgagguguucgagcaggagaucgacccggucaugcagucccugggguacugcugcggccggaaguacgaguucagcccccagacgcucugcugcuacgggaagcagcugugcaccaucccccgcgacgccgccuacuacuccuaccagaaccgguaccacuucugcgagaagugcuucaccgagauccagggcgagaacgugacccugggggacgaccccagccagccgcagacgaccaucuccaaggaccaguucgagaagaagaagaacgacacccucgaccccgagcccuucguggacugcaaggagugcggccgcaagaugcaccagaucugcguccugcacuacgacaucaucuggccgagcggcuucgugugcgacaacugccugaagaagaccgggcggccccgcaaggagaacaaguucuccgccaagcggcuccagaccacgcgccugggcaaccaccuggaggaccgggugaacaaguuccuccgccggcagaaccaccccgaggcgggggaggucuucgugcgcguggucgccagcagcgacaagaccguggaggugaagcccggcaugaagucccgcuucgucgacagcggcgagauguccgagagcuucccguaccggaccaaggcccuguucgccuucgaggagaucgacgggguggacgugugcuucuucggcaugcacguccaggaguacggguccgacugcccgccgcccaacacccgccggguguacaucagcuaccuggacuccauccacuucuuccgcccccggugccuccgcacggccguguaccacgagauccugaucggcuaccuggaguacgucaagaagcucggguacgugaccggccacaucugggcgugcccgcccagcgagggcgacgacuacaucuuccacugccacccgcccgaccagaagauccccaagcccaagcggcugcaggagugguacaagaagaugcuggacaaggccuucgccgagcgcaucauccacgacuacaaggacaucuucaagcaggccaccgaggaccggcucaccuccgcgaaggagcugcccuacuucgagggggacuucuggcccaacgugcuggaggagagcaucaaggagcucgagcaggaggaggaggagcgcaagaaggaggaguccacggccgccagcgagaccaccgagggcucccagggggacagcaagaacgccaagaagaagaacaacaagaagaccaacaagaacaaguccagcaucucccgggccaacaagaagaagcccagcaugcccaacgucuccaacgaccugagccagaagcuguacgcgacgauggagaagcacaaggagguguucuucgucauccaccuccacgccggccccgugaucaacacccugccgcccaucguggaccccgacccccugcucagcugcgaccugauggacgggcgcgacgccuuccugacccucgcccgggacaagcacugggaguucuccagccugcgccgguccaaguggagcacccugugcaugcucgucgagcugcacacgcagggccaggaccgcuucguguacacgugcaacgagugcaagcaccacguggagacccgguggcacugcaccgucugcgaggacuacgaccugugcaucaacugcuacaacacgaagucccacgcccacaagauggugaaguggggccucgggcuggacgacgagggcagcucccagggggagccgcagagcaagagcccccaggagagccgccggcuguccauccagcgcugcauccagagccucgugcacgcgugccagugccggaacgccaacugcucccugcccagcugccagaagaugaagcgcgucgugcagcacaccaagggcugcaagcgcaagaccaacgggggcugccccgugugcaagcagcugaucgcccucugcugcuaccacgccaagcacugccaggagaacaagugcccgguccccuucugccugaacaucaagcacaagcugcggcagcagcagauccagcaccgccuccagcaggcccagcugaugcggcgccggauggcgaccaugaacacgcgcaacgugccccagcagucccugccgagccccaccuccgcgccgcccggcaccccgacccagcagcccagcacgccccagacgccccagccgcccgcccagccccagcccuccccggugagcaugagccccgccggguuccccuccgucgcgcggacccagcccccgaccacggugagcaccggcaagcccaccucccaggugcccgcgcccccgccgcccgcccagcccccgcccgccgccgucgaggcggcccgccagaucgagcgggaggcccagcagcagcagcaccucuaccgcgugaacaucaacaacagcaugccgcccgggcggaccggcauggggacgcccggcucccagauggcccccgugagccugaacgucccccgcccgaaccagguguccggccccgugaugcccagcaugcccccggggcaguggcagcaggcgccccugccccagcagcagcccaugccgggccucccccggcccgucaucuccaugcaggcccaggccgccguggccgggccccgcaugccgagcgugcagccgccccgguccaucagccccuccgcccugcaggaccugcuccgcacccugaaguccccguccagcccccagcagcagcagcagguccugaacauccucaaguccaacccccagcugauggcggccuucaucaagcagcggaccgccaaguacguggccaaccagcccggcaugcagccgcagcccggccugcagagccagcccgggaugcagccccagccgggcaugcaccagcagcccagccuccagaaccugaacgccaugcaggcgggggugccccgccccggcgucccgccccagcagcaggccaugggcggccugaacccccagggccaggcccugaacaucaugaacccggggcacaaccccaacauggccuccaugaacccccaguaccgggagaugcuccgccgccagcugcugcagcagcagcagcagcagcagcagcagcagcagcagcagcagcagcagcagcagggcagcgcggggauggccggcgggauggccggccacggccaguuccagcagccccaggggccgggcggguacccgcccgccaugcagcagcagcagcggaugcagcagcaccucccccugcagggcuccagcauggggcagauggccgcgcagaugggccagcugggccagauggggcagcccggccucggggccgacuccacccccaacauccagcaggcccugcagcagcgcauccugcagcagcagcagaugaagcagcagaucggcagccccgggcagcccaacccgaugagcccccagcagcacaugcucagcggccagccccaggccucccaccuccccggccagcagaucgccaccagccuguccaaccaggugcggagcccggcgcccgugcagagcccccgcccccagagccagccgccccacuccagccccuccccgcggauccagccccagcccagcccccaccacgucuccccgcagacggggagcccccaccccggccucgccgugaccauggccagcuccaucgaccaggggcaccugggcaaccccgagcagagcgccaugcugccgcagcucaacacccccucccgcagcgcccuguccagcgagcugucccucgugggcgacaccacgggggacacccuggagaaguucgucgagggccuguga

SEQ ID NO: 28686 - RNA, 1254 nt, Artificial Sequence
  derived and/or modified sequence opt1 from CREBRF__Homo_sapiens__NP_001161865
augccccagccgagcguguccggcauggacccgcccuucggggacgccuuccgcagccacaccuucuccgagcagacccugaugagcacggaccuccuggccaacuccagcgaccccgacuucauguacgagcuggaccgggagaugaacuaccagcagaacccccgcgacaacuuccucucccuggaggacugcaaggacaucgagaaccuggagagcuucaccgacguccucgacaacgagggcgcgcugaccuccaacugggagcagugggacaccuacugcgaggaccugacgaaguacaccaagcucaccagcugcgacaucugggggaccaaggagguggacuaccugggccuggacgacuucuccagccccuaccaggacgaggaggugaucuccaagacgcccacccucgcccagcugaacagcgaggacucccagagcgucuccgacagccuguacuaccccgacucccucuucagcgugaagcagaacccgcugcccagcuccuuccccgggaagaagaucaccagccgggccgccgcccccgugugcuccagcaagacccugcaggcggaggucccgcucuccgacugcgugcagaaggccagcaagcccacguccagcacccagaucauggugaagaccaacauguaccacaacgagaaggucaacuuccacguggagugcaaggacuacgugaagaaggccaaggucaagaucaaccccgugcagcagucccgcccccugcugagccagauccacaccgacgccgcgaaggagaacacgugcuacugcggcgccguggccaagcggcaggagaagaagggcauggagccgcuccaggggcacgccacccccgcccugcccuucaaggagacccaggagcugcuccugagcccccugccgcaggagggccccgggucccucgcggccggcgaguccagcucccugagcgccuccaccagcgucuccgacagcagccagaagaaggaggagcacaacuacucccuguucgugagcgacaaccucggggagcagcccacgaagugcucccccgaggaggacgaggaggacgaggaggacguggacgacgaggaccacgacgagggcuucggcagcgagcacgagcuguccgagaacgaggaggaggaggaggaggaggaggacuacgaggacgacaaggacgacgacaucagcgacaccuucuccgagccggggaucaucaugcuggccagccuccccgacuga

SEQ ID NO: 28687 - RNA, 1065 nt, Artificial Sequence
  derived and/or modified sequence opt1 from CREBZF__Homo_sapiens__NP_001034707
augcgccacagccugaccaagcuccuggccgccuccggcagcaacucccccacccggagcgaguccccggagcccgcggccacgugcagccugcccuccgaccucacccgcgccgccgccggggaggaggagaccgcggccgccggcagccccgggcggaagcagcaguucggcgacgagggggagcuggaggccggccgcggcucccgcgggggcguggcgguccgggccccgagccccgaggagauggaggaggaggccaucgccucccugcccggggaggagaccgaggacauggacuuccucagcggccuggagcuggccgaccuccuggacccccggcagccggacuggcaccuggaccccgggcucuccagccccggcccccuguccagcuccggcgggggcagcgacuccgggggccuguggcgcggcgacgacgacgacgaggcggccgccgccgagaugcagcgguucagcgaccuccugcagcgccugcucaacgggaucggcgggugcagcuccagcuccgacagcggcuccgccgagaagcggcgccgcaagagccccgggggcggcgggggcgggggcuccgggaacgacaacaaccaggcggccaccaagagcccgcggaaggccgccgccgcggccgcccggcugaaccgccugaagaagaaggaguacgugaugggccucgagucccgggugcgcggccuggccgccgagaaccaggagcugcgggcggagaaccgcgagcucgggaagcggguccaggcccugcaggaggagagccgcuaccugcgcgccgugcucgccaacgagacgggccuggcgcggcugcucucccgccugagcggggugggccugcggcucaccaccucccuguuccgcgacagccccgccggggaccacgacuacgcccugcccgucggcaagcagaagcaggaccuccuggaggaggacgacuccgccggcggggugugccugcacguggacaaggacaaggucagcguggaguucugcuccgccugcgcgcggaaggccagcuccagccucaagauguga

SEQ ID NO: 28688 - RNA, 663 nt, Artificial Sequence
  derived and/or modified sequence opt1 from CREG1__Homo_sapiens__NP_003842
auggccggccugagccgcggguccgcccgggcgcuccuggccgcccugcucgccagcacccugcuggcccuccuggugucccccgcgcgcggccgcgggggccgggaccacggggacugggacgaggccagccggcugccgccccucccgccccgcgaggacgccgcccgggucgcgcgcuucgugacccacguguccgacuggggcgcccuggccacgaucagcacccuggaggccguccggggccgccccuucgccgacgugcucucccugagcgacgggccgcccggcgcgggguccggcgugcccuacuucuaccugagcccccuccagcuguccgucagcaaccugcaggagaaccccuacgccacccucaccaugacgcuggcccagaccaacuucugcaagaagcacggguucgacccccagagcccccugugcgugcacaucaugcucuccggcaccgugaccaaggucaacgagacggagauggacaucgccaagcacucccuguucauccggcacccggagaugaagaccuggcccagcucccacaacugguucuucgccaagcugaacaucaccaacaucugggugcucgacuacuucggcgggcccaagaucgugacccccgaggaguacuacaacgucacggugcaguga

SEQ ID NO: 28689 - RNA, 1269 nt, Artificial Sequence
  derived and/or modified sequence opt1 from CRELD1__Homo_sapiens__NP_001026887
auggcccccuggccgcccaagggccuggugcccgccguccucugggggcugagccuguuccucaaccugcccggcccgaucuggcugcagcccuccccgccgccccagagcuccccgccgccccagccccaccccugccacacgugccgcgggcucguggacagcuucaacaagggccuggagcggaccauccgcgacaacuucgggggcggcaacacggcgugggaggaggagaaccuguccaaguacaaggacagcgagacccggcucguggagguccuggagggggugugcuccaagagcgacuucgagugccaccgccugcucgagcuguccgaggagcugguggagagcuggugguuccacaagcagcaggaggcccccgaccucuuccaguggcugugcuccgacagccugaagcucugcugccccgccggcaccuucgggcccuccugccugcccugccccggcgggaccgagcggcccugcggcggcuacgggcagugcgagggcgaggggacccgcggcggcagcgggcacugcgacugccaggccggcuacgggggcgaggccugcgggcagugcggccugggcuacuucgaggcggagcggaacgccucccaccucgugugcagcgccugcuucgggcccugcgcccgcugcuccggccccgaggagagcaacugccugcagugcaagaaggggugggcgcugcaccaccucaagugcguggacaucgacgagugcggcaccgagggggccaacugcggcgccgaccaguucugcgugaacaccgagggcuccuacgagugccgggacugcgccaaggccugccuggggugcaugggcgcggggcccggccgcugcaagaagugcagccccggguaccagcaggucggcagcaagugccuggacguggacgagugcgagaccgaggugugcccgggcgagaacaagcagugcgagaacacggagggcggguaccggugcaucugcgccgagggguacaagcagauggagggcaucugcgucaaggagcagauccccggcgccuuccccauccucaccgaccugacccccgagaccacgcgccgguggaagcuggggucccacccgcacagcaccuacgugaagaugaagaugcagcgcgacgaggccaccuuccccggccucuacgggaagcaggucgccaagcugggcucccagagccggcaguccgaccgcgggacccggcugauccacagccagcaggcguccagccagcgcuga

SEQ ID NO: 28690 - RNA, 1209 nt, Artificial Sequence
  derived and/or modified sequence opt1 from CRELD2__Homo_sapiens__NP_001128573
augcgccugccccggcgcgccgcccucggccugcugccgcuccugcugcuccugccgcccgcgcccgaggccgccaagaagcccacccccugccaccggugccgcgggcugguggacaaguucaaccagggcauggucgacaccgccaagaagaacuucgggggcgggaacacggccugggaggagaagacccucagcaaguacgaguccagcgagauccggcugcuggagauccucgagggccugugcgaguccagcgacuucgagugcaaccagaugcuggaggcgcaggaggagcaccucgaggccugguggcugcagcugaaguccgaguaccccgaccucuucgagugguucugcgugaagacccugaaggugugcugcagccccggcaccuacgggccggacugccuggccugccagggcgggucccagcgccccugcagcggcaacgggcacugcuccggcgacggcagccggcagggggacggcuccugccgcugccacaugggguaccagggcccccucugcacggacugcauggacggcuacuucagcucccugcggaacgagacccacagcaucugcaccguccgcaccgggcuguccgacagcuacccgcccugcugccucucccugggcugcuggcgcggggugggccacgccuggauccgggggcggaacacgcacacccagcccggcuacagcucccgcguguggaucgcggccuucagccccgccugcgacgagagcugcaagaccugcuccggccugaccaaccgggacugcggggagugcgaggucggcugggugcucgacgagggggccugcguggacgucgacgagugcgccgcggagcccccgcccugcagcgccgcccaguucugcaagaacgccaacggcuccuacacgugcgaggagugcgacagcuccugcguggggugcaccggcgagggccccgggaacugcaaggagugcaucagcggcuacgcccgcgagcacgggcagugcgcggacguggacgagugcucccuggccgagaagaccugcguccggaagaacgagaacugcuacaacacccccggcagcuacgugugcgugugcccggacggguucgaggagacggaggacgccugcgucccgcccgccgaggccgaggcgaccgagggcgagucccccacccagcugcccagccgcgaggaccucuga

SEQ ID NO: 28691 - RNA, 540 nt, Artificial Sequence
  derived and/or modified sequence opt1 from CREM__Homo_sapiens__NP_001254491
auggccgugcccaccagcaucuaccagaccuccacgggccaguacaucgccaucgcgcagggcgggaccauccagaucagcaacccgggguccgacggcguccaggggcugcaggcccucaccaugaccaacagcggcgccccgccgcccggcgccacgaucgugcaguacgccgcgcaguccgccgacgggacccagcaguucuucgugcccggcagccaggucguggugcaggccgccaccggggacaugcccaccuaccagauccgcgcgcccacggccgcccugccccagggcgucgugauggccgccucccccgggagccugcacagcccccagcagcucgcggaggaggccacccggaagcgcgagcugcggcugaugaagaaccgcgaggccgccaaggagugccggcgccggaagaaggaguacgugaagugccucgagucccgcgucgccgugcuggaggugcagaacaagaagcugaucgaggagcucgagacccugaaggacaucugcucccccaagaccgacuacuga

SEQ ID NO: 28692 - RNA, 969 nt, Artificial Sequence
  derived and/or modified sequence opt1 from CRHBP__Homo_sapiens__NP_001873
augagccccaacuucaagcugcagugccacuucauccucaucuuccugaccgcccugcgcggcgagucccgguaccucgagcugcgcgaggccgcggacuacgacccguuccuccuguucagcgccaaccugaagcgggagcuggccggggagcagcccuaccgccgggcccuccgcugccuggacaugcugucccuccagggccaguucaccuucaccgccgaccggccccagcugcacugcgcggccuucuucaucagcgagcccgaggaguucaucaccauccacuacgaccagguguccaucgacugccagggcggggacuuccugaaggucuucgacggguggauccucaagggcgagaaguucccgagcucccaggaccacccccugcccagcgccgagcgcuacaucgacuucugcgaguccggccugagccggcgcuccauccggagcucccagaacguggccaugaucuucuuccgcgugcacgagcccgggaacggcuucacccucaccaucaagacggacccgaaccuguuccccugcaacgucaucagccagacccccaacgggaaguucacccugguggugccccaccagcaccggaacugcuccuucagcaucaucuacccggucgugaucaagaucuccgaccucacccugggccacgugaacgggcugcagcucaagaaguccagcgcgggcugcgagggcaucggggacuucgucgagcugcugggcgggacgggccucgaccccagcaagaugacgccccuggccgaccugugcuaccccuuccacggcccggcccagaugaagguggggugcgacaacaccgugguccgcauggugagcuccggcaagcacgugaaccgggucaccuucgaguaccgccagcucgagcccuacgagcuggagaaccccaacgggaacagcaucggcgaguucugccuguccgggcucuga

SEQ ID NO: 28693 - RNA, 591 nt, Artificial Sequence
  derived and/or modified sequence opt1 from CRH__Homo_sapiens__NP_000747
augcgccugccccuccuggugagcgccggcguccugcucguggcccugcugcccugcccgcccugccgggcgcuccugucccgcgggcccgugcccggcgcccggcaggccccgcagcacccccagccccuggacuucuuccagcccccgccccagagcgagcagccccagcagccccaggcccgccccguccuccugcggaugggggaggaguacuuccugcgccucggcaaccugaacaagucccccgccgcgccccugagcccggccuccagccuccuggccgggggcuccggcagccggcccucccccgagcaggccaccgcgaacuucuuccgcgugcugcuccagcagcugcugcucccccggcgcagccuggacuccccggccgcccuggccgagcgcggggcccggaacgcgcucggcgggcaccaggaggcccccgagcgggagcgccggagcgaggagccgcccaucucccuggaccugaccuuccaccuccugcgcgaggugcuggagauggcccgggccgagcagcucgcccagcaggcgcacagcaaccgcaagcugauggagaucaucggcaaguga

SEQ ID NO: 28694 - RNA, 1335 nt, Artificial Sequence
  derived and/or modified sequence opt1 from CRHR1__Homo_sapiens__NP_001138618
augggcgggcacccccagcugcgccucgugaaggcccugcugcuccugggccugaacccggucagcgccucccuccaggaccagcacugcgagagccugucccuggcgagcaacaucuccgggcuccagugcaacgccagcguggaccugaucgggaccugcuggccccggucccccgccggccagcuggugguccgccccugcccggccuucuucuacggcgugcgguacaacaccacgaacaacggcuaccgcgagugccucgccaacgggagcugggcggcccgggugaacuacuccgagugccaggagauccugaacgaggagaagaaguccaagguccacuaccacguggccgugaucaucaacuaccugggccacugcaucagccucgucgcccugcugguggcguucguccucuuccugcgccugcggcccgggugcacccacuggggcgaccaggccgacggggcccucgaggugggcgcccccuggagcggcgcccccuuccaggugcgccgguccauccgcugccugcggaacaucauccacuggaaccugaucagcgcguucauccuccgcaacgccaccugguucgugguccagcugaccauguccccggaggugcaccagagcaacgugggguggugccggcuggucacggccgccuacaacuacuuccacgugaccaacuucuucuggauguucggcgaggggugcuaccuccacaccgccaucgugcugaccuacuccacggaccgccugcggaaguggauguucaucugcaucggcuggggcguccccuuccccaucaucguggcgugggccaucgggaagcucuacuacgacaacgagaagugcugguucggcaagcgccccgggguguacaccgacuacaucuaccagggcccgaugauccugguccugcucaucaacuucaucuuccuguucaacaucgugcggauccugaugaccaagcuccgcgccagcaccacguccgagaccauccaguaccggaaggccgucaaggccacccuggugcugcucccccugcuggggaucaccuacaugcuguucuucgugaaccccggcgaggacgaggucagccgcgugguguucaucuacuucaacagcuuccucgaguccuuccagggcuucuucgucagcguguucuacugcuuccugaacuccgaggugcggagcgcgauccgcaagcgcuggcaccgguggcaggacaagcacuccauccgcgcccgggucgcccgcgccaugagcauccccacguccccgacccgggugagcuuccacuccaucaagcagagcaccgccguguga

SEQ ID NO: 28695 - RNA, 1317 nt, Artificial Sequence
  derived and/or modified sequence opt1 from CRHR2__Homo_sapiens__NP_001189404
augcgcggccccagcgggccgcccggccugcucuacgugccccaccuccugcugugccugcugugccuccugcccccgccccugcaguacgccgccgggcagucccagaugcccaaggaccagccccucugggcgcugcuggagcaguacugccacaccaucaugacccucacgaaccugagcggcccguacuccuacugcaacaccacccuggaccagaucgggaccugcuggccccggagcgccgccggcgcccucgucgagcgccccugccccgaguacuucaacggcgugaaguacaacacgacccggaacgccuaccgcgagugccuggagaacgggaccugggcguccaagaucaacuacagccagugcgagccgauccuggacgacaagcagcggaaguacgaccuccacuaccgcaucgcccugguggucaacuaccugggccacugcguguccguggccgcccucgucgcggccuuccugcuguuccucgcccugcggagcauccgcugccugcggaacgugauccacuggaaccucaucaccacguucauccugcgcaacgugaugugguuccugcuccagcuggucgaccacgaggugcacgaguccaacgagguguggugccggugcaucaccaccaucuucaacuacuucgucgugaccaacuucuucuggauguucguggaggggugcuaccugcacacggccaucgucaugaccuacagcaccgagcgccuccggaagugccuguuccuguucaucggcuggugcauccccuuccccaucaucguggccugggcgaucgggaagcucuacuacgagaacgagcagugcugguucggcaaggagcccggcgaccugguggacuacaucuaccaggggccgaucauccugguccuccugaucaacuucguguuccuguucaacaucgugcgcauccucaugaccaagcugcgggccuccacgaccagcgagaccauccaguaccgcaaggccgucaaggccacccuggugcuccugccccugcucggcaucacguacaugcuguucuucgugaaccccggggaggacgaccugucccagaucauguucaucuacuucaacagcuuccugcaguccuuccagggcuucuucgucagcguguucuacugcuucuucaacggcgagguccgguccgccgugcgcaagcgguggcaccgcuggcaggaccaccacagccuccgggugcccauggcgcgcgccauguccaucccgaccagccccacccgcaucagcuuccacuccaucaagcagaccgccgccgucuga

SEQ ID NO: 28696 - RNA, 3111 nt, Artificial Sequence
  derived and/or modified sequence opt1 from CRIM1__Homo_sapiens__NP_057525
auguaccugguggccggcgaccgcgggcucgccggcugcgggcaccugcuggucagccuccugggccugcuccugcugcucgcgcgguccgggacccgcgcccuggugugccugcccugcgacgagagcaagugcgaggagccgcggaacugccccggcuccaucgugcagggcgucugcgggugcugcuacaccugcgccagccagcgcaacgaguccugcggcgggacguucggcaucuacgggaccugcgaccggggccuccgcugcgugauccggcccccccugaacggcgacagccugaccgaguacgaggccggggugugcgaggacgagaacuggaccgacgaccagcuccugggcuucaagccgugcaacgagaaccugaucgccgggugcaacaucaucaacggcaagugcgagugcaacacgauccgcaccugcuccaaccccuucgaguuccccagccaggacaugugccucuccgcgcugaagcggaucgaggaggagaagcccgacugcagcaaggcccgcugcgagguccaguucuccccgcggugccccgaggacagcgugcugaucgagggcuacgccccccccggggagugcugcccgcuccccucccgcugcgugugcaaccccgccggcugccugcggaaggucugccagcccgggaaccugaacauccucgugagcaaggcguccggcaagccgggggagugcugcgaccuguacgagugcaagcccguguucggcgucgacugccgcaccguggagugcccccccgugcagcagaccgccugcccgcccgacagcuacgagacgcagguccggcugaccgccgacggcugcugcacccuccccacccgcugcgagugccuguccgggcugugcggcuuccccgugugcgagguggggagcacgccgcggaucgucucccgcggcgacgggacccccggcaagugcugcgacguguucgagugcgugaacgacaccaagcccgccugcgucuucaacaacguggaguacuacgacggcgacauguuccggauggacaacugccgcuucugccggugccaggggggcguggccaucugcuucaccgcgcagugcggggagaucaacugcgagcgcuacuacguccccgagggcgagugcugcccggugugcgaggaccccgucuaccccuucaacaacccggccgggugcuacgccaacggccucauccuggcccacggcgaccgcuggcgggaggacgacugcacguucugccagugcgugaacggggagcgccacugcguggccaccgucugcggccagaccugcaccaaccccgugaaggugcccggggagugcugccccgucugcgaggagccgacgaucaucaccguggacccccccgcgugcggcgagcugagcaacugcacccucaccggcaaggacugcaucaacggguucaagcgggaccacaacggcugccgcacgugccagugcaucaacaccgaggagcugugcagcgagcggaagcaggggugcacccugaacugccccuucggcuuccucaccgacgcccagaacugcgagaucugcgagugccgcccgcggcccaagaagugccgccccaucaucugcgacaaguacugcccccuggggcugcucaagaacaagcacggcugcgacaucugccggugcaagaagugcccggagcuguccugcagcaagaucugcccccugggcuuccagcaggacucccacgggugccucaucugcaagugccgcgaggccagcgccuccgccggcccccccauccugagcgggacgugccugaccguggacggccaccaccacaagaacgaggaguccuggcacgacgggugccgggagugcuacugccucaacggccgcgagaugugcgcgcugaucaccugcccgguccccgccugcggcaaccccaccauccaccccgggcagugcugcccgagcugcgccgacgacuucguggugcagaagcccgagcuguccacgcccagcaucugccacgcccccggcggggaguacuucgucgagggcgagaccuggaacaucgacuccugcacccagugcaccugccacagcgggcgggugcucugcgagacggaggugugcccgccccugcugugccagaaccccucccgcacccaggacagcugcugcccgcagugcaccgaccagcccuuccggcccucccugagccgcaacaacuccguccccaacuacugcaagaacgacgagggcgacaucuuccucgccgcggagagcuggaagccggacgugugcaccuccugcaucugcaucgacagcgugaucagcugcuucuccgagagcugccccuccgucagcugcgagcggcccgugcugcgcaagggccagugcugccccuacugcaucgaggacaccaucccgaagaagguggucugccacuucuccgggaaggccuacgccgacgaggagcggugggaccuggacagcugcacgcacugcuacugccuccagggccagacccugugcuccaccgugagcugccccccccugcccugcguggagccgaucaacgucgagggguccugcugccccaugugccccgagauguacgugcccgagccgaccaacauccccaucgagaagacgaaccaccgcggcgagguggaccucgaggucccccuguggcccaccccgagcgagaacgacaucgugcaccugccccgcgacauggggcaccuccagguggacuaccgggacaaccgccugcaccccuccgaggacagcucccuggacagcaucgccuccgucguggugcccaucaucaucugccucagcaucaucaucgcguuccuguucaucaaccagaagaagcaguggaucccgcugcucugcugguaccggacccccaccaagcccuccagccugaacaaccagcuggucagcguggacugcaagaagggcacgcgcgugcaggucgacuccagccagcggaugcuccgcaucgccgagcccgacgcccgguucuccggcuucuacagcaugcagaagcagaaccaccugcaggccgacaacuucuaccagaccguguga

SEQ ID NO: 28697 - RNA, 849 nt, Artificial Sequence
  derived and/or modified sequence opt1 from CRIP2__Homo_sapiens__NP_001257766
augcccccgcaccaccuccugcccuggcuggcccaggugcccagcgccgagggcgagcugguccgccucgugucccgggccgggggccgcggggcgugcuucuggcccgccgugaccauggagauggccgucgccgcgggcugcgugugcaagggcgggggcugcugccaccgggagccgagccaggaccaccacgagucccaggagcaccgcgggccccuggugggcagccagaccugccugguccaccaggccgaggggacggccgagaagguguccagccucggcaaggacuggcacaaguucugccugaagugcgagcggugcuccaagacccugacccccgggggccacgccgagcacgacggcaagcccuucugccacaagccgugcuacgcgacccucuucgggcccaagggcgugaacaucgggggcgccggcagcuacaucuacgagaagccccuggccgaggggccccaggucacgggcccgaucgaggugcccgccgcccgcgcggaggagcggaaggccuccgggccgcccaagggcccgagccgcgccuccagcgugaccaccuucaccggggagcccaacacgugcccccggugcuccaagaaggucuacuucgccgagaaggugaccagccugggcaaggacuggcaccgccccugccuccggugcgagcgcugcggcaagacccugacccccgggggccacgccgagcacgacgggcagcccuacugccacaagcccugcuacggcauccuguucgggcccaagggcgugaacacgggcgcggucggguccuacaucuacgaccgggacccggagggcaaggugcagcccuga

SEQ ID NO: 28698 - RNA, 615 nt, Artificial Sequence
  derived and/or modified sequence opt1 from CRIP3__Homo_sapiens__NP_996805
augagcuggaccugcccccgcugccagcagccgguguucuucgccgagaaggucuccagccugggcaagaacuggcaccgguucugccucaagugcgagcgcugccacuccauccugagccccgggggccacgccgagcacaacgggcggcccuacugccacaagcccugcuacggcgcgcuguucgggccgcgcggcgugaacaucggcggggugggcuccuaccucuacaacccgcccacccccagccccgggugcacgacgccccugucccccagcuccuucagcccgccccggccccgcaccggccugccccaggggaagaaguccccgccccacaugaagaccuucaccggcgagaccagccucugccccggcugcggggagcccgucuacuucgccgagaaggugaugucccugggccggaacuggcaccgccccugccugcggugccagcgcugccacaagacccucaccgccgggagccacgccgagcacgacggcgugccguacugccacguccccugcuacggcuaccuguucgggcccaagggcgugaacaucggggacgugggcugcuacaucuacgaccccgucaagaucaaguucaaguga

SEQ ID NO: 28699 - RNA, 1341 nt, Artificial Sequence
  derived and/or modified sequence opt1 from CRIPAK__Homo_sapiens__NP_787114
augcacgagcccagccugugcgccaacguggagugcccgcccgcccacaccugccccugcggcguccccgcgugcuccugcgcccacguggagugcccgcccgcccacaccugccgcugcggggugcccgccugcagccacaugcccaugugguccgcccggcuccugacgcgcgcgcacgucgagugcccgcccgcccacacccgggugcacguggagugcccccccgcccacgucccgauguggagcgcccaccugcucaccugcgcggacguggagugccaccugcugacccacgugcccaugugguccgcccgccuccugacgugccccugcggcguccccgccugcagccacgugccgaugcgguccgcccgccugcucacccgggcccacgcggagugcccccccgcccacaccugccccugcggggugccggccugcagccacguccccaugcgcuccgcccggcugcugacccgcgccgacguggagugcccccccgcgcacacgugcccgugcggcgugcccgccugcagccacguccccaccugguccgcccggcucaucacccgcgcccacguggagugcagccccgcccacaccugccggugcggggugccggcgugcucccacguccccauguggagcgugcgccugcugacgcgggccgacgccgagugccccccggcccacaccugccgcugcggcgugcccgccugcucccacguccccauguggagcgcgcggcuccugaccugccgcugcggcgugcccgccugcucccacgugccgauguggagcgcccggcugcucaccugccgcugcgggguccccgccugcucccacgugcccauguggagcgcgcggcugcugacgcgcgcccacgucgagugccccccggcccacaccugccgccggggcgugcccgccugcagccgcgcccacauggagugcccccccgcgcacaccugccacugcggggugccggccugcucccacaccugccggugcggcguccccgccugcagccacgugcccaugugguccgcccgccuccugacgcgggcccacguggagugccccccggcgcacacccgcgcccacgucgagugcccccccgcccacaccugccccugcggggugccggccugcagccacaccugccccugcggcgugcccgccugcucccacaaggcgcuggccuggugguucugccgguuccccguccucccggccgagagcgacgccgugacggugcacuccacccacggcggguuccugauccgcuucuacgucaaggaccccuucuacaucagccugcaccucgagaucaccuga

SEQ ID NO: 28700 - RNA, 306 nt, Artificial Sequence
  derived and/or modified sequence opt1 from CRIPT__Homo_sapiens__NP_054890
auggugugcgagaagugcgagaagaagcugggcaccgucaucacccccgacacguggaaggacggggcccgcaacaccaccgagagcggcgggcggaagcucaacgagaacaaggcccugaccuccaagaaggcgcgcuucgacccguacggcaagaacaaguucagcacgugccggaucugcaaguccagcgugcaccagcccgggucccacuacugccagggcugcgccuacaagaagggcaucugcgccaugugcgggaagaaggugcuggacaccaagaacuacaagcagaccagcgucuga

SEQ ID NO: 28701 - RNA, 750 nt, Artificial Sequence
  derived and/or modified sequence opt1 from CRISP1__Homo_sapiens__NP_001122
auggagaucaagcaccuccuguuccugguggccgccgccugccugcuccccaugcugagcaugaagaagaaguccgcccgcgaccaguucaacaagcuggucaccgaccucccgaacgugcaggaggagaucgugaacauccacaacgcccugcggcgccgggucgugccgcccgccagcaacaugcugaagauguccuggagcgaggaggccgcgcagaacgcccgcaucuucuccaaguacugcgacaugaccgagagcaacccccucgagcggcgccugcccaacacguucugcggcgagaacaugcacaugaccuccuaccccgugagcugguccagcgucaucggggugugguacuccgagagcaccuccuucaagcacggcgaguggaccacgaccgacgacgacaucaccaccgaccacuacacgcagaucgugugggccaccagcuaccugaucgggugcgccaucgcguccugccggcagcagggcagcccccgcuaccucuacgucugccacuacugccacgaggggaacgaccccgagaccaagaacgagccguacaagaccggcgugcccugcgaggccugccccuccaacugcgaggacaagcugugcacgaaccccugcaucuacuacgacgaguacuucgacugcgacauccaggugcacuaccugggcugcaaccacagcaccaccauccucuucugcaaggcgaccugccugugcgacacggagaucaaguga

SEQ ID NO: 28702 - RNA, 732 nt, Artificial Sequence
  derived and/or modified sequence opt1 from CRISP2__Homo_sapiens__NP_001135879
auggcccugcuccccgugcuguuccuggucaccgugcuccugccgagccugcccgccgagggcaaggaccccgccuucaccgcccuccugacgacccagcuccaggugcagcgcgagaucgucaacaagcacaacgagcugcggaaggccguguccccgcccgccagcaacaugcugaagauggaguggucccgcgaggugaccaccaacgcccagcggugggcgaacaagugcacgcugcagcacagcgaccccgaggaccgcaagaccuccacccggugcggggagaaccucuacaugagcuccgaccccaccagcugguccagcgccauccaguccugguacgacgagauccuggacuucgucuacggcguggggcccaagagcccgaacgccguggucggccacuacacgcagcuggugugguacuccaccuaccagguggggugcggcaucgccuacugccccaaccaggacagccucaaguacuacuacgucugccaguacugccccgcgggcaacaacaugaaccgcaagaacacccccuaccagcaggggaccccgugcgccggcugccccgacgacugcgacaaggggcugugcacgaacuccugccaguaccaggaccugcucagcaacugcgacucccugaagaacaccgccggcugcgagcacgagcugcucaaggagaagugcaaggcgaccugccugugcgagaacaagaucuacuga

SEQ ID NO: 28703 - RNA, 807 nt, Artificial Sequence
  derived and/or modified sequence opt1 from CRISP3__Homo_sapiens__NP_001177915
augaagcagauccugcaccccgcccucgagaccaccgacccgugcagcacgggcuucguguuccccgccaugacccuguuccccguccuccuguuccugguggcggggcugcuccccuccuucccggccaacgaggacaaggaccccgccuucaccgcccugcugaccacgcagacccaggugcagcgcgagaucgucaacaagcacaacgagcuccggcgcgccgugagcccgcccgcgcggaacaugcugaagauggaguggaacaaggaggccgccgccaacgcgcagaagugggccaaccagugcaacuaccgccacuccaaccccaaggaccggaugaccagccugaagugcggcgagaaccucuacauguccagcgccuccagcuccuggagccaggccauccaguccugguucgacgaguacaacgacuucgacuucggggugggccccaagacccccaacgccgucguggggcacuacacccagguggucugguacagcuccuaccuggugggcugcggcaacgcguacugccccaaccagaaggugcugaaguacuacuacgucugccaguacugcccggccgggaacugggccaaccgccucuacgugcccuacgagcagggcgcccccugcgccagcugccccgacaacugcgacgacgggcugugcacgaacggcugcaaguacgaggaccuguacuccaacugcaagagccucaagcugacccugaccugcaagcaccagcucgugcgggacuccugcaaggcgagcugcaacugcuccaacagcaucuacuga

SEQ ID NO: 28704 - RNA, 939 nt, Artificial Sequence
  derived and/or modified sequence opt1 from CRISPLD1__Homo_sapiens__NP_001273707
augaacaucuggggccagaucuggcccaaggccguguaccuggucugcaacuacagccccaaggggaacugguggggccacgcccccuacaagcacgggcgccccugcuccgcgugcccgcccagcuucggcgggggcugccgggagaaccucugcuacaaggagggcuccgaccgcuacuacccgccccgggaggaggagaccaacgagaucgagcgccagcagagccaggugcacgacacccacgugcggacgcgcuccgacgacagcucccggaacgaggucaucagcgcccagcagaugucccagaucgugagcugcgaggugcgccugcgggaccagugcaaggggacgaccugcaaccgcuacgagugccccgccggcugccuggacuccaaggccaaggucaucgggagcgugcacuacgagaugcaguccagcaucugccgggccgcgauccacuacggcaucaucgacaacgacgggggcuggguggacaucacccgccagggccggaagcacuacuucaucaaguccaaccgcaacgggauccagaccaucggcaaguaccagagcgccaacuccuucaccgucagcaaggugaccgugcaggccgugaccugcgagacgaccgucgagcagcucugccccuuccacaagcccgccucccacugcccccggguguacugcccccgcaacugcaugcaggcgaacccgcacuacgcccgggucaucgggacccgcguguacagcgaccugagcuccaucugccgggccgccgugcacgccggcgucgugcgcaaccacggcggguacguggacgucaugcccguggacaagcggaagaccuacaucgcgagcuuccagaacggcaucuucuccgagagccugcagaacccgcccgggggcaaggccuuccgcguguucgccgucguguga

SEQ ID NO: 28705 - RNA, 1494 nt, Artificial Sequence
  derived and/or modified sequence opt1 from CRISPLD2__Homo_sapiens__NP_113664
augagcugcgugcugggcggggucaucccccucggccugcuguuccucgugugcgggucccagggcuaccugcugccgaacgugacccuccuggaggagcugcucagcaaguaccagcacaacgagucccacagccgcguccggcgcgccaucccccgggaggacaaggaggagauccugaugcugcacaacaagcuccgcggccaggugcagccccaggccuccaacauggaguacaugaccugggacgacgagcuggagaaguccgcggccgccugggccagccagugcaucugggagcacgggcccaccagccugcucguguccaucggccagaaccugggggcccacuggggccgguaccgcagcccgggguuccacguccaguccugguacgacgaggugaaggacuacaccuaccccuaccccagcgagugcaaccccuggugcccggagcggugcuccggccccaugugcacccacuacacccagaucgugugggcgacgaccaacaagaucgggugcgccgucaacacgugccgcaagaugaccguguggggcgaggugugggagaacgccgucuacuucgugugcaacuacagccccaagggcaacuggaucggggaggcccccuacaagaacggccggccgugcuccgagugcccgcccagcuacgggggcuccugccgcaacaaccugugcuaccgggaggagaccuacacccccaagcccgagaccgacgagaugaacgagguggagaccgcgcccauccccgaggagaaccacgucuggcuccagccccgcgugaugcggccgacgaagcccaagaagaccagcgccgugaacuacaugacccaggucgugcgcugcgacaccaagaugaaggaccggugcaagggcuccacgugcaaccgcuaccagugccccgccgggugccugaaccacaaggccaagaucuucggcacccuguucuacgagagcagcuccagcaucugccgggccgcgauccacuacgggauccucgacgacaagggcgggcugguggacaucacccgcaacggcaagguccccuucuucgugaaguccgagcggcacggcgugcagagccuguccaaguacaagccgagcuccagcuucauggucuccaaggugaagguccaggaccucgacugcuacaccacgguggcccagcugugccccuucgagaagcccgccacccacugcccccgcauccacugcccggcccacugcaaggacgagcccagcuacugggcccccguguucgggaccaacaucuacgcggacaccuccagcaucugcaagacggccguccacgccggcgugaucuccaacgagagcgggggcgacguggacgucaugccgguggacaagaagaagaccuacguggggucccugcggaacggcguccagagcgagucccucggcacgccccgcgacgggaaggccuuccgcaucuucgccgugcggcaguga

SEQ ID NO: 28706 - RNA, 615 nt, Artificial Sequence
  derived and/or modified sequence opt1 from CRK__Homo_sapiens__NP_005197
auggccggcaacuucgacagcgaggagcgcuccagcugguacugggggcggcugucccgccaggaggccguggcgcuccugcagggccagcggcacggggucuuccuggugcgcgacagcuccaccagccccggcgacuacgugcucuccgucagcgagaacucccgggugagccacuacaucaucaacuccagcgggccgcgcccgcccgugcccccgucccccgcccagcccccgcccggcgucagccccucccggcugcgcaucggcgaccaggaguucgacagccugcccgcccuccuggaguucuacaagauccacuaccuggacaccacgacccucaucgagcccgugucccggagccgccagggguccggcgugauccugcggcaggaggaggccgaguacguccgcgcccuguucgacuucaacgggaacgacgaggaggaccuccccuucaagaagggcgacauccugcggauccgcgacaagcccgaggagcagugguggaacgcggaggacagcgaggggaagcggggcaugauccccgugcccuacguggagaaguaccgcccggccagcgccuccgucagcgcccugaucggcgggcgguga

SEQ ID NO: 28707 - RNA, 912 nt, Artificial Sequence
  derived and/or modified sequence opt1 from CRKL__Homo_sapiens__NP_005198
augagcuccgcccgcuucgacagcuccgaccggagcgccugguacauggggcccgugucccgccaggaggcgcagacccggcugcaggggcagcgccacggcauguuccucguccgggacagcuccacgugcccgggggacuacgugcugagcguguccgagaacagccgcgucucccacuacaucaucaacagccugcccaaccggcgcuucaagaucggcgaccaggaguucgaccaccuccccgcccugcuggaguucuacaagauccacuaccucgacaccaccacccugaucgagcccgccccgcgguaccccuccccgcccauggggagcguguccgcccccaaccugcccaccgccgaggacaaccucgaguacgugcgcacgcuguacgacuuccccggcaacgacgcggaggaccugcccuucaagaagggcgagauccucgucaucaucgagaagccggaggagcagugguggagcgcccggaacaaggacgggcgcgugggcaugauccccgugcccuacgucgagaagcuggugcgguccagcccccacgggaagcacggcaaccgcaacuccaacagcuacgggaucccggagcccgcccacgccuacgcgcagccccagaccaccaccccgcugcccgccgugagcggcucccccggcgccgccaucacgccccuccccagcacccagaacgggccggucuucgccaaggcgauccagaagcgggugcccugcgccuacgacaagaccgcccuggcccuggaggugggcgacaucgucaaggugacccgcaugaacaucaacgggcagugggagggcgaggugaacggccggaagggccucuuccccuucacgcacgucaagaucuucgacccccagaacccggacgagaacgaguga

SEQ ID NO: 28708 - RNA, 1269 nt, Artificial Sequence
  derived and/or modified sequence opt1 from CRLF1__Homo_sapiens__NP_004741
augcccgccggccgccgggggccggccgcgcagagcgcccgccggcccccgccccugcucccccugcugcuccugcugugcgugcucggcgcgccccgcgccggguccggcgcccacaccgccgucaucagcccccaggaccccacccugcugaucggguccagccuccuggccacgugcuccgugcacggcgacccgcccggcgccaccgccgaggggcuguacuggacccucaacggccggcgccugccgcccgagcugagccgggugcucaacgcguccacccuggcccuggcccucgccaaccugaacgggagccgccagcgguccggcgacaaccuggucugccacgcccgcgacgggagcauccucgcgggcuccugccuguacgugggccugccgcccgagaagcccgugaacaucagcugcugguccaagaacaugaaggaccucacgugccgguggacccccggggcccacggcgagaccuuccugcacaccaacuacagccugaaguacaagcuccgcugguacgggcaggacaacacgugcgaggaguaccacaccgucggcccccacuccugccacauccccaaggaccuggcccuguucacccccuacgagaucuggguggaggccaccaaccggcucggcagcgcccgcuccgacgugcugacgcuggacauccucgacgucgugaccaccgacccgccgcccgacgugcacgucagccgggucgggggccuggaggaccagcuguccgugcgcugggugagcccgcccgcgcucaaggacuuccuguuccaggccaaguaccagauccgguaccgcguggaggacagcguggacuggaaggucguggacgacguguccaaccagaccagcugccggcuggccgggcucaagcccggcacggucuacuucguccaggugcgcugcaaccccuucgggaucuacggcuccaagaaggccggcaucuggagcgaguggucccaccccaccgccgcgagcacgccccgguccgagcgccccgggcccggcgggggcgccugcgagccccgcgggggcgagccgagcuccggccccgugcggcgcgagcugaagcaguuccugggguggcucaagaagcacgccuacugcagcaaccuguccuuccggcuguacgaccaguggcgcgccuggaugcagaagucccacaagacccggaaccaggacgagggcauccuccccagcgggcgccggggcaccgcccgcgggcccgcgcgguga

SEQ ID NO: 28709 - RNA, 1116 nt, Artificial Sequence
  derived and/or modified sequence opt1 from CRLF2__Homo_sapiens__NP_071431
augggccgccuggugcuccuguggggcgccgccgucuuccugcucggcggguggauggcgcuggggcagggcggggccgccgagggcgugcagauccagaucaucuacuucaaccuggagaccgugcaggucaccuggaacgccagcaaguacucccggacgaaccucaccuuccacuaccgcuucaacggggacgaggccuacgaccagugcaccaacuaccugcugcaggagggccacaccagcgggugccuccuggacgcggagcagcgggacgacauccuguacuucuccauccgcaacggcacgcaccccguguucaccgccagccgguggaugguguacuaccucaagccguccagccccaagcacguccgcuucuccuggcaccaggacgccgugaccgugaccugcagcgaccuguccuacggggaccugcucuacgagguccaguaccggagccccuucgacacggaguggcaguccaagcaggagaacacgugcaacgugaccaucgagggccuggacgccgagaagugcuacagcuucugggugcgcgucaaggcgauggaggacguguacggccccgacaccuacccguccgacuggagcgaggugaccugcuggcagcgcggggagauccgggacgccugcgccgagacccccaccccgcccaagcccaagcuguccaaguucauccucaucagcucccuggccauccugcucauggucagccugcugcuccugucccuguggaagcucuggcgggugaagaaguuccugauccccagcgugcccgaccccaagagcaucuucccgggccuguucgagauccaccaggggaacuuccaggaguggaucaccgacacgcagaacgucgcccaccuccacaagauggcgggcgccgagcaggaguccggccccgaggagccccugguggugcagcuggccaagaccgaggccgagagcccccgcaugcucgacccgcagaccgaggagaaggaggccuccgggggcagccugcagcugccccaccagccccuccagggcggggacgucgugaccaucgggggcuucacguucgugaugaacgaccgguccuacgucgcgcuguga

SEQ ID NO: 28710 - RNA, 1329 nt, Artificial Sequence
  derived and/or modified sequence opt1 from CRLF3__Homo_sapiens__NP_057070
augcgcggcgccauggagcuggagcccgagcuccugcugcaggaggcccgggagaacguggaggcggcccagagcuaccgccgggagcucgggcaccgccuggagggccugcgggaggcccgccggcagaucaaggaguccgccagccagacccgcgacguccucaagcagcacuucaacgaccugaaggggacccugggcaagcuccuggacgagcggcuggugacgcuccugcaggagguggacaccaucgagcaggagaccaucaagccgcuggacgacugccagaagcucaucgagcacggggucaacaccgccgaggaccuggugcgcgagggcgagaucgcgaugcugggcggggugggcgaggagaacgagaagcucugguccuucacgaagaaggccagccacauccagcuggacucccugcccgaggucccccuccugguggacgugcccugccugagcgcccagcucgacgacuccauccugaacaucgucaaggaccacaucuucaagcacgggaccguggccagccggccgcccgugcagaucgaggagcugaucgagaagcccggcgggaucaucguccgcuggugcaagguggacgacgacuucaccgcgcaggacuaccggcuccaguuccgcaagugcaccuccaaccacuucgaggacguguacgucggcagcgagacggaguucaucgugcugcacaucgaccccaacguggacuaccaguuccgggucugcgcccgcggcgacgggcggcaggagugguccccguggagcgugccccagaucggccacuccacccuggugccccacgaguggaccgccggguucgagggcuacagccucuccagccgccggaacaucgcccugcgcaacgacuccgagagcuccggcguccuguacagccgggcccccaccuacuucugcgggcagacgcucaccuuccgcguggagaccgugggccagccggaccgccgggacagcaucggggucugcgcggagaagcaggacggcuacgacucccugcagcgcgaccaggccgugugcaucagcaccaacggggccgucuucgugaacggcaaggagaugacgaaccagcugcccgccgugaccuccggcagcaccgucaccuucgacaucgaggccgugacgcucgggaccaccuccaacaacgagggcgggcacuucaagcugcgggugaccaucagcuccaacaaccgcgaggucguguucgacuggcugcucgaccagagcugcggcucccuguacuucgggugcagcuucuucuaccccggcuggaaggugcuggucuucuga

SEQ ID NO: 28711 - RNA, 609 nt, Artificial Sequence
  derived and/or modified sequence opt1 from CRLS1__Homo_sapiens__NP_001120930
augccccaguacgagaacccguggaccauccccaacaugcugagcaugacccgcaucggccucgcccccgugcugggguaccugaucaucgaggaggacuucaacaucgcccucggcguguucgcgcuggccgggcugacggaccuccuggacggcuucaucgcccggaacugggccaaccagcgcuccgcccuggggagcgcgcucgacccccuggccgacaagauccugaucuccauccucuacgugagccugaccuacgccgaccugaucccggugccccucaccuacaugaucaucucccgggacgucaugcugaucgccgcgguguucuacgugcgcuaccggacccugcccacgccccgcacccucgccaaguacuucaacccgugcuacgccaccgcccggcugaagcccaccuucaucagcaaggucaacacggccgugcagcugauccucguggcggccucccuggccgcccccgucuucaacuacgccgacagcaucuaccugcagauccucuggugcuucaccgcguucaccaccgccgccuccgccuacagcuacuaccacuacggccgcaagacgguccaggugaucaaggacuga

SEQ ID NO: 28712 - RNA, 2061 nt, Artificial Sequence
  derived and/or modified sequence opt1 from CRMP1__Homo_sapiens__NP_001014809
auggccgaccgccggcgcgccuggaacaccgaggacgaccugcccguguaccucgcgcggcccggcagcgccgcccagacgccccgccagaaguacgggggcauguucgccgccgucgagggggcguacgagaacaagaccaucgacuucgacgccuacuccgugggccggcgcgggagcgcccggacgccccgcuccgccggccggcccgacgcggugggccugccggggcccggcgggagcgaggacaccgccuccgacgucagcgagcccuccggcagcgccguguccagccccggggagcgcgacgagcggccgcccacccugcgcauccggcgccccgcgccccgggaccucccgcugggccgcgacaacggccaguccgaccggcugcucaucaagggcgggcgcaucaucaacgacgaccagagccuguacgccgacguguaccuggaggacgggcucaucaagcagaucggcgagaaccugaucguccccggcggggugaagaccaucgaggcgaacggccggauggugauccccgggggcaucgacgucaacaccuaccugcagaagcccucccaggggaugaccgccgccgacgacuucuuccagggcacccgcgccgcccucgugggcgggacgaccaugaucaucgaccacguggucccggagcccggcagcucccugcugaccagcuucgagaaguggcacgaggcggccgacaccaaguccugcugcgacuacagccuccacguggacaucacguccugguacgacggggugcgggaggagcuggagguccuggugcaggacaagggcgugaacagcuuccaggucuacauggccuacaaggacguguaccagaugagcgacucccagcucuacgaggccuucaccuuccugaaggggcugggcgccgugauccucguccacgcggagaacggcgaccugaucgcccaggagcagaagcgcauccuggagauggggaucaccggccccgaggggcacgcccucagccgccccgaggagcuggaggccgaggccguguuccgggcgaucaccaucgccggccgcaucaacugcccgguguacaucacgaaggucauguccaagagcgccgccgacaucaucgcgcuggcccggaagaaggggccccucguguucggcgagcccaucgccgccucccugggcaccgacgggacccacuacuggagcaagaacugggccaaggcggccgccuucgucaccuccccgccccugagccccgaccccacgacccccgacuaccucaccucccugcuggccugcggcgaccuccaggugaccgggagcggccacugcccguacuccacggcccagaaggcggugggcaaggacaacuucacccugauccccgagggggucaacggcaucgaggagcgcaugaccguggugugggacaaggccgucgccaccgggaagauggacgagaaccaguucguggccgugacgagcaccaacgccgcgaagaucuucaaccuguacccccggaagggccgcaucgccgucggguccgacgccgacguggugaucugggacccggacaagcucaagaccaucaccgccaagagccacaaguccgcggucgaguacaacaucuucgagggcauggagugccacggcagcccccugguggugaucucccaggggaagaucgucuucgaggacggcaacaucaacgugaacaaggggaugggccgguucaucccccgcaaggccuuccccgagcaccuguaccagcgggugaagauccgcaacaaggucuucgggcuccagggcgugagccggggcauguacgacgggccgguguacgagguccccgccacgcccaaguacgccacccccgccccguccgccaagagcagccccuccaagcaccagcccccgcccauccgcaaccugcaccagagcaacuucucccugagcggcgcccagaucgacgacaacaacccccggcgcaccgggcaccggaucguggccccgcccggcgggcgcuccaacaucaccagccucggcuga

SEQ ID NO: 28713 - RNA, 2511 nt, Artificial Sequence
  derived and/or modified sequence opt1 from CRNKL1__Homo_sapiens__NP_001265554
augaccgccaccguggagaaccugacguuccagaaggacacccucggcaacgccgucgacaagaaccgccggcacgggagcaccgagccccuggugcuggcgugguccagccaguuccgccggcucaccuggggcugcgcccuggacgcccugcaccgcuccccgugcguggccgccagccagcacggggucacgcaccucauccgguccagccgcacgccccacuccacccggugccgcaaggaggacgcgcagcccggccaccacgggaacggcgccgccagcgugaccgcccaggcgcggggccagcgcuccgugcugcaggucccccugccggugccccggagcugccucuucuccgagagcuucguggucuccgugagcucccagagccgcuuccuggccuccgugcccgggaccggcguccagcggagcaccgccgccgacauggccgcguccaccgccgccgggaagcagcgcauccccaagguggccaaggugaagaacaaggccccggcggagguccagaucaccgccgagcagcugcuccgggaggccaaggagcgcgagcuggagcugcucccgcccccgccccagcagaagaucacggacgaggaggagcugaacgacuacaagcugcggaagcgcaagaccuucgaggacaacauccggaagaaccgcaccgugaucagcaacuggaucaaguacgcccagugggaggagagccucaaggagauccagcgggcccgcuccaucuacgagcgcgcgcuggacguggacuaccggaacaucacccuguggcucaaguacgccgagauggagaugaagaaccgccaggucaaccacgcccggaacaucugggaccgcgccaucacgacccugccccgggugaaccaguucugguacaaguacaccuacauggaggagaugcugggcaacguggccggggcgcgccaggucuucgagcgguggauggaguggcagcccgaggagcaggccuggcacagcuacaucaacuucgagcuccgcuacaaggagguggaccgggcccgcaccaucuacgagcgguucgugcugguccaccccgacgugaagaacuggaucaaguacgcccgcuucgaggagaagcacgcguacuucgcccacgcccggaaggucuacgagcgcgccguggaguucuucggcgacgagcacauggacgagcaccuguacguggccuucgcgaaguucgaggagaaccagaaggaguucgagcggguccgcgugaucuacaaguacgcccucgaccggaucuccaagcaggacgcccaggagcuguucaagaacuacacgaucuucgagaagaaguucggcgaccgccgggggaucgaggacaucaucgugagcaagcgccgcuuccaguacgaggaggaggucaaggccaacccccacaacuacgacgccugguucgacuaccugcggcucguggaguccgacgcggaggccgaggccgugcgcgaggucuacgagcgggccaucgccaacgugccgcccauccaggagaagcgccacuggaagcgguacaucuaccuguggaucaacuacgcgcuguacgaggagcucgaggccaaggaccccgagcgcacccgccagguguaccaggccagccuggagcugaucccccacaagaaguucaccuucgccaagauguggauccucuacgcgcaguucgagauccggcagaagaaccugucccuggcccggcgcgcccucggcaccagcaucgggaagugccccaagaacaagcuguucaaggucuacaucgagcuggagcuccagcugcgggaguucgaccgcugccggaagcuguacgagaaguuccucgaguucggccccgagaacugcacguccuggaucaaguucgccgagcuggagaccauccugggcgacaucgaccgcgcccgggcgaucuacgagcucgccaucagccagccccgccuggacaugccggaggugcuguggaaguccuacaucgacuucgagaucgagcaggaggagaccgagcggacccgcaaccuguaccggcgccuccugcagcggacgcagcacgugaaggucuggaucagcuucgcccaguucgagcuguccagcgggaaggagggcucccucaccaagugccgccagaucuacgaggaggccaacaagaccaugcgcaacugcgaggagaaggaggagcggcugaugcugcucgagagcuggcgcuccuucgaggaggaguucgggaccgccagcgacaaggagcggguggacaagcugaugcccgagaaggugaagaagcgccggaagguccagacggacgacggcuccgacgcggggugggaggaguacuucgacuacaucuuccccgaggacgccgccaaccagcccaaccugaagcuccuggccauggccaagcuguggaagaagcagcagcaggagaaggaggacgcggagcaccacccggacgaggacguggacgagagcgagagcuga

SEQ ID NO: 28714 - RNA, 1488 nt, Artificial Sequence
  derived and/or modified sequence opt1 from CRNN__Homo_sapiens__NP_057274
augccccagcugcuccagaacaucaacggcaucaucgaggccuuccgccgguacgcccgcaccgaggggaacugcaccgcgcugacgcggggcgagcugaagcgccuccuggagcaggaguucgccgacgugaucgucaagccgcacgaccccgccaccguggacgaggugcugcggcuccuggacgaggaccacaccgggaccgucgaguucaaggaguuccuggugcucguguucaaggucgcccaggccugcuucaagacgcugagcgaguccgcggagggcgccugcgggagccaggaguccggcagccugcacuccggcgccagccaggagcucggggagggccagcgcuccgggaccgaggugggccgggccgggaagggccagcacuacgagggcagcucccaccgccagagccagcaggggucccggggccagaaccgccccggggugcagacccagggccaggcgaccggcagcgccugggucuccagcuacgaccggcaggccgagucccagagccaggagcgcaucagcccccagauccagcuguccgggcagacggagcagacccagaaggccggcgaggggaagcggaaccagaccaccgagaugcgcccggagcggcagccccagacgcgcgagcaggaccgggcccaccagaccggcgagaccgugaccggguccggcacgcagacccaggcgggcgccacccagaccguggagcaggacagcagccaccagacggggcgcaccuccaagcagacccaggaggccaccaacgaccagaaccggggcacggagacccacgggcagggccgcagccagaccucccaggccgucaccgggggccacgcccagauccaggcgggcacgcacacccagacccccacccagacgguggagcaggacagcucccaccagaccgggagcaccuccacccagacgcaggagagcaccaacggccagaaccgggggaccgagauccacggccaggggcgcucccagaccagccaggccgugaccggcggccacacgcagauccaggccgggucccacaccgagaccgucgagcaggaccgcagccagaccgugucccacggcggggcccgggagcagggccagacgcagacccagcccggcagcgggcagcgcuggaugcaggucuccaacccggaggccggcgagaccgugcccgggggccaggcgcagaccggggccagcacggaguccggccggcaggaguggagcuccacccacccccgccggugcgugaccgagggccagggggaccgccagcccaccguggucggcgaggaguggguggacgaccacagccgggagacggugauccugcgccucgaccaggggaaccugcacaccagcgucuccagcgcccagggccaggacgccgcccaguccgaggagaagcgggggaucaccgcgcgcgagcuguacagcuaccuccgguccaccaagccguga

SEQ ID NO: 28715 - RNA, 5316 nt, Artificial Sequence
  derived and/or modified sequence opt1 from CROCC__Homo_sapiens__XP_011540774
augaccagcugggacccccagaacccggccggccugugggggcgcacccugggcauggagccccggacgcuggagagcagcgugcugugccaggagaaggggcugggcgcccgcgaccuggcccaggacgcccagaucaccagccugcccgcccugauccgggagaucgucacccgcaaccugagccagcccgagagccccgugcugcuccccgccaccgagauggccagccugcugucccuccaggaggagaaccagcugcugcagcaggagcucagccggguggaggaccugcuggcgcagucccgcgccgagcgggacgagcucgccaucaaguacaacgccgucagcgagcgccuggagcaggcgcugcggcucgagcccggggagcuggagacgcaggagccccgcggccuggugcggcaguccguggagcuccgccggcagcugcaggaggagcaggccagcuaccgccggaagcugcaggccuaccaggagggccagcagcgccaggcccagcucguccagcggcugcaggggaagauccugcaguacaagaagcgcugcuccgagcucgagcagcagcugcuggagcggagcggcgagcucgagcagcagcgccugcgggacaccgagcacucccaggaccuggagagcgcccucauccgccuggaggaggagcagcagcgcuccgcgagccuggcccaggugaacgccaugcuccgggagcagcuggaccaggccggguccgccaaccaggcgcugagcgaggacauccgcaaggugaccaacgacuggacccggugccgcaaggagcucgagcaccgggaggccgccuggcgccgggaggaggagagcuucaacgccuacuucuccaacgagcacagccgccugcugcuccuguggcggcaggucgugggcuuccgccggcugguguccgaggucaagauguucacggagcgcgaccuccugcagcucgggggcgagcuggcccggaccagccgcgcggugcaggaggccggccucgggcuguccaccggccugcggcucgccgagagccgcgccgaggccgcgcuggagaagcaggcccugcuccaggcccagcuggaggagcagcugcgggacaaggugcuccgcgagaaggaccuggcccagcagcagaugcaguccgaccuggacaaggcggaccucagcgcccgggucaccgagcuggggcuggccgugaagcgccucgagaagcagaaccuggagaaggaccaggugaacaaggaccugacggagaagcucgaggcccuggagucccugcgccuccaggagcaggccgcgcuggagaccgaggacggcgagggccugcagcagacccuccgggaccuggcccaggccguccugagcgacuccgagagcggggugcagcucuccggcagcgagcgcaccgccgacgccuccaacgggagccugcggggccuguccgggcagcgcacgccguccccgccccggcgcuccagccccggccggggccgcagcccgcggcgcgggcccucccccgcgugcagcgacuccagcacccucgcccugauccacuccgcccugcacaagcggcagcuccaggugcaggacaugcgcggccgguacgaggccagccaggaccugcuggggacccuccgcaagcagcuguccgacagcgaguccgagcggcgcgcccuggaggagcagcuccagcggcugcgcgacaagaccgacggcgcgaugcaggcccacgaggacgcccagcgggagguccagcgccugcggagcgccaacgagcuccugucccgcgagaaguccaaccuggcgcacucccuccagguggcccagcagcaggccgaggagcugcgccaggagcgggagaagcugcaggccgcccaggaggagcuccgccggcagcgcgaccggcuggaggaggagcaggaggacgcggugcaggacggggcccgcguccggcgcgagcuggagcggagccaccgccagcucgagcagcuggagggcaagcgguccgugcuggccaaggagcucgucgaggugcgcgaggcccugagccgggccacgcugcagcgcgacaugcuccaggcggagaaggccgagguggccgaggcccugaccaaggccgaggcgggccgggucgagcuggagcucuccaugaccaagcugcgcgccgaggaggccagccugcaggacagccucuccaagcugagcgcccugaacgagucccucgcgcaggacaagcuggaccugaaccggcucguggcccagcuggaggaggagaaguccgcccugcaggggcgccagcggcaggccgagcaggaggccaccguggcgcgcgaggagcaggagcgccucgaggagcugcggcuggagcaggaggucgcccgccagggccucgaggggucccugcggguggccgagcaggcccaggaggcccuggagcagcagcuccccacgcugcgccacgagcggagccagcugcaggagcagcucgcgcagcugucccgccagcugagcggccgggagcaggagcucgagcaggcccgccgggaggcccagcgccagguggaggcccuggagcgggccgcgcgcgagaaggaggcccuggccaaggagcacgccgggcucgccguccagcugguggcggccgagcgggagggccgcacccuguccgaggaggccacccggcuccgccuggagaaggaggcccuggagggcagccucuucgaggugcagcggcagcuggcgcagcuggaggcccgccgggagcagcuggaggccgaggggcaggcccuccugcuggccaaggagacccucacgggcgagcuggcggggcugcgccagcagaucaucgccacccaggagaaggccucccucgacaaggagcugauggcccagaagcugguccaggccgagcgggaggcgcaggccagccuccgcgagcagcgcgccgcccacgaggaggaccugcagcggcugcagcgcgagaaggaggccgcguggcgggagcucgaggccgagcgcgcccagcugcagucccagcugcagcgggagcaggaggagcuccuggcccgccuggaggcggagaaggaggagcucagcgaggagaucgccgcccugcagcaggagcgggacgagggccugcuccuggccgaguccgagaagcagcaggcccugagccucaaggaguccgagaagaccgcgcugagcgagaagcugaugggcacccgccacucccucgccacgaucagccuggagauggagcggcagaagcgcgacgcccagagccggcaggagcaggaccgcuccaccgugaacgcccugaccagcgagcuccgggaccugcgcgcccagcgggaggaggcggccgccgcccacgcccaggaggugcgccggcugcaggagcaggcgcgcgaccucgggaagcagcgggacuccugccugcgcgaggccgaggagcugcgcacccagcuccggcugcuggaggacgcccgcgacggccuccggcgcgagcugcuggaggcccagcggaagcuccgcgagagccaggaggggcgggagguccagcgccaggaggcgggcgagcugcggcgcucccugggggagggcgccaaggagcgggaggcccuccgccggagcaacgaggagcugcgcuccgccgugaagaaggccgagagcgagcggaucucccugaagcucgcgaacgaggacaaggagcagaagcuggcccugcucgaggaggcccgcacggccgugggcaaggaggccggggagcugcggaccggccugcaggaggucgagcgcagccggcucgaggcgcgccgggagcugcaggagcugcgccgccagaugaagaugcucgacuccgagaacacccggcuggggcgcgagcuggccgagcuccagggccggcuggcccugggggagcgcgccgagaaggagagccggcgcgagacccucggccugcggcagcgccugcucaagggcgaggccucccuggaggugaugcggcaggagcuccagguggcgcagcgcaagcuccaggagcaggagggggaguuccggacccgcgagcggcgccugcugggcagccucgaggaggcccgggggacggagaagcagcagcuggaccacgcccgcggccuggagcucaagcuggaggccgcccgggcggaggccgccgagcuggggcuccgccuguccgccgcggagggccgggcccagggccuggaggccgagcucgcccgcgucgaggugcagcgccgggccgcggaggcccagcucgggggccugcgcagcgcccuccggcgcgggcugggccuggggcgggccccgucccccgcgccccggcccgugccgggcagccccgcgcgggacgcccccgccgagggcuccggggagggccucaacagccccagcacccuggagugcuccccggggagccagccgcccucccccggccccgccaccagccccgccucccccgaccuggacccggaggcgguccgcggcgcccuccgggaguuccugcaggagcugcgcagcgcccagcgggagcgcgacgagcuccggacccagacguccgcccugaaccgccagcuggcggagauggaggccgagcgggacagcgccaccucccgcgcccggcagcuccagaaggccguggcggagagcgaggaggcccgccgguccguggacgggcgccugagcggcguccaggccgagcuggcccuccaggaggaguccgugcggcgcagcgagcgcgagcggcgcgccacccuggaccagguggcgacccuggagcggucccugcaggccacggagagcgagcuccgcgccucccaggagaagaucagcaagaugaaggccaacgagaccaagcuggagggggacaagcggcgccugaaggagguccucgacgccuccgagagccggaccgugaagcuggagcugcagcgccggagccucgagggcgagcugcagcgcucccggcuggggcucagcgaccgcgaggcgcaggcccaggcccugcaggaccggguggacucccugcagcgccaggucgccgacagcgaggugaaggcgggcacccuccagcugacgguggagcggcugaacggcgcccucgccaaggucgaggaguccgagggggcccugcgcgacaaggugcggggccugaccgaggcccucgcgcagagcuccgccagccugaacuccacccgcgacaagaaccugcaccuccagaaggcccugaccgccugcgagcacgaccgccaggugcugcagguccgcuga

SEQ ID NO: 28716 - RNA, 1923 nt, Artificial Sequence
  derived and/or modified sequence opt1 from CROT__Homo_sapiens__NP_001137407
auggagaaccagcuggccaagagcaccgaggagcgcaccuuccaguaccaggacucccuccccagccugccggugcccucccuggaggagagccucaagaaguaccuggaguccgucacgcggaccugcuaccagauccgcggccuggaccccgacgccaagcggggguuccucgaccugacccgcgagggcauccaggugaagcccuucgcgaaccaggaggaguacaagaagaccgaggagaucgugcagaaguuccagagcgggaucggcgagaagcugcaccagaagcuccuggagcgggccaaggggaagcgcaacuggcuggaggagugguggcucaacgucgccuaccuggacgugcggaucccgucccagcugaacgugaacuucgccggccccgccgcgcacuucgagcacuacuggccgcccaaggagggcacgcagcucgagcgcgggagcaucacccuguggcacaaccugaacuacuggcagcuccugcggaaggagaagguccccgugcacaaggugggcaacacgccccuggacaugaaccaguuccgcaugcuguucuccacgugcaagguccccgggaucacccgggacagcaucaugaacuacuuccgcaccgaguccgagggccggagccccaaccacaucguggugcugugccgcgggcgggccuucgucuucgacgugauccacgagggcugccuggugaccccgcccgagcuccugcgccagcugaccuacauccacaagaagugccacuccgagcccgacggccccgggaucgccgcccucaccagcgaggagcggacccgcugggcgaaggcccgggaguaccugaucggccuggacccggagaaccucgcccugcuggagaagauccaguccagccuccuggucuacuccauggaggacagcagcccccacgugacccccgaggacuacagcgagaucaucgccgccauccugaucggggaccccaccgugcgcuggggcgacaagagcuacaaccucaucuccuucagcaacggcgucuucgggugcaacugcgaccacgcgccguucgacgccaugaucauggugaacaucuccuacuacguggacgagaagaucuuccagaacgagggccgguggaaggggagcgagaagguccgcgacaucccccugcccgaggagcugaucuucaucguggacgagaaggugcucaacgacaucaaccaggccaaggcccaguaccugcgcgaggccuccgaccugcagaucgcggccuacgccuucacgagcuucggcaagaagcucaccaagaacaagaugcugcaccccgacaccuucauccagcuggcccuccagcuggccuacuaccggcugcacgggcacccgggcugcugcuacgagaccgcgaugacgcgccacuucuaccacggccggaccgagaccaugcgcuccugcaccgucgaggccgugcgguggugccagagcaugcaggaccccuccgucaaccuccgcgagcggcagcagaagaugcugcaggccuucgccaagcacaacaagaugaugaaggacugcagcgccgggaagggcuucgaccgccaccuccuggggcuccugcugaucgcgaaggaggagggccuccccgugcccgagcuguucacggacccgcuguucuccaagagcgggggcggcgggaacuucgugcucuccaccagccuggucggcuaccugcgggugcaggggguggucgugcccauggugcacaacggcuacggguucuucuaccacauccgcgacgaccgguucgucguggccugcuccgccuggaaguccugccccgagaccgacgccgagaagcucgugcagcugaccuucugcgcguuccacgacaugauccagcugaugaacuccacgcaccucuga

SEQ ID NO: 28717 - RNA, 675 nt, Artificial Sequence
  derived and/or modified sequence opt1 from CRP__Homo_sapiens__XP_011507509
auggagaagcugcucugcuuccuggugcugaccagccucucccacgccuucggccagaccgacaugagccgcaaggccuucgucuuccccaaggaguccgacacgagcuacgugucccugaaggcgccgcugaccaagccccucaaggccuucaccgugugccugcacuucuacaccgagcugagcuccacgcggggguacagcaucuucuccuacgccaccaagcgccaggacaacgagauccucaucuucuggagcaaggacaucggcuacuccuucaccgucgggggcagcgagauccuguucgaggugcccgaggugaccgucgcccccgugcacaucugcacguccugggagagcgccuccgggaucguggaguucugggucgacggcaagccgcgggugcgcaagagccugaagaagggcuacaccgugggggcggaggccuccaucauccucggccaggagcaggacagcuucgggggcaacuucgaggggucccagagccuggucggcgacaucggcaacgugaacaugugggacuucgugcugagccccgacgagaucaacaccaucuaccucgggggccccuucucccccaacguccugaacuggcgggcccugaaguacgaggugcagggggagguguucaccaagccgcagcucuggcccuga

SEQ ID NO: 28718 - RNA, 1938 nt, Artificial Sequence
  derived and/or modified sequence opt1 from CRTAC1__Homo_sapiens__NP_001193457
auggcccccagcgccgacccgggcaugucccgcaugcugcccuuccuccugcugcucugguuccugcccaucaccgaggggagccagcgggcggagcccauguucaccgccgugacgaacuccguccugccgcccgacuacgacagcaaccccacccagcucaacuacggcguggccgugaccgacgucgaccacgacggggacuucgagaucgugguggccggcuacaacgggcccaaccugguccugaaguacgaccgcgcccagaagcggcucgugaacaucgcgguggacgagcgcuccagcccguacuacgcccugcgggaccgccagggcaacgccaucggcgucaccgccugcgacaucgacggggacggccgggaggagaucuacuuccugaacacgaacaacgcguucuccgggguggccaccuacaccgacaagcuguucaaguuccgcaacaaccggugggaggacauccugagcgacgaggugaacgucgcccgcggcguggccucccuguucgccgggcggagcguggcgugcgucgaccgcaagggcuccggccgguacagcaucuacaucgccaacuacgccuacgggaacgugggccccgacgcccucaucgagauggaccccgaggccuccgaccugagccgcgggauccuggcgcuccgggacguggccgccgaggccggcgucuccaaguacaccggcgggcgcggcgugagcguggggcccauccuguccagcuccgccagcgacaucuucugcgacaacgagaacggcccgaacuuccuguuccacaaccgcggggacggcacguucgucgacgcggccgccagcgccggcguggacgacccccaccagcacgggcggggcguggcccucgcggacuucaaccgggacgggaaggucgacaucguguacggcaacuggaacgggccccaccgccuguaccugcagauguccacccacggcaagguccgguuccgcgacaucgccagccccaaguucuccaugccgagccccgugcgcaccgugaucaccgccgacuucgacaacgaccaggagcucgagaucuucuucaacaacaucgccuaccgguccagcuccgcgaaccgccuguuccgggucauccgccgggagcacggcgacccccugaucgaggagcucaaccccggggacgcccuggagccggagggccgcgggacgggcgggguggugaccgacuucgacggcgacggcaugcuggaccucauccugagccacggggaguccauggcccagccccugagcgucuuccggggcaaccagggguucaacaacaacuggcuccgcguggugccccggacccgcuucggcgccuucgcccggggcgcgaaggucgugcuguacaccaagaaguccggggcccaccuccgcaucaucgacggcgggagcggcuaccucugcgagauggagcccguggcccacuucgggcugggcaaggacgaggccuccagcgucgaggugacguggccggacggcaagauggugucccggaacgucgccagcggggagaugaacuccgugcuggagauccucuacccccgcgacgaggacacccugcaggaccccgcgccccuggagugcggccagggguucagccagcaggagaacggccacugcauggacaccaacgagugcauccaguucccguucgugugcccccgggacaagcccgucugcgugaacaccuacggguccuaccgcugccggacgaacaagaagugcagccgcggcuacgagccgaacgaggacggcaccgccugcguggcccaggucgccuuccucgggggcuacagcuccgccgcgagccggaucuccgagccccugagccgcgccuccuaccugagccucgggcugggccugugccuccagcuguacgcccuguga

SEQ ID NO: 28719 - RNA, 585 nt, Artificial Sequence
  derived and/or modified sequence opt1 from CRTAM__Homo_sapiens__NP_001291711
augugggugaagcugcucagcaucgucgccgaguucugcuucucccccuuccuggugaccgacgaggagaccgccagcgacgcgcuggagcgcaacucccucagcucccaggacccgcagcagcccacgagcaccguguccgucaccgaggacagcuccaccagcgagaucgacaaggaggagaaggagcagacgacccaggaccccgaccugaccaccgaggccaacccccaguaccugggccucgcccggaagaaguccgggauccugcugcucacgcuggugagcuuccugaucuucauccucuucaucaucgugcagcuguucaucaugaagcugcgcaaggcccacgucaucuggaagaaggagaacgagguguccgagcacacccucgagagcuaccggucccgcagcaacaacgaggagaccuccagcgaggagaagaacggccaguccagccacccgaugcggugcaugaacuacaucaccaagcuguacagcgaggccaagacgaagcgcaaggagaacgugcagcacuccaagcuggaggagaagcacauccagguccccgagagcaucguguga

SEQ ID NO: 28720 - RNA, 1206 nt, Artificial Sequence
  derived and/or modified sequence opt1 from CRTAP__Homo_sapiens__NP_006362
auggagcccggccgccgcggggccgccgcgcugcucgcccugcugugcguggccugcgcccuccgggccggccgggcgcaguacgagcgcuacagcuuccgguccuucccgcgcgacgagcugaugccccuggagagcgccuaccggcacgcccucgacaaguacuccggggagcacugggccgagagcgucggcuaccuggagaucucccugcgccuccaccggcugcugcgcgacagcgaggcguucugccaccggaacugcuccgccgcgccccagcccgagccggccgccgggcucgccagcuaccccgagcugcgccuguucggcggccuccugcggcgcgcccacugccugaagcggugcaagcaggggcuccccgccuuccgccagucccagcccagccgggaggugcuggccgacuuccagcgccgggagccguacaaguuccugcaguucgccuacuucaaggcgaacaaccuccccaaggccaucgccgccgcccacaccuuccugcugaagcaccccgacgacgagaugaugaagcgcaacauggcguacuacaagucccuccccggcgccgaggacuacaucaaggaccuggagaccaagagcuacgagucccuguucauccgggccgugcgcgccuacaacggggagaacuggcgcacgagcaucaccgacauggagcucgcccugccggacuucuucaaggcguucuacgagugccuggccgccugcgagggcucccgggagaucaaggacuucaaggacuucuaccucagcaucgccgaccacuacgucgaggugcuggagugcaagauccagugcgaggagaaccugacccccgugaucgggggcuaccccgucgagaaguucguggcgaccauguaccacuaccuccaguucgccuacuacaagcugaacgaccugaagaacgccgcccccugcgccguguccuaccuccuguucgaccagaacgacaaggucaugcagcagaaccugguguacuaccaguaccaccgcgacacguggggccucagcgacgagcacuuccagccgcggcccgaggcggugcaguucuucaacgucaccacccugcagaaggagcuguacgacuucgccaaggagaacaucauggacgacgacgagggggaggugguggaguacgucgacgaccuccuggagcuggaggagaccuccuga

SEQ ID NO: 28721 - RNA, 1953 nt, Artificial Sequence
  derived and/or modified sequence opt1 from CRTC1__Homo_sapiens__NP_001091952
auggccaccagcaacaacccccgcaaguucuccgagaagaucgcccugcacaaccagaagcaggcggaggagaccgccgccuucgaggaggugaugaaggaccucagccugacgcgggccgcccgccugcagcuccagaagucccaguaccugcagcugggccccagccgggggcaguacuacggcgggucccuccccaacgucaaccagaucggcagcgggaccauggaccugcccuuccagcccuccggcuuccugggcgaggcgcucgccgccgccccggugagccugacccccuuccaguccagcgggcuggacaccucccgcacgacccggcaccacggccucguggaccgcgucuaccgggagcgcgggcggcugggcagcccccaccgccggccccuguccguggacaagcacgggcgccaggcggacagcugcccguacggcaccauguaccucuccccgcccgccgacaccagcuggcggcgcacgaacuccgacagcgcccugcaccaguccaccaugacccccacccagcccgagagcuucagcuccggcagccaggacgugcaccagaagcggguccugcuccugacggugcccgggauggaggagaccaccuccgaggccgacaagaaccugagcaagcaggccugggacaccaagaagacgggcucccgccccaagagcugcgaggugcccgggaucaacaucuucccguccgcggaccaggagaacaccaccgcccucauccccgccacccacaacacgggcggcagccugcccgaccugaccaacauccacuuccccuccccgcuccccacgccccuggaccccgaggagccgaccuuccccgcccugagcuccagcuccagcaccgggaaccucgccgcgaaccugacccaccugggcaucgggggcgccgggcagggcauguccacccccggcagcuccccgcagcaccggcccgccggggucagcccccucucccugagcaccgaggcccgccggcagcaggccagccccacgcuguccccgcucagccccaucacccaggcgguggccauggacgcccugucccuggagcagcagcuccccuacgccuucuucacccaggccggcagccagcagcccccgccccagccccagcccccgcccccgccgccgcccgcgucccagcagcccccgcccccgccgccgccccaggcccccgugcgccugccgcccgggggcccccugcuccccagcgccucccugacccgggggccccagcccccgccccuggccgucacggugcccagcucccucccccagagcccgcccgagaaccccggccagcccuccaugggcaucgacaucgcgagcgcccccgcccugcagcaguaccgcaccuccgccgggagccccgccaaccagucccccaccagccccguguccaaccagggcuucagccccgggagcagcccccagcacaccuccacgcugggcuccgucuucggggacgcguacuacgagcagcagauggccgcccgccaggccaacgcccucagccaccagcuggagcaguucaacaugauggagaacgcgaucuccagcuccagccuguacucccccggcagcacccucaacuacucccaggccgccaugaugggccugaccgggagccacggcucccugcccgacagccagcagcugggguacgccucccacagcggcauccccaacaucauccucaccgugaccggcgaguccccgcccagccuguccaaggagcugacgagcagccucgccggggugggcgacgucuccuucgacagcgacucccaguucccccuggacgagcugaagaucgacccccucacccuggacgggcugcacaugcucaacgaccccgacauggugcuggcggaccccgccaccgaggacaccuuccggauggaccgccuguga

SEQ ID NO: 28722 - RNA, 2082 nt, Artificial Sequence
  derived and/or modified sequence opt1 from CRTC2__Homo_sapiens__NP_859066
auggccaccagcggcgccaacgggcccggcuccgcgaccgccagcgccuccaacccgcgcaaguucagcgagaagaucgcccugcagaagcagcggcaggccgaggagacggcggccuucgaggaggugaugauggacaucggguccacccgccuccaggcccagaagcugcggcuggccuacacccgcagcucccacuacggcgggagccuccccaacgucaaccagaucggcuccggccuggcggaguuccagagcccccugcacagcccccucgacuccucccggagcacccgccaccacgggcugguggagcgggugcagcgcgacccgcggcgcauggucagcccccugcggcgcuacacgcggcacaucgacuccucccccuacagccccgccuaccucuccccgccgcccgagagcagcuggcgccggaccauggccuggggcaacuuccccgccgagaaggggcagcuguuccgccugcccuccgcccucaaccggaccagcuccgacagcgcgcugcacaccuccgugaugaaccccagcccccaggacacguaccccggcccgaccccgcccuccauccugcccagccgccgcgggggcauccucgacggcgagauggaccccaaggugcccgccaucgaggagaaccugcuggacgacaagcaccuccugaagcccugggacgccaagaagcuguccagcuccagcucccggccccggagcugcgaggucccggggaucaacaucuuccccucccccgaccagcccgccaacgugccggugcucccgcccgccaugaacaccggcgggagccugcccgaccugaccaaccuccacuucccgccgccccugcccacgccccuggaccccgaggagaccgcguaccccucccucagcggcggcaacuccaccagcaaccugacccacacgaugacccaccuggggaucagccgcggcauggggcucggccccggguacgacgcccccggccugcacagcccccugucccaccccucccuccagagcucccugagcaacccgaaccugcaggccucccucagcagcccccagccccagcugcagggcucccacucccaccccagccugccggccuccagccucgcccgccacguccugcccaccaccucccuggggcaccccagccucuccgcgcccgcccugagcagcuccagcuccagcuccagcacguccagcccggugcugggcgcccccuccuaccccgccagcacccccggggccuccccgcaccaccggcgcgugccccucagcccccugucccugcucgcgggcccggccgacgcccggcgcagccagcagcagcugcccaagcaguucucccccaccaugagccccacccuguccagcaucacgcagggggucccgcuggacaccuccaagcucagcaccgaccagcggcugccgcccuaccccuacagcucccccagccuggugcuccccacccagccccacacgcccaagucccugcagcagccgggccugcccagccaguccugcagcgugcaguccagcggcgggcagccgcccggccgccagucccacuacgggacccccuacccgcccggccccagcgggcacggccagcaguccuaccaccggcccaugagcgacuucaaccucggcaaccuggagcaguucuccauggagagccccuccgccagccugguccucgacccgcccggguucuccgagggccccggguuccugggcggcgaggggcccaugggcgggccccaggacccccacaccuucaaccaccagaaccugacccacugcagccgccacggcuccgggccgaacaucauccucacgggcgacagcagccccggcuucuccaaggagaucgcggccgcccuggccggggugcccggcuucgaggugagcgccgcggggcuggagcucggccuggggcuggaggacgagcuccggauggagccgcugggccuggagggccucaacaugcuguccgaccccugcgcccugcuccccgaccccgccgucgaggagagcuuccgcuccgaccggcugcaguga

SEQ ID NO: 28723 - RNA, 1857 nt, Artificial Sequence
  derived and/or modified sequence opt1 from CRTC3__Homo_sapiens__NP_001036039
auggccgccagccccggcuccgggagcgcgaacccgcgcaaguucuccgagaagaucgcccugcacacccagcggcaggccgaggagacccgcgccuucgagcagcucaugacggaccugacccugagccgggugcaguuccagaagcuccagcagcugcgccugacccaguaccacggcgggucccuccccaacgucagccagcugcgguccagcgccuccgaguuccagcccagcuuccaccaggcggacaacgugcgcggcacccggcaccacgggcugguggagcgccccucccggaaccgcuuccacccgcuccaccggcgcagcggcgacaagcccggccggcaguucgacggguccgccuucggcgccaacuacagcucccagccccuggacgagagcuggccccgccagcagccgcccuggaaggacgagaagcaccccggguuccggcugacguccgcccucaaccgcaccaacagcgacuccgcgcugcacaccagcgcccugagcaccaagccccaggacccguacggcgggggcggccaguccgccuggcccgcccccuacaugggguucugcgacggcgagaacaacgggcacggcgaggucgccagcuuccccggcccgcucaaggaggagaaccugcugaacgugcccaagccccuccccaagcagcugugggagacgaaggagauccagucccugagcgggcggccgcgcuccugcgacgugggcgggggcaacgcguucccccacaacgggcagaaccucggccugagccccuuccugggcacccucaacaccgggggcucccugcccgaccugaccaaccuccacuacagcacgccgcugcccgccucccuggacaccaccgaccaccacuucgggagcauguccgucggcaacagcgugaacaacauccccgccgccaugacccaccucgggauccgguccagcuccggccugcagagcucccgcagcaaccccuccauccaggccacgcugaacaagaccgugcucagcagcucccugaacaaccacccgcagaccagcguccccaacgcguccgcccugcaccccagccuccggcuguucucccugagcaacccgucccucagcaccacgaaccuguccggccccagccgccgccggcagccgcccguguccccgcugacccucagccccgggcccgaggcccaccagggcuucucccgccagcugagcuccaccagcccccuggccccguaccccaccucccagauggugagcagcgaccggucccagcucagcuuccugcccacggaggcccaggcgcaggucuccccgcccccgcccuaccccgcgccccaggagcugacccagccccuccugcagcagccccgcgcccccgaggcccccgcccagcagccccaggccgccagcucccugccccagagcgacuuccagcugcuccccgcccagggguccagccugaccaacuucuucccggacgugggcuucgaccagcaguccaugcggcccgggcccgccuucccgcagcaggucccccuggugcagcagggcagccgcgagcuccaggacuccuuccaccuccggcccagccccuacuccaacugcggcagccugccgaacaccauccugcccgacuccagcacgucccuguucaaggaccugaacagcgcgcucgccgggcugcccgaggugucccugaacguggacacccccuucccgcucgaggaggagcugcagaucgagccccugagccucgacggccugaacaugcugagcgacuccagcauggggcuccuggaccccuccgucgaggagaccuuccgcgccgaccggcuguga

SEQ ID NO: 28724 - RNA, 900 nt, Artificial Sequence
  derived and/or modified sequence opt1 from CRX__Homo_sapiens__NP_000545
augauggccuacaugaaccccggcccgcacuacagcgugaacgcccuggcgcucuccgggcccagcgucgaccugaugcaccaggccgugcccuaccccuccgccccgcgcaagcagcggcgcgagcggaccaccuucacgcgcagccagcuggaggagcucgaggcccuguucgccaagacccaguaccccgacguguacgcgcgggaggaggucgcccugaagaucaaccuccccgagucccgcguccaggugugguucaagaaccggcgcgccaagugccggcagcagcgccagcagcagaagcagcagcagcagcccccgggcgggcaggccaaggcgcggcccgccaagcgcaaggccggcaccagcccccggcccuccaccgacgugugcccggacccccuggggaucagcgacuccuacagcccgccccugcccggccccuccggcagccccacgaccgccguggccaccguguccaucuggagccccgcguccgagagcccgcuccccgaggcccagcgcgccgggcuggucgccuccggccccagccugaccuccgcccccuacgcgaugacguacgccccggccagcgccuucugcagcucccccagcgccuacgggucccccagcuccuacuucagcggccucgaccccuaccuguccccgauggugccccagcucgggggccccgcgcugagcccgcuguccggccccagcguggggcccucccuggcccagagccccaccucccucagcggccaguccuacggggccuacagcccggucgacucccuggaguucaaggaccccaccggcaccuggaaguucacguacaaccccauggacccccuggacuacaaggaccagagcgccuggaaguuccagauccucuga

SEQ ID NO: 28725 - RNA, 1761 nt, Artificial Sequence
  derived and/or modified sequence opt1 from CRY1__Homo_sapiens__NP_004066
augggcgugaacgccguccacugguuccgcaaggggcugcggcuccacgacaaccccgcccugaaggagugcauccagggcgcggacaccauccgcugcguguacauccuggacccgugguucgccgggagcuccaacgugggcaucaaccgguggcgcuuccuccugcagugccuggaggaccucgacgccaaccugcggaagcugaacagccgccucuucgucauccgggggcagcccgccgacguguucccccgccuguucaaggaguggaacaucaccaagcuguccaucgaguacgacagcgagcccuucggcaaggagcgggacgccgcgaucaagaagcucgccacggaggccggcguggaggucaucgugcgcaucucccacacccuguacgaccuggacaagaucaucgagcucaacgggggccagccgccccugaccuacaagcgguuccagacccugaucagcaagauggagccccucgagauccccguggagacgaucaccuccgaggucaucgagaagugcaccaccccgcugagcgacgaccacgacgagaaguacggggugcccucccuggaggagcucggcuucgacacggacgggcugagcuccgccguguggcccggcggcgagaccgaggcgcugacccgccucgagcggcaccuggagcgcaaggccugggucgccaacuucgagcggccccgcaugaacgccaacagccugcucgccuccccgaccgggcugagccccuaccugcgguucggcugccucuccugccgccuguucuacuucaagcugacggaccucuacaagaaggugaagaagaacagcuccccgccccugagccuguacgggcagcuccuguggcgggaguucuucuacaccgcggccaccaacaacccccgcuucgacaagauggagggcaaccccaucugcgugcagauccccugggacaagaaccccgaggcccuggccaagugggccgagggccggaccggguucccguggaucgacgcgaucaugacgcagcuccgccaggagggcuggauccaccaccuggcccgccacgccgucgccugcuuccugacccgcggggaccucuggaucuccugggaggagggcaugaagguguucgaggagcugcugcucgacgccgacuggagcaucaacgcggggagcuggauguggcuguccugcagcuccuucuuccagcaguucuuccacugcuacugccccgugggcuucggccggcggaccgaccccaacggggacuacauccgccgguaccugcccguccuccgcggcuucccggccaaguacaucuacgaccccuggaacgcccccgaggggauccagaagguggccaagugccugaucggcgugaacuaccccaagccgauggucaaccacgccgaggcgagccggcugaacaucgagcgcaugaagcagaucuaccagcagcugucccgguaccgcgggcucggccugcuggccagcgugcccuccaaccccaacggcaacgggggcuucaugggguacagcgccgagaacaucccgggcugcuccagcuccgggagcugcucccagggcagcggcauccuccacuacgcccacggggacucccagcagacccaccuccugaagcagggccggagcuccauggggacgggccugagcggcgggaagcgccccucccaggaggaggacacccagagcaucggccccaaggugcagcggcagagcaccaacuga

SEQ ID NO: 28726 - RNA, 1599 nt, Artificial Sequence
  derived and/or modified sequence opt1 from CRY2__Homo_sapiens__NP_001120929
augcccgccccgcccggccgcacccacaccugguuccugcuccagagccuggaggaccuggacacgucccuccggaagcugaacagccgccuguucgugguccgggggcagcccgccgacguguucccccgccucuucaaggaguggggcgugacccggcugaccuucgaguacgacuccgagccguucgggaaggagcgcgacgcggccaucaugaagauggccaaggaggccggcgucgagguggugaccgagaacagccacacgcuguacgaccucgaccggaucaucgagcugaacgggcagaagccgccccugaccuacaagcgcuuccaggccaucaucucccggauggagcuccccaagaagcccgucggccuggugaccagccagcagauggaguccugccgcgcggagauccaggagaaccacgacgagaccuacggcgugcccagccuggaggagcucggguuccccacggagggccuggggcccgccgucuggcagggcggggagaccgaggcccuggcccggcucgacaagcaccuggagcgcaaggcguggguggccaacuacgagcggccgcgcaugaacgccaacucccugcucgccagccccaccggccugucccccuaccugcgguucggcugccucagcugccgccuguucuacuaccggcugugggaccucuacaagaaggugaagcgcaacuccacgcccccgcugagccuguucgggcagcuccuguggcgggaguucuucuacaccgccgcgaccaacaacccccgcuucgaccggauggagggcaaccccaucugcauccagauccccugggaccgcaacccggaggcccuggccaagugggccgaggggaagaccggcuuccccuggaucgacgccaucaugacccagcuccgccaggagggcuggauccaccaccuggcgcggcacgccgucgccugcuuccugacgcgcggggaccucuggguguccugggagagcggcgugcgggucuucgacgagcugcugcucgacgccgacuucuccgugaacgccgggagcuggauguggcuguccugcagcgcguucuuccagcaguucuuccacugcuacugccccgugggcuucgggcgccggaccgaccccagcggcgacuacauccgccgguaccugccgaagcucaaggccuuccccucccgcuacaucuacgagcccuggaacgcccccgagagcauccagaaggccgccaagugcaucaucggcgucgacuacccgcggcccaucgugaaccacgcggagaccucccgccugaacaucgagcggaugaagcagaucuaccagcagcugagccgcuaccgggggcucugccugcuggccuccgugcccagcugcgucgaggaccucucccacccgguggccgagcccagcuccagccaggccggcuccaugagcuccgcggggccccgcccccugccgagcggccccgccucccccaagcggaagcuggaggccgccgaggagcccccgggggaggagcugagcaagcgcgcccggguggcggagcuccccacccccgagcugcccuccaaggacgccuga

SEQ ID NO: 28727 - RNA, 528 nt, Artificial Sequence
  derived and/or modified sequence opt1 from CRYAB__Homo_sapiens__NP_001276737
auggacaucgccauccaccaccccuggauccgccggccguucuuccccuuccacagccccucccgccuguucgaccaguucuucggcgagcaccuccuggagagcgaccuguuccccaccuccaccagccucuccccguucuaccugcggccgcccagcuuccugcgcgcccccuccugguucgacacggggcucagcgagaugcggcuggagaaggaccgcuucuccgugaaccuggacgucaagcacuucagccccgaggagcucaaggugaaggugcugggcgacgucaucgaggugcacgggaagcacgaggagcggcaggacgagcacggcuucaucucccgcgaguuccaccggaaguaccgcauccccgcggacguggacccccugaccaucaccagcucccucagcuccgacgggguccugaccgugaacggcccccggaagcaggucagcggcccggagcgcacgauccccaucacccgggaggagaagcccgccgugaccgccgcccccaagaaguga

SEQ ID NO: 28728 - RNA, 648 nt, Artificial Sequence
  derived and/or modified sequence opt1 from CRYBA1__Homo_sapiens__NP_005199
auggagacccaggccgagcagcaggagcuggagacccuccccacgaccaagauggcccagaccaacccgacccccggcagccuggggcccuggaagaucacgaucuacgaccaggagaacuuccagggcaagcgcauggaguucaccuccagcugccccaacguguccgagcggagcuucgacaacguccgcucccugaagguggagagcggggcguggaucggcuacgagcacaccuccuucugcgggcagcaguucauccucgagcggggcgaguacccgcgcugggacgccuggagcggcuccaacgccuaccacaucgagcggcugaugagcuuccgccccaucugcuccgccaaccacaaggagagcaagaugaccaucuucgagaaggagaacuucaucgggcggcagugggagaucuccgacgacuaccccagccugcaggccaugggcugguucaacaacgaggugggguccaugaagauccagagcggcgcgugggucugcuaccaguaccccggguaccgcggcuaccaguacauccucgagugcgaccaccacggcggggacuacaagcacuggcgggaguggggcucccacgcccagacgagccagauccaguccauccgccggauccagcaguga

SEQ ID NO: 28729 - RNA, 594 nt, Artificial Sequence
  derived and/or modified sequence opt1 from CRYBA2__Homo_sapiens__NP_476434
augagcuccgcccccgccccgggccccgcgcccgccagccugacccucugggacgaggaggacuuccaggggcgccggugccgccugcuguccgacugcgccaacgugugcgagcggggcgggcucccccgcguccggagcgugaagguggagaacggcgucuggguggccuucgaguacccggacuuccaggggcagcaguucauccuggagaagggcgacuacccccgcugguccgccuggagcggcuccagcucccacaacagcaaccagcugcucuccuuccggcccgugcugugcgcgaaccacaacgacagccgcgucacccuguucgagggggacaacuuccagggcugcaaguucgaccucguggacgacuaccccucccugccgagcauggggugggccuccaaggacgugggcagccugaaggucuccagcggggccuggguggccuaccaguaccccggcuaccggggcuaccaguacgugcucgagcgcgaccggcacuccggggaguucugcacguacggcgagcuggggacccaggcgcacaccggccagcugcagagcauccgccggguccagcacuga

SEQ ID NO: 28730 - RNA, 591 nt, Artificial Sequence
  derived and/or modified sequence opt1 from CRYBA4__Homo_sapiens__NP_001877
augacccugcagugcaccaagagcgccggccccuggaagaugguggucugggacgaggacggguuccagggccgccggcacgaguucacggccgagugcccguccgugcucgagcugggguucgagaccgugcgcagccugaagguccucuccggcgcgugggugggguucgagcacgccggcuuccagggccagcaguacauccuggagcgcggggaguaccccagcugggacgccuggggcgggaacaccgccuaccccgccgagcggcugaccuccuuccggcccgcggccugcgccaaccaccgcgacagccggcucacgaucuucgagcaggagaacuuccugggcaagaagggggagcuguccgacgacuacccgagccuccaggccaugggcugggagggcaacgaggugggguccuuccacguccacagcggcgcgugggugugcucccaguuccccggguaccgcggcuuccaguacgugcuggagugcgaccaccacagcggcgacuacaagcacuuccgggagugggggucccacgcccccaccuuccagguccagagcauccgccggauccagcaguga

SEQ ID NO: 28731 - RNA, 759 nt, Artificial Sequence
  derived and/or modified sequence opt1 from CRYBB1__Homo_sapiens__NP_001878
augagccaggccgccaaggcguccgccagcgccaccguggccgucaaccccggccccgacaccaaggggaagggcgccccgcccgcggggacgucccccagccccggcaccacccuggcccccaccacggugcccaucaccuccgccaaggccgcggagcugcccccggggaacuaccgccucguggucuucgagcuggagaacuuccagggccggcgcgccgaguucagcggcgagugcuccaaccucgccgaccggggguucgaccgcgugcggagcaucaucguguccgccggccccugggucgccuucgagcagagcaacuuccgcggggagauguucauccuggagaagggcgaguacccccgguggaacaccugguccagcuccuaccgcagcgaccggcugauguccuuccgccccaucaagauggacgcgcaggagcacaagaucagccucuucgagggggccaacuucaagggcaacaccaucgagauccagggcgacgacgccccgucccuguggguguacggguucagcgaccgggugggcuccgucaaggugagcagcgggacgugggugggcuaccaguaccccggcuaccgcggguaccaguaccugcucgagcccggcgacuuccggcacuggaacgaguggggcgccuuccagccccagaugcagucccugcgccggcugcgcgacaagcaguggcaccucgaggggagcuucccgguccuggccaccgagccgcccaaguga

SEQ ID NO: 28732 - RNA, 618 nt, Artificial Sequence
  derived and/or modified sequence opt1 from CRYBB2__Homo_sapiens__NP_000487
auggccagcgaccaccagacccaggccggcaagccccagucccugaacccgaagaucaucaucuucgagcaggagaacuuccaggggcacagccacgagcucaacggccccugccccaaccugaaggagaccgggguggagaaggcgggcuccguccuggugcaggccgggcccugggugggcuacgagcaggccaacugcaagggcgagcaguucgucuucgagaagggggaguacccgcggugggacagcuggacguccagccggcgcaccgacucccucagcucccugcggcccaucaagguggacagccaggagcacaagaucauccuguacgagaaccccaacuucaccggcaagaagauggagaucaucgacgacgacgugcccuccuuccacgcccacggguaccaggagaaggucagcuccgugcgcgugcagagcggcaccugggucggguaccaguacccgggcuaccggggccuccaguaccugcuggagaagggggacuacaaggacuccagcgacuucggcgcgccccacccccaggugcaguccgugcgccggauccgcgacaugcaguggcaccagcgcggggccuuccaccccagcaacuga

SEQ ID NO: 28733 - RNA, 636 nt, Artificial Sequence
  derived and/or modified sequence opt1 from CRYBB3__Homo_sapiens__NP_004067
auggccgagcagcacggcgcccccgagcaggcggccgccggcaagagccacggggaccucgggggcuccuacaaggugauccuguacgagcuggagaacuuccaggggaagcgcugcgagcugagcgccgagugcccgucccucaccgacagccugcuggagaaggucggcuccauccagguggagagcggccccuggcucgccuucgagucccgggcguuccgcggggagcaguucgugcuggagaagggcgacuacccccggugggacgccuggagcaacucccgcgacagcgacucccugcucagccugcggccccugaacaucgacuccccgcaccacaagcuccaccuguucgagaaccccgccuucagcgggcgcaagauggagaucgucgacgacgacgugcccucccugugggcccacggcuuccaggaccggguggcgagcguccgcgccaucaacgggaccugggugggcuacgaguuccccggcuaccgggggcgccaguacguguucgagcggggcgaguaccgccacuggaacgagugggacgccucccagccgcagcuccagagcguccggcgcauccgggaccagaaguggcacaagcgcgggcgguuccccuccagcuga

SEQ ID NO: 28734 - RNA, 528 nt, Artificial Sequence
  derived and/or modified sequence opt1 from CRYGB__Homo_sapiens__NP_005201
augggcaagaucaccuucuacgaggaccgcgccuuccaggggcggagcuacgagugcaccacggacugccccaaccugcagccguacuucucccgcugcaacagcauccggguggaguccggcugcuggaugaucuacgagcgccccaacuaccaggggcaccaguacuuccuccggcgcggcgaguaccccgacuaccagcaguggauggggcugagcgacuccauccggagcugcugccugaucccgccccacuccggcgccuaccgcaugaagaucuacgaccgggacgagcuccgcggccagaugagcgagcugaccgacgacugcaucuccguccaggaccgguuccaccugaccgagauccacagccucaacgugcuggagggguccuggauccuguacgagaugcccaacuaccgcggccggcaguaccuccugcgccccggggaguaccggcgcuuccuggacuggggcgcgcccaacgccaagguggggagccuccggcgcgucauggaccuguacuga

SEQ ID NO: 28735 - RNA, 525 nt, Artificial Sequence
  derived and/or modified sequence opt1 from CRYGC__Homo_sapiens__NP_066269
augggcaagaucaccuucuacgaggaccgcgccuuccaggggcggagcuacgagaccacgaccgacugccccaaccugcagccguacuucucccgcugcaacagcauccggguggaguccggcugcuggaugcucuacgagcgccccaacuaccaggggcagcaguaccugcugcggcgcggcgaguaccccgacuaccagcaguggauggggcucagcgacuccauccggagcugcugccugaucccccagaccgucucccaccgccugcggcucuacgagcgcgaggaccacaagggccugaugauggagcugagcgaggacugcccguccauccaggaccgguuccaccucagcgagauccgcucccugcacgugcuggagggcugcugggugcucuacgagcugcccaacuaccgggggcgccaguaccugcuccggccccaggaguaccgccggugccaggacuggggcgccauggacgcgaaggccgggagccugcgccgggucguggaccuguacuga

SEQ ID NO: 28736 - RNA, 525 nt, Artificial Sequence
  derived and/or modified sequence opt1 from CRYGD__Homo_sapiens__NP_008822
augggcaagaucacccuguacgaggaccgcggguuccagggccggcacuacgagugcagcuccgaccaccccaaccuccagccguaccugagccgcugcaacuccgcccggguggacagcgggugcuggaugcuguacgagcagcccaacuacuccggccuccaguacuuccugcgccgcggggacuacgccgaccaccagcaguggaugggccugagcgacuccguccggagcugccggcucaucccccacuccggcagccaccgcauccggcuguacgagcgcgaggacuaccgggggcagaugaucgaguucaccgaggacugcuccugccugcaggaccgcuuccgguucaacgagauccacagccucaacgugcuggagggcuccugggugcuguacgagcucagcaacuaccgcgggcggcaguaccugcugaugcccggcgacuaccgccgguaccaggacuggggcgcgacgaacgcccgcgucgggucccuccggcgcgugaucgacuucagcuga

SEQ ID NO: 28737 - RNA, 537 nt, Artificial Sequence
  derived and/or modified sequence opt1 from CRYGS__Homo_sapiens__NP_060011
augagcaagaccggcaccaagaucacguucuacgaggacaagaacuuccaggggcgccgguacgacugcgacugcgacugcgccgacuuccacaccuaccugucccgcugcaacagcaucaagguggagggcgggaccugggccgucuacgagcggcccaacuucgcgggcuacauguacauccucccgcagggggaguaccccgaguaccagcgcuggaugggccugaacgaccggcuguccagcugccgcgccgugcaccuccccuccggcgggcaguacaagauccagaucuucgagaagggcgacuucagcgggcagauguacgagaccacggaggacugccccuccaucauggagcaguuccacaugcgggagauccacagcugcaaggugcuggagggcgucuggaucuucuacgagcugccgaacuaccgcgggcggcaguaccuccuggacaagaaggaguaccgcaagcccaucgacuggggcgccgccucccccgccgugcagagcuuccggcgcaucguggaguga

SEQ ID NO: 28738 - RNA, 960 nt, Artificial Sequence
  derived and/or modified sequence opt1 from CRYL1__Homo_sapiens__NP_057058
auggccagcuccgccgcgggcugcguggucaucguggggagcggcgugaucgggcgcuccugggccaugcuguucgccagcggcggguuccaggucaagcuguacgacaucgagcagcagcagauccggaacgcccuggagaacauccgcaaggagaugaagcugcucgagcaggccggcucccugaagggcagccuguccguggaggagcagcucagccugaucuccgggugccccaacauccaggaggcgguggagggcgccaugcacauccaggagugcgucccggaggaccuggagcucaagaagaagaucuucgcccagcuggacagcaucaucgacgaccgggugauccuguccagcuccaccagcugccucaugcccuccaagcuguucgccgggcuggugcacgucaagcagugcaucguggcgcaccccgugaacccgcccuacuacaucccccucgucgagcuggugccccaccccgagaccgccccgacgaccguggaccgcacccacgcccugaugaagaagaucggccagugccccaugcggguccagaaggagguggccggguucgugcucaaccgccugcaguacgccaucaucagcgaggcguggcggcuggucgaggagggcaucgugucccccagcgaccucgaccuggugauguccgagggccuggggaugcgcuacgccuucaucggcccccucgagaccaugcaccugaacgccgaggggaugcugagcuacugcgaccgguacagcgagggcaucaagcacguccuccagacguucggcccgauccccgaguucucccgcgccaccgccgagaaggugaaccaggacaugugcaugaaggugcccgacgaccccgagcaccuggcggcccggcgccaguggcgggacgagugccugaugcgccucgccaagcucaagagccagguccagccgcaguga

SEQ ID NO: 28739 - RNA, 945 nt, Artificial Sequence
  derived and/or modified sequence opt1 from CRYM__Homo_sapiens__NP_001879
augagccgcgugcccgccuuccuguccgccgcggaggucgaggagcaccuccggagcuccagccugcugaucccgccccucgagaccgcccuggccaacuucuccagcggccccgagggcggggugaugcagcccgugcgcaccgucgugccggugacgaagcaccggggguaccugggcgucaugcccgccuacuccgccgcggaggacgcccucaccaccaagcuggugaccuucuacgaggaccgcgggaucacgagcgugguccccucccaccaggccaccgugcuccuguucgagcccagcaacggcacccugcuggccgugauggacggcaacgucaucaccgcgaagcggacggccgccguguccgccaucgccaccaaguuccucaagccgcccagcuccgaggugcugugcauccugggggcgggcguccaggccuacagccacuacgagaucuucaccgagcaguucuccuucaaggaggugcgcaucuggaaccggaccaaggagaacgccgagaaguucgccgacacggugcagggggagguccgcgugugcagcuccgugcaggaggccgucgcgggcgccgacgugaucaucaccgugacccucgccaccgagcccauccuguucggggagugggucaagcccggcgcccacaucaacgccgugggcgcgagccggccggacuggcgcgagcuggacgacgagcucaugaaggaggccguccuguacguggacucccaggaggccgcccugaaggagagcggggacgugcuccugagcggcgccgagaucuucgcggagcugggggaggucaucaagggcgugaagcccgcccacugcgagaagacgaccguguucaagucccucggcauggccgucgaggacaccguggccgcgaagcugaucuacgacagcugguccagcgggaaguga

SEQ ID NO: 28740 - RNA, 1050 nt, Artificial Sequence
  derived and/or modified sequence opt1 from CRYZL1__Homo_sapiens__NP_665857
augaagggccuguacuuccagcagagcuccaccgacgaggagaucaccuucguguuccaggagaaggaggaccuccccgugacggaggacaacuucgugaagcuccaggugaaggccugcgcccugagccagaucaacaccaagcugcuggcggagaugaagaugaagaaggaccuguucccggucgggcgcgagaucgccggcaucgugcucgacgugggguccaaggucagcuucuuccagcccgacgacgagguggugggcauccugccccuggacuccgaggaccccgggcucugcgaggucgugcgggugcacgagcacuaccugguccacaagccggagaaggugaccuggaccgaggccgccggcagcauccgcgacggcgugcgggccuacacggcgcugcacuaccucucccaccugagccccgggaaguccguccugaucauggacggcgccagcgccuucgggaccaucgccauccagcucgcgcaccaccgcggcgccaaggugaucuccaccgccugcagccuggaggacaagcagugccuggagcgguuccgcccgcccaucgcccgggugaucgacgucuccaacgggaaggugcacguggccgagagcugccucgaggagaccggcggccugggggucgacaucgugcuggacgcgggcgugcgccucuacuccaaggacgacgagcccgccgucaagcugcagcugcucccccacaagcacgacaucaucacgcugcugggggugggcggccacugggucaccaccgaggagaaccuccagcuggacccgcccgacagccacugccuguuccucaagggggccacccuggccuuccugaacgacgagguguggaaccucuccaacgugcagcagggcaaguaccugugcauccugaaggacgucauggagaagcucagcacggggguguuccggccccagcuggacgagcccaucccccuguacgaggccaagguguccauggaggcgguccagaagaaccagggccgcaagaagcaggucgugcaguucuga

SEQ ID NO: 28741 - RNA, 1482 nt, Artificial Sequence
  derived and/or modified sequence opt1 from CSAD__Homo_sapiens__NP_001231634
auggccgacagcgaggcccugcccucccucgcgggcgacccgguggccgucgaggcccugcugcgcgccguguucgggguggucguggacgaggccauccagaagggcaccagcgugucccagaaggucugcgaguggaaggagcccgaggagcucaagcagcugcuggaccucgagcugcggagccagggggagucccagaagcagauccuggagcgcugccgggcggugauccgcuacagcgugaagaccggccacccccgguucuucaaccagcuguucuccgggcuggacccccacgcccuggccggccgcaucaucacggagagccucaacaccucccaguacaccuacgagaucgccccggucuucgugcugauggaggaggaggugcugcggaagcuccgcgcgcuggucggcuggagcuccggggacggcaucuucugccccgggggcagcaucuccaacauguacgccgugaaccuggcccgguaccagcgcuaccccgacugcaagcagcgggggcuccgcacccugcccccgcuggcccucuucacgagcaaggagugccacuacuccauccagaagggcgccgcguuccugggccuggggaccgacagcgugcgggucgugaaggccgacgagcgcggcaagauggugcccgaggaccucgagcggcagaucgggauggccgaggccgagggcgccguccccuuccugguguccgcgaccagcggcaccacggugcugggggccuucgacccccucgaggccaucgccgacgucugccagcgccacggccuguggcugcacguggacgccgcguggggcggguccgugcuccugagccagacccaccggcaccuccucgacgggauccagcgcgccgacagcgucgccuggaacccgcacaagcugcuggccgccggccuccagugcuccgcgcugcugcuccaggacaccagcaaccugcugaagcggugccacggcucccaggccagcuaccucuuccagcaggacaaguucuacgacguggcccuggacaccggggacaaggucgugcagugcggccgccggguggacugccugaagcucuggcugauguggaaggcccagggggaccagggccuggagcgccgcaucgaccaggcguucguccucgcccgguaccugguggaggagaugaagaagcgcgagggguucgagcuggugauggagcccgaguucgucaacgugugcuucugguucgugccgcccucccugcggggcaagcaggagagccccgacuaccacgagcgccucuccaaggucgcccccgugcugaaggagcggauggugaaggagggcagcaugaugaucggguaccagccccacggcacgcgcgggaacuucuuccgggucgugguggccaacuccgcccugaccugcgcggacauggacuuccuccugaacgagcuggagcgccucggccaggaccuguga

SEQ ID NO: 28742 - RNA, 333 nt, Artificial Sequence
  derived and/or modified sequence opt1 from CSAG3__Homo_sapiens__NP_001123300
auguggaugggccugauccagcucguggagggggucaagcgcaaggaccagggcuuccuggagaaggaguucuaccacaagaccaacaucaagaugcggugcgaguuccuggccugcuggcccgccuucaccgugcucggggaggcguggcgcgaccagguggacuggagccggcugcugcgcgacgccggccucgucaagaugucccggaagccgcgcgccagcagcccccuguccaacaaccacccgcccacgcccaagcgguucccccgccagcccgggcgggagaagggccccaucaaggaggugccgggcaccaaggggucccccuga

SEQ ID NO: 28743 - RNA, 2748 nt, Artificial Sequence
  derived and/or modified sequence opt1 from CSE1L__Homo_sapiens__NP_001243064
auggagcugagcgacgccaaccuccagacccugaccgaguaccugaagaagacgcucgaccccgacccggccauccgccggcccgcggagaaguuccuggaguccguggagggcaaccagaacuacccccugcuccugcugacccuccuggagaagucccaggacaacgucaucaaggugugcgccagcgugaccuucaagaacuacaucaagcgcaacuggcggaucgucgaggacgagcccaacaagaucugcgaggccgaccgcguggccaucaaggccaacaucgugcaccugaugcucagcuccccggagcagauccagaagcagcugagcgacgcgaucuccaucaucgggcgggaggacuucccccagaaguggcccgaccugcucaccgagauggucaaccgcuuccagagcggcgacuuccacgugaucaacggggugcugcggacggcccacucccuguucaagcgcuaccggcacgaguucaagagcaacgagcucuggaccgagaucaagcugguccuggacgccuucgcccucccccugaccaaccuguucaaggcgaccaucgagcucugcuccacgcacgccaacgacgccagcgcccugcgcauccuguucuccagccucauccugaucuccaagcuguucuacagccucaacuuccaggaccugccggaguucuucgaggacaacauggagaccuggaugaacaacuuccacacccugcucacccuggacaacaagcugcuccagacggaccugguguccaacgccauccaguuccuggcgagcgugugcgagcggccccacuacaagaaccucuucgaggaccagaacacccugaccuccaucugcgagaaggucaucgugcccaacauggaguuccgcgccgccgacgaggaggccuucgaggacaacagcgaggaguacauccggcgcgaccuggagggcagcgacaucgacacccggcgccgggccgcgugcgaccucgugcgcgggcugugcaaguucuucgagggccccgucacgggcaucuucuccggguacgugaacagcaugcugcaggaguacgccaagaacccguccgugaacuggaagcacaaggacgccgccaucuaccucgucaccagccuggccuccaaggcgcagacccagaagcacggcaucacccaggccaacgagcuggugaaccucacggaguucuucgugaaccacauccugcccgaccugaaguccgccaacgucaacgaguuccccgugcugaaggccgacgggaucaaguacaucaugaucuuccggaaccaggugcccaaggagcaccuccuggucagcaucccgcugcucaucaaccaccuccaggccgagagcaucgugguccacaccuacgcggcccacgcccuggagcgccuguucaccaugcggggccccaacaacgccacccuguucacggcggccgagaucgcccccuucguggagauccugcucaccaaccuguucaaggcccugacccuccccggguccagcgagaacgaguacaucaugaaggccaucaugcgcuccuucagccugcugcaggaggcgaucaucccguacauccccacccucaucacgcagcugacccagaagcugcucgccguguccaagaaccccagcaagccccacuucaaccacuacauguucgaggccaucugccuguccauccgcaucacgugcaaggccaacccggccgcggucgugaacuucgaggaggcccuguuccucguguucaccgagauccugcagaacgacguccaggaguucauccccuacguguuccaggugaugagccugcuccuggagacccacaagaacgacauccccuccagcuacauggcccuguucccccaccuccugcagccgguccugugggagcggaccggcaacauccccgcccucgugcgccugcugcaggccuuccucgagcggggcuccaacaccaucgcgagcgccgccgccgacaagauccccgggcugcugggcguguuccagaagcucaucgcgagcaaggccaacgaccaccagggguucuaccugcugaacuccaucaucgagcacaugccgcccgagagcgucgaccaguaccgcaagcagaucuucauccuccuguuccagcggcugcagaacuccaagaccacgaaguucaucaagagcuuccucguguucaucaaccuguacugcaucaaguacggcgcccuggcccuccaggagaucuucgacggcauccagcccaagauguucgggauggugcuggagaagaucaucauccccgagauccagaaggucuccggcaacguggagaagaagaucugcgccguggggaucaccaagcugcucaccgagugcccgcccaugauggacaccgaguacaccaagcuguggacgccccugcuccagagccugaucggccuguucgagcuccccgaggacgacaccaucccggacgaggagcacuucaucgacaucgaggacacccccggguaccagaccgcguucucccagcuggccuucgccggcaagaaggagcacgaccccgucggccagauggugaacaaccccaagauccaccuggcccagagccuccacaagcuguccacggccugcccggggcgcgugcccagcauggucuccaccagccugaacgcggaggcccuccaguaccugcagggcuaccugcaggccgccuccgugacccuccuguga

SEQ ID NO: 28744 - RNA, 2919 nt, Artificial Sequence
  derived and/or modified sequence opt1 from CSF1R__Homo_sapiens__NP_005202
augggccccggggugcugcuccugcugcucgucgccaccgccuggcacggccaggggaucccggugaucgagcccagcgugcccgagcuggucgugaagcccggcgcgaccgugacgcugcgcugcgucgggaacggcuccguggagugggacggcccgcccagcccccacuggacccucuacuccgacgggagcuccagcauccuguccaccaacaacgccaccuuccagaacacgggcaccuaccggugcaccgagcccggggacccgcugggcgggagcgccgccauccaccucuacgugaaggaccccgcccgccccuggaacguccuggcgcaggaggugguggucuucgaggaccaggacgcccugcuccccugccugcugaccgacccggugcucgaggccggcgugucccugguccgggugcgcggccggccccugaugcgccacacgaacuacagcuucucccccuggcacggguucaccauccaccgggccaaguucauccagagccaggacuaccagugcuccgcgcucaugggcgggcgcaaggugaugagcaucuccauccggcugaagguccagaaggugauccccggcccgcccgcccugacccucgugcccgccgagcugguccgcauccggggcgaggccgcccagaucgugugcagcgcguccagcguggacgucaacuucgacguguuccugcagcacaacaacaccaagcucgccaucccccagcaguccgacuuccacaacaaccgcuaccagaagguccugacgcugaaccucgaccagguggacuuccagcacgccgggaacuacagcugcguggccagcaacguccagggcaagcacuccaccagcauguucuuccgggugguggaguccgccuaccugaaccugagcuccgagcagaaccucauccaggaggucaccgugggggagggccugaaccugaaggugauggucgaggcguacccggggcuccagggcuucaacuggaccuaccugggccccuucagcgaccaccagcccgagcccaagcuggccaacgccacgaccaaggacaccuaccgccacaccuucacgcucucccugccgcggcugaagcccagcgaggccgggcgcuacuccuuccucgcccggaaccccggcggguggcgcgcgcugaccuucgagcugacccuccgguacccgcccgaggugagcgugaucuggaccuucaucaacggcuccgggacgcugcugugcgccgccagcggcuacccccagcccaacgucaccuggcuccagugcuccggccacaccgaccgcugcgacgaggcccaggugcuccaggugugggacgacccguaccccgagguccugagccaggagcccuuccacaaggugaccgugcagucccuccugacggucgagacccuggagcacaaccagaccuacgagugccgggcccacaacagcgugggguccggcagcugggcguucauccccaucuccgccggggcccacacccacccgcccgacgaguuccuguucacgcccguggucguggccugcaugagcaucauggcgcuccugcugcuccugcugcuccugcugcucuacaaguacaagcagaagcccaaguaccaggugcgcuggaagaucaucgagagcuacgagggcaacuccuacaccuucaucgacccgacccagcugcccuacaacgagaagugggaguucccccgcaacaaccugcaguucgggaagacccucggcgccggcgccuucgggaaggucguggaggccacggccuucggccuggggaaggaggacgcggugcugaaggucgccgugaagaugcucaagagcaccgcccacgccgacgagaaggaggcccugauguccgagcugaagaucaugagccaccucggccagcacgagaacaucgugaaccugcugggcgcgugcacccacgggggccccguccucgugaucaccgaguacugcugcuacggggaccugcugaacuuccuccggcgcaaggccgaggccaugcugggcccgucccugagccccgggcaggaccccgagggcggcguggacuacaagaacauccaccucgagaagaaguacguccggcgcgacuccggguucagcucccagggcguggacaccuacguggagaugcggcccgucagcacguccagcaacgacuccuucagcgagcaggaccuggacaaggaggacgggcgcccgcuggagcuccgggaccugcugcacuucuccagccagguggcccagggcauggccuuccucgcguccaagaacugcauccaccgcgacguggccgcccggaacguccugcugaccaacgggcacguggccaagaucggcgacuucggccucgcgcgcgacaucaugaacgacagcaacuacaucgugaaggggaacgcccggcugcccgucaaguggauggcccccgagagcaucuucgacugcguguacaccgugcaguccgacgucuggagcuacggcauccugcucugggagaucuucucccuggggcugaaccccuacccgggcauccucgugaacagcaaguucuacaagcuggugaaggacggguaccagauggcccagcccgccuucgcgcccaagaacaucuacuccaucaugcaggccugcugggcccuggagcccacccaccgcccgacguuccagcagaucugcagcuuccuccaggagcaggcccaggaggaccggcgcgagcgggacuacaccaaccugcccuccagcucccgcagcggcggcuccgggagcuccagcuccgagcuggaggaggagagcuccagcgagcaccugaccugcugcgagcagggcgacaucgcccagccccugcugcagccgaacaacuaccaguucugcuga

SEQ ID NO: 28745 - RNA, 435 nt, Artificial Sequence
  derived and/or modified sequence opt1 from CSF2__Homo_sapiens__NP_000749
auguggcugcagagccuccugcugcucggcaccguggccugcuccaucagcgcccccgcgcgcuccccgagccccuccacccagcccugggagcacgucaacgccauccaggaggcccggcgccugcugaaccucagccgggacacggccgccgagaugaacgagaccguggaggugaucuccgagauguucgaccugcaggagccgaccugccugcagacccgccucgagcuguacaagcaggggcugcggggcagccucacgaagcugaaggggccccugaccaugauggcgucccacuacaagcagcacugcccgcccacccccgagaccagcugcgccacgcagaucaucaccuucgaguccuucaaggagaaccucaaggacuuccugcuggucauccccuucgacugcugggagcccgugcaggaguga

SEQ ID NO: 28746 - RNA, 1305 nt, Artificial Sequence
  derived and/or modified sequence opt1 from CSF2RA__Homo_sapiens__NP_001155002
augcugcuccuggugaccagccugcuccugugcgagcugccccacccggccuuccuccugauccccgagaaguccgaccugcgcaccgucgcccccgcgagcucccucaacgugcgguucgacagccgcacgaugaaccuguccugggacugccaggagaacaccaccuucagcaagugcuuccugaccgacaagaagaaccggguggucgagccccgccucuccaacaacgagugcagcugcacguuccgggagaucugccugcacgagggcgugaccuucgaggugcacgucaacaccucccagcgcggguuccagcagaagcugcucuacccgaacagcggccgggaggggaccgccgcccagaacuucuccugcuucaucuacaacgccgaccugaugaacugcacgugggcccgcggccccaccgcgccccgggacgugcaguacuuccuguacauccgcaacagcaagcggcgccgggagauccgcugccccuacuacauccaggacuccgggacccacgugggcugccaccucgacaaccugagcggccugaccucccggaacuacuuccucgucaacgggacgagccgcgagaucggcauccaguucuucgacucccugcuggacaccaagaagaucgagcgguucaacccgcccagcaacgugaccgugcgcugcaacaccacgcacugccucguccgguggaagcagccccgcaccuaccagaagcuguccuaccuggacuuccaguaccagcucgacgugcaccggaagaacacccagcccgggaccgagaaccugcugaucaacgugagcggcgaccucgagaaccgcuacaacuucccgagcuccgagccccgcgccaagcacagcgucaagauccgggccgccgacgugcgcauccugaacugguccagcugguccgaggcgaucgaguucgggagccacuccgugacgcaggccggcguccaguggcacaaccugggcagccuccagccgcccagcccccggcugaagcgcuucuccugccugcggcuccccggguccgacgacggcaaccuggggagcguguacaucuacgugcugcucaucgucggcacccuggugugcggcaucgugcugggguuccucuucaagcgcuuccugcggauccagcgccuguucccgcccgucccccagaucaaggacaagcucaacgacaaccacgagguggaggacgagaucaucugggaggaguucacccccgaggagggcaagggguaccgggaggagguccugaccgugaaggagaucacguga

SEQ ID NO: 28747 - RNA, 2694 nt, Artificial Sequence
  derived and/or modified sequence opt1 from CSF2RB__Homo_sapiens__NP_000386
auggugcuggcccagggccuccugagcauggcccugcucgcgcugugcugggagcgcucccuggccggggccgaggagaccaucccccuccagacccugcggugcuacaacgacuacacgagccacaucacgugccgcugggccgacacccaggacgcccagcggcuggucaacgugacccucauccgccgggugaacgaggaccugcuggagcccgucuccugcgaccucagcgacgacaugcccugguccgcgugcccccacccccgcugcgugccgcggcgcugcgugauccccugccagagcuucgucgugacggacguggacuacuucuccuuccagcccgaccggccccugggcacccgccugaccgucacccucacgcagcacgugcagccgcccgagccccgggaccugcagaucagcaccgaccaggaccacuuccugcucaccugguccguggcccuggggagcccccagucccacuggcugagcccgggcgaccucgaguucgaggucguguacaagcgccugcaggacuccugggaggacgccgccauccugcucagcaacaccucccaggcgacgcuggggcccgagcaccugaugcccagcuccaccuacguggcccggguccgcacccggcucgcccccggcagccgccuguccggccggccgagcaaguggagccccgaggugugcugggacucccagcccggggacgaggcccagccccagaaccuggagugcuucuucgacggcgccgcggugcucagcugcuccugggagguccgcaaggagguggccagcuccgugagcuucgggcuguucuacaagccgucccccgacgccggcgaggaggagugcagccccguccugcgggaggggcucggcucccugcacacccgccaccacugccagauccccgugccggaccccgccacccacggccaguacaucgugagcguccagccccggcgcgccgagaagcacaucaaguccagcgugaacauccagauggcgcccccgucccugaacgucaccaaggacggggacagcuacucccuccgcugggagaccaugaagaugcgguacgagcacaucgaccacaccuucgagauccaguaccgcaaggacacggccaccuggaaggacagcaagaccgagacccugcagaacgcccacuccauggcccugcccgcccucgagcccagcacgcgguacugggcgcgcgugcgggugcgcaccucccggaccggcuacaacgggaucuggagcgaguggagcgaggcccgcuccugggacaccgagagcguccugccgaugugggugcuggcccucaucgugaucuuccugacgaucgccguccugcucgcccugcgguucugcggcaucuacggcuaccgccugcggcgcaagugggaggagaagauccccaaccccuccaagagccaccucuuccagaacggguccgcggagcuguggcccccgggcagcauguccgccuucaccagcggguccccgccccaccagggccccugggggagccgguuccccgagcuggagggcguguuccccgugggcuucggggacuccgaggucagcccccugaccaucgaggaccccaagcacgugugcgacccgcccuccggccccgacaccacgcccgccgccagcgaccucccgaccgagcagccgcccagcccccagcccgggccgcccgcggccucccacacccccgagaagcaggccuccagcuucgacuucaacggccccuaccuggggccgccccacagccgcucccugcccgacauccucggccagcccgagccgccccaggagggcgggagccagaaguccccgccgcccggcagccuggaguaccugugccuccccgccgggggccaggugcagcuggucccccuggcccaggcgauggggcccggccaggccguggagguggagcggcgccccucccagggcgccgccgggagccccucccucgagagcggcgggggccccgccccgcccgcgcugggcccccgggucgggggccaggaccagaaggacucccccguggccauccccaugagcuccggggacaccgaggaccccggcguggccagcggguacgucuccagcgccgaccugguguucacgcccaacuccggcgccagcuccgugagccucgucccgucccugggccugcccagcgaccagacccccagccucugccccgggcuggcguccggcccgcccggggcccccggccccgucaagagcggguucgagggcuacguggagcugccgcccaucgagggccgcagcccccgguccccgcgcaacaaccccgugccgcccgaggccaagucccccgugcucaaccccggggagcgccccgccgacgugagccccaccuccccgcagcccgagggccugcugguccuccagcaggucggggacuacugcuuccugcccggccuggggcccggcccgcucagccugcgguccaagcccagcucccccggccccgggccggagaucaagaaccuggaccaggcguuccaggugaagaagccgcccggccaggccgugccccaggugcccgugauccagcuguucaaggcccucaagcagcaggacuaccugagccucccgcccugggaggucaacaagcccggggaggugugcuga

SEQ ID NO: 28748 - RNA, 624 nt, Artificial Sequence
  derived and/or modified sequence opt1 from CSF3__Homo_sapiens__NP_000750
auggccggccccgccacccagagcccgaugaagcugauggcgcuccagcugcugcucuggcacuccgcccuguggaccgugcaggaggccacgccccuggggcccgccagcucccucccccagagcuuccugcugaagugccucgagcagguccgcaagauccagggcgacggggccgcgcugcaggagaagcugguguccgagugcgccaccuacaagcucugccacccggaggagcuggugcugcucggccacagccuggggauccccugggcgccccuguccagcugccccucccaggcccuccagcuggccggcugccugagccagcuccacuccggccuguuccuguaccaggggcuccugcaggcccuggagggcaucagcccggagcucgggcccacccuggacacccugcagcucgacgucgccgacuucgccacgaccaucuggcagcagauggaggagcugggcauggcccccgcgcugcagcccacccagggggccaugccggccuucgccuccgccuuccagcggcgcgcgggcggcgugcucguggccagccaccuccaguccuuccuggaggucagcuaccgggugcugcgccaccuggcccagcccuga

SEQ ID NO: 28749 - RNA, 1599 nt, Artificial Sequence
  derived and/or modified sequence opt1 from CSGALNACT1__Homo_sapiens__NP_001123990
augaugauggugcgccggggccugcuggccuggaucagccgcgucguggugcugcugguccuccugugcugcgccaucuccgugcuguacaugcucgcgugcacccccaagggggacgaggagcagcuggcccugccgcgggccaacagccccaccggcaaggagggguaccaggccgugcuccaggagugggaggagcagcaccgcaacuacgucuccagccugaagcggcagaucgcccagcugaaggaggagcuccaggagcgcuccgagcagcugcggaacggccaguaccaggcgagcgacgccgccgggcugggccucgaccgcuccccgcccgagaagacgcaggccgaccugcuggcguuccuccacagccagguggacaaggccgaggugaacgccggcgucaagcuggccaccgaguacgccgcggugcccuucgacuccuucacccugcagaagguguaccagcucgagaccgggcugacgcggcaccccgaggagaagcccguccgcaaggacaagcgggacgagcugguggaggccaucgagagcgcccucgagacccugaacucccccgccgagaacagcccgaaccaccgccccuacaccgccuccgacuucaucgagggcaucuaccggaccgagcgcgacaaggggacgcuguacgagcucaccuucaagggcgaccacaagcacgaguucaagcggcugauccuguuccgccccuucgggcccaucaugaaggugaagaacgagaagcucaacauggcgaacacccugaucaacgucaucgugccgcuggccaagcggguggacaaguuccgccaguucaugcagaacuuccgggagaugugcaucgagcaggacggccgcguccaccucaccgugguguacuucggcaaggaggagaucaacgaggucaaggggauccuggagaacacgagcaaggccgccaacuuccggaacuucaccuucauccagcugaacggcgaguucucccgcgggaagggccucgacgugggcgcccgcuucuggaaggggagcaacgugcugcuguucuucugcgacgucgacaucuacuucaccuccgaguuccucaacacgugccggcugaacacccagcccggcaagaagguguucuaccccguccuguucagccaguacaaccccgggaucaucuacggccaccacgacgcggugccgccccucgagcagcagcuggugaucaagaaggagaccggguucuggcgcgacuucggcuucggcaugaccugccaguaccgguccgacuucaucaacaucgggggcuucgaccuggacaucaagggguggggcggggaggacguccaccucuaccgcaaguaccugcacagcaaccugaucguggugcggacccccguccgcggccucuuccaccuguggcacgagaagcggugcauggacgagcugacgcccgagcaguacaagaugugcaugcagagcaaggccaugaacgaggccucccacggccagcuggggaugcucguguuccgccacgagaucgaggcccaccuccggaagcagaagcagaagaccagcuccaagaagaccuga

SEQ ID NO: 28750 - RNA, 1629 nt, Artificial Sequence
  derived and/or modified sequence opt1 from CSGALNACT2__Homo_sapiens__NP_061060
augccccgccggggccugauccugcacacccgcacccacuggcugcugcucgggcuggcccugcucugcagccuggugcuguucauguaccuccuggagugcgccccgcagacggacggcaacgcgucccugcccggggucgugggcgagaacuacgggaaggaguacuaccaggcccuccugcaggagcaggaggagcacuaccagacccgggccaccagccugaagcgccagaucgcccagcucaagcaggagcugcaggagauguccgagaagaugcggagccugcaggagcgccggaacgugggcgccaacggcaucggguaccaguccaacaaggagcaggcgcccagcgaccuccuggaguuccugcacucccagaucgacaaggccgaggucagcaucggcgccaagcuccccuccgaguacggggugaucccguucgagagcuucacccugaugaagguguuccagcuggagaugggccucacgcgccaccccgaggagaagcccguccggaaggacaagcgcgacgagcugguggaggugaucgaggccgggcuggaggucaucaacaaccccgacgaggacgacgagcaggaggacgaggagggcccgcucggcgagaagcugaucuucaacgagaacgacuucguggagggguacuaccggaccgagcgcgacaagggcacccaguacgagcuguucuucaagaaggcggaccucaccgaguaccggcacgugacgcuguuccgccccuucgggccccugaugaaggucaaguccgagaugaucgacaucacccggagcaucaucaacaucaucgugccccucgccgagcgcaccgaggccuucgugcaguucaugcagaacuuccgggacgucugcauccaccaggacaagaagauccaccugaccgugguguacuucggcaaggagggccuguccaaggucaagagcauccucgaguccgugacgagcgaguccaacuuccacaacuacacccuggugagccugaacgaggaguucaaccgcgggcggggccucaacgucggggcccgcgccugggacaagggcgaggugcugauguucuucugcgacguggacaucuacuucuccgcggaguuccugaacagcugccggcucaacgccgagccggggaagaaggucuucuaccccguggucuucagccuguacaaccccgccaucguguacgccaaccaggaggugcccccgcccgucgagcagcagcuggugcacaagaaggacuccggcuucuggcgcgacuucggcuucgggaugaccugccaguaccgcagcgacuuccucaccaucggcggguucgacauggaggugaagggcuggggcggggaggacguccaccuguaccggaaguaccugcacggcgaccucaucgugauccgcacgcccgugcccgggcuguuccaccuguggcacgagaagcggugcgccgacgagcugaccccggagcaguaccgcaugugcauccaguccaaggcgaugaacgaggccagccacucccaccucggcaugcuggucuuccgggaggagaucgagacccaccuccacaagcaggccuaccgcaccaacagcgaggccgugggguga

SEQ ID NO: 28751 - RNA, 654 nt, Artificial Sequence
  derived and/or modified sequence opt1 from CSH1__Homo_sapiens__NP_001308
auggcccccggcagccgcaccucccugcuccuggccuucgcgcugcucugccugccguggcugcaggaggccggggccgugcagaccgucccccucagccggcuguucgaccacgccaugcugcaggcccaccgcgcgcaccagcucgccaucgacacguaccaggaguucgaggagaccuacauccccaaggaccagaaguacuccuuccugcacgacagccagaccuccuucugcuucagcgacuccauccccaccccgagcaacauggaggagacgcagcagaaguccaaccuggagcuccugcggaucagccugcuccugaucgaguccuggcuggagcccgugcgcuuccuccggagcauguucgccaacaaccugguguacgacaccuccgacagcgacgacuaccaccuccugaaggaccuggaggagggcauccagacccugauggggcgccucgaggacggcucccggcgcaccgggcagauccugaagcagacguacagcaaguucgacaccaacucccacaaccacgacgcccugcucaagaacuacggccugcuguacugcuuccggaaggacauggacaaggucgagaccuuccuccgcauggugcagugccggagcguggagggcuccugcggguucuga

SEQ ID NO: 28752 - RNA, 654 nt, Artificial Sequence
  derived and/or modified sequence opt1 from CSH2__Homo_sapiens__NP_066271
auggccgccggcagccgcaccucccugcuccuggcguucgcccugcucugccugcccuggcugcaggaggccggggccgugcagaccgucccgcucagccggcuguucgaccacgccaugcugcaggcgcaccgcgcccaccagcucgccaucgacacguaccaggaguucgaggagaccuacauccccaaggaccagaaguacuccuuccugcacgacagccagaccuccuucugcuucagcgacuccauccccacccccagcaacauggaggagacgcagcagaaguccaaccuggagcuccugcggaucagccugcuccugaucgaguccuggcuggagccggugcgcuuccuccggagcauguucgccaacaaccugguguacgacaccuccgacagcgacgacuaccaccuccugaaggaccuggaggagggcauccagacccugauggggcgccucgaggacggcucccggcgcaccgggcagauccugaagcagacguacagcaaguucgacaccaacucccacaaccacgacgcgcugcucaagaacuacggccugcuguacugcuuccggaaggacauggacaaggucgagaccuuccuccgcauggugcagugccggagcguggagggcuccugcggguucuga

SEQ ID NO: 28753 - RNA, 387 nt, Artificial Sequence
  derived and/or modified sequence opt1 from CSHL1__Homo_sapiens__NP_001309
auggaggagacccagcagaaguccaaccuggagcuccugcacaucagccugcuccugaucgagagccgccuggagcccgugcgguuccuccgcuccaccuucacgaacaaccuggucuacgacaccagcgacuccgacgacuaccaccuccugaaggaccuggaggagggcauccagaugcugauggggcggcucgaggacggcagccaccugaccgggcagacccugaagcagacguacuccaaguucgacaccaacagccacaaccacgacgcccuccugaagaacuacggccugcuccacugcuuccgcaaggacauggacaagguggagaccuuccugcggauggugcagugccgcuccgucgaggggagcugcggcuucuga

SEQ ID NO: 28754 - RNA, 1401 nt, Artificial Sequence
  derived and/or modified sequence opt1 from CS__Homo_sapiens__NP_004068
auggcccugcucaccgccgcggcccgccugcugggcaccaagaacgccagcugccucgugcuggccgcccggcacgcguccgccagcuccacgaaccugaaggacauccucgccgaccugaucccgaaggagcaggcccgcaucaagaccuuccggcagcagcacgggaagaccgucgugggccagaucaccguggacaugauguacgggggcaugcgcgggaugaagggccuggucuacgagacgagcgugcucgacccggacgagggcauccgguuccgcggguucuccauccccgagugccagaagcugcugcccaaggcgaagggcggggaggagccccucccggagggccuguucuggcugcucgugaccgggcacauccccaccgaggagcaggucagcuggcuguccaaggagugggccaagcgggccgcccugcccagccacguggugaccaugcucgacaacuuccccacgaaccugcacccgaugucccagcugagcgccgcggucaccgcccucaacuccgagagcaacuucgcccgcgccuacgcccagggcaucucccggaccaaguacugggagcugaucuacgaggacagcauggaccugaucgcgaagcuccccugcguggccgccaagaucuaccgcaaccuguaccgggagggcuccgggaucggcgccaucgacagcaaccuggacuggucccacaacuucaccaacaugcucggguacacggaccaccaguucaccgagcugacccgccuguaccucaccauccacagcgaccacgagggcggcaacguguccgcccacacgagccaccuggucgggagcgcgcuguccgaccccuaccucagcuucgccgccgccaugaacggccuggccgggccccugcacggccucgcgaaccaggaggugcugguguggcugacccagcuccagaaggaggucgggaaggacguguccgacgagaagcugcgggacuacaucuggaacacccugaacagcggccgcguggucccgggcuacgggcacgccgugcuccggaagaccgacccccgcuacacgugccagcgggaguucgcccugaagcaccuccccaacgaccccauguucaagcugguggcccagcuguacaagaucgucccgaacgugcugcucgagcagggcaaggcgaagaaccccuggcccaacguggacgcccacuccgggguccugcugcaguacuacggcaugaccgagaugaacuacuacaccgugcuguucggggucagccgcgcccucggcgugcuggcccagcugaucuggucccgggcccucggcuucccccuggagcgccccaagagcauguccaccgaggggcugaugaaguucguggacagcaaguccggcuga

SEQ ID NO: 28755 - RNA, 1353 nt, Artificial Sequence
  derived and/or modified sequence opt1 from CSK__Homo_sapiens__XP_005254222
augagcgccauccaggccgcguggcccuccggcaccgagugcaucgccaaguacaacuuccacgggaccgccgagcaggaccugccguucugcaagggcgacgugcucacgaucgucgccgugaccaaggaccccaacugguacaaggccaagaacaagguggggcgcgagggcaucauccccgcgaacuacguccagaagcgggagggggugaaggccggcaccaagcugagccugaugcccugguuccacggcaagaucacccgcgagcaggccgagcggcuccuguacccgcccgagacggggcuguuccucgugcgcgaguccaccaacuaccccggcgacuacacccugugcgucagcugcgacgggaagguggagcacuaccggaucauguaccacgccuccaagcugagcaucgacgaggagguguacuucgagaaccucaugcagcuggucgagcacuacaccuccgacgcggacggccugugcacgcgccucaucaagcccaaggugauggaggggaccguggccgcccaggacgaguucuaccggagcggcugggcccugaacaugaaggagcugaagcuccugcagaccaucggcaagggggaguucggcgacgucaugcugggggacuaccgcggcaacaagguggccgugaagugcaucaagaacgacgcgaccgcccaggccuuccucgccgaggccuccgucaugacgcagcugcggcacagcaaccuggugcagcuccugggcgugaucgucgaggagaagggcgggcuguacaucgugaccgaguacauggcgaaggggucccucguggacuaccugcgcagccggggccgcuccguccucgggggcgacugccugcugaaguucagccuggacgugugcgaggccauggaguaccucgagggcaacaacuucgugcaccgggaccuggccgcccgcaacguccugguguccgaggacaacgucgccaaggugagcgacuucgggcucaccaaggaggcguccagcacccaggacacgggcaagcugccggugaaguggaccgcccccgaggcccugcgggagaagaaguucuccaccaagagcgacgucuggagcuucgggauccuccugugggagaucuacuccuucggccgcgugcccuacccccggaucccgcugaaggacguggucccccgcguggagaagggguacaagauggacgcccccgacggcugcccgcccgccguguacgaggucaugaagaacugcuggcaccucgacgcggccaugcggcccagcuuccugcagcugcgcgagcagcucgagcacaucaagacccacgagcugcaccuguga

SEQ ID NO: 28756 - RNA, 10695 nt, Artificial Sequence
  derived and/or modified sequence opt1 from CSMD1__Homo_sapiens__NP_150094
augaccgccuggcgccgcuuccagagccugcuccugcugcucggccugcuggugcucugcgcccgccugcugaccgccgccaaggggcagaacugcggcgggcucguccagggccccaacgggaccaucgagucccccggcuucccccacggcuaccccaacuacgccaacugcaccuggaucaucaucaccggggagcgcaaccgcauccagcugagcuuccacaccuucgcccuggaggaggacuucgacauccucuccguguacgacggccagccccagcaggggaaccugaaggugcggcugagcggcuuccagcuccccuccagcaucgucuccaccgggagcauccugacccugugguucaccaccgacuucgccguguccgcccagggcuucaaggcccucuacgaggugcugcccagccacacgugcggcaaccccggggagauccugaagggcguccuccacgggacccgcuucaacaucggcgacaagauccgguacuccugccugcccggcuacauccuggaggggcacgccauccugaccugcaucgugagccccggcaacggggccuccugggacuuccccgcccccuucugccgcgccgagggcgccugcgggggcacccugcggggcaccagcuccagcaucuccagcccccacuuccccuccgaguacgagaacaacgccgacugcaccuggaccauccuggccgagcccggggacaccaucgcgcucguguucaccgacuuccagcuggaggagggcuacgacuuccuggagaucagcgggaccgaggcccccagcaucuggcucaccggcaugaaccugcccucccccgucaucagcuccaagaacuggcugcgccuccacuucaccagcgacuccaaccaccggcgcaagggguucaacgcccaguuccaggugaagaaggccaucgagcucaagucccggggcgugaagaugcugcccuccaaggacggcagccacaagaacuccguccucagccagggcgggguggcccugguguccgacaugugccccgaccccgggauccccgagaacggccgccgggcggggagcgacuuccgcgucggcgccaacgugcaguucuccugcgaggacaacuacgugcugcagggcagcaaguccaucacgugccagcgggucaccgagacccucgccgccuggagcgaccaccgccccaucugccgggcccggaccugcggguccaaccugcggggccccagcggggugaucaccucccccaacuacccggugcaguacgaggacaacgcgcacugcgucugggugaucaccaccaccgaccccgacaaggugaucaagcuggccuucgaggaguucgagcucgagcgcggcuacgacacccugaccgucggcgacgccgggaaggugggcgacacccgcagcguccuguacgugcucaccgggagcuccgugcccgaccugaucgucagcauguccaaccagauguggcugcaccuccagagcgacgacuccaucggcagccccggguucaaggccguguaccaggagaucgagaagggcggcugcggggacccgggcauccccgccuacgggaagcggaccggcuccagcuuccugcacggggacacccugaccuucgagugccccgcggccuucgagcuggugggcgagcgcgucaucacgugccagcagaacaaccagugguccggcaacaagccgagcugcguguucuccugcuucuucaacuucaccgccagcuccgggaucauccucagccccaacuaccccgaggaguacggcaacaacaugaacugcguguggcugaucaucuccgagcccgggagccggauccaccugaucuucaacgacuucgacgucgagccgcaguucgacuuccucgccgugaaggacgacggcaucuccgacaucaccgugcuggggaccuucagcggcaacgagguccccagccagcuggcguccagcggccacaucgugcgccucgaguuccaguccgaccacagcaccaccgggcggggcuucaacaucacguacaccaccuucgggcagaacgagugccacgaccccggcauccccaucaacgggcgccgguucggcgaccgcuuccugcugggcuccagcguguccuuccacugcgacgacggguucgucaagacccagggcagcgaguccaucacgugcauccuccaggacgggaacgugguguggagcuccaccgucccgcggugcgaggcccccugcggcggccaccugaccgccagcuccggggugauccugccgcccggcuggccgggguacuacaaggacagccuccacugcgaguggaucaucgaggccaagcccggccacuccaucaagaucaccuucgaccgcuuccagacggaggugaacuacgacacccuggagguccgggacgggcccgccagcuccagcccccugaucggcgaguaccacggcacccaggcgccgcaguuccucaucuccaccgggaacuucauguaccugcuguucacgaccgacaacagccgcagcuccaucggcuuccucauccacuacgagagcgugacccuggaguccgacagcugccuggaccccgggauccccgugaacggccaccggcacgggggcgacuucggcauccgcuccaccgucacguucagcugcgaccccggguacacccucuccgacgacgagccgcuggugugcgagcggaaccaccaguggaaccacgcccugcccagcugcgacgcccucugcggcggguacauccagggcaaguccgggaccgugcugagccccggcuuccccgacuucuacccgaacucccugaacugcaccuggacgaucgaggucagccacggcaagggggugcagaugaucuuccacaccuuccaccucgaguccagccacgacuaccugcugaucaccgaggacggcuccuucagcgagcccguggcccgccucaccggguccguccugccccacacgaucaaggccggccuguucggcaacuucaccgcgcagcuccgguucaucagcgacuucuccaucagcuacgagggguucaacaucaccuucagcgaguacgaccuggagccgugcgacgaccccggcgugcccgccuucucccgccggaucggguuccacuucggcgugggggacagccugaccuucuccugcuuccucggcuaccgccuggagggcgccacgaagcugaccugccucgggggcgggcgccgggucuggagcgcgccccucccgcgcugcguggccgagugcggcgcguccgugaaggggaacgagggcacccugcucagccccaacuuccccuccaacuacgacaacaaccacgagugcaucuacaagaucgagaccgaggccggcaaggggauccaccuccgcacgcgcagcuuccagcuguucgagggcgacacccugaaggucuacgacgggaaggacuccagcucccggccccugggcaccuucaccaagaacgagcugcucgggcugauccugaacagcacguccaaccaccucuggcuggaguucaacaccaacggcagcgacaccgaccagggcuuccagcugaccuacaccuccuucgaccucgugaagugcgaggacccggggauccccaacuacggcuaccgcauccgggacgaggggcacuucacggacaccgugguccuguacagcugcaaccccggcuacgccaugcacggguccaacacccugaccugccucagcggcgaccgccgggugugggacaagccccugccguccugcaucgccgagugcggcgggcagauccacgcggccacgagcggccgcauccugagccccggguaccccgcccccuacgacaacaaccuccacugcaccuggaucaucgaggccgacccgggcaagaccaucucccugcacuucaucguguucgacaccgagauggcccacgacauccugaaggucugggacggccccguggacagcgacauccuccugaaggagugguccgggagcgcgcugcccgaggacauccacuccacguucaacagccucacccugcaguucgacuccgacuucuucaucagcaaguccggcuucagcauccaguucuccaccagcaucgccgcgaccugcaacgaccccgggaugccgcagaacggcacgcgguacggggacucccgcgaggccggcgacaccgugaccuuccagugcgaccccggcuaccagcugcaggggcaggccaagaucacgugcguccagcucaacaaccgguucuucuggcagcccgacccgcccacgugcaucgcggccugcggcgggaaccugaccggccccgccggggugauccugagccccaacuacccccagcccuacccgcccggcaaggagugcgacuggcgcgugaaggucaacccggacuucgugaucgcccucaucuucaaguccuucaacauggagcccagcuacgacuuccugcacaucuacgagggcgaggacuccaacagcccccugaucggguccuaccagggcagccaggcccccgagcggaucgagagcuccgggaacagccucuuccuggcguuccgcuccgacgccagcgugggccuguccggguucgccaucgaguucaaggagaagccgcgggaggccugcuucgaccccggcaacaucaugaacggcacccgcgucgggaccgacuucaagcucggcagcacgaucaccuaccagugcgacuccggguacaagauccuggaccccagcuccaucacgugcgugaucggcgcggacgggaagcccagcugggaccagguccugccguccugcaacgcccccugcggcggccaguacaccgggagcgagggcguggugcucucccccaacuacccccacaacuacacggccgggcagaucugccuguacagcaucaccgucccgaaggaguucgugguguucggccaguucgccuacuuccagaccgcccugaacgaccucgcggagcuguucgacggcacccacgcccaggcccggcugcucuccagccuguccgggagccacuccggcgagacgcugccccucgccaccagcaaccagauccugcugcgcuucagcgccaaguccggggcgagcgcccggggcuuccacuucgucuaccaggccgugccccgcaccuccgacacccagugcagcuccgugcccgagccgcgcuacgggcggcgcaucggcagcgaguucuccgccggcagcaucguccgguucgagugcaaccccggguaccuccugcagggcuccacggcccugcacugccagagcgugcccaacgcgcuggcccaguggaacgacaccauccccuccugcguggucccgugcagcgggaacuucacccagcgccggggcaccauccucucccccggguaccccgagcccuacggcaacaaccugaacugcaucuggaagaucaucgugacggagggcagcgggauccagauccaggugaucuccuucgccaccgagcagaacugggacagccuggagauccacgacggcggggacgucaccgccccgcgccucggcuccuucagcgggaccaccgugcccgcccugcugaacagcacguccaaccagcucuaccugcacuuccagagcgacaucuccguggcggccgccggcuuccaccuggaguacaagaccgucggccucgccgcgugccaggagcccgcccugcccagcaacuccaucaagaucggggaccgguacauggugaacgacgugcugagcuuccagugcgagccgggcuacacccuccaggggcgcucccacaucagcugcaugcccggcaccguccggcgcuggaacuaccccuccccgcugugcaucgccacgugcggcgggacccugagcacccucggcggggugauccugucccccggcuuccccgggagcuaccccaacaaccuggacugcaccuggcggaucucccucccgaucggcuacggcgcccacauccaguuccugaacuucagcacggaggccaaccacgacuuccuggagauccagaacgggcccuaccacaccucccccaugaucggccaguucagcgggaccgaccuccccgcggcccugcuguccaccacgcacgagacccucauccacuucuacagcgaccacucccagaaccgccagggcuucaagcuggccuaccaggccuacgagcugcagaacugcccggacccgccgcccuuccagaacggguacaugaucaacagcgacuacagcgugggccaguccgucagcuucgagugcuacccgggcuacauccucaucgggcaccccgugcugaccugccagcacggcaucaaccggaacuggaacuaccccuucccccgcugcgacgccccgugcggguacaacgugaccucccagaacggcacgaucuacagccccggguuccccgacgaguaccccauccugaaggacugcaucuggcucaucaccgucccgcccggccacggcguguacaucaacuucacccugcugcagaccgaggcggugaacgacuacaucgccgucugggacgggcccgaccagaacagcccccagcucggcguguucagcgggaacacggcccuggagaccgccuacuccagcaccaaccaggugcugcucaaguuccacuccgacuucagcaacggcggguucuucguccugaacuuccacgccuuccagcugaagaagugccagccgccgcccgcggugccgcaggccgagaugcucaccgaggacgacgacuucgagaucggcgacuucgugaaguaccagugccaccccggcuacacgcuggucgggaccgacauccugaccugcaagcucuccagccagcugcaguucgagggcucccugccgaccugcgaggcccagugccccgccaacgaggugcggacggggagcuccggcgugauccucagccccggcuaccccgggaacuacuucaacucccagaccugcagcugguccaucaaggucgagcccaacuacaacaucaccaucuucguggacaccuuccagagcgagaagcaguucgacgcgcuggagguguucgacggcagcuccgggcagagcccccugcucgucgugcuguccggcaaccacacggagcagagcaacuucaccucccgcagcaaccagcuguaccuccggugguccaccgaccacgccaccagcaagaagggguucaagauccgcuacgccgccccguacugcucccugacgcacccccugaagaacggcggcauccucaaccggaccgccggggcggugggcagcaagguccacuacuucugcaagcccggguaccgcauggugggccacuccaacgcgaccugccgccggaacccccuggggauguaccagugggacagccugaccccgcucugccaggccguguccugcggcauccccgagagccccggcaacggguccuucacgggcaacgaguucacccuggacagcaaggucguguacgagugccacgagggguucaagcuggaguccagccagcaggccaccgccgugugccaggaggacggccucugguccaacaaggggaagcccccgaccugcaagcccgucgcgugccccagcaucgaggcccagcugagcgagcacgugaucuggcgccuggucuccggcagccucaacgaguacggcgcccaggugcugcuguccugcagccccggguacuaccucgagggcuggcggcugcugcgcugccaggccaacgggaccuggaacaucggcgacgagcggccguccugccgcgugaucagcugcggcucccucagcuucccgcccaacgggaacaagaucggcacgcugaccgucuacggggccaccgcgaucuucacgugcaacacgggcuacacccugguggggucccacgugcgggagugccucgccaacggccuguggagcggcuccgagacccgcugccuggccgggcacugcggcagccccgacccgaucgucaacgggcacaucuccggcgacggguucagcuaccgggacaccgugguguaccagugcaaccccggcuuccgccucgucggcacguccgugcggaucugccugcaggaccacaaguggagcgggcagacccccgugugcguccccaucacgugcggccacccggggaaccccgcccacggcuucaccaacggguccgaguucaaccugaacgacguggugaacuucacgugcaacaccggcuaccuccugcagggcgucagccgcgcgcagugccgguccaacgggcaguggagcagcccccugccgaccugccgcguggugaacugcuccgaccccggcuucgucgagaacgccauccggcacgggcagcagaacuuccccgagagcuucgaguacggcauguccauccucuaccacugcaagaagggguucuaccugcugggcagcuccgcccugaccugcauggccaacggccugugggaccgcagccugcccaagugccucgccaucuccugcgggcacccgggcgugcccgcgaacgccgugcugacgggggagcuguucaccuacggcgccgucgugcacuacagcugccggggcuccgagagccucaucgggaacgacacccgcgugugccaggaggacucccacuggagcggcgcccugccccacugcaccgggaacaaccccggcuucugcggggacccgggcacgcccgcccacggcucccggcugggggacgacuucaagaccaagagccuccugcgcuucuccugcgagaugggccaccagcugcgggggagccccgagcggaccugccuccugaacggcuccuggagcgggcugcagcccgucugcgaggcgguguccugcggcaacccgggcacccccacgaacgggaugaucgugagcagcgacggcauccucuucuccagcuccgucaucuacgccugcugggagggguacaagaccagcggccugaugacccgccacugcaccgccaacgggacguggaccggcaccgcccccgacugcaccaucaucuccugcggcgaccccgggacgcuggccaacggcauccaguucgggaccgacuucaccuucaacaagaccgugagcuaccagugcaacccgggcuacgugauggaggcggucacguccgccaccauccggugcaccaaggacggccgcuggaaccccagcaagcccgugugcaaggccgugcugugcccccagccgccgcccguccagaacgggaccguggagggcuccgacuuccggugggggagcuccaucagcuacuccugcauggacggcuaccagcucagccacuccgccauccugagcugcgaggggcgcggcguguggaagggcgagaucccccagugccugccggucuucugcggggaccccggcauccccgccgaggggcggcucuccggcaagagcuucaccuacaagagcgagguguucuuccagugcaagucccccuucauccugguggggagcucccgccgggucugccaggcggacggcacguggagcggcauccagccgaccugcaucgaccccgcccacaacacgugccccgacccggggacgccccacuucggcauccagaacuccagccgcggguacgaggugggcuccacgguguucuuccggugccgcaagggguaccacauccagggcagcaccacccggaccugccuggccaaccucacgugguccggcauccagaccgagugcaucccccacgccugccgccagcccgagaccccggcgcacgccgacguccgggccaucgaccugcccaccuucggguacacgcugguguacacgugccaccccggcuucuuccucgccgggggcagcgagcaccggaccugcaaggccgacaugaaguggaccgggaagucccccgugugcaagagcaagggcguccgggaggugaacgagacggugaccaagaccccgguccccuccgacguguucuucgugaacagccuguggaagggcuacuacgaguaccuggggaagcgccagcccgcgacccucacggucgacugguucaacgccaccuccagcaaggugaacgccaccuucuccgaggccagccccgucgagcugaagcugaccggcaucuacaagaaggaggaggcccaccuccugcugaaggcguuccagaucaaggggcaggccgacaucuucguguccaaguucgagaacgacaacuggggccucgacggcuacgugagcagcgggcuggagcggggcggguucacguuccagggcgacauccacgggaaggacuucggcaaguucaagcuggagcgccaggacccgcucaaccccgaccaggacuccagcucccacuaccacggcaccagcuccgggagcgucgccgccgccauccuggugcccuucuucgcgcugauccucuccggcuucgccuucuaccuguacaagcaccggacccgccccaaggugcaguacaacggguacgccggccacgagaacagcaacgggcaggccuccuucgagaacccgauguacgacaccaaccugaagcccacggaggcgaaggccguccgcuucgacaccacccucaacaccgugugcacgguggucuga

SEQ ID NO: 28757 - RNA, 10824 nt, Artificial Sequence
  derived and/or modified sequence opt1 from CSMD2__Homo_sapiens__XP_011538874
augccccgcucccgggggcgcgagcuggggcggugcggcugcccggccgggcgcgcccggggcgagaccgggaucuccgcccuggugcccggcgccggcagccgcugggggcggccgcccccgcccacgcccccgccccugcugcugcugcugggcugcgggcuccuguccgucagcgccgccgccggccagaacugcaccuuccagcugcacgggcccaacggcaccguggagucccccggcuuccccuacggguaccccaacuacgccaacugcaccuggaccaucaccgccgaggagcagcaccgcauccagcucguguuccagagcuucgcccuggaggaggacuucgacguccuguccguguucgacggcccgccccagcccgagaaccuccggacccgccugaccggguuccagcugcccgccaccaucgugagcgccgccaccacccucucccugcggcugaucagcgacuacgccgucuccgcccagggcuuccacgccaccuacgaggugcuccccagccacacgugcggcaaccccgggcgccugcccaacggcauccagcagggguccaccuucaaccugggcgacaaggugcgguacagcugcaaccucggguucuuccuggagggccacgcgguccugaccugccacgccggcuccgagaacagcgccaccugggacuucccccuccccuccugccgcgccgacgacgccugcgggggcacccugcgggggcagagcggcaucaucuccagcccccacuuccccagcgaguaccacaacaacgcggacugcaccuggaccauccuggccgagcucggggacaccaucgcccugguguucaucgacuuccagcuggaggacggcuacgacuuccucgaggugaccggcaccgagggguccagccugugguucaccggcgccucccugccggcccccgucaucagcuccaagaacuggcuccgccugcacuucaccagcgacgggaaccaccggcagcgcggcuucuccgcgcaguaccaggugaagaagcagaucgagcugaagucccggggcgugaagcucaugcccuccaaggacaacagccagaagaccuccguccugacccaggugggcgugagccagggccacaacaugugccccgacccggggauccccgagcgcggcaagcggcugggguccgacuuccgccucggcagcuccguccaguucacgugcaacgagggcuacgaccugcaggggagcaagcgcaucacgugcaugaagguguccgacauguucgccgccuggagcgaccaccggcccgugugccgcgcccggaugugcgacgcccaccuccggggcccguccgggaucaucaccagccccaacuuccccauccaguacgacaacaacgcgcacugcgucuggaucaucaccgcccucaaccccagcaaggugaucaagcuggccuucgaggaguucgaccuggagcggggcuacgacacccucaccgugggggacggcggccaggacggggaccagaagaccguccuguacauccugacgggcaccuccgugccggaccucaucgucagcaccaaccaccagauguggcugcuguuccagaccgacggguccggcagcucccugggguucaaggccagcuacgaggagaucgagcagggcuccugcggcgaccccgggauccccgcguacggccgccgggaggggagccgcuuccaccacggcgacacgcucaaguucgagugccagcccgccuucgagcugguggggcagaaggccaucacgugccagaagaacaaccagugguccgccaagaagccgggcugcguguucagcugcuucuucaacuucaccucccccagcggcgucgugcugucccccaacuaccccgaggacuacgggaaccaccuccacugcguguggcugauccuggcccggccggagagccgcauccaccucgcguucaacgacaucgacgucgagccccaguucgacuuccuggugaucaaggacggcgccaccgccgaggcccccgugcuggggaccuucuccggcaaccagcuccccagcuccaucacgagcagcgggcacgucgcccggcuggaguuccagaccgaccacuccaccggcaagcgcggcuucaacaucaccuucacgaccuuccggcacaacgagugcccggaccccggggugcccgugaacggcaagcgcuucggggacagccugcagcucggcuccagcaucuccuuccugugcgacgagggcuuccuggggacccagggcagcgagaccaucacgugcguccucaaggagggguccgugguguggaacagcgcgguccugcggugcgaggcccccugcggcgggcaccugaccuccccgagcggcaccauccucucccccggcuggcccggguucuacaaggacgcccugagcugcgccugggugaucgaggcccagcccggcuacccgaucaagaucaccuucgaccgcuucaagacggaggugaacuacgacacccuggagguccgggacgggcgcaccuacuccgcgccccucaucggcguguaccacgggacccaggugccccaguuccugaucagcacguccaacuaccuguaccuccuguucagcaccgacaagucccacagcgacaucggcuuccagcugcgguacgagaccaucacccuccaguccgaccacugccuggacccgggcauccccgucaacgggcagcgccacggcaacgacuucuacgugggggcccuggugacguucagcugcgacagcggcuacacccucuccgacggggagccccuggagugcgagcccaacuuccaguggagccgcgcccugccguccugcgaggcccucugcggcggcuucauccaggggagcuccggcaccauccugagccccggguuccccgacuucuaccccaacaaccugaacugcaccuggaucaucgagacgucccacggcaagggcgucuucuucaccuuccacaccuuccaccucgagagcgggcacgacuaccugcugaucaccgagaacggcuccuucacgcagccgcuccggcagcugaccgggagccgccugcccgcgcccaucuccgccggccucuacgggaacuucaccgcccaggugcgguucaucagcgacuucuccaugagcuacgagggcuucaacaucaccuucuccgaguacgaccuggagcccugcgaggagccggaggugcccgccuacagcauccgcaagggccugcaguucggggucggcgacacgcucaccuucuccugcuuccccggguaccggcuggagggcaccgcccgcaucacgugccucgggggccggcgccggcuguggagcagcccccugccgcgcugcguggcggagugcggcaacagcgugacggggacccagggcacccugcucagccccaacuuccccgucaacuacaacaacaaccacgagugcaucuacuccauccagacccagcccgggaagggcauccagcugaaggcccgggccuucgagcugagcgagggggacgugcucaagguguacgacggcaacaacaacuccgcccgccugcugggcgucuucagccacuccgagaugaugggggugacgcucaacagcaccuccagcucccuguggcuggacuucaucaccgacgccgagaacaccagcaagggcuucgagcuccacuucuccagcuucgagcugaucaagugcgaggacccggggacccccaaguucggcuacaaggugcacgacgaggggcacuucgcgggcuccagcgucuccuucagcugcgaccccggcuacucccugcgggggagcgaggagcuccugugccuguccggcgagcgccggacgugggaccgcccccucccgaccugcguggccgagugcgggggcaccgugcggggcgaggucagcggccaggugcugagccccggcuaccccgcccccuacgagcacaaccugaacugcaucuggaccaucgaggccgaggccgggugcacgaucggccuccacuuccugguguucgacaccgaggagguccacgacgugcugcgcaucugggacgggccgguggaguccggcguccuccugaaggagcugagcggccccgcgcuccccaaggaccugcacuccaccuucaacagcguggugcugcaguucuccaccgacuucuucacgagcaagcagggguucgccauccaguucuccgucagcaccgccaccuccugcaacgacccgggcaucccccagaacgggagccgguccggcgacagcugggaggccggggacuccaccguguuccagugcgaccccggcuacgcgcuccagggcagcgccgagaucuccugcgugaagaucgagaaccgcuucuucuggcagcccagcccgcccacgugcaucgcccccugcgggggcgaccugaccgggcccuccggcgucauccugagcccgaacuaccccgagcccuacccgcccgggaaggagugcgacuggaaggugaccgucucccccgacuacgugaucgcccucguguucaacaucuucaaccuggagcccggcuacgacuuccugcacaucuacgacggccgggacagccucagcccccugaucggguccuucuacggcagccagcugcccgggcgcaucgaguccagcuccaacagccucuuccuggccuuccgcuccgacgcgagcgucuccaacgccggcuucgugaucgacuacaccgagaacccccgggagagcugcuucgaccccggguccaucaagaacggcacgcgcgugggcagcgaccugaagcucggguccagcgucaccuacuacugccacggcggguacgagguggagggcaccuccacccugagcugcauccugggccccgacgggaagccgguguggaacaacccccggcccgucugcacggcccccugcggcgggcaguacgugggcuccgacggggugguccucagcccgaacuacccccagaacuacaccuccggccagaucugccuguacuucgugaccgugcccaaggacuacgucguguucggccaguucgccuucuuccacaccgcccugaacgacguggucgaggugcacgacgggcacagccagcacagccgccugcucuccagccuguccggcagccacacgggggagucccugccccucgcgaccagcaaccaggugcugaucaaguucuccgccaagggccuggccccggcccggggguuccacuucgucuaccaggccgugccccgcaccagcgcgacccagugcuccagcgugcccgagccgcgguacggcaagcgccucggcuccgacuucagcgucggggccaucgugcgguucgagugcaacuccggcuacgcccugcaggggagccccgagaucgagugccugcccgugcccggcgcccucgcccaguggaacgucuccgcgccgacgugcguggugcccugcgggggcaaccugaccgagcgccggggcaccauccugagccccggguuccccgagccguaccucaacucccugaacugcgucuggaagaucguggugcccgagggcgccgggauccagauccaggucgugagcuucgugaccgagcagaacugggacagccuggaggucuucgacggcgccgacaacacggugaccaugcucggcuccuucagcgggaccaccgugcccgcccugcugaacuccaccagcaaccagcucuaccugcacuucuacuccgacaucagcgucuccgcggccggcuuccaccuggaguacaagacgguggggcucagcuccugccccgagccggccgugcccagcaacggcgucaagaccggggagcgcuaccuggugaacgacguggucuccuuccagugcgagcccggcuacgcccugcagggccacgcccacaucagcugcaugcccgggaccgugcggcgcuggaacuacccgccgccccugugcaucgcgcagugcggcgggaccguggaggagauggagggcgucauccugucccccggguucccgggcaacuaccccagcaacauggacugcuccuggaagaucgcccugcccgugggcuucggggcccacauccaguuccucaacuucagcacggagcccaaccacgacuacaucgagauccggaacggcccguacgagaccucccgcaugauggggcgguucagcggcuccgagcugcccagcagccugcucuccaccagccacgagaccacgguguacuuccacuccgaccacagccagaaccgccccggguucaagcuggaguaccaggccuacgagcugcaggagugcccggaccccgagcccuucgccaacggcaucguccggggcgcgggguacaacgugggccaguccgucaccuucgagugccuccccggguaccagcugaccggccacccggugcugaccugccagcacgggacgaaccgcaacugggaccacccccuccccaagugcgaggugcccugcggcggcaacaucaccagcuccaacgggaccgucuacagcccgggcuuccccucccccuacagcuccagccaggacugcguguggcugaucaccgugcccaucgggcacggcguccgccugaaccucucccugcugcagacggagccgagcggcgacuucaucaccaucugggacgggccccagcagaccgcgccccggcucggcguguucacccgcuccauggccaagaagacggugcagagcuccagcaaccagguccugcugaaguuccaccgggacgccgccaccgggggcaucuucgcgaucgccuucuccgccuacccccucaccaagugcccgccgcccaccauccugcccaacgccgagguggugacggagaacgaggaguucaacaucggggacaucguccgcuaccggugccugccgggcuucacccucgugggcaacgagauccugaccugcaagcuggggaccuaccuccaguucgaggggccgccgcccaucugcgaggugcacugcccgacgaacgagcugcugaccgacagcaccggggucauccucagccaguccuaccccggcagcuacccccaguuccagaccugcuccuggcuggugcgcguggagcccgacuacaacaucagccugacggucgaguacuuccucuccgagaagcaguacgacgaguucgagaucuucgacgggccgagcggccagagcccccugcugaaggcgcucagcggcaacuacuccgcgccccugaucgugaccagcuccagcaacuccguguaccugcgguggagcuccgaccacgccuacaaccgcaagggguucaagauccgguacagcgccccguacugcucccucccccgcgcgccccugcacggcuucauccuggggcagaccagcacccagcccggcggguccauccacuucggcugcaacgcgggcuaccggcucgucgggcacagcauggccaucugcacgcgccacccgcagggcuaccaccuguggagcgaggccaucccccugugccaggcccucuccugcgggcugcccgaggcccccaagaacggcaugguguucggcaaggaguacaccguggggaccaaggcgauguacagcugcuccgagggcuaccaccuccaggccggggccgaggccaccgccgagugccucgacacgggccuguggagcaaccggaacgucccgccccagugcgugcccgugaccugccccgacgucuccagcaucuccguggagcacgggcgcuggcggcugaucuucgagacccaguaccaguuccaggcgcagcucaugcugaucugcgacccgggcuacuacuacaccggccagcgcgugauccggugccaggccaacgggaaguggagccugggcgacuccacccccacgugccgcaucaucagcugcggggagcuccccaucccgcccaacggccaccggaucgggacccuguccgucuacggcgccaccgccaucuucagcugcaacuccggcuacacccugguggggagccgcgugcgggagugcauggcgaacggccucugguccgggagcgagguccgcugccuggccggccacugcgggacgcccgagcccaucgugaacggccacaucaacggcgagaacuacuccuaccgcgggagcguggucuaccagugcaacgccggcuuccggcugaucgggauguccgugcgcaucugccagcaggaccaccacuggagcggcaagacccccuucugcgugcccaucacgugcgggcaccccggcaaccccgucaacggccucacccaggggaaccaguucaaccugaacgacguggugaaguucgucugcaaccccggcuacauggccgagggggccgcgcggagccagugccuggccuccggccaguggagcgacaugcucccgacgugccgcaucaucaacugcaccgaccccggccaccaggagaacuccgugcgccaggugcacgccagcgggccccaccgcuucuccuucggcaccaccgucagcuaccggugcaaccacggguucuaccugcugggcacgcccgugcucuccugccagggggacggcaccugggaccgcccgcggccccagugccugcuggugagcugcggccaccccggguccccgccccacagccagauguccggcgacagcuacaccgucggggccguggugcgcuacuccugcaucggcaagcggacccucgucgggaacagcacgcgcaugugcggccuggacggccacuggaccgggucccugccccacugcagcggcaccuccgugggggucugcggcgaccccgggaucccggcccacggcauccggcucggcgacagcuucgaccccgggaccgugaugcgcuucuccugcgaggcgggccacgugcugcgggggagcagcgagcgcacgugccaggccaacggcuccuggagcggcucccagcccgagugcggggucaucagcugcggcaaccccgggaccccguccaacgcccgggugguguucagcgacggccuggucuucuccagcuccaucguguacgagugccgcgagggguacuacgccaccggccuccugagccggcacugcuccgugaacggcaccuggacggggagcgaccccgagugccuggucaucaacugcggcgaccccgggauccccgccaacggccugcgccucgggaacgacuuccgcuacaacaagaccgugaccuaccagugcgugccgggcuacaugauggagucccaccgggucagcgugcuguccugcaccaaggaccgcacguggaacggcaccaagcccgugugcaaggcgcugaugugcaagccgccgccccucauccccaacgggaaggucgugggcagcgacuucauguggggguccagcgugaccuacgccugccuggagggcuaccagcugagccuccccgccgucuucacgugcgaggggaacggcuccuggacgggcgagcugccccagugcuuccccguguucugcggggaccccggcgugcccagccgggggcgccgggaggaccgcggcuucuccuaccggagcuccgucagcuucuccugccacccgccccuggugcucguggggagcccccgccgguucugccaguccgacggcaccuggagcggcacccagcccuccugcaucgaccccacccugacgaccugcgccgaccccggggucccccaguucggcauccagaacaacagccagggguaccaggugggcuccaccgugcuguuccgcugccagaagggcuaccuccugcaggggagcaccacccggacgugccugcccaaccucaccugguccggcaccccgcccgacugcgucccccaccacugccgccagcccgagaccccgacgcacgccaacgugggggcgcuggaccugcccagcaugggcuacacccucaucuacuccugccaggagggguucagccugaagggcggcuccgagcaccggaccugcaaggccgacgggagcuggaccggcaagccgcccaucugccuggccgaggugcgccccagcgggcggcccaucaacacggcccgcgagccgccccucacccaggcgcugauccccggcgacgucuucgccaagaacucccuguggaagggggccuacgaguaccagggcaagaagcagcccgccaugcuccgggugaccggcuuccagguggccaacagcaaggucaacgcgaccaugaucgaccacuccgggguggagcugcaccuggccggcacguacaagaaggaggacuuccaccuccugcuccagguguaccagaucaccgggcccgucgagaucuucaugaacaaguucaaggacgaccacugggcccucgacggccacgugagcuccgagagcuccggggccaccuucaucuaccagggcagcgugaagggccagggguucggccaguucggguuccagcgccuggaccugcggcuccuggaguccgaccccgagagcaucggccgccacuucgccuccaacagcuccagcgucgcggccgccauccuggugccguucaucgcccucaucaucgccggguucgugcuguaccuguacaagcaccggcgccgccccaagguccccuucaacggcuacgcgggccacgagaacaccaacgugcgggccacguucgagaaccccauguacgaccgcaacauccagccgaccgacaucauggccuccgaggccgaguucaccgugagcaccgucugcacggcgguguga

SEQ ID NO: 28758 - RNA, 10617 nt, Artificial Sequence
  derived and/or modified sequence opt1 from CSMD3__Homo_sapiens__NP_443132
augaagggcauccgcaagggggagagccgggccaaggaguccaagcccugggagcccggcaagcgccggugcgccaagugcgggcgccuggacuucauccugaugaagaagaugggcaucaagagcggguucaccuucuggaaccugguguuccugcugaccgucuccugcgugaagggcuucaucuacacgugcggcgggacccugaagggccugaacgggaccaucgagagccccggcuuccccuacggguaccccaacggcgcgaacugcaccugggugaucaucgccgaggagcggaaccgcauccagaucgucuuccaguccuucgcccucgaggaggaguacgacuaccugagccuguacgacggccacccccaccccaccaacuuccggacccgccucaccggguuccaccucccgccgcccgugaccuccaccaagagcguguucucccugcggcucaccagcgacuucgccgucuccgcccacggcuucaagguguacuacgaggagcugcagagcuccagcugcgggaaccccggcgugccgcccaagggcguccuguacgggacccgcuucgacgugggcgacaagauccgguacuccugcgugaccggguacauccucgacggccacccccagcugaccugcaucgccaacagcgucaacaccgccuccugggacuuccccgugcccaucugccgcgccgaggacgccugcgggggcaccaugcggggcagcuccgggaucaucagcagccccuccuuccccaacgaguaccacaacaacgcggacugcaccuggaccaucguggccgagcccggcgacaccaucagccugaucuucaccgacuuccagauggaggagaaguacgacuaccucgagaucgagggguccgagccgcccaccaucuggcugagcggcaugaacaucccgccgcccaucaucuccaacaagaacuggcugcgccuccacuucgucaccgacagcaaccaccgguaccgcggguucuccgcccccuaccaggugaagaaggccaucgacuucaagagccggggcuucaagcuguuccccggcaaggacaacuccaacaaguucagcauccugaacgagggcgggaucaagaccgccuccaaccucugccccgaccccggggagcccgagaacggcaagcgcaucgggagcgacuucucccugggcagcaccgugcaguucuccugcgacgaggacuacguccugcagggcgccaagagcaucacgugccagcggaucgcggagguguucgccgccugguccgaccaccgccccgugugcaaggucaagaccugcgggagcaaccuccagggccccuccgggaccuucaccagccccaacuuccccuuccaguacgacagcaacgcccagugcgugugggugaucaccgcggucaacacgaacaaggugauccagaucaacuucgaggaguucgaccuggagaucggcuacgacacccugaccaucggcgacgggggcgaggucggggacccccggaccgugcuccaggugcugacgggcuccuucguccccgaccugaucgugagcauguccagccagauguggcuccaccuccagaccgacgaguccguggggagcgucggcuucaaggugaacuacaaggagaucgagaaggaguccugcggcgaccccgggacgccccuguacggcauccgcgagggggacggcuucagcaaccgcgacgugcuccgguucgagugccaguucggguucgagcugaucggcgagaaguccaucgucugccaggagaacaaccaguggagcgccaacauccccaucugcaucuuccccugccuguccaacuucaccgcccccaugggcaccgugcucagccccgacuaccccgagggguacggcaacaaccugaacugcaucuggaccaucaucuccgaccccgggagccgcauccaccuguccuucaacgacuucgaccucgagagccaguucgacuuccuggccgugaaggacggcgacucccccgagagccccauccuggggaccuucaccggcgccgagguccccagccaccucaccuccaacagccacauccugcggcuggaguuccaggcggaccacuccaugagcggccgcggguucaacaucacguacaacaccuucggccacaacgagugccccgaccccgggauccccaucaacgcccggcgcuucggcgacaacuuccagcucggguccagcaucuccgugaucugcgaggagggcuucaucaagacccagggcaccgagacgaucacgugcauccugauggacgggaaggugauguggagcggccugauccccaagugcggggcccccugcggcggccacuucuccgcccccagcggggucauccugucccccggcuggcccggguacuacaaggacagccucaacugcgagugggugaucgaggccgagcccggccacuccaucaagaucaccuucgagcgguuccagaccgagcugaacuacgacgugcuggagguccacgacgggcccaaccuccugagcccgcugcucggcuccuacaacggcacccaggucccccaguuccuguucagcuccagcaacuucaucuaccuccuguucaccaccgacaacucccgcagcaacaacggguucaagauccacuacgagagcgugaccgucaacacguacuccugccuggaccccggcaucccggugcacgggcggcgcuacggccacgacuucagcaucggguccaccgugagcuucuccugcgacagcggcuaccggcugucccacgaggagccccuccugugcgagaagaaccacugguggagccacccccugccgaccugcgacgcgcucugcggcggggacguccgcggcccguccgggaccauccugagccccggcuaccccgaguucuaccccaacucccugaacugcacguggaccguggacgugacccacgggaagggcguccaguucaacuuccacaccuuccaccucgaggaccaccacgacuaccugcugaucacggagaacggcagcuucacccagccgcucgcccggcugaccggguccgaccugccgcccaccaucaacgccggccucuacgggaacuuccgcgcccagcugcgguucaucagcgacuucuccaucagcuacgagggcuucaacaucacguucuccgaguacaaccuggagcccugcgaggacccgggcaucccccaguacgggagccgcaucggcuucaacuucgggaucggcgacacccucaccuucuccugcagcagcggguaccggcuggagggcaccuccgagaucaucugccugggcgggggccgccggguguggagcgcgccccucccccgcugcguggccgagugcggggccuccgccacgaacaacgagggcauccugcugagcccgaacuacccccucaacuacgagaacaaccacgagugcaucuacuccauccagguccaggccgggaagggcaucaacaucagcgcgcgcaccuuccaccuggcccagggcgacgugcugaagaucuacgacgggaaggacaagaccacccaccuccugggcgccuucacgggggccuccaugcggggccugacccucagcuccaccagcaaccagcuguggcuggaguucaacuccgacaccgaggggacggacgagggcuuccagcucguguacaccagcuucgagcugucccacugcgaggaccccggcaucccccaguucggguacaagaucagcgaccagggccacuucgccggguccaccaucaucuacggcugcaacccgggguacacccugcacggcagcucccuccugaagugcaugaccggcgagcgccgggcgugggacuacccccugcccagcugcaucgccgagugcgggggccgcuucaagggggaguccagcggccggauccucagccccggcuacccguuccccuacgacaacaaccugcgcugcauguggaugaucgaggucgaccccgggaacaucgugucccugcaguuccucgccuucgacacggaggccagccacgacauccugcgggugugggacgggccgcccgagaacgacaugcugcucaaggagaucuccgggagccugauccccgagggcauccacuccacccugaacaucgucaccauccaguucgacaccgacuucuacaucagcaaguccggguucgccauccaguucagcuccagcguggcgacggccugccgcgaccccggcgugcccaugaacggcacccggaacggggacggccgcgagcccggggacaccgucguguuccagugcgaccccggcuacgagcuccagggggaggagcggaucacgugcauccagguggagaaccgcuacuucuggcagcccuccccgcccgucugcaucgcccccugcggcggcaaccugacggggagcuccggcuucauccugagccccaacuucccgcaccccuacccccacucccgggacugcgacuggaccaucaccgugaacgccgacuacgugaucagccucgcguucaucuccuucagcaucgagcccaacuacgacuuccuguacaucuacgacgggccggacuccaacagcccccugaucggcagcuuccaggacuccaagcuccccgagcgcaucgagagcuccagcaacaccaugcaccuggccuuccgguccgacgggagcgucuccuacacgggcuuccaccuggaguacaaggccaagcuccgcgagagcugcuucgaccccggcaacaucaugaacgggacccggcugggcauggacuacaagcugggguccaccgugaccuacuacugcgacgccggcuacgugcuccagggguacagcacgcugaccugcaucaugggcgacgacggccgcccgggguggaaccgggcccugcccuccugccacgcgcccugcggcagccgcuccaccgggagcgagggcaccguccucucccccaacuacccgaagaacuacagcgugggccacaacugcguguacuccaucgccguccccaaggaguucguggucuucgggcaguucguguucuuccagacgagccugcacgacguggucgagguguacgacggccccacccagcaguccagccugcucagcucccugagcgggucccacagcggcgagucccugccccucagcuccgggaaccagaucaccauccgguucaccagcgugggcccgaucacggccaagggcuuccacuucgucuaccaggccgugccccgcaccuccagcacccagugcuccagcgugcccgagccccgcuucgggcggcgcaucggcaacgaguucgccgucggguccagcgugcuguucgacugcaacccgggcuacauccugcacggguccaucgcgauccggugcgagaccgugcccaacagccucgcccaguggaacgacucccugcccacgugcaucgucccgugcggcggcauccugaccaagcgcaaggggaccauccucagccccggcuaccccgagcccuacgacaacaaccugaacugcguguggaagaucaccgugccggagggggccggcauccagguccagguggugagcuucgccacggagcacaacugggacucccuggacuucuacgacgggggcgacaacaacgcgccccggcucggcagcuacuccgggaccaccaucccccaccuccugaacagcaccuccaacaaccucuaccugaacuuccagagcgacaucuccgucagcgcggccggcuuccaccuggaguacacggccaucgggcucgacuccugccccgagccgcagacccccagcuccggcaucaagaucggcgaccgcuacauggugggggacguggucagcuuccagugcgaccagggcuacucccugcaggggcacagccacaucacgugcaugcccggccccgugcggcgcuggaacuacccgauccccaucugccuggcccagugcgggggcgcgauguccgacuucagcggcgugauccugucccccggguuccccggcaacuacccgagcucccucgacugcaccuggaccaucaaccugcccaucggguucggcguccaccuccaguucgugaacuucagcacggagaccauccacgacuaccucgaggugcggagcggguccagcgagaccuccaccgucaucggccgccugagcggcccccagauccccuccagccuguucuccacgacccacgagaccagccucuacuuccacuccgacuacagccagaacaagcagggguuccacaucguguaccaggccuaccagcugcaguccugcccggacccccggcccuuccgcaacggcuucgugaucgggaacgacuucaccgucggccagacgaucagcuucgagugcuuccccggguacacccugaucggcaacuccgcccugaccugccugcacggcgugagccggaacuggaaccacccgcugccccgcugcgaggcccucugcgggggcaacaucaccgccaugaacgggacgaucuacucccccggcuacccggacgaguaccccaacuuccaggacugcuucuggcuggugcgggugccgcccgggaacggcaucuacaucaacuucaccgugcugcagaccgagccgaucuacgacuucaucaccgugugggacggccccgaccagaacagcccccagaucgggcaguucuccggcaacacggcgcucgagagcgucuacuccaccagcaaccagauccugaucaaguuccacagcgacuucaccaccuccggguucuucgugcugagcuaccacgccuaccagcuccgcgugugccagcccccgccgcccguccccaacgccgagauccugacggaggacgacgaguucgagaucggcgacaucauccgguaccagugccugccgggcuucacccucguggggaacgccauccugaccugccgccugggcgagcggcuccagauggacggggcgccgcccgugugccagguccugugccccgcgaacgagcugcgccucgacuccaccggcgugauccugagcccgggguaccccgacuccuaccccaaccugcagaugugcgccuggagcaucuccguggagaagggcuacaacaucacgauguucgucgaguucuuccagaccgagaaggaguucgacgugcuccagguguacgacggccccaacauccagagcccgguccugaucucccugagcggggacuacuccagcgccuucaacaucaccuccaacggccacgagguguuccuccaguggagcgccgaccacgggaacaacaagaagggcuuccgcauccgguacaucgccuucuacugcuccacccccgaguccccgccccacggguacaucaucucccagacgggcggccagcugaacagcgugguccgcugggcgugcgaccggggguuccgccuggugggcaaguccagcgccgucugccgcaagagcuccuacggguaccacgccugggacgccccggugcccgccugccaggcgaucagcugcggcauccccaaggcccccaccaacgggggcauccucaccaccgacuaccuggugggcacgcgcgucaccuacuucugcaacgacggguaccggcuguccagcaaggagcucaccaccgccgugugccaguccgacggcacguggagcaaccacaacaagaccccgcgcugcguggucaucuccugcggggagcugcccaccccgcccaacggcaacaagaucggcacccagacgagcuacggguccaccgccaucuucacgugcgaccugggcuucaugcucguggggagcgcggugcgggagugccuguccagcggccugugguccgagagcgagacccgcugccucgccgggcacugcggcauccccgagcugaucgucaacggccaggugaucggggagaacuacggcuaccgggacaccguggucuaccagugcaaccccggguuccgccugaucggcuccagcgugcggaucugccagcaggaccacaacugguccgggcagcuccccagcugcgugcccgucuccugcggccaccccggcagccccaucuacgggcgcacgagcggcaacggguucaacuucaacgacguggugaccuucuccugcaacaucggcuaccugaugcaggggcccaccaaggcccagugccaggccaaccggcaguggagccacccgccgcccaugugcaaggucgugaacugcuccgaccccggcaucccggccaacagcaagcgcgaguccaagaucgagcacggcaacuucaccuacgggacgguggucuucuacgacugcaaccccggcuacuuccuguucgggagcuccgugcucaucugccagcccaacggccagugggacaagccccugccggagugcaucaugaucgacugcgggcaccccggcgugccgcccaacgcgguccugagcggcgagaaguacaccuucggguccaccgugcacuacagcugcaccggcaagcggucccuccuggggcagagcucccgcacgugccagcugaacggccacuggagcggcucccagccgcacugcagcggggacgccaccgggaccugcggggaccccggcacccccgggcacggcucccggcaggagagcaacuuccgcacgaaguccaccgugcgguacgccugcgacaccggcuacauccuccacgggagcgaggagcggaccugccuggccaacggcagcuggacggggcgccagcccgagugcaaggccguccagugcggcaacccggggaccaccgcgaacggcaagguguuccggaucgacggcaccacguucuccagcuccgugaucuacagcugcauggagggguacauccuguccggccccagcguccgccagugcaccgccaacgggaccugguccggcacccuccccaacugcacgaucaucagcugcggggaccccggcaucccggccaacggccugcgguacggggacgacuacguggugggccagaacgucuccuacaugugccagcccggguacaccauggagcugaacggcagccgcauccggaccugcaccaucaacggcacgugguccggggugaugccgaccugccgcgccgugaccugcccgacgccgccccagaucagcaacggccggcucgaggggacgaacuucgacuggggcuucuccaucagcuacaucugcucccccggguacgagcugagcuucccggccguccugaccugcgugggcaacggcaccugguccggggaggugccccagugccuccccaaguucugcggcgaccccgggaucccggcgcagggcaagcgcgagggcaagagcuucaucuaccagagcgaggucuccuucagcugcaacuuccccuucauccuggugggcuccagcacccggaucugccaggccgacggcacgugguccgggagcagcccccacugcaucgagcccacccagaccagcugcgagaacccgggcgugccccgccacgggucccagaacaacaccuucggcuuccaggucgggagcguggugcaguuccacugcaagaagggccaccuccugcagggcuccaccacgcggaccugccugcccgaccugaccuggagcgggauccagcccgagugcaucccgcacuccugcaagcagcccgagacccccgcccacgccaacgucgugggcauggaccugcccagccacggguacacgcugaucuacacgugccagccgggcuucuuccuggccggcggcaccgagcaccgcgugugccgguccgacaacaccuggacgggcaagguccccaucugcgaggccgggagcaagauccucgugaaggacccccgccccgcccugggcaccccgucccccaagcugagcgugcccgacgacgucuucgcccagaacuacaucuggaagggguccuacaacuucaagggccggaagcagcccaugacccucaccgugacgagcuucaacgccagcaccggccgcgucaacgcgacccuguccaacagcaacauggagcugcuccuguccgggguguacaagagccaggaggcccggcugaugcuccgcaucuaccugaucaaggugccggcccacgccuccgucaagaagaugaaggaggagaacugggccauggacggcuucgugagcgcggagcccgacggggccaccuacguguuccagggcuucauccaggggaaggacuacggccaguucggccugcagcggcucgggcugaacauguccgagggcagcaacuccagcaaccagccccacgggacgaacuccagcuccgucgccaucgccauccuggugccguucuucgcccucaucuucgcgggcuucggguucuaccuguacaagcagcgcaccgcccccaagacccaguacaccggcugcagcgugcacgagaacaacaacggccaggccgccuucgagaaccccauguacgacacgaacgcgaaguccgucgaggggaaggccgugcgcuucgaccccaaccugaacaccgugugcaccauggucuga

SEQ ID NO: 28759 - RNA, 531 nt, Artificial Sequence
  derived and/or modified sequence opt1 from CSN1S1__Homo_sapiens__NP_001020275
augcgccugcucauccugaccugccugguggccgucgcccucgcgcggcccaagcugccgcugcgcuaccccgagcggcuccagaaccccagcgaguccagcgagcccaucccgcuggagucccgcgaggaguacaugaacggcaugaaccggcgcaacauccugcgggagaagcagaccgacgagaucaaggacacgcgcaacgagagcacccagaacugcgugguggccgagcccgagaagauggaguccagcaucuccagcuccagcgaggagcaguucugccggcucaacgaguacaaccagcugcagcugcaggccgcccacgcccaggagcagauccgccggaugaacgagaacucccacguccaggugcccuuccagcagcucaaccagcuggcggccuaccccuacgccgugugguacuacccgcagaucaugcaguacguccccuucccgcccuucagcgacaucuccaaccccaccgcccacgagaacuacgagaagaacaacgugaugcugcagugguga

SEQ ID NO: 28760 - RNA, 681 nt, Artificial Sequence
  derived and/or modified sequence opt1 from CSN2__Homo_sapiens__XP_011529920
augaaggugcugauccucgccugccuggucgcccuggcgcucgcccgcgagaccaucgagagccuguccagcuccgaggagagcaucaccgaguacaagcagaagguggagaaggugaagcacgaggaccagcagcagggcgaggacgagcaccaggacaagaucuaccccuccuuccagccgcagccccugaucuaccccuucgucgagcccaucccguacggguuccucccccagaacauccugccccuggcccagcccgccguggugcucccggucccccagcccgagaucauggaggugcccaaggccaaggacacgguguacaccaagggccgggucaugccggugcucaagagccccaccauccccuucuucgacccccagaucccgaagcugaccgaccuggagaaccugcaccucccccugccccugcugcagccccucaugcagcaggucccgcagcccaucccccagacgcuggcgcugcccccgcagccccucugguccgugccccagcccaaggugcugccgaucccccagcaggucgugcccuacccgcagcgcgccgugcccgugcaggcccugcuccugaaccaggagcugcuccugaaccccacccaccagaucuaccccgucacccagccgcuggcccccgugcacaaccccaucagcguguga

SEQ ID NO: 28761 - RNA, 549 nt, Artificial Sequence
  derived and/or modified sequence opt1 from CSN3__Homo_sapiens__NP_005203
augaaguccuuccugcucguggucaacgcccuggcccugacccuccccuuccuggcgguggaggugcagaaccagaagcagcccgccugccacgagaacgacgagcgccccuucuaccagaagaccgcccccuacguccccauguacuacgugccgaacagcuaccccuacuacggcacgaaccuguaccagcggcgccccgccaucgccaucaacaaccccuacgugccgcggaccuacuacgcgaaccccgccgucgugcgcccccacgcccagaucccccagcggcaguaccucccgaacagccacccgcccaccgugguccgccggcccaaccugcaccccuccuucaucgccaucccgcccaagaagauccaggacaagaucaucauccccaccaucaacacgaucgcgaccguggagcccacccccgcccccgccaccgagcccacgguggacagcgucgugaccccggaggccuucuccgagagcaucaucaccuccacccccgagacgaccaccguggccgucaccccgcccacggcguga

SEQ ID NO: 28762 - RNA, 1098 nt, Artificial Sequence
  derived and/or modified sequence opt1 from CSNK1A1__Homo_sapiens__NP_001020276
auggccagcuccagcggcuccaaggccgaguucaucgucgggggcaaguacaagcuggugcgcaagaucgggagcggcuccuucggggacaucuaccucgcgaucaacaucaccaacggcgaggagguggccgugaagcuggagagccagaaggcccggcacccccagcugcucuacgaguccaagcuguacaagauccugcagggcggggucggcaucccgcacauccgcugguacgggcaggagaaggacuacaacgugcucgugauggaccugcugggccccagccucgaggaccuguucaacuucugcucccggcgcuucaccaugaagacgguccugaugcucgccgaccagaugaucagccggaucgaguacgugcacaccaagaacuucauccaccgcgacaucaagcccgacaacuuccugauggggaucggccggcacugcaacaagugccuggagucccccgugggcaagcgcaagcggagcaugaccgucuccaccagccaggacccguccuucagcgggcucaaccagcuguuccugaucgacuucggccucgccaagaaguaccgcgacaaccggacgcgccagcacauccccuaccgggaggacaagaaccugaccgggaccgcgcgcuacgccuccaucaacgcccaccugggcaucgagcagagccggcgcgacgacauggagucccucggcuacgugcugauguacuucaaccggaccagccugcccuggcaggggcucaaggccgcgacgaagaagcagaaguacgagaagaucagcgagaagaagauguccacccccguggagguccugugcaagggcuucccggccgaguucgccauguaccugaacuacugccgcgggcuccgguucgaggaggcccccgacuacauguaccugcgccagcuguuccggauccucuuccgcacccugaaccaccaguacgacuacaccuucgacuggacgaugcugaagcagaaggccgcgcagcaggccgccagcuccagcggccaggggcagcaggcccagacccccaccggcaagcagaccgacaagacgaaguccaacaugaagggcuucuga

SEQ ID NO: 28763 - RNA, 1248 nt, Artificial Sequence
  derived and/or modified sequence opt1 from CSNK1D__Homo_sapiens__NP_001884
auggagcugcgcgugggcaaccgguaccgccucgggcggaagaucggcagcggguccuucggcgacaucuaccuggggaccgacaucgccgccggcgaggaggucgcgaucaagcuggagugcgugaagaccaagcacccccagcuccacaucgagagcaagaucuacaagaugaugcagggcggggugggcaucccgacgauccgcuggugcggggccgagggcgacuacaacgucauggugauggagcugcuggggcccucccucgaggaccuguucaacuucugcagccggaaguucucccugaagaccgugcuccugcuggccgaccagaugaucagccgcaucgaguacauccacuccaagaacuucauccaccgggacgucaagcccgacaacuuccucaugggccugggcaagaaggggaaccugguguacaucaucgacuucggccucgccaagaaguaccgcgacgcccggacccaccagcacauccccuaccgcgagaacaagaaccugaccgggacggcgcgguacgccagcaucaacacccaccugggcaucgagcagucccgccgggacgaccucgagagccugggcuacgugcugauguacuucaaccucgggucccugccguggcagggccugaaggccgccaccaagcgccagaaguacgagcggaucagcgagaagaagauguccacccccaucgagguccucugcaagggguaccccagcgaguucgcgacguaccugaacuucugccgcucccugcgguucgacgacaagcccgacuacagcuaccuccgccagcuguuccggaaccuguuccaccgccagggcuucuccuacgacuacguguucgacuggaacaugcucaaguucggggccagccgggccgccgacgacgccgagcgcgagcgccgggaccgcgaggagcggcugcgccacucccggaacccggcgacccgcggccugcccagcaccgccagcggccggcuccgcgggacccaggagguggccccgcccacgccccugacccccaccucccacaccgccaacacgagcccccggcccgucuccggcauggagcgcgagcggaaggugagcaugcgccugcaccgcggggccccggugaacaucuccagcuccgaccucaccggccggcaggacaccagccggauguccaccagccagauccccgggcgcgucgcguccagcggccugcaguccguggugcaccgguga

SEQ ID NO: 28764 - RNA, 1272 nt, Artificial Sequence
  derived and/or modified sequence opt1 from CSNK1G3__Homo_sapiens__NP_001026982
auggagaacaagaagaaggacaaggacaagagcgacgaccgcauggcccggcccuccggccgcagcgggcacaacacccggggcaccggguccagcuccagcggcgugcugauggucgggccgaacuuccgcgugggcaagaagaucggcugcgggaacuucggcgagcuccggcuggggaagaaccuguacacgaacgaguacguggccaucaagcucgagcccaugaagucccgcgcgccccagcugcaccuggaguaccgguucuacaagcagcucggcagcggggacggcaucccccaggucuacuacuucggcccgugcgggaaguacaacgccauggugcuggagcugcucggccccucccuggaggaccuguucgaccucugcgaccgcaccuucagccugaagaccgugcugaugaucgccauccagcucaucucccggauggaguacguccacagcaagaaccugaucuaccgcgacgugaagcccgagaacuuccugaucgggcggcccggcaacaagacccagcaggucauccacaucaucgacuucggccucgccaaggaguacaucgacccggagacgaagaagcacauccccuaccgcgagcacaagucccugaccgggaccgcccgguacaugagcaucaacacccaccugggcaaggagcagucccgccgggacgaccucgaggcgcuggggcacauguucauguacuuccugcgcggcagccuccccuggcaggggcugaaggccgacacgcugaaggagcgguaccagaagaucggcgacaccaagcgcgccacccccaucgaggugcucugcgagaacuucccggagauggccaccuaccugcgguacgugcgccggcuggacuucuucgagaagcccgacuacgacuaccuccgcaagcuguucacggaccuguucgaccgcaagggcuacauguucgacuacgaguacgacuggaucgggaagcagcuccccacccccgugggcgcgguccagcaggacccggcccuguccagcaaccgggaggcccaccagcaccgcgacaagaugcagcaguccaagaaccagguggugagcagcaccaacggggagcugaacaccgacgaccccacggccggccgguccaacgcccccaucaccgcgcccaccgaggucgaggugauggacgagaccaacugccagaaggugcucaacauguggugcugcugcuucuucaagcgccggaagcgcaagacgauccagcggcacaaguga

SEQ ID NO: 28765 - RNA, 1176 nt, Artificial Sequence
  derived and/or modified sequence opt1 from CSNK2A1__Homo_sapiens__XP_011527477
augagcggccccgugccgucccgcgcccgggucuacaccgacgugaacacccaccgcccccgggaguacugggacuacgagagccacguggucgagugggggaaccaggacgacuaccagcuggugcgcaagcucggccgggggaaguacuccgagguguucgaggccaucaacaucacgaacaacgagaaggucguggugaagauccugaagcccgucaagaagaagaagaucaagcgcgagaucaagauccuggagaaccuccggggcgggcccaacaucaucacccuggcggacaucgugaaggacccggugagccgcacccccgcccuggucuucgagcacgugaacaacaccgacuucaagcagcucuaccagacgcugaccgacuacgacauccgguucuacauguacgagauccugaaggcccucgacuacugccacuccaugggcaucaugcaccgcgacgugaagccccacaacgucaugaucgaccacgagcaccggaagcugcgccugaucgacuggggccucgccgaguucuaccaccccgggcaggaguacaacgugcggguggccagccgcuacuucaagggcccggagcugcuggucgacuaccagauguacgacuacucccucgacauguggagccuggggugcaugcuggcguccaugaucuuccggaaggagcccuucuuccacggccacgacaacuacgaccagcucgugcgcaucgccaaggugcuggggaccgaggaccuguacgacuacaucgacaaguacaacaucgagcucgacccccgguucaacgacauccugggccgccacagccggaagcgcugggagcgguucguccacuccgagaaccagcaccuggugagccccgaggcccucgacuuccuggacaagcugcuccgcuacgaccaccagucccgccugaccgcccgggaggcgauggagcacccguacuucuacacgguggucaaggaccaggcccgcaugggcagcuccagcaugcccgggggcuccacccccgugagcuccgccaacaugaugagcgggaucagcuccguccccaccccgagcccccugggcccccucgccggcucccccgugaucgccgcggccaacccgcuggggaugcccgugcccgccgccgccggcgcgcagcaguga

SEQ ID NO: 28766 - RNA, 1053 nt, Artificial Sequence
  derived and/or modified sequence opt1 from CSNK2A2__Homo_sapiens__NP_001887
augcccggcccggccgccgggagccgcgcgcggguguacgccgaggucaacucccugcgcagccgggaguacugggacuacgaggcccacgugcccuccuggggcaaccaggacgacuaccagcucgugcgcaagcuggggcggggcaaguacagcgaggucuucgaggccaucaacaucaccaacaacgagcgcgugguggucaagauccugaagcccgugaagaagaagaagaucaagcgggaggugaagauccucgagaaccugcgcgggggcaccaacaucaucaagcugaucgacacggucaaggaccccguguccaagaccccggcccucguguucgaguacaucaacaacaccgacuucaagcagcuguaccagauccugaccgacuucgacauccgguucuacauguacgagcuccugaaggcgcuggacuacugccacagcaagggcaucaugcaccgcgacgucaagccccacaacgugaugaucgaccaccagcagaagaagcuccggcugaucgacugggggcuggccgaguucuaccaccccgcccaggaguacaacgugcgcgucgccucccgguacuucaagggccccgagcuccugguggacuaccagauguacgacuacagccuggacauguggucccucgggugcaugcuggcgagcaugaucuuccgccgggagccguucuuccacggccaggacaacuacgaccagcuggugcgcaucgccaagguccucgggacggaggagcuguacggcuaccugaagaaguaccacaucgaccucgacccccacuucaacgacauccugggccagcacucccggaagcgcugggagaacuucauccacagcgagaaccggcaccuggugucccccgaggcccucgaccugcuggacaagcuccugcgcuacgaccaccagcagcggcugaccgccaaggaggccauggagcaccccuacuucuacccgguggucaaggagcagagccagcccugcgcggacaacgccgugcucuccagcgggcugaccgccgcccgcuga

SEQ ID NO: 28767 - RNA, 648 nt, Artificial Sequence
  derived and/or modified sequence opt1 from CSNK2B__Homo_sapiens__NP_001311
augagcuccagcgaggagguguccuggaucagcugguucugcggccugcgcgggaacgaguucuucugcgaggucgacgaggacuacauccaggacaaguucaaccucaccggccugaacgagcaggucccccacuaccggcaggcccuggacaugauccucgaccuggagccggacgaggagcuggaggacaaccccaaccaguccgaccucaucgagcaggccgcggagaugcuguacgggcugauccacgcccgcuacauccucaccaaccggggcaucgcccagaugcuggagaaguaccagcagggggacuucggcuacugcccccgcguguacugcgagaaccagcccaugcugccgaucggccucagcgacauccccggggaggccauggugaagcuguacugccccaagugcauggacguguacacgcccaaguccagccggcaccaccacaccgacggcgccuacuucgggaccggcuucccgcacaugcuguucauggugcaccccgaguaccgccccaagcggcccgcgaaccaguucgucccgcgccucuacggguucaagauccaccccauggccuaccagcugcagcugcaggccgccuccaacuucaagagccccgugaagaccauccgguga

SEQ ID NO: 28768 - RNA, 6969 nt, Artificial Sequence
  derived and/or modified sequence opt1 from CSPG4__Homo_sapiens__NP_001888
augcaguccggcccccgcccgccccugcccgcccccgggcucgcccuggcccugacccucaccaugcuggcccggcuggccuccgccgccagcuucuucggcgagaaccaccucgaggugcccguggccacggcccugaccgacaucgaccugcagcuccaguucuccaccucccagcccgaggcccugcugcuccuggccgcggggcccgccgaccaccuccugcugcagcuguacuccggccgccuccaggugcggcuggugcuggggcaggaggagcugcgccugcagacccccgccgagacgcugcucuccgacuccaucccccacaccguggugcugaccgugguggagggcugggccacccugagcguggacggcuuccucaacgccuccagcgcggugcccggggcgccccuggaggugcccuacggccuguucgucggcgggacggggacccucgggcugcccuaccugcggggcaccucccgcccccuccgggggugccugcacgccgccacccugaacggccgcagccuccugcggccccugacgcccgacgugcacgaggggugcgccgaggaguucuccgcgagcgacgacguggcccucggcuucuccggcccccacagccuggccgccuuccccgccugggggacccaggacgagggcacccuggaguucacccucacgacccagucccgccaggcgccccuggccuuccaggccgggggccggcgcggggacuucaucuacguggacaucuucgagggccaccuccgcgccguggucgagaagggccaggggaccgugcugcugcacaacagcgugcccgucgccgacggccagccccacgagguguccgugcacaucaacgcgcaccgccuggagaucagcgucgaccaguaccccacccacacgagcaaccgcggggugcucuccuaccuggagccccgcggcagccugcugcucgggggccuggacgccgaggccucccggcaccuccaggagcaccgccucggccugacccccgaggccaccaacgcgagccugcucgggugcauggaggaccuguccgugaacggccagcggcgcgggcugcgggaggcccuccugacccgcaacauggccgccggcugccgccuggaggaggaggaguacgaggacgacgccuacgggcacuacgaggcguucagcacgcucgcccccgaggccuggcccgccauggagcugcccgagcccugcguccccgagcccggccugccgcccguguucgccaacuucacccagcuccugaccaucagcccccuggucguggcggagggcgggaccgccuggcucgaguggcggcacgugcagcccacgcuggaccugauggaggccgagcuccgcaagagccagguccuguucuccgugacccggggcgcccgccacggggagcuggagcucgacauccccggcgcccaggcgcggaagauguucacccugcuggacguggucaaccgcaaggcccgguucauccacgacggcagcgaggacaccuccgaccagcucgugcuggaggugagcgucacggcccgcgugcccaugcccuccugccugcggcgcgggcagaccuaccuccugcccauccaggugaaccccgucaacgacccgccccacaucaucuucccccacggcagccugauggugauccucgagcacacccagaagccccuggggcccgagguguuccaggccuacgaccccgacuccgcgugcgagggccugaccuuccagguccucgggacgagcuccggccugcccguggagcggcgcgaccagcccggcgagccggccaccgaguucagcugccgggagcuggaggccgggucccucguguacguccaccgcggcgggcccgcccaggaccugaccuuccgggugagcgacggccugcaggccuccccgcccgcgacccucaagguggucgccauccgcccggccauccagauccaccgguccaccgggcugcgccuggcccagggcagcgccaugcccauccuccccgcgaaccuguccguggagacgaacgccgugggccaggacgucagcgugcuguuccgggugaccggggcccuccaguucggcgagcugcagaagcagggggccggcggggucgagggcgccgaguggugggcgacccaggccuuccaccagcgcgacguggagcagggccgcgugcgguaccuguccaccgacccccagcaccacgccuacgacacggucgagaaccucgcccuggagguccagguggggcaggagauccugagcaaccucuccuucccggucaccauccagcgcgcgaccguguggaugcugcggcuggagccccuccacacccagaacacgcagcaggagacccugaccaccgcccaccuggaggccacgcucgaggaggccggccccagcccgcccaccuuccacuacgaggugguccaggcgccccggaaggggaaccugcagcugcagggcacccggcucuccgacgggcagggcuucacccaggacgacauccaggcgggccgcgugacguacggggccaccgcccgggccagcgaggccguggaggacaccuuccgcuuccgggucaccgcgcccccguacuucagcccccuguacacguuccccauccacaucggcggggaccccgacgccccggugcugaccaacgugcuccuggucgugcccgagggcggcgagggggugcugagcgccgaccaccucuucgucaagucccugaacagcgccuccuaccuguacgaggugauggagcgcccccggcacggccgccucgccuggcgggggacccaggacaagaccacgauggugaccagcuucaccaacgaggaccugcugcgcggccggcucgucuaccagcacgacgacuccgagaccacggaggacgacauccccuucguggcgacccgccagggggagagcagcggcgacauggccugggaggaggugcggggcgucuuccgcguggccauccagccggucaacgaccacgcccccgugcagaccaucucccggaucuuccacguggcccgcgggggccggcgccugcugaccacggacgacgucgcguucagcgacgccgacuccggguucgccgacgcccagcucgugcugacccgcaaggaccuccuguucggcagcaucguggcggucgacgagcccacccggcccaucuaccgcuucacccaggaggaccugcggaagcgccgggugcuguucgugcacuccggggccgaccgcggcuggauccagcuccaggucagcgacggccagcaccaggccacggcccugcuggaggugcaggccuccgagccguaccuccggguggcgaacgggagcucccuggucgugccccagggcgggcagggcaccaucgacaccgccgugcugcaccucgacaccaaccuggacauccgcagcggggacgagguccacuaccacgugaccgccggcccccgguggggccagcuggugcgcgccgggcagcccgccacggcguucucccagcaggaccuccuggacggcgccguccuguacagccacaacgggucccugagcccgcgggacaccauggccuucuccguggaggccggccccgugcacaccgacgccacccuccaggucacgaucgcgcuggagggcccccuggcgccccugaagcuggugcgccacaagaagaucuacguguuccagggggaggccgccgagauccggcgcgaccagcuggaggcggcccaggaggccgucccgcccgccgacaucguguucagcgucaagagcccgcccagcgccggcuaccucgugauggugucccgcggggcccuggccgacgagccgcccagccuggaccccgugcagagcuucucccaggaggccgucgacaccggccgggugcucuaccugcacagccggccggaggccugguccgacgccuucagccuggacguggcguccgggcucggcgcgccccuggagggcguccugguggagcucgaggugcugcccgccgccaucccccuggaggcccagaacuucagcgucccggagggcggcucccucacccuggcgccgccccugcuccgcgugagcgggcccuacuucccgacccugcugggccucucccuccaggugcuggagccgccccagcacggggcccuccagaaggaggacggcccccaggcccggacgcugagcgccuucuccuggcgcauggucgaggagcagcugauccgcuacgugcacgacggcagcgagacccucaccgacuccuucgugcugauggcgaacgccagcgagauggaccggcagucccacccggucgccuucaccgugacggugcugcccgucaacgaccagccgcccauccucaccaccaacaccgggcugcagaugugggagggcgccacggccccgauccccgcggaggcccugcgcagcaccgacggggacuccggcagcgaggaccucguguacaccaucgagcagcccuccaacgggcgggugguccugcgcggcgcccccggcaccgaggugcggagcuucacgcaggcccagcuggacgggggccucgugcuguucagccaccgcgggacccuggacggcggguuccgguuccgccucuccgacggcgagcacaccagcccgggccacuucuuccgggucaccgcccagaagcagguccugcugucccucaaggggagccagacgcugaccgucugccccggcuccgugcagccccugagcucccagacccuccgcgcgagcuccagcgccgggaccgacccccagcugcugcucuaccgggugguccgcggcccgcagcugggccggcuguuccacgcccagcaggacuccacgggggaggcccucgugaacuucacccaggccgagguguacgcgggcaacauccuguacgagcacgagaugccgcccgagcccuucugggaggcccacgacacccuggagcuccagcugagcuccccgcccgcccgcgacgucgccgccacccuggcgguggccgugagcuucgaggccgccugcccccagcggccgucccaccucuggaagaacaaggggcuguggguccccgagggccagcgcgcgcggaucacgguggccgcccuggacgccagcaaccuccuggccuccgugcccagcccccagcgcuccgagcacgacguccuguuccaggugacccaguucccgagccgggggcagcuccuggugagcgaggagccccugcacgcgggccagccccacuuccuccagucccagcuggccgccggccagcuggucuacgcccacgggggcgggggcacccagcaggacggguuccacuuccgcgcccaccuccagggccccgcgggcgccagcguggccgggccgcagaccuccgaggccuucgccaucacggugcgggacgucaacgagcggccgccccagccccaggcgagcgugccgcugcgccugacccggggcucccgcgcccccaucagccgggcccagcucuccguggucgaccccgacagcgcccccggggagaucgaguacgaggugcagcgcgcgccgcacaacggcuuccugucccuggucgggggcggccucgggcccgucacccgguucacccaggccgacguggacagcggccgccuggccuucguggccaacggguccagcgucgccggcaucuuccagcuguccaugagcgacggggcgagcccgccccucccgaugagccuggccguggacauccugcccuccgccaucgaggugcagcuccgggcgccccuggaggucccccaggcccugggccgcagcucccucagccagcagcagcugcggguggugagcgaccgcgaggagccggaggccgccuaccggcugauccagggcccccaguacgggcaccuccuggucggcgggcgccccaccuccgccuucagccaguuccagaucgaccagggcgaggugguguucgccuucacgaacuucuccagcucccacgaccacuuccggguccuggcccucgcgcgcggcgugaacgccagcgccguggucaacgugaccgugcgggcccugcugcacgucugggccgggggcccguggccccagggggccacccuccgccuggaccccaccgugcuggacgccggcgagcucgccaaccggacgggguccgugccccgcuuccggcugcuggagggcccgcgccacggccgcgucgugcgggugccccgcgcccggaccgagcccgggggcagccagcuggucgagcaguucacccagcaggaccucgaggacgggcgccugggccuggagguggggcggcccgagggccgcgcgccgggccccgccggggacucccucacccuggagcugugggcccagggcgugccgcccgccgucgccagccucgacuucgcgacggagccguacaacgccgcccggcccuacuccguggcccugcugagcguccccgaggccgcgcgcaccgaggccgggaagcccgaguccagcaccccgaccggcgagcccgggcccauggccuccagccccgagccggccguggccaagggcggcuuccucuccuuccuggaggcgaacauguucagcgugaucauccccaugugccugguccuccugcugcucgcccugauccugccccuccuguucuaccugcggaagcgcaacaagacggggaagcacgacguccaggugcucaccgccaagccccggaacggccuggccggggacaccgagaccuuccgcaaggucgagccgggccaggcgaucccccugacggccgugcccggccaggggcccccgcccggcgggcagcccgacccggagcuccugcaguucugccggacccccaaccccgcccugaagaacggccaguacuggguguga

SEQ ID NO: 28769 - RNA, 1206 nt, Artificial Sequence
  derived and/or modified sequence opt1 from CSPG5__Homo_sapiens__NP_001193871
augcccccggccauccccgaggccaccgaggcgagcggcccgcccucccccacccccggggacaagcugagccccgccuccgagcuccccaaggagagcccgcuggagguguggcugaaccucggcggguccacgcccgacccccagggccccgagcugaccuacccguuccaggggacccuggagccccagcccgccagcgacaucaucgacaucgacuacuucgagggccucgacggcgaggggcgcggcgccgaccugggguccuuccccggcagcccggggaccuccgagaaccaccccgacacggagggcgagacccccagcuggucccugcucgaccuguacgacgacuucacccccuucgacgagagcgacuucuacccgaccacguccuucuacgacgaccuggacgaggaggaggaggaggaggaggacgacaaggacgccgucggcgggggcgaccucgaggacgagaacgagcugcuggugcccaccgggaagcccggccucggccccgggaccggccagccgaccagccgguggcacgcggugccgccccagcacacgcugggguccguccccggcagcuccaucgcccugcgcccccggcccggggagcccggccgcgaccucgccagcuccgagaacggcaccgagugccggagcggguucgugcgccacaacggcagcugccgguccgugugcgaccuguucccgagcuacugccacaacgggggccagugcuaccuggucgagaacaucggggccuucugccgcugcaacacccaggacuacaucuggcacaagggcaugcggugcgaguccaucaucaccgacuuccaggugaugugcguggcggucggcagcgccgcccucgugcugcugcuccuguucaugaugacgguguucuucgccaagaagcuguaccuccugaagaccgagaacaccaagcugcgccggaccaacaaguuccgcacgcccuccgagcuccacaacgacaacuucagccuguccaccaucgccgaggggagccaccccaacgacgaccccuccgcgccgcacaagauccaggagguccucaagagcugccugaaggaggaggaguccuucaacauccagaacagcaugucccccaagcuggagggcgggaagggcgaccaggccgaccuggacgugaacugccuccagaacaaccugaccuga

SEQ ID NO: 28770 - RNA, 2631 nt, Artificial Sequence
  derived and/or modified sequence opt1 from CSPP1__Homo_sapiens__NP_001278268
auggacgagcgcuuccgguacgagagcgacuucgaccgccggcugucccgcguguacaccaacgaccggaugcaccgcaacaagcggggcaacaugcccccgauggagcacgacggggacgucaucgagcagagcaacauccgcaucuccagcgccgagaacaaguccgcccccgacaacgagaccagcaaguccgcgaaccaggacacgugcagccccuucgccggcaugcucuucgggggcgaggaccgggagcugauccagcgccggaaggagaaguaccgccuggagcuccuggagcagauggccgagcagcagcggaacaagcgccgggagaaggaccuggagcuccgcguggccgccuccggggcgcaggaccccgagaagagcccggaccggcugaagcaguucuccguggccccccgccacuucgaggagaugaucccccccgagcggccgcgcaucgccuuccagaccccccugcccccccucagcgccccguccgucccccccauccccagcgugcacccggugcccucccagaacgaggaccugcggagcggccuguccagcgcgcucggcgagauggucuccccccgcaucgccccccugccgccccccccccugcucccgccccuggccaccaacuaccgcacccccuacgacgacgccuacuacuucuacgggagccggaacacguucgaccccagccuggccuacuacggcuccgggaugaugggcgugcagccggcggccuacgugagcgcccccgucacccaccagcucgcccagcccguggugaacaccgucgggcagaacgagcugaagaucaccuccgaccaggugaucaacagcggccugaucuucgaggacaagccgaagcccuccaagcagagccuccaguccuaccaggaggcccugcagcagcagauccgcgagcgggaggagcgccggaagaaggagcgcgaggagaaggaggaguacgaggcgaagcuggaggccgagaugcggacguacaaccccuggggcaaggggggcgggggcgccccccuccgcgacgccaagggcaaccugaucagccacaugcagacccaguccagcccguucgcccgggggaacguguucggcgagccccccaccgagcugcagaucaagcagcaggagcucuacaagaacuuccugcgcuuccagaucgaggagaagaagcagcgggaggaggcggagcgcgagcggcugcgcaucgccgaggagaaggaggagcggcgccucgccgagcagcgggcccgcauccagcaggaguacgaggaggagcaggagaagaagcgggagaaggaggaggagcagcgccugaagaacgaggagcacauccgccuggccgaggagcggcagaaggaggcggagcgcaagaagaaggaggaggaggagaaguacaaccuccagcugcagcacuacugcgagcgggacaaccugaucggggaggagaccaagcacaugcgccagcccuccccgaucguccccgcccuccagaacaagaucgccagcaagcugcagcggccccccuccguggacagcaucauccgcuccuucauccacgagagcuccaugagccgggcccaguccccgcccgugcccgcgcgcaagaaccagcugcgggccgaggaggagaagaagaacgucaucauggagcucagcgagaugcgcaagcagcugcggagcgaggagcgccggcugcaggagcgccuccugcacauggacuccgacgacgagauccccauccggaagaaggagcgcaacccgauggacaucuucgacauggcccggcaccgccugcaggcccccgugcggcgccagagccccaagggccucgacgccgcgacguuccagaacgugcacgacuucaacgagcugaaggaccgggacuccgagacccgcgucgaccugaaguucauguaccucgaccccccgcgcgaccaccacacccuggagauccagcagcaggcccugcugcgggagcagcagaagcgccucaaccggaucaagaugcaggagggggccaagguggaccuggacgccauccccagcgccaaggugcgcgagcagcggaugccccgcgacgacaccuccgacuuccugaagaacagccuccuggaguccgacagcgcguucaucggcgccuacggcgagacguaccccgccaucgaggacgacguccugccgccccccucccagcucccgagcgcccgggagcgccggcgcaacaaguggaaggggcuggacaucgacuccagccggcccaacguggcccccgacggccugucccucaagagcaucuccagcgucaacguggacgagcugcgcgugcggaacgaggagcgcaugcggcgccugaacgaguuccacaacaagcccaucaacaccgacgacgaguccagccucgucgacccggacgacaucaugaagcacaucggggacgacggcagcaacuccguggcgaccgagcccuggcugcggcccgggaccagcgagacgcugaagcgcuucauggccgagcagcucaaccaggagcagcagcagauccccggcaagccgggcaccuucaccuggcaggggcuguccaccgcccacggcuga

SEQ ID NO: 28771 - RNA, 1770 nt, Artificial Sequence
  derived and/or modified sequence opt1 from CSRNP1__Homo_sapiens__NP_149016
augaccggccugcucaagcgcaaguucgaccagcuggacgaggacaacagcuccgugagcuccagcuccagcuccagcgggugccagucccggagcugcucccccagcuccagcgucucccgcgccugggacagcgaggaggagggcccgugggaccagaugccccugcccgaccgggacuucugcgggccccgcuccuucaccccgcucagcauccugaagcgggcccgccgggagcgccccggccggguggcguucgacgggaucacgguguucuacuucccccgcugccagggcuucaccuccguccccagccggggcgggugcacccugggcauggcccuccgccacagcgccugccggcgcuucucccuggccgaguucgcccaggagcaggcgcgggcccgccacgagaagcugcggcagcgccucaaggaggagaagcuggagaugcugcaguggaagcucagcgccgccggggugccgcaggcggaggccggccugccgcccguggucgacgccaucgacgacgccuccguggaggaggaccuggccguggcggucgccgggggccggcucgaggaggugagcuuccugcagcccuaccccgcccgccggcgccgcgcccugcuccgggccuccggcgugcgccggaucgaccgcgaggagaagcgggagcugcaggcgcugcgccagagccgggaggacugcgggugccacugcgaccgcaucugcgaccccgagaccugcuccugcagccucgccggcaucaagugccagauggaccacacggccuuccccugcgggugcugccgggagggcugcgagaaccccaugggccgcgucgaguucaaccaggcccgggugcagacccacuucauccacacccugacccgccugcagcucgagcaggaggccgaguccuuccgggagcuggaggcgccggcccaggggagcccgcccucccccggcgaggaggcccuggugcccacguucccccucgccaagccgcccaugaacaacgagcugggggacaacagcugcuccagcgacaugaccgacuccagcaccgccuccagcuccgcgagcggcaccagcgaggcccccgacugccccacgcaccccgggcugcccggcccgggcuuccagcccggggucgacgacgacucccucgcccgcauccugagcuucuccgacagcgacuucggcggggaggaggaggaggaggaggagggcuccguggggaaccuggacaaccucagcugcuuccaccccgccgacaucuucggcaccuccgacccgggcgggcuggcgagcuggacccacuccuacagcggcugcuccuucaccagcggggugcuggacgagaacgccaaccucgacgccuccugcuuccugaacggcgggcuggagggcagccgggagggcucccuccccgggacgagcgucccgcccuccauggacgccggccgcagcagcuccguggaccugagccuguccagcugcgacuccuucgagcuccugcaggcccugcccgacuacagccucgggccccacuacaccucccagaaggugagcgacucccuggacaacaucgaggcgccccacuucccccugccgggccucagcccgcccggcgacgccuccagcugcuuccuggagucccugaugggguucagcgagcccgccgccgaggcccuggaccccuucaucgacucccaguucgaggacaccguccccgcgagccucauggagcccgugcccguguga

SEQ ID NO: 28772 - RNA, 1758 nt, Artificial Sequence
  derived and/or modified sequence opt1 from CSRNP3__Homo_sapiens__NP_079245
augagcggcauccugaagcgcaaguucgaggagguggacggguccagccccugcuccagcguccgggaguccgacgacgaggugagcuccagcgaguccgccgacagcggcgacuccgugaacccgagcaccuccagccacuucacccccuccagcauccucaagcgcgagaagcggcugcgcacgaagaacguccacuucuccugcgugaccguguacuacuucacccggcgccagggguucaccagcguccccucccagggcgggagcacgcugggcaugagcucccggcacaacagcgugcgccaguacacccucggcgaguucgcccgggagcaggagcgccugcaccgggagaugcugcgcgagcaccuccgggaggagaagcugaacucccugaagcucaagaugaccaagaacgggaccguggagagcgaggaggcguccacgcugacccuggacgacaucagcgacgacgacaucgaccucgacaacaccgaggucgacgaguacuucuuccugcagccccugccgaccaagaagcgccgggcccuccugcgcgccuccggcgugaagaagaucgacguggaggagaagcacgagcugcgggccauccgccucagccgggaggacugcgggugcgacugccgcgucuucugcgaccccgacacgugcacgugcucccuggccggcaucaagugccagguggaccggaugagcuuccccugcgggugcaccaaggagggcugcuccaacaccgcgggccgcaucgaguucaaccccauccgcgugcggacccacuuccugcacaccaucaugaagcucgagcuggagaagaaccgcgagcagcagaucccgacccugaacgggugccacagcgagaucuccgcccacagcuccagcaugggccccgucgcccacuccguggaguacagcaucgccgacuccuucgagaucgagaccgagccccaggcggccgugcuccaccuccagagcgccgaggagcuggacugccagggggaggaggaggaggaggaggaggacggcagcuccuucugcagcggcgucacggacuccagcacccagucccuggcccccagcgaguccgacgaggaggaggaggaggaggaggaggaggaggaggaggaggacgacgacgacgacaagggggacggcuucguggaggggcugggcacccacgccgagguggucccgcugcccagcgugcucugcuacuccgacgggaccgcggugcacgagagccacgccaagaacgccuccuucuacgccaacagcuccacgcuguacuaccagaucgacagccacauccccggcacccccaaccagaucuccgagaacuacagcgagcgggacaccgucaagaacggcacccugucccucgugccguacacgaugacccccgagcaguucgucgacuacgcccgccaggcggaggaggccuacggggccagccacuaccccgccgccaaccccagcgugaucgugugcugcuccagcuccgagaacgacagcggcgucccgugcaacucccuguaccccgagcaccggagcaaccacccccagguggaguuccacuccuaccugaaggggcccagccaggagggcuucguguccgcgcucaacggggacagccacaucuccgagcacccggccgagaacagccugucccuggccgagaaguccauccuccacgaggagugcaucaagagccccgucguggagaccgugcccgucuga

SEQ ID NO: 28773 - RNA, 582 nt, Artificial Sequence
  derived and/or modified sequence opt1 from CSRP1__Homo_sapiens__NP_001180500
augcccaacuggggcgggggcaagaagugcggggugugccagaagaccgucuacuucgccgaggaggugcagugcgagggcaacagcuuccacaaguccugcuuccugugcauggugugcaagaagaaccucgacagcaccacggucgccgugcacggggaggagaucuacugcaaguccugcuacggcaagaaguacggcccgaagggguacggcuacgggcagggcgcggggacccugagcaccgacaagggcgagucccugggcaucaagcacgaggaggcccccgggcaccgccccaccacgaaccccaacgccagcaaguucgcccagaagaucggcggguccgagcggugcccgcgcugcagccaggccguguacgcggccgagaaggucaucggcgccggcaaguccuggcacaaggccugcuuccggugcgcgaagugcgggaagggccucgagagcaccacccuggccgacaaggacggggagaucuacugcaagggcugcuacgccaagaacuucgggcccaagggcuucggcuucgggcagggcgccggggcccuggugcacuccgaguga

SEQ ID NO: 28774 - RNA, 2349 nt, Artificial Sequence
  derived and/or modified sequence opt1 from CSRP2BP__Homo_sapiens__NP_065397
auggacagcuccauccaccugagcucccucaucagccgccacgacgacgaggccacccggaccuccacgagcgagggccuggaggagggggagguggagggcgagacccugcucaucgucgaguccgaggaccaggccagcguggaccugucccacgaccagagcggggacucccugaacagcgacgagggcgacguguccuggauggaggagcagcucagcuacuucugcgacaagugccagaaguggauccccgcgucccagcugcgcgagcagcugagcuaccucaagggggacaacuucuuccgguucacgugcuccgacugcagcgccgacggcaaggagcaguacgagcgccugaagcugaccuggcagcaggucgugaugcucgccauguacaaccugucccuggagggcagcgggcggcagggcuacuuccgcuggaaggaggacaucugcgccuucaucgagaagcacuggaccuuccuccuggggaaccggaagaagaccagcaccuggugguccaccguggccggcugccugagcgucggguccccgauguacuuccgcagcggcgcgcaggaguucggcgagcccgggugguggaagcucgugcacaacaagccgcccacgaugaagcccgagggcgagaagcuguccgccagcacccugaagaucaaggccgccuccaagcccacccucgaccccaucaucaccguggaggggcugcggaagcgcgcgagccggaaccccgucgaguccgccauggagcugaaggagaagcgcagccggacgcaggaggccaaggacauccgccgggcccagaaggaggccgcgggcuuccucgaccgcuccaccagcuccaccccggugaaguucaucagccggggccgccggcccgacgugauccuggagaagggggaggucaucgacuucuccagccuguccagcuccgaccgcacgccccucaccagccccagcccgucccccagccuggacuucuccgcccccggcacccccgccagccacuccgccaccccgagccugcucuccgaggccgaccugauccccgacgugaugccgccccaggcgcuguuccacgacgacgacgagauggagggggacggcgugaucgaccccgggauggaguacgucccgccgcccgccggcagcguggccuccggccccguggucgggggccggaagaaggugcgcgggcccgagcagaucaagcaggagguggagagcgaggaggagaagcccgaccgcauggacaucgacuccgaggacaccgacagcaacacgucccuccagacccgggcccgcgagaagcggaagccccagcuggagaaggacaccaagcccaaggagccccgcuacacccccgucagcaucuacgaggagaagcugcuccugaagcggcuggaggccugcccgggcgcgguggccaugacgcccgaggcccgccggcucaagcgcaagcugaucgugcggcaggccaagcgcgaccgggggcugccccucuucgaccuggaccaggucgugaacgccgcgcugcuccuggucgacggcaucuacggcgccaaggagggcgggaucucccgccugcccgccgggcaggccaccuaccggacgaccugccaggacuuccgcauccucgaccgguaccagaccagccugccgucccgcaagggcuuccggcaccagaccaccaaguuccuguaccgccugguggggagcgaggacauggcgguggaccagagcaucgucucccccuacaccagccggauccucaagcccuacauccgccgcgacuacgagacgaagcccccgaagcugcagcugcucucccagauccggagccaccuccaccgcuccgacccccacuggacccccgagcccgacgccccgcuggacuacugcuacgugcggcccaaccacauccccaccaucaacagcaugugccaggaguucuucuggcccggcaucgaccuguccgagugccugcaguacccggacuucagcguggucgugcuguacaagaaggugaucaucgccuucggcuucaugguccccgacgugaaguacaacgaggccuacaucuccuuccucuucgugcaccccgaguggcgccgggccgggaucgcgaccuucaugaucuaccaccugauccagacgugcaugggcaaggacgucacccugcacgugagcgccuccaaccccgccaugcuccuguaccagaaguucggguucaagaccgaggaguacgugcuggacuucuacgacaaguacuacccgcucgagagcaccgagugcaagcacgccuucuuccugcgccugcggcgcuga

SEQ ID NO: 28775 - RNA, 582 nt, Artificial Sequence
  derived and/or modified sequence opt1 from CSRP2__Homo_sapiens__NP_001287894
augcccguguggggcgggggcaacaagugcggggccugcggccgcaccgucuaccacgccgaggaggugcagugcgacgggcggagcuuccaccgcugcugcuuccugugcauggugugccggaagaaccucgacuccaccacggucgcgauccacgacgaggagaucuacugcaagagcugcuacggcaagaaguacggcccgaagggguacggcuacgggcagggcgccgggacccugaacauggaccgcggcgagcggcugggcaucaagcccgaguccgugcagccccaccgccccaccaccaacccgaacacgagcaaguucgcccagaaguacgggggcgccgagaagugcucccggugcggggacagcguguacgccgcggagaagaucaucggcgccggcaagcccuggcacaagaacugcuuccgcugcgccaagugcgggaagucccucgagagcaccacccugaccgagaaggagggcgagaucuacugcaaggggugcuacgccaagaacuucggccccaagggguucggcuacggccagggggcgggcgcccugguccacgcccaguga

SEQ ID NO: 28776 - RNA, 585 nt, Artificial Sequence
  derived and/or modified sequence opt1 from CSRP3__Homo_sapiens__NP_003467
augcccaacuggggcgggggcgccaagugcggggccugcgagaagaccguguaccacgcggaggagauccagugcaacggccgcagcuuccacaagaccugcuuccacugcauggccugccggaaggcccuggacuccacgaccguggccgcccacgagagcgagaucuacugcaaggugugcuacgggcgccgguacggcccgaagggcaucggguacggccagggggcgggcugccucuccaccgacaccggggagcaccugggccugcaguuccagcagagccccaagcccgcccgcuccgugacgaccagcaaccccuccaaguucaccgccaaguucggcgagagcgagaagugcccgcggugcgggaaguccgucuacgccgcggagaaggugaugggcgggggcaagcccuggcacaagaccugcuuccgcugcgccaucugcggcaagagccucgaguccacgaacgugaccgacaaggacggggagcuguacugcaaggucugcuacgccaagaacuucggccccaccgggaucggcuucgggggccugacccagcaggucgagaagaaggaguga

SEQ ID NO: 28777 - RNA, 426 nt, Artificial Sequence
  derived and/or modified sequence opt1 from CST1__Homo_sapiens__NP_001889
auggcccaguaccugagcacccuccugcugcuccuggccacccuggcgguggcccucgccuggucccccaaggaggaggaccgcaucaucccgggcgggaucuacaacgccgaccugaacgacgagugggugcagcgggcccugcacuucgcgaucagcgaguacaacaaggccacgaaggacgacuacuaccgccggccccuccgcgugcugcgggcccgccagcagaccgugggcggggucaacuacuucuucgacguggaggugggccggaccaucugcaccaagucccagcccaaccuggacacgugcgccuuccacgagcagcccgagcuccagaagaagcagcugugcagcuucgagaucuacgaggucccgugggagaaccgccggucccuggucaagagccgcugccaggaguccuga

SEQ ID NO: 28778 - RNA, 426 nt, Artificial Sequence
  derived and/or modified sequence opt1 from CST2__Homo_sapiens__NP_001313
auggccuggccccugugcacccuccugcugcuccuggccacccaggcgguggcccuggccuggagcccgcaggaggaggaccgcaucaucgagggcgggaucuacgacgccgaccucaacgacgagcggguccagcgcgcccugcacuucgugaucuccgaguacaacaaggcgaccgaggacgaguacuaccggcgccugcuccgggugcugcgcgcccgggagcagaucgucggcggggugaacuacuucuucgacaucgaggugggccgcaccaucugcaccaagagccagcccaaccuggacacgugcgccuuccacgagcagcccgagcuccagaagaagcagcugugcuccuuccagaucuacgagguccccugggaggaccggaugagccuggugaacucccgcugccaggaggccuga

SEQ ID NO: 28779 - RNA, 441 nt, Artificial Sequence
  derived and/or modified sequence opt1 from CST3__Homo_sapiens__NP_001275543
auggccggcccccugcgcgccccgcuccugcugcucgcgauccuggccguggcccuggccgucagccccgccgcgggguccagccccggcaagcccccgcggcucgucgggggccccauggacgccuccguggaggaggagggggugcgccgggcccuggacuucgccgugggcgaguacaacaaggcgagcaacgacauguaccacucccgcgcccuccaggugguccgggcccgcaagcagaucguggccggcgugaacuacuuccuggacgucgagcuggggcggacgaccugcaccaagacccagcccaaccuggacaacugccccuuccacgaccagccgcaccucaagcgcaaggccuucugcagcuuccagaucuacgcggugcccuggcagggcaccaugacccuguccaagagcacgugccaggacgccuga

SEQ ID NO: 28780 - RNA, 426 nt, Artificial Sequence
  derived and/or modified sequence opt1 from CST4__Homo_sapiens__NP_001890
auggcccgcccccugugcacccuccugcugcucauggccacccuggcgggcgcccuggccagcuccagcaaggaggagaaccggaucauccccgggggcaucuacgacgccgaccucaacgacgagugggugcagcgcgcccugcacuucgcgaucuccgaguacaacaaggccacggaggacgaguacuaccggcgcccgcugcagguccuccgggcccgcgagcagaccuucgggggcgugaacuacuucuucgacguggaggucgggcggaccaucugcaccaagagccagcccaaccuggacacgugcgccuuccacgagcagcccgagcugcagaagaagcagcucugcuccuucgagaucuacgaggugccgugggaggaccgcaugagccuggugaacucccggugccaggaggcguga

SEQ ID NO: 28781 - RNA, 429 nt, Artificial Sequence
  derived and/or modified sequence opt1 from CST5__Homo_sapiens__NP_001891
augauguggcccaugcacaccccgcugcuccugcugaccgcccucaugguggccgucgcgggcagcgccuccgcccagagccgcacgcuggccgggggcauccacgccaccgaccugaacgacaaguccgugcagugcgcgcucgacuucgccaucagcgaguacaacaaggugaucaacaaggacgaguacuacucccggccccugcaggucauggccgccuaccagcagaucgucgggggcgugaacuacuacuucaacgugaaguucgggcgcacgaccugcaccaagagccagcccaaccuggacaacugccccuucaacgaccagccgaagcucaaggaggaggaguucugcuccuuccagaucaacgaggugcccugggaggacaagaucagcauccugaacuacaagugccggaagguguga

SEQ ID NO: 28782 - RNA, 450 nt, Artificial Sequence
  derived and/or modified sequence opt1 from CST6__Homo_sapiens__NP_001314
auggcccgcagcaaccugccccucgcccugggccuggcgcucguggccuucugccugcuggcccucccgcgggacgcccgcgcccggccccaggagcgcauggucggggagcugcgggaccugucccccgacgacccccaggugcagaaggcggcccaggccgccguggcgagcuacaacaugggcuccaacagcaucuacuacuuccgcgacacccacaucaucaaggcccagucccagcucgucgccgggaucaaguacuuccugaccauggagaugggcagcacggacugccggaagacccgcgugaccggggaccacguggaccugaccacgugcccgcucgccgccggcgcgcagcaggagaagcugcggugcgacuucgagguccugguggugcccuggcagaacuccagccagcuccugaagcacaacugcguccagauguga

SEQ ID NO: 28783 - RNA, 438 nt, Artificial Sequence
  derived and/or modified sequence opt1 from CST7__Homo_sapiens__NP_003641
augcgcgccgccggcacccugcucgcguucugcugccuggugcugagcaccaccgggggccccuccccggacacgugcagccaggaccucaacucccgggucaagcccggguuccccaagaccaucaagaccaacgaccccggcgugcugcaggccgcccgcuacagcguggagaaguucaacaacugcacgaacgacauguuccuguucaaggagucccggaucacccgcgcccucguccagaucgugaaggggcugaaguacaugcuggagguggagaucggccggacgaccugcaagaagaaccagcaccuccgccuggacgacugcgacuuccagaccaaccacacccugaagcagacccucagcugcuacuccgaggucuggguggugccguggcugcagcacuucgagguccccgugcugcggugccacuga

SEQ ID NO: 28784 - RNA, 429 nt, Artificial Sequence
  derived and/or modified sequence opt1 from CST8__Homo_sapiens__NP_005483
augccccgcugccgguggcugagccucauccugcugaccaucccgcucgcccugguggcccgcaaggaccccaagaagaacgagaccggcguccugcggaagcucaagcccgugaacgcguccaacgccaacgugaagcagugccugugguucgccaugcaggaguacaacaaggagagcgaggacaaguacgucuuccugguggugaagacgcuccaggcccagcugcaggucaccaaccugcucgaguaccugaucgacguggagaucgcccgcuccgacugccggaagccccugagcaccaacgagaucugcgcgauccaggagaacuccaagcucaagcgcaagcugagcugcuccuuccuggugggggcccucccguggaacggcgaguucaccgucauggagaagaagugcgaggacgccuga

SEQ ID NO: 28785 - RNA, 480 nt, Artificial Sequence
  derived and/or modified sequence opt1 from CST9__Homo_sapiens__NP_001008693
augagcagcccccagcgccggaaggccaugccgugggcccugucccuccugcugaugggcuuccagcuccuggugaccuacgcguggugcuccgaggaggagaugggcgggaacaacaagaucguccaggaccccauguuccuggccaccguggaguucgcccucaacacguucaacgugcagagcaaggaggagcacgccuaccgccugcugcggguccucuccagcuggcgcgaggacuccauggaccggaaguggcgcgggaagaugguguucagcaugaaccugcagcugcggcagaccgugugccgcaaguucgaggacgacaucgacaacugccccuuccaggagucccucgagcugaacaacguccggcagggcaucagcuucccccaggugcacuccugcgggugcugcaugggcugcggcguggggaccggcgccgcggacaaggccaucccgcgcgacaaggggaaguga

SEQ ID NO: 28786 - RNA, 444 nt, Artificial Sequence
  derived and/or modified sequence opt1 from CST9L__Homo_sapiens__NP_542177
augcugggccuccccuggaagggcgggcugagcugggcccugcuccugcugcuccuggggucccagauccugcucaucuacgccuggcacuuccacgagcagcgcgacugcgacgagcacaacgugauggcgcgguaccugccggccaccgucgaguucgccgugcacaccuucaaccagcagagcaaggacuacuacgccuaccgccugggccacauccucaacuccuggaaggagcaggucgagagcaagacgguguucuccauggagcugcugcucgggcggacccgcugcggcaaguucgaggacgacaucgacaacugccacuuccaggagagcaccgagcugaacaacaccuucacgugcuucuucaccaucuccacccggcccuggaugacccaguucagccugcucaacaagacgugccuggagggcuuccacuga

SEQ ID NO: 28787 - RNA, 297 nt, Artificial Sequence
  derived and/or modified sequence opt1 from CSTA__Homo_sapiens__NP_005204
augauccccggcgggcugagcgaggccaagccggccacccccgagauccaggagaucguggacaaggucaagccccagcucgaggagaagaccaacgagacguacggcaagcuggaggcggugcaguacaagacccagguggucgccgggaccaacuacuacaucaaggugcgcgccggcgacaacaaguacaugcaccugaagguguucaagucccuccccgggcagaacgaggaccugguccugaccggcuaccagguggacaagaacaaggacgacgagcucacgggcuucuga

SEQ ID NO: 28788 - RNA, 297 nt, Artificial Sequence
  derived and/or modified sequence opt1 from CSTB__Homo_sapiens__NP_000091
augaugugcggcgcccccagcgccacccagccggcgaccgccgagacgcagcacaucgccgaccaggugcgcucccagcuggaggagaaggagaacaagaaguuccccgucuucaaggccgugagcuucaagucccagguggucgccgggaccaacuacuucaucaaggugcacgugggcgacgaggacuucguccaccuccggguguuccagagccugccccacgagaacaagccccugacccucuccaacuaccagaccaacaaggcgaagcacgacgagcugacguacuucuga

SEQ ID NO: 28789 - RNA, 1296 nt, Artificial Sequence
  derived and/or modified sequence opt1 from CSTF1__Homo_sapiens__NP_001315
auguaccgcaccaaggugggccugaaggaccggcagcagcucuacaagcugaucaucagccagcugcucuacgacggguacaucuccaucgccaacggccugaucaacgagaucaagccccagagcgucugcgccccguccgagcagcugcuccaccugaucaagcuggggauggagaacgacgacaccgcggugcaguacgccaucggccgcagcgacacgguggcccccgggaccggcaucgaccucgaguucgacgccgacguccagaccaugucccccgaggccagcgaguacgagaccugcuacgugacgucccacaagggccccugccggguggcgaccuacagccgcgacgggcagcugaucgccaccggcuccgccgacgccagcaucaagauccuggacaccgagcggaugcucgcgaaguccgccaugccgaucgaggucaugaugaacgagacggcccagcagaacauggagaaccaccccgugauccgcacccuguacgaccacguggacgaggugaccugccuggccuuccaccccaccgagcagauccucgccagcgggucccgggacuacacgcugaagcuguucgacuacagcaagcccuccgcgaagcgcgccuucaaguacauccaggaggccgagaugcuccggagcaucuccuuccacccgagcggcgacuucauccuggucgggacccagcaccccacccugcgccucuacgacaucaacaccuuccagugcuucguguccugcaacccccaggaccagcacacggacgccaucugcagcgucaacuacaacagcuccgccaacauguacgugaccggcagcaaggacggcugcaucaagcugugggacgggguguccaaccggugcaucaccaccuucgagaaggcgcacgacggcgccgaggucugcagcgccaucuucuccaagaacagcaaguacauccuguccagcgggaaggacuccguggccaagcucugggagaucagcacgggccgcacccuggugcgguacaccggcgccgggcuguccggccgccagguccaccggacccaggcgguguucaaccacacggaggacuacgugcuccugcccgacgagcgcaccaucagccugugcugcugggacucccggaccgccgagcgccggaaccuccugagccuggggcacaacaacaucguccgcugcaucgugcacuccccgaccaaccccggcuucaugacgugcagcgacgacuuccgggcccgcuucugguaccgccgguccaccaccgacuga

SEQ ID NO: 28790 - RNA, 1734 nt, Artificial Sequence
  derived and/or modified sequence opt1 from CSTF2__Homo_sapiens__NP_001316
auggccggccugaccgugcgcgaccccgccgucgaccggagccuccgcuccguguucguggggaacaucccguacgaggcgaccgaggagcagcugaaggacaucuucagcgaggucggccccgugguguccuuccggcuggucuacgaccgcgagacggggaagcccaagggcuacggguucugcgaguaccaggaccaggagaccgcccucagcgccaugcggaaccugaacggccgcgaguucuccggccgggcccugcgcguggacaacgccgcgagcgagaagaacaaggaggagcucaagucccuggggaccggcgcccccgugaucgagagcccguacggggagaccaucucccccgaggacgcccccgagagcaucuccaaggccgucgcgagccugcccccggagcagauguucgagcucaugaagcagaugaagcugugcgugcagaacagcccccaggaggcccggaacaugcugcuccagaacccccagcuggccuacgcccugcuccaggcccagguggucaugcgcaucguggaccccgagaucgcgcugaagauccugcaccggcagacgaacaucccgacccucaucgccggcaacccccagcccgugcacggggccggccccggcuccggguccaacgugagcaugaaccagcagaacccgcaggcgccccaggcccagucccugggcgggaugcacgugaacggcgccccgccccugaugcaggccagcaugcagggcggggugcccgcccccggccagaugcccgccgccgucaccgggcccggcccggggucccucgcgcccggcggcgggaugcaggcccaggugggcaugcccgggagcggccccgugagcauggagcgcgggcaggucccgaugcaggacccccgggccgccaugcagcgcggcucccugcccgccaacgugccgacgccccggggccugcucggggacgcgcccaacgacccccgcggcgggacccugcugagcgugaccggcgaggucgagccgcggggguaccucggcccgccccaccagggcccgcccaugcaccacgugcccgggcacgagucccgcgggcccccgccccacgagcugcgcggcggcccccugcccgagccccggccccucauggccgagccccggggccccaugcuggaccagcgcgggcccccgcuggacggccgcgggggccgggacccccgcgggaucgacgcccggggcauggaggcccgcgcgauggaggcccggggccucgacgcccgcgggcuggaggcccgggccauggaggcgcgcgccauggaggcccgggccauggaggcccgcgcgauggaggcccgggccauggagguccgcggcauggaggcccgggggauggacacccgcggccccgugcccgggccgcggggccccauccccagcggcaugcaggggccgucccccaucaacaugggcgccguggucccccaggggagccgccaggugcccgugaugcagggcaccgggaugcagggcgcguccauccagggcgggagccagccgggcggguucucccccggccagaaccaggucacgccccaggaccacgagaaggccgcccugaucaugcagguccuccagcugaccgccgaccagaucgcgaugcugcccccggagcagcggcagagcauccucauccugaaggagcagauccagaaguccaccggggcccccuga

SEQ ID NO: 28791 - RNA, 1851 nt, Artificial Sequence
  derived and/or modified sequence opt1 from CSTF2T__Homo_sapiens__NP_056050
augagcucccuggccgugcgcgaccccgccauggaccggagccuccgcuccgucuucgugggcaacaucccguacgaggcgaccgaggagcagcugaaggacaucuucagcgaggugggguccgucgugagcuuccggcugguguacgaccgcgagaccggcaagcccaagggguacggcuucugcgaguaccaggaccaggagacggcccucuccgccaugcggaaccugaacgggcgcgaguucagcggccgggcccugcgcgucgacaacgccgcguccgagaagaacaaggaggagcucaagagccugggccccgccgcccccaucaucgacuccccguacggggaccccaucgaccccgaggacgcccccgagagcaucacccgggcgguggccucccugccgcccgagcagauguucgagcucaugaagcagaugaagcugugcgugcagaacagccaccaggaggcccgcaacaugcugcuccagaacccccagcuggccuacgcccugcuccaggcgcaggucgugaugcggaucauggaccccgagaucgcccugaagauccugcaccgcaagauccacgugaccccgcucauccccggcaagucccagagcgucuccgugagcgggcccggccccgggccgggccccggccugugccccgggcccaacgugcugcucaaccagcagaacccgcccgccccccagccccagcaccuggcccggcgcccggucaaggacauccccccccugaugcagacccccauccagggcgggaucccggcccccggccccaucccggcggccgugcccggcgccgggcccggcucccucacgcccgggggcgccaugcagccgcagcuggggaugcccggcgugggccccgucccccuggagcgggggcaggugcagaugagcgacccgcgcgcccccaucccccggggccccgugaccccggggggccuccccccccgcgggcugcugggcgacgcgcccaacgacccgcggggcgggacccuccugagcgucaccggcgagguggagccccgcggguaccugggccccccccaccaggggccgcccaugcaccacgccuccggccacgacacgcggggccccagcucccacgagaugcgcgggggcccccucggggacccgcgccugcugaucggcgagccccggggccccaugaucgaccagcgcgggcucccgauggacggccgggggggccgcgacagccgggccauggagacccgcgccauggagaccgaggugcuggagacccgggucauggagcgccgggggauggagacgugcgccauggagacccgcggcauggaggcgcggggcauggacgcccgcgggcuggagaugcggggccccgugcccuccagccgcgggcccaugaccggcgggauccagggcccgggccccaucaacaucggggccggcgggcccccccagggcccgcggcagguccccgggaucuccggcgugggcaaccccggggccggcaugcaggggaccggcauccaggggacgggcaugcagggcgcggggauccagggcgggggcaugcagggcgccgggauccagggcgugagcauccaggggggcgggauccagggcggcgggauccagggcgccuccaagcaggggggcagccagcccuccagcuucuccccggggcagagccaggucaccccccaggaccaggagaaggccgcccucaucaugcaggugcugcagcugaccgcggaccagaucgccaugcucccccccgagcagcgccaguccauccugauccugaaggagcagauccagaagagcaccggcgccuccuga

SEQ ID NO: 28792 - RNA, 438 nt, Artificial Sequence
  derived and/or modified sequence opt1 from CSTL1__Homo_sapiens__NP_612140
augggcaucgggugcuggcgcaacccccugcuccugcugaucgcccucgugcugagcgccaagcugggccacuuccagcggugggagggguuccagcagaagcucauguccaagaagaacaugaacagcacccugaacuucuucauccaguccuacaacaacgcgagcaacgacaccuaccuguaccgcguccagcggcucauccgcucccagaugcagcugacgaccggcguggaguacaucgugaccgucaagaucggguggaccaagugcaagcggaacgacacgagcaacuccagcugcccgcugcaguccaagaagcuccgcaagagccugaucugcgagucccugaucuacaccaugcccuggaucaacuacuuccagcucuggaacaacagcugccuggaggccgagcacgugggccggaaccugcgcuga

SEQ ID NO: 28793 - RNA, 570 nt, Artificial Sequence
  derived and/or modified sequence opt1 from CT45A1__Homo_sapiens__NP_001017417
augaccgacaagaccgagaagguggccgucgaccccgagacgguguucaagcgcccgcgggagugcgacagccccuccuaccagaagcgccagcggauggcccugcucgcgcgcaagcagggcgccggggacagccugaucgccggcuccgccaugagcaaggccaagaagcugaugaccgggcacgcgaucccgcccucccagcucgacagccagaucgacgacuucaccggcuucuccaaggaccggaugaugcagaagcccgggagcaacgcccccgugggcggcaacgucaccuccagcuucuccggggacgaccuggagugccgcgagacggccagcucccccaagagccagcgggagaucaacgccgacaucaagcgcaagcuggugaaggagcuccggugcgugggccagaaguacgagaagaucuucgagaugcuggaggggguccagggccccaccgcggugcgcaagcgguucuucgaguccaucaucaaggaggccgcccgcugcaugcggcgcgacuucgugaagcaccugaagaagaagcucaagcggaugaucuga

SEQ ID NO: 28794 - RNA, 795 nt, Artificial Sequence
  derived and/or modified sequence opt1 from CT55__Homo_sapiens__NP_001026875
augcugcgccuccugcggcuggcccucgccuucuacggccgcaccgcggaccccgccgagcggcaggggccgcagcagcagggccugccccagggggacacccagcugacgaccgugcagggcgucgugaccagcuucugcggggacuacggcaugaucgacgaguccaucuacuucagcuccgacguggucaccggcaacgugccccucaagguggggcagaaggucaacgugguggucgaggaggacaagccccacuacggccugcgcgccaucaagguggacguggucccgcggcaccuguacggggccggccccagcgacuccgggacgcgcgugcucaucggcugcgugaccagcaucaacgaggacaacaucuacaucuccaacagcaucuacuucuccaucgccaucgucagcgaggacuucgugcccuacaagggcgaccugcuggagguggaguacuccaccgagcccgggaucagcaacaucaaggcgaccuccgucaagccgauccggugcauccacacggaggaggugugcaucaccagcgugcacggccgcaacggggucaucgacuacaccaucuucuucacccucgacuccgugaagcugcccgacggcuacgugccccaggucgacgacaucgugaacgucgugaugguggagagcauccaguucugcuucaucuggcgggccaucuccaucacgcccguccacaagagcuccagcggcuuccaggacgacgggggccuggggcgcccgaagcgggagcgccggagccaguccaucuga

SEQ ID NO: 28795 - RNA, 342 nt, Artificial Sequence
  derived and/or modified sequence opt1 from CT83__Homo_sapiens__NP_001017978
augaacuucuaccugcuccuggccagcuccauccugugcgcccucaucguguucuggaaguaccgccgguuccagcgcaacaccggcgagaugagcuccaacagcaccgcgcuggcccugguccggcccuccagcuccgggcucaucaacagcaacacggacaacaaccuggccguguacgaccugucccgcgacauccucaacaacuucccgcacagcaucgcccggcagaagcgcauccuggugaaccuguccauggucgagaacaagcucguggagcuggagcacacccugcucagcaagggcuuccgcggggccagcccccaccggaaguccaccuga

SEQ ID NO: 28796 - RNA, 543 nt, Artificial Sequence
  derived and/or modified sequence opt1 from CTAG1A__Homo_sapiens__NP_640343
augcaggccgagggccgcgggaccggcgggagcaccggcgacgccgacgggcccggcggcccggggauccccgacggccccgggggcaacgccgggggccccggcgaggccggggccacgggcgggcggggcccgcgcggcgccggggccgcgcgggccuccggccccgggggcggggcgccccgcggcccccacggcggggccgcgagcggccugaacgggugcugccggugcggcgcccgcgggccggagucccggcuccuggaguucuaccuggccaugcccuucgccacccccauggaggccgagcucgcgcgccggagccuggcccaggacgcgcccccgcugcccgugcccggcguccuccugaaggaguucaccguguccggcaacauccugaccauccgccucacggccgccgaccaccggcagcugcagcugagcaucuccagcugccuccagcagcugucccugcucauguggaucacccagugcuuccugcccguguuccuggcccagccgcccagcgggcagcgccgguga

SEQ ID NO: 28797 - RNA, 633 nt, Artificial Sequence
  derived and/or modified sequence opt1 from CTAG2__Homo_sapiens__NP_066274
augcaggccgagggccgcgggaccggcgggagcaccggcgacgccgacgggcccggcggccccgggauccccgacggccccgggggcaacgccgggggccccggcgaggccggggccacgggcgggcggggcccgcgcggcgccggggccgcccgggccuccggcccccgcgggggcgcgccccgggggccccacggcggcgccgcgagcgcccaggacgggcgcugcccgugcggcgcccggcgccccgacucccggcugcucgagcugcacaucaccaugcccuucagcucccccauggaggccgagcuggugcgccggauccucagccgcgacgccgcgccgcugccccggcccggggccguccugaaggacuucaccguguccggcaaccuccuguucaugagcgugcgcgaccaggaccgggagggggccggccgcaugcgggucgugggcugggggcugggcuccgccagccccgaggggcagaaggcccgcgaccuccggaccccgaagcacaagguguccgagcagcgccccggcacgcccgggcccccgccgcccgagggcgcgcagggcgacgggugccggggcgucgccuucaacgugauguucagcgcgccccacaucuga

SEQ ID NO: 28798 - RNA, 2238 nt, Artificial Sequence
  derived and/or modified sequence opt1 from CTAGE1__Homo_sapiens__NP_758441
augcgccccgacucccaccccuacggcuuccccugggagcuggugauccgggccgccgucgcgggguucuucgccgugcuguuccuguggcgcuccuuccggagcgugaccucccgccuguacguccggcgcgagaagaaguucgccguggcccucagcggccugaucgaggagaagugcaagcugcucgagaaguucucccuggugcagaaggaguacgagggguacgaggucgagagcucccugaagaacgccagcuucgagaaggaggcgaccgaggcccagucccucgaggccacgugcgagaagcugaaccgguucaacagcgagcuggugcacgagauccucugccuggagaaggagcugaaggaggagaaguccaagcacagcgagcagaacgagcucauggccgacaucuccaagcgcauccagagccuggaggacgaguccaagagccugaagucccagguggcggaggccaagaugaccuucaagcgguuccaggccaacgaggagcgccucgagaucgagauccaggacgccuggaaggagaacagcgagcugcaggagucccagaagcagcugcuccaggaggccgaggucuggaaggagcaggucagcgagcugaucaagcagaagcggaccuucgaggacagcaaggugcacgcggagcagguccugaacgacaaggagaaccacaucaagacccucacggagcgccugcugaagaugaaggacggcguggccaugcucgaggaggacgugaccgacgacgacaaccucgagcuggagaugaacuccgagagcgaggacggggccuaccucgacaacccgcccaagggcgcccugaagaagcugauccacgccgcgaagcucaacgccucccugaagacccuggagggcgagcggaaccagaucuacauccagcucagcgagguggacaagaccaaggaggagcugacggagcacaucaagaaccugcagaccgagcaggccucccuccagagcgagaacacccacuucgaguccgagaaccagaagcugcagcagaagcugaaggugaugaccgagcucuaccaggagaacgagaugaagcuguaccgcaagcugaucguggaggagaagugccggcucgagaaggaggagaagcugagcaaggucgacgagaugaucucccacgccacggaggagcuggagaccuaccgcaagcgggccaaggaccucaaggaguucgagaagaccauccacuucuaccagaagaagaucauccugcacgagaagaaggcgcacgacaacuggagcgccgccuggaccgccgagcgcaaccugaacgaccugcggaaggagaacgcccacaaccgccagaagcucacggagaucgaguucaagaucaagcugcuggagaaggaccccuacgggcucgacgugcccaacaccgcguucggccggcagcacucccccuacgggcccagcccccugggcuggcccuccagcgagacccgcgccucccuguacccgcccacccuccuggaggggccccugcgccucagcccccugcugccccggggcggcgggcgcggcucccgggggcccggcaacccgcccgaccaccagaucacgaaggagcgcggcgagagcuccugcgaccggcucaccgacccccaccgcgcccccagcgacgccgggccgcuggcgccgcccugggagcaggacuaccggaugauguucccgccgcccggccagagcuaccccgacuccgcccugccgccccagcgccaggaccgguucuacagcaacugcgcccgccucuccgggcccgccgagcugcggagcuucaacaugcccucccuggacaagauggacggcagcaugcccuccgagauggagagcucccgcaacgacaccaaggacaaccucgggaaccugaaggugcccgacagcucccugcccgccgagaacgaggcgaccggccccggcuucgugcccccgccccucgcccccauccgggggcugcuguuccccgucgacacgcgcggccccuucauccggcgcgggccgcccuucccgcccccgccgcccggcaccguguucggggccagccccgacuacuucagcccccgggacguccccggcccgccccgcgcccccuucgccaugcggaacguguaccucccccgcggcuuccugcccuaccgcccgccccggcccgcguucuucccgcccgcccccaccuucuga

SEQ ID NO: 28799 - RNA, 2430 nt, Artificial Sequence
  derived and/or modified sequence opt1 from CTAGE5__Homo_sapiens__NP_001234918
auggaggagcccggcgugaccccgcagcccuaccuggggcuccugcuggaggagcuccgccgggucguggccgcccugcccgagggcaugcgccccgacagcaaccuguacggguucccgugggagcucgugaucugcgcggccgucgugggcuucuucgccgugcuguucuuccuguggcgguccuuccgcagcguccggucccgccucuacguggggcgggagaagaagcuggcccugaugcucagcggccugaucgaggagaaguccaagcugcucgagaaguucagccuggugcagaaggaguacgagggcuacgaggucgaguccagccugaaggacgccuccuucgagaaggaggcgaccgaggcccagagccucgagguggagaaccagauggccacgugcgagaagcugaaccgcuccaacagcgagcuggaggacgagauccucugccuggagaaggagcugaaggaggagaaguccaagcacagcgagcaggacgagcucauggccgacaucuccaagcggauccagagccuggaggacgaguccaagagccugaagucccagguggcggaggccaagaugaccuucaagaucuuccagaugaacgaggagcgccucaagaucgccaucaaggacgcccugaacgagaacagccagcugcaggagagccagaagcagcuccugcaggaggccgaggucuggaaggagcagguguccgagcugaacaagcagaaggugaccuucgaggacagcaagguccacgcggagcaggugcucaacgacaaggagucccacaucaagacccugacggagcggcugcucaagaugaaggacugggccgccaugcugggggaggacaucaccgacgacgacaaccuggagcucgagaugaacagcgaguccgagaacggcgccuaccuggacaacccccccaagggggcccugaagaagcucauccacgcggccaagcugaacgccagccugaagacccucgagggcgagcgcaaccagaucuacauccagcuguccgagguggacaagaccaaggaggagcugacggagcacaucaagaaccuccagaccgagcaggccagccugcaguccgagaacacccacuucgagaacgagaaccagaagcugcagcagaagcugaaggucaugaccgagcucuaccaggagaacgagaugaagcugcaccggaagcugacgguggaggagaacuaccgccucgagaaggaggagaagcugagcaagguggacgagaagaucucccacgccaccgaggagcuggagaccuaccggaagcgcgcgaaggaccucgaggaggagcuggagcggaccauccacagcuaccaggggcagaucaucucccacgagaagaaggcccacgacaacuggcuggccgcccgcaacgccgagcggaaccucaacgaccugcgcaaggagaacgcgcacaaccggcagaagcugacggagaccgagcucaaguucgagcugcuggagaaggaccccuacgcccucgacgucccgaacaccgccuucggccgcgagcacagccccuacggccccuccccccugggguggccgagcuccgagacccgcgccuuccugagcccccccacgcuccuggagggcccccugcggcucuccccgcugcugcccgggggcggcgggcgcggcagccgggggcccggcaacccccucgaccaccagaucaccaacgagcgcggggagagcuccugcgaccggcugaccgacccgcaccgcgcgcccagcgacaccggcucccugagcccccccugggaccaggaccggcgcaugauguucccgccccccggccaguccuaccccgacagcgcccucccgccccagcggcaggaccgcuucugcuccaacagcgggcggcuguccggccccgccgagcugcgcagcuucaacaugccgucccucgacaagauggacgggagcaugcccuccgagauggagagcucccggaacgacacgaaggacgaccugggcaaccugaacgugcccgacagcucccuccccgccgagaacgaggccaccgggccgggcuucgugccccccccccuggcgccgauccgcggcccccuguuccccgucgacgcccgggggcccuuccuccgccggggcccgcccuucccccccccgccccccggggccauguucggcgccagccgcgacuacuuccccccgggggacuuccccggcccccccccggcccccuucgcgaugcggaacguguaccccccgcgcggcuucccccccuaccugcccccgcgccccggguucuucccccccccgccccacagcgagggccgguccgaguuccccagcgggcugauccccccguccaacgagcccgccaccgagcaccccgagccccagcaggagaccuga

SEQ ID NO: 28800 - RNA, 1290 nt, Artificial Sequence
  derived and/or modified sequence opt1 from CTBP1__Homo_sapiens__NP_001012632
augagcggcgugcggcccccgaucaugaacgggccccugcacccccgcccccucgucgcccugcuggacggccgcgacugcaccguggagaugccgauccucaaggacguggccaccgucgcguucugcgacgcccaguccacgcaggagauccacgagaaggugcugaacgaggccgugggggcccugauguaccacaccaucacccucacccgggaggaccuggagaaguucaaggcccugcgcaucaucguccggaucggcagcggguucgacaacaucgacaucaaguccgcgggcgaccucggcaucgccgugugcaacgugcccgccgccagcgucgaggagacggcggacuccacccugugccacauccugaaccucuaccgccgggccaccuggcugcaccaggcccugcgcgaggggacccgggugcagagcguggagcagauccgcgaggucgccuccggcgccgcgcggauccgcggggagacgcucggcaucaucgggcugggccgggugggccaggccguggcccugcgcgccaaggccuucggguucaacguccucuucuacgaccccuaccugagcgacggcguggagcgggcgcuggggcuccagcgcguguccacccugcaggaccuccucuuccacagcgacugcgucacccugcacugcggccugaacgagcacaaccaccaccucaucaacgacuucaccgugaagcagaugcggcagggcgccuuccuggugaacacggcccgcgggggccuggucgacgagaaggcccucgcccaggcgcugaaggaggggcggauccgcggcgccgcccuggacgugcacgaguccgagcccuucagcuucucccaggggccgcucaaggacgcccccaaccugaucugcacgccccacgccgcgugguacagcgagcaggccuccaucgagaugcgggaggaggccgcccgcgagauccgccgggcgaucaccggccgcauccccgacagccugaagaacugcgugaacaaggaccaccucaccgccgccacccacugggccuccauggacccggccgucgugcaccccgagcugaacggcgcggccuaccgguacccgcccggggucgugggcguggcccccaccgggauccccgccgccgucgagggcaucgugcccagcgcgaugucccugagccacgggcugcccccgguggcccacccgccccacgcccccagccccggccagaccgucaagcccgaggccgaccgcgaccacgccuccgaccagcuguga

SEQ ID NO: 28801 - RNA, 1338 nt, Artificial Sequence
  derived and/or modified sequence opt1 from CTBP2__Homo_sapiens__NP_001277143
auggcccugguggacaagcacaaggucaagcgccagcggcucgaccgcaucugcgagggcauccggccccagaucaugaacgggccgcugcacccccgcccccugguggcccuccuggacggccgggacugcaccguggagaugcccauccugaaggaccucgcgaccgucgccuucugcgacgcccagagcacgcaggagauccacgagaaggugcugaacgaggccgugggggccaugauguaccacaccaucacccugacccgcgaggaccucgagaaguucaaggcgcugcgggucaucgugcgcaucggcuccggguacgacaacguggacaucaaggccgccggcgagcugggcaucgccgucugcaacaucccgagcgcggccguggaggagacggccgacuccaccaucugccacauccucaaccuguaccggcgcaacaccuggcuguaccaggcccuccgggaggggacccgcgugcagagcgucgagcagauccgggagguggccuccggcgcggcccgcauccgcggggagacgcugggccugaucggguucggccggaccggccaggccguggccguccgggccaaggcguucggguucagcgugaucuucuacgaccccuaccuccaggacggcaucgagcgcucccugggggugcagcgggucuacacccugcaggaccuccuguaccagagcgacugcgugucccugcacugcaaccucaacgagcacaaccaccaccugaucaacgacuucaccaucaagcagaugcgccagggcgccuuccuggugaacgccgcccggggcgggcucgucgacgagaaggcccuggcgcaggcccugaaggagggccgcauccgcggggccgcccucgacgugcacgagagcgagcccuucuccuucgcccagggcccccugaaggacgcgccgaaccugaucugcacgccccacaccgccugguacagcgagcaggccucccucgagaugcgggaggccgcggccaccgagauccgccgggccaucaccgggcgcauccccgagagccugcggaacugcgugaacaaggaguucuucgucacguccgcccccuggagcgugaucgaccagcaggccauccacccggagcugaacggcgcgaccuaccgcuacccgcccggcaucgucgggguggcccccggcgggcuccccgccgccauggagggcaucauccccgggggcauccccgugacccacaaccugcccaccgucgcccacccgucccaggcgcccagccccaaccagcccacgaagcacggcgacaaccgggagcacccgaacgagcaguga

SEQ ID NO: 28802 - RNA, 3654 nt, Artificial Sequence
  derived and/or modified sequence opt1 from CTC1__Homo_sapiens__NP_079375
auggccgccggccgcgcccaggugcccagcuccgagcaggcguggcuggaggacgcccaggucuucauccagaagacccucugcccggccgugaaggagcccaacgugcagcugacgccccuggucaucgacugcgugaagaccguguggcucagccaggggcggaaccagggcuccacccugccccugagcuacuccuucgucagcgugcaggaccucaagacccaccagcgccugccgugcugcucccaccugagcugguccagcuccgccuaccaggcgugggcccaggaggccgggcccaacggcaacccccucccccgggagcagcugcugcuccuggggacccugacggaccucagcgccgaccuggagcaggagugccgcaacggcucccuguacgugcgggacaacaccggcguccucagcugcgagcugaucgaccuggaccucuccuggcuggggcaccuguuccucuucccgcgcuggagcuaccugccgcccgcgcgguggaacuccagcggcgaggggcaccuggagcucugggacgcccccgugcccguguucccccugaccaucucccccggccccgucaccccgauccccgugcuguaccccgagagcgccagcugccuccugcgccugcggaacaagcuccgcggggugcagcggaaccuggccggcucccugguccgccucagcgcccuggugaaguccaagcagaaggcguacuucauccugagccucggccggucccaccccgccgugacgcacgucagcaucaucguccaggugccggcccagcuggucuggcaccgcgcccugcggcccgggaccgccuacgugcucaccgagcugcgcguguccaagauccggggccagcgccagcacgucuggaugaccagccaguccagccggcugcuccugcugaagcccgagugcgugcaggagcucgagcuggagcuggaggggccccugcucgaggcggacccgaagccccugcccaugcccuccaacagcgaggacaagaaggacccggagucccugguccgcuacagccggcuccuguccuacagcggcgccgugacgggcgugcugaacgagcccgccgggcucuacgagcuggacggccagcuggggcucugccuggccuaccagcaguuccgcggccugcgccgggucaugcgccccggggugugccuccagcugcaggacgugcaccuccugcaguccgucggcggcgggacccggcgcccggugcuggcccccugccugcggggcgcggugcuccugcagagcuucucccgccagaagcccggggcccacagcagccggcaggccuacggcgccucccuguacgagcagcucgucugggagcgccagcuggggcugccccucuaccugugggccaccaaggcgcuggaggagcucgccugcaagcugugcccgcacgugcugcggcaccaccaguuccuccagcacagcucccccggcagccccucccugggccugcagcuccuggcccccacccuggaccuccuggccccgcccgggagccccgugcgcaacgcgcacaacgagauccuggaggagccccaccacugcccgcuccagaaguacacgcggcugcagacccccuccagcuuccccacccuggccacccucaaggaggagggccagcgcaaggccugggccuccuucgaccccaaggcccugcugccgcuccccgaggcgagcuaccugcccuccugccagcugaaccggcgccucgccuggagcuggcugugccugcuccccuccgccuucugcccggcccagguccugcugggggugcucguggccagcucccacaagggcugccugcagcugcgggaccagagcgggucccuccccugccugcugcucgcgaagcacagccagccccugagcgacccccgccugaucggcugccucguccgggccgagcgcuuccagcugaucguggagcgggacgugcgcuccagcuucccguccuggaaggagcugagcaugcccggcuucauccagaagcagcaggcccgcgucuacgugcaguucuuccucgccgacgcccugauccugcccgugccgcggcccugccuccacuccgcgacgcccagcacgccccagaccgacccgaccgggcccgagggcccccaccuggggcagucccgccuguuccuccugugccacaaggaggcccugaugaagcggaacuucugcgugcccccgggcgccagccccgaggugcccaagcccgcccucuccuucuacgugcugggcagcuggcucgggggcacccagcgcaaggaggggaccggcugggggcugccggagccccagggcaacgacgacaacgaccagaagguccaccugaucuucuucggcuccagcgugcggugguucgaguuccugcaccccggccagguguaccgccucaucgcgcccgggccggccacccccaugcuguucgagaaggacggguccagcugcaucucccggcgcccccuggagcucgccggcugcgccagcugccugaccguccaggacaacuggacgcuggagcucgaguccagccaggacauccaggacgugcuggacgccaacaagucccugcccgagagcagccucaccgaccugcuguccgacaacuucaccgacagccucguguccuucagcgcggagauccugucccggacccugugcgagccgcuggucgccagccucuggaugaagcuggggaacacgggcgccaugcgccggugcgugaagcugaccguggcccucgagaccgccgagugcgaguucccgccccaccuggacgucuacaucgaggacccccaccucccgcccucccugggccugcugcccggggcgcgcgugcacuucagccagcucgagaagcgggugucccgcagccacaacgucuacugcugcuuccgguccagcaccuacguccaggugcuguccuucccgcccgagacgaccaucagcaucccccugccccacaucuaccucgccgagcugcugcagggcgggcagucccccuuccaggccaccgccagcugccacaucguguccguguucagccuccagcuguucugggugugcgccuacugcaccuccaucugccgccagggcaagugcacccggcuggggagcacgugccccacccagaccgcgaucagccaggccaucauccgccuccuggucgaggacggcaccgccgaggccguggugacgugccggaaccaccacgucgcggccgcccugggccucugcccccgcgagugggccucccugcuggacuucguccaggugcccgggcggguggugcuccaguucgccggcccgggggcgcagcuggagagcuccgcccgcguggacgagcccaugaccauguuccuguggacccucugcaccagccccuccguccugcgccccaucgugcugagcuucgagcucgagcggaagccguccaagaucgucccccuggagccgccccgccugcagcgguuccagugcggcgagcuccccuuccugacgcacgugaacccccgccugcggcucagcugccuguccauccgcgagagcgaguacuccagcucccuggggauccucgccagcuccugcuga

SEQ ID NO: 28803 - RNA, 1200 nt, Artificial Sequence
  derived and/or modified sequence opt1 from CTCF__Homo_sapiens__NP_001177951
auggccuucgugaccagcggcgagcugguccgccaccggcgcuacaagcacacccacgagaagcccuucaagugcuccaugugcgacuacgccagcguggagguguccaagcucaagcggcacauccgcagccacacgggggagcggccguuccagugcucccugugcagcuacgcgucccgcgacaccuacaagcugaagcggcacaugcgcacccacagcggcgagaagcccuacgagugcuacaucugccacgcccgguucacccaguccgggacgaugaagaugcacauccuccagaagcacaccgagaacgucgccaaguuccacugcccccacugcgacaccgugaucgcccgcaagagcgaccugggcgugcaccuccggaagcagcacuccuacaucgagcaggggaagaagugccgcuacugcgacgccgucuuccacgagcgguacgcgcugauccagcaccagaagucccacaagaacgagaagcgcuucaagugcgaccagugcgacuacgccugccggcaggagcgccacaugaucaugcacaagcggacccacacgggcgagaagcccuacgccugcagccacugcgacaagaccuuccgccagaagcagcugcuggacaugcacuucaagcgguaccacgacccgaacuucgugcccgccgcguucgugugcagcaagugcggcaagaccuucacccgccggaacacgauggcccgccacgccgacaacugcgccgggcccgacggcgucgagggggagaacggcggggagaccaagaaguccaagcgcggccggaagcgcaagaugcggagcaagaaggaggacuccagcgacuccgagaacgccgagcccgaccucgacgacaacgaggacgaggaggagccggcgguggagaucgagcccgagcccgagccccagccggugacccccgccccgccgcccgccaagaagcgccggggccgcccgcccgggcggaccaaccagcccaagcagaaccagcccacggccaucauccaggucgaggaccagaacaccggcgccaucgagaacaucaucguggaggugaagaaggagcccgacgcggagcccgccgagggggaggaggaggaggcccagcccgccgccaccgacgcgcccaacggcgaccugacccccgagaugauccugagcaugauggaccgcuga

SEQ ID NO: 28804 - RNA, 1992 nt, Artificial Sequence
  derived and/or modified sequence opt1 from CTCFL__Homo_sapiens__NP_001255970
auggccgccaccgagaucagcgugcuguccgagcaguucaccaagaucaaggagcucgagcugaugcccgagaagggccugaaggaggaggagaaggacggggucugccgcgagaaggaccaccggagcccguccgagcucgaggcggagcgcacgagcggcgccuuccaggacuccgugcuggaggaggagguggagcugguccucgcccccagcgaggaguccgagaaguacauccugacccugcagaccgugcacuucaccagcgaggccguggagcuccaggacaugucccugcugagcauccagcagcaggaggggguccagguggugguccagcagcccggccccgggcuccuguggcuggaggagggcccgcggcagucccuccagcagugcguggccaucagcauccagcaggagcuguacagcccccaggagauggaggugcugcaguuccacgcgcucgaggagaacgucaugguggccuccgaggacuccaagcuggccgugagccuggccgagacgaccggccucaucaagcuggaggaggagcaggagaagaaccagcugcucgcggagcgcaccaaggagcagcuguucuucgucgagaccauguccggggacgagcggagcgacgagaucgugcugacgguguccaacagcaacgucgaggagcaggaggaccagcccaccgccggccaggccgacgccgagaaggccaagagcaccaagaaccagcgcaagaccaagggggcgaagggcacguuccacugcgacgugugcauguucaccuccagccggauguccagcuucaaccgccacaugaagacccacaccuccgagaagccccaccucugccaccugugccugaagacguuccggaccgugacccuccugcgcaaccacgucaacacccacacggggacccggccguacaagugcaacgacugcaacauggccuucgugaccagcggcgagcuggugcgccaccggcgcuacaagcacacccacgagaagcccuucaagugcuccaugugcaaguacgccagcgucgaggccuccaagcucaagcggcacgugcgcagccacacgggcgagcggcccuuccagugcugccagugcuccuacgccagccgcgacaccuacaagcugaagcggcacaugcgcacccacuccggggagaagcccuacgagugccacaucugccacacccgguucacgcagagcggcaccaugaagauccacauccugcagaagcacggggagaacgucccgaaguaccagugcccccacugcgcgaccaucaucgcccgcaaguccgaccuccgcgugcacaugcggaaccugcacgccuacagcgccgccgagcugaagugccgcuacugcuccgcgguguuccacgagcgguacgcccucauccagcaccagaagacccacaagaacgagaagcgcuucaagugcaagcacugcagcuacgccugcaagcaggagcggcacaugacggcccacauccgcacccacaccggcgagaagcccuucacgugccuguccugcaacaagugcuuccggcagaagcagcugcucaacgcccacuuccgcaaguaccacgacgcgaacuucauccccaccgucuacaagugcagcaagugcggcaagggguucagccgguggaucaaccugcaccgccacuccgagaagugcggcagcggggaggccaaguccgccgccagcggcaaggggcggcgcacccggaagcgcaagcagaccauccugaaggaggcgaccaagggccagaaggaggccgccaagggcuggaaggaggccgccaacggggacgaggcggccgccgaggaggccuccaccacgaagggcgagcaguucccgggggagauguuccccguggccugccgggagaccaccgcgcgcgugaaggaggaggucgacgagggcgugaccugcgagaugcuccugaacacgauggacaaguga

SEQ ID NO: 28805 - RNA, 2886 nt, Artificial Sequence
  derived and/or modified sequence opt1 from CTDP1__Homo_sapiens__NP_004706
auggaggugcccgccgccggccgcgucccggcggagggggcccccaccgccgccguggccgaggugcggugccccggccccgcgccgcugcgccuccuggaguggcgggucgccgccggggccgcggugcgcaucggcagcgugcuggccgucuucgaggccgccgccuccgcgcagagcuccggggccagccagucccggguggccagcggcggcugcgugcgccccgcccggcccgagcgccggcuccgcuccgagcgggccggggucgugcgcgagcugugcgcgcagcccggccagguggucgccccgggggccgugcuggugcggcucgagggcugcagccaccccgucgugaugaaggggcugugcgccgagugcggccaggaccugacccagcuccaguccaagaacggcaagcagcaggucccccugagcacggccaccguguccauggugcacagcgugcccgagcugauggucuccagcgagcaggcggagcagcucgggcgcgaggaccagcagcggcugcaccgcaaccggaagcuggugcucaugguggaccuggaccagacccugauccacaccacggagcagcacugccagcagauguccaacaagggcaucuuccacuuccagcucgggcgcggcgagccgaugcugcacacccggcugcgcccccacugcaaggacuuccucgagaagaucgccaagcuguacgagcugcacgucuucaccuucggcagccggcucuacgcccacaccaucgccggguuccuggaccccgagaagaagcuguucucccaccgcauccucagccgcgacgagugcaucgaccccuucuccaagacgggcaaccugcggaaccuguucccgugcggggacagcauggugugcaucaucgacgaccgcgaggacgucuggaaguucgcccccaaccucaucaccgugaagaaguacguguacuuccagggcaccggggacaugaacgcgccgcccggcagccgggagucccagacccgcaagaaggucaaccacagccggggcacggagguguccgagcccagcccgcccgugcgcgaccccgagggggucacccaggcccccggcguggagcccuccaacgggcuggagaagcccgcccgggagcugaacggcagcgaggccgcgacgccccgcgacuccccgcggcccgggaagcccgacgagcgcgacaucuggccgcccgcccaggcccccaccagcucccaggagcucgccggcgcccccgagccgcagggcagcugcgcgcagggcgggcggguggcccccgggcagcgccccgcccagggcgccaccgggaccgaccuggacuucgaccuguccagcgacuccgagagcuccagcgaguccgagggcaccaagagcuccagcagcgccuccgacggcgagagcgaggggaagcggggccgccagaagcccaaggcggccccggagggggccggcgcccucgcccagggcuccagccuggagcccgggcggcccgcggcccccucccugccgggcgaggccgagcccggggcccacgcgcccgacaaggagcccgagcucggcgggcaggaggagggcgagcgcgacggccugugcgggcugggcaacgggugcgccgaccggaaggaggccgagaccgagagccagaacuccgagcucagcggcgucacggccggggagucccuggaccagagcauggaggaggaggaggaggaggacaccgacgaggacgaccaccugaucuaccucgaggagauccuggugcgcgugcacaccgacuacuacgccaaguacgaccgguaccugaacaaggagaucgaggaggcgccggacauccgcaagaucguccccgagcucaaguccaaggugcuggccgacguggccaucaucuucagcggccugcaccccaccaacuuccccaucgagaagacgcgcgagcacuaccacgccaccgcccugggcgcgaagauccucacccggcugguccuguccccggacgcccccgaccgcgccacccaccucaucgccgcccgggcggggacggagaaggugcugcaggcccaggagugcggccaccuccacguggucaaccccgacuggcuguggagcugccuggagcgcugggacaagguggaggagcagcuguucccccuccgggacgaccacaccaaggcccagcgcgagaacuccccggccgcguuccccgaccgggagggggugcccccgaccgcccuguuccaccccaugcccguccugcccaaggcccagccgggccccgaggugcgcaucuacgacagcaacaccgggaagcucauccggacgggcgcccgcggcccgcccgcccccuccagcagccugcccauccggcaggagcccuccagcuuccgcgcggugcccccgccccagccccagauguucggggaggagcugcccgacgcccaggacggcgagcagccggggcccucccggcgcaagcggcagcccagcauguccgagaccaugccccucuacacccugugcaaggaggaccuggagagcauggacaaggaggucgacgacauccucggcgagggguccgacgacagcgacuccgagaagcgccggccggaggagcaggaggaggagccccagccccgcaagcccggcacccggcgcgagcggacgcugggcgccccggccagcuccgagcgcagcgccgccgggggccgcgggccccggggccacaagcgcaagcugaacgaggaggacgcggccuccgagagcucccgggagagcuccaacgaggacgagggcagcuccagcgaggccgacgagauggccaaggcgcucgaggccgagcugaacgaccugauguga

SEQ ID NO: 28806 - RNA, 783 nt, Artificial Sequence
  derived and/or modified sequence opt1 from CTDSP1__Homo_sapiens__NP_001193807
augguggccgcccccugggcgacccaggagcaggaggagggccgcgggauccagccgggcgaccgcggggaccagaaguccgccgccagccagaagccccggagccggggcauccugcacucccucuucugcugcgucugccgcgacgacggggaggcccugcccgcccacagcggcgcgccccugcucguggaggagaacggcgccaucccgaagacccccgugcaguaccugcugcccgaggccaaggcccaggacuccgacaagaucugcgucgugaucgaccucgacgagacgcuggugcacagcuccuucaagcccgucaacaacgcggacuucaucaucccgguggagaucgacggggugguccaccagguguacgugcugaagcggccccacgucgacgaguuccuccagcgcaugggcgagcuguucgagugcgugcuguucaccgccagccucgccaaguacgccgaccccguggccgaccugcuggacaaguggggcgcguuccgggcccgccucuuccgggaguccugcgucuuccaccgcgggaacuacgugaaggaccugagccggcuggggcgcgaccuccggcgcgugcugauccuggacaacucccccgccagcuacgucuuccacccggacaacgccgugcccguggccuccugguucgacaacaugagcgacaccgagcuccacgaccugcugcccuucuucgagcagcucucccgggucgacgacguguacagcgugcugcgccagccccggccgggcuccuga

SEQ ID NO: 28807 - RNA, 816 nt, Artificial Sequence
  derived and/or modified sequence opt1 from CTDSP2__Homo_sapiens__NP_005721
auggagcacggcagcaucaucacccaggcccgccgggaggacgcccuggugcucaccaagcaggggcuggucuccaagagcucccccaagaagccgcgcggccggaacaucuucaaggcgcuguucugcugcuuccgcgcccagcacguggggcagagcuccagcuccacggagcucgccgccuacaaggaggaggccaacaccaucgccaagagcgaccugcugcagugccuccaguaccaguucuaccagauccccgggaccugccugcugcccgaggugaccgaggaggaccagggccggaucugcgucgugaucgaccucgacgagacgcuggugcacuccagcuucaagcccaucaacaacgcggacuucaucgucccgaucgagaucgagggcaccacccaccagguguacgugcugaagcgccccuacgucgacgaguuccuccggcgcaugggcgagcuguucgagugcgugcuguucaccgccucccucgccaaguacgcggaccccgugacggaccugcuggaccggugcggggucuuccgcgcccgccucuuccgggagagcugcguguuccaccagggcugcuacgugaaggaccugucccggcuggggcgcgaccuccggaagacccugauccuggacaacagccccgccuccuacaucuuccacccggagaacgccguccccgugcagagcugguucgacgacauggccgacaccgagcuccugaaccugauccccaucuucgaggagcucuccggcgcggaggacguguacaccagccuggggcagcugcgcgcccccuga

SEQ ID NO: 28808 - RNA, 831 nt, Artificial Sequence
  derived and/or modified sequence opt1 from CTDSPL__Homo_sapiens__NP_001008393
auggacggccccgccaucaucacccaggugaccaacccgaaggaggacgaggggcgccugcccggcgccggggagaaggcgagccagugcaacgucucccucaagaagcagcggagccgcuccauccugagcuccuucuucugcugcuuccgggacuacaacguggaggccccgccgcccagcucccccagcgugcugccgccccucgucgaggagaacggcgggcugcagaagggcgaccagcgccaggugauccccauccccuccccgcccgccaaguaccugcuccccgaggugacgguccuggacuacggcaagaagugcguggugaucgaccuggacgagacccucguccacagcuccuucaagcccaucagcaacgccgacuucaucgugcccguggagaucgacgggaccauccaccaggucuacgugcugaagcggccccacguggacgaguuccugcagcgcaugggccagcuguucgagugcguccucuucaccgccucccuggcgaaguacgccgaccccguggccgaccuccuggaccgguggggcguguuccgcgcccggcuguuccgcgagagcugcgucuuccaccgggggaacuacgugaaggaccucucccgccuggggcgggagcugagcaaggugaucaucgucgacaacucccccgcgagcuacaucuuccaccccgagaacgccgugcccgugcaguccugguucgacgacaugacggacaccgagcuccuggaccugaucccguucuucgagggccucagccgcgaggacgacgucuacagcaugcugcaccggcugugcaaccgcuga

SEQ ID NO: 28809 - RNA, 603 nt, Artificial Sequence
  derived and/or modified sequence opt1 from CTF1__Homo_sapiens__NP_001136016
augagccgccgggagggcucccuggacccccagaccgacagcuccgugagccuccugccgcaccuggaggccaagauccgccagacccacucccucgcccaccuccugacgaaguacgcggagcagcugcugcaggaguacguccagcugcagggggaccccuucggccuccccagcuucagcccgccccggcugcccguggccgggcuguccgcccccgcccccucccacgccggccucccggugcacgagcgccugcggcuggacgcggccgcccucgccgcgcugccgccccugcucgacgccgucugccgccggcaggccgagcugaacccccgcgcgccccggcugcuccgccggcuggaggacgccgcccgccaggcccgggcccugggggccgccguggaggcgcuccuggccgcccugggcgccgccaaccgcggcccccgggcggagccgcccgccgccaccgccagcgccgcguccgccaccgggguguuccccgccaagguccucggccugcgcgugugcgggcuguaccgggaguggcucagccgcaccgagggcgaccuggggcagcugcuccccggcggcuccgccuga

SEQ ID NO: 28810 - RNA, 1050 nt, Artificial Sequence
  derived and/or modified sequence opt1 from CTGF__Homo_sapiens__NP_001892
augaccgccgccagcaugggccccgugcgcgucgcguucguggugcugcucgcccugugcucccggccggccgucgggcagaacugcagcggccccugccgcugccccgacgagcccgccccgcggugccccgccggggugucccuggugcucgacggcugcgggugcugccgcgucugcgcgaagcagcugggcgagcugugcaccgagcgggaccccugcgacccccacaagggccucuucugcgacuucgggagcccggccaaccgcaagaucggcgugugcacggccaaggacggggcccccugcaucuucggcgggaccguguaccgguccggcgagagcuuccaguccagcugcaaguaccagugcacgugccuggacggcgcggucgggugcaugccccugugcuccauggacgugcgccuccccagcccggacugccccuucccccggcgcgugaagcugcccggcaagugcugcgaggagugggucugcgacgagccgaaggaccagaccgugguggggcccgcccuggccgccuaccggcucgaggacaccuucggccccgaccccaccaugauccgcgccaacugccugguccagaccaccgagugguccgcgugcagcaagacgugcggcauggggaucuccacccgggugaccaacgacaacgccagcugccgccuggagaagcagucccggcucugcauggugcgcccgugcgaggccgaccuggaggagaacaucaagaagggcaagaagugcauccggacccccaagaucagcaagcccaucaaguucgagcuguccgggugcacgagcaugaagaccuaccgcgccaaguucugcggcgucugcaccgacgggcggugcugcacgccccaccgcaccaccacccucccgguggaguucaagugccccgacggcgaggugaugaagaagaacaugauguucaucaagaccugcgccugccacuacaacugccccggcgacaacgacaucuucgagucccuguacuaccggaagauguacggggacauggcguga

SEQ ID NO: 28811 - RNA, 690 nt, Artificial Sequence
  derived and/or modified sequence opt1 from CTHRC1__Homo_sapiens__NP_001243028
auguggcccccgggccgcagcaucaccgugaagcugcgggagaagaccgucucccgcaagcucgagaugaacgggcccagcgccuuccagggccugaucugcgggaaguacaacggcaugugccugcaggggcccgccggcgugcccggccgggacggguccccgggcgcgaacgggauccccggcacgcccgggauccccggccgcgacggcuucaagggggagaagggcgagugccuccgggagagcuucgaggaguccuggaccccgaacuacaagcagugcagcugguccagccugaacuacgggaucgaccugggcaagaucgccgagugcaccuucaccaagaugcgcuccaacagcgcccuccgggugcuguucuccggcagccugcgccucaagugccggaacgccugcugccagcgcugguacuucacguucaacggggccgagugcuccggcccccugcccaucgaggcgaucaucuaccuggaccaggggagccccgagaugaacuccaccaucaacauccaccggaccagcuccgucgagggccucugcgaggggaucggcgccggccugguggacguggccaucugggucgggaccugcagcgacuacccgaagggcgacgccuccacgggguggaacagcgugagccgcaucaucaucgaggagcugcccaaguga

SEQ ID NO: 28812 - RNA, 1803 nt, Artificial Sequence
  derived and/or modified sequence opt1 from CTIF__Homo_sapiens__NP_001135869
auggagaacagcuccgccgccagcgcguccagcgaggccggcuccagccgcucccaggagaucgaggagcuggagcgguucaucgacagcuacgugcucgaguaccagguccaggggcugcuggccgacaagaccgagggcgacggggaguccgagcgcacccagagccacaucucccaguggacggccgacugcagcgagccccucgacuccagcugcuccuucagccggggccgcgccccgccccagcagaacggguccaaggacaacagccuggacaugcugggcaccgacaucugggcggccaacaccuucgacuccuucagcggcgccaccugggaccuccagcccgagaagcuggacuucacgcaguuccaccggaaggugcgccacacccccaagcagccgcugccccacaucgaccgggaggggugcggcaaggggaagcucgaggacggcgacgggaucaaccugaacgacaucgagaaggugcugcccgccuggcagggcuaccaccccaugccgcacgaggucgagaucgcgcacaccaagaagcuguuccgccggcgccggaacgaccgccggcgccagcagcggccgcccggcgggaacaagccccagcagcacggcgaccaccagcccgggagcgccaagcacaaccgcgaccaccagaaguccuaccagggcggcagcgcgccccaccccuccgggcggcccacccaccacggcuacagccagaaccgccgguggcaccacgggaacaugaagcacccgcccggcgacaagggggaggccggcgcccaccgcaacgccaaggagacgaugaccaucgagaaccccaagcucgaggacaccgccggcgacaccgggcacuccagccuggaggcgccccgguccccggacacgcucgcccccguggccagcgagcgccugccgccccagcaguccggcgggcccgagguggagaccaagcgcaaggacagcauccugcccgagcggaucggcgagcgccccaagaucacccuccugcaguccagcaaggaccggcugcgccggcgccucaaggagaagguccccgacgagguggccguggagaccacgaccccgcagcagaacaagauggacaagcugaucgagauccugaacuccaugcggaacaacagcuccgacgucgacaccaagcucaccacguucauggaggaggcccagaacagcaccaacuccgaggagaugcugggggagaucgugcgcaccaucuaccagaaggccgugagcgaccgguccuucgccuucaccgccgcgaagcugugcgacaagauggcccucuucauggucgagggcacgaaguuccgcagccugcugcucaacaugcugcagaaggacuucaccgugcgggaggagcugcagcagcaggacguggagcgcuggcucggcuucaucaccuuccugugcgaggucuucgggaccaugcggagcuccacgggcgagcccuuccgcgugcuggugugccccaucuacacgugccuccgggagcugcugcagagccaggacgucaaggaggacgccgugcucugcugcuccauggagcugcagagcaccgggcgccugcucgaggagcagcugccggagaugaugaccgagcugcucgccuccgcccgggacaagaugcugugccccagcgaguccaugcugacccgcagccuccugcuggaggugaucgagcugcacgcgaacuccuggaacccccucacgcccccgaucacccaguacuacaaccggaccauccagaagcugaccgccuga

SEQ ID NO: 28813 - RNA, 525 nt, Artificial Sequence
  derived and/or modified sequence opt1 from CTLA4__Homo_sapiens__NP_001032720
auggccugccugggcuuccagcgccacaaggcccagcucaaccuggcgacccggaccuggcccugcacgcuccuguucuuccugcuguucauccccguguucugcaaggccaugcacgucgcccagcccgccguggugcucgccagcucccgcgggaucgcgagcuucgucugcgaguacgccucccccggcaaggccaccgaggugcgggugaccguccugcgccaggccgacagccaggugaccgaggugugcgcggccacguacaugauggggaacgagcugaccuuccucgacgacuccaucugcaccggcaccagcuccgggaaccaggucaaccugacgauccagggccugcgggccauggacaccggccucuacaucugcaagguggagcugauguacccgccgcccuacuaccuggggaucggcaacgggacccagaucuacgugaucgccaaggagaagaagcccagcuacaaccgcggccucugcgagaacgcccccaaccgggcgcgcauguga

SEQ ID NO: 28814 - RNA, 2526 nt, Artificial Sequence
  derived and/or modified sequence opt1 from CTNNA1__Homo_sapiens__NP_001277236
augaccgccgugcacgccggcaacaucaacuucaagugggaccccaagagccuggagauccgcacccucgcggucgagcggcugcuggagccgcucgugacccaggugaccacccuggucaacaccaacuccaaggggcccagcaacaagaagcgcggccgguccaagaaggcccacgugcuggccgccagcguggagcaggccacggagaacuuccucgagaagggggacaagaucgcgaaggagucccaguuccugaaggaggagcuggucgccgccguggaggacgugcgcaagcagggcgaccucaugaaggccgcggccggggaguucgccgacgaccccugcagcuccgucaagcggggcaacauggugcgcgccgcccgggcgcugcugagcgccgugacccgccuccugauccuggccgacauggccgacgucuacaagcuccuggugcagcugaagguggucgaggacggcauccucaagcugcggaacgccgggaacgagcaggaccugggcauccaguacaaggcgcucaagcccgagguggacaagcugaacaucauggccgccaagcgccagcaggagcugaaggacguggggcaccgggaccagauggccgccgcgcgcggcauccuccagaagaacgucccgauccuguacaccgccucccaggccugccugcagcaccccgacguggccgccuacaaggcgaaccgggaccucaucuacaagcagcugcagcaggccgugaccgggaucagcaacgccgcccaggcgacggccuccgacgacgccagccagcaccagggcggcgggggcggggagcuggccuacgcccucaacaacuucgacaagcagaucaucgucgacccccuguccuucagcgaggagcgcuuccggcccucccuggaggagcgccucgagagcaucaucuccggcgcggcccugauggccgacagcuccugcacccgggacgaccgccgggagcgcaucguggccgagugcaacgccgugcggcaggcgcugcaggaccuccugagcgaguacaugggcaacgccgggcgcaaggagcgcagcgacgcccugaacuccgccaucgacaagaugaccaagaagacccgggaccuccgccggcagcugcgcaaggccgucauggaccacgugagcgacuccuuccuggagacgaacgucccgcuccuggugcugaucgaggcggccaagaacggcaacgagaaggaggugaaggaguacgcccaggucuuccgggagcacgccaacaagcucaucgagguggcgaaccuggccugcagcaucuccaacaacgaggagggggugaagcugguccgcaugagcgccucccagcucgaggcccugugcccccaggugaucaacgccgcgcuggcccuggccgccaagccccagagcaagcucgcccaggagaacauggaccuguucaaggagcagugggagaagcagguccgggugcugaccgacgcgguggacgacaucaccuccaucgacgacuuccucgccgugagcgagaaccacauccuggaggacgucaacaagugcgugaucgcccugcaggagaaggacguggacggccucgaccgcaccgccggggccauccggggccgcgcggcccgggucauccacguggugacguccgagauggacaacuacgagcccggcgucuacaccgagaaggugcuggaggccaccaagcugcucagcaacaccgugaugccgcgcuucacggagcaggucgaggccgcgguggaggcccuguccagcgaccccgcccagcccauggacgagaacgaguucaucgacgccucccggcugguguacgacgggauccgcgacauccggaaggccguccucaugauccgcacccccgaggagcuggacgacagcgacuucgagaccgaggacuucgacgugcggucccgcaccagcgugcagacggaggacgaccagcugaucgcgggccaguccgcccgggccaucauggcccagcucccgcaggagcagaaggccaagaucgcggagcaggucgccagcuuccaggaggagaaguccaagcuggacgccgaggugagcaagugggacgacagcgggaacgacaucaucgugcuggccaagcagaugugcaugaucaugauggagaugaccgacuucacccgcggcaaggggccccucaagaacaccuccgacgucaucagcgccgcgaagaagaucgccgaggccggcucccgcauggacaagcugggccggacgaucgccgaccacugccccgacagcgccugcaagcaggaccugcucgcguaccugcagcgcaucgcccuguacugccaccagcucaacaucugcuccaaggugaaggccgaggugcagaaccucgggggcgagcuggucgugagcgggaacugcgacacgugcggcgcccugcaggggcugaagggcuggcccccgccccugugcuggccccucaccggcuggaccgcgcccugcccguga

SEQ ID NO: 28815 - RNA, 2583 nt, Artificial Sequence
  derived and/or modified sequence opt1 from CTNNA2__Homo_sapiens__NP_001158355
augaccagcgccaccucccccaucauccugaagugggaccccaagagccucgagauccgcacgcugaccguggagcggcugcucgagccgcuggucacccaggugaccacgcuggugaacaccuccaacaagggccccagcgggaagaagaagggccgcuccaagaaggcccacguccucgcggccagcguggagcaggccacccagaacuuccuggagaagggggagcagaucgccaaggagucccaggaccugaaggaggagcucguggccgcggucgaggacgugcggaagcagggcgagaccaugcgcaucgccagcuccgaguucgccgacgaccccugcagcuccgugaagcgggggacgaugguccgcgccgcgcgggcccugcugagcgccgugacccgccuccugauccuggccgacauggccgacgugaugcggcuccugucccaccugaagaucgucgaggaggcgcucgaggccgugaagaacgccaccaacgagcaggaccuggccaaccgcuucaaggaguucggcaaggagauggugaagcugaacuacgucgccgcgcggcgccagcaggagcucaaggacccgcacugccgggacgagauggccgccgcccgcggcgcccugaagaagaacgcgaccaugcuguacacggccagccaggccuuccuccggcaccccgacguggccgccacccgcgcgaaccgggacuacguguucaagcagguccaggaggccaucgccgggaucuccaacgccgcgcaggccaccagccccaccgacgaggccaagggccacacggggaucggcgagcuggccgccgcgcugaacgaguucgacaacaagaucauccucgaccccaugaccuucuccgaggcccgcuuccggccgagccuggaggagcgccuggaguccaucaucagcggggccgcccucauggccgacagcuccugcacccgggacgaccgccgcgagcggaucguggcggagugcaacgccgugcgccaggcccugcaggaccugcucagcgaguacaugaacaacaccggccggaaggagaagggcgacccccugaacaucgccaucgacaagaugacgaagaagacccgcgaccugcggcgccagcuccggaaggccgucauggaccacaucuccgacagcuuccuggagaccaacgugccccugcucgugcugaucgaggcggccaaguccgggaacgagaaggaggucaaggaguacgcccagguguuccgcgagcacgccaacaagcuggucgagguggcgaaccucgccugcagcaucuccaacaacgaggagggcgugaagcugguccggauggccgccacccagaucgacagccugugcccccaggugaucaacgccgcgcucacgcuggccgcccgcccgcaguccaagguggcccaggacaacauggacgucuucaaggaccagugggagaagcagguccgggugcugaccgaggccguggacgacaucaccagcguggacgacuuccucuccgugagcgagaaccacauccuggaggacgucaacaagugcgugaucgcgcugcaggagggggacguggacacccuggaccgcacggccggcgccauccggggccgcgccgcccgggucauccacaucaucaacgcggagauggagaacuacgaggccgggguguacaccgagaaggugcucgaggccaccaagcugcuguccgagaccgucaugccccgcuucgccgagcaggucgagguggcgaucgaggcccucagcgccaacgugccccagcccuucgaggagaacgaguucaucgacgccucccggcugguguacgacggcgugcgcgacauccggaaggccguccugaugauccgcacgccggaggagcucgaggacgacagcgacuucgagcaggaggacuacgacgugcgcucccggaccagcgugcagaccgaggacgaccagcugaucgcggggcaguccgcccgcgccaucauggcccagcugccccaggaggagaaggccaagaucgcggagcaggucgagaucuuccaccaggagaaguccaagcucgacgccgagguggccaagugggacgacagcggcaacgacaucaucgugcuggccaagcagaugugcaugaucaugauggagaugaccgacuucacgcgggggaagggcccccugaagaacaccagcgacgucaucaacgccgcgaagaagaucgccgaggccggcagccgcauggacaagcucgcccgggccguggcggaccagcuggacuccgccaccagccugauccaggccgccaagaaccucaugaacgcggugguccugaccgugaaggccuccuacguggccagcaccaaguaccagaaggucuacgggacggccgccgugaacucccccguggucagcuggaagaugaaggcgccggagaagaagccccuggugaagcgcgagaagcccgaggaguuccagacccgggugcgccggggcucccagaagaagcacaucagccccguccaggcccucuccgaguucaaggccauggacagcuucuga

SEQ ID NO: 28816 - RNA, 1167 nt, Artificial Sequence
  derived and/or modified sequence opt1 from CTNNA3__Homo_sapiens__NP_001278062
augaaguccacccagcgccgggagaagcagggcagcaugagcgccgagacccccaucacgcugaacaucgacccgcaggaccuccaggugcagaccuucaccgucgagaagcugcuggagccccucaucauccaggugaccacgcuggugaacugcccccagaaccccuccagccgcaagaaggggcgguccaagcgcgccagcguccugcucgcguccguggaggaggccaccuggaaccugcuggacaagggcgagaagaucgcccaggaggccaccgugcucaaggacgagcugaccgccagccuggaggagguccggaaggaguccgaggcgcucaaggugagcgccgagcgcuucacggacgacccgugcuuccugcccaagcgggaggccgugguccaggccgcgcgcgcccugcucgccgccgugacccggcugcugauccucgccgacaugaucgacgugaugugccugcugcagcacgucuccgcguuccagcgcaccuucgagagccucaagaacguggccaacaaguccgaccugcagaagaccuaccagaagcuggggaaggagcucgagaaccuggacuaccuggccuucaagcggcagcaggaccucaagagccccaaccagcgcgacgagaucgccggcgcccgggcgucccugaaggagaacagcccccugcuccacuccaucugcagcgccugccuggagcacuccgacguggccagccugaaggccagcaaggacacggucugcgaggagauccagaacgcccucaacgugaucuccaacgcgagccaggggauccagaacaugaccaccccgcccgagccccaggccgccacccugggcuccgcccuggacgagcucgagaaccugaucgugcugaacccccucacggucaccgaggaggagauccgcccgagccuggagaagcggcuggaggccaucaucuccggcgcggcccuccuggccgacagcuccugcacccgcgaccugcaccgggagcgcaucaucgccgagugcaacgcgauccggcaggcccuccaggaccugcugagcgaguacaugaacaaccucugcaaccagaaguccgaccuggggcugaccggcgugaagaucaagcugcucgaggagugcaucaucuucuggagccuguga

SEQ ID NO: 28817 - RNA, 2157 nt, Artificial Sequence
  derived and/or modified sequence opt1 from CTNNAL1__Homo_sapiens__NP_001273903
auggccgccagccccggcccggcgggggugggcggggccggcgccgucuacgggagcggcagcuccggcuucgcccuggacagcgggcucgagaucaagacccgcuccguggagcagacccugcugccccucgugagccagaucacgacccugaucaaccacaaggacaacaccaagaaguccgacaagacccugcaggccauccagcgggucggccaggcggugaaccucgccguggggcgcuucgucaaggugggcgaggccaucgccaacgagaacugggaccugaaggaggagaucaacaucgcgugcaucgaggccaagcaggccggggagacgaucgccgcccugaccgacaucaccaaccucaaccaccuggagagcgacggccagaucaccaucuucacggacaagaccggcgugaucaaggcggcccggcugcuccuguccagcgucaccaaggugcugcuccuggccgaccgcguggucaucaagcagaucaucaccucccggaacaaggugcuggccacgauggagcgccucgagaaggugaacagcuuccaggaguucguccagaucuucucccaguucgggaacgagaugguggaguucgcccaccugagcggcgaccggcagaacgaccugaaggacgagaagaagaaggcgaagauggccgccgcccgcgccgugcucgagaagugcaccaugaugcugcugaccgcguccaagaccugccuccggcaccccaacugcgagagcgcccacaagaacaaggagggggucuucgaccgcaugaagguggcccuggacaaggugaucgagaucgucacggacugcaagcccaacggcgagaccgacaucuccagcaucuccaucuucaccggcaucaaggaguucaagaugaacaucgaggcccugcgggagaaccucuacuuccagagcaaggagaaccugagcgugacccuggaggugauccucgagcgcauggaggacuucacggacuccgccuacaccagccacgagcaccgggagcgcauccuggagcuguccacccaggcgcggauggagcuccagcagcugaucagcgucuggauccaggcccaguccaagaagaccaagagcaucgccgaggagcuggagcucuccauccugaagaucagccacucccugaacgagcucaagaaggagcugcacagcacggccacccagcuggcggccgaccuccugaaguaccacgccgaccacgugguccugaaggcccucaagcugaccgggguggagggcaaccuggaggcccucgcggaguacgccugcaagcuguccgagcagaaggagcagcugguggagaccugccgccugcuccggcacaucagcgggacggagccgcuggagaucacgugcauccacgccgaggagaccuuccaggucaccggccagcagaucaucuccgccgccgagacccugacccuccaccccagcuccaagaucgcgaaggagaaccuggacguguucugcgaggccugggagagccagaucuccgacaugagcacccugcuccgcgagaucaacgacguguucgaggggcggcgcggcgagaaguacggcuaccugucccugcccaagcccaugaagaacaacgccaaccucaagagccugaagccggacaagcccgacagcgaggagcaggccaagaucgccaagcuggggcucaagcugggccugcucaccuccgacgcggacugcgagaucgagaagugggaggaccaggagaacgagaucguccaguacgggcggaacaugagcuccauggccuacagccuguaccuguucacgcgcggcgaggggccccucaagaccucccaggaccugauccaccagcuggagguguucgccgccgagggccucaagcugaccagcuccgugcaggcguucagcaagcagcugaaggacgacgacaagcucaugcugcugcucgagaucaacaagcugaucccccugugccaccagcuccagaccgucaccaagacgucccugcagaacaagguguuccugaagguggacaagugcaucaccaagacccgcagcaugauggcccuccugguccagcugcucucccugugcuacaagcugcucaagaaguccgagacccgguacuga

SEQ ID NO: 28818 - RNA, 2346 nt, Artificial Sequence
  derived and/or modified sequence opt1 from CTNNB1__Homo_sapiens__NP_001091679
auggccacccaggccgaccugauggagcucgacauggcgauggagcccgaccgcaaggccgccgugagccacuggcagcagcaguccuaccuggacagcggcauccacuccggggccaccacgaccgcccccagccuguccggcaaggggaaccccgaggaggaggacgucgacaccagccaggugcucuacgagugggagcagggcuucucccagagcuucacccaggagcaggucgcggacaucgacgggcaguacgccaugacgcgggcccagcgcgugcgggccgcgauguuccccgagacccuggacgagggcaugcagauccccuccacccaguucgacgccgcccacccgaccaacgugcagcgccuggccgagcccagccagaugcucaagcacgccguggucaaccugaucaacuaccaggacgacgcggagcuggccacgcgggccauccccgagcucaccaagcugcugaacgacgaggaccaggugguggucaacaaggccgccgugauggugcaccagcucuccaagaaggaggcgagccgccacgccaucaugcggagcccccagauggucuccgccaucgugcgcaccaugcagaacaccaacgacguggagacggcccggugcaccgccggcacccugcacaaccugucccaccaccgcgaggggcuccuggcgaucuucaagagcggcgggaucccggcccuggucaagaugcucggcucccccguggacagcgugcuguucuacgccaucaccacgcugcacaaccuccugcugcaccaggagggggccaagauggccguccggcucgcgggcggccugcagaagaugguggcccugcucaacaagaccaacgugaaguuccuggccaucaccaccgacugccugcagauccucgccuacgggaaccaggaguccaagcugaucauccuggcgagcggcgggccccaggcccucgucaacaucaugcgcacguacaccuacgagaagcugcuguggaccaccagccgggugcucaaggugcuguccgucugcagcuccaacaagcccgccaucguggaggccggcggcaugcaggcccuggggcuccaccugacggacccgagccagcgccugguccagaacugccucuggacccugcggaaccuguccgacgcggccaccaagcaggagggcauggaggggcuccugggcacccuggugcagcuccuggggagcgacgacaucaacguggucacgugcgccgccggcauccuguccaaccugaccugcaacaacuacaagaacaagaugauggugugccaggugggcgggaucgaggcccucguccgcaccgugcugcgggcgggcgaccgcgaggacaucaccgagcccgccaucugcgcccugcggcaccucacgagccgccaccaggaggccgagauggcccagaacgcggugcggcugcacuacgggcugcccgucguggugaagcuccugcacccgcccucccacuggccccugaucaaggccaccgucggccucauccgcaaccuggcccugugccccgccaaccacgcgccccuccgcgagcagggggccaucccgcggcuggugcagcugcucgugcgcgcccaccaggacacccagcggcgcaccagcaugggcggcacgcagcagcaguucgucgagggggugcggauggaggagaucguggagggcugcaccggggcccugcacauccuggcccgcgacguccacaaccggaucgugauccgcggccucaacaccaucccccuguucgugcagcugcucuacucccccaucgagaacauccagcgggucgcggccggggugcugugcgagcuggcccaggacaaggaggccgccgaggcgaucgaggccgagggcgccaccgcgccccucaccgagcugcugcacagccgcaacgagggcguggccacguacgccgccgccguccucuuccggauguccgaggacaagccgcaggacuacaagaagcgccugagcguggagcugaccuccagccucuuccggaccgagcccauggccuggaacgagaccgcggaccuggggcuggacaucggcgcccagggggagccccucggcuaccgccaggacgaccccuccuaccggagcuuccacuccggcggguacggccaggacgcccuggggauggacccgaugauggagcacgagaugggcgggcaccaccccggcgccgacuaccccguggacggccugccggaccucgggcacgcccaggaccugauggacggccugccgcccggggacagcaaccagcucgcgugguucgacacggaccuguga

SEQ ID NO: 28819 - RNA, 1611 nt, Artificial Sequence
  derived and/or modified sequence opt1 from CTNNBL1__Homo_sapiens__NP_001268424
augcgccggaagcagaccggcacccgcgagcgggggcgcuaccgggaggaggagaugacgguggucgaggaggccgacgacgacaagaagcgccugcuccagaucaucgaccgggacggcgaggaggaggaggaggaggaggagccccuggacgagagcuccgugaagaagaugauccugaccuucgagaagcgcagcuacaagaaccaggagcuccggaucaaguucccggacaaccccgagaaguucauggaguccgagcuggaccugaacgacaucauccaggagaugcacguggucgccaccaugcccgaccucuaccaccuccugguggagcugaacgcggugcagagccugcuggggcuccugggccacgacaacaccgacgucuccaucgccgugguggaccugcuccaggagcugacggacaucgacacccugcacgagagcgaggagggggccgagguccucaucgacgcccugguggacggccagguggucgcccugcucgugcagaaccuggagcgccuggacgaguccgugaaggaggaggcggacggcguccacaacacccucgccaucguggagaacauggccgaguuccggcccgagaugugcaccgagggggcccagcagggccugcugcaguggcuccugaagcgccugaaggcgaagaugccguucgacgccaacaagcucuacugcagcgaggugcuggccauccugcuccaggacaacgacgagaaccgggagcugcugggggagcucgacggcaucgacguccugcugcagcagcucuccguguucaagcgccacaaccccagcacggccgaggagcaggagaugauggagaaccuguucgacucccugugcagcugccucaugcuguccagcaaccgggagcgcuuccugaagggggagggccuccagcugaugaaccugaugcuccgggagaagaagaucucccgcagcuccgcccugaaggugcuggaccacgcgaugaucggccccgaggggaccgacaacugccacaaguucgucgacauccugggccuccggaccaucuucccccuguucaugaaguccccgcgcaagaucaagaagguggggaccacggagaaggagcacgaggagcacgugugcagcauccuggccagccuccugcggaaccugcgcggccagcagcgcacccggcuccugaacaaguucaccgagaacgacagcgagaaggucgaccgccugauggagcuccacuucaaguaccugggcgccaugcaggucgccgacaagaagaucgagggggagaagcacgacauggugcggcgcggcgagaucaucgacaacgacaccgaggaggaguucuaccugcggcgccucgacgccgggcuguucgugcugcagcacaucugcuacaucauggcggagaucugcaacgccaacgugccccagauccggcagcgcguccaccagauccucaacaugcggggcuccagcaucaagaucgugcgccacaucaucaaggaguacgccgagaacaucggggacggccggucccccgaguuccgcgagaacgagcagaagcggauccugggccugcucgagaacuucuga

SEQ ID NO: 28820 - RNA, 2907 nt, Artificial Sequence
  derived and/or modified sequence opt1 from CTNND1__Homo_sapiens__NP_001078927
auggacgacagcgagguggaguccaccgccagcauccuggccuccgucaaggagcaggaggcgcaguucgagaagcucacccgcgcccuggaggaggagcggcgccacgugagcgcccagcuggagcgggugcgcgucagcccccaggacgccaacccgcucauggccaacggcacccugacccggcgccaccagaacgggcgguucgugggcgacgcggaccuggagcgccagaaguucagcgaccucaagcugaacgggccccaggaccacucccaccuccuguacagcaccaucccccggaugcaggagcccggccagaucguggagaccuacacggaggaggacccggagggggccauguccgucgugagcguggagaccuccgacgacggcaccacccgccggacggagaccaccgucaagaagguggugaagaccgucacgacccgcaccgugcagcccguggccaugggccccgacgggcugcccgucgacgccagcuccgugagcaacaacuacauccagacccugggccgggacuuccgcaagaacgggaacggcgggccgggccccuacgugggccaggcggggacggccacccucccccggaacuuccacuacccgcccgacggcuacucccgccacuacgaggacggguaccccggcggcagcgacaacuacgggucccugagccgggucacccgcaucgaggagcgguaccgccccuccauggagggcuaccgggcccccagccgccaggacguguacgggccgcagccccaggugcgcgucggcgggagcuccguggaccugcaccgguuccaccccgagcccuacggccucgaggacgaccagcgcagcaugggcuacgacgaccuggacuacgggaugauguccgacuacggcaccgcccggcgcacggggaccccgagcgacccccggcgccggcugcgcuccuacgaggacaugaucggcgaggaggugcccagcgaccaguacuacugggcgccccucgcccagcacgagcgggggucccuggccagccuggacucccuccgcaagggcggcccgcccccgcccaacuggcggcagcccgagcugcccgaggucaucgccaugcugggguuccgccucgacgccgugaaguccaacgccgcggccuaccugcagcaccugugcuaccggaacgacaaggucaagaccgacgugcgcaagcucaagggcauccccgugcuggucgggcugcucgaccacccgaagaaggaggugcaccugggcgccugcggggcccugaagaacaucuccuucggccgggaccaggacaacaagaucgccaucaagaacugcgacggcgugcccgcgcucguccgccugcugcggaaggcccgcgacauggaccucaccgaggugaucacggggacccuguggaaccugagcucccacgacagcaucaagauggagaucguggaccacgcccuccacgcccugaccgacgaggucaucaucccccacuccggcugggagcgggagcccaacgaggacugcaagccgcgccacaucgagugggagagcgugcugaccaacacggccgggugccuccgcaacguguccagcgagcgguccgaggcgcgccggaagcugcgcgagugcgacggccuggucgacgcccucaucuucaucgugcaggccgagaucggccagaaggacagcgacagcaagcugguggagaacugcgucugccugcuccggaaccuguccuaccaggugcaccgcgagaucccccaggccgagcgguaccaggaggcggcccccaacguggccaacaacaccgggccccacgccgccagcugcuucggcgcgaagaaggggaaggacgagugguucucccgcggcaagaagccgaucgaggaccccgccaacgacaccgucgacuuccccaagcggaccagccccgcccgcggguacgagcugcuguuccagccggagguggugcggaucuacaucucccuccugaaggagagcaagacgcccgccauccuggaggccuccgcgggcgccauccagaaccucugcgccggccgcuggaccuacgggcgguacauccgcagcgcccugcggcaggagaaggcccuguccgcgaucgccgaccuccugaccaacgagcacgagcgcgucgugaaggccgccagcggcgcgcugcggaaccucgccguggacgcccgcaacaaggagcugaucgggaagcacgccauccccaaccuggucaagaaccuccccggcgggcagcagaacuccagcuggaacuucuccgaggacaccgugaucagcauccugaacacgaucaacgaggugaucgccgagaaccuggaggcggccaagaagcuccgggagacccagggcaucgagaagcugguccugaucaacaaguccggcaaccgcagcgagaaggaggugcgggccgccgcccucgugcugcagaccaucuggggguacaaggagcugcgcaagccgcucgagaaggagggcuggaagaaguccgacuuccaggucaaccugaacaacgcgagccgcagccaguccagccacuccuacgacgacagcacccugccccucaucgaccggaaccagaaguccgacaagaagcccgaccgcgaggagauccagaugagcaacaugggguccaacaccaagagccuggacaacaacuacuccacgcccaacgagcggggcgaccacaaccgcacccuggaccggagcggggaccucggcgacauggagccgcugaagggcaccacgccccugaugcaggacgaggggcaggagucccucgaggaggagcuggacgugcuggugcucgacgacgagggcgggcaggucagcuaccccuccaugcagaagaucuga

SEQ ID NO: 28821 - RNA, 3405 nt, Artificial Sequence
  derived and/or modified sequence opt1 from CTNND2__Homo_sapiens__NP_001275644
augagcuccaugagcuccgccgaggagcaguuccaguggcagagccaggacggccagaaggacaucgaggacgagcugaccaccgggcucgagcugguggacuccugcauccgcagccugcaggaguccggcauccucgacccccaggacuacagcacgggggagcggccgucccugcugagccaguccgcccuccagcugaacagcaagcccgagggcuccuuccaguaccccgcgagcuaccacuccaaccagacccuggcccucggggagaccacccccagccagcugccggcccgcggcacgcaggcccgggccaccggccaguccuucagccaggggaccaccucccgcgcgggccaccuggccgggcccgagcccgcccccccgcccccccccccgccccgggagcccuucgcccccagccucggcagcgcguuccaccugccggacgccccccccgccgccgccgcggccgcccuguacuacuccagcuccacgcuccccgccccgccccgcgggggcagcccccuggccgcgccccagggcggguccccgaccaagcugcagcggggcgggagcgcccccgagggcgccaccuacgccgccccccgcggcuccagccccaagcaguccccgagccggcucgcgaaguccuacagcaccuccagccccaucaacaucgucguguccagcgccgggcugucccccauccgcgugacgagcccgcccaccguccaguccaccaucagcagcucccccauccaccagcugagcuccaccaucggcacguacgccacccucagccccaccaagcggcuggugcacgccuccgagcaguacagcaagcacucccaggagcuguacgccaccgcgacgcuccagcgcccggggagccuggccgccggcucccgggccagcuacuccagccagcacgggcaccugggccccgagcuccgcgcgcugcagucccccgagcaccacaucgaccccaucuacgaggaccggguguaccagaagccgcccaugcgcagccugucccagagccagggcgacccccuccccccggcccacaccgggaccuaccggaccuccacggcccccagcagccccggcgucgacuccgugccccugcagcgcaccgggagccagcacggcccgcagaacgccgccgcggccaccuuccagcgggccuccuacgccgccgggcccgcgagcaacuacgccgaccccuaccgccagcugcaguacugccccuccguggagagcccguacuccaagagcggccccgcccucccccccgagggcacccuggcccgguccccgagcaucgacuccauccagaaggacccccgcgaguucggguggcgcgaccccgagcugccggaggucauccagaugcuccagcaccaguuccccagcgugcaguccaacgccgcggccuaccugcagcaccugugcuucggcgacaacaagaucaaggccgagauccggcgccaggggggcauccagcuccugguggaccugcucgaccaccggaugacggagguccaccgcagcgccugcggggcgcugcggaaccugguguacggcaaggccaacgacgacaacaagaucgcccucaagaacugcggcgggauccccgcccuggugcgccugcuccggaagaccaccgaccuggagauccgcgagcuggucaccggcgugcuguggaaccucuccagcugcgacgcccugaagaugcccaucauccaggacgcgcuggccgugcucacgaacgccgucaucaucccgcacuccgggugggagaacagcccccugcaggacgaccggaagauccagcugcacuccagccaggugcuccgcaacgccaccggcugccugcggaacgugagcuccgccggcgaggaggcgcgccggcgcaugcgggagugcgacgggcugaccgacgcccuccuguacgucauccagagcgcccugggcuccagcgagaucgacuccaagaccguggagaacugcgugugcauccuccgcaaccugagcuaccggcuggccgccgagacgucccaggggcagcacaugggcaccgacgagcucgacgggcugcugugcggcgaggcgaacggcaaggacgccgagagcuccgggugcuggggcaagaagaagaagaagaagaagagccaggaccagugggacggggucggcccccuccccgacugcgccgagccgcccaaggggauccagaugcuguggcaccccuccaucgugaagcccuaccugacccuccugagcgagugcuccaacccggacacccuggagggcgccgcgggcgcccuccagaaccuggccgccgggagcuggaagugguccgucuacauccgcgccgcggugcggaaggagaagggccugcccauccucguggagcugcugcgcaucgacaacgaccgcgucgugugcgccguggccaccgcccuccggaacauggcccuggacguccgcaacaaggagcugaucgggaaguacgcgaugcgggaccucgugcaccgccugcccggcgggaacaacagcaacaacacggccuccaaggccaugagcgacgacaccgugaccgccgucugcugcacccugcacgaggugaucacgaagaacauggagaacgccaaggcgcuccgggacgccggcggcaucgagaagcugguggggaucuccaagagcaagggcgacaagcacagccccaaggucgugaaggccgccucccaggugcugaacagcauguggcaguaccgcgaccuccggucccuguacaagaaggacggguggagccaguaccacuucgucgccuccagcuccaccaucgagcgcgaccggcagcgcccguacagcuccagccggacccccuccaucagccccgugcgcgugucccccaacaaccggagcgcguccgccccggccagcccccgcgagaugaucucccugaaggagcggaagaccgacuacgagugcacgggcagcaacgccaccuaccacggggcgaagggcgagcacaccucccgcaaggacgccaugaccgcccagaacacgggcaucagcacccucuaccggaacagcuacggggcccccgccgaggacaucaagcacaaccaggucuccgcgcagcccgugccgcaggagcccagccgcaaggacuacgagaccuaccagcccuuccagaacuccacccggaacuacgacgagagcuucuucgaggaccaggugcaccaccgccccccggccuccgaguacacgaugcaccugggccugaagagcaccgggaacuacgucgacuucuacuccgccgcccggcccuacagcgagcucaacuacgagaccucccacuaccccgccagcccggacuccuggguguga

SEQ ID NO: 28822 - RNA, 1203 nt, Artificial Sequence
  derived and/or modified sequence opt1 from CTNS__Homo_sapiens__NP_001026851
augauccgcaacuggcugaccaucuucauccucuucccccugaagcugguggagaagugcgagagcuccgucagccucaccgugccgcccguggucaagcuggagaacggcuccagcacgaacgugucccugacccuccggccgccccugaacgccacccuggugaucaccuucgagaucacguuccgcagcaagaacaucaccauccucgagcugccggacgaggucguggugccgcccggggucaccaacuccagcuuccaggugaccucccagaacgugggccagcugacggucuaccuccacgggaaccacagcaaccagaccggcccccggauccgcuuccuggugauccgguccagcgccaucuccaucaucaaccaggugaucggguggaucuacuucgucgcguggagcaucuccuucuacccccaggugaucaugaacuggcgccggaaguccgugaucggccugagcuucgacuucgucgcccucaaccugaccggcuucguggccuacagcguguucaacaucgggcugcucuggguccccuacaucaaggagcaguuccugcugaaguaccccaacggcgugaaccccgugaacuccaacgacgucuucuucagccuccacgccgugguccugacccugaucaucaucgugcagugcugccucuacgagcgcgggggccagcgggugagcuggcccgccaucggguuccugguccuggcguggcuguucgccuucgugacgaugaucguggccgccgucggcgugaccaccuggcuccaguuccuguucugcuucuccuacaucaagcucgcggugacccuggucaaguacuucccccaggccuacaugaacuucuacuacaagagcacggagggcugguccaucgggaacgugcugcucgacuucaccggcgggagcuucucccugcugcagauguuccuccagagcuacaacaacgaccaguggacccugaucuucggcgaccccaccaaguucggccuggggguguucuccaucgucuucgacgugguguucuucauccagcacuucugccucuaccgcaagcggcccggccugcaggccgcccgcacggggagcggcucccggcugcgccaggacugggccccgagccuccagcccaaggcgcugccccagaccaccuccgucagcgccuccagccugaagggguga

SEQ ID NO: 28823 - RNA, 1308 nt, Artificial Sequence
  derived and/or modified sequence opt1 from CTPS1__Homo_sapiens__NP_001288166
augcccuucaucgaggccuuccgccaguuccaguucaaggugaagcgggagaacuucugcaacauccacgucagccuggugccgcagcccuccagcaccggcgagcagaagaccaagcccacgcagaacuccgugcgcgagcuccgggggcugggccugagccccgaccucgucgugugccgcugcuccaacccgcuggacaccagcgugaaggagaagaucuccauguucugccacgucgagcccgagcaggucaucugcgugcacgacgugagcuccaucuaccgggugccccugcuccuggaggagcaggggguggucgacuacuuccugcgccggcucgaccugcccaucgagcgccagccgcggaagaugcugaugaaguggaaggagauggccgaccgcuacgaccggcuccuggagaccugcagcaucgcgcuggugggcaaguacaccaaguucuccgacagcuacgccuccgugaucaaggcccucgagcacagcgcccuggccaucaaccacaagcuggagaucaaguacaucgacuccgcggaccucgagcccaucacgagccaggaggagcccguccgcuaccacgaggccuggcagaagcugugcuccgcccacggggugcuggugcccggcggcuucgggguccggggcaccgaggggaagauccaggccaucgcgugggcccgcaaccagaagaagccguuccucggcgugugccuggggaugcagcuggccguggucgaguucagccggaacgugcucggcuggcaggacgccaacuccaccgaguucgaccccaccacgagccaccccguggucguggacaugcccgagcacaacccgggccagaugggcgggaccaugcgccuggggaagcggcgcacccuguuccagaccaagaacagcgucaugcggaagcucuacggcgacgccgacuaccuggaggagcgccaccggcaccgcuucgaggugaaccccguguggaagaagugccuggaggagcagggccucaaguucgucgggcaggacguggagggcgagcgcauggagaucguggagcuggaggaccaccccuucuucgucggggugcaguaccaccccgaguuccugucccggccgaucaagcccagcccgcccuacuucggccuccugcuggcguccguggggcgccucagccacuaccugcagaagggcugccggcugagcccccgcgacacguacuccgaccgguccggcagcuccagccccgacuccgagaucaccgagcucaaguuccccagcaucaaccacgacuga

SEQ ID NO: 28824 - RNA, 3522 nt, Artificial Sequence
  derived and/or modified sequence opt1 from CTR9__Homo_sapiens__NP_055448
augagccgcggcuccaucgagaucccccugcgggacaccgacgaggugaucgagcucgacuucgaccagcugccggagggggacgaggucaucagcauccugaagcaggagcacacccagcuccacaucuggaucgcccuggcccuggaguacuacaagcagggcaagacggaggaguucgugaagcuccuggaggcggcccgcaucgacgggaaccuggacuaccgggaccacgagaaggaccagaugaccugccucgacacccuggccgccuacuacgugcagcaggcccgcaaggagaagaacaaggacaacaagaaggaccugaucacccaggcgacgcuccuguacaccauggccgacaagaucaucauguacgaccagaaccaccuccugggccgggccugcuucugccugcuggagggggacaagauggaccaggccgacgcgcaguuccacuucguccucaaccagucccccaacaacauccccgcccugcugggcaaggccugcaucagcuucaacaagaaggacuaccgcggcgcccucgccuacuacaagaaggcgcugcggaccaaccccgggugcccggccgaggugcgccugggcauggggcacugcuucgugaagcucaacaagcuggagaaggcccggcuggccuucucccgcgcccucgagcugaacagcaagugcgucggcgcgcugguggggcucgccgugcuggagcugaacaacaaggaggccgacuccaucaagaacggcguccagcuccugagccgggccuacaccaucgaccccuccaaccccauggugcugaaccaccucgccaaccacuucuucuucaagaaggacuacagcaaggugcagcaccuggcgcugcacgccuuccacaacacggaggucgaggccaugcaggccgaguccugcuaccagcucgcccgcagcuuccacgugcaggaggacuacgaccaggcguuccaguacuacuaccaggccacccaguucgccuccagcuccuucgugcugcccuucuucggccuggggcagauguacaucuaccggggcgacaaggagaacgccagccagugcuucgagaagguccucaaggcguacccgaacaacuacgagaccaugaagauccuggggucccuguacgccgccagcgaggaccaggagaagcgcgacaucgccaagggccaccucaagaaggugaccgagcaguaccccgacgacguggaggccuggaucgagcuggcgcagauccuggagcagacggacauccagggcgcccucuccgccuacgggaccgccacccggauccugcaggagaagguccaggccgacgugccgcccgagauccugaacaacgugggcgcgcugcacuuccgccucgggaaccugggcgaggccaagaaguacuuccuggccagccucgaccgggccaaggccgaggcggagcacgacgagcacuacuacaacgccaucagcgucaccacguccuacaaccuggcccgccuguacgaggccaugugcgaguuccacgaggcggagaagcucuacaagaacauccugcgggagcaccccaacuacguggacugcuaccugcgccucggggccauggcccgggacaagggcaacuucuacgaggccagcgacugguucaaggaggcccugcagaucaaccaggaccaccccgacgcguggucccugaucggcaaccuccaccuggccaagcaggagugggggcccggccagaagaaguucgagcgcauccugaagcagcccagcacccaguccgacaccuacagcaugcucgcccuggggaacguguggcugcagacccuccaccagccgacgcgcgaccgggagaaggagaagcgccaccaggaccgggcccuggccaucuacaagcagguccugcgcaacgacgcgaagaaccucuacgccgccaacggcaucggggccgugcuggcccacaagggcuacuuccgggaggcgcgcgacgucuucgcccaggugcgggaggccaccgccgacaucuccgacguguggcugaaccucgcgcacaucuacgucgagcagaagcaguacaucagcgccgugcagauguacgagaacugccugcgcaaguucuacaagcaccagaacaccgaggugguccuguaccucgcccgggcccuguucaagugcggcaagcugcaggagugcaagcagacccuccugaaggcccgccacguggcgcccuccgacacggugcugauguucaacgucgcccucgugcugcagcggcuggccaccagcgugcucaaggacgagaaguccaaccugaaggagguccugaacgccgugaaggagcucgagcuggcccaccgcuacuucagcuaccuguccaaggugggggacaagaugcgguucgaccucgcgcuggccgccaccgaggcccgccagugcagcgaccugcucucccaggcccaguaccacgucgcgcgggcccgcaagcaggacgaggaggagcgggagcugcgcgccaagcaggagcaggagaaggagcugcuccggcagaagcugcugaaggagcaggaggagaagcgccuccgcgagaaggaggagcagaagaagcugcuggagcagcgggcccaguacguggagaagaccaagaacauccucauguucacgggcgagaccgaggccaccaaggagaagaagcgcgggggcgggggcggccggcgcagcaagaagggcggggaguucgacgaguucgugaacgacgacaccgacgacgaccugcccaucuccaagaagaagaagcggcgcaaggggagcggcuccgagcaggagggcgaggacgaggagggcggggagcggaagaagaagaagcgccggcgccaccccaagggggaggagggcagcgacgacgacgagacggagaacgggccgaagcccaagaagcggcgcccgcccaaggcggagaagaagaaggcccccaagcccgagcggcugccgcccagcaugaagggcaagaucaaguccaaggccaucaucagcuccagcgacgacuccagcgacgaggacaagcucaagaucgccgacgagggccacccccgcaacuccaacagcaacuccgacagcgacgaggacgagcagcggaagaagugcgcguccagcgaguccgacagcgacgagaaccagaacaaguccgggagcgaggccggcagcccccgccggccccgccggcagcgcuccgaccaggacagcgacuccgaccagccgagccggaagcgccgccccuccgggagcgagcaguccgacaacgagagcguccaguccggccggagccacuccggggugagcgagaacgacucccgccccgccagccccuccgccgagagcgaccacgaguccgagcggggcagcgacaacgagggcuccgggcagggcagcgggaacgaguccgagccggagggcagcaacaacgaggccagcgaccgcggguccgagcacggcagcgacgacuccgacuga

SEQ ID NO: 28825 - RNA, 792 nt, Artificial Sequence
  derived and/or modified sequence opt1 from CTRB1__Homo_sapiens__NP_001897
auggccagccuguggcuccuguccugcuucagccuggugggcgccgcguucgggugcggcguccccgccauccacccggugcucuccgggcugagccgcaucgugaacggcgaggacgccguccccggguccuggcccuggcaggucagccugcaggacaagaccggcuuccacuucugcggcgggucccucaucagcgaggacuggguggugaccgccgcccacugcggcgugcggacguccgacguggucguggcgggggaguucgaccagggcagcgacgaggagaacauccaggugcugaagaucgccaaggucuucaagaaccccaaguucuccauccugaccgugaacaacgacaucacccuccugaagcuggccaccccggcccgcuucagccagacgguguccgcggucugccuccccagcgccgacgacgacuuccccgccgggacccugugcgccaccaccggcuggggcaagacgaaguacaacgccaacaagacccccgacaagcugcagcaggcggcccucccgcugcuguccaacgccgagugcaagaaguccugggggcggcgcaucaccgacgugaugaucugcgccggcgccagcggggugagcuccugcaugggcgacagcggcgggccccucgucugccagaaggacggcgcguggacccugguggggaucgugagcuggggcuccgacacgugcagcaccuccagccccggggucuacgcccgggugaccaagcugauccccugggugcagaagauccucgccgccaacuga

SEQ ID NO: 28826 - RNA, 792 nt, Artificial Sequence
  derived and/or modified sequence opt1 from CTRB2__Homo_sapiens__NP_001020371
auggccuuccuguggcuccugagcugcugggcccugcucggcaccaccuucgggugcggcgugcccgcgauccacccgguccuguccgggcugagccgcaucgugaacggcgaggacgccgugcccggguccuggcccuggcaggucagccuccaggacaagacgggcuuccacuucugcggcgggucccugaucagcgaggacuggguggugaccgccgcccacugcggcguccggaccuccgacgugguggucgccggggaguucgaccagggcagcgacgaggagaacauccaggugcugaagaucgcgaagguguucaagaaccccaaguucuccauccucaccgucaacaacgacaucacgcugcugaagcucgccaccccggcccgcuucagccagaccguguccgccgugugccugcccagcgcggacgacgacuuccccgccgggacccugugcgccacgaccggcuggggcaagaccaaguacaacgccaacaagacccccgacaagcuccagcaggccgcgcugccgcugcucuccaacgccgagugcaagaaguccugggggcggcgcaucacggacgucaugaucugcgccggcgccagcggggugagcuccugcaugggcgacagcggcgggccccuggugugccagaaggacggcgccuggacccuggucgggaucguguccuggggcagccggaccugcagcaccacgacccccgcgguguacgcccgcgucgccaagcucauccccugggugcagaagauccuggccgccaacuga

SEQ ID NO: 28827 - RNA, 843 nt, Artificial Sequence
  derived and/or modified sequence opt1 from CTRC__Homo_sapiens__XP_011538852
augcugggcaucaccgugcucgccgcccugcuggcgugcgccagcuccugcgggguccccagcuucccgcccaaccucuccgcccgcguggugggcggggaggacgcccggccccacagcuggcccuggcagaucucccugcaguaccugaagaacgacaccuggcgccacacgugcggcgggacccucaucgccagcaacuucguccugaccgcggcccacugcaucuccaacacccggacguaccgcguggccgugggcaagaacaaccuggaggucgaggacgaggagggcagccucuucguggggguggacaccauccacguccacaagcgguggaacgcccugcugcuccgcaacgacaucgcgcugaucaagcuggccgagcacguggagcucuccgacaccauccagguggccugccugccggagaaggacagccugcuccccaaggacuaccccugcuacgucaccggcugggggcggcuguggcgcggccugcgguggcccacggagcucccggugggggagcgcuuccugggcggcguguggcaccggcagcuguggcuccccgccgggcugcagcacccccaggaggccggcucccugcaccccgggguccgccuccaccggcuggaccagcgcgagaacgcggccgugaucugcugcugggagcggcgccagcgggugccggccaccgccaucaacuuccugcuccugggcccgcccggcagccugaucugcgccgcguccgucgccagccuccuguccggggccgcccccuuccacaccauggagcccaagcgcgaccccacccagcccgugagccccacgcugcacuga

SEQ ID NO: 28828 - RNA, 795 nt, Artificial Sequence
  derived and/or modified sequence opt1 from CTRL__Homo_sapiens__NP_001898
augcugcuccugagccugacccucucccuggugcugcucggcagcuccugggggugcggcauccccgccaucaagccggcccugagcuucucccagcgcaucgucaacggggagaacgcggugcugggcagcuggcccuggcaggucucccuccaggacagcuccggguuccacuucugcggcggcagccugaucucccagagcuggguggugaccgccgcccacugcaacgugucccccgggcggcacuucgucgugcugggcgaguacgaccgcagcuccaacgccgagccccuccaggugcugagcgucucccgggccaucacgcacccgagcuggaacuccaccaccaugaacaacgacgugacccugcucaagcuggcgagccccgcccaguacacgacccgcaucagccccgugugccuggccuccagcaacgaggcccucaccgaggggcugaccugcgucacgaccggcugggggcggcuguccggcgugggcaacgugacccccgcgcaccuccagcaggucgcccugccgcuggugaccgugaaccagugccgccaguacugggggagcuccaucacggacagcaugaucugcgccggcggggccggcgccuccagcugccagggcgacuccgggggcccccucgucugccagaaggggaacaccugggugcugaucggcaucgugagcugggggaccaagaacugcaacguccgggcgcccgccguguacacccgcguguccaaguucagcacguggaucaaccaggucaucgccuacaacuga

SEQ ID NO: 28829 - RNA, 1497 nt, Artificial Sequence
  derived and/or modified sequence opt1 from CTSA__Homo_sapiens__NP_000299
augaccagcagcccccgcgccccgcccggcgagcaggggcggggcggggccgagaugauccgcgcggccccgccgccccuguuccuccugcugcuccugcugcuccugcugguguccugggccucccggggcgaggccgcccccgaccaggacgagauccagcgccuccccgggcuggcgaagcagcccagcuuccggcaguacuccggcuaccugaagggcagcggguccaagcaccuccacuacugguucgucgagagccagaaggaccccgagaacucccccguggugcuguggcugaacggcgggcccggcugcagcucccucgacgggcugcugaccgagcacggccccuuccucguccagccggacggcgugacgcuggaguacaaccccuacagcuggaaccugaucgccaacgugcucuaccuggagucccccgccggggucggcuucagcuacuccgacgacaaguucuacgccaccaacgacaccgagguggcgcagagcaacuucgaggcccugcaggacuucuuccgccucuuccccgaguacaagaacaacaagcuguuccugaccggggaguccuacgccggcaucuacaucccgacgcucgccgugcuggucaugcaggaccccagcaugaaccugcagggccucgccguggggaacggccuguccagcuacgagcagaacgacaacagccugguguacuucgcguacuaccacgggcuccugggcaaccggcugugguccagccuccagacccacugcugcucccagaacaagugcaacuucuacgacaacaaggaccuggagugcgucaccaaccugcaggagguggcccgcaucguggggaacagcggccucaacaucuacaaccuguacgcccccugcgccggcgggguccccucccacuuccgguacgagaaggacaccguggugguccaggaccugggcaacaucuucacgcgccucccgcugaagcggauguggcaccaggcccugcuccgcagcggggacaaggugcggauggacccgcccugcaccaacaccaccgcggccuccacguaccugaacaaccccuacgugcgcaaggcccugaacauccccgagcagcucccccagugggacaugugcaacuuccuggucaaccugcaguaccggcgccuguaccggagcaugaacucccaguaccucaagcugcugagcucccagaaguaccagauccuccuguacaacggcgacguggacauggccugcaacuucaugggggacgagugguucguggacagccugaaccagaagauggagguccagcgccggcccuggcucgugaaguacggcgacuccggcgagcagaucgccggguucgucaaggaguucagccacaucgcguuccugaccaucaagggcgccgggcacauggugcccaccgacaagccgcuggccgccuucaccauguucucccgcuuccucaacaagcagcccuacuga

SEQ ID NO: 28830 - RNA, 1020 nt, Artificial Sequence
  derived and/or modified sequence opt1 from CTSB__Homo_sapiens__NP_680093
auguggcagcugugggccagccucugcugccugcuggugcucgccaacgcgcgcucccggcccagcuuccacccgcuguccgacgagcuggucaacuacgugaacaagcgcaacaccaccuggcaggccggccacaacuucuacaacguggacaugagcuaccucaagcggcugugcgggacguuccugggcgggcccaagccgccccagcgcgucauguucaccgaggaccucaagcugcccgccuccuucgacgcccgggagcaguggccccagugccccaccaucaaggagauccgcgaccagggcagcugcggguccugcugggccuucggcgcgguggaggccaucagcgaccggaucugcauccacaccaacgcccacguguccgucgaggugagcgccgaggaccugcucacgugcugcggcuccaugugcggggacggcugcaacgggggcuaccccgcggaggccuggaacuucuggacccgcaaggggcuggugagcggcggccuguacgagucccacgucgggugccggccguacagcaucccgcccugcgagcaccacgugaacggcucccgcccgcccugcaccggggagggcgacacccccaagugcagcaagaucugcgagcccggcuacucccccacguacaagcaggacaagcacuacggguacaacagcuacuccgugagcaacagcgagaaggacaucauggccgagaucuacaagaacggccccgucgagggggccuucuccguguacagcgacuuccuccuguacaaguccggcguguaccagcacgucaccggggagaugaugggcggccacgccauccggauccugggguggggcguggagaacgggacccccuacuggcucguggcgaacagcuggaacaccgacuggggcgacaacggguucuucaagauccugcgcggccaggaccacugcggcaucgaguccgaggucguggccgggaucccccggacggaccaguacugggagaagaucuga

SEQ ID NO: 28831 - RNA, 426 nt, Artificial Sequence
  derived and/or modified sequence opt1 from CTSC__Homo_sapiens__NP_001107645
augggcgccgggcccagccugcuccuggccgcgcugcuccugcugcucuccggcgacggggccgugcgcugcgacaccccggccaacugcaccuaccuggaccugcucggcacgugggucuuccagguggggagcuccggcagccagcgggacgugaacugcuccgucaugggcccccaggagaagaaggugguggucuaccugcagaagcuggacaccgccuacgacgaccucgggaacagcggccacuucaccaucaucuacaaccagggguucgagaucgugcugaacgacuacaagugguucgccuucuucaaggacgugaccgacuucaucucccaccuguucaugcagcucggcacggucgggaucuacgaccugccccaccuccgcaacaagcuggcgaugaaccggcgcuggggcuga

SEQ ID NO: 28832 - RNA, 1239 nt, Artificial Sequence
  derived and/or modified sequence opt1 from CTSD__Homo_sapiens__NP_001900
augcagcccagcucccugcucccccuggcccugugccuccuggccgcgcccgccagcgcccuggugcgcaucccccuccacaaguucaccuccauccggcgcaccaugagcgaggucggcggguccguggaggaccugaucgccaagggccccgugagcaaguacucccaggccgucccggcggugacggaggggcccauccccgaggugcugaagaacuacauggacgcccaguacuacggcgagaucgggaucggcacgcccccgcagugcuucaccgucguguucgacaccggcagcuccaaccucugggugcccagcauccacugcaagcugcuggacaucgccugcuggauccaccacaaguacaacuccgacaagagcuccaccuacgucaagaacgggaccagcuucgacauccacuacggcuccgggagccucuccggcuaccugagccaggacaccguguccgugcccugccagagcgccagcuccgcgagcgcccucgggggcgucaagguggagcgccagguguucggcgaggccaccaagcagcccgggaucacguucaucgccgccaaguucgacggcauccuggggauggcguacccgcggaucuccgucaacaacgugcugcccguguucgacaaccugaugcagcagaagcucgucgaccagaacaucuucagcuucuaccugucccgggaccccgacgcccagcccggcggcgagcugaugcucgggggcaccgacagcaaguacuacaaggggucccugagcuaccugaacgugacccgcaaggccuacuggcagguccaccucgaccagguggagguggccuccggccugacccugugcaaggaggggugcgaggccaucguggacacgggcaccagccucauggucggcccgguggacgagguccgggagcugcagaaggcgaucggggccgugccccugauccagggcgaguacaugauccccugcgagaagguguccacccuccccgccaucacccugaagcucgggggcaagggguacaagcugagcccggaggacuacacgcugaaggucucccaggccggcaagacccugugccucagcggcuucauggggauggacaucccgccgcccuccggcccccuguggauccugggggacguguucaucggccgcuacuacaccguguucgaccgggacaacaaccgcgucggguucgccgaggcggcccggcucuga

SEQ ID NO: 28833 - RNA, 1191 nt, Artificial Sequence
  derived and/or modified sequence opt1 from CTSE__Homo_sapiens__NP_001901
augaagacccugcuccugcugcuccuggugcugcucgagcugggcgaggcccaggggagccugcaccgcgucccccuccggcgccacccgucccugaagaagaagcugcgggcccgcagccagcucuccgaguucuggaagucccacaaccuggacaugauccaguucaccgagagcugcagcauggaccaguccgcgaaggagccccugaucaacuaccucgacauggaguacuucggcacgaucagcaucggguccccgccccagaacuucaccgugaucuucgacaccggcagcuccaaccugugggugcccagcgucuacugcaccucccccgccugcaagacgcacagccgguuccagcccucccagagcuccaccuacagccagcccgggcaguccuucagcauccaguacggcaccggcagccuguccgggaucaucggcgccgaccaggugagcguggaggggcucaccgucgugggccagcaguucggggaguccgugacggagccgggccagaccuucgucgacgccgaguucgacggcauccuggggcugggcuaccccagccucgccgucgggggcgugacccccguguucgacaacaugauggcgcagaaccugguggaccugcccauguucuccguguacaugagcuccaacccggagggcggggccggcagcgagcucaucuucgggggcuacgaccacucccacuucagcgggucccugaacuggguccccgugaccaagcaggccuacuggcagaucgcccuggacaacauccaggugggcggcacggucauguucugcagcgaggggugccaggcgaucguggacaccggcaccucccucaucaccgggcccagcgacaagaucaagcagcugcagaacgccaucggcgccgcccccguggacggggaguacgccgucgagugcgcgaaccugaacgugaugccggacgugacguucaccaucaacggcguccccuacacccucucccccaccgccuacacgcugcuggacuucguggacggcaugcaguucugcagcuccggguuccagggccucgacauccacccgcccgccgggccccuguggauccugggcgacgucuucauccgccaguucuacagcguguucgaccgggggaacaaccgcgugggccucgcccccgccguccccuga

SEQ ID NO: 28834 - RNA, 1455 nt, Artificial Sequence
  derived and/or modified sequence opt1 from CTSF__Homo_sapiens__NP_003784
auggcccccuggcugcagcuccugagccugcucggccugcugccgggggccguggcggcccccgcccagccccgcgccgccuccuuccaggcgugggggcccccgagccccgagcuccuggcccccacccgguucgcccuggagauguucaaccgcgggcgggccgcgggcacccgcgccguccucgggcuggugcggggccgcgugcggcgcgccggccaggggucccuguacagccucgaggccacgcuggaggagcccccgugcaacgaccccauggucugccggcugcccguguccaagaagacccuccugugcagcuuccaggugcuggacgagcucggccgccacguccugcugcggaaggacugcgggcccguggacaccaaggugccgggcgccggggagcccaaguccgcguucacccagggcagcgccaugaucuccagccucucccagaaccaccccgacaaccgcaacgagacguucagcuccgucaucagccugcugaacgaggacccccucucccaggaccugccggugaagauggccagcaucuucaagaacuucgugaucaccuacaaccggaccuacgaguccaaggaggaggcccgcuggcggcugagcgucuucgugaacaacauggugcgcgcccagaagauccaggcgcucgaccggggcaccgcccaguacggggucacgaaguucuccgaccugaccgaggaggaguuccgcaccaucuaccugaacacccuccugcggaaggagcccggcaacaagaugaagcaggccaagagcgugggggaccuggccccgcccgagugggacuggcgcagcaagggcgccgugacgaaggucaaggaccagggcaugugcggguccugcugggcguucagcgugaccggcaacguggaggggcagugguuccucaaccagggcacccugcugucccucagcgagcaggagcugcuggacugcgacaagauggacaaggccugcaugggcggccuccccuccaacgccuacagcgccaucaagaaccugggcgggcuggagaccgaggacgacuacuccuaccagggccacaugcagagcugcaacuucuccgccgagaaggcgaaggucuacaucaacgacagcguggagcucucccagaacgagcagaagcuggccgccuggcuggccaagcgggggcccaucagcguggcgaucaacgccuucggcaugcaguucuaccgccacgggaucucccgcccccuccggccccugugcagcccguggcugaucgaccacgccguccuccuggugggcuacggcaaccgcuccgacguccccuucugggccaucaagaacagcugggggacggacuggggcgagaagggguacuacuaccugcaccggggcuccggggccugcggcgugaacaccauggcgagcuccgccguggucgacuga

SEQ ID NO: 28835 - RNA, 768 nt, Artificial Sequence
  derived and/or modified sequence opt1 from CTSG__Homo_sapiens__NP_001902
augcagccccugcuccugcugcucgccuuccugcugccgaccggcgccgaggcgggggagaucaucggcgggcgcgagagccggccccacucccgccccuacauggccuaccuccagauccagagccccgccggccagucccggugcgggggcuuccuggugcgcgaggacuucguccugaccgccgcccacugcuggggcagcaacaucaacgugacccucggggcgcacaacauccagcggcgcgagaacacccagcagcacaucaccgcccggcgcgccauccggcacccgcaguacaaccagcgcaccauccagaacgacaucaugcugcugcagcucucccggcgcgugcggcgcaaccggaacgucaaccccguggcccugccccgcgcgcaggagggccugcggcccgggacgcucugcaccguggccggcugggggcgcgucagcaugcggcgcggcaccgacacccugcgggaggugcagcugcgcgugcagcgcgaccggcagugccuccgcaucuucggcuccuacgacccgcggcgccagaucugcgucggggaccggcgcgagcggaaggccgccuucaagggcgacagcgggggcccccugcugugcaacaacguggcccacggcaucguguccuacggcaagagcuccggggucccgcccgagguguucacgcgcgugagcuccuuccuccccuggauccggaccaccaugcgcagcuucaagcugcuggaccagauggagacgccccucuga

SEQ ID NO: 28836 - RNA, 1008 nt, Artificial Sequence
  derived and/or modified sequence opt1 from CTSH__Homo_sapiens__NP_004381
augugggccacccugccccuccugugcgccggcgcguggcugcucggggugccggucugcggcgccgccgagcugugcgugaacagccuggagaaguuccacuucaaguccuggaugagcaagcaccgcaagaccuacuccacggaggaguaccaccaccggcuccagaccuucgccagcaacuggcgcaagaucaacgcccacaacaacgggaaccacaccuucaagauggcgcugaaccaguucuccgacaugagcuucgccgagaucaagcacaaguaccugugguccgagccccagaacugcagcgccaccaaguccaacuaccuccggggcacggggcccuacccgcccagcguggacuggcgcaagaagggcaacuucgucucccccgugaagaaccagggcgccugcgggagcugcuggaccuucuccaccaccggcgcgcuggagagcgccaucgccaucgccacggggaagaugcugucccucgccgagcagcagcugguggacugcgcgcaggacuucaacaaccacggcugccagggcgggcugcccagccaggccuucgaguacauccucuacaacaagggcaucaugggggaggacaccuaccccuaccagggcaaggacggguacugcaaguuccagccgggcaaggccaucggcuucgucaaggacguggccaacaucaccaucuacgacgaggaggccaugguggaggcggucgcccuguacaaccccguguccuucgccuucgaggugacccaggacuucaugauguaccggacggggaucuacagcuccaccagcugccacaagacccccgacaaggucaaccacgccgugcuggccgugggcuacggggagaagaacggcauccccuacuggaucgucaagaacagcugggggccgcaguggggcaugaacggcuacuuccucaucgagcgcgggaagaacaugugcggccuggcggccugcgccuccuaccccaucccccugguguga

SEQ ID NO: 28837 - RNA, 1002 nt, Artificial Sequence
  derived and/or modified sequence opt1 from CTSL__Homo_sapiens__XP_005251773
augaaccccacccugauccucgccgccuucugccugggcaucgcgagcgccacccugacguucgaccacucccucgaggcccaguggaccaaguggaaggccaugcacaaccgccuguacgggaugaacgaggagggcuggcggcgcgccgugugggagaagaacaugaagaugaucgagcugcacaaccaggaguaccgggaggggaagcacagcuucaccauggcgaugaacgccuucggcgacaugaccuccgaggaguuccgccaggucaugaacggguuccagaaccggaagccgcgcaagggcaagguguuccaggagccccucuucuacgaggcgccccggagcguggacuggcgcgagaagggcuacgucacgcccgugaagaaccaggggcagugcggcuccugcugggccuucagcgccaccggggcccuggagggccagauguuccggaagaccgggcgccugaucucccucagcgagcagaaccugguggacugcuccggcccgcagggcaacgaggggugcaacggcgggcugauggacuacgccuuccaguacguccaggacaacggcggccucgacagcgaggaguccuaccccuacgaggccaccgaggagagcugcaaguacaaccccaaguacuccguggccaacgacacgggguucguggacauccccaagcaggagaaggcgcugaugaaggccgucgccaccgugggcccgaucagcguggccaucgacgccgggcacgaguccuuccuguucuacaaggagggcaucuacuucgagcccgacugcagcuccgaggacauggaccacgggguccucguggugggcuacggcuucgagagcaccgaguccgacaacaacaaguacuggcuggucaagaacagcuggggcgaggagugggggaugggcggguacgugaagauggcgaaggaccggcgcaaccacugcgggaucgccagcgccgccuccuaccccaccguguga

SEQ ID NO: 28838 - RNA, 966 nt, Artificial Sequence
  derived and/or modified sequence opt1 from CTSO__Homo_sapiens__NP_001325
auggacgugcgcgcccugcccuggcucccguggcugcuguggcuccugugccggggcgggggcgacgccgacagccgcgcgcccuucacccccaccuggccccggucccgcgagcgggaggccgccgccuuccgcgagagccugaaccggcaccgcuaccucaacucccuguucccgagcgagaacuccacggccuucuacgggaucaaccaguucagcuaccuguuccccgaggaguucaaggcgaucuaccuccgguccaagcccagcaaguucccccgcuacuccgccgagguccacaugagcaucccgaacgugucccugccccugcgguucgacuggcgcgacaagcaggucgugacccaggugcggaaccagcagaugugcggcgggugcugggccuucagcguggucggcgccguggaguccgcguacgccaucaagggcaagccccucgaggaccugagcgugcagcaggucaucgacugcuccuacaacaacuacgggugcaacggcgggagcacccugaacgcccucaacuggcugaacaagaugcaggucaagcuggugaaggacuccgaguaccccuucaaggcccagaacggccucugccacuacuucagcgggucccacagcggcuucagcaucaagggcuacuccgccuacgacuucagcgaccaggaggacgagauggcgaaggcccugcugaccuucgggccgcucguggugaucguggacgccgucuccuggcaggacuaccugggcgggaucauccagcaccacugcagcuccggcgaggccaaccacgccgugcugaucacgggcuucgacaagaccgggagcacccccuacuggaucgugcgcaacuccuggggcagcuccuggggcgucgacggguacgcgcacgugaagauggggagcaacgugugcggcaucgccgacuccgucagcuccaucuucguguga

SEQ ID NO: 28839 - RNA, 1005 nt, Artificial Sequence
  derived and/or modified sequence opt1 from CTSV__Homo_sapiens__NP_001188504
augaaccugagccucgugcuggccgccuucugccugggcaucgcguccgccguccccaaguucgaccagaaccucgacaccaagugguaccaguggaaggccacccaccgccggcuguacggggccaacgaggagggcuggcgccgggccgugugggagaagaacaugaagaugaucgagcugcacaacggggaguacagccagggcaagcacggguucacgauggcgaugaacgccuucggcgacaugaccaacgaggaguuccgccagaugaugggcugcuuccggaaccagaaguuccgcaaggggaagguguuccgggagccccucuuccuggaccugccgaaguccgucgacuggcgcaagaagggcuacgugacccccgugaagaaccagaagcagugcgggagcugcugggccuucuccgccaccggcgcgcucgaggggcagauguuccggaagacgggcaagcuggucagccuguccgagcagaaccucguggacugcagccgcccccagggcaaccaggggugcaacggcggguucauggcccgggccuuccaguacgugaaggagaacggcggccuggacuccgaggagagcuacccguacgucgccguggacgagaucugcaaguaccgccccgagaacuccguggccaacgacaccggguucaccgucguggcgcccggcaaggagaaggcccugaugaaggccguggccaccgucgggcccaucagcguggccauggacgcgggccacuccagcuuccaguucuacaaguccgggaucuacuucgagccggacugcagcuccaagaaccucgaccacggcgugcuggucgugggcuacggguucgagggcgccaacagcaacaacuccaaguacuggcuggugaagaacagcugggggcccgaguggggcagcaacggguacgucaagaucgccaaggacaagaacaaccacugcggcaucgccacggccgcguccuaccccaacguguga

SEQ ID NO: 28840 - RNA, 1131 nt, Artificial Sequence
  derived and/or modified sequence opt1 from CTSW__Homo_sapiens__NP_001326
auggcccugaccgcccaccccagcugccuccuggcgcugcucguggccggccuggcccaggggauccgcggcccgcugcgggcccaggaccucgggccccagccccuggagcugaaggaggccuucaagcuguuccagauccaguucaaccgcuccuaccucagccccgaggagcacgcgcaccggcuggacaucuucgcccacaaccucgcccaggcccagcgccugcaggaggaggaccugggcaccgcggaguucggggucacgccguucuccgaccucaccgaggaggaguucggccagcuguacggcuaccggcgcgccgccgggggcgugcccagcauggggcgggagauccgcuccgaggagcccgaggagagcgugcccuucuccugcgacuggcggaaggucgccggcgccaucagcccgaucaaggaccagaagaacugcaacugcugcugggcgauggccgccgccgggaacaucgagacccuguggcgcaucuccuucugggacuucguggacgugagcguccaggagcuccuggacugcggccggugcggcgacgggugccacggcggguucgugugggacgccuucaucaccgugcugaacaacuccggccucgcgagcgagaaggacuaccccuuccagggcaagguccgcgcccaccggugccaccccaagaaguaccagaagguggccuggauccaggacuucaucaugcugcagaacaacgagcaccgcaucgcccaguaccuggccacguacgggcccaucaccgugaccaucaacaugaagccgcuccagcuguaccggaagggcgucaucaaggcgacccccacgaccugcgacccccagcugguggaccacuccgugcuccuggucggguucggcagcgugaaguccgaggaggggaucugggccgagaccgugagcucccagagccagccccagccgccccaccccacccccuacuggauccugaagaacuccuggggcgcccaguggggcgagaagggguacuuccgccuccaccggggcagcaacacgugcgggaucaccaaguucccgcugaccgcccgcguccagaagcccgacaugaagccccgggugagcugcccgcccuga

SEQ ID NO: 28841 - RNA, 912 nt, Artificial Sequence
  derived and/or modified sequence opt1 from CTSZ__Homo_sapiens__NP_001327
auggcccgccggggccccggguggcgcccgcugcuccugcuggugcuccuggccggcgcggcccagggcgggcuguacuuccggcgcgggcagaccugcuaccggccccuccgcggcgacggccuggcgccccuggggcggagcaccuacccccgcccgcacgaguaccucucccccgccgaccugcccaagagcugggacuggcggaacgucgacggcgugaacuacgccuccaucacgcgcaaccagcacaucccccaguacugcgggagcugcugggcccacgccuccaccagcgccauggccgaccggaucaacaucaagcgcaagggcgcguggccguccacccugcucagcgugcagaacgucaucgacugcgggaacgccggcuccugcgagggcgggaacgaccugagcgugugggacuacgcccaccagcacggcauccccgacgagaccugcaacaacuaccaggccaaggaccaggagugcgacaaguucaaccagugcgggacgugcaacgaguucaaggagugccacgccauccggaacuacacccuguggcgcgugggcgacuacggcucccucagcgggcgggagaagaugauggcggagaucuacgccaacggccccaucuccugcgggaucauggccaccgagcgccuggccaacuacaccggcgggaucuacgccgaguaccaggacacgaccuacaucaaccacgucgugagcguggcgggcuggggcaucuccgacgggaccgaguacuggaucguccggaacagcuggggcgagcccuggggcgagcgcggguggcugcggaucgugaccuccacguacaaggacgggaagggcgcccgcuacaaccucgccaucgaggagcacugcaccuucggcgacccgaucguguga

SEQ ID NO: 28842 - RNA, 4992 nt, Artificial Sequence
  derived and/or modified sequence opt1 from CTTNBP2__Homo_sapiens__NP_219499
auggccaccgacggcgccagcugcgagcccgaccugucccgcgcgccggaggacgccgccggggccgccgcggaggccgccaagaaggaguucgacguggacacccucagcaaguccgagcugcggaugcugcucagcgucauggagggcgagcuggaggcccgcgaccuggugaucgaggcgcuccgggcccgccggaaggagguguucauccaggagcgcuacgggcgguucaaccugaacgaccccuuccuggcccuccagcgcgacuacgaggccggcgccggggacaaggagaagaagcccgucugcacgaacccccuguccauccuggaggcggugauggcccacugcaagaagaugcaggagcggaugagcgcccagcucgccgccgcggagucccgccagaagaagcuggagauggagaagcugcagcuccaggcccuggagcaggagcacaagaagcuggccgcccggcucgaggaggagcgcggcaagaacaagcaggucguccugaugcuggugaaggagugcaagcagcucagcggcaaggugaucgaggaggcccagaagcuggaggacgucauggcgaagcuggaggaggagaagaagaagaccaacgagcucgaggaggagcuguccgccgagaagcggcgcagcaccgagauggaggcccagauggagaagcagcuguccgaguucgacaccgagcgggagcagcuccgcgccaagcugaaccgggaggaggcccacacgaccgaccugaaggaggagaucgacaagaugcgcaagaugaucgagcagcucaagcgggggagcgacuccaagccgagccugucccugccccgcaagaccaaggaccggcgccucgugagcaucuccgugggcaccgaggggacggucacccgcagcguggcgugccagaccgaccuggugaccgagaacgccgaccacaugaagaagcugccccucacgaugcccgucaagccguccaccggcagcccccuggugagcgccaacgccaagggguccgugugcaccagcgcgaccauggcccggcccggcaucgaccgccaggccuccuacggcgaccugaucggggccagcguccccgccuucccgccgcccuccgcgaacaagaucgaggagaacggccccagcacgggguccacccccgaccccaccagcuccaccccgccccuccccagcaacgccgccccgcccacggcccagacccccggcaucgcgccccagaacucccaggccccgcccaugcacagccugcacucccccugcgccaacaccagccugcaccccggccucaacccccggauccaggccgcccgcuuccgguuccaggggaacgccaacgaccccgaccagaacggcaacaccacgcaguccccgcccagccgcgacgugucccccaccagccgggacaaccugguggcgaagcagcuggcccgcaacaccgucacccaggcccucucccgguucacgagcccccaggccggggcgccgagccgccccggcgugccgcccaccggggacgugggcacccacccgcccgucggccggaccucccugaagacgcacgggguggcccgcgucgaccggggcaacccgccgcccaucccgcccaagaagcccgggcugagccagacccccuccccgccccacccccagcucaaggugaucaucgacagcucccgcgccagcaacaccggcgccaagguggacaacaagaccguggccuccacgcccagcucccugccccaggggaaccgggugaucaacgaggagaaccugcccaagagcuccagcccccagcugccgcccaagcccuccaucgaccucaccguggcgcccgccggcugcgccgucagcgcccuggccaccucccaggugggcgcguggcccgccgccacccccgggcugaaccagcccgccugcagcgacuccagccucgugauccccaccacgaucgccuucugcagcuccaucaaccccgucagcgcguccagcugccgccccggcgccuccgacagccugcuggugaccgccuccggguggagccccucccucaccccgcugcugaugagcggcgggcccgcgccccucgccggccggcccacccugcugcagcaggccgccgcccagggcaacgugacgcuccuguccaugcugcucaacgaggaggggcuggacaucaacuacagcugcgaggacggccacuccgcccuguacagcgcggccaagaacgggcacaccgacugcguccgccuccugcuguccgccgaggcccaggugaacgccgcggacaagaacggcuucaccccgcucugcgccgccgccgcccagggccacuucgagugcguggagcugcugaucagcuacgacgcgaacaucaaccacgccgccgacgggggccagacgccccucuaccuggccugcaagaacgggaacaaggagugcaucaagcugcuccuggaggccggcaccaaccgguccgucaagaccaccgacggguggacccccgugcacgcggccguggacacgggcaacgucgacagccugaagcuccugauguaccaccgcauccccgcccacggcaacuccuucaacgaggaggagagcgagagcuccguguucgaccuggacgggggcgaggagagcccggaggggaucuccaagcccgugguccccgccgaccucaucaaccacgcgaaccgcgagggcuggaccgccgcccacaucgccgccagcaagggguucaagaacugccuggagauccugugccggcacggcggccucgagcccgagcgccgggacaagugcaaccgcaccgugcacgacguggcgaccgacgacugcaagcaccuccuggagaaccugaacgcccugaagaucccgcugcggaucuccgucggggagaucgagcccagcaacuacggcuccgacgaccucgagugcgagaacacgaucugcgcccugaacauccgcaagcagaccagcugggacgacuucuccaaggccgugagccaggcccugaccaaccacuuccaggcgaucuccagcgacgggugguggucccucgaggacgugaccugcaacaacacgaccgacagcaacaucggccuguccgcccggagcauccgcuccaucacccuggggaacguccccuggagcgugggccaguccuucgcccagagccccugggacuucaugcggaagaacaaggccgagcacaucaccgugcuccugagcggcccgcaggaggggugccuguccagcgucacguacgccuccaugaucccccuccagaugaugcagaacuaccugcgccugguggagcaguaccacaacgugaucuuccacggccccgaggggagccuccaggacuacaucguccaccagcuggcgcugugccucaagcaccggcagauggccgccggcuucuccugcgagaucgugcgcgccgagguggacgcgggguucagcaaggagcagcugcuggaccucuucaucuccagcgccugccugauccccgucaagcaguccccgagcaagaagaagaucaucaucauccuggagaaccucgagaaguccagccuguccgagcugcuccgggacuuccuggcgccccuggagaaccgcagcaccgagucccccugcaccuuccagaagggcaacggccucagcgagugcuacuacuuccacgagaacugcuuccugauggggaccaucgccaaggccugccugcagggcuccgaccuccuggugcagcagcacuuccggugggugcagcugcgcugggacggggagccgaugcagggccuccugcagcgguuccugcgccggaaggucgugaacaaguucaagggccaggcccccagccccugcgaccccgugugcaagaucgucgacugggcccucuccguguggcgccagcugaacagcugccuggcccggcucgggacgccggaggcccugcugggccccaaguacuuccucagcugccccgugguccccgggcacgcccaggugaccgugaaguggauguccaagcuguggaacggcgucaucgcgccgcgcgugcaggaggccauccugagccgcgccuccgugaagcggcagcccggguucggccagaccaccgccaagcgccaccccagccagggccagcaggccgucgugaaggcggcccucuccauccugcugaacaaggccguccuccacgggugcccccugccgcgggccgagcuggaccagcacacggcggacuucaagggcgggagcuucccccucuccaucgugagcuccuacaacacgugcaacaagaagaagggcgagagcggggccuggcgcaaggugaacaccagcccccggcgcaaguccggccgguucucccugcccaccuggaacaagccggaccugagcaccgagggcaugaagaacaagaccaucucccagcugaacugcaaccgcaacgccagccucuccaagcagaagucccuggagaacgaccugagccucacccugaaccuggaccagcggcucagccuggggagcgacgacgaggccgaccuggucaaggagcuccaguccaugugcagcuccaagagcgaguccgacaucagcaagaucgccgacucccgcgacgaccugcggauguucgacagcuccggcaacaaccccgugcugagcgcgaccaucaacaaccuccgcaugcccgugucccagaaggaggucagcccccuguccagccaccagaccacggagugcuccaacagcaaguccaagaccgagcugggggugagccgggugaaguccuuccucccggucccccgcagcaaggugacccagugcagccagaacaccaagcgguccagcuccagcuccaacacgcgccagaucgagaucaacaacaacagcaaggaggugaacuggaaccugcacaagaacgagcaccuggagaagcccaacaaguga

SEQ ID NO: 28843 - RNA, 1905 nt, Artificial Sequence
  derived and/or modified sequence opt1 from CTTN__Homo_sapiens__NP_001171669
auguggaaggccagcgccggccacgcgguguccaucgcccaggacgacgccggggccgacgacugggagaccgaccccgacuucgucaacgacgugagcgagaaggagcagcgcuggggcgccaagaccgugcagggguccggccaccaggagcacaucaacauccacaagcugcgggagaacgucuuccaggagcaccagacgcucaaggagaaggagcuggagaccgggccgaaggcgagccacggcuacggcgggaaguucggcguggagcaggaccgcauggacaaguccgccguggggcacgaguaccagagcaagcuguccaagcacugcagccaggucgacuccgugcggggcuucgggggcaaguucggcgugcagauggaccgcgucgaccagagcgccgugggguucgaguaccagggcaagaccgagaagcacgccucccagaaggacuacagcuccggguucggcggcaaguacggggugcaggcggaccgggucgacaagagcgccgugggcuucgacuaccaggggaagaccgagaagcacgagucccagcgcgacuacagcaagggcuucgggggcaaguacggcaucgacaaggacaagguggacaaguccgccgucggguucgaguaccagggcaagacggagaagcacgagagccagaaggacuacgugaagggguucggcgggaaguucggcgugcagaccgaccggcaggacaagugcgcccucggcugggaccaccaggagaagcugcagcugcacgagucccagaaggacuacagcaagggguucggcgggaaguacggcguccagaaggaccgcauggacaagaacgccagcaccuucgaggacgugacccagguguccagcgcguaccagaagacgguccccguggaggccgugaccuccaagaccagcaacauccgggccaacuucgagaaccucgccaaggagaaggagcaggaggaccgccggaaggccgaggcggagcgcgcccagcggauggccaaggagcgccaggagcaggaggaggcccggcgcaagcuggaggagcaggcccgggcgaagacccagacgccgcccgucucccccgcgccccagcccaccgaggagcgccugcccagcuccccgguguacgaggacgccgccagcuucaaggccgagcucuccuaccgggggcccgucagcggcaccgagcccgagcccguguacuccauggaggccgccgacuaccgcgaggccagcucccagcagggccuggccuacgcgaccgaggccguguacgagagcgccgaggccccggggcacuaccccgccgaggacuccacguacgacgaguacgagaacgaccugggcaucaccgcggucgcccucuacgacuaccaggccgccggggacgacgagaucagcuucgaccccgacgacaucaucaccaacaucgagaugaucgacgacggcugguggcggggcgugugcaaggggcgcuuccgcgagcuggccuucuccugcgugcgggucgcgcuggugcccaucaagugcagccgcgaccucccgggccaggcccgggggcugcgcuccgcccuguggcgggugggccgcaaggacugcccccggcgcggggccagcagccgggucucccuccugggccgccggggccuggggcucauggaggugaaccccgagcugagccaccccgagcaccgcuccugccacgugcggugggagaucugccugugccacaccgucacggcccgccggauccgcaagcucaucagcuuccugcggucccgcgaggcgggcccggugcccagcugcucccaggucgggggcgugagcuuccagaaggugaccuggaagugccuggggaccugggugcccgagugccccuga

SEQ ID NO: 28844 - RNA, 1047 nt, Artificial Sequence
  derived and/or modified sequence opt1 from CTU1__Homo_sapiens__NP_660275
augcccgccccgcccugcgccagcugccacgcggcccgcgccgcccugcggcgcccccucuccggccaggcccugugcggggcgugcuucugcgccgccuucgaggccgaggugcugcacaccguccucgcgggccggcugcugcccccgggggccgugguggccgucggcgccagcgggggcaaggacuccaccgugcucgcccacgugcugcgcgcgcuggcgccccggcucggcaucagccugcagcuggucgccguggacgaggggaucggcggguaccgcgacgccgcccucgccgccgugcggcgccaggccgcccggugggagcugccccugacggucguggccuacgaggaccucuucggcggguggaccauggacgcgguggcccgcuccaccgccggcagcggccggucccgcagcugcugcaccuucugcgggguccugcggcgccgggcccuggaggagggcgcccgccgggugggggcgacgcacaucgugaccggccacaacgccgacgacauggccgagaccguccucaugaacuuccugcgcggcgacgccgggcggcuggcgcgcggcgggggccucgggucccccggcgagggcggggcccugccgcggugccgcccccugcaguucgccagccagaaggagguggugcucuacgcccacuuccgccggcuggacuacuucuccgaggagugcgucuacgcccccgaggcguuccgcggccacgcccgggaccugcucaagcgccuggaggccgcccggcccagcgccgugcuggaccucgugcacuccgcggagcgccuggcccuggccccggccgcccggccgccccgccccggggcgugcagccggugcggcgcccucgccucccgcgcccugugccaggcgugcgcccugcucgacgggcugaaccggggccgcccccggcuggccaucggcaaggggcgccggggccucgacgaggaggccacccccgggacgcccggcgaccccgcccgcccgcccgcgagcaaggccguccccaccuucuga

SEQ ID NO: 28845 - RNA, 246 nt, Artificial Sequence
  derived and/or modified sequence opt1 from CTXN3__Homo_sapiens__NP_001041717
auggacggcgggcagcccaucccgagcucccuggugccccucggcaacgagagcgccgacuccagcaugucccuggagcagaagaugaccuucgucuucgugauccuccuguucaucuuccuggggauccugaucgugcgcugcuuccggauccuccuggaccccuaccgcagcaugcccaccuccacgugggccgacggccuggaggggcucgagaagggccaguucgaccacgcgcuggccuga

SEQ ID NO: 28846 - RNA, 10872 nt, Artificial Sequence
  derived and/or modified sequence opt1 from CUBN__Homo_sapiens__NP_001072
augaugaacaugagccugcccuuccucuggucccugcugacccuccugaucuucgccgaggugaacggcgaggccggggagcuggagcuccagcgccagaagcggagcaucaaccugcagcagccgcgcauggcgaccgagcggggcaaccuggucuuccucacgggguccgcccagaacaucgaguuccgcaccggcagccuggggaagaucaagcugaacgacgaggaccucuccgagugccugcaccagauccagaagaacaaggaggacaucaucgagcugaagggcagcgccaucggccucccccagaacaucuccagccagaucuaccagcugaacuccaagcugguggaccucgagcggaaguuccaggggcugcagcagaccguggacaagaaggucugcagcuccaaccccugccagaacggcgggaccugccugaaccuccacgacagcuucuucugcaucugccccccgcaguggaagggcccccugugcuccgccgacgugaacgagugcgagaucuacagcgggacgccccuguccugccagaacggcggcaccugcgugaacaccauggggagcuacuccugccacugccccccggagaccuacggcccccagugcgccagcaaguacgacgacugcgaggggggcuccgucgcgcgcugcgugcacggcaucugcgaggaccucaugcgggagcaggccggggagcccaaguacagcugcgugugcgacgccggcuggauguucagccccaacuccccggccugcacgcuggaccgcgacgagugcagcuuccagcccgggcccugcuccacccugguccagugcuucaacacccagggcagcuucuacugcggggcgugccccaccggcuggcagggcaacggguacaucugcgaggacaucaacgagugcgagaucaacaacggcgggugcuccguggccccgcccguggagugcgucaacacgcccggcagcucccacugccaggccugccccccgggguaccagggcgacggccgggugugcacccucaccgacaucugcagcguguccaacgggggcugccaccccgacgccagcugcuccagcacccuggggucccugccccucugcacgugccugcccggcuacaccgggaacggcuacggcccgaacgggugcguccagcugagcaacaucugccucucccaccccugccugaacggccagugcaucgacaccgugagcggguacuucugcaagugcgacuccggcuggaccggcgugaacugcacggagaacaucaacgagugccugagcaaccccugccucaacgggggcaccugcgucgacgggguggacuccuucagcugcgagugcacccgccuguggaccggcgcccugugccaggugccccagcaggucugcggggagagccucuccggcaucaacggcagcuucuccuaccggagcccggacgugggguacgugcacgacgucaacugcuucugggugaucaagacggagaugggcaagguccugcgcaucaccuucaccuucuuccggcuggaguccauggacaacugcccccacgaguuccuccagguguacgacggggacagcuccagcgcguuccagcugggccgcuucugcggguccagccugccccacgagcuccuguccagcgacaacgcccuguacuuccaccucuacuccgagcaccugcggaacggccgcggcuucaccgugcggugggagacgcagcagccggagugcgggggcauccugaccgggcccuacggcagcaucaagucccccggguaccccggcaacuacccgcccggccgcgacugcgucuggaucguggugaccagccccgaccugcucgucaccuucacguucgggacccugucccuggagcaccacgacgacugcaacaaggacuaccucgagauccgggacggcccccuguaccaggacccgcugcucgggaaguucugcaccaccuucagcgugcccccccugcagacgaccggccccuucgcccgcauccacuuccacagcgacucccagaucagcgaccagggguuccacaucaccuaccugaccuccccgagcgaccuccggugcggcggcaacuacaccgaccccgagggggagcuguuccugcccgagcucuccggccccuucacgcacacccgccagugcguguacaugaugaagcagccgcagggggagcagauccagaucaacuucacccacgucgagcugcagugccagagcgacuccagccagaacuacaucgaggugcgcgacggcgagacccugcucggcaaggugugcgggaacggcacgaucucccacaucaagagcaucaccaacuccgucuggauccgguucaagaucgacgccagcguggagaaggccuccuuccgcgcgguguaccaggucgccugcggggacgagcugaccggcgagggggugauccggagccccuucuuccccaacguguaccccggcgagcgcaccugccgguggacgauccaccagccgcagucccaggucauccugcucaacuucaccguguucgagaucggcagcuccgcccacugcgagaccgacuacguggagaucgggagcuccagcauccugggcagccccgagaacaagaaguacugcgggaccgacauccccuccuucaucacgagcgucuacaacuuccuguacgugaccuucgugaaguccagcuccaccgagaaccacggcuucauggccaaguucagcgccgaggaccucgcgugcggggagauccugaccgaguccacgggcaccauccagagccccggccacccgaacgucuacccccacgggaucaacugcaccuggcacauccuggugcagcccaaccaccucauccaccugauguucgagaccuuccaccuggaguuccacuacaacugcacgaacgacuaccucgagguguacgacaccgacuccgagaccagccugggccgcuacugcgggaaguccaucccgcccagccugaccuccagcggcaacucccucaugcuggucuucgugacggacagcgaccuggccuacgagggguuccucaucaacuacgaggccaucuccgccgccaccgcgugccugcaggacuacaccgacgaccugggcaccuucacgagccccaacuuccccaacaacuacccgaacaacugggagugcaucuaccggaucaccgugcgcaccggccagcucaucgccguccacuucaccaacuucucccuggaggaggccaucgggaacuacuacacggacuuccuggagauccgggacggcggguacgagaagagcccccuccugggcaucuucuacggcagcaaccugccccccaccaucaucucccacagcaacaagcucuggcugaaguucaaguccgaccagaucgacacccgcagcggguucuccgccuacugggacggcagcuccaccgggugcggcgggaaccugacgaccagcuccggcaccuucaucagcccgaacuaccccaugcccuacuaccacuccagcgagugcuacugguggcucaaguccagccacggcuccgcguucgagcuggaguucaaggacuuccaccuggagcaccaccccaacugcacccucgacuaccuggccguguacgacgggccgagcuccaacagccaccugcucacccagcugugcggcgacgagaagcccccccugauccgguccagcggggacagcauguucaucaagcuccgcacggacgagggccagcaggggcggggcuucaaggccgaguaccgccagaccugcgagaacguggucaucgugaaccagaccuacggcauccuggaguccaucggguaccccaacccguacagcgagaaccagcacugcaacuggaccauccgggccacgaccggcaacaccgugaacuacaccuuccuggccuucgaccucgagcaccacaucaacugcuccacggacuaccuggagcuguacgacgggccccgccagaugggccgguacugcggggucgaccucccccccccgggcagcaccaccuccagcaagcugcaggugcugcuccugaccgacggcguggggcgccgggagaagggcuuccagaugcagugguucgucuacgggugcggcggggagcuguccggcgcgacgggcagcuucuccagccccggguuccccaaccgcuaccccccgaacaaggagugcaucugguacauccgcaccgaccccggcuccagcauccagcucaccauccacgacuucgacguggaguaccacucccggugcaacuucgacgugcuggagaucuacgggggccccgacuuccacagcccccgcaucgcccagcugugcacccagcgguccccggagaaccccaugcaggucagcuccacgggcaacgagcucgccauccgcuucaagaccgaccugagcaucaacgggcggggcuucaacgccuccuggcaggccgugaccgggggcugcgggggcaucuuccaggcgcccagcggcgagauccacagcccgaacuaccccucccccuaccgcagcaacaccgacugcuccugggugauccgggucgaccgcaaccaccgggugcugcucaacuucacggacuucgaccuggagccccaggacagcugcaucauggccuacgacgggcuguccagcaccaugucccgccucgcccggaccugcggccgcgagcagcuggccaacccgaucgugagcuccgggaacagccuguuccuccgguuccaguccggccccagccgccagaaccggggguuccgcgcccaguuccggcaggcgugcggcggccacauccugaccuccagcuucgacacggucuccagcccccgcuuccccgccaacuacccgaacaaccagaacugcuccuggaucauccaggcccagcccccccugaaccacaucacccucagcuucacccacuucgagcuggagcgguccaccacgugcgcccgcgacuucguggagauccuggacgggggccacgaggacgcgccccuccgggggcgcuacugcggcaccgacaugccgcaccccaucaccagcuucagcuccgcccugacccugcgcuucgugagcgacuccagcaucuccgccgggggcuuccacacgaccgucaccgccagcguguccgccugcggcgggaccuucuacauggcggagggcaucuucaacagccccggguaccccgacaucuacccgcccaacgucgagugcguguggaacaucguguccagccccggcaaccggcuccagcuguccuucaucagcuuccagcuggaggacucccaggacugcagccgcgacuucgucgagauccgggaggggaacgccacgggccaccucgugggccgcuacugcgggaacuccuucccccugaacuacagcuccaucgugggccacacccuguggguccgguucaucagcgacgggagcggcuccggcaccggguuccaggccaccuucaugaagaucuucggcaacgacaacaucguggggacccacggcaagguggccagcccguucuggcccgagaacuacccccacaacuccaacuaccaguggacggucaacgugaacgccagccacgugguccacgggcgcauccucgagauggacaucgaggagauccagaacugcuacuacgacaagcugcggaucuacgacggccccuccauccacgcgcgccugaucggcgccuacugcgggacccagaccgagagcuucuccagcaccggcaacucccugacguuccacuucuacagcgacuccagcaucuccgggaagggcuuccuccuggagugguucgccguggacgccccggacggggugcugcccaccaucgcccccggcgcgugcggcggguuccuccggaccggcgacgcccccgucuuccuguucagcccgggguggcccgacuccuacagcaaccgcguggacugcaccuggcugauccaggcccccgacuccacgguggagcucaacauccugagccuggacaucgagucccaccggaccugcgccuacgacagccucgucauccgcgacggcgacaacaaccuggcgcagcagcuggccgugcucugcgggcgggagaucccgggccccauccgcagcaccggcgaguacauguucauccgguucaccuccgacagcuccgugacgcgcgccggguucaacgccagcuuccacaaguccugcggcggguaccugcacgccgaccggggcaucaucaccagccccaaguaccccgagaccuacccguccaaccugaacugcagcuggcacguccucgugcaguccggccugaccaucgcggugcacuucgagcagcccuuccagauccccaacggggacagcuccugcaaccagggcgacuaccugguccuccgcaacgggcccgacaucugcagcccgccccugggcccccccgggggcaacggccacuucugcgggucccacgccagcuccacgcuguucaccagcgacaaccagauguucgugcaguucaucuccgaccacagcaacgagggccagggguucaagaucaaguacgaggccaagucccucgccugcggcgggaacguguacauccacgacgccgacagcgcgggcuacgucaccagcccgaaccacccccacaacuaccccccccacgccgacugcaucuggauccuggccgccccgcccgagacccggauccagcugcaguucgaggaccgcuucgacaucgaggugacgcccaacugcaccuccaacuaccucgagcugcgcgacggcguggacagcgacgcccccauccuguccaaguucugcgggaccagccucccguccagccagugguccagcggcgaggucauguaccugcgguuccgcuccgacaacagccccacccacgugggguucaaggcgaaguacuccaucgcccagugcggcgggcgggugcccggccagagcggcgucguggaguccaucgggcaccccacgcugccguaccgcgacaaccucuucugcgaguggcaccugcagggccugagcgggcacuaccucaccaucuccuucgaggacuucaaccugcagaacagcuccggcugcgagaaggacuucguggagaucugggacaaccacaccagcgggaacauccugggccgguacugcggcaacaccauccccgacuccaucgacacgagcagcaacaccgccgucgugcgcuucgugaccgacggguccgucaccgccagcggcuuccggcuccgcuucgaguccagcauggaggagugcgggggcgaccugcagggcuccaucgggacguucaccagccccaacuacccgaaccccaacccccacggccggaucugcgaguggcgcaucaccgcccccgaggggcggcgcaucacccugauguucaacaaccuccggcuggcgacgcacccguccugcaacaacgagcacgugaucguguucaacggcauccgcagcaacuccccccagcuggagaagcucugcagcuccgucaacgugagcaacgagaucaaguccagcgggaacaccaugaaggugaucuucuucaccgacggcucccggcccuacggcggguucaccgccagcuacacguccagcgaggacgccgucugcggcgggucccugcccaacaccccggagggcaacuucaccagccccggguacgacggcgugcgcaacuacagccggaaccugaacugcgaguggacccucuccaaccccaaccagggcaacagcuccaucagcauccacuucgaggacuucuaccuggagucccaccaggacugccaguucgacgugcuggaguuccgcgucggggacgccgacggcccccucauguggcggcugugcgggccgagcaagcccacccugccccucgugauccccuacucccagguguggauccacuucgucacgaacgagcgcguggagcacaucggcuuccacgcgaaguacagcuucaccgacugcgggggcauccagaucggcgacuccggggucaucaccagcccgaacuaccccaacgccuacgacucccugacccacugcagcucccugcucgaggccccccagggccacacgaucacccugaccuucagcgacuucgacaucgagccccacaccacgugcgccugggacuccgugaccgugcggaacgggggcagcccggagucccccaucaucggccaguacugcgggaacagcaacccccgcaccauccaguccggcagcaaccagcuggucgugaccuucaacagcgaccacucccuccaggggggcggguucuacgccacguggaacacccagacccugggcugcggcgggaucuuccacagcgacaacggcaccauccgcuccccccacuggccgcagaacuuccccgagaacagccggugcuccuggacggcgaucacccacaagagcaagcaccuggagaucuccuucgacaacaacuuccucauccccagcggggacggccagugccagaacuccuucgugaaggucugggccgggaccgaggagguggacaaggcccugcuggccaccggcugcggcaacguggcccccgggccggucaucacgcccagcaacaccuucaccgcgguguuccagucccaggaggcccccgcccagggcuucagcgccuccuucgugagccgcugcggguccaacuucaccggcccgagcggguacaucaucucccccaacuaccccaagcaguacgacaacaacaugaacugcacguacgucaucgaggccaacccccucagcguggugcugcugaccuucgucagcuuccaccucgaggcgcgguccgccgugaccggcagcugcgugaacgacggcguccacaucauccgcggguacuccgugaugagcaccccguucgccacggugugcggcgacgagaugcccgccccccugaccaucgcggggcccguccugcucaacuucuacuccaacgagcagaucaccgacuucggcuucaaguucagcuaccggaucaucuccugcgggggcguguucaacuucagcuccggcaucaucaccagcccggccuacuccuacgccgacuaccccaacgacaugcacugccuguacacgaucaccgugagcgacgacaaggucaucgagcugaaguucuccgacuucgacguggugcccagcaccuccugcagccacgacuaccucgccaucuacgacggggccaacaccuccgacccccugcugggcaaguucugcgggagcaagcgcccgcccaacgucaaguccagcaacaacagcaugcuccugguguucaagacggacuccuuccagaccgcgaagggcuggaagaugagcuuccggcagacccugggcccccagcaggggugcggcggguaccucaccggcuccaacaacaccuucgccagccccgacuccgacagcaacgggauguacgacaagaaccugaacugcguguggaucaucaucgccccggucaacaaggugauccaccugacguucaacaccuucgcccucgaggccgcguccacccgccagcggugccuguacgacuacgugaagcuguacgacggcgacagcgagaacgccaaccucgccggcaccuucugcggguccacgguccccgcccccuucaucagcuccggcaacuuccugaccgugcaguucaucagcgaccugacccucgagcgcgagggguucaacgccaccuacacgaucauggacaugcccugcggcgggaccuacaacgcgaccuggaccccgcagaacaucuccagccccaacuccagcgaccccgacgugcccuucuccaucugcacgugggucaucgacagcccgccccaccagcaggugaagaucaccgugugggcccugcagcugaccucccaggacugcacccagaacuaccuccagcugcaggacagcccccagggccacggcaacagccgguuccaguucugcgggcgcaacgccuccgccguccccguguucuacagcuccaugagcacggcgauggugaucuucaaguccggcgucgugaaccggaacagccgcauguccuucaccuaccagaucgccgacugcaaccgggacuaccacaaggccuucgggaaccugcgcagcccgggcuggcccgacaacuacgacaacgacaaggacugcaccgugacccucacggccccccagaaccacaccaucucccuguucuuccacagccuggggaucgagaacuccgucgagugccggaacgacuuccucgaggugcgcaacggcagcaacuccaacagcccgcugcugggcaaguacugcgggacccuccugcccaaccccguguucucccagaacaacgagcuguaccugcgguucaagagcgacuccgucaccagcgaccgcggcuacgagaucaucuggacguccagccccagcgggugcggcggcacccucuacggggaccgcggcuccuucaccagcccgggguaccccggcaccuaccccaacaacacguacugcgagugggugcugguggcccccgcggggcggcuggucaccaucaacuucuacuucaucuccaucgacgacccgggcgacugcgugcagaacuaccucacccuguacgacggccccaacgccagcucccccagcuccgggcccuacugcggcggggacaccagcaucgccccguucgucgccuccagcaaccagguguucaucaaguuccacgccgacuacgcgcgccggcccuccgccuuccgccugacgugggacagcuga

SEQ ID NO: 28847 - RNA, 1161 nt, Artificial Sequence
  derived and/or modified sequence opt1 from CUEDC1__Homo_sapiens__NP_001278954
augaccagccuguuccgccgguccagcuccggcagcgggggcgggggcaccgccggggcccgcggcggcgggggcgggacggcggcgccccaggagcucaacaacucccggccggcccgccaggugcggcgccuggaguucaaccaggccauggacgacuucaagaccauguuccccaacauggacuacgacaucaucgagugcguccugcgggccaacagcggcgccguggacgccaccaucgaccagcuccugcagaugaaccuggagggcgggggcuccagcgggggcguguacgaggacuccagcgacuccgaggacagcaucccgcccgagauccucgagcgcacccuggagcccgacuccagcgacgaggagcccccgcccgucuacuccccgcccgccuaccacaugcacguguucgaccggcccuacccccuggccccgcccacgcccccgccccgcaucgacgcgcucgggagcggcgcccccaccucccagcggcgcuaccggaacuggaacccgccccugcugggcaaccuccccgacgacuuccugcgcauccugccccagcagcucgacagcauccaggggaacgccggcgggcccaagcccggcuccggggagggcugcccgcccgccauggccggccccgggcccggcgaccaggagagccgguggaagcaguaccuggaggacgagcgcaucgcgcuguuccuccagaacgaggaguucaugaaggagcugcagcggaaccgcgacuuccugcucgcccuggagcgggaccgccugaaguacgagagccagaaguccaagagcuccagcguggccgucgggaacgacuucggcuucuccagccccgugcccgggaccggcgacgccaaccccgccguguccgaggacgcccucuuccgggacaagcugaagcacaugggcaagagcacccgccgcaagcuguucgagcucgcgcgggccuucuccgagaagacgaagaugcgcaagagcaagcggaagcaccuccugaagcaccagucccugggggccgccgcgagcaccgccaaccugcuggacgacgucgagggccacgccugcgacgaggacuuccgcgggcggcgccaggaggccccgaagguggaggagggccuccgggaggggcaguga

SEQ ID NO: 28848 - RNA, 864 nt, Artificial Sequence
  derived and/or modified sequence opt1 from CUEDC2__Homo_sapiens__NP_076945
auggagcuggagcgcaucgugagcgccgcccuccuggcguucguccagacccaccuccccgaggccgaccuguccggccuggacgaggugaucuucagcuacgugcuggggguccucgaggaccugggcccguccgggcccagcgaggagaacuucgacauggaggccuucaccgagaugauggaggccuacgugcccggcuucgcccacaucccccgggggacgaucggcgacaugaugcagaagcuguccggccagcucagcgacgcgcgcaacaaggagaaccugcagccgcaguccagcggggugcagggccagguccccaucucccccgagccccugcagcggccggagaugcucaaggaggagacccgcagcuccgccgccgccgcggccgacacccaggacgaggccaccggggccgaggaggagcugcugcccggcguggacgugcuccuggaggucuuccccacgugcagcguggagcaggcccagugggugcuggcgaaggcccgcggggaccucgaggaggccguccagaugcugguggagggcaaggaggagggccccgccgccugggaggggccgaaccaggaccugccccggcggcuccgcggcccccagaaggacgagcugaaguccuucauccugcagaaguacaugaugguggacagcgcggaggaccagaagauccaccggcccauggccccgaaggaggcccccaagaagcucauccgcuacaucgacaaccaggucguguccaccaagggggagcgguucaaggacgugcgcaaccccgaggccgaggagaugaaggccaccuacaucaaccugaagcccgcgcggaaguaccgcuuccacuga

SEQ ID NO: 28849 - RNA, 2331 nt, Artificial Sequence
  derived and/or modified sequence opt1 from CUL1__Homo_sapiens__XP_011514934
augagcuccacccgcagccagaacccccacggccugaagcagaucgggcucgaccagaucugggacgaccugcgggccggcauccagcaggucuacacccgccaguccauggccaagagccgguacauggagcuguacacgcacguguacaacuacugcaccuccgugcaccagagcaaccaggcgcgcggggccggcgugccgcccuccaagagcaagaaggggcagacccccggcggcgcccaguucgucgggcucgagcuguacaagcggcugaaggaguuccucaagaacuaccugaccaaccugcucaaggacggcgaggaccugauggacgaguccgugcugaaguucuacacgcagcagugggaggacuaccgcuucagcuccaaggugcucaacgggaucugcgccuaccugaaccggcacuggguccgccgggagugcgacgagggccgcaaggggaucuacgagaucuacagccuggcccucgugaccuggcgggacugccuguuccgcccccugaacaagcaggucaccaacgcggugcucaagcugaucgagaaggagcggaacggcgagaccaucaacacgcgccugaucuccggcguggugcagagcuacgucgagcucgggcugaacgaggacgacgccuucgccaagggcccgacccugaccguguacaaggaguccuucgagagccaguuccucgccgacaccgagcgguucuacacgcgcgaguccaccgaguuccugcagcagaaccccgugaccgaguacaugaagaaggcggaggcccggcugcucgaggagcagcgccggguccagguguaccugcacgagagcacccaggacgagcuggcccgcaagugcgagcagguccucaucgagaagcaccuggagaucuuccacacggaguuccagaaccugcucgacgccgacaagaacgaggaccuggggcggauguacaaccuggugucccgcauccaggacggccucggcgagcugaagaagcugcucgagacccacauccacaaccaggggcuggccgcgaucgagaagugcggcgaggccgcccugaacgaccccaagauguacgugcagaccgugcucgacguccacaagaaguacaacgcccuggugaugagcgccuucaacaacgacgcgggguucguggccgcccuggacaaggccugcggccgcuucaucaacaacaacgccgucaccaagauggcgcagagcuccagcaagucccccgagcuccuggcccgguacugcgacagccugcucaagaaguccagcaagaacccggaggaggccgagcuggaggacacgcugaaccaggugauggucguguucaaguacaucgaggacaaggacguguuccagaaguucuacgccaagaugcuggccaagcgccucguccaccagaacuccgcgagcgacgacgccgaggccuccaugaucagcaagcugaagcaggccugcggguucgaguacaccuccaagcugcagcggauguuccaggacaucggcgugagcaaggaccucaacgagcaguucaagaagcaccugaccaacuccgagccccuggaccucgacuucagcauccaggugcuguccagcggcuccuggcccuuccagcagagcugcaccuucgcgcugcccuccgagcucgagcgcagcuaccagcgguucacggccuucuacgccagccgccacuccgggcggaagcugaccuggcuguaccagcucagcaagggcgagcuggucaccaacugcuucaagaaccgcuacacccugcaggccuccacguuccagauggccauccuccugcaguacaacaccgaggacgcguacaccgugcagcagcugaccgacagcacgcagaucaagauggacauccucgcccaggugcugcagauccugcucaaguccaagcugcugguccucgaggacgagaacgccaacguggacgagguggagcugaagccggacacccugaucaagcucuaccugggguacaagaacaagaagcugcgggucaacaucaacgugcccaugaagaccgagcagaagcaggagcaggagaccacgcacaagaacaucgaggaggaccgcaagcuccugauccaggccgccaucgugcggaucaugaagaugcgcaagguccugaagcaccagcagcuccugggcgaggugcugacccagcucagcucccgguucaagccccgcgugcccgucaucaagaagugcaucgacauccugaucgagaaggaguaccuggagcggguggacggggagaaggacaccuacagcuaccucgcguga

SEQ ID NO: 28850 - RNA, 2295 nt, Artificial Sequence
  derived and/or modified sequence opt1 from CUL2__Homo_sapiens__NP_001185707
auguaccgcgugaccuggagcaccuucuggcugcgguuccagcacuacacgugcaccaugucccucaagccccgcgucguggacuucgacgagaccuggaacaagcugcugaccacgaucaaggccguggucaugcucgaguacguggagcgggccaccuggaacgaccgcuucagcgacaucuacgcgcugugcguggccuacccggagccccugggcgagcggcucuacaccgagaccaagaucuuccuggagaaccacguccgccaccuccacaagcgggugcuggaguccgaggagcagguccuggugauguaccaccgcuacugggaggaguacagcaagggggccgacuacauggacugccuguaccgguaccucaacacgcaguucaucaagaagaacaagcugaccgaggccgaccugcaguacggcuacgggggcguggacaugaacgagccccucauggagaucggggagcuggcccuggacauguggcgcaagcucaugguggagccccugcaggcgauccugauccggaugcuccugcgcgagaucaagaacgaccggggcggcgaggacccgaaccagaaggucauccacggggugaucaacuccuucgugcacgucgagcaguacaagaagaaguucccccugaaguucuaccaggagaucuucgagagccccuuccucaccgagaccggcgaguacuacaagcaggaggccuccaaccugcugcaggagagcaacugcucccaguacauggagaaggugcucgggcgccugaaggacgaggagauccggugccgcaaguaccugcaccccagcuccuacacgaaggugauccacgagugccagcagcggauggucgccgaccaccuccaguuccugcacgccgagugccacaacaucauccgccaggagaagaagaacgacauggcgaacauguacgugcugcuccgggccgugagcaccggccugccgcacaugauccaggagcugcagaaccacauccacgacgaggggcuccgcgccaccuccaaccugacccaggagaacaugcccacgcuguucgucgagagcgugcucgaggugcacggcaaguucguccagcugaucaacaccgugcugaacggcgaccagcacuucauguccgcccucgacaaggcccugaccagcgucgugaacuaccgggagcccaaguccgugugcaaggcgcccgagcugcucgccaaguacugcgacaaccugcugaagaaguccgccaaggggaugaccgagaacgaggucgaggaccgccucacgagcuucaucaccguguucaaguacaucgacgacaaggacguguuccagaaguucuacgcccgcaugcuggccaagcggcugauccacggccugagcaugagcauggacuccgaggaggcgaugaucaacaagcucaagcaggccugcggguacgaguucaccagcaagcugcaccgcauguacaccgacauguccgucagcgccgaccugaacaacaaguucaacaacuucaucaagaaccaggacacggugaucgaccucggcaucuccuuccagaucuacgugcugcaggccggcgccuggccgcugacccaggcgcccagcuccaccuucgccaucccccaggagcucgagaaguccguccagauguucgagcuguucuacagccagcacuucagcgggcggaagcugaccuggcuccacuaccugugcacgggcgaggugaagaugaacuaccuggggaagcccuacguggccauggucaccaccuaccagauggccgugcuccuggccuucaacaacuccgagaccgugagcuacaaggagcugcaggacuccacgcagaugaacgagaaggagcucaccaagaccaucaagagccugcuggacgucaagaugaucaaccacgacuccgagaaggaggacaucgacgcggagagcuccuucagccucaacaugaacuucuccagcaagcgcaccaaguucaagaucacgaccagcaugcagaaggacaccccgcaggagauggagcagacccgguccgccguggacgaggaccgcaagauguaccugcaggccgccaucgugcggaucaugaaggcgcgcaagguccugcggcacaacgcccucauccaggaggugaucagccagucccgcgcccgguucaaccccagcaucuccaugaucaagaagugcaucgaggugcugaucgacaagcaguacaucgagcgcagccaggccuccgccgacgaguacagcuacgucgcguga

SEQ ID NO: 28851 - RNA, 2109 nt, Artificial Sequence
  derived and/or modified sequence opt1 from CUL3__Homo_sapiens__NP_001244126
augagcaaccuguccaagggcaccgggagccgcaaggacaccaagaugcggauccgcgccuuccccgugcgggaggacguccucaacucccugaacaacaacuuccugcagacgcucaaccaggccuggaacgaccaccagaccgcgauggugaugauccgcgacauccugauguacauggaccggguguacguccagcagaacaacguggagaacguguacaaccugggccucaucaucuuccgcgaccaggucgugcgguacgggugcauccgcgaccaccuccggcagacccugcuggacaugaucgcccgcgagcggaagggcgagguggucgaccgcggggccauccggaacgccugccagaugcugaugauccugggccucgagggccgcagcguguacgaggaggacuucgaggccccguuccuggagauguccgcggaguucuuccagauggagagccagaaguuccuggccgagaacuccgccagcguguacaucaagaaggucgaggcccggaucaacgaggagaucgagcgcgugaugcacugccucgacaaguccaccgaggagcccaucgugaaggucguggagcgggagcugaucagcaagcacaugaagacgaucguggagauggagaacuccgggcugguccacaugcucaagaacggcaagaccgaggaccuggggugcauguacaagcuguucagccgcgugcccaacggccucaagaccaugugcgagugcauguccagcuaccugcgggagcaggggaaggcgcugguguccgaggagggcgagggcaagaaccccgucgacuacauccaggggcuccuggaccucaagagccgcuucgaccgguuccugcuggaguccuucaacaacgaccgccuguucaagcagaccaucgccggcgacuucgaguacuuccucaaccugaacagccgcuccccggaguaccugagccucuucaucgacgacaagcugaagaagggggugaagggccugacggagcaggagguggagaccauccucgacaaggccaugguccuguuccgguucaugcaggagaaggacguguucgagcgcuacuacaagcagcaccuggcccggcgccuccugaccaacaagagcgucuccgacgacagcgagaagaacaugaucuccaagcugaagaccgagugcggcugccaguucacgagcaagcucgaggggauguuccgggacauguccaucagcaacaccaccauggacgaguuccgccagcaccuccaggccaccggcgugucccucgggggcguggaccugacgguccgggugcugaccaccggguacuggcccacccagagcgcgacgcccaagugcaacaucccgcccgcgccccgccacgccuucgagaucuuccggcgcuucuaccuggccaagcacuccggccggcagcugacccugcagcaccacaugggcagcgccgaccugaacgccaccuucuacgggcccgugaagaaggaggacggcuccgaggucggggugggcggggcccaggugaccggcagcaacacgcgcaagcacauccugcaggucuccaccuuccagaugaccauccucaugcuguucaacaaccgggagaaguacaccuucgaggagauccagcaggagacggacauccccgagcgcgagcuggugcgggcccuccagagccuggccugcggcaagccgacccagcgcgugcugaccaaggagcccaaguccaaggagaucgagaacgggcacaucuucaccgucaacgaccaguucacgagcaagcuccaccgggugaagauccagaccguggccgcgaagcagggcgaguccgaccccgagcgcaaggagacccggcagaaggucgacgacgaccgcaagcacgagaucgaggccgccaucgugcgcaucaugaagucccggaagaagaugcagcacaacgugcuggucgccgaggugacccagcagcugaaggcccgcuuccuccccagcccgguggucaucaagaagcggaucgaggggcugaucgagcgcgaguaccuggcgcggacgcccgaggaccgcaagguguacaccuacguggccuga

SEQ ID NO: 28852 - RNA, 2280 nt, Artificial Sequence
  derived and/or modified sequence opt1 from CUL4A__Homo_sapiens__NP_001008895
auggccgacgaggcgccccgcaagggcagcuucuccgcccugguggggcggaccaacggccucaccaagccggccgcccuggccgccgcgcccgccaagcccgggggcgccgggggcagcaagaagcuggucaucaagaacuuccgcgaccggccccgccucccggacaacuacacgcaggacaccuggcggaagcugcacgaggccgugcgcgcggugcaguccagcaccuccauccgguacaaccuggaggagcucuaccaggccgucgagaaccugugcagccacaaggugucccccaugcuguacaagcagcuccgccaggccugcgaggaccacgugcaggcccagauccugcccuuccgggaggacagccuggacuccguccucuuccugaagaagaucaacacgugcuggcaggaccacugccgccagaugaucaugauccggagcaucuuccuguuccucgaccgcaccuacgugcugcagaacuccacccugcccagcaucugggacaugggccucgagcuguuccggacccacaucaucuccgacaagauggugcagagcaagaccaucgacgggauccugcuccugaucgagcgcgagcgguccggcgaggccgucgaccgcagccugcuccggucccugcuggggaugcucagcgaccuccagguguacaaggacuccuucgagcugaaguuccucgaggagacgaacugccuguacgcggccgagggccagcgccugaugcaggagcgggaggugccggaguaccucaaccacgucagcaagcgccuggaggaggagggggaccgggugaucaccuaccuggaccacagcacccagaagccccucaucgccugcguggagaagcagcugcugggcgagcaccucaccgccauccugcagaagggccuggaccaccuccuggacgagaaccgcguccccgaccuggcccagauguaccagcuguucucccgcgugcgcgggggccagcaggcgcugcugcagcacuggagcgaguacaucaagacguucgggaccgccaucgugaucaaccccgagaaggacaaggacaugguccaggaccuccuggacuucaaggacaagguggaccacgugaucgaggucugcuuccagaagaacgagcgguucgugaaccugaugaaggaguccuucgagaccuucaucaacaagcggccgaacaagcccgccgagcugaucgccaagcacguggacagcaagcuccgcgccggcaacaaggaggcgaccgacgaggagcuggagcggacgcuggacaagaucaugauccucuuccgcuucauccacggcaaggacgucuucgaggccuucuacaagaaggaccuggccaagcggcugcucguggggaaguccgccagcgucgacgccgagaaguccaugcugagcaagcugaagcacgagugcggcgcggccuucaccuccaagcucgaggggauguucaaggacauggagcugagcaaggacaucauggugcacuucaagcagcacaugcagaaccaguccgacagcggccccaucgaccugaccgugaacauccucaccaugggguacuggcccacguacaccccgauggagguccaccugacccccgagaugaucaagcugcaggagguguucaaggccuucuaccucggcaagcacuccggccgcaagcugcaguggcagaccacgcuggggcacgccgugcucaaggcggaguucaaggagggcaagaaggaguuccaggucagccuguuccagacccuggugcuccugauguucaacgagggggacggcuucuccuucgaggagaucaagauggccaccgggaucgaggacagcgagcugcggcgcacccuccagucccuggccugcggcaaggcccgggugcugaucaagagccccaagggcaaggaggucgaggacggggacaaguucaucuucaacggcgaguucaagcacaagcuguuccgcaucaagaucaaccagauccagaugaaggagacgguggaggagcaggucuccaccaccgagcggguguuccaggaccgccaguaccagaucgacgccgcgaucgugcggaucaugaagaugcgcaagacccucgggcacaaccugcucgugagcgagcuguacaaccagcugaaguuccccgucaagccgggcgaccucaagaagcggaucgagagccugaucgaccgcgacuacauggagcgggacaaggacaaccccaaccaguaccacuacguggccuga

SEQ ID NO: 28853 - RNA, 2688 nt, Artificial Sequence
  derived and/or modified sequence opt1 from CUL4B__Homo_sapiens__NP_001073341
auguuccccaccggcuucagcuccccgagccccuccgccgccgcggccgcccaggaggugcgcagcgccaccgacgggaacacguccaccaccccgcccaccagcgccaagaagcggaagcugaacuccagcuccagcuccagcuccaacagcuccaacgagcgcgaggacuucgacagcacguccagcuccagcagcaccccgccccuccagccccgggacuccgcgagccccuccaccagcuccuucugccugggcgucagcguggccgccuccagccacgugcccauccagaagaagcugcgcuucgaggacacccucgaguucgucggguucgacgccaagauggcggaggaguccagcuccagcuccagcuccagcucccccacggccgccaccagccagcagcagcagcugaagaacaaguccauccugaucagcagcguggccuccgugcaccacgccaacggccucgccaagagcuccaccaccgucagcuccuucgcgaacagcaagcccggguccgccaagaagcuggugaucaagaacuucaaggacaagcccaagcugccggagaacuacacggacgagaccuggcagaagcucaaggaggccguggaggccauccagaacagcaccuccaucaaguacaaccuggaggagcuguaccaggcggucgagaaccucugcagcuacaagaucuccgccaaccuguacaagcagcugcggcagaucugcgaggaccacaucaaggcccagauccaccaguuccgcgaggacagccucgacuccgugcuguuccugaagaagaucgaccggugcuggcagaaccacugccgccagaugaucaugauccggagcaucuuccucuuccuggaccgcaccuacgugcugcagaacuccaugcuccccagcaucugggacaugggccuggagcuguuccgggcccacaucaucuccgaccagaagguccagaacaagacgaucgacggcauccuccugcugaucgagcgcgagcggaacggggaggccaucgaccgcagccuccugcggagccugcucuccaugcugagcgaccugcagaucuaccaggacuccuucgagcagcgcuuccucgaggagaccaaccggcuguacgcggccgagggccagaagcugaugcaggagcgcgaggugcccgaguaccuccaccacgugaacaagcggcuggaggaggaggccgaccgccugaucaccuaccucgaccagaccacgcagaagucccugaucgccaccgucgagaagcagcugcucggggagcaccugaccgccauccugcagaagggccucaacaaccugcuggacgagaaccggauccaggaccucagccugcuguaccagcuguucagccgcgugcgcgggggcgugcagguccuccugcagcaguggaucgaguacaucaaggcguucggcuccaccaucgugaucaaccccgagaaggacaagacgauggugcaggagcugcucgacuucaaggacaaggucgaccacaucaucgacaucugcuuccugaagaacgagaaguucaucaacgccaugaaggaggccuucgagaccuucaucaacaagcggccgaacaagcccgccgagcugaucgcgaaguacguggacagcaagcuccgcgccgggaacaaggaggccaccgacgaggagcuggagaagaugcuggacaagaucaugaucaucuuccgguucaucuacggcaaggacguguucgaggccuucuacaagaaggaccucgccaagcgccugcuggucgggaaguccgcgagcguggacgccgagaaguccaugcucagcaagcugaagcacgagugcggcgccgccuucaccuccaagcuggagggcauguucaaggacauggagcucagcaaggacaucaugauccaguucaagcaguacaugcagaaccagaacguccccgggaacaucgagcugacggugaacauccugaccaugggcuacuggcccaccuacgugccgauggagguccaccucccgcccgagauggugaagcugcaggagaucuucaagaccuucuaccuggggaagcacuccggccggaagcuccaguggcagagcacgcuggggcacugcgugcugaaggccgaguucaaggagggcaagaaggagcuccaggucucccuguuccagacccuggugcuccugauguucaacgagggcgaggaguucagccuggaggagaucaagcaggcgaccgggaucgaggacggcgagcuccgccggacccugcagucccuggccugcgggaaggcccgcgugcucgccaagaaccccaagggcaaggacaucgaggacggggacaaguucaucugcaacgacgacuucaagcacaagcuguuccggaucaagaucaaccagauccagaugaaggagacggucgaggagcaggccagcaccaccgagcgcguguuccaggaccggcaguaccagaucgacgcggccaucgugcgcaucaugaagaugcggaagacccugagccacaaccuccuggucuccgagguguacaaccagcugaaguuccccgugaagcccgccgaccucaagaagcgcaucgagagccugaucgaccgggacuacauggagcgcgacaaggagaaccccaaccaguacaacuacaucgccuga

SEQ ID NO: 28854 - RNA, 2343 nt, Artificial Sequence
  derived and/or modified sequence opt1 from CUL5__Homo_sapiens__NP_003469
auggccaccagcaaccugcucaagaacaagggcucccugcaguucgaggacaagugggacuucaugcgccccaucgugcugaagcuccugcggcaggagagcgucaccaagcagcagugguucgaccuguucuccgacgugcacgccgugugccucugggacgacaaggggccggcgaagauccaccaggcccugaaggaggacauccuggaguucaucaagcaggcccaggcccgcguccucagccaccaggacgacacggcccugcugaaggcguacaucguggaguggcggaaguucuucacccagugcgacauccuccccaagcccuucugccagcuggagaucacccugaugggcaagcagggguccaacaagaaguccaacguggaggacagcaucguccgcaagcucaugcuggacaccuggaacgagagcaucuucuccaacaucaagaaccggcugcaggacagcgccaugaagcucgugcacgccgagcgccugggcgaggccuucgacucccagcuggugaucgggguccgggagagcuacgugaaccucugcuccaaccccgaggacaagcugcagaucuaccgcgacaacuucgagaaggcguaccuggacagcacggagcgguucuaccgcacccaggccccguccuaccuccagcagaacggcgugcagaacuacaugaaguacgccgacgccaagcugaaggaggaggagaagcgggcccugcgcuaccucgagacccggcgcgagugcaacagcgucgaggcgcugauggagugcugcgugaacgcccuggugaccuccuucaaggagacgauccucgccgagugccagggcaugaucaagcggaacgagaccgagaagcugcaccugauguucagccucauggacaagguccccaacgggaucgagcccaugcugaaggaccuggaggagcacaucaucuccgccggccucgccgacaugguggcggccgccgagaccaucaccacggacagcgagaaguacguggagcagcugcugacccucuucaaccgcuucagcaagcuggucaaggaggccuuccaggacgacccccgguuccugaccgcccgcgacaaggcguacaaggccguggugaacgacgccaccaucuucaagcucgagcugccgcugaagcagaagggggucggccucaagacgcagcccgaguccaagugccccgagcugcuggccaacuacugcgacaugcuccugcggaagacgccccugagcaagaagcugaccuccgaggagaucgaggccaagcucaaggaggugcugcuggugcucaaguacguccagaacaaggacguguucaugcgcuaccacaaggcgcaccugacccggcgccugauccucgacaucagcgccgacuccgagaucgaggagaacauggucgaguggcugcgcgagguggggaugccggccgacuacgugaacaagcuggcccggauguuccaggacaucaaggucagcgaggaccucaaccaggcguucaaggagaugcacaagaacaacaagcuggcccugcccgccgacuccgugaacaucaagauccucaacgccggcgccuggagccgcuccagcgagaagguguucgucucccugcccaccgagcuggaggaccucauccccgagguggaggaguucuacaagaagaaccacagcggccggaagcugcacuggcaccaccugauguccaacgggaucaucaccuucaagaacgaggugggccaguacgaccucgaggucaccaccuuccagcuggcggugcuguucgccuggaaccagcgcccgcgggagaagaucagcuucgagaaccucaagcuggccacggagcugcccgacgccgagcuccgccggacccuguggucccugguggccuuccccaagcucaagcgccagguccugcuguacgagccccaggugaacagcccgaaggacuucaccgaggggacccucuucuccgugaaccaggaguucagccugaucaagaacgcgaagguccagaagcggggcaagaucaaccugaucggccgccuccagcugacgaccgagcggaugcgcgaggaggagaacgaggggaucgugcagcugcggauccuccgcacccaggaggccaucauccagaucaugaagaugcggaagaagaucuccaacgcccagcugcagaccgagcugguggagauccucaagaacauguuccugccccagaagaagaugaucaaggagcagaucgaguggcugaucgagcacaaguacauccgccgggacgagagcgacaucaacacguucaucuacauggccuga

SEQ ID NO: 28855 - RNA, 5349 nt, Artificial Sequence
  derived and/or modified sequence opt1 from CUL7__Homo_sapiens__NP_001161842
augagccgcggguucuggcuggccgagccccucgccgggaccggcccccaccccgcccccguggccgccgacucccgggggugcagcuccgucccccgccggcacgcccccagccgccuguccgugagcacccccucccggggccccggggcccgcauggugggcgagcugcgguaccgcgaguuccgggucccccucggcccggggcugcacgcguaccccgacgagcugauccgccagcgggugggccacgacgggcaccccgaguaccagauccgcuggcucauccugcggcgcggcgacgagggggacggcggcagcggccagguggacugcaaggccgagcacauccugcucuggauguccaaggacgagaucuacgccaacugccacaagaugcugggcgaggacgggcaggucaucggccccagccaggaguccgccggcgaggugggggcccuggacaagagcgugcucgaggagauggagaccgacgucaagucccugauccagcgggcccugcgccagcucgaggagugcgugggcaccaucccgcccgcgccccuccugcacaccgugcacguccucagcgccuacgccuccaucgagccccugaccgggguguucaaggacccgcgggugcuggaccuccugaugcacaugcugagcucccccgacuaccagauccgcuggagcgcgggccggaugauccaggcccucuccagccacgacgccggggagggccagugcggcgaggaggggaaggccggcgaggggcugggccgccugcgggacagccaggacacggucgccggggcguccgaccucauccgcacccgcacccagauccugcugagccucucccagcaggaggccaucgagaagcaccuggacuucgacagccggugcgcccugcucgcccuguucgcccaggcgacccuguccgagcaccccaugagcuucgagggcauccagcucccccaggugccgggccgcgugcuguucucccuggucaagcgguaccuccacgugacgagccugcuggaccagcucaacgacuccgccgccgagcccggggcccagaacaccagcgcccccgaggagcuguccggcgagcgcgggcagcuggagcucgaguucagcauggcgaugggcacccugaucuccgagcuggugcaggccaugcggugggaccaggccagcgaccgcccccgguccagcgcccgcuccccggggagcaucuuccagccccagcucgcggacgucucccccggccugcccgccgcccaggcccagccgagcuuccggcgcagccggcgcuuccggccccgcuccgaguucgccagcggcaacaccuacgcgcuguacgugcgggacacgcugcagcccgggaugcgcgugcggaugcucgacgacuacgaggagaucuccgccggcgacgagggggaguuccgccagagcaacaacggcgucccgcccgugcaggucuucugggaguccaccggccggaccuacugggugcacuggcacaugcuggagauccugggguucgaggaggacaucgaggacaugguggaggccgacgaguaccagggcgccgucgccagccgcgugcucgggcgcgcgcugcccgccuggcgguggcgccccaugaccgagcuguacgccgugccguacguccuccccgaggacgaggacacggaggagugcgagcaccugacccuggccgaguggugggagcuccuguucuucaucaagaagcuggacggccccgaccaccaggaggugcuccagauccugcaggagaaccuggacggggagauccucgacgacgagauccuggccgagcuggcggugcccaucgagcucgcccaggaccugcugcucacccugccgcagcggcugaacgacuccgcccuccgcgaccugaucaacugccacgucuacaagaaguacggccccgaggcccuggcgggcaaccaggccuaccccagccuccuggaggcccaggaggacgugcugcuccuggacgcccaggcccaggcgaaggacuccgaggacgccgccaagguggaggccaaggagcccccgagccagucccccaacacgccccugcagcggcucgucgagggguacggccccgccgggaagauccugcuggaccucgagcaggcgcugagcuccgagggcacgcaggagaacaaggugaagccgcugcuccugcagcugcagcgccagccccagcccuuccucgcccugaugcagagccuggacacccccgagaccaaccggacccuccaccugacggugcugcgcauccucaagcagcuggucgacuucccggaggcccugcuccugcccuggcacgaggccguggacgccugcauggcgugccugcggucccccaacaccgaccgcgaggugcuccaggagcugaucuucuuccugcaccggcucaccagcgucucccgcgacuacgccguggugcugaaccagcugggggcccgggacgccaucagcaaggcgcucgagaagcaccugggcaagcuggagcucgcccaggagcugcgcgacauggucuucaagugcgagaagcacgcccaccuguaccggaagcucaucaccaacauccugggcgggugcauccagauggugcugggccagaucgaggaccaccgccggacgcaccagcccaucaacaucccguucuucgacguguuccuccgcuaccugugccaggggagcuccgucgaggugaaggaggacaagugcugggagaagguggaggucagcuccaacccccaccgggccagcaagcugaccgaccacaaccccaagaccuacugggaguccaacggcagcgccgggucccacuacaucacccuccacaugcgccggggcauccugauccgccagcugacgcuccugguggcgagcgaggacuccagcuacaugccggcccgcguggucgugugcggcggggacuccaccagcucccugcacaccgagcucaacagcgugaacgucaugcccuccgccagccgggugauccugcuggagaaccucacccgcuucuggcccaucauccagauccggaucaagcgcugccagcagggcgggaucgacacgcggauccgcggccuggagauccuggggcccaagccgaccuucuggcccguguuccgggagcagcucugccgccacacccggcuguucuacaugguccgcgcccaggccuggucccaggacauggcggaggaccggcgcagccugcuccaccuguccagccggcugaacggcgcccuccgccaggagcagaacuucgccgaccgguuccugcccgacgacgaggccgcccaggcgcugggcaagaccugcugggaggcccucgugagccccgugguccagaacaucaccuccccggacgaggacgggaucagcccccugggcuggcugcuggaccaguaccucgagugccaggaggccguguucaacccccagucccgcgggcccgccuucuucagccgggugcgccggcugacgcaccuccugguccacguggagccgugcgaggcgccgccgcccguggucgcgaccccgcgccccaagggccgcaaccggucccacgacuggagcucccuggccacccgcggccugcccagcuccaucaugcggaaccucacccgcugcuggcgggccgugguggagaagcaggucaacaacuuccugacgagcuccuggcgcgacgacgacuucgugccccgguacugcgagcacuucaacauccugcagaacagcuccagcgagcuguucgggccgcgcgccgcguuccugcuggcccuccagaacggcugcgccggggcccugcugaagcuccccuuccugaaggccgcgcacguguccgagcaguucgcccggcacaucgaccagcagauccagggcagccgcaucgggggcgcccaggagauggagcggcuggcccagcuccagcagugccugcaggccguccugaucuucuccggccucgagaucgcgaccaccuucgagcacuacuaccagcacuacauggccgaccgccugcuggggguggucagcuccuggcucgagggcgccgugcuggagcagaucgggcccugcuuccccaaccggcugccgcagcagaugcuccagagccugagcaccuccaaggagcugcagcgccaguuccacguguaccagcuccagcagcuggaccaggagcugcucaagcuggaggacacggagaagaagauccaggucggccugggggccagcggcaaggagcacaaguccgagaaggaggaggaggccggcgcggccgccgugguggacgucgccgagggggaggaggaggaggaggagaacgaggaccucuacuacgagggcgcgaugcccgaggugagcgugcugguccugucccggcacagcuggcccguggccuccaucugccacacccucaacccccggaccugccugccgagcuaccugcgggggacccucaaccgcuacuccaacuucuacaacaagagccagucccaccccgcccuggagcggggcagccagcgccggcugcaguggacguggcucgggugggccgagcugcaguucggcaaccagacccugcacguguccaccguccagauguggcuccugcuguaccucaacgaccugaaggccgugagcguggagucccugcucgcguucagcggccuguccgccgacaugcugaaccaggccaucgggccccucaccagcucccgcggcccgcuggaccugcacgagcagaaggacauccccgggggcguccucaagauccgcgacggcagcaaggagccccggagccgcugggacaucgugcggcugaucccgccccagacguaccugcaggccgagggggaggacggccagaaccucgagaagcgccggaaccugcugaacugccucaucgugcgcauccugaaggcccacggggacgagggccugcacaucgaccagcucgucugccuggugcuggaggcguggcagaaggggcccugcccgccccgcggccucguguccagccugggcaagggguccgccugcagcuccaccgacguccugagcugcauccuccaccuccugggcaaggggacccuccgccggcacgacgaccgcccccaggugcuguccuacgccgugcccgucaccgugauggagccccacacggagagccugaaccccggcuccagcgggcccaacccgccccugaccuuccacacccugcagauccggucccgcggcgugcccuacgccagcugcaccgccacgcaguccuucagcaccuuccgguga

SEQ ID NO: 28856 - RNA, 7554 nt, Artificial Sequence
  derived and/or modified sequence opt1 from CUL9__Homo_sapiens__NP_055904
auggugggcgagcgccacgccggggaccugauggugccccucggcccccggcugcaggccuaccccgaggagcugauccgccagcggcccgggcacgacggccaccccgaguaccucauccgcuggagcgugcugaagugcggggaggugggcaaggucggcguggaggaggggaaggccgagcacauccugauguggcucuccgcccccgagguguacgccaacugccccggccugcugggggagcgggcccucagcaagggccugcagcacgagcccgccggggucuccggcagcuucccccgcgaccccggcgggcuggacgagguggcgaugggcgagauggaggccgacgugcaggcccucguccggcgcgccgcgcggcagcuggccgaguccgggacccccagccugaccgccgccgugcuccacaccauccacgugcuguccgccuacgcgagcaucggcccccugaccggcgucuuccgcgagaccggggcccucgaccugcugaugcacaugcucugcaaccccgagccccagauccggcgcuccgccggcaagaugcugcaggcccuggccgcgcacgacgccgggagccgggcccacgugcuccugucccugagccagcaggacggcaucgagcagcacauggacuucgacucccgcuacacccuccuggagcuguucgccgagaccaccagcuccgaggagcacugcauggccuucgaggggauccaccucccccagauccccggcaagcugcuguucagccucgugaagcgguaccugugcgucaccucccugcucgaccagcugaacagcucccccgagcugggcgcgggggaccagagcagcccgugcgccacccgcgagaagucccggggccagcgcgagcucgaguucagcauggccguggggaaccugaucuccgagcuggugcggagcaugggcugggcccgcaaccucuccgagcaggggauguccccgccccgccccacgcgcuccaucuuccagcccuacaucagcggccccucccugcugcuccccaccaucgucaccacgccccggcggcagggcuggguguuccgccagcggagcgaguucuccagccgcuccggguacggcgaguacgugcagcagacgcugcagccggggaugcggguccgcaugcuggacgacuacgaggagaucagcgccggcgacgagggggaguuccggcaguccaacaacggcaucccgcccguccagguguucuggcagagcaccggccgcaccuacuggguccacuggcacaugcucgagauccuggggcccgaggaggcgaccgaggacaaggccuccgccgccguggagaagggcgcgggggccacgguccugggcaccgccuucccgagcugggacuggaaccccauggacggccuguacccccucccguaccugcagcccgagccccagaagaacgagcgggugggguaccugacccaggccgaguggugggagcuccuguucuucaucaagaagcuggaccucugcgagcagcagcccaucuuccagaaccuguggaagaaccuggacgagacccucggcgagaaggcccugggggagaucuccgugagcgucgagauggcggagagccugcuccaggugcuguccagccgcuucgagggcuccacgcugaacgaccuccugaacagccagaucuacaccaaguacgggcugcucuccaacgagccgagcuccagcuccaccagccggaaccacuccugcacccccgaccccgaggaggagagcaaguccgaggccagcuucuccgaggaggagacggagagccugaaggccaaggccgaggcccccaagaccgaggcggagccgaccaagacccgcacggagacccccauggcccaguccgacagccagcuguucaaccagcuccuggugaccgagggcaugacccugcccacggagaugaaggaggccgccagcgagauggcccgggcgcuccgcggccccgggccgcgguccagccuggaccagcacgucgccgccgugguggccaccguccagaucuccagccuggacaccaaccuccagcuguccggccugagcgcgcucucccaggccguggaggaggugaccgagcgcgaccacccccugguccggcccgaccgcagccugcgggagaagcucgugaagaugcugguggagcugcucacgaaccaggucggggagaagaugguggugguccaggcccugcgccugcucuaccugcugaugaccaagcacgaguggcgcccccucuucgcccgggagggcgggaucuacgccgugcuggugugcaugcaggaguacaagaccuccguccuggugcagcaggcgggccucgccgcccugaagaugcuggccguggccagcuccagcgagaucccgaccuucgucaccggccgcgacuccauccacagccucuucgacgcgcagaugacgcgggagaucuucgccuccaucgacagcgccacccgccccggguccgagagccugcugcucaccgugcccgccgccgugauccugaugcugaacaccgagggcugcuccagcgcggcccggaacgggcuccugcugcucaaccugcugcucugcaaccaccacacgcugggcgaccagaucaucacccaggagcugcgcgacacccucuuccggcacagcgggaucgcgccccgcaccgagccgaugcccacgacccggaccauccugaugaugcugcucaaccgcuacuccgagccgcccggcagcccggagcgggccgcgcuggagacccccaucauccagggccaggacgggucccccgagcugcucauccgcagccuggucggcgggccguccgccgagcugcuccuggaccuggagcgggugcucugccgcgagggcagccccgggggcgccgugcggccccugcugaagcgccuccagcaggagacgcagcccuuccugcugcuccugcggacccuggacgccccgggccccaacaagacccuccugcuguccguccuccgcgugaucacccggcugcuggacuuccccgaggccauggugcuccccuggcacgagguccuggagccgugccugaacugccucagcgggcccuccagcgacuccgagaucgugcaggagcugacgugcuuccugcaccgccuggcgagcaugcacaaggacuacgccgugguccucugcugccugggcgccaaggagauccuguccaaggugcucgacaagcacagcgcccagcugcugcucgggugcgagcugcgggaccuggugaccgagugcgagaaguacgcccagcucuacuccaaccugaccagcuccauccuggcgggcugcauccagaugguccucggccagaucgaggaccaccgccgcacccaccagcccaucaacauccccuucuucgacguguuccugcggcaccugugccaggggagcuccguggaggucaaggaggacaagugcugggagaagguggaggugagcagcaacccgcaccgcgccuccaagcucacggaccacaaccccaagaccuacugggagagcaacggcuccaccgggagccacuacaucacccugcacaugcaccggggcguccuggugcgccagcucacgcugcugguggccuccgaggacagcuccuacaugcccgcccgggucgugguguucgggggcgacagcaccuccugcaucggcaccgagcucaacaccgucaacgugaugcccagcgccucccgcgucauccugcuggagaaccucaaccgguucuggccgaucauccagauccgcaucaagcggugccagcagggcgggaucgacacgcgcgugcgcgggguggagguccugggccccaagcccaccuucuggccccuguuccgcgagcagcucugccggcggaccugccuguucuacaccauccgggcgcaggccuggagccgcgacaucgccgaggaccaccggcgccugcuccagcugugcccgcggcugaaccgcgugcuccgccacgagcagaacuucgccgaccgguuccugcccgacgacgaggccgcgcaggcccuggggaagacgugcugggaggcccucgugagcccccucguccagaacaucaccagccccgacgccgagggcguguccgcgcugggcuggcuccuggaccaguaccuggagcagcgcgagaccagccggaacccgcucucccgcgccgccagcuucgccucccgggugcgccggcugugccaccuccucguccacguggagccgccgcccgggccgagccccgagcccagcacccgcccguucuccaagaacagcaagggccgggaccgcucccccgcccccagccccgugcugccguccagcucccugcggaacaucacgcagugcuggcucagcgucgugcaggagcaggucucccgcuuccuggcggccgccuggcgggcccccgacuucgucccccgcuacugcaagcuguacgagcaccuccagcgggccgggagcgagcuguucggcccccgcgcggccuucaugcuggcccuccgguccggguucagcggcgcccugcugcagcaguccuuccucaccgccgcgcacaugagcgagcaguucgcccgcuacaucgaccagcagauccagggcgggcugaucggcggggccccgggcguggagaugcugggccagcuccagcggcaccuggagcccaucauggugcuguccgggcucgagcuggccaccaccuucgagcacuucuaccagcacuacauggcggaccgccugcucagcuucggcuccagcuggcuggagggggccguccuggagcagaucggccucugcuuccccaaccggcugccccagcugaugcuccagucccugagcaccagcgaggagcugcagcgccaguuccaccucuuccagcugcagcgccuggacaagcuguuccuggagcaggaggacgaggaggagaagcggcuggaggaggaggaggaggaggaggaggaggaggaggccgagaaggagcuguucaucgaggacccgucccccgccaucagcauccuggugcugagcccccgcugcuggcccgugagcccgcucugcuaccuguaccacccccggaagugccugcccacggaguucugcgacgcccucgaccgcuucuccagcuucuacucccagagccagaaccaccccguccuggacauggggccgcaccggcgccugcaguggaccuggcucggccgggcggagcugcaguucggcaagcagauccugcacguguccaccgugcagauguggcuccugcugaaguucaaccagaccgaggaggucagcguggagacgcuccugaaggacuccgaccugagccccgagcuccugcugcaggcccuggugccccucaccuccgggaacggcccccugacccugcacgaggggcaggacuucccgcacggcgggguccuccgccugcacgagcccggcccccagcggagcggcgaggcccuguggcucaucccgccccaggccuaccugaacguggagaaggacgaggggcgcacccuggagcagaagcggaaccuccuguccugccugcucgugcgcauccugaaggcccacggcgagaaggggcugcacaucgaccagcucgucugccuggugcuggaggcguggcagaagggccccaacccgcccgggacgcucggccacaccguggccggcggggucgccugcaccagcaccgacgugcuguccugcauccugcaccuccugggccagggguacgugaagcggcgcgacgaccggccccagauccugauguacgccgcccccgagcccaugggccccugccgcgggcaggcggacguccccuucugcggcagccaguccgagacgagcaagcccagccccgaggccguggccacccucgccucccugcagcugcccgcgggccggaccaugagcccccaggagguggaggggcucaugaagcagaccguccgccaggugcaggagacgcugaaccuggagcccgacguggcccagcaccuccuggcccacucccacuggggcgccgagcagcugcuccagagcuacuccgaggaccccgagccgcugcugcucgccgcggggcugugcguccaccaggcccaggccgugcccgugcggcccgaccacugccccgucugcgugagcccgcugggcugcgacgacgaccuccccucccugugcugcaugcacuacugcugcaagagcugcuggaacgaguaccugaccacccgcaucgagcagaaccucgugcugaacugcacgugccccaucgccgacugccccgcccagccgacgggcgcguucauccgcgccaucgucuccagccccgaggugaucuccaaguacgagaaggcccugcuccggggguacguggagagcugcuccaaccugaccuggugcaccaacccccagggcugcgaccgcauccugugccggcaggggcucggcugcgggaccacgugcagcaagugcggcugggccuccugcuucaacugcagcuuccccgaggcccacuacccggcguccugcggccacaugagccagugggucgacgacgggggcuacuacgacgggaugagcguggaggcccaguccaagcaccuggccaagcugaucagcaagcgcugccccuccugccaggcccccaucgagaagaacgagggcugccuccacaugaccugcgccaagugcaaccacggguucugcuggcggugccugaaguccuggaagccgaaccacaaggacuacuacaacugcuccgcgauggucagcaaggccgcccgccaggagaagcgguuccaggacuacaacgagcgcugcaccuuccaccaccaggcccgggaguucgcggugaaccugcgcaaccggguguccgccauccacgaggugccgccgccccgcagcuucaccuuccucaacgacgccugccagggccuggagcaggcccggaaggugcuggccuacgcgugcguguacuccuucuacagccaggacgccgaguacauggacgucguggagcagcagacggagaaccucgagcugcacaccaacgcccugcagauccuccuggaggagacccugcuccgcugccgggaccuggccuccagccugcgccuccugcgggccgacugccuguccaccggcauggagcuccugcgccggauccaggagcgccugcucgcgauccugcagcacagcgcccaggacuuccggguggggcugcaguccccgagcgucgaggccugggaggccaagggccccaacaugcccgggucccagccccaggccagcuccggcccggaggcggaggaggaggaggaggacgacgaggacgacgugcccgaguggcagcaggacgaguucgacgaggagcucgacaacgacagcuucagcuacgacgaguccgagaaccuggaccaggagacguucuucuucggggacgaggaggaggacgaggacgaggccuacgacuga

SEQ ID NO: 28857 - RNA, 597 nt, Artificial Sequence
  derived and/or modified sequence opt1 from CUTA__Homo_sapiens__NP_001014433
augaucggcagcgggcuggccggcuccgggggcgccgggggccccagcuccaccgugaccuggugcgcccucuucagcaaccacgucgcggccacgcaggccucccugcugcucagcuucguguggaugccggcccugcugcccguggcgucccgccuccugcugcucccccggguccugcugaccauggccagcggcuccccgcccacccagcccagccccgccuccgacagcggguccggcuacgugcccgggagcguguccgccgcguucgugaccugcccgaacgagaagguggccaaggagaucgcccgcgccguggucgagaagcggcucgccgcgugcgugaaccugaucccccagaucacgagcaucuacgaguggaagggcaagaucgaggaggacuccgaggugcugaugaugaucaagacccagagcucccucguccccgcccugaccgacuucgugcgcagcgugcaccccuacgaggucgccgaggugaucgcccugccgguggagcaggggaacuuccccuaccuccaguggguccggcaggucaccgagagcguguccgacagcaucacgguccugcccuga

SEQ ID NO: 28858 - RNA, 4551 nt, Artificial Sequence
  derived and/or modified sequence opt1 from CUX1__Homo_sapiens__NP_001189472
auggccgccaacgugggcagcauguuccaguacuggaagcgcuucgaccugcagcagcuccagcgggagcuggacgcgaccgccaccguccuggccaaccgccaggacgaguccgagcagagccggaagcgccucaucgagcagucccgggaguucaagaagaacacgcccgaggaccugcgcaagcaggucgccccgcugcucaagagcuuccagggggagaucgacgcccuguccaagcggagcaaggaggcggaggccgccuuccugaacguguacaagcgccucaucgacguccccgaccccgugcccgcccuggaccugggccagcagcuccagcugaaggugcagcggcugcacgacaucgagaccgagaaccagaagcuccgcgagacccuggaggaguacaacaaggaguucgcggaggucaagaaccaggaggugaccaucaaggcccugaaggagaagauccgggaguacgagcagacgcucaagaaccaggccgagaccaucgcccuggagaaggagcagaagcugcagaacgacuucgccgagaaggagcgcaagcuccaggagacccagauguccaccacgagcaagcuggaggaggcggagcacaaggugcagucccugcagaccgcccucgagaagacccggaccgagcuguucgaccugaagacgaaguacgacgaggagaccaccgccaaggccgacgagaucgagaugaucaugaccgaccucgagcgcgccaaccagcgggcggaggucgcccagcgcgaggccgagacgcugcgggagcagcugagcuccgccaaccacagccuccagcuggccucccagauccagaaggcgccggacguggagcaggccaucgaggugcugacccgcagcucccucgaggucgagcuggccgccaaggagcgggagaucgcccagcugguggaggacgugcagcgccuccaggcgagccugaccaagcugcgggagaacuccgccagccagaucucccagcucgagcagcagcugagcgccaagaacagcacccugaagcagcucgaggagaagcugaaggggcaggccgacuacgaggaggucaagaaggagcugaacauccucaaguccauggaguucgcgcccagcgagggcgccgggacgcaggacgccgccaagccccuggaggugcugcuccuggagaagaaccgcucccugcagagcgagaacgccgcgcugcgcaucuccaacagcgaccucuccggcagcgcccggcgcaagggcaaggaccagcccgagucccggcgcccggggagccugcccgccccgccgcccucccagcugccccggaaccccggcgagcaggccagcaacaccaacgggacccaccaguucucccccgccggccucagccaggacuucuucuccagcucccuggcgagccccucccugccccucgccagcaccgggaaguucgcccugaacagccugcuccagcgccagcugaugcaguccuucuacagcaaggccaugcaggaggccggcuccacgagcaugaucuucuccaccggccccuacagcaccaacuccaucagcucccagagcccccugcagcaguccccggacgugaacgggauggcgcccagccccucccagagcgaguccgccggcagcguguccgagggggaggagauggacaccgccgagaucgcccgccaggugaaggagcagcucaucaagcacaacaucggccagcggaucuucggccacuacgugcuggggcugagccagggcagcgucuccgagauccucgcgcggcccaagccguggaacaagcugacggugcgcgggaaggagcccuuccacaagaugaagcaguuccugagcgacgagcagaacauccucgcccugcgguccauccagggccgccagcgggagaaccccgggcagagccugaaccgccucuuccaggaggugcccaagcggcgcaacggcuccgagggcaacaucaccacccggauccgcgccagcgagaccggguccgacgaggccaucaagagcauccuggagcaggccaagcgggagcugcagguccagaagacggcggagccggcccagcccuccagcgccuccggcagcgggaacuccgacgacgccauccgcagcauccuccagcaggcccgccgggagauggaggcgcagcaggccgcccuggaccccgcccugaagcaggccccgcucucccagagcgacaucaccauccugacccccaagcugcucuccaccagccccaugcccacgguguccagcuacccgccccuggcgaucagccugaagaagcccuccgccgcccccgaggccggcgcgagcgcccucccgaacccgcccgcccugaagaaggaggcccaggacgcccccgggcuggacccccagggcgcggccgacugcgcccagggcguccuccgccaggugaagaacgagguggggcgguccggcgccuggaaggaccacugguggagcgccguccagcccgagcgccggaacgcggccuccagcgaggaggccaaggccgaggagaccgggggcgggaaggagaagggcuccggcgggagcggcgggggcucccagccccgcgccgagcggagccagcugcagggccccuccagcuccgaguacuggaaggaguggccgagcgcggagucccccuacagccaguccagcgagcugucccucaccggggccagccgcagcgagacgccccagaacagcccccugccguccucccccaucgugcccaugagcaagcccaccaagccguccgugccgccccugacccccgagcaguacgaggucuacauguaccaggagguggacaccaucgagcucacccgccaggugaaggagaagcuggccaagaacggcaucugccagcggaucuucggggagaagguccugggccucagccagggguccgugagcgacaugcugucccggcccaagcccuggagcaagcugacccagaagggccgcgagcccuucauccggaugcagcucuggcugaacggcgagcuggggcagggcgugcucccgguccaggggcagcagcagggccccgugcugcacuccgugacgagccugcaggacccccuccagcaggggugcgucuccagcgaguccacccccaagaccagcgccuccugcagcccggcccccgagucccccaugagcagcuccgagagcgugaagucccugaccgagcuggugcagcagcccugcccgcccaucgaggcgagcaaggacuccaagccgcccgagcccagcgacccgcccgccuccgacagccagcccacgacgccccucccccuguccggccacagcgcccuguccauccaggagcucgucgccaugagccccgagcuggacaccuacggcaucaccaagcgcgugaaggaggugcugaccgacaacaaccucgggcagcggcuguucggcgagaccauccuggggcucacccagggcuccgucagcgaccugcuggcgcgccccaagccguggcacaagcucucccugaaggggcgggagcccuucgugcgcaugcagcuguggcucaacgaccccaacaacguggagaagcugauggacaugaagcggauggagaagaaggccuacaugaagcgccggcacagcuccgucagcgacucccagcccugcgagccgcccagcgugggcaccgaguacagccagggcgccagcccccagccgcagcaccagcugaagaagccccgcgugguccucgcccccgaggagaaggaggcccugaagcgcgcguaccagcagaagcccuacccgucccccaagacgaucgaggaccuggccacccagcucaaccugaagaccuccaccgugaucaacugguuccacaacuaccggagccgcauccggcgcgagcuguucaucgaggagauccaggccgggucccagggccaggccggggccagcgacucccccagcgcgcgguccggccgcgccgcccccagcuccgagggggacagcugcgacggcguggaggccacggagggcccgggguccgccgacaccgaggagcccaagagccagggcgaggcggagcgggaggaggucccccgccccgccgagcagaccgagccgccgcccuccgggacccccggccccgacgacgcccgggacgacgaccacgagggcgggcccguggagggccccgggccccucccgagccccgccuccgcgacggccaccgccgcccccgccgcgcccgaggacgccgccaccagcgccgccgcggccccgggcgaggggcccgccgcccccuccagcgcgcccccgcccagcaacuccagcuccagcuccgcgccccgccggccgagcucccugcagagccuguucggccuccccgaggccgccggcgcccgcgacucccgggacaacccccugcgcaagaagaaggccgccaaccugaacagcaucauccaccggcucgagaaggccgccucccgcgaggagcccaucgagugggaguucuga

SEQ ID NO: 28859 - RNA, 4461 nt, Artificial Sequence
  derived and/or modified sequence opt1 from CUX2__Homo_sapiens__NP_056082
auggccgccaacgugggcagcauguuccaguacuggaagcgcuucgaccugcggcgccuccagaaggagcugaacuccgucgcgagcgagcuguccgcccggcaggaggagagcgagcacucccacaagcaccucaucgagcugcgccgggaguucaagaagaacgugcccgaggagauccgcgagaugguggccccgguccugaagagcuuccaggccgaggugguggcccucuccaagcggagccaggaggcggaggccgccuuccuguccgucuacaagcagcugaucgaggcccccgaccccgugcccguguucgaggcggcccgcagccucgacgaccggcugcagccgcccuccuucgaccccagcgggcagccccgccgggaccugcacaccuccuggaagcgcaacccggagcuccugagccccaaggagcagcgggagggcaccucccccgccgggcccacgcugaccgagggcagccgccucccggggauccccggcaaggcccugcugaccgagacccuccugcagcggaacgaggccgagaagcagaagggccugcaggagguccagaucacgcucgcggcccgccugggggaggccgaggagaagaucaaggugcugcacuccgcccucaaggccacccaggcggagcugcuggagcuccggcgcaaguacgacgaggaggccgccagcaaggccgacgaggugggccugaucaugaccaaccuggagaaggccaaccagcgggcggaggccgcccagcgcgaggucgagucccuccgggagcagcuggccagcgugaacagcuccauccgccuggccugcugcagcccccaggggcccuccggcgacaaggugaacuucacccucugcagcgggccgcgccuggaggcggcccuggccuccaaggaccgggagauccuccgccugcugaaggacguccagcaccuccagagcucccugcaggagcuggaggaggccagcgcgaaccagaucgccgaccucgagcggcagcugacggccaaguccgaggccaucgagaagcuggaggagaagcuccaggcccagagcgacuacgaggagaucaagaccgagcuguccauccugaaggcgaugaagcucgccagcuccaccugcagccugccccagggcauggccaagcccgaggacucccugcugaucgccaaggaggccuucuuccccacccagaaguuccuccuggagaagccgagccugcucgcgucccccgaggaggaccccagcgaggacgacuccaucaaggacagccugggcacggagcagagcuaccccuccccgcagcagcugcccccccccccggggcccgaggacccccucagcccgucccccggccagccccugcuggggcccagccucggcccggacggcacccgcaccuucucccugagccccuuccccucccuggccagcggggagcggcucaugaugcccccggccgccuucaagggcgaggccgggggccugcugguguucccccccgcguucuacggggccaagcccccgaccgcccccgccacgcccgcgcccggcccggagccccucggcgggcccgagcccgccgacggcgggggcgggggcgccgccggcccgggggccgaggaggagcagcuggacaccgcggagaucgccuuccaggugaaggagcagcugcucaagcacaacaucggccagcgcgucuucgggcacuacgugcugggccugucccaggggagcguguccgagauccucgcccggcccaagcccuggcgcaagcugaccgucaagggcaaggagcccuucaucaagaugaagcaguuccugagcgacgagcagaacgugcucgcccugcggaccauccaggugcgccagcggggcuccaucacgccgcgcauccggacccccgagaccgggagcgacgacgccaucaaguccauccuggagcaggcgaagaaggagaucgagagccagaagggcggggagcccaagaccuccgucgccccgcucagcaucgccaacggcacgacccccgccagcaccuccgaggacgccaucaagagcauccuggagcaggcgcgccgggagaugcaggcccagcagcaggcccugcucgagauggagguggccccccgcggccgguccguccccccgagcccccccgagcgccccucccuggcgaccgccagccagaacggggccccggcccuggugaagcaggaggagggcuccgggggccccgcccaggcgccccuccccgugcugagcccggccgccuucguccaguccaucauccggaaggugaagagcgagaucggggacgccggcuacuucgaccaccacugggccuccgaccgcggccugcucagccgccccuacgcguccgugagccccucccugagcuccagcuccagcagcggguacuccggccagcccaacgggcgggccuggccgcgcggcgacgaggcccccgucccccccgaggacgaggccgccgcgggggccgaggacgagccgccccggacgggcgagcugaaggccgagggcgccaccgccgaggcgggggcccgccuccccuacuaccccgccuacgugccgcggacccugaagcccaccgugcccccccugacgccggagcaguacgagcucuacauguaccgcgaggucgacacccuggagcugacccggcaggugaaggagaagcucgccaagaacggcaucugccagcgcaucuucggggagaaggugcugggccugagccagggguccgucagcgacaugcucucccggcccaagcccuggagcaagcugacccagaagggccgcgagccguucauccggaugcagcuguggcucuccgaccagcugggccaggcgguggggcagcagcccggcgccagccaggccucccccacggagccccgcagcuccccgagccccccccccuccccgaccgagcccgagaagagcucccaggagccccugagccucucccuggagagcuccaaggagaaccagcagcccgaggggcggagcagcuccagccuguccggcaagauguacagcgggucccaggccccgggcggcauccaggagaucguggccaugagccccgagcucgacaccuacuccaucaccaagcgcgucaaggaggugcugaccgacaacaaccuggggcagcggcucuucggcgagagcauccuggggcugacgcagggcuccgugagcgaccuccugucccgccccaagcccuggcacaagcugagccucaagggccgggagccguucguccgcaugcagcuguggcugaacgacccccacaacguggagaagcuccgggacaugaagaagcuggagaagaaggcguaccugaagcgccgguacgggcucaucuccaccggcagcgacuccgagagccccgccacccgcuccgagugccccagcccgugccugcagccccaggaccugucccuccugcagaucaagaagccccgcgugguccuggcccccgaggagaaggaggcccuccggaaggccuaccagcuggagccguaccccagccagcagaccaucgagcugcucagcuuccagcugaaccugaagacgaacaccgugaucaacugguuccacaacuaccgcucccggaugcgccgggagaugcucguggaggggacccaggacgagcccgaccuggaccccagcggcgggccgggcauccugccccccggccacucccacccggaccccaccccccagagccccgacuccgagacggaggaccagaagccgaccgucaaggagcucgagcugcaggaggggcccgaggagaacagcaccccccugaccacgcaggacaaggcgcaggugcgcaucaagcaggagcagauggaggaggacgccgaggaggaggccggcucccagccccaggacagcggggagcucgacaagggccaggggccgcccaaggaggagcaccccgaccccccgggcaacgacggccugcccaagguggcccccgggccccugcucccgggcggguccacccccgacugccccagccugcacccccagcaggaguccgaggccggcgagcggcugcacccggacccccugagcuucaaguccgcgagcgaguccagccgcugcucccucgaggucagccugaacucccccagcgccgccagcucccccgggcugaugaugagcguguccccggugcccagcuccagcgcccccaucuccccgagcccccccggcgcgcccccggccaagguccccuccgccagccccaccgccgacauggccggcgcgcuccaccccuccgccaaggugaacccgaaccugcagcggcgccacgagaagauggccaaccugaacaacaucaucuaccggguggagcgcgccgccaaccgggaggaggcgcucgagugggaguucuga

SEQ ID NO: 28860 - RNA, 1824 nt, Artificial Sequence
  derived and/or modified sequence opt1 from CUZD1__Homo_sapiens__NP_071317
auggagcuggugcgccggcucaugccccugacccugcucauccugagcugccuggccgagcucaccauggccgaggcggagggcaacgccuccugcacggucagccucgggggcgccaacauggccgagacccacaaggccaugauccugcagcucaacccguccgagaacugcaccuggaccaucgagcgccccgagaacaagagcauccggaucaucuucuccuacgugcagcuggaccccgacgggagcugcgaguccgagaacaucaagguguucgacggcacgagcuccaacgggccccugcucggccaggucugcagcaagaacgacuacgugccgguguucgaguccagcuccagcacccugaccuuccagaucgucaccgacuccgcgcgcauccagcggacgguguucguguucuacuacuucuucagccccaacaucuccauccccaacugcggcggguaccuggacacccucgagggcagcuucaccucccccaacuacccgaagccccaccccgagcuggccuacugcgucuggcacauccagguggagaaggacuacaagaucaagcugaacuucaaggagaucuuccucgagaucgacaagcagugcaaguucgacuuccuggccaucuacgacgggcccagcaccaacagcggccugaucggccaggugugcgggcgcgucacgccgaccuucgaguccagcuccaacagccucaccguggugcuguccaccgacuacgccaacagcuaccggggcuucuccgcgagcuacacguccaucuacgccgagaacaucaacaccaccagccugaccugcuccagcgaccgcaugcgggucaucaucuccaagagcuaccucgaggccuucaacuccaacgggaacaaccugcagcugaaggaccccacgugccgccccaagcucagcaacgugguggaguucuccgucccccugaacggcugcgggaccauccggaagguggaggaccagagcaucaccuacaccaacaucaucacguucuccgccagcagcaccuccgaggugaucacccgccagaagcagcugcagaucaucgucaagugcgagaugggccacaacagcaccguggagaucaucuacaucacggaggacgacgugauccagucccagaacgcccucggcaaguacaacaccagcauggcgcuguucgaguccaacagcuucgagaagaccauccuggaguccccguacuacgucgaccucaaccagacccuguucgugcaggucagccugcacacguccgaccccaaccucgugguguuccuggacacgugccgggccagccccaccuccgacuucgccagccccaccuacgaccugaucaaguccgggugcagccgcgacgagaccugcaaggucuacccgcuguucggccacuacgggcgguuccaguucaacgccuucaaguuccugcgcuccaugagcuccguguaccugcagugcaaggugcucaucugcgacagcagcgaccaccagucccggugcaaccagggcugcgucagccgcuccaagcgggacaucagcuccuacaaguggaagaccgacagcaucaucgggcccauccgccugaagcgggaccgcuccgccagcggcaacuccggcuuccagcacgagacccacgcggaggagacccccaaccagcccuucaacagcgugcaccuguucuccuucauggugcucgcccugaacgucgugaccguggccacgaucaccguccgccacuucgugaaccagcgggccgacuacaaguaccagaagcugcagaacuacuga

SEQ ID NO: 28861 - RNA, 2727 nt, Artificial Sequence
  derived and/or modified sequence opt1 from CWC22__Homo_sapiens__NP_065994
augaaguccagcguggcccagaucaagcccagcuccggccacgaccgccgggagaaccugaacagcuaccagcgcaacuccagcccggaggaccgguacgaggagcaggagcgcagcccccgggaccgcgacuacuucgacuacagccgguccgacuacgagcacagccgccgggggcgcuccuacgacagcuccauggagagccggaaccgcgaccgggagaagcgccgggagcgcgagcgggacaccgaccgcaagcggucccgcaagagccccucccccggccggcgcaacccggagaccagcgucacgcaguccagcagcgcccaggacgagcccgcgaccaagaagaagaaggacgagcucgacccccugcugacccgcaccgggggcgccuacaucccgcccgccaagcuccggaugaugcaggagcagaucacggacaagaacucccuggccuaccagcgcaugagcugggaggcccugaagaaguccaucaacgggcucaucaacaaggugaacaucagcaacaucuccaucaucauccaggagcugcugcaggagaacaucgugcggggccgcggccuccugagccgguccguccugcaggcgcagagcgccucccccaucuucacccacguguacgccgcccucguggcgaucaucaacagcaaguucccccagaucggggagcugauccugaagcgccucauccugaacuuccggaagggcuaccgccggaacgacaagcagcugugccucaccgccuccaaguucgucgcccaccugaucaaccagaacguggcccacgaggugcugugccucgagaugcugacccugcuccuggagcgccccacggacgacagcgucgagguggccaucggguuccugaaggagugcggccucaagcugacccagguguccccgcgggggaucaacgcgaucuucgagcgccugcggaacauccuccacgagagcgagaucgacaagcgcguccaguacaugaucgaggugauguucgccgugcggaaggacggcuucaaggaccaccccaucauccuggagggccuggaccucgucgaggaggacgaccaguucacccacaugcugccccuggaggacgacuacaaccccgaggacgugcucaacguguucaagauggacccgaacuucauggagaacgaggagaaguacaaggccaucaagaaggagauccuggacgagggggacaccgacuccaacacggaccaggacgccggcagcuccgaggaggacgaggaggaggaggaggaggagggggaggaggacgaggagggccagaaggucaccauccacgacaagaccgagaucaaccuggugagcuuccgccggaccaucuaccucgccauccaguccagccuggacuucgaggagugcgcgcacaagcugcucaagauggaguuccccgagagccagacgaaggagcugugcaacaugauccuggacugcugcgcccagcagcgcaccuacgagaaguucuucggccuccuggccgggcgguucugcaugcugaagaaggaguacauggaguccuucgagggcaucuucaaggagcaguacgacaccauccaccgccucgagaccaacaagcugcgcaacguggccaagauguucgcccaccuccuguacacggacagccugcccugguccguccuggagugcaucaagcugagcgaggagaccaccaccuccagcucccggaucuucgugaagaucuucuuccaggagcucugcgaguacauggggcugcccaagcugaacgcgcgccucaaggacgagacgcugcagccguucuucgagggccugcucccccgggacaacccccgcaacacccgguucgccaucaacuucuucaccagcaucgggcugggcggccugaccgacgagcuccgcgagcaccugaagaacacgcccaaggugaucgucgcccagaagccggacguggagcagaacaaguccagccccuccagcuccagcuccgccagcuccagcagcgaguccgacagcuccgacagcgacuccgacagcuccgacagcuccagcgaguccagcuccgaggagagcgacuccagcuccaucagcucccacagcagcgccuccgcgaacgacguccggaagaaggggcacggcaagacccgcagcaaggagguggacaagcugauccggaaccagcagaccaacgaccgcaagcagaaggagcggcgccaggagcacgggcaccaggagacccggacggagcgcgagcggcgcuccgagaagcaccgggaccagaacagcuccggcagcaacuggcgcgaccccaucaccaaguacaccuccgacaaggacgugcccagcgagcggaacaacuacucccgcgucgccaacgaccgggaccaggagaugcacaucgaccucgagaacaagcacggggacccgaagaagaagcgcggcgagcgccggaacagcuucuccgagaacgagaagcacacccaccgcaucaaggacagcgagaacuuccggcgcaaggaccgguccaagagcaaggagaugaaccgcaagcacuccggcagccgguccgacgaggaccgcuaccagaacggggccgagcggcgcugggagaaguccagccgguacagcgagcagagccgcgaguccaagaagaaccaggaccggcgccgggagaagucccccgccaagcagaaguga

SEQ ID NO: 28862 - RNA, 1176 nt, Artificial Sequence
  derived and/or modified sequence opt1 from CWC27__Homo_sapiens__NP_001284573
augagcaacaucuacauccaggagccgcccaccaacggcaaggugcugcucaagaccacggccggggacaucgacaucgagcugugguccaaggaggcccccaaggcgugccgcaacuucauccagcugugccucgaggccuacuacgacaacaccaucuuccaccgggucgugcccggcuucaucgugcagggcggggaccccaccgggaccggcagcggcggggaguccaucuacggcgcccccuucaaggacgaguuccacagccgccugcgguucaaccgccgggggcuggucgccauggccaacgcgggcucccacgacaacgggagccaguucuucuucacgcucggccgcgccgacgagcugaacaacaagcacaccaucuucggcaaggugaccggggacaccguguacaacaugcugcggcucuccgaggucgacaucgacgacgacgagcgcccccacaacccccacaagaucaagagcugcgaggugcuguucaaccccuucgacgacaucaucccgcgggagaucaagcgccugaagaaggagaagcccgaggaggaggugaagaagcucaagcccaagggcacgaagaacuucucccugcugagcuucggggaggaggccgaggaggaggaggaggaggucaaccgggugucccagagcaugaagggcaaguccaagagcucccacgaccuccugaaggacgacccccaccugagcuccgugccggucguggagagcgagaagggcgacgcccccgaccucguggacgacggggaggacgaguccgcggagcacgacgaguacaucgacggcgacgagaagaaccugaugcgcgagcggaucgccaagaagcugaagaaggacaccagcgccaacgucaagagcgccggggagggcgagguggagaagaaguccgugagccgcuccgaggagcuccggaaggaggcccgccagcugaagcgggagcugcucgcggccaagcagaagaaggucgagaacgccgccaagcaggccgagaagcgcagcgaggaggaggaggcgccgcccgacggggccguggccgaguaccggcgcgagaagcagaaguacgaggcccugcggaagcagcaguccaagaagggcaccagccgcgaggaccaggacgugaccugcacguccgucuga

SEQ ID NO: 28863 - RNA, 1497 nt, Artificial Sequence
  derived and/or modified sequence opt1 from CWF19L1__Homo_sapiens__NP_001290333
auggcccagaagccccugcgccuccuggccugcggcgacguggaggggaaguucgacauccuguucaaccggguccaggcgauccagaagaaguccggcaacuucgaccuccugcugugcguggggaacuucuucggcagcacccaggacgccgagugggaggaguacaagaccgggaucaagaaggccccgauccagacguacgugcucggcgccaacaaccaggagaccgucaaguacuuccaggacgccgacggcugcgagcuggcggagaacaucaccuaccuggggcgcaagggcaucuucaccgggagcuccggccuccagaucguguaccugagcgggacggagucccugaacgagcccgugcccggcuacagcuucucccccaaggacgucagcucccuccggaugaugcugugcaccaccagccaguucaagggcguggacauccugcucaccuccccguggcccaagugcguggggaacuucggcaacagcuccggggaggucgacacgaagaagugcggcagcgcccugguguccagccuggccaccggccucaagccccgcuaccacuucgccgcgcuggagaagaccuacuacgagcggcugcccuaccgcaaccacaucauccuccaggagaacgcccagcacgccacccgguucaucgcccuggccaacguggggaacccggagaagaagaaguaccuguacgcguucuccaucguccccaugaagcucauggacgccgccgagcuggugaagcagccgcccgacgugacggagaaccccuaccgcaagagcggccaggaggccuccaucgggaagcagauccuggcccccgucgaggagagcgcgugccaguucuucuucgaccucaacgagaagcagggccggaagcgcagcuccaccgggcgggacagcaaguccagcccccaccccaagcagccgcgcaagccgccccagccgcccggccccugcugguucugccuggccucccccgagguggagaagcaccugguggucaacaucggcacccacugcuaccucgcccuggccaagggcgggcugagcgacgaccacgugcucauccugcccaucgggcacuaccaguccguggucgagcugagcgccgaggugguggaggaggucgagaaguacaaggcgacccuccggcgcuucuucaagucccggggcaaguggugcguggucuucgagcgcaacuacaagagccaccaccuccagcugcagaucgcccagcccggggccgccuacuucuacguggagcuggacacgggcgagaagcuguuccaccggaucaagaagaacuucccccugcaguucggccgcgaggugcucgccuccgaggcgauccugaacguccccgacaagagcgacuggcggcagugccagaucuccaaggaggacgaggagacccuggcccgccgguuccgcaaggacuucgagcccuacgacuucacccucgacgacuga

SEQ ID NO: 28864 - RNA, 2685 nt, Artificial Sequence
  derived and/or modified sequence opt1 from CWF19L2__Homo_sapiens__NP_689647
auggccaccagcauggccgcggccuccggccgcuucgagagcgccaaguccaucgaggagcggaaggagcagacccgcaacgcccgggccgaggugcugcgccaggcgaaggccaacuucgagaaggaggagcggcgcaaggagcucaagcggcugcgcggggaggacacguggaugcugcccgacgucaacgagcggaucgagcaguucagccaggagcacuccgugaagaagaagaagaagaaggacaagcacagcaagaaggccaagaaggagaagaagaagaaguccaagaagcagaaguacgagaagaacaacgagagcuccgacagcuccagcuccagcgaggacgaguggguggaggccgucccgucccagacccccgacaaggagaaggcguggaaggugaaggacgagaaguccggcaaggacgacacccagaucaucaagcgcgacgaguggaugaccguggacuucaugagcgucaagacggugagcuccagcagccucaaggccgagaaggagaccaugcggaagaucgagcaggagaagaaccaggcccuggagcaguccaagcugauggagcgcgagcucaaccccuacuggaaggacgggggcaccgggcugcccccggaggacugcagcguguccagcaucaccaaggucuccgugguggaggacggcggccugagcuggcuccggaaguccuaccugcgcaugaaggagcaggccgagaagcagagccggaacuucgaggacaucgucgccgagcgcuacggguccauggagaucuuccagagcaagcuggaggacgcggagaaggccgccuccacgaaggaggacuaccggcgcgagcgguggcgcaagcccaccuacagcgacaaggcccagaacugccaggagucccgggagagcgaccucgugaaguacggcaacuccagccgcgaccgcuacgccaccaccgacacggcgaagaacuccaacaacgagaaguucaucggggacgagaaggacaagcggcccggcagccuggagaccugccgccgggaguccaacccccgccagaaccaggaguucagcuucgggaaccugcgggccaaguuccuccgcccgagcgacgacgaggagcuguccuuccacagcaagggccggaaguucgagccccuguccagcuccagcgcccucguggcccagggcucccugugcagcggguuccgcaagcccaccaagaacuccgaggagcggcugaccagcuggucccgcagcgacggccgcggggacaagaagcacuccaaccagaagcccagcgagacguccaccgacgagcaccagcacgucccggaggacccccgggagaagucccaggacgaggugcuccgggacgacccgcccaagaaggagcaccuccgcgacaccaagagcaccuucgccggcagccccgagcgggagagcauccacauccuguccguggacgagaagaacaagcucggcgcgaagaucaucaaggccgagaugauggggaacauggagcuggccgagcagcugaagguccagcucgagaaggccaacaaguucaaggagacgaucacccagauccccaagaaguccggcguggagaacgaggaccagcaggaggugauccugguccgcaccgaccagagcgggcggguguggcccgugaacacccccggcaagagccuggagucccagggcgggcgccggaagcgccagauggucagcacgcacgaggagcgcgagcgggugcgcuacuuccacgacgacgacaaccucucccugaacgaccuggucaagaacgagaagaugggcaccgccgagaaccagaacaagcuguucaugcggauggcgagcaaguucauggggaagaccgacggcgacuacuacacccuggacgacauguucguguccaaggccgccgagcgcgagcggcugggggaggaggaggagaaccagcgcaagaaggccaucgcggagcaccggagccucgccgcccagauggagaagugccuguacugcuucgacuccagccaguucccgaagcaccugaucguggccaucggcgucaagguguaccucugccugcccaacgugcgcucccugacggaggggcacugccucaucgucccccugcagcaccaccgggccgcgacccugcucgacgaggacaucugggaggagauccagauguuccgcaagagccuggugaagauguucgaggacaagggccuggacugcaucuuccucgagaccaacauguccaugaagaagcaguaccacaugguguacgagugcaucccccugccgaaggaggucggcgacauggcccccaucuacuucaagaaggccaucauggagagcgacgaggagugguccaugaacaagaagcugaucgaccugagcuccaaggacauccgcaagagcgugccccgggggcuccccuacuucagcguggacuucggccugcacgggggcuucgcccacgucaucgaggaccagcacaaguucccgcacuacuucgggaaggagaucaucggcggcaugcuggacaucgagccccggcucuggcgcaaggggauccgggaguccuucgaggaccagcgcaagaaggcccugcaguucgcgcagugguggaagcccuacgacuucaccaagagcaagaacuacuga

SEQ ID NO: 28865 - RNA, 2100 nt, Artificial Sequence
  derived and/or modified sequence opt1 from CWH43__Homo_sapiens__NP_079363
augcccagccuguggcgcgagauccuccuggagucccugcucggcugcgugagcuggucccuguaccacgaccuggggccgaugaucuacuacuucccccuccagacccuggagcugaccggccucgagggguucagcaucgccuuccugucccccaucuuccugacgaucacccccuucuggaagcucgucaacaagaaguggaugcugacccugcuccggaucaucaccaucggcagcaucgccuccuuccaggcgccgaacgccaagcugcgccugauggugcucgcccugggggugagcuccagccugaucguccaggccgugacguggugguccggcagccaccuccagcgguaccugcgcaucuggggcuucauccuggggcagaucgugcucgucgugcugcggaucugguacaccucccugaaccccaucuggagcuaccagauguccaacaaggugauccucacccugagcgccaucgcgacccuggaccgcaucggcacggacggggacugcuccaagcccgaggagaagaagaccggcgaggucgccaccgggauggccagccggcccaacuggcuccuggccggcgcggccuucggcucccugguguuccucacccacuggguguucggggaggucagccuggugagccgcugggccguguccggccacccgcaccccgggcccgaccccaacccguucggcggcgccguccugcucugccuggccagcgggcugaugcuccccuccugccugugguuccggggcacggggcugaucuggugggugaccggcaccgcgagcgccgccgggcuccuguaccugcacaccugggccgccgcgguguccggcugcgucuucgccaucuucacggccagcauguggccccagacccucggccaccugaucaacuccgggaccaaccccggcaagaccaugacgaucgccaugaucuucuaccugcucgagaucuucuucugcgccuggugcaccgcguucaaguucgugcccgggggcguguacgcccgcgagcggagcgacguccugcuggggaccaugaugcugaucaucggccucaacaugcuguucggcccgaagaagaaccuggaccuccugcugcagaccaagaacuccagcaaggugcuguuccgcaaguccgagaaguacaugaagcuguuccuguggcuccuggugggggucggccugcucgggcugggccugcggcacaaggccuacgagcgcaagcucgggaagguggcccccacgaaggaggucagcgccgcgaucuggcccuuccgguucggcuacgacaacgagggcugguccagccuggagcgcuccgcccaccuccucaacgagaccggggccgacuucaucaccauccuggagagcgacgccuccaagccguacaugggcaacaacgaccugaccauguggcucggggagaagcugggcuucuacacggacuucggccccagcacccgguaccacaccugggggaucauggcgcugucccgcuaccccaucgucaagagcgagcaccaccuccugcccagcccggagggcgagaucgcccccgccaucacccugacggugaacaucuccgggaagcucguggacuucguggugacccacuucggcaaccacgaggacgaccuggaccggaagcugcaggccaucgccgucagcaagcuccugaaguccagcuccaaccaggugaucuuccugggguacaucaccagcgcgcccggcucccgcgacuaccuccagcugaccgagcacggcaacgugaaggacaucgacagcacggaccacgaccgguggugcgaguacaucauguaccgcgggcugauccgccucggcuacgcccggaucucccacgccgagcugagcgacuccgagauccagauggccaaguuccgcauccccgacgacccgaccaacuaccgggacaaccagaaggucgugaucgaccaccgcgaggugagcgagaagauccacuucaacccccgguucggguccuacaaggagggccacaacuacgagaacaaccaccacuuccacaugaacacccccaaguacuuccuguga

SEQ ID NO: 28866 - RNA, 1194 nt, Artificial Sequence
  derived and/or modified sequence opt1 from CX3CL1__Homo_sapiens__NP_002987
auggcccccaucagccuguccuggcuccugcgccuggccaccuucugccaccucaccgugcugcuggcgggccagcaccacggggucacgaagugcaacaucacgugcagcaagaugaccuccaagaucccgguggcccuccugauccacuaccagcagaaccaggccagcugcggcaagcgggccaucauccuggagacccgccagcaccgccucuucugcgccgaccccaaggagcagugggugaaggacgcgaugcagcaccuggaccggcaggccgccgcccugacccggaacgggggcaccuucgagaagcagaucggggaggucaagccccgcaccacccccgcggccggcggcauggacgaguccguggugcucgagccggaggccacgggggagagcuccagccuggagcccacccccuccagccaggaggcccagcgggcccugggcaccucccccgagcucccgaccggggucacgggcagcuccgggacccgccugccgcccacccccaaggcgcaggacggcggccccguggggaccgagcuguuccgggugccgcccgucagcacggccgccaccuggcaguccagcgcgccccaccagcccggccccucccucugggccgaggccaagaccagcgaggcccccuccacccaggaccccagcacgcaggccagcaccgccuccagcccggcccccgaggagaacgcgcccuccgaggggcagcgcguguggggccagggccagagcccccggccggagaacucccuggagcgcgaggagauggggcccgugcccgcccacaccgacgccuuccaggacuggggccccgggagcauggcccacgucuccguggugccggucagcuccgagggcacccccagccgggagcccguggccuccgggagcuggacgccgaaggcggaggagcccauccacgccaccauggacccccagcgccugggcgugcucaucacccccgucccggacgcccaggccgcgacccggcgccaggccgugggccugcuggccuuccucgggcugcuguucugccucggcguggccauguucacguaccagucccugcaggggugcccccggaagauggccggcgagauggcggaggggcugcgcuacaucccccggagcugcggcuccaacagcuacguccucgugcccguguga

SEQ ID NO: 28867 - RNA, 1164 nt, Artificial Sequence
  derived and/or modified sequence opt1 from CX3CR1__Homo_sapiens__NP_001164645
augcgcgagccccuggaggccuucaagcucgccgaccuggacuuccgcaagagcucccuggcgagcggcuggcggauggccuccggggccuucaccauggaccaguucccggagagcgugaccgagaacuucgaguacgacgaccucgccgaggccugcuacaucggcgacaucgucguguucgggacgguguuccuguccaucuucuacagcgucaucuucgcgaucggccugguggggaaccuccugguggucuucgcccugaccaacuccaagaagcccaagagcgugaccgacaucuaccuccugaaccuggcccucuccgaccugcuguucguggccacccuccccuucuggacgcacuaccugaucaacgagaagggccugcacaacgcgaugugcaaguucaccaccgccuucuucuucaucggcuucuucgggagcaucuucuucaucaccgucaucuccaucgaccgguaccucgccaucgugcuggccgccaacagcaugaacaaccgcacggugcagcacggcgucaccaucucccugggggugugggcggccgccauccucguggccgcgccccaguucauguucaccaagcagaaggagaacgagugccugggcgacuacccggagguccugcaggagaucuggcccgugcuccggaacguggagaccaacuuccugggguuccugcucccccugcugaucaugagcuacugcuacuuccgcaucauccagacccucuucuccugcaagaaccacaagaaggccaaggccaucaagcugauccugcucgucgugaucguguucuuccuguucuggacgcccuacaacgucaugaucuuccuggagacccucaagcuguacgacuucuucccgagcugcgacaugcggaaggaccugcgccucgcccuguccgugaccgagacgguggccuucagccacugcugccugaacccccucaucuacgccuucgcgggcgagaaguuccggcgcuaccuguaccaccuguacggcaagugccucgccguccugugcgggcgguccgugcacgucgacuucagcagcuccgagagccagcgcucccggcacggcagcgugcuguccagcaacuucaccuaccacaccuccgacggggacgcccuccugcugcuguga

SEQ ID NO: 28868 - RNA, 603 nt, Artificial Sequence
  derived and/or modified sequence opt1 from CXADR__Homo_sapiens__NP_001193993
auggcccugcugcugugcuucgugcugcucugcggcgucguggacuucgcccgcagccuguccaucaccacccccgaggagaugaucgagaaggcgaagggggagacggccuaccugccgugcaaguucacccucagccccgaggaccagggcccccuggacaucgaguggcugaucucccccgccgacaaccagaagguggaccaggucaucauccucuacagcggggacaagaucuacgacgacuacuacccggaccugaagggccgggugcacuucaccuccaacgaccucaagagcggggacgccuccaucaacgugaccaaccugcagcugagcgacaucggcacguaccagugcaaggucaagaaggcccccggcguggcgaacaagaagauccaccuggugguccucgggaagaugugccaccuccagcgcgccgugcggccccugcccgaggccaccuccgccgugaucauccacccguggggccccugccugcugcccaccuggaaggacaucccccgccugagcaucaccaaguaccaggucaagacgcucaacgcgcugcugcgggugcgccucucccaccuccugcgguga

SEQ ID NO: 28869 - RNA, 297 nt, Artificial Sequence
  derived and/or modified sequence opt1 from CXCL10__Homo_sapiens__NP_001556
augaaccagaccgccauccugaucugcugccucaucuuccugacccugagcggcauccagggggugccccucucccgcaccguccggugcacgugcaucagcaucuccaaccagccggugaacccccgcagccuggagaagcuggagaucauccccgccucccaguucugcccccggguggagaucaucgcgaccaugaagaagaagggcgagaagcgcugccucaacccggagagcaaggccaucaagaaccugcugaaggccgucuccaaggagcggagcaagcgcucccccuga

SEQ ID NO: 28870 - RNA, 285 nt, Artificial Sequence
  derived and/or modified sequence opt1 from CXCL11__Homo_sapiens__NP_005400
augagcgugaagggcauggccaucgcccuggcggucauccucugcgccaccguggugcagggguuccccauguucaagcgcggccggugccugugcaucgggccgggcgucaaggccgugaagguggccgacaucgagaaggccuccaucauguaccccagcaacaacugcgacaagaucgaggucaucaucacccugaaggagaacaaggggcagcgcugccucaaccccaaguccaagcaggcgcggcugaucaucaagaagguggagcgcaagaacuucuga

SEQ ID NO: 28871 - RNA, 282 nt, Artificial Sequence
  derived and/or modified sequence opt1 from CXCL12__Homo_sapiens__NP_000600
augaacgccaagguggucguggugcugguccucgugcugaccgcccugugccucagcgacggcaagcccgugucccugagcuaccgcugcccgugccgguucuucgagucccacgucgcgcgcgccaacgugaagcaccugaagauccucaacacccccaacugcgcccugcagaucguggcccggcugaagaacaacaaccgccaggucugcaucgaccccaagcucaaguggauccaggaguaccuggagaaggcccugaacaagcgguucaagauguga

SEQ ID NO: 28872 - RNA, 330 nt, Artificial Sequence
  derived and/or modified sequence opt1 from CXCL13__Homo_sapiens__NP_006410
augaaguucaucagcaccucccugcuccugaugcugcucgugagcucccugagccccguccagggcgugcuggagguguacuacaccucccuccgcugccggugcguccaggagagcuccguguucaucccgcgccgguucaucgaccgcauccagauccugccccgggggaacggcugcccccgcaaggagaucaucguguggaagaagaacaagagcaucgucugcguggacccccaggccgaguggauccagcggaugauggaggugcugcgcaagcgguccagcuccacgcucccgguccccguguucaagcgcaagauccccuga

SEQ ID NO: 28873 - RNA, 336 nt, Artificial Sequence
  derived and/or modified sequence opt1 from CXCL14__Homo_sapiens__NP_004878
augagccugcucccccgccgggccccgcccguguccaugcgccugcuggccgcggcccuccugcugcuccugcuggcccucuacaccgcccgggucgacggcagcaagugcaagugcucccgcaaggggcccaagauccgguacagcgacgugaagaagcuggagaugaagcccaaguacccgcacugcgaggagaagauggugaucaucaccacgaaguccgucagccgcuaccggggccaggagcacugccugcaccccaagcuccaguccaccaagcgcuucaucaagugguacaacgccuggaacgagaagcggcgcguguacgaggaguga

SEQ ID NO: 28874 - RNA, 822 nt, Artificial Sequence
  derived and/or modified sequence opt1 from CXCL16__Homo_sapiens__NP_001094282
augagcggcucccagagcgagguggcccccuccccgcagagcccccgcucccccgagauggggcgggaccugcgccccggcagccggguccuccugcugcuccugcugcuccugcugguguaccucacccagccggggaacggcaacgagggguccgugaccggcagcugcuacugcggcaagcgcaucuccagcgacuccccgcccagcguccaguucaugaaccggcugcgcaagcaccuccgggccuaccaccgcugccuguacuacacgcgguuccagcugcuguccuggagcgugugcgggggcaacaaggaccccugggugcaggagcucauguccugccuggaccugaaggagugcgggcacgcguacagcggcaucgucgcccaccagaagcaccuccugcccaccuccccgcccaucagccaggccuccgagggggccagcagcgacauccacacccccgcccagaugcugcucuccacccugcagagcacgcagcgccccacccugcccgugggcucccucagcuccgacaaggagcugacccggcccaacgagaccacgauccacaccgcgggccacagccuggccgccgggcccgaggccggcgagaaccagaagcagccggagaagaacgcggggcccaccgcccgcaccuccgccacggugcccguccucugccugcuggccaucaucuucauccucaccgccgcgcugagcuacgugcugugcaagcggcgccggggccagagcccccaguccuccccggaccuccccgugcacuacauccccgucgcccccgacagcaacaccuga

SEQ ID NO: 28875 - RNA, 360 nt, Artificial Sequence
  derived and/or modified sequence opt1 from CXCL17__Homo_sapiens__NP_940879
augaaggugcugaucagcucccuccugcugcuccugccccugaugcucaugagcauggucuccagcucccugaacccgggcguggcccgcgggcaccgggaccgcggccaggccagccggcgcuggcugcaggagggcgggcaggagugcgagugcaaggacugguuccuccgggcgccccgccggaaguucaugaccguguccgggcugcccaagaagcagugccccugcgaccacuucaagggcaacgucaagaagacccgccaccagcggcaccaccgcaagccgaacaagcacagccgggccugccagcaguuccugaagcagugccagcuccgcuccuucgcccugccccuguga

SEQ ID NO: 28876 - RNA, 324 nt, Artificial Sequence
  derived and/or modified sequence opt1 from CXCL1__Homo_sapiens__NP_001502
auggcccgcgccgcgcugagcgccgcccccuccaacccgcggcuccugcgcguggcccugcuccugcugcuccuggucgccgcgggccggcgcgccgccggggccagcguggcgaccgagcugcggugccagugccuccagacccugcagggcauccaccccaagaacauccaguccgugaacgucaagagccccgggccccacugcgcccagacggaggugaucgccacccugaagaacggccgcaaggccugccucaacccggccucccccaucgugaagaagaucaucgagaagaugcugaacagcgacaaguccaacuga

SEQ ID NO: 28877 - RNA, 324 nt, Artificial Sequence
  derived and/or modified sequence opt1 from CXCL2__Homo_sapiens__NP_002080
auggcccgcgccacccugagcgcggcccccuccaacccgcggcuccugcgcguggcccugcuccugcugcuccuggucgccgccagccggcgcgcggccggcgcgccccuggccaccgagcuccggugccagugccugcagacgcugcaggggauccaccucaagaacauccaguccgugaaggucaagagccccggcccccacugcgcccagaccgaggugaucgccacccugaagaacgggcagaaggccugccugaacccggccucccccauggugaagaagaucaucgagaagaugcucaagaacggcaagagcaacuga

SEQ ID NO: 28878 - RNA, 324 nt, Artificial Sequence
  derived and/or modified sequence opt1 from CXCL3__Homo_sapiens__NP_002081
auggcccacgccacccugagcgcggcccccuccaacccgcgccuccugcggguggcccugcuccugcugcuccuggucgccgccagccgccgggcggccggcgccuccguggugaccgagcugcgcugccagugccuccagacgcugcaggggauccaccugaagaacauccagagcgucaacgugcggucccccggcccccacugcgcccagaccgaggugaucgcgacccucaagaacgggaagaaggccugccugaaccccgccagcccgaugguccagaagaucaucgagaagauccugaacaagggcuccaccaacuga

SEQ ID NO: 28879 - RNA, 345 nt, Artificial Sequence
  derived and/or modified sequence opt1 from CXCL5__Homo_sapiens__NP_002985
augagccugcucuccagccgcgccgcccgggugcccggcccguccagcucccugugcgcgcugcucguccugcugcuccugcugacccagcccgggcccaucgccagcgccggccccgccgccgcggugcuccgcgagcugcggugcgugugccugcagaccacgcaggggguccacccgaagaugaucuccaaccuccagguguucgccaucggcccccagugcagcaagguggaggucguggccucccugaagaacgggaaggagaucugccuggaccccgaggcccccuuccucaagaaggugauccagaagauccuggacggcggcaacaaggagaacuga

SEQ ID NO: 28880 - RNA, 345 nt, Artificial Sequence
  derived and/or modified sequence opt1 from CXCL6__Homo_sapiens__NP_002984
augagccugcccuccagccgcgccgcccgggugccgggccccuccgggagccucugcgcgcugcuggcccuccugcugcuccugaccccgcccggcccccuggccuccgccgggcccgucagcgccgugcucaccgagcugcgcugcacgugccugcgggugacccuccgcgucaaccccaagaccaucggcaagcuccagguguuccccgcggggccgcagugcuccaagguggaggucguggccagccugaagaacggcaagcaggucugccuggaccccgaggcccccuuccugaagaaggugauccagaagauccuggacuccggcaacaagaagaacuga

SEQ ID NO: 28881 - RNA, 300 nt, Artificial Sequence
  derived and/or modified sequence opt1 from CXCL8__Homo_sapiens__NP_000575
augaccagcaagcuggccguggcccuccuggcggccuuccugaucuccgccgcccucugcgagggcgccguccugccccgcagcgcgaaggagcugcggugccagugcaucaagaccuacuccaagccguuccaccccaaguucaucaaggagcuccgcgugaucgagagcgggccccacugcgccaacacggagaucaucgugaagcuguccgacggccgggagcugugccucgaccccaaggagaacuggguccagcgcgugguggagaaguuccugaagcgggccgagaacagcuga

SEQ ID NO: 28882 - RNA, 378 nt, Artificial Sequence
  derived and/or modified sequence opt1 from CXCL9__Homo_sapiens__NP_002407
augaagaaguccggcgugcuguuccuccuggggaucauccugcucguccugaucggcgugcaggggacccccgugguccgcaagggccggugcagcugcaucagcaccaaccaggggacgauccaccuccagucccugaaggaccugaagcaguucgccccgagccccuccugcgagaagaucgagaucaucgccacccugaagaacggcgugcagaccugccucaaccccgacagcgcggacgugaaggagcugaucaagaagugggagaagcaggucucccagaagaagaagcagaagaacggcaagaagcaccagaagaagaaggugcugaaggugcgcaagagccagcggucccgccagaagaagaccacguga

SEQ ID NO: 28883 - RNA, 1053 nt, Artificial Sequence
  derived and/or modified sequence opt1 from CXCR1__Homo_sapiens__NP_000625
augagcaacaucaccgacccccagaugugggacuucgacgaccugaacuucaccggcaugccgcccgccgacgaggacuacucccccugcaugcucgagacggagacccugaacaaguacguggucaucaucgccuacgcgcugguguuccuccugagccugcucgggaacucccuggugaugcuggucauccucuacagccgcgugggccgguccgugaccgacgucuaccugcugaaccucgcccuggccgaccuccucuucgcccugacccugcccaucugggccgcgagcaaggugaacggguggaucuucggcacguuccucugcaagguggucucccugcugaaggaggugaacuucuacagcgggauccuccugcuggccugcaucuccguggaccgcuaccucgccaucguccacgccacccggacccugacccagaagcgccaccuggugaaguucgugugccucggcugcuggggccugagcaugaaccugucccucccguucuuccuguuccggcaggcguaccaccccaacaacagcucccccgucugcuacgaggugcuggggaacgacacggccaaguggcgcauggugcuccggauccugccccacaccuucggcuucaucgucccgcuguucgugaugcuguucugcuacggguucacccugcgcacccuguucaaggcccacaugggccagaagcaccgggccaugcgcgugaucuucgccgucgugcucaucuuccugcugugcuggcuccccuacaaccuggugcugcucgcggacacgcugaugcggacccaggucauccaggagagcugcgagcgccggaacaacaucgggcgcgcccuggacgccaccgagauccucggcuuccugcacuccugccugaaccccaucaucuacgccuucaucggccagaacuuccggcacggguuccugaagauccucgccaugcacggccuggugagcaaggaguuccuggcgcgccaccgggucaccuccuacacgagcuccagcgugaacgugagcuccaaccucuga

SEQ ID NO: 28884 - RNA, 1083 nt, Artificial Sequence
  derived and/or modified sequence opt1 from CXCR2__Homo_sapiens__NP_001161770
auggaggacuucaacauggagagcgacuccuucgaggacuucuggaagggcgaggaccugagcaacuacuccuacagcuccacccugcccccguuccugcuggacgccgcccccugcgagcccgagagccucgagaucaacaaguacuucguggucaucaucuacgcgcugguguuccugcucucccugcuggggaacagccucgugaugcuggucauccuguacucccgcgugggccggagcgugaccgacgucuaccuccugaaccuggcccucgccgaccugcuguucgcccucacgcugcccaucugggccgcguccaaggugaacggguggaucuucggcaccuuccugugcaagguggucagccuccugaaggaggugaacuucuacuccgggauccugcuccuggccugcaucagcguggaccgcuaccuggccaucguccacgccacccggacccucacgcagaagcgcuaccuggugaaguucaucugccuguccaucuggggccucagccugcugcucgcgcugccggugcuccucuuccggcgcaccgucuacuccagcaacgugucccccgccugcuacgaggacaugggcaacaacaccgccaacuggcggaugcugcugcgcauccucccccagagcuucggguucaucgugccccugcugaucaugcuguucugcuacggcuucacccuccggacgcuguucaaggcccacauggggcagaagcaccgcgccaugcgggucaucuucgcgguggugcucaucuuccugcugugcuggcucccguacaaccugguccugcuggccgacacccucaugcgcacccaggugauccaggagaccugcgagcggcgcaaccacaucgaccgggcccuggacgccacggagauccugggcauccuccacagcugccugaacccccugaucuacgccuucaucgggcagaaguuccgccacggccuccugaagauccuggcgauccacggccucaucuccaaggacagccugcccaaggacucccggcccagcuucgugggguccagcuccggccacaccagcaccacccuguga

SEQ ID NO: 28885 - RNA, 1248 nt, Artificial Sequence
  derived and/or modified sequence opt1 from CXCR3__Homo_sapiens__NP_001136269
auggagcugcgcaaguacggccccgggcggcucgccggcaccgugaucgggggcgccgcgcagagcaagucccagaccaagagcgacuccaucacgaaggaguuccugccggggcuguacaccgcccccagcucccccuucccgcccagccaggucuccgaccaccaggugcucaacgacgccgagguggccgcccugcuggagaacuucagcuccagcuacgacuacggcgagaacgaguccgacagcugcugcaccuccccgcccugcccccaggacuucagccucaacuucgaccgcgcguuccugcccgcccuguacucccuccuguuccugcucggccugcuggggaacggcgccgucgccgcggugcuccugagccggcgcaccgcccuguccagcacggacaccuuccuccugcaccuggccguggccgacacccuccugguccugacccucccccugugggccguggacgcggccgugcagugggucuucggguccggccugugcaagguggccggggcccucuucaacaucaacuucuacgccggcgcgcugcugcucgccugcaucagcuucgaccgguaccugaacaucgugcacgccacgcagcuguaccgccggggcccgcccgcccgcgucacccugaccugccucgccgugugggggcugugccuccuguucgcgcugcccgacuucaucuuccucagcgcccaccacgacgagcggcugaacgccacccacugccaguacaacuucccccaggugggccgcacggcccugcggguccuccagcugguggccggguuccugcucccccugcuggugauggcguacugcuacgcccacauccucgccguccugcuggugucccgcggccagcggcgccugcgggccaugcgccucguggucgugguggucguggcguucgcccugugcuggacccccuaccaccuggucgugcucguggacauccugauggaccugggcgcccucgcccggaacugcgggcgcgagagccgggucgacguggccaaguccgugaccagcggccugggguacaugcacugcugccugaacccgcuccuguacgcguucgucggcgugaaguuccgcgagcggauguggaugcugcuccugcgccuggggugccccaaccagcgcggccuccagcggcagcccuccagcucccgccgggacagcuccuggagcgagaccuccgaggccagcuacuccggccuguga

SEQ ID NO: 28886 - RNA, 1071 nt, Artificial Sequence
  derived and/or modified sequence opt1 from CXCR4__Homo_sapiens__NP_001008540
augagcaucccccugccgcuccugcagaucuacaccuccgacaacuacaccgaggagaugggcagcggggacuacgacuccaugaaggagcccugcuuccgcgaggagaacgccaacuucaacaagaucuuccugcccacgaucuacagcaucaucuuccucaccggcaucguggggaacggccuggucauccuggugaugggguaccagaagaagcuccgguccaugaccgacaaguaccgccugcaccugagcguggccgaccuccuguucgucaucacccugcccuucugggcgguggacgccguggccaacugguacuucggcaacuuccucugcaaggccguccacgugaucuacacggugaaccuguacuccagcguccugauccucgccuucaucucccuggaccgguaccuggcgaucgugcacgccaccaacagccagcgcccgcggaagcuccuggccgagaagguggucuacgugggcguguggauccccgcccugcuccugaccauccccgacuucaucuucgcgaacgucuccgaggccgacgaccgcuacaucugcgaccgguucuaccccaacgaccugugggugguggucuuccaguuccagcacaucaugguggggcucauccugccgggcaucgugauccugagcugcuacugcaucaucaucuccaagcucagccacuccaaggggcaccagaagcgcaaggcccugaagaccacggucauccugauccucgccuucuucgccugcuggcugcccuacuacaucggcaucagcaucgacuccuucauccugcucgagaucaucaagcaggggugcgaguucgagaacaccgugcacaaguggaucagcaucaccgaggcgcuggccuucuuccacugcugccugaaccccauccucuacgccuuccugggcgccaaguucaagaccuccgcccagcacgcgcugacgagcgugagccggggcuccagccucaagauccuguccaaggggaagcgcggcgggcacagcuccgucagcaccgaguccgagagcuccagcuuccacuccagcuga

SEQ ID NO: 28887 - RNA, 1119 nt, Artificial Sequence
  derived and/or modified sequence opt1 from CXCR5__Homo_sapiens__NP_001707
augaacuacccccugacccucgagauggaccuggagaaccuggaggaccucuucugggagcuggaccgccuggacaacuacaacgacaccagccucguggagaaccaccugugcccggccacggagggcccccugauggccuccuucaaggcggucuucgugcccguggccuacagccucaucuuccugcugggggucaucggcaacgugcucgugcuggucauccuggagcggcaccgccagacccgguccagcaccgagaccuuccucuuccaccuggccguggccgaccugcuccugguguucauccugcccuucgccgucgcggagggguccgugggcugggugcucgggacguuccugugcaagaccgucaucgcccugcacaaggugaacuucuacugcagcucccuccugcuggccugcaucgccguggaccgcuaccucgcgaucguccacgccgugcacgccuaccggcaccgccggcugcugagcauccacaucacgugcggcaccaucuggcucgugggcuuccugcuggcccucccggagauccuguucgccaaggucucccaggggcaccacaacaacagccugccccgcugcaccuucucccaggagaaccaggcggagacccacgccugguucaccagccgguuccucuaccacguggccggcuuccugcugcccaugcucgugaugggguggugcuacgucggcguggugcaccgccugcggcaggcccagcgccggccccagcgccagaaggccguccggguggcgauccuggucaccuccaucuucuuccucugcuggagcccguaccacaucgugaucuuccuggacacgcuggcccgccucaaggccguggacaacacgugcaagcugaacgggucccugcccgucgccaucaccaugugcgaguuccucggccuggcccacugcugccugaaccccaugcuguacaccuucgcgggcgugaaguuccggagcgaccucucccgccugcugaccaagcucgggugcaccggccccgccagccugugccagcuguucccguccuggcggcgcagcagccucuccgagagcgagaacgccaccucccugaccacguucuga

SEQ ID NO: 28888 - RNA, 1029 nt, Artificial Sequence
  derived and/or modified sequence opt1 from CXCR6__Homo_sapiens__NP_006555
auggccgagcacgacuaccacgaggacuacggcuucagcuccuucaacgacagcucccaggaggagcaccaggacuuccugcaguucagcaagguguuccuccccugcauguaccuggucguguucgugugcgggcuggucggcaacucccucgugcuggugaucagcaucuucuaccacaagcugcagucccucaccgacgucuuccuggugaaccugccgcucgccgaccugguguucgucugcacccugcccuucugggcguacgccgggauccacgaguggguguucggccaggugaugugcaagagccuccuggggaucuacacgaucaacuucuacaccuccaugcugauccugaccugcaucaccgucgaccgcuucaucgugguggucaaggccacgaaggccuacaaccagcaggccaagcggaugaccuggggcaaggugaccagccuccugaucugggugaucucccuccuggucagccugccccagaucaucuacggcaacguguucaaccucgacaagcugaucugcggguaccacgacgaggcgaucuccaccgugguccuggccacgcagaugacccucggcuucuuccugccccugcucaccaugaucgugugcuacagcgugaucaucaagacccugcugcacgccgggggcuuccagaagcaccgcucccucaagaucaucuuccuggucauggccguguuccugcucacgcagaugccguucaaccugaugaaguucauccggagcacccacugggaguacuacgcgaugaccuccuuccacuacaccaucauggucacggaggccaucgccuaccugcgcgccugccucaaccccgugcuguacgccuucgugagccugaaguuccggaagaacuucuggaagcucgucaaggacaucgggugccugcccuaccugggcgugucccaccaguggaaguccagcgaggacaacagcaagaccuucagcgcgucccacaacguggaggccaccagcauguuccagcucuga

SEQ ID NO: 28889 - RNA, 549 nt, Artificial Sequence
  derived and/or modified sequence opt1 from CXorf36__Homo_sapiens__NP_078965
auggagccccagcugggcccggaggccgccgcgcuccgccccggguggcuggcccugcuccugugggugagcgcccuguccugcagcuucucccuccccgccagcucccugagcucccuggucccccaggugcggaccagcuacaacuucggccgcaccuuccucgggcuggacaagugcaacgccugcaucggcacguccaucugcaagaaguucuucaaggaggagauccggagcgacaacuggcuggcgucccaccucgggcugccgcccgacagccugcucuccuaccccgccaacuacagcgacgacuccaagaucuggcgccccguggagaucuuccggcuggucagcaaguaccagaacgagaucuccgaccgccggaucugcgccagcgccuccgcgccgaagaccugcagcaucgagcgcgugcugcggaagaccgagcgcuuccagaaguggcuccaggccaagcggcugacccccgaccuggugcaggacugccaccagggccagcgcgagcucaaguuccugugcaugcugcgguga

SEQ ID NO: 28890 - RNA, 1086 nt, Artificial Sequence
  derived and/or modified sequence opt1 from CXorf66__Homo_sapiens__NP_001013421
augaaccuggugaucugcguccuccugcugagcaucuggaagaacaacugcaugaccaccaaccagacgaacggcuccagcaccaccggggacaagcccguggaguccaugcagaccaagcucaacuaccugcgccggaaccugcucauccuggugggcaucaucaucauggucuucguguucaucugcuucugcuaccugcacuacaacugccucagcgacgacgccuccaaggccgggauggugaagaagaagggcaucgcggccaagagcuccaagacgagcuucuccgaggccaagaccgccagccagugcuccccggagacccagcccaugcugagcaccgccgacaaguccagcgacuccagcucccccgagcgcgcgagcgcccaguccagcacggagaagcugauccggcccagcucccuccagaagccgagcauccccaacuccgccgggaagcugacccgccccagcuaccccaagcgguccagcaaguccagcugcuccaagaagcugagcaaguccagccaccucgagaaggcccacaagaagggcucccuggagaagcugugcaagcucgacuacgcgugcaagcuggccagcuccgacaagccgguccgcccgccccagcuguucaagccccucuacagcucccacccccagaacgagaucagccccuccaagcccuucggcccccaggagcuggccaagccgcccaagcacuucaaccccaagcggagcgugagccuggggcgcgccgcccuccuguccaacagcgagcuggcggagaccugccagcccuacaagaagaagcaccucguggccaagaccuaccggccgcuggucaacgacaucuccgaggccaaggagaagaacacgcagaaccugcacgugagcuccaaggucaagagcuccagccgcuccuuccggaagcucgacagccgcaacaacgccuacggcgaccacgugaacgacuccgacaccaugaaguacuacagcgagguggacuccgacaaggugaucaucaucacgugcgaccggggguacaaccaggucaccagcgaggugacccugaacgacuga

SEQ ID NO: 28891 - RNA, 1512 nt, Artificial Sequence
  derived and/or modified sequence opt1 from CXorf67__Homo_sapiens__NP_981952
auggccacccagagcgacauggagaaggagcagaagcaccagcaggacgagggccagggcgggcugaacaacgagaccgcccucgcguccggggacgccugcggcacggggaaccaggaccccgccgccagcgugaccaccgucuccagccaggccucccccagcggcggcgcggcccuguccagcuccaccgccgggagcuccgccgcggccgccacgagcgccgccaucuucaucaccgacgaggcguccggccugcccaucaucgccgccgugcucaccgagcgccacagcgaccggcaggacugccgcagcccccacgagguguucgggugcgucgugcccgagggcgggucccaggccgccgugggcccgcagaaggcgaccggccacgccgacgagcaccuggcccagacgaagucccccgggaacagccggcgccggaagcagcccugccgcaaccaggccgcccccgcgcagaagccgcccggccggcgccuguuccccgagccccucccgcccuccagccccggguuccggcccagcuccuacccgugcagcggcgccuccaccagcucccaggccacccagcccggccccgcccugcugagccacgccuccgaggcgcgccccgccacccggagccgcaucacgcucgucgccuccgcccugcggcgccgggcgagcgggccgggccccgugauccgcgggugcaccgcccagcccggccccgccuucccgcaccgggccacccaccuggaccccgcccgccucucccccgagagcgcgcccgggccggcccggcgcggccgggccuccgugcccggccccgcccgccgcgggugcgacagcgccccgggccccgcgcggcgcgggcgggacuccgcccccgucagcgcgccccgcggccgggacuccgccccggggagcgcccgccggggccgcgacuccgcccccggccccgcccugcgggugcgcaccgcccggagcgacgccgggcaccgcagcacguccaccacccccggcaccgggcugcggagccgcuccacgcagcagcggagcgcgcuccugucccgccggagccuguccggcagcgccgacgagaacccguccugcgggaccggcagcgagcgccucgccuuccagucccggagcggcucccccgaccccgaggugcccagccgcgccuccccgcccgucuggcacgccgugcgcaugcgggcgagcucccccagcccgcccgggcgcuucuuccugcccaucccccagcagugggacgagagcuccagcuccagcuacgccuccaacagcuccagccccucccggagcccgggccugucccccagcucccccagccccgaguuccucgggcugcgcuccaucagcaccccgucccccgagagccugcgguacgcccucaugcccgaguucuacgcccuguccccggugccgcccgaggagcaggccgagaucgagagcaccgcgcaccccgccacgccgcccgagcccuga

SEQ ID NO: 28892 - RNA, 1983 nt, Artificial Sequence
  derived and/or modified sequence opt1 from CXXC1__Homo_sapiens__NP_001095124
auggagggcgacgggagcgaccccgagccgcccgacgccggcgaggacuccaagagcgagaacggggagaacgcccccaucuacugcaucugccgcaagcccgacaucaacugcuucaugaucggcugcgacaacugcaacgagugguuccacggggacugcauccggaucaccgagaagauggcgaaggccauccgcgagugguacugccgggagugccgcgagaaggacccgaagcuggagauccgguaccgccacaagaagucccgggagcgcgacggcaacgagcgggacagcuccgagccccgcgacgagggcgggggccggaagcgccccgugcccgacccggaccuccagcggcgcgccgggagcggcaccggggucggcgccaugcuggcccggggcuccgcgagcccccacaaguccagcccccagccccugguggccacgccgucccagcaccaccagcagcagcagcagcagaucaagcgcagcgcccggaugugcggggagugcgaggccugccgccggaccgaggacugcggccacugcgacuucugccgcgacaugaagaaguucgggggccccaacaagauccggcagaagugccgccuccgccagugccagcugcgggcgcgcgaguccuacaaguacuuccccagcucccugagccccgugaccccguccgagagccucccccggccccgccggccccugccgacccagcagcagccccagcccucccagaagcugggccgcauccgggaggacgagggggccgucgccagcagcacggugaaggagcccccggaggccaccgccacccccgagccccucuccgacgaggaccugccccuggacccggaccucuaccaggacuucugcgcgggcgccuucgacgaccacgggcugcccuggaugagcgacaccgaggagucccccuuccuggacccggcccuccgcaagcgggccgugaaggucaagcacgugaagcgccgggagaagaaguccgagaagaaggugauggagcgcaaggaggagcgguacaagcgccaccggcagaagcagaagcacaaggacaaguggaagcaccccgagcgcgccgacgcgaaggaccccgccagccugccccagugccugggcccggggugcguccggcccgcccagcccagcuccaaguacugcagcgacgacugcggcaugaagcucgccgccaaccgcaucuacgagauccugccccagcggauccagcaguggcagcaguccccgugcaucgcggaggagcacggcaagaagcugcucgagcgcauccgccgggagcagcagagcgcccgcacgcggcugcaggagauggagcgccgguuccacgagcuggaggccaucauccuccgcgccaagcagcaggccgugcgggaggacgaggaguccaacgagggggacagcgacgacaccgaccugcagaucuucugcguguccugcggccaccccaucaacccccgcgucgcgcugcggcacauggagcgcugcuacgccaaguacgagagccagaccuccuucgggagcauguaccccacccggaucgagggcgccacgcgccucuucugcgacguguacaacccgcaguccaagaccuacugcaagcggcuccaggugcugugccccgagcacagccgcgaccccaagguccccgccgacgaggugugcgggugcccgcucgugcgggacgucuucgagcugaccggcgacuucugccgccugcccaagcggcagugcaaccgccacuacugcugggagaagcuccggcgcgcggagguggaccuggagcgggugcgcgucugguacaagcuggacgagcuguucgagcaggagcgcaacgugcggaccgccaugacgaaccgcgccggccugcuggcccucaugcugcaccagaccauccagcacgacccccugaccaccgaccuccgguccagcgccgaccgcuga

SEQ ID NO: 28893 - RNA, 1104 nt, Artificial Sequence
  derived and/or modified sequence opt1 from CXXC4__Homo_sapiens__NP_079488
augaacaccaacgugugcgucgagcccggcccgagccccgaggcccccgggcugcccaaggagucccaccucccggagggcgcccugaacagccugguggacuacaacuccgagauggagcgcuaccggagcuucgcgaccuccuucuacaagacgaacgggggcgccuucccccaggccgccaagaucgcccgcaucaccacccccaucuuccccagcuccgcggccgccgccgcggccgccgcccggaucgggaugagcccguggaacugcgacaacgccgcgaccgccgccgccgccacggcgaugcucuggggcuccggcgggggcgggggcgggggcggcgggggcgggggcggcgggggcgggggcgggggcggcgggggcgggggcgggggcggccgcaagagcuccagcgccgccgccuccagcuccgccagcuccagcuccgcgauccugcccgccgggggcgggggcgggggcggcgggggcgggagccggaccagcaugcaccaccgcaacgacucccagcggcugggcaaggccggcugcccgcccgagcccagccuccagauggccaacaccaacuuccuguccacccugagccccgagcacugccgcccccucgccggggagugcaugaacaagcugaagugcggcgcggccgaggccgagaucaugaaccugcccgagcggguggggacguucuccgccaucccggcgcucggcgggaucagccugccgcccggcgucaucgugaugaccgcccugcacucccccgccgccgccagcgcggccgugaccgacuccgccuuccagaucgccaaccucgccgacugcccccagaaccacagcuccagcuccagcuccagcuccggcggggcgggcggggccaaccccgccaagaagaagcgcaagcggugcggcgucugcgugcccugcaagcgccugaucaacugcggggugugcagcuccugccggaaccgcaagaccggccaccagaucugcaaguuccggaagugcgaggagcugaagaagaagcccggcacgagccucgagcgcaccccgguccccagcgccgaggccuuccggugguucuucuga

SEQ ID NO: 28894 - RNA, 669 nt, Artificial Sequence
  derived and/or modified sequence opt1 from CYB561D2__Homo_sapiens__NP_001278213
auggcccugagcgccgagaccgagucccacaucuaccgcgcgcuccggaccgccagcggcgccgccgcccaccugguggcgcugggguucacgaucuucgucgccgugcucgcccgccccggcuccagccuguucuccuggcacccggugcugaugagccucgccuucuccuuccugaugaccgaggcgcugcucgucuucagccccgaguccagccugcugcacucccucagccggaaggggcgcgcccggugccacugggugcugcagcugcucgcccugcugugcgcccuccugggccuggggcucgugauccugcacaaggagcagcugggcaaggcccaccucgucacccgccacggccaggcggggcugcuggccgugcucugggccggccugcagugcuccgggggcguggggcugcucuaccccaagcugcugccccgguggccgcucgccaagcugaagcuguaccacgccaccagcggccucgucggcuaccugcugggguccgcgagccuccugcugggcaugugcucccucugguucacggccagcgugaccggggccgccugguaccuggccgugcugugccccguccucaccucccuggugaucaugaaccaggugagcaacgcguaccuguaccgcaagcggauccagcccuga

SEQ ID NO: 28895 - RNA, 756 nt, Artificial Sequence
  derived and/or modified sequence opt1 from CYB561__Homo_sapiens__XP_005257148
auggagggcggggccgccgcggccacccccaccgcccugccguacuacguggccuucagccagcuccugggccugacgcucgucgccaugaccggggcguggcugggccuguaccgcgggggcaucgccugggaguccgaccuccaguucaacgcccacccccugugcauggugaucggccugaucuuccuccaggggaacgcccugcugguguaccgggucuuccgcaacgaggcgaagcggaccaccaaggugcuccacggccugcugcacaucuucgcccucgugaucgcccuggucgggcugguggccguguucgacuaccaccgcaagaagggcuacgccgaccucuacagccugcacuccuggugcgggauccuggucuucgugcucuacuucgugcaguggcuggucggcuucagcuucuuccuguuccccggcgcguccuucagccuccggucccgcuaccggccccagcacaucuucuucggggccacgaucuuccugcugagcgugggcaccgcccuccuggggcugaaggaggcccuccuguucaaccugggcggcaaguacuccgccuucgagccggagggggugcucgcgaacguccugggccugcuccuggccugcuucgggggcgccgugcuguacauccucacccgcgccgacuggaagcggcccagccaggccgaggagcaggcgcuguccauggacuucaagacccugacggagggggacagccccggcucccaguga

SEQ ID NO: 28896 - RNA, 375 nt, Artificial Sequence
  derived and/or modified sequence opt1 from CYB5A__Homo_sapiens__NP_001177736
auggccgagcagagcgacgaggccgugaaguacuacacccuggaggagauccagaagcacaaccacuccaagagcaccuggcucauccugcaccacaaggucuacgaccugacgaaguuccucgaggagcaccccggcggggaggaggugcugcgcgagcaggcgggcggggacgccaccgagaacuucgaggacgugggccacuccaccgacgcccgggagaugagcaagaccuucaucaucggggagcugcacccggagacgcucaucaccaccaucgacuccagcuccagcugguggaccaacugggucauccccgccaucuccgccguggcgguggcccugauguaccgccuguacauggccgaggacuga

SEQ ID NO: 28897 - RNA, 453 nt, Artificial Sequence
  derived and/or modified sequence opt1 from CYB5B__Homo_sapiens__NP_085056
augagcggcuccauggccaccgccgaggcgagcggguccgacggcaaggggcaggagguggagaccagcgucaccuacuaccgccuggaggagguggccaagcggaacucccucaaggagcuguggcuggugauccacggccgcgucuacgacgugacccgguuccucaacgagcaccccgggggcgaggaggugcugcuggagcaggccggcgucgacgccagcgaguccuucgaggacguggggcacagcuccgacgcccgcgagaugcucaagcaguacuacaucggcgacauccacccgagcgaccugaagcccgaguccgggagcaaggaccccuccaagaacgacacgugcaagagcugcugggcguacuggauccugcccaucaucggcgccgugcuccugggguuccuguaccgguacuacaccuccgagagcaaguccagcuga

SEQ ID NO: 28898 - RNA, 906 nt, Artificial Sequence
  derived and/or modified sequence opt1 from CYB5R3__Homo_sapiens__NP_000389
augggcgcccagcugagcacccucgggcacauggugcuguuccccgucugguuccuguacucccuccugaugaagcuguuccagcgcagcacccccgccaucacgcucgagucccccgacaucaaguacccccugcggcugaucgaccgcgagaucaucagccacgacacccggcgcuuccgguucgcgcuccccuccccgcagcacauccugggccugcccguggggcagcacaucuaccucagcgcccgcaucgacggcaaccuggugguccggcccuacacccccaucuccagcgacgacgacaagggguucguggaccuggugaucaaggucuacuucaaggacacccacccgaaguuccccgccggcggcaagaugucccaguaccucgagagcaugcagaucggggacacgaucgaguuccgcggccccuccgggcugcugguguaccagggcaaggggaaguucgccauccggcccgacaagaaguccaacccgaucauccgcaccgucaagagcgugggcaugaucgccggcgggaccggcaucacccccaugcuccaggugauccgggcgaucaugaaggaccccgacgaccacacggugugccaccuccuguucgccaaccagaccgagaaggacauccugcugcgccccgagcuggaggagcuccggaacaagcacagcgcccgcuucaagcugugguacacccuggaccgggccccggaggcgugggacuacgggcagggcuucgucaacgaggagaugauccgcgaccaccucccgccgcccgaggaggagccccuggugcugaugugcgggcccccgcccaugauccaguacgccugccuccccaaccuggaccacgugggccaccccaccgagcggugcuucgucuucuga

SEQ ID NO: 28899 - RNA, 1566 nt, Artificial Sequence
  derived and/or modified sequence opt1 from CYB5R4__Homo_sapiens__NP_057314
augcugaacgugcccagccaguccuucccggcgccccgcagccagcagcgggucgccuccggcgggcgcagcaaggugccccucaagcagggccggucccugauggacuggauccgccugaccaagagcgggaaggaccucaccggccugaaggggcggcugaucgaggugacggaggaggagcucaagaagcacaacaagaaggacgacugcuggaucugcauccgcggcuucgucuacaacgugucccccuacauggaguaccacccgggcggggaggacgagcugaugcgggccgccggcagcgacgggaccgagcuguucgaccaggugcaccgcugggucaacuacgaguccaugcucaaggagugccuggugggccggauggccaucaagcccgccgugcugaaggacuaccgcgaggaggagaagaagguccucaacgggaugcugcccaagagccaggugaccgacacccuggccaaggagggccccuccuacccgagcuacgacugguuccagacggacucccucgugaccaucgcgaucuacaccaagcagaaggacaucaaccuggacagcaucaucgucgaccaccagaacgacuccuuccgggccgagaccaucaucaaggacugccuguaccucauccacaucggccugagccacgaggugcaggaggacuucuccgugcgcgucguggagagcguggggaagaucgagaucguccugcagaagaaggagaacacguccugggacuuccucggccacccccugaagaaccacaacagccugaucccccggaaggacaccgggcucuacuaccgcaagugccagcugaucagcaaggaggacgugacccacgacacccggcuguucugccucaugcugcccccguccacgcaccuccaggugcccaucggccagcacgucuaccugaagcugcccaucaccggcaccgagaucgugaagcccuacaccccggugagcgggucccugcucagcgaguucaaggagcccguccugcccaacaacaaguacaucuacuuccugaucaagaucuaccccacgggccucuucaccccggagcuggaccgccugcagaucggggacuucguguccgucagcucccccgagggcaacuucaagaucagcaaguuccaggagcucgaggaccuguuccugcucgccgccgggaccggcuucacccccauggugaagauccugaacuacgcgcugacggacauccccucccuccggaaggugaagcugauguucuucaacaagaccgaggacgacaucaucuggcgcagccagcuggagaagcucgccuucaaggacaagcggcuggacgucgaguucgugcuguccgccccgaucagcgaguggaacggcaagcaggggcacaucucccccgcccugcucagcgaguuccugaagcgcaaccuggacaaguccaaggugcucgucugcaucugcggccccgugcccuucaccgagcagggggugcggcugcugcacgaccucaacuucagcaagaacgagauccacuccuucaccgccuga

SEQ ID NO: 28900 - RNA, 588 nt, Artificial Sequence
  derived and/or modified sequence opt1 from CYBA__Homo_sapiens__NP_000092
augggccagaucgagugggccaugugggccaacgagcaggcgcuggccagcgggcucauccugaucaccggcgggaucguggccaccgccggccgcuucacgcagugguacuucggggccuacuccaucgucgcgggcguguucgugugccugcucgaguacccccggggcaagcgcaagaaggggagcaccauggagcgguggggccagaaguacaugaccgccgucgugaagcuguucgggcccuucacccgcaacuacuacgugcgggccguccugcaccuccugcuguccgugcccgccggcuuccuccuggcgacgauccuggggaccgccugccucgccaucgccagcggcaucuaccugcuggccgcggugcgcggcgagcaguggacccccaucgagcccaagccccgggagcgcccccagaucgggggcaccaucaagcagccgcccuccaacccgccgccccggccgcccgccgaggcccgcaagaagcccagcgaggaggaggccgccgucgcggccgggggcccgcccggcgggccccaggugaaccccauccccgugacggacgaggucguguga

SEQ ID NO: 28901 - RNA, 1713 nt, Artificial Sequence
  derived and/or modified sequence opt1 from CYBB__Homo_sapiens__NP_000388
augggcaacugggccgugaacgaggggcugagcaucuucgucauccucguguggcugggccugaacguguuccucuucgucugguacuaccgcguguacgacaucccgcccaaguucuucuacacccggaagcugcugggguccgcccucgcgcuggcccgcgcccccgccgccugccugaacuucaacugcaugcucauccugcugcccgugugccggaaccuccugagcuuccugcgcggcuccagcgcgugcugcuccacccggguccgccggcagcucgaccgcaaccugacguuccacaagaugguggccuggaugaucgcccugcacagcgccauccacaccaucgcgcaccucuucaacguggaguggugcgucaacgcccgggugaacaacuccgaccccuacagcguggcccuguccgagcugggggaccgccagaacgagagcuaccucaacuucgcccggaagcgcaucaagaacccggagggcggccuguaccuggccgucacccuccuggcggggaucaccggcguggugaucacgcugugccucauccugaucaucaccuccagcaccaagaccauccggcgcuccuacuucgaggucuucugguacacgcaccaccuguucgugaucuucuucaucgggcucgccauccacggcgccgagcggaucgugcgcgggcagaccgccgagagccuggccguccacaacaucaccgugugcgagcagaagaucuccgaguggggcaagaucaaggagugccccaucccccaguucgcgggcaacccgcccaugaccuggaaguggaucguggggcccauguuccuguaccucugcgagcggcugguccgcuucuggcggagccagcagaagguggugaucacgaaggucgugacccaccccuucaagaccaucgagcugcagaugaagaagaagggcuucaagauggaggucgggcaguacaucuucgugaagugccccaagguguccaagcucgaguggcacccguucacccugacgagcgcccccgaggaggacuucuucuccauccacauccgcaucgucggcgacuggaccgagggccuguucaacgccugcgggugcgacaagcaggaguuccaggacgccuggaagcuccccaagaucgccguggacggccccuucgggaccgcgagcgaggacguguucagcuacgaggucgugaugcuggugggcgccgggaucggcgucaccccguucgccuccauccucaagagcgugugguacaaguacugcaacaacgccacgaaccugaagcugaagaagaucuacuucuacuggcugugccgggacacccacgccuucgagugguucgcggaccuccugcagcugcucgagucccagaugcaggagcgcaacaacgccggcuuccugagcuacaacaucuaccugaccgggugggacgagucccaggccaaccacuucgccgugcaccacgacgaggagaaggacgucaucaccggccugaagcagaagacgcucuacgggcgccccaacugggacaacgaguucaagaccaucgcgagccagcaccccaacacccggaucggcguguuccugugcgggcccgaggcccuggccgagacccucuccaagcagagcaucuccaacagcgaguccggcccgcgcggcgugcacuucaucuucaacaaggagaacuucuga

SEQ ID NO: 28902 - RNA, 474 nt, Artificial Sequence
  derived and/or modified sequence opt1 from CYBRD1__Homo_sapiens__NP_001120855
auggccauggagggcuacuggcgcuuccuggcccuccuggggagcgcgcugcucgugggcuuccuguccgucaucuucgcccuggugugggugcuccacuaccgggaggggcugggcugggacgggagcgcccuggaguucaacuggcaccccguccucauggugaccggcuucguguucauccagggcaucgccuccuuccgcuucuucagccuguccgccagcaugggguccgcguucagcccguccaucagccacgcccacacgugccuguucuggaacugccaccucuggaacuccgacugcaacagcaccuacggcaucgaccgggagaccgacuucuuccccgagcgcuccugcauccaguacauccccgcccggcgcugcuuccggaaguacgccuggcccagcgacccggggguccgcggcccccacuuccuggacucccaccagaccgcgauggagaccagcuga

SEQ ID NO: 28903 - RNA, 978 nt, Artificial Sequence
  derived and/or modified sequence opt1 from CYC1__Homo_sapiens__NP_001907
auggccgccgcggccgccagccugcgcggcgugguccucgggccccgcggcgccgggcugccgggcgcccgcgcgcgggggcugcucugcuccgcccgccccggccagcugccccugcggacgccccaggccguggcccucagcuccaagagcggccugucccgcgggcggaaggugaugcugagcgcgcucggcaugcuggccgccgggggcgccgggcuggccgucgcgcuccacuccgccgugagcgccuccgaccuggagcugcacccgcccagcuaccccuggucccaccgcggccuccugagcucccuggaccacaccagcauccggcgcggcuuccagguguacaagcaggucugcgccuccugccacagcauggacuucguggccuaccggcaccucgugggggucugcuacaccgaggacgaggcgaaggagcuggccgccgagguggaggugcaggacggccccaacgaggacggggagauguucaugcgcccgggcaagcuguucgacuacuuccccaagcccuaccccaacuccgaggccgcccgggcggccaacaacggcgcccucccgcccgaccugagcuacaucguccgcgcccggcacgggggcgaggacuacguguucucccugcucaccggguacugcgagccgcccaccggcgugagccugcgcgaggggcuguacuucaaccccuacuuccccggccaggccaucgcgauggccccgcccaucuacaccgacguccucgaguucgacgacggcacgcccgccaccaugagccagaucgccaaggacgugugcaccuuccugcggugggcguccgagcccgagcacgaccaccgcaagcggauggggcugaagaugcucaugaugauggcccugcuggugccccucgucuacaccaucaagcgccacaaguggagcgugcugaagucccggaagcuggccuaccggcccccgaaguga

SEQ ID NO: 28904 - RNA, 318 nt, Artificial Sequence
  derived and/or modified sequence opt1 from CYCS__Homo_sapiens__NP_061820
augggcgacguggagaaggggaagaagaucuucaucaugaagugcagccagugccacaccgucgagaagggcgggaagcacaagaccggccccaaccugcacggccucuucgggcgcaagacgggccaggccccgggguacuccuacaccgccgcgaacaagaacaagggcaucaucuggggcgaggacacccugauggaguaccuggagaaccccaagaaguacauccccgggaccaagaugaucuucguggggaucaagaagaaggaggagcgggccgaccucaucgccuaccugaagaaggccacgaacgaguga

SEQ ID NO: 28905 - RNA, 3762 nt, Artificial Sequence
  derived and/or modified sequence opt1 from CYFIP1__Homo_sapiens__NP_001274739
auggccgcccaggugacccuggaggacgcgcucagcaacgucgaccugcuggaggagcucccccugccggaccagcagcccugcaucgagcccccgcccuccagccugcucuaccagcccaacuucaacaccaacuucgaggaccgcaacgccuucgugacgggcaucgcccgguacaucgagcaggccaccgugcacuccagcaugaacgagaugcuggaggaggggcaggaguacgccgucaugcuguacaccuggcgcuccugcagccgggcgaucccccaggugaagugcaacgagcagcccaaccgcguggagaucuacgagaagaccgucgaggugcucgagccggaggugacgaagcugaugaacuucauguacuuccagcggaacgccaucgagcgcuucugcggcgagguccggcgccugugccacgccgagcggcgcaaggacuucguguccgaggccuaccucaucacccuggggaaguucaucaacauguucgcggugcuggacgagcucaagaacaugaagugcagcgucaagaacgaccacuccgccuacaagcgggccgcccaguuccugcgcaagauggccgacccccagagcauccaggagucccagaaccugagcauguuccucgcgaaccacaacaagaucacccagucccugcagcagcagcuggaggugaucagcggcuacgaggagcuccuggccgacaucgugaaccugugcgucgacuacuacgagaaccggauguaccucacccccuccgagaagcacaugcugcugaaggugaugggguucggccucuaccugauggacggcagcguguccaacaucuacaagcuggacgccaagaagcgcaucaaccucagcaagaucgacaaguacuucaagcagcugcaggucgugccccuguucggggacaugcagaucgagcucgcccgguacaucaagacguccgcccacuacgaggagaacaagagccgcuggaccugcaccagcuccggcagcuccccgcaguacaacaucugcgagcagaugauccagauccgggaggaccacaugcgcuucaucagcgagcuggcgcgguacuccaacagcgagguggucaccggguccggccgccaggaggcccagaagacggacgccgaguaccggaagcuguucgaccucgcccugcaggggcugcagcuccugagccagugguccgcccacgugauggagguguacagcuggaagcugguccaccccaccgacaaguacuccaacaaggacugccccgacagcgcggaggaguacgagcgcgccacccgcuacaacuacaccuccgaggagaaguucgcccucguggaggucaucgccaugaucaagggccuccaggugcugaugggccggauggagagcguguucaaccacgccauccgccacacggucuacgcggcccugcaggacuucucccaggugacccugcgggagccccugcgccaggccaucaagaagaagaagaacgugauccagagcguccuccaggccauccggaagaccgugugcgacugggagaccgggcacgagccguucaacgaccccgcgcugcgcggcgagaaggaccccaaguccggguucgacaucaaggugccccggcgcgccgucggcccgagcuccacgcagcuguacauggugcggaccaugcuggagagccucaucgccgacaagagcggcuccaagaagacccugcgcagcucccuggaggggcccaccauccucgacaucgagaaguuccaccgggagagcuucuucuacacgcaccugaucaacuucuccgagacccugcagcagugcugcgaccucagccagcugugguuccgcgaguucuuccuggagcucaccaugggccggcgcauccaguuccccaucgagauguccaugcccuggauccugaccgaccacauccuggagacgaaggaggccagcaugauggaguacgugcucuacucccuggaccuguacaacgacagcgcccacuacgcgcucacccgguucaacaagcaguuccuguacgacgagaucgaggccgaggucaaccugugcuucgaccaguucguguacaagcucgccgaccagaucuucgccuacuacaaggugauggccgggucccugcugcucgacaagcgccugcggagcgagugcaagaaccagggcgcgaccauccaccucccgcccuccaaccgcuacgagacccugcugaagcagcggcacguccagcugcucgggcgcagcaucgaccugaaccgccugaucacgcagcggguguccgccgccauguacaagagccucgagcuggccaucggccgcuucgaguccgaggaccugaccagcaucguggagcucgacggccugcuggagaucaaccggaugacccacaagcuccugagccgcuaccugacccucgacggguucgacgccauguuccgggaggcgaaccacaacgucuccgcccccuacggccgcaucacgcugcacguguucugggagcugaacuacgacuuccuccccaacuacugcuacaacgggagcaccaaccgguucgugcgcaccguccugccguucucccaggaguuccagcgggacaagcagcccaacgcccagccccaguaccugcacggcagcaaggcccucaaccuggcguacuccagcaucuacggguccuaccgcaacuucgugggcccgccccacuuccaggugaucugccggcugcucggcuaccaggggaucgccgucgugauggaggagcugcugaagguggucaagagccuccugcagggcaccauccugcaguacgugaagacccucauggaggugaugcccaagaucugccgccugccccggcacgaguacggguccccgggcauccuggaguucuuccaccaccagcucaaggacaucgucgaguacgccgagcugaagacggugugcuuccagaaccugcgcgagguggggaacgccauccucuucugccugcugaucgagcagagccucucccuggaggaggucugcgaccugcuccacgccgcgcccuuccagaacauccugccccgggugcacgugaaggagggcgagcgccuggacgccaagaugaagcggcucgagagcaaguacgcgccccugcaccuggucccgcucaucgagcgccugggcacgccccagcagaucgccaucgcccgggagggggaccugcucaccaaggagcgccugugcugcggccuguccauguucgaggugauccucacccggauccgcagcuuccuggacgaccccaucuggcgcgggccccugccguccaacggcgugaugcacgucgacgagugcguggaguuccaccggcucuggagcgccaugcaguucguguacugcauccccgucggcacccacgaguucaccguggagcagugcuucggggacggccugcacugggccgggugcaugaucaucgugcugcucggccagcagcgccgguucgccguccuggacuucugcuaccaccuccugaaggugcagaagcacgacgggaaggacgagaucaucaagaacgugccccugaagaagauggucgagcgcauccggaaguuccagauccugaacgacgagaucaucaccauccucgacaaguaccugaaguccggcgacggcgaggggacccccguggagcacgugcgcugcuuccagccgcccauccaccagagccuggccuccagcuga

SEQ ID NO: 28906 - RNA, 3684 nt, Artificial Sequence
  derived and/or modified sequence opt1 from CYFIP2__Homo_sapiens__NP_001278650
augaccacccacgugacgcuggaggacgcccucagcaacgucgaccugcuggaggagcucccccugcccgaccagcagcccugcaucgagcccccgcccuccagcaucauguaccaggccaacuucgacaccaacuucgaggaccgcaacgcguucgugaccggcaucgcccgguacaucgagcaggccaccgugcacuccagcauggucaagugcaacgagcagcccaaccgcguggagaucuacgagaagacgguggagguccuggagcccgaggugaccaagcucaugaaguucauguacuuccagcggaaggccaucgagcgcuucugcuccgaggugaagcggcugugccacgccgagcgccggaaggacuucgucagcgaggcguaccugcucacccuggggaaguucaucaacauguucgccgugcuggacgagcucaagaacaugaagugcuccgugaagaacgaccacagcgccuacaagcgcgccgcgcaguuccugcggaagauggccgacccccaguccauccaggagagccagaaccuguccauguuccucgccaaccacaaccgcaucacccagugccugcaccagcagcuggaggucaucccgggcuacgaggagcuccuggccgacaucgugaacaucugcguggacuacuacgagaacaagauguaccugacgcccagcgagaagcacaugcuccugaaggucaugggguucggccuguaccucauggacgggaacguguccaacaucuacaagcuggacgccaagaagcggaucaaccugagcaagaucgacaaguucuucaagcagcuccagguggucccccuguucggcgacaugcagaucgagcuggcgcgcuacaucaagaccuccgcccacuacgaggagaacaagagcaaguggaccugcacccaguccagcaucagcccccaguacaacaucugcgagcagauggugcagauccgggacgaccacauccgcuucaucagcgagcucgcccgguacagcaacuccgagguggucacgggcagcgggcuggacucccagaaguccgacgaggaguaccgcgagcuguucgaccucgcccugcggggccugcagcuccuguccaaguggagcgcccacgugauggagguguacuccuggaagcugguccacccgaccgacaaguucugcaacaaggacugccccgggaccgcggaggaguacgagcgcgccacccgguacaacuacacgagcgaggagaaguucgccuucguggaggucaucgccaugaucaagggccuccaggugcugauggggcgcauggaguccguguucaaccaggccauccggaacaccaucuacgcggcccugcaggacuucgcccaggucacccuccgcgagccccugcgccaggccgugcggaagaagaagaacgugcugaucagcguccuccaggccauccgcaagaccaucugcgacugggagggcggccgggagcccccgaacgaccccugccugcgcggggagaaggaccccaagggcggguucgacaucaaggugccccggcgcgcggugggcccguccagcacgcagcuguacaugguccggaccaugcucgagucccugaucgccgacaagagcggcuccaagaagacccugcgcagcucccuggacgggcccaucgugcucgccaucgaggacuuccacaagcagagcuucuucuucacccaccuccugaacaucuccgaggcccugcagcagugcugcgaccugagccagcugugguuccgggaguucuuccucgagcugacgaugggccgccggauccaguuccccaucgagaugagcaugcccuggauccugaccgaccacauccucgagaccaaggagccguccaugauggaguacgugcuguacccccuggaccucuacaacgacagcgcguacuacgcccugaccaaguucaagaagcaguuccuguacgacgagaucgaggccgaggucaaccucugcuucgaccaguucguguacaagcuggccgaccagaucuucgccuacuacaaggcgauggccggguccgugcugcucgacaagcgcuuccgggccgagugcaagaacuacggcgucaucauccccuacccgcccagcaaccgcuacgagacgcugcugaagcagcggcacgugcagcuccuggggcgcuccaucgaccugaaccggcucaucacccagcgcaucagcgccgccauguacaagucccuggaccaggcgaucagccgguucgaguccgaggaccugaccagcaucguggagcucgaguggcugcuggagaucaaccgccucacccaccgccugcugugcaagcacaugacgcucgacuccuucgacgccauguuccgggaggccaaccacaacgucagcgcccccuacggccgcaucacccugcacguguucugggagcugaacuucgacuuccuccccaacuacugcuacaacggcuccaccaaccgguucgugcgcaccgccaucccguucacgcaggagccccagcgggacaagcccgcgaacguccagcccuacuaccuguacgggagcaagccgcugaacaucgccuacucccacaucuacagcuccuaccgcaacuucgugggcccgccccacuucaagaccaucugccggcuccugggguaccagggcaucgccguggucauggaggagcugcucaagaucgucaagagccugcugcaggggaccauccuccaguacgugaagacccugaucgaggugaugcccaagaucugccgccugccccggcacgaguacggcagccccggcauccucgaguucuuccaccaccagcugaaggacaucaucgaguacgccgagcugaagaccgacguguuccagucccuccgcgagguggggaacgcgauccuguucugccugcucaucgagcaggcccugagccaggaggaggucugcgaccugcuccacgccgcccccuuccagaacauccugccccggguguacaucaaggagggcgagcgccuggaggugcggaugaagcgccucgaggccaaguacgcgccgcugcaccuggucccccucaucgagcggcuggggacgccccagcagaucgccaucgcccgcgagggcgaccugcucaccaaggagcggcugugcugcgggcuguccauguucgaggugauccucacccgcauccggagcuaccugcaggaccccaucuggcgcggcccgccgcccaccaacggcgugaugcacgucgacgagugcguggaguuccaccggcugugguccgccaugcaguucguguacugcauccccgucgggacgaacgaguucaccgccgagcagugcuucggcgacgggcucaacugggcgggcugcagcaucaucgugcugcugggccagcagcgccgcuucgaccucuucgacuucugcuaccaccuccugaaggugcagcggcaggacgggaaggacgagaucaucaagaacgucccccugaagaagauggccgaccgcauccggaaguaccagauccugaacaacgagguguucgccauccugaacaaguacaugaaguccguggagaccgacagcuccaccgucgagcacgugcgcugcuuccagccgcccauccaccagagccucgccacgaccugcuga

SEQ ID NO: 28907 - RNA, 573 nt, Artificial Sequence
  derived and/or modified sequence opt1 from CYGB__Homo_sapiens__NP_599030
auggagaaggugcccggcgagauggagaucgagcgccgggagcgcagcgaggagcuguccgaggccgagcggaaggccgugcaggcgaugugggcccgccucuacgccaacugcgaggacguggggguggccauccugguccgguucuucgugaacuuccccagcgccaagcaguacuucucccaguucaagcacauggaggacccccuggagauggagcgcagcccccagcuccggaagcacgcgugccgcgugaugggcgcccugaacaccgucguggagaaccugcacgaccccgacaagguguccagcguccucgcccugguggggaaggcccacgcgcugaagcacaagguggagccggucuacuucaagauccucuccggcgugauccuggagguggucgccgaggaguucgccagcgacuucccgcccgagacccagcgggccugggccaagcugcgcgggcucaucuacucccacgugacggcggccuacaaggaggugggcuggguccagcagguccccaacgccaccaccccgcccgccacccugcccagcuccggccccuga

SEQ ID NO: 28908 - RNA, 1956 nt, Artificial Sequence
  derived and/or modified sequence opt1 from CYLC1__Homo_sapiens__NP_066941
augagccugccccgccuccugaaggugaacauccggaccuacgacaacuccauccccaucagcgaguccagccgcaaguccuggaaccagaagcacuucgcccugaccuuccccaagccccuccagcggggcacgaacgacaagagccgcccccugaagucccagaucaccgucacccggcacgacaagcgcaagcuggaggaggggcagaagcccgcccacaaguggauccggcacagcuuccgcaagauccuccaguggccgcccaucuacaccgcggcccgggagcagacgcccuuccgccaccuguacaccuccaagacccaccugaagaaggccgaguacaagaaguccaaggacgagaagggcgggaccccgcucaagaaggacagcaagaagaagggcgggagcuacgccacgaaccccgaguccaagcagaucguggaggagaagaccaagcggcagaacgaggccgacaagacgccccucaagagcucccacgagaacgagcagagcaagaaguccaagagcuccagcgagaccaaccccgagagccagaacuccaagaccgugagcaagaacugcucccagaaggacaagaaggacagcaagaacuccaagaagaccaacaccgaguuccugcacaccaagaacaacccgaagaaggaccugaagcgcagcaagacguccaacgaccccaucagcgagaucugcuccgagaacagccugaacgucgacuuccugaugcucgugggccaguccgacgacgagagcaucaacuucgacgcguggcugcggaacuacucccagaacaacagcaagaacuacucccugaaguacaccaaguacaccaagaaggacaccaagaagaacgccaagaaguccagcgacgccgagagcgaggacuccaaggacgccaagaaggacagcaagaaggugaagaagaacgucaagaaggacgacaagaagaaggacgugaagaaggacacggagagcaccgacgcggaguccggcgacagcaaggacgagcgcaaggacaccaagaaggacaagaagaagcucaagaaggacgacaagaagaaggacaccaagaaguaccccgaguccacggacaccgagagcggggacgccaaggacgcccggaacgacucccgcaaccugaagaaggccagcaagaacgacgacaagaagaaggacgccaagaagaucaccuucuccaccgacagcgaguccgagcuggagagcaaggagucccagaaggacgagaagaaggacaagaaggacagcaagacggacaacaagaaguccgugaagaacgacgaggagagcaccgacgcggacuccgagcccaagggcgacagcaagaaggggaagaaggacgagaagaagggcaagaaggacuccaagaaggacgacaagaagaaggacgccaagaagaacgccgagagcaccgagauggagagcgaccucgagcugaagaaggacaagaagcacuccaaggagaagaaggggagcaagaaggacaucaagaaggacgcccggaaggacaccgaguccacggacgccgaguucgacgagagcuccaagaccggcuucaagaccagcaccaagaucaagggcuccgacacggagagcgaggagucccuguacaagccgggggcgaagaagaagaucgacgagagcgacggcaccuccgccaacagcaagauggaggggcucgaguccaagcgcggcuuccggaugagcuccaagaagaccaccuucaacgagaagggcgagaaggccagcaccgggcgcgucccgcccucccgggagaagccgccccugcccgccugcgagcccagccugcccucccccaaggugcgccgccucugcuggugcaagaugcccccgccgccgcccaagccccgguacgcgccccugcccgaggcccccuggauccacaagcugcucuga

SEQ ID NO: 28909 - RNA, 1047 nt, Artificial Sequence
  derived and/or modified sequence opt1 from CYLC2__Homo_sapiens__NP_001331
augagccugccccgcuuccagcgggugaacuucggcccguacgacaacuacauccccgucuccgagcucagcaagaaguccuggaaccagcagcacuucgcccugcuguuccccaagccccagcgcccggggaccaagcggcgcagcaagcccucccagauccgggacaacaccgugagcaucaucgacgaggagcagcuccgcggcgaccggcgccagccccuguggauguaccggucccugaugcgcaucagcgagcggcccuccguguaccucgccgcgcgccggcagccgcugaagcccacgcgcaccgucgagguggacagcaaggccgccgagaucgggaagaagggcgaggacaagaccacccagaaggacacgaccgacuccgagagcgagcugaagcaggggaagaaggacuccaagaagggcaaggacaucgagaagggcaaggaggagaagcucgacgccaagaaggacagcaagaaggggaagaaggacgccgagaagggcaaggacuccgcgaccgagagcgaggacgagaagggcggggccaagaaggacaacaagaaggacaagaaggacuccaacaaggggaaggacagcgccaccgaguccgagggcgagaagggcgggacggagaaggacagcaagaagggcaagaaggacagcaagaaggggaaggacuccgccaucgagcugcaggcggugaaggccgacgagaagaaggacgaggacggcaagaaggacgccaacaagggcgacgagagcaaggacgccaagaaggacgccaaggagaucaagaaggggaagaaggacaagaagaagcccuccagcaccgacuccgacagcaaggacgacgucaagaaggaguccaagaaggacgcgaccaaggacgccaagaagguggccaagaaggacaccgagaaggagagcgccgacuccaagaaggacgccaagaagaacgcgaagaaggacgccaagaaggacgccaagaagaacgccaagaaggacgagaagaaggacgccaagaagaagggcaaguga

SEQ ID NO: 28910 - RNA, 2862 nt, Artificial Sequence
  derived and/or modified sequence opt1 from CYLD__Homo_sapiens__NP_001035877
augagcuccggccuguggagccaggagaaggugaccucccccuacugggaggagcgcaucuucuaccuccugcugcaggagugcagcgucaccgacaagcagacgcagaagcuccugaaggugccgaagggguccaucggccaguacauccaggaccggagcguggggcacucccgcauccccagcgccaagggcaagaagaaccagaucgggcugaagauccucgagcagccccacgccguccuguucguggacgagaaggacguggucgagaucaacgagaaguucaccgagcugcuccuggcgaucaccaacugcgaggagcgguucucccuguucaagaaccgcaaccggcucagcaagggccugcagaucgacgugggcugccccgugaagguccagcugcgcuccggggaggagaaguucccgggcguggugcgguuccgcgggccccuccuggccgagcggaccgucagcggcaucuucuucgggguggagcugcucgaggagggccgcggccagggguucacggacggcguguaccaggggaagcagcuguuccagugcgacgaggacugcggcgucuucguggcccuggacaagcucgagcugaucgaggacgacgacaccgcccuggaguccgacuacgccggccccggggacaccaugcaggucgagcugcccccgcucgagaucaacagccgggucucccugaaggugggcgagaccaucgagagcgggacggugaucuucugcgacguccuccccggcaaggagucccugggguacuucgugggcguggacauggacaaccccaucggcaacugggacgggcgcuucgacggcguccagcugugcagcuucgcgugcguggaguccaccauccuccugcacaucaacgacaucauccccgagagcgucacccaggagcggcgcccgcccaagcuggccuucaugagccgcggggugggcgacaagggguccagcucccacaacaagcccaaggccaccggcagcacguccgaccccggcaaccggaaccggagcgagcuguucuacacccugaacggguccagcguggacucccagccgcagagcaaguccaagaacaccugguacaucgacgagguggccgaggaccccgccaagagccugaccgagaucuccacggacuucgaccgcagcuccccgccccuccagcccccgcccgugaacagccugaccaccgagaaccgguuccacucccugcccuucagccucaccaagaugcccaacacgaacggcuccaucgggcacagcccccugagccuguccgcgcagagcgugauggaggagcucaacaccgcccccguccaggagagcccgccccuggccaugccgcccggcaacucccacgggcuggaggugggcucccucgccgaggugaaggagaacccgcccuucuacggcgucauccgcuggaucgggcagccgcccggccugaacgaggugcuggcggggcucgagcuggaggacgagugcgccggcugcaccgacggcaccuuccgggggacgcgcuacuucacgugcgcccugaagaaggcccuguucgugaagcucaagagcugccgccccgacucccgguucgccagccugcagcccgucuccaaccagaucgagcgcugcaacagccuggcguucggcggguaccucuccgaggugguggaggagaacaccccgcccaagauggagaaggagggccuggagaucaugaucgggaagaagaagggcauccagggccacuacaacagcugcuaccuggacuccacccucuucugccuguucgccuucagcuccguccuggacaccgugcuccugcggcccaaggagaagaacgacguggaguacuacagcgagacccaggagcugcuccgcaccgagaucgucaacccccugcggaucuacggguacgugugcgccaccaagaucaugaagcugcgcaagauccucgagaagguggaggccgccuccggcuucacgagcgaggagaaggaccccgaggaguuccugaacauccuguuccaccacauccuccgggucgagccccugcugaagauccgcagcgcggggcagaaggugcaggacugcuacuucuaccagaucuucauggagaagaacgagaaggugggcguccccaccauccagcagcuccuggagugguccuucaucaacagcaaccugaaguucgccgaggcccccuccugccucaucauccagaugccccgguucgggaaggacuucaagcuguucaagaagaucuuccccagccuggagcucaacaucaccgaccugcuggaggacaccccgcgccagugccggaucugcggcggccucgccauguacgagugccgcgagugcuacgacgaccccgacaucuccgccgggaagaucaagcaguucugcaagacgugcaacacccaggugcaccuccaccccaagcggcugaaccacaaguacaaccccgugagccucccgaaggaccugcccgacugggacuggcgccacggcugcauccccugccagaacauggagcuguucgcgguccucugcaucgagaccucccacuacguggccuucgugaaguacgggaaggacgacagcgccuggcuguucuucgacuccauggccgaccgggacggcgggcagaacggcuucaacaucccccaggucaccccgugccccgaggugggcgaguaccugaagaugagccucgaggaccugcacucccuggacagccgccggauccaggggugcgcgcgccggcuccugugcgacgccuacaugugcauguaccagucccccaccaugagccuguacaaguga

SEQ ID NO: 28911 - RNA, 1566 nt, Artificial Sequence
  derived and/or modified sequence opt1 from CYP11A1__Homo_sapiens__NP_000772
augcuggccaagggccugcccccgcgcagcgugcuggucaaggggugccagaccuuccuguccgcgccccgggagggccucgggcgccugcgggugcccaccggcgagggggccggcaucagcacgcgcagcccccggccguucaacgagauccccucccccggcgacaacggguggcugaaccucuaccacuucuggcgcgagaccggcacccacaaggugcaccuccaccacguccagaacuuccagaaguacgggcccaucuaccgggagaagcugggcaacguggaguccguguacgucaucgacccggaggacguggcccuccuguucaagagcgaggggcccaaccccgagcgcuuccugaucccgcccuggguggccuaccaccaguacuaccagcggcccaucggcguccuccugaagaaguccgccgccuggaagaaggaccgcguggcgcugaaccaggaggugauggcccccgaggccaccaagaacuuccucccccugcuggacgccgucagccgggacuucguguccgugcuccaccgccggaucaagaaggcgggcagcgggaacuacuccggcgacaucagcgacgaccuguuccgcuucgccuucgaguccaucacgaacgucaucuucggggagcggcagggcaugcuggaggagguggugaacccggaggcccagcgcuucaucgacgccaucuaccagauguuccacaccagcguccccaugcucaaccugccgcccgaccuguuccgccucuuccggaccaagaccuggaaggaccacguggccgcgugggacgugaucuucuccaaggccgacaucuacacgcagaacuucuacugggagcugcggcagaagggcagcguccaccacgacuaccgcgggauccuguaccggcuccugggcgacuccaagaugagcuucgaggacaucaaggccaacgugaccgagaugcuggccgggggcguggacaccaccuccaugacgcuccaguggcaccuguacgagauggcccgcaaccugaagguccaggacaugcuccgcgcggaggugcuggccgcccggcaccaggcccagggggacauggccaccaugcugcagcucgucccccugcugaaggcgagcaucaaggagacccuccgccugcaccccaucagcgugacccugcagcgguaccucgugaacgaccugguccugcgcgacuacaugauccccgccaagacgcucguccagguggccaucuacgcccugggccgggagcccaccuucuucuucgacccggagaacuucgaccccacccgcuggcuguccaaggacaagaacaucaccuacuuccggaaccucggcuucggguggggcgugcgccagugccuggggcggcgcaucgccgagcuggagaugacgaucuuccugaucaacaugcucgagaacuuccggguggagauccagcaccugagcgacgugggcaccaccuucaaccugauccucaugcccgagaagcccaucuccuucaccuucuggccguucaaccaggaggcgacgcagcaguga

SEQ ID NO: 28912 - RNA, 1512 nt, Artificial Sequence
  derived and/or modified sequence opt1 from CYP11B1__Homo_sapiens__NP_000488
auggcccugcgcgccaaggcggaggugugcauggccguccccuggcucagccugcagcgggcccaggcccugggcacccgcgccgcgcgggugccgcgcaccgugcuccccuucgaggccaugccccggcgccccgggaaccgguggcugcgccugcuccagaucuggcgggagcagggcuacgaggaccugcaccuggagguccaccagacguuccaggagcucgggccgaucuuccgcuacgaccugggcggggccggcauggugugcgugaugcugcccgaggacgucgagaagcuccagcaggucgacucccugcacccccaccggaugagccuggagcccuggguggccuaccgccagcaccggggccacaagugcgggguguuccuccugaacggcccggaguggcgcuucaaccggcugcgccucaaccccgaggugcugucccccaacgcggugcagcgguuccugcccauggucgacgccguggcccgcgacuucagccaggcccucaagaagaaggugcugcagaacgcccgggggucccugacccucgacguccagccgagcaucuuccacuacaccaucgaggcguccaaccuggcccuguucggcgagcgccucgggcuggugggccacagccccuccagcgccucccugaacuuccuccacgcccuggaggugauguucaagagcaccguccagcugauguucaugccccggucccucagccgcuggacgucccccaagguguggaaggagcacuucgaggccugggacugcaucuuccaguacggcgacaacugcauccagaagaucuaccaggagcuggcguucagccgcccgcagcaguacaccuccaucguggccgagcugcuccugaacgccgagcugagccccgacgccaucaaggccaacuccauggagcucaccgcggggagcgucgacaccacgguguucccccugcugaugacccucuucgagcuggcccggaaccccaacgugcagcaggcccugcgccaggagagccucgccgccgcggccuccaucagcgagcacccgcagaaggccaccaccgagcugccccugcuccgggccgcgcugaaggagacgcugcgccuguaccccgucggccucuuccuggagcggguggccuccagcgaccugguccuccagaacuaccacauccccgccgggacccuggugcgcguguuccuguacucccucggccggaacccggcccuguucccccgccccgagcgguacaacccccagcgcuggcuggacauccggggcagcgggcgcaacuucuaccacgucccguucggcuucgggaugcggcagugccucggccgccggcuggccgaggcggagaugcugcuccugcugcaccacgugcucaagcaccuccagguggagacccugacccaggaggacaucaagauggucuacuccuucauccugcgccccagcauguucccccugcugacguuccgggccaucaacuga

SEQ ID NO: 28913 - RNA, 1512 nt, Artificial Sequence
  derived and/or modified sequence opt1 from CYP11B2__Homo_sapiens__NP_000489
auggcccugcgcgccaaggcggaggugugcgucgccgcccccuggcucucccugcagcgggcccgcgcccugggcacccgggcggcccgcgccccgcggaccgugcuccccuucgaggccaugccccagcaccccgggaaccgcuggcugcggcugcuccagaucuggcgcgagcagggcuacgagcaccuccaccuggagaugcaccagacguuccaggagcuggggccgaucuuccgguacaaccugggcgggccccgcauggugugcgucaugcugcccgaggacguggagaagcuccagcaggucgacucccugcaccccugccggaugauccuggagccguggguggcguaccgccagcaccggggccacaagugcggcguguuccuccugaacgggcccgaguggcgcuucaaccggcugcgccucaaccccgacgugcugagccccaaggccguccagcgguuccugccgaugguggacgccguggcccgcgacuucucccaggcccucaagaagaagguccugcagaacgcgcggggcagccugacccucgacgugcagcccuccaucuuccacuacaccaucgaggccagcaaccuggcccuguucggggagcgccucggccugguggggcacucccccagcuccgccagccugaacuuccuccacgcccuggaggucauguucaaguccaccgugcagcugauguucaugccccggagccucucccgcuggaucagcccgaagguguggaaggagcacuucgaggcgugggacugcaucuuccaguacggcgacaacugcauccagaagaucuaccaggagcuggccuucaaccgcccccagcacuacacgggcaucgucgccgagcugcuccugaaggccgagcugucccucgaggccaucaaggcgaacagcauggagcugaccgccggguccguggacaccaccgccuucccccugcucaugacgcuguucgagcuggcccggaaccccgacgugcagcagauccuccgccaggagagccuggccgcggccgccuccaucagcgagcacccgcagaaggccaccaccgagcugccccuccugcgggcggcccugaaggagacccugcgccucuaccccgucggccuguuccuggagcggguggugagcuccgaccucguccugcagaacuaccacauccccgccgggacgcuggugcaggucuuccucuacagccugggccgcaacgccgcccuguucccgcggcccgagcgcuacaacccccagcgguggcucgacauccgcggcuccgggcggaacuuccaccacgugcccuucggcuucgggaugcgccagugccugggccggcgccuggcggaggccgagaugcuccugcugcuccaccacgugcugaagcacuuccuggucgagacccucacccaggaggacaucaagaugguguacagcuucauccugcggccggggaccagcccccugcucacguuccgcgccaucaacuga

SEQ ID NO: 28914 - RNA, 1527 nt, Artificial Sequence
  derived and/or modified sequence opt1 from CYP17A1__Homo_sapiens__NP_000093
augugggagcugguggcccuccugcugcucacccuggccuaccuguucuggcccaagcgccggugcccgggcgcgaaguaccccaagagccuccugucccugccccucgucgggagccugcccuuccugccgcgccacggccacaugcacaacaacuucuucaagcuccagaagaaguacgggcccaucuacuccgugcggaugggcaccaagacgaccgugaucgucgggcaccaccagcuggccaaggaggugcugaucaagaagggcaaggacuucagcggccgcccccagauggccacccucgacaucgccuccaacaaccggaaggggaucgccuucgcggacagcggcgcccacuggcagcugcaccgccggcuggccauggccaccuucgcccucuucaaggacggggaccagaagcuggagaagaucaucugccaggagaucuccacgcugugcgacaugcucgcgacccacaacggccagagcaucgacaucuccuuccccguguucgucgccgugaccaacgugaucagccugaucugcuucaacaccuccuacaagaacggggacccggagcugaacgucauccagaacuacaacgagggcaucaucgacaaccucagcaaggacucccugguggaccuggugcccuggcucaagaucuuccccaacaagacgcuggagaagcucaagagccacgucaagauccgcaacgaccuccugaacaagauccuggagaacuacaaggagaaguuccgguccgacagcaucaccaacaugcucgacacccugaugcaggccaagaugaacuccgacaacggcaacgccgggcccgaccaggacagcgagcugcucuccgacaaccacauccugaccacgaucggcgacaucuucggggcgggcguggagaccaccaccagcguggucaaguggacgcuggccuuccuccugcacaacccccaggugaagaagaagcuguacgaggagaucgaccagaacgugggcuucagccgcaccccgaccaucuccgaccggaaccgccuccugcugcucgaggccaccauccgggagguccugcgccugcggcccguggcccccaugcucaucccgcacaaggccaacguggacagcuccaucggggaguucgcggucgacaagggcacggaggugaucaucaaccugugggcccugcaccacaacgagaaggaguggcaccagcccgaccaguucaugcccgagcgcuuccugaaccccgccgggacccagcucaucagcccguccgugagcuaccugcccuucggcgccgggccccgguccugcaucggcgagauccuggcccgccaggagcuguuccugaucauggcguggcugcuccagcgguucgaccuggagguccccgacgacggccagcugccgagccucgaggggauccccaagguggucuuccugaucgacuccuucaaggugaagaucaaggugcgccaggccuggcgggaggcccaggccgagggcagcaccuga

SEQ ID NO: 28915 - RNA, 1512 nt, Artificial Sequence
  derived and/or modified sequence opt1 from CYP19A1__Homo_sapiens__NP_112503
auggugcuggagaugcucaaccccauccacuacaacaucaccagcaucgucccggaggccaugcccgccgcgaccaugcccgugcugcugcucaccggccuguuccugcucguguggaacuacgaggggaccuccagcauccccggcccgggguacugcaugggcaucgggccccugaucucccacggccgcuuccuguggaugggcaucgggagcgccugcaacuacuacaaccgggucuacggcgaguucaugcgcguguggaucuccggggaggagacccucaucaucagcaaguccagcuccauguuccacaucaugaagcacaaccacuacagcucccgguucggcagcaagcuggggcugcagugcaucggcaugcacgagaagggcaucaucuucaacaacaaccccgagcucuggaagaccacgcgccccuucuucaugaaggcccuguccgggccgggccuggugcggauggucaccgugugcgccgagagccucaagacccaccuggaccgccuggaggaggugaccaacgaguccggguacgucgacgugcucacgcugcugcggcgcgugaugcucgacaccagcaacacccuguuccugcggaucccccucgacgaguccgccaucgucgugaagauccagggcuacuucgacgcguggcaggcccugcugaucaagcccgacaucuucuucaagaucagcuggcucuacaagaaguacgagaaguccgugaaggaccugaaggacgccaucgagguccugaucgccgagaagcgccggcgcaucagcaccgaggagaagcucgaggagugcauggacuucgcgacggagcugauccuggccgagaagcggggcgaccucacccgcgagaacgugaaccagugcauccuggagaugcugaucgccgcccccgacaccaugagcgugucccucuucuucaugcuguuccugaucgccaagcacccgaacgucgaggaggcgaucaucaaggagauccagaccgugaucggggagcgggacaucaagaucgacgacauccagaagcucaaggugauggagaacuucaucuacgagagcaugcgcuaccagcccgucguggaccuggugaugcggaaggcccuggaggacgacgucaucgacggcuaccccgugaagaaggggacgaacaucauccucaacaucggccgcaugcaccggcuggaguucuuccccaagccgaacgaguucacccuggagaacuucgccaagaacguccccuaccgcuacuuccagcccuucggguucggcccccggggcugcgccgggaaguacaucgccauggugaugaugaaggcgauccucgugacccugcugcgccgcuuccacgucaagacccuccagggccagugcguggaguccauccagaagauccacgaccugagccugcacccggacgagacgaagaacaugcuggagaugaucuucacgccccggaacuccgaccgcugccucgagcacuga

SEQ ID NO: 28916 - RNA, 1539 nt, Artificial Sequence
  derived and/or modified sequence opt1 from CYP1A1__Homo_sapiens__NP_000490
augcuguuccccaucagcauguccgccaccgaguuccuccuggccagcgugaucuucugccuggucuucugggugauccgcgcgucccggccccaggugcccaagggccucaagaacccgcccgggccguggggcuggccccugaucgggcacaugcugacccucggcaagaacccccaccuggcccugagccgcaugucccagcaguacggggacguccuccagauccggaucggcagcacgcccguggugguccuguccggccuggacaccauccgccaggcccucgugcggcagggggacgacuucaagggccgcccggaccuguacaccuucacccugaucagcaacgggcaguccaugagcuucucccccgacagcggccccgugugggccgcccggcgccggcucgcgcagaacgggcugaaguccuucagcaucgccuccgaccccgccagcuccacgagcugcuaccuggaggagcacgucuccaaggaggccgaggugcucaucagcacccugcaggagcugauggcgggcccgggccacuucaaccccuaccgcuacguggucgugagcgugaccaacgucaucugcgccaucugcuucgggcggcgcuacgaccacaaccaccaggagcuccugucccuggugaaccucaacaacaacuucggcgagguggucgggagcggcaaccccgccgacuucauccccauccugcgguaccugccgaaccccucccucaacgccuucaaggaccugaacgagaaguucuacagcuucaugcagaagauggugaaggagcacuacaagaccuucgagaagggccacauccgcgacaucacggacucccugaucgagcacugccaggagaagcagcucgacgagaacgccaacgugcagcugagcgacgagaagaucaucaacaucguccuggaccucuucggggcgggcuucgacaccgugaccaccgccaucuccuggagccugauguaccuggugaugaacccccggguccagcgcaagauccaggaggagcucgacacggugaucgggcggucccgccggccccgccugagcgaccggucccaccucccguacauggaggccuucauccuggagaccuuccgccacagcuccuucguccccuucaccaucccccacagcaccacgcgcgacaccucccugaagggcuucuacauccccaaggggcggugcguguucgugaaccaguggcagaucaaccacgaccagaagcugugggucaacccgagcgaguuccuccccgagcgcuuccugacccccgacggcgccaucgacaaggugcuguccgagaaggugaucaucuucggcauggggaagcggaagugcaucggcgagaccaucgcccgcugggaggucuuccucuuccuggcgauccugcuccagcggguggaguucagcgugccccugggggucaagguggacaugacgccgaucuacggccugaccaugaagcacgccugcugcgagcacuuccagaugcagcugcgcuccuga

SEQ ID NO: 28917 - RNA, 1551 nt, Artificial Sequence
  derived and/or modified sequence opt1 from CYP1A2__Homo_sapiens__NP_000752
auggcccugagccaguccgugcccuucagcgccaccgagcuccugcuggcguccgccaucuucugccucgucuucugggugcugaagggccugcgcccgcgggugcccaaggggcucaagagcccgcccgagcccuggggcuggccccugcuggggcacguccucacccugggcaagaacccccaccuggcccucucccgcaugagccagcgguacggggacgugcugcagauccgcaucggcuccacgcccgugcugguccucagccggcuggacaccauccgccaggcccuggugcggcagggcgacgacuucaaggggcgcccggaccucuacaccuccacccugaucacggacggccagagccugaccuucuccaccgacagcgggcccgugugggccgcgcggcgccggcucgcccagaacgcccugaacaccuucuccaucgccagcgaccccgcguccagcuccagcugcuaccuggaggagcacgucuccaaggaggccaaggcccucaucagccgccugcaggagcugauggccggccccgggcacuucgacccguacaaccaggugguggucagcguggccaacgugaucggcgcgaugugcuucggccagcacuuccccgaguccagcgacgagaugcucucccuggucaagaacacgcacgaguucguggagaccgccagcuccgggaacccccuggacuucuuccccauccuccgguaccugccgaaccccgcccugcagcgcuucaaggccuucaaccagcgguuccucugguuccugcagaagaccgugcaggagcacuaccaggacuucgacaagaacagcguccgcgacaucaccggcgcccuguucaagcacuccaagaaggggccccgggcgagcggcaaccucaucccccaggagaagaucgugaaccuggugaacgacaucuucggcgccggguucgacacggucaccaccgccaucuccuggagccugauguaccucgugaccaagccggagauccagcgcaagauccagaaggagcuggacacggugaucggccgggagcgccggccccgccuguccgaccgcccccagcuccccuaccuggaggccuucauccuggagaccuuccggcacagcuccuuccucccguucaccaucccccacagcaccacgcgcgacaccacccugaacggguucuacauccccaagaagugcugcgucuucgugaaccaguggcaggucaaccacgaccccgagcugugggaggacccguccgaguuccggcccgagcgcuuccucaccgccgacggcacggcgaucaacaagccccugagcgagaagaugaugcuguucgggaugggcaagcggcgcugcaucggcgaggugcuggccaagugggagaucuuccucuuccuggccauccugcuccagcagcuggaguucuccgugccgcccggggucaagguggaccugacccccaucuacggccucaccaugaagcacgcccggugcgagcacgugcaggcccgccugcgguucagcaucaacuga

SEQ ID NO: 28918 - RNA, 1632 nt, Artificial Sequence
  derived and/or modified sequence opt1 from CYP1B1__Homo_sapiens__NP_000095
augggcaccagccugucccccaacgacccguggccccucaacccccugagcauccagcagaccacgcugcuccugcugcucuccgugcuggccaccguccacguggggcagcgccugcuccggcagcgccggcgccagcugcggagcgcgcccccgggccccuucgccuggccccugaucgggaacgccgccgccgugggccaggccgcgcaccucuccuucgcccgccuggcccggcgcuacggggacgucuuccagauccggcugggcagcugccccaucguggugcucaacggcgagcgcgccauccaccaggcgcugguccagcagggguccgccuucgccgaccggccggccuucgccagcuuccgcgugguguccggcgggcggagcauggcguucggccacuacuccgagcacuggaagguccagcgccgggccgcccacagcaugaugcgcaacuucuucacccggcagccccgcucccgccaggugcuggaggggcacgugcucagcgaggcccgggagcuggucgcccugcucgugcggggcuccgcggacggcgccuuccuggacccccgcccccugaccguggucgccguggccaacgugaugagcgccgucugcuucgggugccgcuacucccacgacgacccggaguuccgggagcuccugagccacaacgaggaguucggccgcacggugggggcgggcucccugguggacgucaugcccuggcuccaguacuuccccaaccccgugcggaccguguuccgcgaguucgagcagcugaaccggaacuucagcaacuucauccuggacaaguuccuccgccacugcgagagccugcggccgggcgccgcgccccgcgacaugauggacgccuucauccuguccgccgagaagaaggccgccggggacagccacggcgggggcgcccggcucgaccuggagaacguccccgccaccaucaccgacaucuucggggcgucccaggacacgcugagcaccgcccuccaguggcugcugcuccuguucacccgcuaccccgacgugcagacccggguccaggccgagcuggaccagguggugggccgcgaccggcucccgugcaugggcgaccagcccaaccugcccuacguccuggccuuccucuacgaggccaugcgcuucuccagcuucgugcccgugacgaucccgcacgcgaccaccgccaacaccuccguccugggguaccacauccccaaggacacggugguguucgucaaccaguggagcgugaaccacgacccccugaaguggcccaacccggagaacuucgaccccgcccgguuccucgacaaggacggccugaucaacaaggaccugaccucccgcgugaugaucuucagcgucgggaagcggcgcugcaucggcgaggagcuguccaagaugcagcuguuccucuucaucagcauccuggcccaccagugcgacuuccgggccaaccccaacgagccggcgaagaugaacuucuccuacgggcucaccaucaagcccaagagcuucaaggugaacgugacccugcgcgaguccauggagcugcucgacagcgccguccagaaccugcaggccaaggagacgugccaguga

SEQ ID NO: 28919 - RNA, 1488 nt, Artificial Sequence
  derived and/or modified sequence opt1 from CYP21A2__Homo_sapiens__NP_000491
augcugcuccugggccugcuccugcugcucccccugcuggccggggcccgccuccuguggaacugguggaagcugcggagccuccaccucccgccccuggcgcccggcuuccugcaccuccugcagcccgaccugccgaucuaccugcuggggcucacccagaaguucggccccaucuaccgccugcaccuggggcuccaggacguggucgugcugaacuccaagcggaccaucgaggaggccauggugaagaagugggccgacuucgccggccgccccgagccccugacguacaagcucgucagccggaacuacccggaccugucccugggcgacuacagccuccuguggaaggcccacaagaagcugacccgcuccgcgcuccugcuggggauccgggacagcauggagcccgugguggagcagcucacccaggaguucugcgagcgcaugcgggcccagcccggcacccccgucgccaucgaggaggaguucucccugcugacgugcagcaucaucugcuaccucaccuucggggacaagaucaaggacgacaaccugaugccggccuacuacaagugcauccaggaggugcugaagaccuggucccacuggagcauccagaucguggacgucauccccuuccuccgcuucuuccccaaccccggccugcggcgccugaagcaggcgaucgagaagcgggaccacaucguggagaugcagcuccgccagcacaaggagucccugguggccgggcaguggcgggacaugauggacuacaugcugcagggcgucgcccagccgagcauggaggagggcuccgggcagcuccuggagggccacgugcacauggccgccguggaccugcugaucgggggcaccgagacgaccgcgaacacccucagcugggccgucguguuccugcugcaccaccccgagauccagcagcgccuccaggaggagcuggaccacgagcugggccccggggccuccagcucccgggugcccuacaaggaccgcgcccggcucccgcugcugaacgccaccaucgcggagguccuccgccugcggcccguggugccccuggcccucccccaccgcacgacccgcccgagcuccaucagcggcuacgacauccccgaggggaccgucaucauccccaaccugcagggcgcccaccuggacgagaccgugugggagcggccccacgaguucuggccggaccgcuuccucgagcccgggaagaacagccgggcccuggccuucggcugcggcgcgcgcgugugccugggggagccccucgcccggcuggagcuguucgucgugcucacgcgccugcugcaggccuucacccuccugccguccggcgacgcccugcccagccuccagccccugccccacugcuccgucauccugaagaugcagccguuccaggugcggcuccagccccgcgggaugggcgcccacagccccgggcagucccaguga

SEQ ID NO: 28920 - RNA, 1545 nt, Artificial Sequence
  derived and/or modified sequence opt1 from CYP24A1__Homo_sapiens__NP_000773
augagcucccccaucagcaagucccgcagccuggccgccuuccuccagcagcugcgguccccgcgccagccgccccggcuggugaccagcaccgcguacacgagcccccagccgcgcgagguccccgugugcccccucaccgccggcggggagacccagaacgccgccgcccugcccggcccgaccuccuggccccugcucgggucccugcugcagauccucuggaagggcgggcugaagaagcagcacgacacgcugguggaguaccacaagaaguacggcaagaucuuccggaugaagcucggcagcuucgaguccguccaccuggggagccccugccugcucgaggcgcuguaccgcaccgaguccgccuacccccagcggcuggagaucaagccguggaaggccuaccgcgacuaccggaaggagggcuacgggcuccugauccuggagggcgaggacuggcagcgcgugcggagcgccuuccagaagaagcucaugaagcccggggaggugaugaagcuggacaacaagaucaacgagguccuggcggacuucaugggccgcaucgacgagcucugcgacgagcggggccacguggaggaccuguacuccgagcugaacaaguggagcuucgaguccaucugccucgugcuguacgagaagcgcuucgggcugcuccagaagaacgccggcgacgaggccgucaacuucaucauggccaucaagaccaugaugagcaccuucgggcggaugauggugacgcccguggagcugcacaagucccugaacaccaaggucuggcaggaccacacccucgccugggacaccaucuucaagagcgugaaggcgugcaucgacaaccgccuggagaaguacagccagcagcccuccgccgacuuccugugcgacaucuaccaccagaaccggcucagcaagaaggagcuguacgccgccgugacggagcugcagcucgccgcggucgagaccaccgccaacucccugauguggauccuguacaaccucagccgcaacccccaggugcagcagaagcugcugaaggagauccaguccgugcuccccgagaaccaggucccccgggccgaggaccugcgcaacaugcccuaccugaaggccugccucaaggagagcaugcggcugaccccguccgugcccuucacgacccgcacccuggacaaggccaccgugcugggcgaguacgcgcuccccaagggcacgguccugaugcugaacacccaggugcucgggagcuccgaggacaacuucgaggacagcucccaguuccgccccgagcgguggcugcaggagaaggagaagaucaacccguucgcccaccuccccuucggcguggggaagcgcaugugcaucggccggcgccuggccgagcugcagcugcaccucgcccugugcuggaucguccggaaguacgacauccaggccaccgacaacgagcccguggagaugcugcacagcgggacccucguccccucccgcgagcugccgaucgcguucugccagcgguga

SEQ ID NO: 28921 - RNA, 1494 nt, Artificial Sequence
  derived and/or modified sequence opt1 from CYP26A1__Homo_sapiens__NP_000774
augggccugcccgcccuccuggccagcgcgcugugcaccuucgugcucccgcugcuccuguuccuggccgccaucaagcugugggaccucuacugcgucuccgggcgcgaccggagcugcgcccugccccugccgcccggcaccaugggguuccccuucuucggcgagacgcuccagauggugcugcagcgccggaaguuccugcagaugaagcgccggaaguacggguucaucuacaagacccaccucuucggccgccccaccgugcgggucaugggcgccgacaacgugcgccggauccugcugggggagcaccgccucguguccguccacuggcccgcgagcgugcggaccauccugggcuccgggugccugagcaaccuccacgacuccagccacaagcagcgcaagaaggugaucaugcgggccuucucccgcgaggcccuggagugcuacguccccgugaucacggaggaggugggcagcucccuggagcaguggcucagcugcggggagcggggccugcuggucuacccggaggugaagcgccucauguuccggaucgccaugcgcauccugcugggcugcgagccccagcucgcgggggacggcgacuccgagcagcagcugguggaggccuucgaggagaugacccggaaccuguucagccuccccaucgacguccccuucuccgggcuguaccgcggcaugaaggcccggaaccugauccacgcccgcaucgagcagaacauccgcgccaagaucugcggccuccgggcgagcgaggccgggcagggcugcaaggacgcccugcagcugcucaucgagcacuccugggagcgcggggagcggcuggacaugcaggcccugaagcagagcuccaccgagcuccuguucggcgggcacgagaccacggccagcgcggccaccagccugaucaccuaccucggccuguacccgcacgugcugcagaaggugcgcgaggagcucaaguccaagggccugcugugcaagagcaaccaggacaacaagcuggacauggagauccucgagcagcugaaguacaucgggugcgucaucaaggagacccugcggcucaacccgcccgugcccggcggguuccgcguggcccugaagacguucgagcugaacggcuaccagauccccaagggguggaacgucaucuacuccaucugcgacacccacgacguggccgagaucuucaccaacaaggaggaguucaaccccgaccgguucaugcucccccaccccgaggacgccagccgcuucuccuucaucccguucggcggcgggcugcggagcugcgugggcaaggaguucgcgaagauccugcucaagaucuucaccgucgagcuggcccgccacugcgacuggcagcugcucaacgggccgcccacgaugaagaccucccccaccguguaccccgucgacaaccugcccgcccgguucacccacuuccacggcgagaucuga

SEQ ID NO: 28922 - RNA, 1314 nt, Artificial Sequence
  derived and/or modified sequence opt1 from CYP26B1__Homo_sapiens__NP_001264671
augcuguucgagggccucgaccuggugagcgcccuggccacccucgcggccugccuggucuccgugacccugcuccuggccgugagccagcagcuguggcagcuccgcugggccgccacgcgggacaaguccugcaagcugcccaucccgaaggggagcaugggcuucccccugaucggggagaccggccacuggcuccugcaggucuucuccaagaucuucagccacgaggcgcuggaguccuaccuccccaagauccagcuggugauccaggacacccugcgcgccuggagcucccaccccgaggccaucaacguguaccaggaggcccagaagcucaccuuccggauggcgauccgcguccugcugggguucagcaucccggaggaggaccucggccaccuguucgagguguaccagcaguucguggacaacgucuucucccugcccguggaccuccccuucagcggcuaccggcgcgggauccaggcccggcagauccugcagaagggccuggagaaggccauccgcgagaagcuccagugcacgcaggggaaggacuaccuggacgcccuggaccuccugaucgaguccagcaaggagcacggcaaggagaugaccaugcaggagcugaaggacgggacccucgagcugaucuucgccgcguacgccaccacggccuccgccagcaccucccugaucaugcagcuccugaagcaccccaccgugcuggagaagcuccgggacgagcugcgcgcccacggcauccugcacagcggcgggugcccgugcgagggcacccuccggcuggacacgcuguccgggcuccgcuaccuggacugcgucaucaaggaggugaugcggcuguucacccccaucagcggcggcuaccgcaccgugcuccagaccuucgagcuggacggguuccagauccccaagggcuggagcgucauguacuccauccgggacacgcacgacaccgcgcccguguucaaggacgugaacgucuucgacccggaccgcuucagccaggcccgguccgaggacaaggacgggcgcuuccacuaccugcccuucggcgggggcgugcggaccugccugggcaagcaccucgccaagcuguuccugaaggugcucgccgucgagcuggccagcaccucccgcuucgagcuggcgacgcggaccuucccccgcaucacccucgugcccgugcugcacccggucgacgggcugagcgugaaguucuucggccucgacuccaaccagaacgagauccugcccgagaccgaggccaugcugagcgccacggucuga

SEQ ID NO: 28923 - RNA, 1569 nt, Artificial Sequence
  derived and/or modified sequence opt1 from CYP26C1__Homo_sapiens__NP_899230
auguuccccuggggccugagcugccucuccgugcugggggccgccggcaccgcgcugcucugcgccgggcugcugcucagccuggcccagcaccuguggacccuccgcuggaugcugucccgggaccgcgccagcacgcugccgcuccccaagggcuccaugggguggcccuucuucggcgagacccugcacuggcugguccagggcagccgguuccacuccagccgccgggagcgcuacgggaccguguucaagacccaccuccugggccggcccgugauccgcgucuccggggccgagaacgugcggacgauccugcucggcgagcaccgccuggugcggagccaguggccgcaguccgcgcacauccugcucgggagccacacccugcugggcgccgucggcgagccccaccgccggcgccggaaggugcucgcccgcguguucucccgggccgcgcuggagcgcuacgucccccggcugcagggggcccuccgccacgaggugcggagcuggugcgccgccggcgggcccguguccgucuacgacgccagcaaggcgcugaccuuccgcauggccgcccgcauccugcucggccugcggcuggacgaggcccagugcgccacccucgcgcgcacguucgagcagcugguggagaaccuguucucccucccgcuggacgugcccuucagcggccugcggaaggggauccgcgcccgggaccagcuccaccgccaccuggagggcgccaucuccgagaagcugcacgaggacaaggccgccgagcccggggacgcgcucgaccugaucauccacagcgcccgggagcugggccacgagcccagcaugcaggagcucaaggaguccgccgucgagcugcuguucgccgccuucuucaccaccgcgagcgccuccaccagccucgugcugcugcugcuccagcacccggccgccaucgcgaagauccgcgaggagcugguggcccaggggcugggccgggccugcggcugcgcccccggggccgcgggcggguccgagggcccgccgcccgacugcgggugcgagcccgaccucagccuggccgcccugggccgccuccgguacgucgacugcguggugaaggagguccugcgccugcucccgcccguguccggcggguaccggacggcccugcgcaccuucgagcuggacggcuaccagauccccaagggguggagcgugauguacuccauccgggacacccacgagaccgccgcggucuaccgcagcccgcccgagggcuucgaccccgagcgguucggggccgcccgcgaggacucccggggcgccagcucccgcuuccacuacauccccuucggcgggggcgcccgcagcugccucgggcaggagcuggcgcaggccgugcugcagcuccuggccgucgagcuggugcggacggcccgcugggagcucgcgacccccgccuuccccgccaugcagaccgugcccaucguccaccccguggacggccugcggcuguucuuccacccccucacccccuccguggccggcaacgggcugugccuguga

SEQ ID NO: 28924 - RNA, 1596 nt, Artificial Sequence
  derived and/or modified sequence opt1 from CYP27A1__Homo_sapiens__NP_000775
auggccgcccugggcugcgcgcgccuccggugggcccugcgcggggccggccgggggcugugcccccacggcgcccgcgccaaggcggccaucccggccgcccuccccagcgacaaggcgaccggggcccccggcgccggccccggggugcggcgccggcagcgcucccuggaggagaucccgcggcugggccagcuccgcuucuucuuccagcuguucguccagggguacgcccugcagcuccaccagcuccaggugcuguacaaggccaaguacggccccauguggaugagcuaccuggggccccagaugcacgugaaccuggcguccgcgccccugcucgagcaggucaugcggcaggagggcaaguacccggugcgcaacgacauggagcuguggaaggagcaccgggaccagcacgaccugaccuacggccccuucacgaccgaggggcaccacugguaccagcuccgccaggcccugaaccagcggcugcucaagcccgccgaggccgcccuguacaccgacgccuucaacgaggugaucgacgacuucaugacccgccuggaccagcuccgggccgagagcgccuccggcaaccaggucagcgacauggcccagcuguucuacuacuucgcgcuggaggccaucugcuacauccucuucgagaagcgcaucgggugccugcagcgguccauccccgaggacacggugaccuucgugcgcagcaucggccugauguuccagaacucccucuacgccaccuuccugccgaaguggacccggcccguccugcccuucuggaagcgcuaccucgacggcuggaacgccaucuucagcuucgggaagaagcugaucgacgagaagcuggaggacauggaggcccagcuccaggcggccggccccgacgggauccagguguccggcuaccugcacuuccugcucgccagcgggcagcuguccccgcgcgaggccaugggcagccugcccgagcuccugauggcgggcguggacacgaccuccaacacccugaccugggcccucuaccaccugagcaaggaccccgagauccaggaggcccugcacgaggaggucgugggggugguccccgccggccaggugccgcagcacaaggacuucgcccacaugccccuccugaaggcggugcugaaggagacgcugcggcucuaccccgucgugcccaccaacucccgcaucaucgagaaggagaucgagguggacggguuccuguucccgaagaacacccaguucgucuucugccacuacguggugagccgggaccccaccgccuucuccgagcccgagagcuuccagccccaccgcuggcugcggaacagccagccggccacgccccgcauccagcaccccuucggcuccgucccguucggguacggcgugcgggccugccucggccgccggaucgccgagcuggagaugcagcugcuccuggcgcgccugauccagaaguacaaggucgugcucgcccccgagaccggggagcucaagagcguggcccggaucguccuggugcccaacaagaaggugggccugcaguuccugcagcgccagugcuga

SEQ ID NO: 28925 - RNA, 1527 nt, Artificial Sequence
  derived and/or modified sequence opt1 from CYP27B1__Homo_sapiens__NP_000776
augacccagacccugaaguacgccagccgcguguuccaccggguccgcugggcccccgagcucggcgcgucccugggguaccgggaguaccacagcgcccgccggucccuggccgacaucccgggccccagcacgcccuccuuccucgccgagcuguucugcaagggcgggcugagccgccuccacgagcuccaggugcagggggccgcgcacuucggccccguguggcuggccuccuucggcaccguccggaccguguacguggccgccccggcgcuggucgaggagcugcugcgccaggaggggccccggcccgagcgcugcagcuucucccccuggaccgagcaccggcgcugccggcagcgcgccugcggccuccugacggccgagggggaggaguggcagcggcugcgcagccuccuggccccgcugcuccugcggccccaggccgcggcccgcuacgccggcacccugaacaacguggugugcgaccucguccggcgccugcggcgccagcgcgggcggggcaccggcccgcccgcccuggugcgcgacguggccggggaguucuacaaguucggccucgaggggaucgcggccguccugcugggcucccggcucggcugccuggaggcccaggugccgcccgacaccgagacguucauccgcgccguggggagcgucuucguguccacccugcucaccauggccaugccccacuggcugcggcaccuggugcccggccccugggggcgccucugccgggacugggaccagauguucgcguucgcccagcgccacgucgagcggcgcgaggccgaggccgccaugcggaacggcgggcagcccgagaaggaccuggagagcggcgcgcaccugacccacuuccucuuccgcgaggagcugcccgcccaguccauccugggcaacgugacggagcuccugcuggccgggguggacaccgucagcaacacccucuccugggcccuguacgagcugagccggcaccccgaggugcagaccgcgcuccacuccgagaucacggccgcccugagcccgggcagcuccgccuaccccagcgccaccgugcugucccagcucccccugcugaaggcggucgugaaggagguccugcgccucuaccccguggugccggggaacagccggguccccgacaaggacauccacgugggcgacuacaucauccccaagaacacccuggugacccugugccacuacgccacgucccgcgaccccgcccaguucccggagcccaacagcuuccggcccgcccgcuggcucggggagggcccgacgccccaccccuucgccucccugcccuucggcuucgggaagcggagcugcaugggccgccgccuggcggagcucgagcugcagauggcccuggcccagauccucacccacuucgagguccagccggagcccggggccgcccccgugcggcccaagacccgcaccgugcuggucccggagcgguccaucaaccugcaguuccucgaccgcuga

SEQ ID NO: 28926 - RNA, 1119 nt, Artificial Sequence
  derived and/or modified sequence opt1 from CYP27C1__Homo_sapiens__NP_001001665
augcgcagcgugcugcggcagcgcauccucaagcccaaggacgucgccaucuacuccggcgaggugaaccaggugaucgccgaccugaucaagcggaucuaccugcuccgcagccaggcggaggacggggagaccgucaccaacgugaacgaccuguucuucaaguacuccauggagggcguggccacgauccuguacgagagccggcucgggugccuggagaacuccaucccgcagcugaccgucgaguacaucgaggcccucgagcugauguucagcauguucaagaccuccauguacgccggcgccaucccccgcuggcugcggcccuucauccccaagccguggcgcgaguucugccggagcugggacggccucuucaaguucucccagauccacguggacaacaagcugcgcgacauccaguaccagauggaccgggggcgccgggugagcggcgggcugcucaccuaccuguuccugucccaggcgcucacgcugcaggagaucuacgccaacgucaccgagaugcugcucgccggcguggacaccaccagcuucacgcuguccuggaccguguaccugcucgcccgccaccccgagguccagcagaccguguaccgggagaucgugaagaaccugggggagcgccacguccccaccgcggccgacgugcccaaggugccgcugguccgggcccuccugaaggagacgcugcgccucuuccccgugcugcccggcaacgggcgggugacccaggaggaccuggucaucggcggcuaccucauccccaaggggacccagcuggcccugugccacuacgccaccagcuaccaggacgagaacuucccgcgcgcgaaggaguuccggcccgagcgcuggcuccgcaagggcgaccuggaccggguggacaacuucggguccauccccuucggccacggcgugcgcagcugcaucgggcggcgcaucgccgagcuggagauccaccucgucgugauccagcugcugcagcacuucgagaucaagacguccagccagaccaacgccguccacgccaagacccacggccuccugacccccgggggcccgauccacgugcgguucgugaaccgcaaguga

SEQ ID NO: 28927 - RNA, 1485 nt, Artificial Sequence
  derived and/or modified sequence opt1 from CYP2A13__Homo_sapiens__NP_000757
augcuggccagcggccuccugcuggugacccuccuggccugccugaccgucauggugcucauguccguguggcgccagcggaagucccgcgggaagcugcccccgggccccacgccccugcccuucaucgggaacuaccuccagcugaacaccgagcagauguacaacucccugaugaagaucagcgagcgguacggcccggucuucaccauccaccucgggccccgccggguggugguccugugcggccacgacgcggugaaggaggcccugguggaccaggccgaggaguucuccggccgcggggagcaggccaccuucgacuggcuguucaagggcuacggggucgccuucagcaacggcgagcgggcgaagcagcugcgccgguucuccaucgccacgcugcgcggguucggcgugggcaagcgggggaucgaggagcgcauccaggaggaggccggcuuccucaucgacgcccugcgggggacccacggcgcgaacaucgaccccaccuucuuccugagccgcaccguguccaacgucaucagcuccaucguguucggcgaccgguucgacuacgaggacaaggaguuccucagccugcugcgcaugaugcucggguccuuccaguucacggccaccagcaccggccagcuguacgagauguucuccagcgugaugaagcaccuccccgggccgcagcagcaggccuucaaggagcuccagggccuggaggacuucaucgccaagaaggucgagcacaaccagcggacccuggaccccaacagcccccgcgacuucaucgacagcuuccucauccggaugcaggaggaggagaagaaccccaacacggaguucuaccugaagaaccuggugaugaccacccucaaccuguucuucgccgggaccgagacgguguccaccacccugcgcuacggcuuccuccugcugaugaagcacccggaggucgaggcgaaggugcacgaggagaucgaccgggugaucggcaagaaccgccagcccaaguucgaggaccgcgccaagaugcccuacaccgaggccgucauccacgagauccagcgguucggggacaugcuccccaugggccuggcccaccgcgugaacaaggacacgaaguuccgggacuucuuccugccgaaggggaccgagguguuccccaugcucggcagcguccugcgcgacccccgguucuucagcaacccccgcgacuucaacccgcagcacuuccuggacaagaaggggcaguucaagaaguccgacgccuucgugcccuucagcaucggcaagcgguacugcuucggcgaggggcucgcgcgcauggagcuguuccuguucuucaccaccaucaugcagaacuuccgguucaagagcccccagucccccaaggacaucgacgucuccccgaagcacgugggcuucgccacgaucccccgcaacuacaccaugagcuuccucccccgguga

SEQ ID NO: 28928 - RNA, 1485 nt, Artificial Sequence
  derived and/or modified sequence opt1 from CYP2A6__Homo_sapiens__NP_000753
augcuggccagcggcaugcuccugguggcccugcucgucugccugaccgugauggugcugauguccgucuggcagcagcgcaagagcaaggggaagcugcccccgggccccacgccccuccccuucaucgggaacuaccugcagcucaacacggagcagauguacaacucccugaugaagaucagcgagcgguacggcccgguguucaccauccaccuggggccccgccggguggucgugcucugcggccacgacgcggugcgcgaggcccuggucgaccaggccgaggaguucuccggccgcggggagcaggccaccuucgacuggguguucaagggcuacgggguggucuucagcaacggcgagcgggccaagcagcugcggcgcuucuccaucgcgacccuccgggacuucggggugggcaagcgcggcaucgaggagcggauccaggaggaggccggguuccugaucgacgcccugcgcggcaccgggggcgccaacaucgaccccaccuucuuccucagccggaccguguccaacgucaucagcuccaucguguucggcgaccgcuucgacuacaaggacaaggaguuccugagccugcuccggaugaugcuggggaucuuccaguucaccuccacgagcaccggccagcuguacgagauguucuccagcgugaugaagcaccuccccgggccgcagcagcaggcguuccagcugcugcagggccucgaggacuucaucgccaagaaggucgagcacaaccagcgcacccuggaccccaacagcccccgggacuucaucgacuccuuccugauccgcaugcaggaggaggagaagaaccccaacaccgaguucuaccucaagaaccuggugaugacgacccugaaccucuucaucgggggcaccgagaccguguccacgacccugcgguacggcuuccugcuccugaugaagcacccggaggucgaggccaaggugcacgaggagaucgaccgcgugaucgggaagaaccggcagcccaaguucgaggaccgcgccaagaugcccuacauggaggccgucauccacgagauccagcgcuucggcgacgugauccccaugagccuggcgcggcgcgucaagaaggacaccaaguuccgggacuucuuccucccgaaggggaccgagguguaccccaugcugggcagcgugcugcgcgaccccuccuucuucagcaacccccaggacuucaacccgcagcacuuccucaacgagaaggggcaguucaagaaguccgacgccuucguccccuucagcaucggcaagcggaacugcuucggcgaggggcuggcccgcauggagcuguuccucuucuucacgaccgugaugcagaacuuccggcugaaguccagccagucccccaaggacaucgacgugagccccaagcacgucggcuucgccaccaucccgcgcaacuacaccauguccuuccugccccgguga

SEQ ID NO: 28929 - RNA, 1485 nt, Artificial Sequence
  derived and/or modified sequence opt1 from CYP2A7__Homo_sapiens__NP_000755
augcuggccagcggccugcugcugguggcccuccuggcgugccugaccgucauggugcucauguccguguggcagcagcgcaagagccgggggaagcugcccccgggccccacgccccugcccuucaucgggaacuaccuccagcugaacaccgagcacaucugcgacuccaucaugaaguucagcgagugcuacggcccggucuucaccauccaccuggggccccgccggguggugguccucugcggccacgacgccgugcgcgaggcccugguggaccaggccgaggaguucuccggccgcggggagcaggccaccuucgacugggucuucaagggcuacgggguggcguucagcaacggcgagcgggccaagcagcugcuccgguucgccaucgccacccugcgcgacuucggggugggcaagcggggcaucgaggagcgcauccaggaggaguccggguuccugaucgaggcgauccggagcacgcacggcgccaacaucgaccccaccuucuuccucucccgcaccgucagcaacgugaucuccagcaucguguucggggaccgguucgacuacgaggacaaggaguuccugucccugcucagcaugaugcugggcaucuuccaguucaccuccacgagcaccggccagcuguacgagauguucuccagcgucaugaagcaccuccccgggccgcagcagcaggccuucaagcugcugcagggccucgaggacuucaucgccaagaagguggagcacaaccagcgcacccuggaccccaacagcccccaggacuucaucgacagcuuccugauccacaugcaggaggaggagaagaaccccaacaccgaguucuaccucaagaaccugaugaugagcacgcugaaccucuucaucgccgggaccgagaccguguccaccacgcugcgguacggcuuccugcuccugaugaagcacccggaggucgaggcgaaggugcacgaggagaucgaccgcgugaucgggaagaaccggcagcccaaguucgaggaccgcaccaagaugcccuacauggaggccgucauccacgagauccagcgguucggcgacgugauccccaugagccuggcccgccgggugaagaaggacaccaaguuccgcgacuucuuccucccgaagggcaccgaggucuuccccaugcugggguccgugcugcgcgaccccagcuucuucuccaacccccaggacuucaacccgcagcacuuccucgacgacaagggccaguucaagaaguccgacgccuucguccccuucuccaucgggaagcggaacugcuucggcgaggggcuggcccgcauggagcuguuccucuucuucacgaccgugaugcagaacuuccggcucaagagcucccagagccccaaggacaucgacgugucccccaagcacgucguguucgcgaccaucccgcgcaacuacaccaugagcuuccugccccgguga

SEQ ID NO: 28930 - RNA, 1476 nt, Artificial Sequence
  derived and/or modified sequence opt1 from CYP2B6__Homo_sapiens__NP_000758
auggagcugagcgugcuccuguuccuggcccuccugaccggccugcuccugcugcucguccagcgccaccccaacacccacgaccggcugccgcccgggccccgcccccugccgcuccugggcaaccugcuccagauggaccggcgcgggcugcugaaguccuuccuccgguuccgcgagaaguacggcgacguguucaccgugcaccuggggccccggcccgucgugaugcugugcggcguggaggccauccgcgaggcgcucgucgacaaggccgaggccuucagcggccgggggaagaucgccaugguggaccccuucuuccgcggcuacggggugaucuucgccaacggcaaccgguggaagguccugcgccgguucuccgugaccaccaugcgcgacuucgggaugggcaagcggagcguggaggagcgcauccaggaggaggcgcagugccugaucgaggagcuccggaaguccaagggcgcccugauggacccgaccuuccuguuccagagcaucacggccaacaucaucugcuccaucgucuucgggaagcgcuuccacuaccaggaccaggaguuccucaagaugcugaaccuguucuaccagaccuucagccucaucuccagcguguucggccagcuguucgagcuguucuccggguuccucaaguacuuccccggcgcccaccgccagguguacaagaaccugcaggagaucaacgcguacaucggccacagcgucgagaagcaccgggagacccuggaccccuccgcccccaaggaccucaucgacaccuaccugcugcacauggagaaggagaaguccaacgcccacagcgaguucagccaccagaaccucaaccugaacacgcugucccucuucuucgccgggaccgagaccaccagcacgacccugcgguacggcuuccugcucaugcugaaguacccgcacguggccgagcgcguguaccgcgagaucgagcaggucaucgggccccaccggccgcccgagcugcacgaccgcgcgaagaugcccuacaccgaggccgugaucuacgagauccagcgguucuccgaccuccugcccaugggcgugccccacaucgucacccagcacacgagcuuccgcggguacaucauccccaaggacaccgagguguuccugauccugagcaccgcccuccacgacccgcacuacuucgagaagcccgacgccuucaaccccgaccacuuccuggacgccaacggcgcgcugaagaagaccgaggccuucauccccuucucccucggcaagcggaucugccugggggagggcaucgcccgcgccgagcuguuccucuucuucacgaccauccugcagaacuucagcauggccuccccgguggcgcccgaggacaucgaccugacgccccaggagugcggggucggcaagaucccgcccaccuaccagauccgguuccucccccgcuga

SEQ ID NO: 28931 - RNA, 1473 nt, Artificial Sequence
  derived and/or modified sequence opt1 from CYP2C18__Homo_sapiens__NP_000763
auggaccccgccguggcccugguccucugccugagcugccuguuccuccugucccuguggcgccagagcuccggccgggggcgccuccccagcggccccacgccccugcccaucaucgggaacauccugcagcucgacgugaaggacauguccaagagccugaccaacuucuccaagguguacggcccggucuucaccguguacuucgggcugaagcccaucgugguccuccacggcuacgaggcggugaaggaggcccugaucgaccacggcgaggaguucagcgggcggggcuccuuccccguggccgagaaggucaacaaggggcugggcauccucuucagcaacgggaagcgcuggaaggagauccggcgcuucugccugaugacccugcggaacuucggcaugggcaagcgcuccaucgaggaccgggugcaggaggaggcccgcugccucguggaggagcugcggaagaccaacgccagccccugcgacccgaccuucauccuggggugcgcgcccugcaacgucaucugcuccgugaucuuccacgaccgcuucgacuacaaggaccagcgguuccucaaccugauggagaaguucaacgagaaccugcgcauccucagcucccccuggauccaggugugcaacaacuuccccgcccugaucgacuaccugccgggcagccacaacaagaucgccgagaacuucgccuacaucaaguccuacguccucgagcggaucaaggagcaccaggagagccuggacaugaacuccgcgcgcgacuucaucgacugcuuccugaucaagauggagcaggagaagcacaaccagcagagcgaguucacgguggagagccucaucgccaccgugaccgacauguucggggccggcaccgagacgaccuccaccacccugcgguacggccugcuccugcugcucaaguaccccgaggucacggccaaggugcaggaggagaucgagugcguggucgggcgcaaccggagccccugcaugcaggaccgcucccacaugcccuacaccgacgccguggugcacgagauccagcgguacaucgaccugcugccgaccaaccucccccacgcggugaccugcgacgucaaguucaagaacuaccugauccccaagggcacgaccaucaucaccagccugaccuccguccuccacaacgacaaggaguuccccaacccggagauguucgaccccgggcacuuccuggacaagagcggcaacuucaagaaguccgacuacuucaugcccuucagcgccgggaagcgcaugugcaugggcgagggccuggcccgcauggagcuguuccucuuccugacgaccauccuccagaacuucaaccugaagucccagguggaccccaaggacaucgacaucaccccgaucgccaacgccuucgggcgggugccgccccuguaccagcugugcuucauccccgucuga

SEQ ID NO: 28932 - RNA, 1473 nt, Artificial Sequence
  derived and/or modified sequence opt1 from CYP2C19__Homo_sapiens__NP_000760
auggaccccuucgugguccuggugcucugccugagcugccugcuccugcuguccaucuggcgccagagcuccggccgggggaagcucccgcccggccccacgccccugccggugaucgggaacauccugcagaucgacaucaaggacgucagcaagucccucaccaaccugagcaagaucuacggccccguguucacccuguacuucgggcucgagcgcauggugguccugcacggcuacgagguggugaaggaggcccugaucgaccucggcgaggaguucuccgggcggggccacuucccccuggccgagcgcgcgaaccggggguucggcaucgucuucagcaacgggaagcgcuggaaggagauccggcgcuucucccugaugacccuccggaacuucggcaugggcaagcgcagcaucgaggaccgggugcaggaggaggcccgcugccugguggaggagcugcggaagaccaaggccucccccugcgacccgaccuucauccucgggugcgcccccugcaacgucaucugcagcaucaucuuccagaagcgcuucgacuacaaggaccagcaguuccugaaccugauggagaagcucaacgagaacauccggaucguguccacgcccuggauccagaucugcaacaacuuccccaccaucaucgacuacuucccgggcacccacaacaagcugcugaagaaccucgccuucauggagagcgacauccuggagaaggugaaggagcaccaggaguccauggacaucaacaacccccgcgacuucaucgacugcuuccugaucaagauggagaaggagaagcagaaccagcagagcgaguucaccaucgagaaccucgucaucacggcggccgaccugcugggggccggcaccgagaccaccuccacgacccuccgguacgcccugcugcuccugcugaagcaccccgaggugaccgcgaaggugcaggaggagaucgagcgcgucaucggccggaaccgcagccccugcaugcaggaccgggggcacaugccguacaccgacgccguggugcacgagguccagcgcuacaucgaccucauccccacgucccugccccacgccgugaccugcgacgugaaguuccgcaacuaccugauccccaagggcaccaccauccucacgagccugaccagcguccugcacgacaacaaggaguucccgaaccccgagauguucgacccccggcacuuccucgacgagggcgggaacuucaagaaguccaacuacuucaugcccuucagcgccgggaagcgcaucugcgugggcgagggccuggcccggauggagcuguuccucuuccugaccuucauccugcagaacuucaaccugaagucccucaucgacccgaaggaccuggacaccacgcccgucgugaacggguucgcgagcgugccgcccuucuaccagcugugcuucauccccgucuga

SEQ ID NO: 28933 - RNA, 1473 nt, Artificial Sequence
  derived and/or modified sequence opt1 from CYP2C8__Homo_sapiens__NP_000761
auggagcccuucgugguccuggugcucugccugagcuucaugcuccucuucucccuguggcgccagagcugccggcgccggaagcugccgcccggccccacgccccuccccaucaucgggaacaugcugcagaucgacgugaaggacaucugcaaguccuucaccaacuucagcaaggucuacggccccguguucaccguguacuucgggaugaaccccaucgucguguuccacggcuacgaggccgugaaggaggcccugaucgacaacggggaggaguucuccggccgcggcaacagccccaucucccagcggaucaccaaggggcucggcaucaucagcuccaacgggaagcgcuggaaggagauccggcgcuucagccugaccacccugcggaacuucggcauggggaagcgcuccaucgaggaccggguccaggaggaggcgcacugccucguggaggagcugcgcaagacgaaggccagcccgugcgaccccaccuucauccugggcugcgcccccugcaacgugaucugcuccgucguguuccagaagcgguucgacuacaaggaccagaacuuccucacccugaugaagcgcuucaacgagaacuuccggauccugaacagccccuggauccaggugugcaacaacuucccgcuccugaucgacugcuuccccggcacccacaacaagguccugaagaacguggcccucacgcgcuccuacauccgggagaaggugaaggagcaccaggccagccuggacgucaacaacccccgcgacuucaucgacugcuuccugaucaagauggagcaggagaaggacaaccagaaguccgaguucaacaucgagaaccucguggggaccguggcggaccuguucgucgccggcaccgagaccacgagcaccacccugcgguacgggcuccugcugcuccugaagcaccccgaggugaccgccaaggugcaggaggagaucgaccacgucaucggccgccaccgguccccgugcaugcaggaccgcagccacaugcccuacacggacgccgugguccacgagauccagcgcuacagcgaccuggugcccaccggcgugccccacgcggucaccaccgacacgaaguuccggaacuaccucaucccgaaggggaccaccaucauggcccugcugaccuccgugcuccacgacgacaaggaguuccccaaccccaacaucuucgaccccggccacuuccuggacaagaacgggaacuucaagaaguccgacuacuucaugccguucagcgccggcaagcgcaucugcgccggggagggccuggcccggauggagcuguuccuguuccugacgaccauccuccagaacuucaaccucaagagcguggacgaccugaagaaccugaacaccaccgcggucacgaagggcaucgugucccugccgcccagcuaccagaucugcuucauccccguguga

SEQ ID NO: 28934 - RNA, 1473 nt, Artificial Sequence
  derived and/or modified sequence opt1 from CYP2C9__Homo_sapiens__NP_000762
auggacagccuggugguccucgugcugugccuguccugccuccugcugcucagccuguggcgccaguccagcggccgggggaagcugcccccgggccccacgccccuccccgugaucgggaacauccugcagaucggcaucaaggacaucuccaagagccugaccaaccucuccaaggucuacgggccgguguucacccuguacuucggccugaagcccaucgugguccuccacggcuacgaggccgugaaggaggcccugaucgaccugggggaggaguucagcggccgcgggaucuucccccucgcggagcgggccaaccgcggcuucgggaucguguucuccaacggcaagaaguggaaggagauccggcgcuucagccugaugacccugcggaacuucggcauggggaagcgcuccaucgaggaccggguccaggaggaggcccgcugccucguggaggagcugcggaagaccaaggccagccccugcgacccgaccuucauccugggcugcgcccccugcaacgugaucugcuccaucaucuuccacaagcgcuucgacuacaaggaccagcaguuccucaaccugauggagaagcugaacgagaacaucaagauccucagcucccccuggauccagaucugcaacaacuucagccccaucaucgacuacuucccggggacgcacaacaagcugcugaagaacgucgcguucaugaaguccuacauccucgagaaggugaaggagcaccaggagagcauggacaugaacaacccccaggacuucaucgacugcuuccugaugaagauggagaaggagaagcacaaccagcccuccgaguucaccaucgagagccuggagaacaccgccguggaccucuucggcgccggcaccgagacgaccagcaccacccugcgguacgcccugcuccugcugcucaagcaccccgaggucacggcgaaggugcaggaggagaucgagcgcgugaucgggcggaaccgcuccccgugcaugcaggaccggagccacaugcccuacaccgacgccgucgugcacgaggugcagcgcuacaucgaccugcugcccaccucccucccccacgccgugaccugcgacaucaaguuccggaacuaccugaucccgaagggcacgaccauccugaucagccucaccuccguccugcacgacaacaaggaguuccccaaccccgagauguucgacccccaccacuuccuggacgagggcgggaacuucaagaaguccaaguacuucaugccguucagcgccgggaagcgcaucugcgugggcgaggcccucgcgggcauggagcuguuccuguuccugaccagcauccuccagaacuucaaccugaagucccuggucgaccccaagaaccucgacacgacccccguggucaacggguucgccagcgugcccccguucuaccagcugugcuucauccccguguga

SEQ ID NO: 28935 - RNA, 1494 nt, Artificial Sequence
  derived and/or modified sequence opt1 from CYP2D6__Homo_sapiens__NP_000097
augggccuggaggcccucgugccccuggccgucaucguggcgaucuuccugcuccugguggaccugaugcaccgccggcagcgcugggccgcccgguacccgcccgggccccucccccugccgggccuggggaaccuccugcacgucgacuuccagaacacccccuacugcuucgaccagcugcgccggcgcuucggcgacguguucagccuccagcuggccuggacccccguggucgugcugaacgggcucgccgcggugcgggaggcccuggucacgcacggcgaggacaccgccgaccggcccccggugcccaucacccagauccugggcuucgggccccgcucccagggcguguuccucgcccgcuacgggcccgcguggcgggagcagcgccgguucagcgucuccacccugcgcaaccugggccucgggaagaagucccuggagcagugggugacggaggaggccgccugccugugcgccgccuucgcgaaccacagcggccggccguuccgccccaacggccuccuggacaaggccgugagcaacgucaucgccucccugaccugcgggcggcgcuucgaguacgacgacccccgguuccuccgccugcuggaccucgcccaggagggccugaaggaggagagcggguuccugcgggaggugcucaacgccgugcccguccugcugcacaucccggcgcucgccggcaaggugcugcgcuuccagaaggccuuccugacccagcucgacgagcugcugaccgagcaccgcaugacgugggaccccgcccagccgccccgggaccucaccgaggccuuccuggcggagauggagaaggccaagggcaaccccgaguccagcuucaacgacgagaaccugcgcaucguggucgccgaccucuucuccgccgggauggugaccaccagcacgacccuggccuggggccugcuccugaugauccugcaccccgacgugcagcggcgcguccagcaggagaucgacgacgugaucgggcagguccggcgccccgagaugggcgaccaggcgcacaugcccuacaccaccgccgugauccacgaggugcagcgguucggggacaucgucccgcugggcgugacgcacaugaccucccgcgacaucgaggugcagggcuuccggauccccaaggggaccacccucaucacgaaccugagcuccguccugaaggacgaggccgugugggagaagcccuuccgcuuccaccccgagcacuuccucgacgcccagggccacuucgugaagccggaggcguuccugcccuucagcgccgggcggcgcgccugccugggcgagccccucgcccggauggagcuguuccuguucuucaccucccuccugcagcacuucagcuucuccgucccgaccgggcagccccgccccagccaccacggcguguucgccuuccuggugagccccuccccguacgagcucugcgcggucccccgguga

SEQ ID NO: 28936 - RNA, 1482 nt, Artificial Sequence
  derived and/or modified sequence opt1 from CYP2E1__Homo_sapiens__NP_000764
augagcgcccugggcgugaccgucgcccuccuggugugggcggccuuccugcuccugguguccauguggcgccagguccacagcuccuggaaccugcccccggggcccuucccccuccccaucaucggcaaccuguuccagcuggagcucaagaacauccccaagagcuucacccggcuggcccagcgcuucgggccgguguucacgcuguacgugggcucccagcggauggucgugaugcacggguacaaggccgugaaggaggcccuccuggacuacaaggacgaguucagcggccgcggcgaccugcccgcguuccacgcccaccgggaccgcgggaucaucuucaacaacggccccaccuggaaggacauccggcgcuucucccucaccacccugcggaacuacgggaugggcaagcaggggaacgagagccgcauccagcgggaggcccacuuccugcucgaggcccugcgcaagacgcagggccagccguucgaccccaccuuccugaucggcugcgcgcccugcaacgucaucgccgacauccucuuccggaagcacuucgacuacaacgacgagaaguuccugcgccugauguaccucuucaacgagaacuuccaccuccuguccacccccuggcugcagcuguacaacaacuucccgagcuuccugcacuaccuccccgggucccaccggaaggugaucaagaacguggccgaggucaaggaguacgugagcgagcgcgugaaggagcaccaccagucccuggaccccaacugcccccgggaccugaccgacugccuccuggucgagauggagaaggagaagcacagcgccgagcgccuguacacgauggacggcaucaccgugaccguggccgaccucuucuucgcggggaccgagacgaccuccaccacccugcgguacggccugcucauccugaugaaguacccggagaucgaggagaagcugcacgaggagaucgaccgcgucaucggccccagccggauccccgccaucaaggaccgccaggagaugcccuacauggacgccguggugcacgagauccagcgcuucaucacgcucgucccguccaaccugccccacgaggccacccgggacaccaucuuccgcggguaccugauccccaagggcaccguggugguccccacgcucgacagcgugcuguacgacaaccaggaguucccggaccccgagaaguucaagcccgagcacuuccugaacgagaacgggaaguucaaguacuccgacuacuucaagcccuucagcaccggcaagcgggucugcgccggggagggccucgcgcgcauggagcuguuccugcugcucugcgccauccugcagcacuucaaccugaagccgcucguggaccccaaggacaucgaccugagccccauccacaucggcuucgggugcaucccgccccgguacaagcugugcgugaucccccgcuccuga

SEQ ID NO: 28937 - RNA, 1476 nt, Artificial Sequence
  derived and/or modified sequence opt1 from CYP2F1__Homo_sapiens__NP_000765
auggacagcaucuccaccgccauccugcuccugcugcucgcccuggugugccugcuccugacccugagcucccgcgacaagggcaagcugcccccggggccccggccccucagcauccugggcaaccuccugcugcucugcucccaggacaugcugaccagccugaccaagcucuccaaggaguacgggagcauguacaccguccaccugggcccccgccggguggugguccuguccggguaccaggcggugaaggaggcccucguggaccagggcgaggaguucagcggccgcggggacuacccggccuucuucaacuucaccaagggcaacgggaucgccuucuccagcggcgaccgguggaagguccugcgccaguucuccauccagauccugcggaacuucgggaugggcaagcgcagcaucgaggagcggauccucgaggagggcuccuuccugcuggccgagcuccgcaagaccgagggggagcccuucgaccccaccuucgugcugagccgguccgugagcaacaucaucugcuccguccuguucggcagccgcuucgacuacgacgacgagcggcuccugaccaucauccgccugaucaacgacaacuuccagaucaugagcucccccuggggcgagcucuacgacaucuucccgagccugcuggacugggugcccgggccccaccagcggaucuuccagaacuucaagugccuccgcgaccugaucgcgcacuccgugcacgaccaccaggccagccuggacccccgguccccgcgcgacuucauccagugcuuccucaccaagauggccgaggagaaggaggacccccugagccacuuccacauggacacgcugcucaugaccacccacaaccugcuguucggcgggaccaagacggucuccaccacccuccaccacgccuuccuggcgcugaugaaguaccccaaggugcaggcccgggugcaggaggagaucgaccucgucgugggccgcgcccggcugcccgcccugaaggaccgcgccgcgaugccguacaccgacgccgugauccacgagguccagcgcuucgccgacaucauccccaugaaccugccccaccgggugacgcgcgacaccgccuuccggggguuccucauccccaagggcaccgacgugaucacccugcugaacacgguccacuacgacccgagccaguuccucacgccccaggaguucaaccccgagcacuuccuggacgccaaccaguccuucaagaagucccccgcguucaugccguucagcgccgggcgccggcugugccucggcgagagccuggcccgcauggagcuguuccucuaccugaccgccauccugcaguccuucagccuccagccccugggcgcccccgaggacaucgaccugacgccccucuccagcgggcugggcaaccugccgcggcccuuccagcucugccugcgcccccgguga

SEQ ID NO: 28938 - RNA, 1506 nt, Artificial Sequence
  derived and/or modified sequence opt1 from CYP2R1__Homo_sapiens__NP_078790
auguggaagcuguggcgcgccgaggagggcgccgcggcccucgggggcgcccuguuccugcuccuguucgcccugggggugcggcagcuccugaagcagcgccggcccaugggcuucccgcccgggccgcccggccugcccuucaucggcaacaucuacagccucgccgcguccagcgagcugccccacgucuacaugcgcaagcagucccagguguacggggagaucuucagccuggaccucggcgggaucuccaccgugguccugaacggcuacgacguggugaaggagugccugguccaccagagcgagaucuucgccgaccggcccugccucccccuguucaugaagaugaccaagaugggcgggcugcucaacucccgcuacggccggggguggguggaccaccgccggcuggccgugaacagcuuccgcuacuucggcuacgggcagaaguccuucgagagcaagauccuggaggagacgaaguucuucaacgacgccaucgagaccuacaagggccggccguucgacuucaagcagcucaucaccaacgcggucuccaacaucaccaaccugaucaucuucggcgagcgcuucacguacgaggacaccgacuuccagcacaugaucgagcuguucagcgagaacguggagcucgccgccuccgccagcguguuccuguacaacgccuuccccuggaucgggauccugcccuucggcaagcaccagcagcuguuccggaacgcggccgucguguacgacuuccugucccgccugaucgagaaggccagcgugaaccggaagccccagcucccgcagcacuucgucgacgccuaccuggacgagauggaccaggggaagaacgaccccuccagcaccuucuccaaggagaaccugaucuucagcgugggcgagcucaucaucgccgggaccgagacgaccaccaacgugcugcgcugggcgauccuguucauggcccucuaccccaacauccagggccagguccagaaggagaucgaccugaucaugggccccaacgggaagccgagcugggacgacaagugcaagaugcccuacaccgaggccgugcugcacgaggugcuccgguucugcaacaucgucccccugggcaucuuccacgccacguccgaggacgccguggugcgcggguacagcauccccaagggcaccaccgucaucaccaaccuguacuccgugcacuucgacgagaaguacuggcgggacccggaggucuuccaccccgagcgcuuccucgacagcuccggguacuucgcgaagaaggaggcccuggugcccuucagccugggccggcgccacugccucggcgagcaccuggcccgcauggagauguuccuguucuucacggcccuccugcagcgguuccaccuccacuucccccacgagcuggugccggaccucaagccccgccuggggaugacccugcagccccagcccuaccucaucugcgccgagcggcgcuga

SEQ ID NO: 28939 - RNA, 1515 nt, Artificial Sequence
  derived and/or modified sequence opt1 from CYP2S1__Homo_sapiens__NP_085125
auggaggccaccggcaccugggcccugcuccuggcgcuggcccuccugcugcuccugacgcuggcccucagcgggacccgcgcccggggccaccucccgcccgggcccacgccccugccccugcugggcaaccugcuccagcugcgcccgggggcccuguacuccggccucaugcggcugagcaagaaguacggccccguguucaccaucuaccuggggcccuggcgccccgucguggugcucgucggccaggaggcggugcgggaggcccucgggggccaggccgaggaguucuccgggcgcggcaccguggccaugcuggagggcaccuucgacgggcacggcgucuucuucagcaacggggagcgguggcgccagcugcggaaguucaccaugcuggcgcugcgcgaccucggcaugggcaagcgggagggggaggagcugauccaggccgaggcccgcugccugguggagaccuuccagggcacggaggggcggccguucgaccccucccuccugcuggcccaggccaccagcaacguggucugcucccuccuguucggccugcgcuucagcuacgaggacaaggaguuccaggcgguggugcgggccgccgggggcacccuccugggcgucuccagccagggcgggcagaccuacgagauguucuccugguuccugcgcccccuccccgggccgcacaagcagcugcugcaccacgugagcacgcucgccgccuucaccgugcggcagguccagcagcaccagggcaaccuggacgcguccgggcccgcccgcgaccugguggacgccuuccuccugaagauggcccaggaggagcagaaccccggcaccgaguucaccaacaagaacaugcugaugacggugaucuaccuccuguucgccggcaccaugaccgucagcaccacggugggguacacccugcugcuccugaugaaguacccccacgugcagaaguggguccgggaggagcugaaccgcgagcucggcgcggggcaggccccgucccugggcgaccggacccgccugcccuacaccgacgccgugcuccacgaggcccagcgccugcuggcccucgugcccauggggaucccccggacgcugaugcgcaccacccgguuccgcggcuacacccugccgcagggcacggaggucuucccccuccuggggagcauccugcacgaccccaacaucuucaagcaccccgaggaguucaacccggaccgguuccucgacgcggacggccgcuuccggaagcacgaggccuuccugcccuucucccuggggaagcgcgugugccucggcgagggccuggccaaggccgagcuguuccucuucuucaccaccauccugcaggcguucagccuggagucccccugcccgcccgacacccucagccugaagcccacggucagcgggcuguucaacaucccgcccgccuuccagcuccaggugcggcccaccgaccugcacuccaccacccagacgcgcuga

SEQ ID NO: 28940 - RNA, 1635 nt, Artificial Sequence
  derived and/or modified sequence opt1 from CYP2U1__Homo_sapiens__NP_898898
augagcucccccggccccagccagccgcccgccgaggacccgcccuggcccgcccgccugcuccgggcgccccuggggcugcuccgccuggaccccuccggcggggcccugcuccugugcggccugguggcccuccugggguggagcuggcugcggcgccggcgcgcccggggcaucccgcccggccccacccccuggccccucgucgggaacuucggccacgugcugcugccgcccuuccuccgccggcgcuccuggcugagcucccggacccgcgccgcggggaucgaccccagcgugaucggcccccagguccugcucgcccaccuggcccggguguacggguccaucuucagcuucuucaucggccacuaccugguggucgugcucuccgacuuccacagcgugcgcgaggcccugguccagcaggcggagguguucuccgaccggccccgcgugccccugaucagcaucgucacgaaggagaagggcgugguguucgcccacuacgggcccgucuggcggcagcagcgcaaguucucccacagcacccuccggcacuucggccuggggaagcugucccucgagccgaagaucaucgaggaguucaaguacgugaaggccgagaugcagaagcacggcgaggaccccuucugccccuucagcaucaucuccaacgccgugagcaacaucaucugcagccugugcuucggccagcgcuucgacuacaccaacuccgaguucaagaagaugcugggguucaugagccggggccucgagaucugccugaacucccagguccugcucgugaacaucugccccuggcuguacuaccugccguucgggcccuucaaggagcuccgccagaucgagaaggacaucaccagcuuccugaagaagaucaucaaggaccaccaggagucccuggaccgcgagaacccccaggacuucaucgacauguaccuccugcacauggaggaggagcggaagaacaacagcaacuccagcuucgacgaggaguaccuguucuacaucaucggcgaccucuucaucgccgggacggacaccaccaccaacucccugcuguggugccuccuguacaugagccugaaccccgacgugcaggagaagguccacgaggagaucgagcgcgugaucggcgcgaaccgggccccgucccucacggacaaggcccagaugcccuacaccgaggccaccaucauggaggugcagcgccugaccgucguggucccccuggccaucccgcacaugacgagcgagaacaccgugcugcagggcuacaccauccccaaggggacccucauccugcccaaccugugguccgugcaccgggaccccgcgaucugggagaagccggaggacuucuaccccaaccgcuuccucgacgaccagggccagcugaucaagaaggagacguucauccccuucgggaucggcaagcgggucugcaugggggagcagcuggccaagauggagcuguuccucauguucgugagccugaugcaguccuucgccuucgcccuccccgaggacagcaagaagccgcugcugaccggccgcuucggccucacccuggccccgcaccccuucaacaucaccaucucccggcgcuga

SEQ ID NO: 28941 - RNA, 1473 nt, Artificial Sequence
  derived and/or modified sequence opt1 from CYP2W1__Homo_sapiens__NP_060251
auggcccugcuccugcugcuguuccugggccugcucgggcuguggggccugcucugcgccugcgcgcaggaccccagcccggccgcccgcuggccgcccgggccccggccccugccccuggugggcaaccuccaccuccugcgccucucccagcaggaccggagccugauggagcuguccgagcgcuacgggcccgucuucaccgugcaccucggccggcagaagaccgugguccugacgggcuucgaggccgugaaggaggcccuggcggggcccggccaggagcucgccgaccgcccgcccaucgccaucuuccagcugauccagcgcgggggcgggaucuucuucagcuccggcgcccgguggcgggcggcccgccaguucaccgugcgggcccugcacagccucggcgucgggcgcgagcccguggccgacaagauccugcaggagcugaagugccucuccggccagcuggacggguaccggggccgccccuucccgcuggcccuccugggcugggcgcccagcaacaucaccuucgcccugcuguucgggcggcgcuucgacuaccgggaccccguguucgucucccugcugggccucaucgacgaggugauggugcugcuggggagccccggccuccagcuguucaacgucuacccguggcugggggcccuccugcagcugcaccgccccgugcuccggaagaucgaggaggugcgcgccauccugcggacccugcucgaggcccgccgcccccacgucugccccggcgacccggugugcuccuacguggacgcgcugauccagcagggccagggggacgaccccgagggccuguucgccgaggccaacgccgucgccugcacgcuggacauggugauggcggggaccgagaccaccagcgccacgcuccagugggccgcccugcugaugggccggcaccccgacgugcaggggcgcguccaggaggagcucgaccgggugcugggccccggccgcaccccgcggcuggaggaccagcaggcccuccccuacaccuccgcggugcugcacgagguccagcgcuucaucacccugcucccccacgugccccggugcacggccgccgacacccagcucgggggcuuccugcucccgaaggggacccccgucaucccccugcugaccagcgugcuccuggacgagacgcaguggcagaccccgggccaguucaaccccgggcacuuccuggacgccaacggccacuucgugaagcgcgaggcguuccuccccuucuccgccggccggcgcgucugcgugggggagcggcuggcccgcaccgagcuguuccuccuguucgccggccugcuccagcgguaccgccugcugcccccgcccggggugagccccgccucccucgacaccacgcccgcgcgggccuucaccaugcgcccgcgggcccaggcccugugcgccgucccccgccccuga

SEQ ID NO: 28942 - RNA, 1410 nt, Artificial Sequence
  derived and/or modified sequence opt1 from CYP39A1__Homo_sapiens__NP_057677
auggagcugaucagccccaccgugaucaucauccucggcugccuggcccuguuccuccugcugcagcgcaagaaccuccggcgcccgcccugcaucaagggguggauccccuggaucggcgucggguucgaguucggcaaggcgccccuggaguucaucgagaaggcccggaucaaguacgggccgaucuucaccguguucgccaugggcaaccgcaugacguucgugaccgaggaggagggcaucaacgucuuccugaaguccaagaagguggacuucgagcucgccgugcagaacaucgucuaccggaccgccagcauccccaagaacguguuccuggcccugcacgagaagcucuacaucaugcugaaggggaagaugggcaccgugaaccugcaccaguucacggggcagcucaccgaggagcugcacgagcagcuggagaaccucggcacccacgggaccauggaccugaacaaccugguccgccaccuccuguaccccgugacggugaacaugcuguucaacaagucccucuucagcaccaacaagaagaagaucaaggaguuccaccaguacuuccaggucuacgacgaggacuucgaguacggcucccagcugcccgagugccugcuccggaacuggagcaaguccaagaagugguuccuggagcuguucgagaagaacaucccggacaucaaggcgugcaagagcgccaaggacaacuccaugacccuccugcaggccacccuggacaucguggagacggagaccagcaaggagaacucccccaacuacggccuccugcugcucugggccagccuguccaacgcggugcccgucgccuucuggacccuggccuacgugcucagccaccccgacauccacaaggccaucauggaggggaucuccagcguguucggcaaggccgggaaggacaagaucaaggucuccgaggacgaccuggagaaccugcuccugaucaaguggugcgugcuggagaccauccgccucaaggcgccgggcgugaucacgcggaaggucgugaagcccguggagauccugaacuacaucauccccagcggcgaccugcucaugcugucccccuucuggcugcaccgcaacccgaaguacuuccccgagcccgagcuguucaagcccgagcgguggaagaaggccaaccucgagaagcacagcuuccuggacugcuucauggccuucgggagcggcaaguuccagugcccggcccgcugguucgcccugcucgagguccagaugugcaucauccugauccuguacaaguacgacugcucccuccuggacccccugcccaagcagagcuaccuccaccuggugggggucccccagccggagggccagugccggaucgaguacaagcagcgcaucuga

SEQ ID NO: 28943 - RNA, 1182 nt, Artificial Sequence
  derived and/or modified sequence opt1 from CYP3A43__Homo_sapiens__NP_001265850
auggaccugauccccaacuucgccauggagaccugggugcucgucgccaccagccuggugcugcucuacaucuacggcacgcacucccacaagcuguucaagaagcuggggaucccgggccccacgccccuccccuuccuggggaccauccuguucuaccuccgccggagccugaacaagaucccguccugggcgugguggcugacccccgugauccccgcccucugggaggccgaggccggcgggagccccaagguccgcuccagccggccggcccugcccaccuggguguucggcauccugaccgagaacgugaugaagaacaccgagaagugcggcgcgcuguuccccuuccugacccccgucuucgaggcccugaacaucggccucuucccgaaggacgugacgcacuuccugaagaacuccaucgagcgcaugaaggagagccggcugaaggacaagcagaagcaccgcguggacuucuuccagcagaugaucgacucccagaacagcaaggagaccaagucccacaaggcccucagcgaccuggagcuggucgcccaguccaucaucaucaucuucgcggccuacgacaccaccagcacgacccuccccuucaucauguacgagcuggccacccaccccgacgugcagcagaagcugcaggaggagaucgacgccgugcuccccaacaaggccccggucaccuacgacgcgcuggugcagauggaguaccuggacaugguggucaacgagacgcuccggcuguuccccguggugucccgcgucacccgggugugcaagaaggacaucgagaucaacgggguguucauccccaaggggcuggccgucauggugcccaucuacgcccuccaccacgacccgaaguacuggaccgagcccgagaaguucugccccgagcgcuucagcaagaagaacaaggacuccaucgaccuguaccgguacauccccuucggcgccgggccgcgcaacugcaucggcaugcgguucgcccugaccaacaucaagcucgcggugauccgcgcccugcagaacuucagcuucaagcccugcaaggagacgcagaucccccugaagcucgacaaccugcccauccugcagccggagaagcccaucguccucaaggugcaccuccgggacggcaucaccuccgggcccuga

SEQ ID NO: 28944 - RNA, 1509 nt, Artificial Sequence
  derived and/or modified sequence opt1 from CYP3A4__Homo_sapiens__NP_001189784
auggcccugauccccgaccucgccauggagaccuggcugcugcucgcggugagccugguccugcucuaccuguacggcacccacucccacgggcuguucaagaagcucggcaucccggggcccacgccccugcccuuccugggcaacauccucagcuaccacaagggguucugcauguucgacauggagugccacaagaaguacggcaagguguggggcuucuacgacgggcagcagccggugcuggccaucaccgaccccgacaugaucaagaccguccuggugaaggagugcuacuccguguucaccaaccgccggcccuucggccccgucggguucaugaaguccgccaucagcaucgccgaggacgaggaguggaagcgccuccggagccugcuguccccgacguucaccagcggcaagcucaaggagauggugcccaucaucgcccaguacggggacgugcugguccgcaaccugcggcgcgaggcggagaccggcaagcccgugacccucaaggacguguucggcgccuacuccauggacgucaucacgagcaccuccuucggggugaacaucgacagccugaacaacccccaggacccguucguggagaacaccaagaagcugcuccgguucgacuuccuggaccccuucuuccuguccaucaucuuccccuuccucauccccauccuggagguccugaacaucugcguguucccgcgcgaggugaccaacuuccuccgcaagagcgucaagcggaugaaggagucccggcuggaggacacgcagaagcaccgcguggacuuccugcagcucaugaucgacagccagaacuccaaggagaccgagagccacaaggcccuguccgaccuggagcucguggcccagagcaucaucuucaucuucgcgggcuacgagaccaccagcuccguccugagcuucaucauguacgagcuggccacgcaccccgacgugcagcagaagcuccaggaggagaucgacgccgugcugcccaacaaggcgcccccgaccuacgacaccguccugcagauggaguaccucgacaugguggucaacgagacccugcggcuguuccccaucgccaugcgccucgagcgggugugcaagaaggacguggagaucaacgggauguucauccccaagggcgucguggugaugauccccuccuacgcccugcaccgcgacccgaaguacuggacggagcccgagaaguuccugcccgagcgguucagcaagaagaacaaggacaacaucgaccccuacaucuacaccccguucggcuccgggccccgcaacugcaucggcaugcgguucgcccucaugaacaugaagcuggcccugauccgcguccugcagaacuucagcuucaagcccugcaaggagacccagaucccgcucaagcugucccucgggggccugcugcagcccgagaagcccguggugcugaaggucgagagccgggacgggaccguguccggcgccuga

SEQ ID NO: 28945 - RNA, 1509 nt, Artificial Sequence
  derived and/or modified sequence opt1 from CYP3A5__Homo_sapiens__NP_000768
auggaccugauccccaaccucgccguggagaccuggcugcugcucgccgucagccuggugcugcucuaccuguacggcacccgcacgcacgggcuguucaagcggcucggcaucccggggcccacgccccugccccugcucggcaacgugcuguccuaccgccaggggcuguggaaguucgacaccgagugcuacaagaaguacggcaagauguggggcaccuacgaggggcagcucccgguccuggcgaucaccgaccccgacgugauccggaccgugcuggucaaggagugcuacagcguguucaccaaccgccggucccucggccccgugggguucaugaaguccgccaucagccuggccgaggacgaggaguggaagcgcauccggagccugcucucccccaccuucacgagcggcaagcugaaggagauguucccgaucaucgcccaguacggggacguccuggugcgcaaccuccggcgcgaggccgagaagggcaagcccgugacccugaaggacaucuucggcgcguacuccauggacgucaucaccgggaccagcuucggcgugaacaucgacucccugaacaacccccaggaccccuucguggagagcacgaagaaguuccucaaguucggguuccuggacccgcuguuccucuccaucauccuguuccccuuccugacccccgucuucgaggcccucaacgugagccuguuccccaaggacaccaucaacuuccuguccaagagcgugaaccggaugaagaagucccgccucaacgacaagcagaagcaccggcuggacuuccugcagcucaugaucgacagccagaacuccaaggagaccgagagccacaaggcccugagcgaccuggagcucgccgcgcaguccaucaucuucaucuucgccggcuacgagacgaccagcuccguccugagcuucacccuguacgagcucgccacccacccggacgugcagcagaagcugcagaaggagaucgacgccgugcugcccaacaaggccccgcccacguacgacgcggucgugcagauggaguaccucgacaugguggucaacgagacccugcgccuguuccccguggccauccggcuggagcggaccugcaagaaggacgucgagaucaacggcguguucauccccaagggguccaugguggucauccccaccuacgcccuccaccacgaccccaaguacuggacggagccggaggaguuccgccccgagcgcuucagcaagaagaaggacuccaucgaccccuacaucuacacccccuucggcaccgggccgcggaacugcaucggcaugcgcuucgcccugaugaacaugaagcuggcccucauccgggugcugcagaacuucagcuucaagcccugcaaggagacccagaucccccugaagcucgacacgcaggggcugcugcagccggagaagcccaucgugcucaaggucgacucccgcgacggcacccugagcggcgaguga

SEQ ID NO: 28946 - RNA, 1608 nt, Artificial Sequence
  derived and/or modified sequence opt1 from CYP3A7-CYP3A51P__Homo_sapiens__NP_001243426
auggaccugauccccaaccucgccguggagaccuggcugcugcucgccgucagccugauccugcucuaccuguacggcacccgcacgcacgggcuguucaagaagcucggcaucccggggcccacgccccugcccuuccugggcaacgcgcucuccuuccggaagggguacuggaccuucgacauggagugcuacaagaaguaccgcaagguguggggcaucuacgacugccagcagccgaugcuggccaucaccgaccccgacaugaucaagaccgugcuggucaaggagugcuacagcguguucaccaaccggcgccccuucggccccgugggguucaugaagaacgccaucuccaucgccgaggacgaggaguggaagcggauccgcagccuccuguccccgaccuucaccagcggcaagcugaaggagaugguccccaucaucgcccaguacggggacgugcucgugcggaaccugcgccgggaggcggagacgggcaagcccgucacccugaagcacguguucggggccuacuccauggacgugaucaccagcaccuccuucggcgucagcaucgacucccucaacaacccccaggacccguucguggagaacacgaagaagcugcugcgcuucaacccccucgaccccuucgugcugagcaucaaggucuuccccuuccugaccccgauccucgaggcccugaacaucaccguguucccccggaaggugaucuccuuccugaccaagagcgucaagcagaucaaggagggccgccucaaggagacgcagaagcaccggguggacuuccugcagcugaugaucgacucccagaacagcaaggacuccgagacccacaaggcccucagcgaccuggagcugauggcgcaguccaucaucuucaucuucgccggguacgagaccaccagcagcgugcucuccuucaucaucuacgagcuggccacgcaccccgacguccagcagaaggugcagaaggagaucgacaccgugcugcccaacaaggccccgcccaccuacgacaccguccuccagcuggaguaccuggacaugguggucaacgagacgcuccgccuguuccccguggccaugcggcuggagcgcgugugcaagaaggacgucgagaucaacggcauguucauccccaagggggugguggucaugaucccgagcuacgugcuccaccacgaccccaaguacuggaccgagcccgagaaguuccugcccgagcgguucuccaagaagaacaaggacaacaucgacccguacaucuacacccccuucggcagcggcccccgcaacugcaucgggaugcgguucgcgcuggugaacaugaagcucgcccugguccgcgugcugcagaacuucuccuucaagccgugcaaggagacccagaucccccugaagcuccgguucggcgggcugcugcucacggagaagcccaucgugcugaaggccgagagccgcgacgagaccuucgucgacauggagcccauccacauggacuuccugcgcucccucgccuuccagggcccgcaccugugcuucuucugggagcugcucugccccaccauccggagccgcuga

SEQ ID NO: 28947 - RNA, 1512 nt, Artificial Sequence
  derived and/or modified sequence opt1 from CYP3A7__Homo_sapiens__NP_000756
auggaccugauccccaaccucgccguggagaccuggcugcugcucgccgucagccugauccugcucuaccuguacggcacccgcacgcacgggcuguucaagaagcucggcaucccggggcccacgccccugcccuuccugggcaacgcgcucuccuuccggaagggguacuggaccuucgacauggagugcuacaagaaguaccgcaagguguggggcaucuacgacugccagcagccgaugcuggccaucaccgaccccgacaugaucaagaccgugcuggucaaggagugcuacagcguguucaccaaccggcgccccuucggccccgugggguucaugaagaacgccaucuccaucgccgaggacgaggaguggaagcggauccgcagccuccuguccccgaccuucaccagcggcaagcugaaggagaugguccccaucaucgcccaguacggggacgugcucgugcggaaccugcgccgggaggcggagacgggcaagcccgucacccugaagcacguguucggggccuacuccauggacgugaucaccagcaccuccuucggcgucagcaucgacucccucaacaacccccaggacccguucguggagaacacgaagaagcugcugcgcuucaacccccucgaccccuucgugcugagcaucaaggucuuccccuuccugaccccgauccucgaggcccugaacaucaccguguucccccggaaggugaucuccuuccugaccaagagcgucaagcagaucaaggagggccgccucaaggagacgcagaagcaccggguggacuuccugcagcugaugaucgacucccagaacagcaaggacuccgagacccacaaggcccucagcgaccuggagcugauggcgcaguccaucaucuucaucuucgccggguacgagaccaccagcagcgugcucuccuucaucaucuacgagcuggccacgcaccccgacguccagcagaaggugcagaaggagaucgacaccgugcugcccaacaaggccccgcccaccuacgacaccguccuccagcuggaguaccuggacaugguggucaacgagacgcuccgccuguuccccguggccaugcggcuggagcgcgugugcaagaaggacgucgagaucaacggcauguucauccccaagggggugguggucaugaucccgagcuacgugcuccaccacgaccccaaguacuggaccgagcccgagaaguuccugcccgagcgguucuccaagaagaacaaggacaacaucgacccguacaucuacacccccuucggcagcggcccccgcaacugcaucgggaugcgguucgcgcuggugaacaugaagcucgcccugguccgcgugcugcagaacuucuccuucaagccgugcaaggagacccagaucccccugaagcuccgguucggcgggcugcugcucacggagaagcccaucgugcugaaggccgagagccgcgacgagaccgucuccggcgccuga

SEQ ID NO: 28948 - RNA, 1503 nt, Artificial Sequence
  derived and/or modified sequence opt1 from CYP46A1__Homo_sapiens__NP_006659
augagccccggccugcuccugcugggguccgccgugcuccuggccuucggccugugcugcaccuucguccaccgcgcgcggagccgcuacgagcacaucccggggccgccccggcccuccuuccuccugggccaccuccccugcuucuggaagaaggacgaggucgggggccgcgugcugcaggacguguuccuggacugggccaagaaguacggccccguggugcgggucaacguguuccacaagaccagcgugaucgucacgucccccgagagcgugaagaaguuccugauguccaccaaguacaacaaggacagcaagauguaccgcgcccuccagaccguguucggggagcggcuguucggccaggggcuggucuccgagugcaacuacgagcgcuggcacaagcagcggcgcgugaucgaccucgccuucagccgguccagccuggugucccugauggagaccuucaacgagaaggccgagcagcucgucgagauccuggaggcgaaggccgacggccagacgcccgugagcaugcaggacaugcugaccuacaccgccauggacauccucgccaaggcggccuucgggauggagaccuccaugcugcugggcgcccagaagccgcucagccaggccgugaagcugaugcuggagggcaucacggccucccgcaacacccucgcgaaguuccugcccgggaagcggaagcagcugcgcgagguccgggagagcauccgcuuccuccgccaggugggccgggacugggugcagcggcgccgggaggcccugaagcgcggggaggagguccccgccgacauccugacccagauccucaaggccgaggagggcgcccaggacgacgagggccugcuggacaacuucgugaccuucuucaucgcggggcacgagacguccgccaaccaccucgccuucaccgugauggagcugagccgccagcccgagaucgucgcccggcugcaggccgagguggacgaggucaucggcagcaagcgcuaccucgacuucgaggaccuggggcggcugcaguaccucucccaggugcugaaggagagccugcgccucuacccgcccgcguggggcaccuuccggcugcuggaggaggagacccucaucgacggggugcgcguccccggcaacacgccccugcuguucuccaccuacgugaugggccggauggacaccuacuucgaggacccgcugaccuucaaccccgaccgcuucgggcccggcgcccccaagccgcgguucacguacuuccccuucagccucgggcaccgcuccugcaucggccagcaguucgcccagauggaggugaaggucgugauggccaagcugcugcagcggcucgaguuccgccuggugcccgggcagcgguucggccugcaggagcaggccacccucaagccccuggacccgguccugugcacccuccgcccccggggcuggcagcccgcgcccccgcccccgcccugcuga

SEQ ID NO: 28949 - RNA, 804 nt, Artificial Sequence
  derived and/or modified sequence opt1 from CYP4A11__Homo_sapiens__XP_011539132
augagcguguccguccugagccccucccgccuccugggcgacgugagcgggauccugcaggccgccucccuccugauccugcuccugcugcucaucaaggcggugcagcuguaccugcaccggcaguggcuccugaaggcccugcagcaguuccccugcccgcccagccacuggcuguucggccacauccaggagcuccagcaggaccaggagcugcagcgcauccagaagugggucgagaccuuccccuccgccugcccccacuggcucuggggcgggaaggugcgggugcagcuguacgaccccgacuacaugaaggucauccuggggcgcagcgcccucuccugccugagcgaccccaagucccacggcagcuaccgguuccuggcccccuggaucggcuacgggcuccugcugcucaacggccagaccugguuccagcaccgccggaugcugacgccggcguuccacuacgacauccugaagcccuacguggggcucauggccgacuccgugcgcgucaugcuggacaagugggaggagcugcucggccaggacagcccccuggagguguuccagcacgugucccugaugacccucgacaccaucaugaagugcgccuucagccaccagggguccauccaggucgaccggcccagcgacccgaccgaggagggcuccacgaccgagggcgggggcgccggggaggaccaggaggaggaggcguucggcuucagcggcuacccgccccuggggcagaacggcgagugggagcaccuggugcgccaggggccgcccugcuga

SEQ ID NO: 28950 - RNA, 1494 nt, Artificial Sequence
  derived and/or modified sequence opt1 from CYP4B1__Homo_sapiens__NP_001306090
auggugcccagcuuccugucccucagcuucuccagccugggccugugggccuccgggcucauccugguccugggcuuccucaagcugauccaccuccuccugcgccggcagacccuggccaaggcgauggacaaguucccggggccgcccacccacuggcuguucggccacgcccuggagauccaggagacggggagccuggacaaggugguguccugggcccaccaguuccccuacgcccacccccucugguucggccaguucaucggcuuccugaacaucuacgagcccgacuacgccaaggcggucuacagccgcgggggccgggggcugcucgugcuggagggccccaaguggcugcagcaccgcaagcuccugacccccggguuccacuacgacgugcugaagccguacgucgccguguucaccgaguccacccggaucaugcucgacaagugggaggagaaggcccgcgagggcaagagcuucgacaucuucugcgacgugggccacauggcccugaacacgcugaugaagugcaccuucgggcggggcgacaccgggcucggccacucccgcgacagcuccuacuaccuggcggucagcgaccugacccuccugaugcagcagcggcugguguccuuccaguaccacaacgacuucaucuacuggcucacgccccacggccgccgguuccugcgcgccugccagguggcccacgaccacaccgaccaggucauccgggagcgcaaggccgcccugcaggacgagaaggugcggaagaagauccagaaccgccggcaccucgacuuccuggacauccugcucggggcgcgcgacgaggacgacaucaagcugagcgacgccgaccugcgggccgagguggacaccuucauguucgagggccacgacaccacgaccuccgggaucagcugguuccucuacugcauggcccuguaccccgagcaccagcaccgcugccgggaggagguccgcgagauccugggcgaccaggacuucuuccagugggacgaccucgggaagaugaccuaccugaccaugugcaucaaggaguccuuccgccuguacccgcccgugccccagguguaccggcagcucagcaagcccgucacguucguggacggccgcagccugcccgccggcucccugaucagcaugcacaucuacgcgcugcaccggaacuccgccguguggccggaccccgaggucuucgacagccuccgcuucuccaccgagaacgccagcaagcggcaccccuucgccuucaugcccuucuccgccgggccgcgcaacugcaucggccagcaguucgcgaugagcgagaugaagguggugaccgccaugugccugcugcgguucgaguucucccucgaccccagccgccugcccaucaagaugccccagcugguccuccgguccaagaacggguuccaccuccaccugaagccgcugggccccgggagcggcaaguga

SEQ ID NO: 28951 - RNA, 1575 nt, Artificial Sequence
  derived and/or modified sequence opt1 from CYP4F11__Homo_sapiens__NP_067010
augccccagcugagccucuccuggcugggccuggggccgguggccgccagccccuggcuccugcugcuccuggucggcggguccuggcugcucgcgcgcgugcuggccuggaccuacaccuucuacgacaacugccggcgccugcagugcuucccccagcccccgaagcagaacugguucuggggccaccaggggcucgugacgcccaccgaggagggcaugaagacccugacccagcuggucacgaccuacccccagggcuucaagcucuggcuggggcccaccuucccgcugcucauccugugccaccccgacaucauccggcccaucaccagcgccuccgccgccguggcgcccaaggacaugaucuucuacggcuuccugaagccguggcucggggacggccugcugcucagcgggggcgacaaguggucccgccaccggcgcaugcugacgcccgccuuccacuucaacauccugaagcccuacaugaagaucuucaacaagagcgugaacaucaugcacgacaaguggcagcggcucgccuccgagggcagcgcccgccuggacauguucgagcacaucucccugaugacccucgacagccugcagaagugcgucuucuccuucgagagcaacugccaggagaagcccuccgaguacaucgcggccauccuggagcucagcgccuucguggagaagcggaaccagcagauccugcugcacaccgacuuccucuacuaccugaccccggacgggcagcgcuuccggcgcgccugccaccuggugcacgacuucacggacgccgucauccaggagcggcgcugcacccuccccacccagggcaucgacgacuuccugaagaacaaggcgaaguccaagacccuggacuucaucgacgugcuccugcugagcaaggacgaggacgggaaggagcucuccgacgaggacauccgggccgaggccgacacguucauguucgagggccacgacaccaccgccagcggccugagcugggugcuguaccaccucgccaagcaccccgaguaccaggagcagugccgccaggagguccaggagcugcugaaggaccgggagcccaucgagaucgagugggacgaccuggcgcagcucccguuccugaccaugugcaucaaggagucccugcgccuccacccgcccgugcccgugaucagccggugcugcacgcaggacuucguccugcccgacgggcgcgugauccccaagggcaucgugugccugaucaacaucaucgggauccacuacaaccccaccgucuggcccgacccggagguguacgaccccuuccgguucgaccaggagaacaucaaggagcgcagcccccucgccuucaucccguucuccgccggcccccgcaacugcaucgggcaggccuucgccauggcggagaugaaggugguccuggcccugacccuccugcacuuccggauccugcccacccacacggagccccgccggaagccggagcucauccugcgcgccgagggcggccuguggcuccggguggagccccugggggccaacucccaguga

SEQ ID NO: 28952 - RNA, 1575 nt, Artificial Sequence
  derived and/or modified sequence opt1 from CYP4F12__Homo_sapiens__NP_076433
augagccugcucucccugcccuggcugggccuccgcccgguggccaccagccccuggcugcugcuccugcuggucgugggguccuggcuccuggcccggauccuggcguggaccuacgccuucuacaacaacugccgccggcuccagugcuucccccagcccccgaagcgcaacugguucuggggccaccuggggcugaucacgcccaccgaggagggccucaagaacagcacccagauguccgccaccuacagccagggguucacgguguggcugggccccaucauccccuucaucguccugugccacccggacaccauccgguccaucaccaacgccagcgccgcgaucgcccccaaggacaaccucuucauccgcuuccugaagcccuggcugggcgaggggauccuccuguccggcggggacaaguggagccggcaccgccggaugcugacccccgccuuccacuucaacauccucaaguccuacaucacgaucuucaacaagagcgccaacaucaugcuggacaaguggcagcaccuggcguccgagggcagcucccgccucgacauguucgagcacaucagccugaugacccuggacucccuccagaagugcaucuucagcuucgacucccacugccaggagcggccgagcgaguacaucgccaccauccuggagcugagcgcccucguggagaagcgcucccagcacauccugcagcacauggacuuccuguacuaccucagccacgacgggcggcgcuuccaccgggccugccgccuggugcacgacuucaccgacgccgucauccgggagcgccggcgcacgcugcccacccagggcaucgacgacuucuucaaggacaaggcgaaguccaagacccucgacuucaucgacgugcugcugcucagcaaggacgaggacggcaaggcccuguccgacgaggacauccgggccgaggccgacaccuucauguucgggggccacgacacgaccgccagcgggcuguccugggugcucuacaaccuggcgcgccaccccgaguaccaggagcgcugccggcaggagguccaggagcugcucaaggaccgcgaccccaaggagaucgagugggacgaccuggcccagcugccguuccugaccaugugcgugaaggagagccuccggcugcacccgcccgcccccuucaucucccgcugcugcacccaggacaucgugcugcccgacggccgggucauccccaagggcaucacgugccucaucgacaucaucggggugcaccacaaccccaccguguggcccgacccggaggucuacgaccccuuccgcuucgaccccgagaacagcaagggccggagcccccuggccuucaucccguucuccgccgggccccgcaacugcaucggccaggcguucgccauggccgagaugaagguggugcuggcccucaugcugcugcacuuccgguuccuccccgaccacaccgagccgcgccggaagcuggagcugaucaugcgcgccgagggcgggcucuggcugcgggucgagccccugaacgugucccuccaguga

SEQ ID NO: 28953 - RNA, 1596 nt, Artificial Sequence
  derived and/or modified sequence opt1 from CYP4F22__Homo_sapiens__NP_775754
augcugcccaucaccgaccgccuccugcaccuccucggccuggagaagaccgccuuccggaucuacgccgugagcacgcugcuccuguuccugcuguucuuccuguuccgccugcuccugcgguuccugcgccucugccgguccuucuacaucacgugccgccggcugcgcugcuucccgcagccgccccggcgcaacuggcugcucgggcaccugggcauguaccugcccaacgaggcggggcuccaggacgagaagaagguccuggacaacaugcaccacgugcugcucguguggaugggccccguccugccccugcucgugcuggugcaccccgacuacaucaagccccugcucggggccagcgccgccaucgccccgaaggacgaccuguucuacggcuuccugaagcccuggcucggcgacgggcugcugcucuccaagggcgacaaguggagccggcaccgccggcugcugacccccgcguuccacuucgacauccucaagcccuacaugaagaucuucaaccaguccgccgacaucaugcacgccaaguggcgccaccuggccgaggggagcgcggucucccuggacauguucgagcacaucagccucaugacccuggacucccugcagaagugcguguucagcuacaacuccaacugccaggagaagaugagcgacuacaucuccgccaucaucgagcucagcgcccuguccgugcggcgccaguaccggcugcaccacuaccucgacuucaucuacuaccgcagcgccgacggccggcgcuuccggcaggccugcgacaugguccaccacuucaccaccgaggugauccaggagcgccgccgggcgcugcgccagcagggggccgaggccuggcugaaggccaagcagggcaagacccuggacuucaucgacgugcuccugcuggcccgggacgaggacggcaaggagcucuccgacgaggacauccgcgcggaggccgacaccuucauguucgaggggcacgacacgaccagcuccggcaucagcuggaugcuguucaaccuggccaaguacccggaguaccaggagaagugccgggaggagauccaggaggucaugaaggggcgcgagcucgaggagcuggagugggacgaccugacccagcuccccuucaccacgaugugcaucaaggagagccugcggcaguacccgcccgugacccuggugucccgccagugcaccgaggacaucaagcuccccgacggccggaucauccccaagggcaucaucugccuggucagcaucuacgggacccaccacaaccccacgguguggcccgacuccaagguguacaacccguaccgcuucgaccccgacaacccccagcagcggagcccccuggccuacgucccguucuccgccggcccccgcaacugcaucgggcagagcuucgcgauggccgagcuccgggugguggucgcccugacccugcuccgcuuccggcuguccguggaccgcacccggaaggugcgccggaagcccgagcugauccuccgcaccgagaacggccuguggcugaaggucgagccccucccgccccgcgccuga

SEQ ID NO: 28954 - RNA, 1563 nt, Artificial Sequence
  derived and/or modified sequence opt1 from CYP4F2__Homo_sapiens__NP_001073
augagccagcugucccucagcuggcugggccuguggcccguggccgccuccccguggcuccugcugcuccuggucggggcgagcuggcugcucgcccacgugcuggccuggaccuacgccuucuacgacaacugccgccggcugcgcugcuucccccagccgccccggcgcaacugguucuggggccaccaggggauggugaaccccaccgaggagggcaugcggguccucacgcagcugguggccaccuacccccagggguucaagguguggaugggccccaucagcccccugcucucccugugccacccggacaucauccgcuccgucaucaacgcgagcgccgccaucgcccccaaggacaaguucuucuacuccuuccuggagcccuggcucggcgacgggcugcugcucagcgcgggcgacaaguggucccggcaccgccggaugcugacccccgccuuccacuucaacauccugaagccguacaugaagaucuucaacgagagcgugaacaucaugcacgccaaguggcagcuccuggccuccgaggggagcgccugccuggacauguucgagcacaucucccucaugacccuggacagccugcagaagugcguguucuccuucgacagccacugccaggagaagcccuccgaguacaucgcggccauccucgagcugagcgcccuggucagcaagcgccaccacgagauccuccugcacaucgacuuccuguacuaccucacgcccgacggccagcgguuccgccgggccugccgccuggugcacgacuucaccgacgccgugauccaggagcggcgccggacccugcccucccagggggucgacgacuuccuccaggcgaaggccaagagcaagacccuggacuucaucgacgugcugcuccuguccaaggacgaggacggcaagaagcugagcgacgaggacauccgcgccgaggccgacacguucauguucgagggccacgacaccaccgccuccgggcucagcugggugcuguaccaccuggcgaagcacccggaguaccaggagcggugccgccaggagguccaggagcuccugaaggaccgggagcccaaggagaucgagugggacgaccuggcccaccuccccuuccugaccaugugcaugaaggagucccugcgccugcacccgcccgugcccgugaucagccgccacgucacgcaggacaucgugcuccccgacggccgggugauccccaaggggaucaucugccugaucuccgucuucggcacccaccacaacccggccguguggcccgaccccgagguguacgaccccuuccgcuucgacccggagaacaucaaggagcggagcccccuggccuucauccccuucuccgccggcccgcgcaacugcaucgggcagaccuucgcgauggccgagaugaaggucgugcucgcccugacccugcuccgguuccgcguccugcccgaccacacggagccccggcgcaagcccgagcuggugcuccgggccgagggcgggcuguggcugcgcguggagccgcucagcuga

SEQ ID NO: 28955 - RNA, 1563 nt, Artificial Sequence
  derived and/or modified sequence opt1 from CYP4F3__Homo_sapiens__NP_000887
augccccagcugagccucuccagccugggccuguggccgauggccgccucccccuggcuccugcugcuccuggugggggcgagcuggcugcucgcccgcauccuggccuggaccuacaccuucuacgacaacugcugccggcugcgcugcuucccccagcccccgaagcggaacugguuccucggccaccuggggcugauccacuccagcgaggagggccuccuguacacgcagucccuggccugcaccuucggggacaugugcugcuggugggucggccccuggcacgccaucgugcgcaucuuccaccccaccuacaucaagcccguccucuucgcgccggccgccaucgugcccaaggacaagguguucuacagcuuccugaagcccuggcugggcgacgggcuccugcuguccgccggcgagaaguggagccggcaccgccggaugcucacccccgcguuccacuucaacauccugaagccguacaugaagaucuucaacgaguccgugaacaucaugcacgccaaguggcagcugcucgccagcgagggguccgcccgccuggacauguucgagcacaucagccugaugacgcucgacucccugcagaagugcgucuucagcuucgacucccacugccaggagaagcccagcgaguacaucgccgcgauccuggagcucuccgcccuggugaccaagcggcaccagcagauccugcucuacaucgacuuccuguacuaccugacccccgacggccagcgcuuccggcgcgccugccggcucgugcacgacuucaccgacgccgucauccaggagcgccggcgcacgcugcccagccaggggguggacgacuuccugcaggccaaggccaagagcaagacccucgacuucaucgacgugcugcugcucuccaaggacgaggacggcaagaagcugagcgacgaggacauccgggcggaggccgacaccuucauguucgagggccacgacaccacggccuccgggcugagcuggguccucuaccaccuggccaagcacccggaguaccaggagcgcugccggcaggaggugcaggagcugcugaaggaccgcgagcccaaggagaucgagugggacgaccucgcgcagcugcccuuccugaccaugugcaucaaggagucccuccggcugcacccgcccgugcccgccgucagccgcugcugcacccaggacaucgugcugcccgacggccgcgugauccccaaggggaucaucugccucaucuccgucuucggcacccaccacaacccggccguguggcccgaccccgagguguacgaccccuuccgguucgacccgaagaacaucaaggagcgcagcccccuggccuucauccccuucuccgccggcccgcggaacugcaucgggcaggcguucgccauggccgagaugaaggucgugcugggccucacgcugcugcgcuuccgggugcuccccgaccacaccgagccccgccggaagcccgagcugguccugcgcgccgagggcgggcucuggcugcggguggagccgcugagcuga

SEQ ID NO: 28956 - RNA, 1563 nt, Artificial Sequence
  derived and/or modified sequence opt1 from CYP4F8__Homo_sapiens__NP_009184
augagccugcucucccugagcuggcugggccuccgccccguggccgccuccccguggcugcugcuccuggucgugggggcgagcuggcugcucgcccggauccuggccuggaccuacgccuucuaccacaacggccgccggcugcgcugcuucccccagccccggaagcagaacugguuccucgggcaccugggccuggugacccccacggaggaggggcuccgcguccugacccagcugguggccaccuacccgcagggcuucgugcgguggcucggccccaucacccccaucaucaaccugugccaccccgacaucguccgcuccgugaucaacacgagcgacgcgaucaccgacaaggacaucguguucuacaagacccugaagccguggcucggggacggccugcugcucuccgucggggacaaguggcggcaccaccgccggcugcugacccccgccuuccacuucaacauccucaagcccuacaucaagaucuucagcaaguccgccaacaucaugcacgccaaguggcagcgccuggcgauggagggcagcacgugccuggacguguucgagcacaucucccucaugacccuggacagccugcagaagugcaucuucuccuucgacagcaacugccaggagaagcccuccgaguacaucaccgccaucauggagcucagcgcccugguggucaagcggaacaaccaguucuuccgcuacaaggacuuccuguacuuccucaccccgugcgggcggcgcuuccaccgggccugccgccuggugcacgacuucacggacgccgugauccaggagcggcgccggacccugaccucccagggcgucgacgacuuccuccaggcgaaggccaagagcaagacccuggacuucaucgacgugcugcuccuguccgaggacaagaacggcaaggagcugagcgacgaggacauccgcgccgaggccgacacguucauguucgggggccacgacaccaccgccagcgggcucuccugggugcuguacaaccuggcgcgccaccccgaguaccaggagcggugccgccaggagguccaggagcuccugaaggaccgggagcccaaggagaucgagugggacgaccuggcccagcugcccuuccucaccaugugccugaaggagagccugcgccuccacccgcccauccccacguucgcccggggcugcacccaggacguggugcugcccgacucccgcgucaucccgaagggcaacgugugcaacaucaacaucuucgccauccaccacaaccccagcguguggcccgaccccgaggucuacgacccguuccgguucgaccccgagaacgcccagaagcgcucccccauggcguucauccccuucagcgccgggccgcggaacugcaucggccagaaguucgccauggccgagaugaaggugguccuggcccucacccugcugcgcuuccggauccuccccgaccaccgcgagccccggcgcaccccggagaucgugcugcgggcggaggacgggcuguggcuccgcguggagccccugggcuga

SEQ ID NO: 28957 - RNA, 1578 nt, Artificial Sequence
  derived and/or modified sequence opt1 from CYP4V2__Homo_sapiens__NP_997235
auggccggccuguggcucgggcugguguggcagaagcugcuccuguggggcgccgcgagcgcccugucccucgccggggccagccugguccugucccuccugcagcgcguggccagcuacgcgcggaaguggcagcagaugcgccccaucccgaccguggcccgggccuacccccuggucggccacgcccuccugaugaagcccgacgggcgcgaguucuuccagcagaucaucgaguacaccgaggaguaccggcacaugccccugcucaagcugugggugggcccggugcccauggucgcgcuguacaacgccgagaacguggaggugauccucacguccagcaagcagaucgacaaguccagcauguacaaguuccuggagcccuggcugggccucgggcugcugaccuccaccggcaacaaguggcgcagccggcgcaagaugcucacccccacguuccacuucaccauccuggaggacuuccuggacaucaugaacgagcaggccaacauccucgucaagaagcuggagaagcacaucaaccaggaggccuucaacugcuucuucuacaucacccugugcgcccucgacaucaucugcgagaccgcgauggggaagaacaucggcgcccaguccaacgacgacagcgaguacgugcgggccguguaccgcauguccgagaugaucuuccggcgcaucaagaugccguggcuguggcuggaccucugguaccugauguucaaggaggggugggagcacaagaagucccugcagauccuccacacguucaccaacagcgucaucgccgagcgggccaacgagaugaacgcgaacgaggacugccgcggcgacggccgggggagcgcccccuccaagaacaagcgccgggccuuccuggaccugcuccugagcgugaccgacgacgagggcaaccgccugucccacgaggacauccgggaggagguggacaccuucauguucgaggggcacgacacgaccgccgccgcgaucaacuggagccucuaccugcugggcagcaaccccgagguccagaagaagguggaccacgagcucgacgacguguucggcaaguccgaccgccccgccaccgucgaggaccugaagaagcugcgguaccucgagugcgugaucaaggagacccugcgccuguucccgagcgugccccuguucgcccgcuccgucagcgaggacugcgagguggccggguaccgggugcucaagggcacggaggccgucaucauccccuacgcgcugcaccgcgacccccgguacuucccgaaccccgaggaguuccagcccgagcgcuucuuccccgagaacgcccaggggcggcacccguacgccuacgugcccuucuccgccggcccccgcaacugcaucgggcagaaguucgcggucauggaggagaagaccauccugagcugcauccuccggcacuucuggaucgaguccaaccagaagcgcgaggagcugggccuggagggccagcucauccugcggcccagcaacgggaucuggaucaagcugaagcgccggaacgccgacgagcgcuga

SEQ ID NO: 28958 - RNA, 1530 nt, Artificial Sequence
  derived and/or modified sequence opt1 from CYP51A1__Homo_sapiens__NP_000777
auggccgccgcggccggcaugcugcuccuggggcugcuccaggccggcgggagcgugcugggccaggccauggagaaggucaccgggggcaaccugcucuccaugcugcugaucgccugcgcguucacccucagccugguguaccugauccgccucgccgccggccaccuggugcagcugcccgccggggucaaguccccgcccuacaucuucagccccauccccuuccucggccacgcgaucgccuucgggaaguccccgaucgaguuccuggagaacgccuacgagaaguacggccccguguucagcuucacgaugguggggaagaccuucaccuaccugcucggcuccgacgccgccgcgcugcuguucaacagcaagaacgaggaccucaacgccgaggacgucuacucccggcugaccacgcccguguucggcaaggggguggccuacgacguccccaacccgguguuccuggagcagaagaagaugcucaagagcggccugaacaucgcccacuucaagcagcacguguccaucaucgagaaggagaccaaggaguacuucgagagcuggggcgaguccggggagaagaacgucuucgaggcccugagcgagcucaucauccugaccgcgucccacugccugcacggcaaggagauccgcagccagcucaacgagaagguggcccagcuguacgccgaccuggacgggggcuucucccacgccgccuggcuccugcccggguggcugccccuccccagcuuccggcgccgggaccgcgcgcaccgggagaucaaggacaucuucuacaaggccauccagaagcgccggcagucccaggagaagaucgacgacauccugcagacccugcucgacgccacguacaaggacggccgcccgcugaccgacgacgagguggccgggaugcugaucggccuccugcuggccggccagcacaccagcagcaccacguccgcguggaugggguucuuccucgcccgggacaagacccugcagaagaagugcuaccuggagcagaagaccgucugcggcgagaaccucccgccccugaccuacgaccagcugaaggaccugaaccuccuggaccgcugcaucaaggagacgcugcggcuccgcccgcccaucaugaucaugaugcggauggcccgcacgccccagaccguggccggguacaccaucccgcccggccaccaggugugcgucagccccaccgugaaccagcggcugaaggacuccuggguggagcgccuggacuucaaccccgaccgguaccuccaggacaaccccgcgagcggggagaaguucgccuacguccccuucggcgccggccgccaccggugcaucggggagaacuucgccuacgugcagaucaagaccaucugguccaccaugcugcgccuguacgaguucgaccucaucgacggcuacuuccccaccgugaacuacacgaccaugauccacacccccgagaaccccgucauccgcuacaagcggcgcagcaaguga

SEQ ID NO: 28959 - RNA, 1515 nt, Artificial Sequence
  derived and/or modified sequence opt1 from CYP7A1__Homo_sapiens__NP_000771
augaugaccaccagccugaucuggggcaucgccaucgccgcgugcugcugccucuggcugauccuggggauccgccggcgccagacgggcgagccgccccucgagaacgggcugauccccuaccugggcugcgcccuccaguucggggccaacccccuggaguuccugcgggccaaccagcgcaagcacggccacguguucacgugcaagcucaugggcaaguacguccacuucaucaccaacccccuguccuaccacaaggugcugugccacgggaaguacuucgacuggaagaaguuccacuucgccaccagcgcgaaggccuucggccaccgguccaucgaccccauggacgggaacaccaccgagaacaucaacgacaccuucaucaagacccuccagggccacgcccugaacagccugacggaguccaugauggagaaccuccagcgcaucaugcggccgcccgugagcuccaacagcaagaccgccgcgugggucaccgaggggauguacuccuucugcuaccgcgugauguucgaggccggcuaccugaccaucuucggccgggaccugacgcgccgggacacccagaaggcccacauccucaacaaccuggacaacuucaagcaguucgacaagguguuccccgcccuggucgccgggcuccccauccacauguuccgcaccgcgcacaacgcccgggagaagcuggccgagagccugcgccacgagaaccuccagaagcgggaguccaucagcgagcugaucucccugcgcauguuccucaacgacacccugagcacguucgacgaccuggagaaggccaagacccaccucguggugcugugggccucccaggcgaacaccauccccgccaccuucuggagccuguuccagaugauccggaaccccgaggccaugaaggccgccacggaggaggucaagcgcacccucgagaacgcgggccagaaggugucccuggaggggaaccccaucugccugagccaggccgagcucaacgaccugccggugcuggacuccaucaucaaggagagccuccggcugagcuccgccagccugaacauccgcaccgccaaggaggacuucacccuccaccuggaggacggcuccuacaacauccggaaggacgacaucaucgcccuguacccccagcucaugcaccuggaccccgagaucuaccccgacccgcugacguucaaguacgaccgcuaccucgacgagaacggcaagaccaagaccaccuucuacugcaacgggcugaagcugaaguacuacuacaugcccuucggcagcggggcgacgaucugccccggccgccuguucgccauccacgagaucaagcaguuccucauccugaugcuguccuacuucgagcucgagcugaucgaggggcaggccaagugcccgccccuggaccagagccgggccggccucggcauccugccgccccugaacgacaucgaguucaaguacaaguucaagcaccucuga

SEQ ID NO: 28960 - RNA, 1521 nt, Artificial Sequence
  derived and/or modified sequence opt1 from CYP7B1__Homo_sapiens__NP_004811
auggccggcgaggugagcgccgcgaccgggcgcuucucccuggagcggcucggccugcccgggcuggcccucgccgccgcccugcugcuccuggcgcugugccuccugguccgccggacccgccggccgggcgagccgccccugaucaagggguggcuccccuaccugggcguggugcugaaccuccgcaaggacccccugcgguucaugaagacgcugcagaagcagcacggcgacaccuucaccguccuccucgggggcaaguacaucaccuucauccuggaccccuuccaguaccagcucgugaucaagaaccacaagcagcugagcuuccgcguguucuccaacaagcugcucgagaaggccuucagcaucucccagcugcagaagaaccacgacaugaacgacgagcugcaccucugcuaccaguuccugcagggcaagagccuggacauccuccuggaguccaugaugcagaaccugaagcaggucuucgagccccagcuccugaagacgaccagcugggacaccgccgagcuguaccccuucugcuccagcaucaucuucgagaucaccuucacgaccaucuacgggaaggugaucgugugcgacaacaacaaguucaucuccgagcuccgggacgacuuccugaaguucgacgacaaguucgccuaccuggucagcaacaucccgaucgagcuccuggggaacgugaaguccauccgcgagaagaucaucaagugcuucagcuccgagaagcuggcgaagaugcagggcuggagcgagguguuccagucccggcaggacguccucgagaaguacuacgugcacgaggaccuggagaucggcgcccaccaccugggguuccucugggccagcguggccaacaccauccccaccauguucugggccauguacuaccugcugcgccaccccgaggcgauggccgccguccgggacgagaucgaccgccuccugcaguccacgggccagaagaaggggagcggcuuccccauccaccugacccgggagcagcuggacagccucaucugccuggaguccagcaucuucgaggcccugcgccucuccagcuacuccaccaccauccgguucguggaggaggaccugacgcugagcuccgagaccggcgacuacugcgugcgcaagggggaccucgucgccaucuucccgcccgugcugcacggcgaccccgagaucuucgaggcgcccgaggaguuccgguacgaccgcuucaucgaggacgggaagaagaagaccaccuucuucaagcggggcaagaagcugaagugcuaccucaugccguucgggacgggcaccagcaagugccccggccgcuucuucgcccugauggagaucaagcagcugcucgugauccugcugaccuacuucgaccucgagaucaucgacgacaagcccaucgggcugaacuacucccgccugcuguucggcauccaguaccccgacagcgacguccuguuccgguacaaggugaaguccuga

SEQ ID NO: 28961 - RNA, 1506 nt, Artificial Sequence
  derived and/or modified sequence opt1 from CYP8B1__Homo_sapiens__NP_004382
auggugcuguggggccccguccucggggcccugcugguggugaucgccggcuaccucugccugccggggaugcugcgccagcggcgccccugggagccgccccucgacaagggcaccguccccuggcuggggcacgcgauggccuuccggaagaacauguucgaguuccugaagcgcaugcggaccaagcacggcgacguguucacggugcagcucggcgggcaguacuucaccuucgucauggacccccugagcuucggcuccauccugaaggacacccagcgcaagcucgacuucgggcaguacgccaagaagcuggugcugaagguguucggcuaccggagcguccagggggaccacgagaugauccacuccgccagcaccaagcaccuccgcggcgacggccugaaggaccugaacgagacgaugcucgacucccugagcuucgugaugcugaccuccaagggguggagccucgacgccuccugcuggcacgaggacagccuguuccgguucugcuacuacauccuguucaccgcgggcuaccucucccuguucggguacaccaaggacaaggagcaggaccugcuccaggccggcgagcuguucauggaguuccgcaaguucgaccuccuguucccccgguucguguacagccugcuguggccccgcgaguggcucgaggucggccggcugcagcgccuguuccacaagaugcucuccgugagccacucccaggagaaggaggggaucagcaacuggcugggcaacaugcugcaguuccuccgggagcagggggugccguccgccaugcaggacaaguucaacuucaugaugcugugggccagccagggcaacacggggcccaccuccuucugggcgcugcucuaccugcugaagcaccccgaggccauccgcgccguccgggaggaggccacccaggugcucggcgaggcccgccuggagaccaagcagagcuucgcguucaagcugggcgcccuccagcacacgcccgugcuggacagcgucguggaggagacccugcggcugcgcgccgccccgacccuccugcggcuggugcacgaggacuacacccucaagauguccagcgggcaggaguaccuguuccgccacggcgacauccuggcccucuuccccuaccuguccguccacauggaccccgacauccaccccgagccgacgguguucaaguacgaccgcuuccugaaccccaacgggagccggaagguggacuucuucaagaccggcaagaagauccaccacuacaccaugcccuggggguccggcgucagcaucugccccggccgcuucuucgcgcucuccgaggugaagcuguucauccugcucauggucacccacuucgaccuggagcugguggacccggacacgccccucccccacguggacccccagcgguggggguucggcaccaugcagccgagccacgacguccgcuuccgguaccgccugcaccccaccgaguga

SEQ ID NO: 28962 - RNA, 477 nt, Artificial Sequence
  derived and/or modified sequence opt1 from CYS1__Homo_sapiens__NP_001032237
augggcagcggguccagccgcuccagccggacccugcgccggcgccggucccccgagagccucccggccggccccggggccgcggcccuggagggcgggacccgccggcgcgugcccgucgccgccgccgaggugcccggcgcggccgccgaggaggccccgggccgggaccccucccccguggcgcccccggacgggcgcgacgagacgcugcggcuccuggacgagcugcucgccgagagcgccgccuggggcccgcccgagcccgcgccccgccggcccgcccgccugcggcccaccgccgucgccggguccgccgugugcgccgagcagagcaccgagggccaccccggguccggcaacgugagcgaggcgccgggcuccgggcgcaagaagcccgagcggcccgccgccaucagcuacgaccacuccgaggagggccugauggccagcaucgagcgcgaguacugccgguga

SEQ ID NO: 28963 - RNA, 1014 nt, Artificial Sequence
  derived and/or modified sequence opt1 from CYSLTR1__Homo_sapiens__NP_001269117
auggacgagaccggcaaccugaccgugagcuccgccacgugccacgacaccaucgacgacuuccgcaaccaggucuacagcacccucuacuccaugaucagcguggugggguucuucggcaacggguucguccuguacgugcugaucaagaccuaccacaagaaguccgccuuccagguguacaugaucaaccucgcggucgccgaccugcugugcgugugcacgcucccccugcggguggucuacuacgugcacaagggcaucuggcuguucggggacuuccucugccgccugagcaccuacgcccuguacgugaaccucuacugcuccaucuucuucaugaccgccaugagcuucuuccggugcaucgccaucgucuucccggugcagaacaucaaccuggugacccagaagaaggcgcgcuucgucugcgugggcaucuggaucuucgugauccugacguccagccccuuccucauggccaagccccagaaggacgagaagaacaacaccaagugcuucgagcccccgcaggacaaccagaccaagaaccacguccuggugcugcacuacgugucccucuucgucggcuucaucauccccuucgugaucaucaucgugugcuacaccaugaucauccugacgcugcucaagaaguccaugaagaagaaccugagcagccacaagaaggccaucgggaugaucauggucgugaccgccgcguuccuggucuccuucaugcccuaccacauccagcggaccauccaccuccacuuccugcacaacgagaccaagcccugcgacagcgugcugcgcaugcagaaguccguggucaucacgcucagccuggccgccuccaacugcugcuucgacccgcugcucuacuucuucagcggcgggaacuuccggaagcgccugagcaccuuccggaagcacucccugagcuccgugaccuacgugccccgcaagaaggccagccuccccgagaagggcgaggagaucugcaaggucuga

SEQ ID NO: 28964 - RNA, 1197 nt, Artificial Sequence
  derived and/or modified sequence opt1 from CYTH1__Homo_sapiens__NP_004753
auggaggaggacgacagcuacgugcccuccgaccugaccgccgaggagcgccaggagcucgagaacauccggcgccggaagcaggagcugcuggccgacauccagcgccucaaggacgagaucgcggaggucgccaacgagaucgagaaccugggcagcaccgaggagcggaagaacaugcagcgcaacaagcaggucgccauggggcggaagaaguucaacauggacccgaagaagggcauccaguuccugaucgagaacgaccuccugaagaacacgugcgaggacaucgcccaguuccuguacaagggggagggccucaacaagaccgccaucggggacuaccugggcgagcgcgacgaguucaacauccaggugcugcacgcguucguggagcuccacgaguucaccgaccugaaccuggugcaggcccuccggcaguuccugugguccuuccgccugcccggcgaggcccagaagaucgaccggaugauggaggccuucgcgcagcgcuacugccagugcaacaacgggguguuccagagcaccgacacgugcuacguccucuccuucgccaucaucaugcugaacaccagccugcacaaccccaacgugaaggacaagcccaccguggagcgguucaucgccaugaaccgcggcaucaacgacgggggcgaccucccggaggagcugcugcggaaccucuacgaguccaucaagaacgagcccuucaagauccccgaggacgacgggaacgaccugacccacacguucuucaaccccgaccgcgagggcuggcugcucaagcugggcgggggccgggucaagaccuggaagcgccggugguucauccugaccgacaacugccucuacuacuucgaguacaccacggacaaggagccgcgcgggaucaucccccuggagaaccugagcauccgggagguggaggacuccaagaagcccaacugcuucgagcucuacauccccgacaacaaggaccaggugaucaaggccugcaagaccgaggccgacggccgcgucguggagggcaaccacaccguguaccgcaucagcgcgccgacccccgaggagaaggaggaguggaucaagugcaucaaggccgccaucucccgggaccccuucuacgagaugcuggccgcccgcaagaagaaggucagcuccacgaagcggcacuga

SEQ ID NO: 28965 - RNA, 1200 nt, Artificial Sequence
  derived and/or modified sequence opt1 from CYTH3__Homo_sapiens__NP_004218
auggacgaggacggcgggggcgagggcggcggggugcccgaggaccugagccucgaggagcgcgaggagcugcuggacauccggcgccggaagaaggagcucaucgacgacaucgagcgccugaaguacgagaucgccgaggucaugaccgagaucgacaaccugaccuccguggaggagagcaagacgacccagcggaacaagcagaucgccauggggcgcaagaaguucaacauggacccgaagaagggcauccaguuccucaucgagaacgaccugcugcaguccagccccgaggacguggcgcaguuccucuacaagggggagggccugaacaagaccgucaucggggacuaccugggcgagcgggacgaguucaacaucaaggugcuccaggccuucguggagcugcacgaguucgccgaccugaaccucguccaggcccugcgccaguuccugugguccuuccggcuccccggggaggcccagaagaucgaccgcaugauggaggcguucgccagccgguacugccugugcaaccccggcguguuccaguccaccgacacgugcuacgugcugagcuucgccaucaucaugcucaacaccucccugcacaaccacaacguccgcgacaagccgaccgccgagcgguucaucgcgaugaaccgcggcaucaacgagggcggggaccugcccgaggagcuccugcggaaccuguacgagagcaucaagaacgagcccuucaagauccccgaggacgacgggaacgaccucacccacacguucuucaacccggaccgcgagggcuggcugcugaagcucggcgggcgggugaagaccuggaagcgccggugguucauccugaccgacaacugccuguacuacuucgaguacaccacggacaaggagccccgcggcaucaucccccucgagaaccuguccauccgggagguggaggacccccgcaagccgaacugcuucgagcuguacaaccccagccacaaggggcaggucaucaaggccugcaagaccgaggccgacggccgcgugguggaggggaaccacgucguguaccggaucuccgcccccagccccgaggagaaggaggaguggaugaaguccaucaaggccagcaucucccgcgacccguucuacgacaugcucgcgacccggaagcgccggaucgccaacaagaaguga

SEQ ID NO: 28966 - RNA, 1080 nt, Artificial Sequence
  derived and/or modified sequence opt1 from CYTIP__Homo_sapiens__NP_004279
augagccugcagcgccuccugcagcacuccagcaacggcaaccuggccgacuucugcgccgggcccgcguacuccagcuacuccacccucaccggcagccugacgauggacgacaaccggcgcauccagaugcuggccgacaccguggccacccucccgcgggggcgcaagcagcuggcccugacccgguccagcucccucagcgacuucuccuggagccagcgcaagcuggucacgguggagaagcaggacaacgagaccuucggcuucgagauccaguccuaccggccccagaaccagaacgccugcagcuccgagauguucacccugaucugcaagauccaggaggacagccccgcgcacugcgccgggcuccaggccggcgacgugcuggccaacaucaacggcgucuccaccgagggguucacguacaagcaggucguggaccugauccgcagcuccggcaaccuccugaccaucgagacccugaacgggaccaugauccucaagcggacggagcuggaggcgaagcuccaggugcugaagcagacccugaagcagaaguggguggaguaccgcagccugcagcuccaggagcaccggcugcugcacggcgacgccgccaacugccccagccucgagaacauggaccuggacgagcugucccucuucgggccgcugcccggccccggccccgcccugguggaccgcaaccggcucagcuccgagagcuccugcaagagcuggcuguccagcaugaccauggacuccgaggacggguaccagaccugcgucagcgaggacuccagccgcggcgccuucucccggcagacgagcaccgacgacgagugcuucaucccgaaggagggggacgacuuccugcgccgguccagcucccgccggaaccgcagcaucuccaacaccagcagcggcuccaugagcccccucugggagggcaaccuguccagcauguucgggacccugccccggaagucccgcaagggcagcgugcgcaagcagcuccugaaguucauccccgggcugcaccgggcgguggaggaggaggagucccgcuucuga

SEQ ID NO: 28967 - RNA, 411 nt, Artificial Sequence
  derived and/or modified sequence opt1 from CYTL1__Homo_sapiens__NP_061129
augcgcacccccggcccgcugcccgugcuccugcugcuccuggccggggcccccgcggcccggcccaccccgcccacgugcuacagccgcaugcgggcccugucccaggagaucacccgcgacuucaaccuccugcaggucagcgagcccuccgagcccugcgugcgguaccugccgcgccucuaccuggacauccacaacuacugcgugcuggacaagcuccgggacuucgucgccagcccgcccugcuggaagguggcccagguggacucccugaaggacaaggcgcgcaagcuguacaccaucaugaacagcuucugccggcgcgaccucgucuuccugcuggacgacugcaacgcccucgaguaccccauccccgugaccacggugcugcccgaccggcagcgcuga

SEQ ID NO: 28968 - RNA, 789 nt, Artificial Sequence
  derived and/or modified sequence opt1 from CYYR1__Homo_sapiens__NP_443186
augaagugcgagcccggcuggccgcgcacccccgaguggccgcccagcccccggcuguccgccguggggcgcgacaaggagaccugggcccccagcgcggcccggcucggcccccgcgcgccccagcugcgcggggucccgcagucccuggcccgggacgcccccggccccgggagccucggccggcugccccgccaguggccgggccugugcuccacgcggcucagcggggcccugcugucccccagcgaccgcccgcccuccagccccuucccgcccgugcccggcucccccuucgcccccagccuccggccgcccgccuggauggacgcgccccgccugcccgugcggcccgggguccugcuccccaagcuggugcuccuguucguguacgccgacgacugccuggcccagugcggcaaggacugcaaguccuacugcugcgacgggaccaccccguacugcugcagcuacuacgccuacaucggcaacauccuguccggcaccgccaucgccgggaucgucuucggcaucguguucaucaugggggugaucgcgggcaucgccaucugcaucugcaugugcaugaagaaccaccgcgccacgcgggucggcauccuccgcaccacccacaucaacaccgugagcuccuaccccgggcccccgcccuacggccacgaccacgagauggaguacugcgccgaccugcccccgcccuacagccccacgccccaggggcccgcccagcgguccccgcccccgcccuaccccggcaacgcgcgcaaguga

SEQ ID NO: 28969 - RNA, 1164 nt, Artificial Sequence
  derived and/or modified sequence opt1 from D2HGDH__Homo_sapiens__NP_001274178
auggugggcgggagcguccccguguucgacgagaucauccuguccaccgcccgcaugaaccgggugcucagcuuccacuccgucagcggcauccuggugugccaggccgggugcgugcuggaggagcucucccgcuacgucgaggagcgggacuucaucaugccgcuggaccugggcgcgaaggggagcugccacaucggcggcaacguggccaccaacgccgggggccuccgcuuccugcgguacgggucccugcacggcacggugcucgggcuggaggucgugcuggccgacggcaccgugcucgacugccugaccagccugcgcaaggacaacaccggcuacgaccucaagcagcuguucaucggguccgagggcacgcuggggaucaucaccaccgucagcauccucugcccgcccaagccccgggccgugaacguggcguuccugggcugccccggcuucgccgagguccugcagaccuucuccacgugcaaggggaugcucggcgagauccugagcgccuucgaguucauggacgccgugugcaugcagcugguggggcgccaccuccaccuggcgucccccguccaggagagccccuucuacgugcugaucgagaccuccggcagcaacgccgggcacgacgccgagaagcucggccacuuccuggagcacgcccugggcuccgggcucgugaccgacggcaccauggccacggaccagcggaaggucaagaugcugugggcgcugcgcgagcggaucaccgaggcccucagccgcgacggguacguguacaaguacgaccugucccugcccguggagcggcucuacgacaucgucaccgaccugcgcgcccggcugggcccgcacgccaagcacguggucggguacggccaccucggcgacgggaaccugcaccugaacgugaccgccgaggcguucagccccagccuccuggccgcccuggagccccacguguacgaguggacggccggccagcagggguccgucagcgccgagcacggcgugggguuccgcaagcgggacgugcucggcuacuccaagcccccgggcgcgcugcagcugaugcagcagcucaaggcccugcuggaccccaaggggauccugaaccccuacaagacccuccccagccaggccuga

SEQ ID NO: 28970 - RNA, 3207 nt, Artificial Sequence
  derived and/or modified sequence opt1 from DAAM1__Homo_sapiens__NP_001257449
auggcgccccgcaagcggggcgggcgcggcaucagcuucaucuucugcugcuuccggaacaacgaccaccccgagaucaccuaccgccugcggaacgacuccaacuucgcccuccagaccauggagcccgcccugcccaugccgcccguggaggagcuggacgucauguucagcgagcucguggacgagcuggaccugacggacaagcaccgcgaggccauguucgcccuccccgccgagaagaaguggcagaucuacugcuccaagaagaaggaccaggaggagaacaagggggccaccagcuggcccgaguucuacaucgaccagcugaacuccauggcggcccgcaagagccugcucgcccuggagaaggaggaggaggaggagcgcuccaagaccaucgagagccugaagaccgcccuccggacgaagcccaugcgcuucgugacccgguucaucgaccuggacggccuguccugcauccucaacuuccugaagaccauggacuacgagaccagcgagucccgcauccacacgagccugaucgggugcaucaaggcgcucaugaacaacucccagggccgggcccacguccuggcccacagcgaguccaucaacgugaucgcccagagccuguccaccgagaacaucaagaccaagguggccguccucgagauccugggcgcggugugccuggugcccgggggccacaagaagguccuccaggccaugcugcacuaccagaaguacgccagcgagcgcacccgguuccagacgcugaucaacgaccucgacaaguccaccgggcgcuaccgggacgaggugagccugaagaccgccaucaugagcuucaucaacgccgugcugucccagggcgcgggggucgagagccucgacuuccgccugcaccuccgguacgaguuccucaugcugggcauccagcccgugaucgacaagcugcgcgagcacgagaacuccacccucgaccggcaccuggacuucuucgagaugcugcgcaacgaggacgagcucgaguucgccaagcgcuucgagcuggugcacaucgacaccaagagcgccacgcagauguucgagcugacccggaagcggcugacccacuccgaggccuacccccacuucaugagcauccugcaccacugccugcagaugcccuacaagcgguccggcaacacgguccaguacuggcuccugcuggaccgcaucauccagcagaucgugauccagaacgacaaggggcaggaccccgacagcacgccccucgagaacuucaacaucaagaacgugguccggaugcuggugaacgagaacgaggugaagcaguggaaggagcaggccgagaagaugcgcaaggagcacaacgagcugcagcagaagcuggagaagaaggagcgggagugcgacgcgaagacccaggagaaggaggagaugaugcagacccucaacaagaugaaggagaagcuggagaaggagaccaccgagcacaagcaggucaagcagcaggucgccgaccugaccgcccagcuccacgagcugucccgccgggccgugugcgccagcauccccggcgggcccucccccggcgcgcccggcgggcccuuccccagcuccgugcccggcagccugcucccgccgcccccgcccccgccccuccccgggggcaugcugccgccgccgcccccgccccugccgcccgggggcccgcccccgccgcccgggcccccgccccugggcgccaucaugcccccgcccggcgcccccauggggcuggcccucaagaagaaguccaucccccagcccaccaacgcgcucaagagcuucaacugguccaagcugcccgagaacaagcuggagggcacgguguggaccgagaucgacgacaccaaggucuucaagauccuggaccuggaggaccucgagcgcaccuucagcgccuaccagcggcagcagaaggaggccgacgccaucgacgacacgcuguccagcaagcugaaggugaaggagcucagcgugaucgacgggcgccgggcccagaacugcaacauccugcugucccgccucaagcugagcaacgacgagaucaagcgggcgauccugaccauggacgagcaggaggaccuccccaaggacaugcuggagcagcugcucaaguucguccccgagaaguccgacaucgaccugcuggaggagcacaagcacgagcucgaccgcauggccaaggccgaccgguuccuguucgagaugagccgcaucaaccacuaccagcagcggcugcagucccucuacuucaagaagaaguucgccgagcgcguggccgaggugaagcccaaggucgaggcgauccgcagcggcuccgaggagguguuccggagcggcgcccugaagcagcugcucgaggugguccuggccuucgggaacuacaugaacaagggccagcgcgggaacgccuacggcuucaagaucuccagccugaacaagaucgccgacaccaaguccagcaucgacaagaacaucacccuccugcacuaccugaucacgaucguggagaacaaguaccccuccgugcucaaccugaacgaggagcugcgggacaucccccaggcggccaaggucaacaugaccgagcucgacaaggagaucagcacccugcgcuccgggcugaaggccguggagaccgagcucgaguaccagaagucccagccgccccagcccggcgacaaguucgugagcgucgugagccaguucaucaccguggccagcuucuccuucagcgacgucgaggaccugcuggcggaggccaaggaccucuucacgaaggccgugaagcacuucggcgaggaggccgggaagauccagcccgacgaguucuucggcaucuucgaccaguuccugcaggccguguccgaggcgaagcaggagaacgagaacaugcggaagaagaaggaggaggaggagcgccgggcccgcauggaggcccagcugaaggagcagcgggagcgcgagcggaagaugcgcaaggccaaggagaacagcgaggaguccggggaguucgacgaccucgucagcgcccugcgguccggcgagguguucgacaaggaccugagcaagcucaagcgcaaccggaagcgcaucaccaaccagaugaccgacuccagccgggagcgccccaucaccaagcugaacuucuga

SEQ ID NO: 28971 - RNA, 3207 nt, Artificial Sequence
  derived and/or modified sequence opt1 from DAAM2__Homo_sapiens__NP_001188356
auggcgccccgcaagcggagccaccacggccugggguuccucugcugcuucggcggguccgacauccccgagaucaaccugcgcgacaaccacccccugcaguucauggaguucagcucccccauccccaacgccgaggagcucaacauccgguucgccgagcugguggacgagcuggaccucaccgacaagaaccgcgaggccauguucgcccugccgcccgagaagaaguggcagaucuacugcagcaagaagaaggagcaggaggaccccaacaagcuggccaccuccuggcccgacuacuacaucgaccggaucaacagcauggccgcgaugcagucccucuacgccuucgacgaggaggagacggagaugcgcaaccaggucguggaggaccugaagaccgcccugcggacccagcccaugcgcuucgugacccgguucaucgagcucgagggccugacgugccugcucaacuuccugcgcagcauggaccacgcgaccugcgagucccggauccacaccagccugaucgggugcaucaaggcgcucaugaacaacucccagggccgcgcccacguccuggcccagcccgaggccaucagcaccaucgcccagucccugcggacggagaacagcaagaccaagguggcggugcucgagauccugggcgccgucugccuggugcccgggggccacaagaaggugcuccaggccaugcugcacuaccaggucuacgccgccgagcgcacccgguuccagacccugcucaacgagcuggaccgcucccuggggcgguaccgcgacgaggugaaccucaagacggcgaucaugagcuucaucaacgccgugcugaacgccggcgccggggaggacaaccuggaguuccggcuccaccuccgcuacgaguuccugaugcucggcauccagcccgucaucgacaagcugcggcagcacgagaacgccauccuggacaagcaccucgacuucuucgagauggugcgcaacgaggacgaccuggagcuggcgcgccgguucgacauggugcacaucgacaccaaguccgccagccagauguucgagcugauccacaagaagcugaaguacaccgaggccuaccccugccugcucuccguccugcaccacugccugcagaugcccuacaagcgcaacggcggguacuuccagcaguggcagcuccuggaccggauccugcagcagaucgugcugcaggacgagcgcggcguggaccccgaccucgcgccccuggagaacuucaacgucaagaacaucgugaacaugcugaucaacgagaacgaggugaagcaguggcgggaccaggccgagaaguuccgcaaggagcacauggagcucgucagccggcuggagcgcaaggagcgggagugcgagaccaagacgcuggagaaggaggagaugaugcgcacccucaacaagaugaaggacaagcuggcccgggagagccaggagcugcgccaggcccggggccagguggccgagcucguggcccagcuguccgagcugagcaccgggcccgucuccagcccgccgccgcccggcgggccccucacccuguccagcuccaugacgaccaacgaccugccgccgcccccgccgccccuccccuucgccugcugcccgcccccgccgcccccgccccugccgcccggcgggccgcccaccccgcccggcgcgccgcccugccuggggaugggccucccccugccccaggaccccuaccccagcuccgacgugccccugcgcaagaagcgggucccccagcccagccacccccucaaguccuucaacugggugaagcugaacgaggagcgcgugcccggcaccgucuggaacgagaucgacgacaugcaggucuuccggauccuggaccucgaggacuucgagaagauguucagcgccuaccagcgccaccagaaggagcugggguccacggaggacaucuaccuggccagccggaaggugaaggagcucuccgugaucgacggccgccgcgcccagaacugcaucauccugcugagcaagcucaagcuguccaacgaggagauccggcaggccauccugaagauggacgagcaggaggaccucgccaaggacaugcuggagcagcugcucaaguucauccccgagaaguccgacaucgaccugcuggaggagcacaagcacgagaucgagcgcauggcccgggccgaccgcuuccucuacgagaugagccggaucgaccacuaccagcagcgccugcaggcccuguucuucaagaagaaguuccaggagcggcucgcggaggccaagcccaagguggaggccauccugcuggccagccgcgagcucgugcggagcaagcgccugcggcagaugcuggaggucauccucgccaucgggaacuucaugaacaagggccagcgcgggggcgcguacggcuuccggguggccucccugaacaagaucgccgacaccaagagcuccaucgaccgcaacaucagccugcuccacuaccugaucaugauccuggagaagcacuuccccgacauccucaacaugcccuccgagcugcagcaccuccccgaggccgcgaaggugaaccuggccgagcuggagaaggaggucgggaaccugcggcgcggccuccgggccguggagguggagcuggaguaccagcgccggcagguccgcgagcccagcgacaaguucgugcccgugauguccgacuucaucaccgucagcuccuucagcuucuccgagcuggaggaccagcucaacgaggcccgggacaaguucgccaaggcgcugaugcacuucggggagcacgacagcaagaugcagcccgacgaguucuucggcaucuucgacaccuuccugcaggccuucuccgaggcccgccaggaccucgaggccaugcgccggcgcaaggaggaggaggagcggcgcgcccggauggaggcgaugcugaaggagcagcgcgagcgggagcgcuggcagcggcagcgcaaggugcuggccgccgggagcucccucgaggagggcggcgaguucgacgaccuggugagcgcccugcgguccggggaggucuucgacaaggaccucugcaagcugaagcgcagccggaagcgcagcggcucccaggcccuggaggugacgcgggagcgcgcgaucaaccggcucaacuacuga

SEQ ID NO: 28972 - RNA, 2250 nt, Artificial Sequence
  derived and/or modified sequence opt1 from DAB2__Homo_sapiens__NP_001231800
augagcaacgagguggagaccuccgccaccaacggccagcccgaccagcaggccgcgccgaaggcccccagcaagaaggagaagaagaaggggcccgagaagacggacgaguaccugcucgcccgcuucaagggcgacggggucaaguacaaggccaagcugaucggcaucgacgacgugcccgacgcccggggggacaagaugucccaggacagcaugaugaagcugaagggcauggcggccgccggccgcucccaggggcagcacaagcagcggaucugggugaacaucagccucuccggcaucaagaucaucgacgagaagaccggggucaucgagcacgagcacccggugaacaagaucagcuucaucgcccgcgacgugaccgacaaccgggcguucggcuacgucugcgggggcgagggccagcaccaguucuucgccaucaagaccgggcagcaggccgagccccuggugguggaccugaaggaccucuuccaggucaucuacaacgugaagaagaaggaggaggagaagaagaagaucgaggaggccuccaaggccguggagaacggcagcgaggcgcugaugauccuggacgaccagacgaacaagcucaaguccgagagcaaggacauccugcuggucgaccucaacuccgagaucgacaccaaccagaacagccugcgcgagaaccccuuccugaccaacgggaucaccuccugcagccucccccggccgacgccccaggccuccuuccugcccgagaacgccuucagcgccaaccugaacuucuuccccaccccgaaccccgaccccuuccgcgacgaccccuucacccagccggaccaguccacccccagcagcuucgacucccucaagagccccgaccagaagaaggagaacuccagcuccagcuccacgccccugagcaacggcccgcugaacggcgacguggacuacuucgggcagcaguucgaccagaucuccaaccggaccggcaagcaggaggcccaggcggggcccuggcccuucagcuccagccagacccagcccgccgugcgcacccagaacggcgucuccgagcgggagcagaacggguucagcgugaaguccagcccgaaccccuucgugggcuccccccccaagggccucagcauccagaacggggucaagcaggaccuggaguccagcgugcagagcuccccgcacgacagcaucgccaucaucccccccccgcaguccacgaagcccggccgcgggcggcgcaccgccaagagcuccgccaacgaccugcucgcgagcgacaucuucgccccccccguguccgagccgagcggccaggccucccccaccgggcagcccaccgcccugcagcccaacccgcuggaccucuucaagacgagcgcccccgcgcccgucggcccccuggugggccuggggggcgugaccgucacccucccgcaggccgggcccuggaacaccgccucccugguguucaaccagagccccuccauggcccccggcgcgaugauggggggccagccgagcggcuucucccagcccgucaucuucgggacgagccccgccguguccggcuggaaccagcccagcccguucgccgccagcacccccccccccgugccggucgugugggggcccuccgccagcguggcgcccaacgccugguccaccaccagcccgcugggcaaccccuuccaguccaacaucuuccccgcccccgccgucagcacgcagccgcccuccaugcacagcucccuccuggugacccccccccagccgcccccccgggccggccccccgaaggacaucagcuccgacgcguucaccgcccuggacccccucggggacaaggagaucaaggacgugaaggagauguucaaggacuuccagcugcgccagccccccgccgucccggcccggaagggcgagcagaccagcuccgggacgcugagcgccuucgcguccuacuucaacagcaaggugggcaucccccaggagaacgccgaccacgacgacuucgacgccaaccagcuccugaacaagaucaacgagccccccaagccggccccccgccaggugucccugcccgucaccaagagcaccgacaacgcguucgagaaccccuucuucaaggacuccuucgggagcagccaggccuccguggccagcucccagccggugagcuccgagauguaccgggaccccuucggcaaccccuucgccuga

SEQ ID NO: 28973 - RNA, 3399 nt, Artificial Sequence
  derived and/or modified sequence opt1 from DAB2IP__Homo_sapiens__NP_115941
auggagcccgacagccugcucgaccaggacgacuccuacgagagcccgcaggagcgccccggcucccggcgcagccugcccgggucccugagcgagaagucccccagcauggagccguccgccgccacccccuuccgggugaccggcuuccucagccgccggcugaagggguccaucaagcgcacgaagagccagcccaagcuggaccggaaccacuccuuccgccacauccuccccggcuuccggagcgcggccgccgccgccgcggacaacgagcgcucccaccugaugccgcggcugaaggagagccgcucccacgagagccuccugucccccagcagcgccgucgaggcccuggaccucuccauggaggaggagguggugaucaagcccguccacagcuccauccuggggcaggacuacugcuucgaggugaccaccagcuccggcagcaagugcuucuccugccggagcgccgcggagcgcgacaaguggauggagaaccugcggcgcgccgugcaccccaacaaggacaacucccggcgcgucgagcacauccucaagcugugggugaucgaggccaaggaccugccggccaagaagaaguaccucugcgagcugugccuggacgacgugcucuacgcccggaccacgggcaagcugaagaccgacaacgucuucuggggggagcacuucgaguuccacaaccugcccccccuccgcaccgugaccgugcaccuguaccgggagacggacaagaagaagaagaaggagcgcaacagcuaccugggccucgucucccugcccgcggccagcguggccgggcgccaguucguggagaagugguacccggucgugacccccaaccccaagggcgggaagggccccggcccgaugauccggaucaaggcccgcuaccagaccaucaccauccugcccauggagauguacaaggaguucgccgagcacaucacgaaccacuaccucgggcugugcgcggcccuggagcccauccucuccgccaagaccaaggaggagauggccagcgcccuggugcacauccugcaguccaccggcaaggucaaggacuuccucaccgaccugaugaugagcgagguggaccggugcggggacaacgagcaccugaucuuccgcgagaacacgcucgcgaccaaggccaucgaggaguaccugaagcuggugggccagaaguaccuccaggacgcccugggcgaguucaucaaggcccuguacgaguccgacgagaacugcgaggucgaccccagcaagugcuccgccgcggaccucccggagcaccaggggaaccugaagaugugcugcgagcuggccuucugcaagaucaucaacagcuacugcguguucccccgggagcucaaggagguguucgccagcuggcgccaggagugcuccagccggggccgccccgacaucuccgagcggcugaucagcgccucccuguuccugcgcuuccucugccccgcgaucaugagcccgucccuguucaaccugcuccaggaguaccccgacgaccggaccgcccgcacccugacgcugaucgccaaggucacccagaaccucgccaacuucgccaaguucgggagcaaggaggaguacauguccuucaugaaccaguuccuggagcacgaguggaccaacaugcagcgguuccugcucgagaucagcaaccccgagacccuguccaacacggcgggcuucgagggguacaucgaccugggccgcgagcucagcucccugcacagccugcucugggaggccgugucccagcuggagcagagcaucgucuccaagcugggcccgcucccccggauccugcgcgacgugcacaccgcccugagcacccccgggagcggccagcuccccgggaccaacgaccuggccuccacgccgggcagcggguccagcuccaucagcgccggccugcagaagauggugaucgagaacgaccucuccggccugaucgacuucacccggcugcccagccccacccccgagaacaaggaccucuucuucgucacccgcuccagcggggugcagccgucccccgcgcggagcuccagcuacuccgaggccaacgagcccgaccugcagauggccaacggcgggaagagccuguccaugguggaccuccaggacgcccgcacgcuggacggcgaggccgggagccccgcgggcccggacguccugcccaccgacggccaggccgccgccgcgcagcucguggccggguggcccgcccgcgccacccccgugaaccuggccggccuggcgaccguccggcgcgccgggcagacgccgaccacccccggcaccuccgagggcgcccccgggcggccccagcuccuggccccgcugagcuuccagaaccccguguaccagauggccgcgggccucccccugagcccccgcgggcugggcgacuccgggagcgagggccacuccagccucuccagccacuccaacagcgaggagcuggccgccgccgccaagcugggcuccuucagcaccgcggccgaggagcucgcccggcgcccgggggagcuggcccggcgccagaugucccugacggagaagggcgggcagcccaccgugccccggcagaacagcgcgggcccgcagcgccggaucgaccagcccccccccccgcccccccccccgccccccgccccccgcgggcggaccccgcccaaccuccuguccacccugcaguacccccgccccagcuccggcacgcucgccagcgccuccccggacugggucggccccagcacccggcugcgccagcaguccagcagcuccaagggggacagccccgagcugaagccccgggccgugcacaagcagggcccgucccccgugagccccaacgcgcucgaccgcaccgccgccuggcugcugaccaugaacgcccagcuccuggaggacgaggggcugggccccgacccgccccaccgggaccgccuccgguccaaggacgagcugagccaggccgagaaggaccuggcgguccuccaggacaagcugcgcaucuccacgaagaagcuggaggaguacgagacccucuucaagugccaggaggagaccacccagaagcuggugcuggaguaccaggcccgccucgaggagggggaggagcggcugcgccggcagcaggaggacaaggacauccagaugaagggcaucaucagccgccugauguccguggaggaggagcucaagaaggaccacgccgagaugcaggccgccgucgacagcaagcagaagaucaucgacgcgcaggagaagcggaucgccucccuggacgccgccaacgcccgccugaugagcgcgcucacgcagcugaaggaguccaugcacuga

SEQ ID NO: 28974 - RNA, 1515 nt, Artificial Sequence
  derived and/or modified sequence opt1 from DACH1__Homo_sapiens__NP_004383
auggccgugcccgccgcgcugaucccgcccacccagcucgucccgccccagccgcccaucagcaccuccgccagcuccagcggcacgaccaccuccaccagcuccgccacgagcucccccgcccccagcaucgggccgcccgccuccagcggccccacccuguuccgccccgagccgaucgcguccgccgccgccgcggccgccaccgugaccagcaccgggggcgggggcggcgggggcggguccggcgggggcggcgggagcuccggcaacgggggcggcgggggcgggggcgggggcggcagcaacugcaaccccaaccuggccgccgcguccaacgggagcggcgggggcgggggcggcaucagcgccgggggcgggguggccuccagcacccccaucaacgccuccaccggcagcuccagcuccagcuccagcuccagcuccagcuccagcuccagcuccagcagcuccagcuccagcuccagcugcgggccccucccgggcaagcccgucuacuccacccccagccccguggagaacacgccccagaacaacgagugcaagaugguggaccugcggggcgccaaggucgcguccuucaccguggaggggugcgagcugaucugccucccccaggccuucgaccuguuccugaagcaccucgugggcgggcugcacaccgucuacaccaagcugaagcgccucgagaucacgcccguggugugcaacgucgagcagguccggauccugcgcggccugggcgccauccagcccggggugaaccggugcaagcucaucagccgcaaggacuucgagacccuguacaacgacugcaccaacgccuccagccggccgggccgcccgcccaagcggacccaguccgugacgagccccgagaacucccacaucaugccccacagcgugcccgggcugaugucccccggcaucaucccgcccaccgacgagacgccccucagcacccccacggcccgcgacagccuggacaagcugucccucaccgggcacggccagccgcugccgcccggcuuccccagccccuuccuguuccccgacgggcucuccagcaucgagacccugcugaccaacauccagggccuccugaagguggcgaucgacaacgcccgggcccaggagaagcagguccagcuggagaagacggagcucaagauggacuuccugcgcgagcgggagcugcgcgagacccucgagaagcagcuggccauggagcagaagaaccgggccaucgugcagaagcgccugaagaaggagaagaaggcgaagcggaagcuccaggaggcccuggaguucgagaccaagcgccgggagcaggccgagcagacccugaagcaggccgcguccacggacagccuccgcgugcugaacgacucccugacccccgagaucgaggccgaccggagcgggggccgcaccgacgccgagcgcaccauccaggacgggcggcucuaccugaagacgaccgucauguacuga

SEQ ID NO: 28975 - RNA, 1716 nt, Artificial Sequence
  derived and/or modified sequence opt1 from DACH2__Homo_sapiens__NP_001132986
auggccgugagcgccucccccgugaucagcgcgaccuccagcggcgccggggugccgggcgggcuguuccgcgccgagccccucuacuccacgccccgggagcccccgcgccugacgcccaacaugaucaacagcuucguggucaacaaccacuccaacagcgccggcgggggcggccgggggaacaccaacaccaacgagugccgcaugguggacaugcacggcaugaagguggccuccuuccugauggacgggcaggagcucaucugccugccccaggucuucgaccuguuccucaagcaccuggugggcgggcugcacaccguguacacgaagcucaagcggcuggacaucagccccgucgugugcaccguggagcagguccgcauccugcggggccucggcgcgauccagccgggggugaaccgcugcaagcugaucacccggaaggacuucgagacccuguucacggacugcaccaacgccuccagccgccccggccggccgcccaagcgcucccucggggugcugcaggagaacgcccggcugcucacccacgccguccccggccugcugagccccggccucaucacccccacggggaucaccgcggccgccauggccgaggccaugaagcugcagaagaugaagcugauggcgaugaacacccuccagggcaacgggucccagaacggcaccgagagcgagcccgacgaccugaacuccaacaccgggggcagcgaguccagcugggacaaggacaagaugcagagcccguucgccgcccccggcccccagcacgggaucgcccacgccgcgcuggccggccagcccgggaucggcggggccccgacccucaacccccugcagcagaaccaccuccugaccaaccgccuggaccugcccuucaugaugaugccccacccgcuccugcccgugucccugccgcccgccagcguggccauggcgaugaaccagaugaaccaccucaacaccaucgccaacauggccgccgccgcgcagauccacagcccccugucccgggccggcacguccgucaucaaggagcgcauccccgagagccccuccccggcccccagccuggaggagaaccaccggcccggcucccagaccagcucccacaccagcuccagcguguccagcucccccagccagauggaccaccaccucgagcgcauggaggaggugccgguccagauccccaucaugaaguccccgcuggacaagauccagcugacccccgggcaggcccuccccgcgggcuuccccgggcccuucaucuucgccgacagccugagcuccguggagacgcugcucaccaacauccagggccugcugaagguggcccucgacaacgcccggauccaggagaagcagauccagcaggagaagaaggagcugcgccuggagcuguaccgggagcgcgagauccgcgagaaccucgagcggcagcuggccgucgagcugcagagccgcaccaccaugcagaagcggcucaagaaggagaagaagacgaagcgcaagcugcaggaggcgcuggaguucgaguccaagcggcgcgagcaggucgagcaggcccucaagcaggccaccaccagcgacuccgggcugcggaugcugaaggacaccggcauccccgacaucgagaucgagaacaacggcacgccgcacgacagcgccgccaugcaggcguga

SEQ ID NO: 28976 - RNA, 2400 nt, Artificial Sequence
  derived and/or modified sequence opt1 from DACT1__Homo_sapiens__NP_001072988
augaagcccagcccggccggcaccgccaaggagcuggagccgcccgcgcccgcccgcggggagcagcggaccgccgagcccgagggccgcuggcgggagaagggggaggccgacacggagcgccagcggacccgcgagcggcaggaggccacccucgcgggccuggccgagcuggaguaccuccgccagcggcaggagcugcuggugcgcggggcccuccggggcgccggcggggcgggcgccgccgcgccccgcgccggggagcugcugggcgaggccgcccagcggucccgccucgaggagaaguuccuggaggagaacauccugcuccugcggaagcagcugaacugccuccgccggcgcgacgccgggcugcugaaccagcuccaggagcuggacaagcagaucagcgaccugcggcucgacgucgagaagaccuccgaggagcaccuggagacggacagccgccccuccagcggcuucuacgagcuguccgacggcgccagcgggucccucagcaacuccagcaacuccguguucagcgagugccuguccagcugccacuccagcacgugcuucugcagcccccuggaggccacccucucccugagcgacggcugcccgaaguccgcggacgugaaccccaaguaccagugcgaccuggucagcaagaacgggaacgacguguaccgguaccccagcccccuccacgccguggccguccaguccccgauguuccugcugugccucaccggcaacccccugcgcgaggaggaccgccugggcaaccacgccuccgacaucugcgggggcagcgagcucgacgccgugaagaccgacuccagccugcccucccccagcucccuguggagcgcgucccacccgagcuccagcaagaagauggacggguacauccucucccuggugcagaagaagacccaccccguccggaccaacaagccccgcaccagcgugaacgccgaccccacgaagggccugcuccggaacggguccgugugcguccgcgccccgggcggcgugagccaggggaacagcgugaaccugaagaacuccaagcaggccugccugcccagcggcgggauccccucccucaacaacggcaccuucagcccgcccaagcagugguccaaggagagcaaggccgagcaggcggaguccaagcgggucccccugcccgaggggugccccagcggcgccgccuccgaccugcagagcaagcaccucccgaagaccgccaagcccgcgucccaggagcacgcccgcugcagcgccaucggcaccggggagucccccaaggagagcgcccagcuguccggcgccagcccgaaggagucccccagccgggggcccgcgcccccgcaggagaacaagguggugcagccccugaagaagaugagccagaagaacucccugcagggcgucccgcccgccacgccgccccuccugagcaccgccuuccccguggaggagcgccccgcccuggacuucaaguccgaggggagcucccagagccucgaggaggcccaccuggugaaggcgcaguucauccccggccagcagcccuccguccggcugcaccgcggccaccggaacauggggguggugaagaacagcucccucaagcaccgcggccccgcccugcaggggcuggagaacggccuccccaccguccgggagaagacccgcgccggcagcaagaagugccgguucccggacgaccuggacacgaacaagaagcugaagaaggccuccagcaaggggcgcaaguccggcgggggccccgaggccggggugcccggccggcccgcgggcgggggccaccgcgccgggagccgggcccacggccacgggcgcgaggccgucguggcgaagccgaagcacaagcgcaccgacuaccggcgcuggaaguccagcgccgagaucuccuacgaggaggcccuccggcgcgcccggcgcggccggcgcgagaacgugggccuguaccccgcccccgucccccugccguacgcgagccccuacgccuacguggccuccgacagcgaguacagcgccgagugcgagucccucuuccacagcaccguggucgacaccuccgaggacgagcagagcaacuacacgaccaacugcuucggggacuccgagagcuccgugagcgagggcgaguucgugggggaguccaccaccacgagcgacuccgaggagagcggcgggcugaucuggucccaguucguccagacccugcccauccagaccgugaccgccccggaccuccacaaccaccccgcgaagacguucgugaagaucaaggccagccacaaccugaagaagaagauccugcgguuccgcuccggcagccucaagcugaugaccaccgucuga

SEQ ID NO: 28977 - RNA, 843 nt, Artificial Sequence
  derived and/or modified sequence opt1 from DACT2__Homo_sapiens__NP_001273280
auguggacccccggcgggccgcccggcagcgccgggugggaccgccggcgccugggcgcccggcuccgcgcggccuucgccgggcugcaggagcugcagggccuccgggccacccagcaggagcgcgugcggggcgcccuggcgcugcagcccccgcccgcccccgccgcccccugcgggccccacggccuccacgggccggagcagcagcuggaggcggcccuggccgcccuccaggagcagcugucccgccugcggcagcaggacaucggccucaagacgcaccuggaccagcuggaccuccagaucagcaagcugcagcuggacgucgggaccgccuccggcgaggcgcucgacagcgacucccgccccagcuccggcuucuacgagaugagcgacgggggcuccugcagccuguccaccagcugcgccuccgugugcagcgaccacaucucccccagccuggggucccuccugcccguggcccaggcccacaaggcccggccgagcaugggcgacuggcgcccccgguccgucgacgagaccacggugcccgcguggcgcccccaggccaccgaggagggcgcccggccgcccgggagcguggaggacgccggccagcccugggggaccuucuggccccgcccggucagcaccgagcugugcaacgcccccggcgagcucgacaugcacgcgccgcccgccgggugcacguccagcucccugaccggcgugggcagcgggcugcggggcaagugcgggcucugcggcugccagcugcccuucugcuccgugaacaccagcuccaagaccaagagcuccgggaucagccgccagcaguga

SEQ ID NO: 28978 - RNA, 1890 nt, Artificial Sequence
  derived and/or modified sequence opt1 from DACT3__Homo_sapiens__NP_659493
augauccgcgccuucagcuuccccguguccccggagcggggccgccugcggggguggcucgagggcagccuggccgggcugugcgagcuccacuggcugcgcgagcggcaggaguaccgcguccagcaggcgcugcggcucgcccagcccggcauggggggcgccgaggccgaggacgaggaggacgccgacgaggacgaggacgcggccgccgcccgccgggcggccgccgcccuggaggagcagcuggaggcccuccccggccuggugugggaccuggggcagcagcucggcgaccugucccuggagagcgggggccucgagcaggaguccgggcgcagcuccggcuucuacgaggaccccagcuccaccggcgggccggacagcccccccuccaccuucugcggcgacagcggguucuccggcagcuccagcuacggccggcuggggcccuccgagccgcgcggcaucuacgcgagcgagcggcccaagucccugggggacgccagccccagcgcccccgagguggucggcgcccgcgccgcggugccgcgguccuucagcgcccccuaccccacggccgggggcuccgccggccccgaggccugcagcuccgcggagcgccgggcccgcgccgggccguuccucacccccagcccccugcacgccguggccaugcgguccccccgcccgugcggccggccccccaccgacagccccgacgcggggggcgccgggcgcccgcuggacggcuacaucuccgcccuccugcgccggcgccggcgccggggcgccgggcagccccgcaccagccccggcggggcggacggcgggccccggcgccagaacuccguccggcagcgcccgcccgacgccagccccuccccgggcagcgcccggcccgcccgcgagcccucccuggagcgggugggcgggcaccccacgagcccggccgcgcucucccgcgccugggccagcuccugggagagcgaggccgcccccgagcccgcggcccccccggccgcccccagcccccccgacuccccggccgagggccggcuggugaaggcgcaguacauccccggggcccaggccgccacccgcggccugcccggccgggcggcccgccggaagcccccgccccucacccgcgggcgcagcgucgagcagucccccccccgggagcgcccgcgggccgccggccgccgggggcgcauggccgaggcgagcggccggcgcggguccccccgggcccgcaaggccagccggucccagagcgagaccucccugcugggccgcgccagcgccgugcccuccggccccccgaaguaccccacggcggagcgggaggagccccgcccgccccggccccgccgggggcccgccccgacccucgccgcccaggccgcgggcagcugccgccgguggcgcuccaccgccgagaucgacgccgccgacgggcggcgcgugcgcccccgggcgcccgccgcccgcguccccggcccggggcccagccccuccgccccccagcggcgccugcuguacggcugcgccggcagcgacuccgagugcagcgcggggcggcucggcccgcuggggcgccggggccccgccgggggcgugggcgggggcuacggggagagcgaguccagcgccuccgagggcgagagccccgccuucuccagcgccuccagcgacuccgacgggagcggcggccugguguggccccagcagcucgucgcggccaccgccgccuccgggggcggggccggcgcgggcgccccggccgggcccgccaagguguucgugaagaucaaggccagccacgcgcugaagaagaagauccugcgcuuccgguccggcagccucaaggucaugacgaccguguga

SEQ ID NO: 28979 - RNA, 342 nt, Artificial Sequence
  derived and/or modified sequence opt1 from DAD1__Homo_sapiens__NP_001335
augagcgccuccguggucagcgugaucucccgcuuccuggaggaguaccucagcuccacgccccagcggcugaagcugcucgacgccuaccugcuguacauccuccugaccggcgcgcugcaguucggguacugccuccuggugggcaccuucccguucaacagcuuccuguccggguucaucagcugcgucggcuccuucauccucgccgugugccugcgcauccagaucaacccccagaacaaggccgacuuccaggggaucagccccgagcgggccuucgccgacuuccuguucgcguccaccauccuccaccugguggucaugaacuucgugggcuga

SEQ ID NO: 28980 - RNA, 2688 nt, Artificial Sequence
  derived and/or modified sequence opt1 from DAG1__Homo_sapiens__NP_001171113
augcgcaugagcgugggccugucccuccugcugccccucugggggcggaccuuccugcugcuccugagcgucgugauggcccagucccacuggccgagcgagcccuccgaggccgugcgcgacugggagaaccagcuggaggcgagcaugcacuccguccucagcgaccugcacgaggccgugcccaccguggucggcauccccgacgggacggccguggugggccgguccuuccgcgucaccaucccgaccgaccugaucgccagcuccggggacaucaucaaggugagcgccgcgggcaaggaggcccuccccuccuggcugcacugggacagccagucccacacccuggagggccucccccuggacacggacaagggggugcacuacaucagcgucuccgccacccggcugggcgccaacgggagccacaucccccagaccuccagcguguucagcaucgagguguacccggaggaccacuccgagcuccagagcguccgcaccgcgucccccgaccccggcgagguggugagcuccgccugcgccgccgacgagcccgucacggugcugaccgugauccuggacgccgaccucaccaagaugaccccgaagcagcggaucgaccugcugcaccgcaugcggagcuucuccgaggucgagcuccacaacaugaagcuggugcccguggucaacaaccgccuguucgacaugagcgcguucauggccgggcccggcaacgccaagaagguggucgagaacggcgcccuccuguccuggaagcuggggugcagccucaaccagaacuccgugcccgacauccacggcguggaggccccggcgcgggagggggccaugagcgcccagcugggcuaccccgucgugggcuggcacaucgccaacaagaagcccccccugccgaagcgcgugcggcgccagauccacgccacgcccacccccgucaccgcgaucgggcccccgaccacggccauccaggagccccccucccggaucgugcccaccccgaccagccccgccaucgcccccccgaccgagacgauggccccccccgugcgcgaccccgucccgggcaagcccaccgugaccauccggacccgcggggcgaucauccagacgcccacccucggccccauccagccgacccggguguccgaggccgggaccacgguccccggccagauccgccccaccaugaccauccccggcuacguggagccgaccgccguggccacgccccccaccaccaccacgaagaagccccgggucagcaccccgaagcccgcgacccccuccaccgacagcaccacgaccaccacccgccgccccacgaagaagccgcggaccccccgccccgugccccgggugaccaccaaggucuccaucacgcgccuggagaccgccagcccgcccacccggauccgcaccacgaccagcggggugccccggggcggggagccgaaccagcgccccgagcugaagaaccacaucgaccggguggacgccugggucggcaccuacuucgaggugaagauccccuccgacaccuucuacgaccacgaggacacgaccaccgacaagcucaagcugacccugaagcuccgcgagcagcagcuggugggggagaagagcuggguccaguucaacuccaacagccagcugauguacggccuccccgacuccagccacgugggcaagcacgaguacuucaugcacgccacggacaaggggggccuguccgccguggacgcguucgagauccacguccaccggcgcccgcagggggaccgggcccccgcccgcuucaaggccaaguucgugggcgaccccgcccuggugcucaacgacauccacaagaagaucgcgcuggucaagaagcuggccuucgccuucggggaccggaacugcagcaccaucacccuccagaacaucacccgcggcuccaucgugguggaguggacgaacaacacccugccccuggagccgugccccaaggagcagaucgccggccugagccggcgcaucgccgaggacgacgggaagccccggcccgcguucuccaacgcccucgagccggacuucaaggccaccagcaucaccgucacgggcuccgggagcugccgccaccugcaguucauccccguggugcccccccgccgggucccguccgaggccccccccaccgaggugcccgaccgcgacccggagaagagcuccgaggacgacguguaccugcacaccgucauccccgcggugguggucgccgccauccuccugaucgccggcaucaucgccaugaucugcuaccggaagaagcgcaagggcaagcugacccucgaggaccaggcgacguucaucaagaagggggugcccaucaucuucgccgacgagcuggacgacagcaagcccccgcccagcuccagcaugccccugauccuccaggaggagaaggccccccugccgccccccgaguacccgaaccaguccgugcccgagaccaccccccugaaccaggacaccaugggcgaguacacgccccuccgggacgaggacccgaacgccccccccuaccagcccccgccccccuucaccgcccccauggaggggaagggcagccgcccgaagaacaugacccccuaccgguccccccccccguacgucccccccuga

SEQ ID NO: 28981 - RNA, 570 nt, Artificial Sequence
  derived and/or modified sequence opt1 from DAND5__Homo_sapiens__NP_689867
augcugcucggccagcugagcacccugcucugccugcuguccggggcccuccccaccggcagcgggcgcccggagccccagagcccccggccccaguccugggccgcggccaaccagacgugggcccugggcccgggggcccugccgccccucgugcccgccuccgcgcugggcagcuggaaggccuuccugggccuccagaaggcccgccagcuggggaugggccggcugcagcgcgggcaggacgaggucgccgcggugacccucccccugaacccccaggaggugauccagggcaugugcaaggccguccccuucguccagguguucucccggcccgggugcagcgccauccgccugcggaaccaccucugcuucggccacugcuccagccuguacaucccgggcuccgaccccacgccccuggugcucugcaacagcugcaugcccgcccgcaagcggugggccccgguggugcuguggugccugaccggguccagcgcgucccgccggcgcgucaagaucagcaccaugcucaucgagggcugccacugcucccccaaggccuga

SEQ ID NO: 28982 - RNA, 378 nt, Artificial Sequence
  derived and/or modified sequence opt1 from DAOA__Homo_sapiens__NP_001155284
augcgcaccgccaucuggaaguggcaccggggcaucuaccgcgaccacuacgugcuggggagccucaccuuccugucccccaugcagcgggccggcacgagcaaccaguggaacauggggaaggucaugacccuggacuccggcgacgaggugaccuuccacaagaccuggccgacggagaccgggagccccuaccgccucgaggagguguccagccacgucggcaagguguucauggcgcggaacuacgaguuccuggccuacgaggccuccaaggaccgccggcagccccuggagcgcauguggaccugcaacuacaaccagcagaaggaccagagcugcaaccacaaggagaucaccuccacgaaggccgaguga

SEQ ID NO: 28983 - RNA, 1044 nt, Artificial Sequence
  derived and/or modified sequence opt1 from DAO__Homo_sapiens__XP_011536307
augcgcguggucgugaucggcgccggggugaucggccugagcaccgcccucugcauccacgagcgguaccacuccguccugcagccccuggacaucaagguguacgcggaccgcuucaccccgcucacgaccaccgacguggccgccgggcuguggcagcccuaccugagcgaccccaacaacccccaggaggccgacuggucccagcagaccuucgacuaccuccugagccacguccacuccccgaacgccgagaaccugggccucuuccugaucagcggguacaaccuguuccacgaggcgauccccgaccccuccuggaaggacacggugcucggcuuccggaagcugacgccccgcgagcuggacauguucccggacuacggcuacgggugguuccacaccagccucauccuggagggcaagaacuaccugcaguggcucaccgagcggcugaccgagcgcggggugaaguucuuccagcggaaggucgaguccuucgaggagguggcccgcgagggcgccgacgugaucgucaacugcaccggggugugggccggcgcgcugcagcgggacccccuccugcagcccggccgcgggcagaucaugaagguggacgcccccuggaugaagcacuucauccugacccacgacccggagcggggcaucuacaacagccccuacaucauccccgggacccagacggucacccucggcggcaucuuccagcuggggaacugguccgagcugaacaacauccaggaccacaacaccaucugggagggcugcugccgccucgagcccacccugaagaacgcccggaucaucggggagcgcacgggcuuccggccggugcgcccccagauccggcuggagcgcgagcagcuccggaccgggcccagcaacaccgaggugauccacaacuacggccacggcggguacggccugaccauccacugggggugcgcccuggaggccgcgaagcuguucggccgcauccucgaggagaagaagcugucccggaugcccccgagccaccucuga

SEQ ID NO: 28984 - RNA, 1197 nt, Artificial Sequence
  derived and/or modified sequence opt1 from DAP3__Homo_sapiens__NP_001186778
augaugcugaagggcaucacccgccucaucagccggauccacaagcuggaccccgggcgcuuccugcacaugggcacccaggcccggcaguccaucgccgcgcaccucgacaaccaggugccggucgagagcccccgcgccaucucccggacgaacgagaacgaccccgccaagcacggggaccagcacgagggccagcacuacaacaucagcccccaggaccuggagaccguguucccgcacgggcugccgccccgcuucgugaugcaggucaagaccuucuccgaggccugccucauggugcggaagcccgcccuggagcugcuccacuaccugaagaacaccagcuucgcguaccccgccauccgcuaccugcucuacggcgagaagggcacggggaagacccugucccugugccacgugauccacuucugcgccaagcaggacuggcucauccugcacauccccgacgcccaccugugggucaagaacugccgggaccuccugcagagcuccuacaacaagcagcgcuucgaccagccccuggaggcgagcaccuggcucaagaacuucaagaccacgaacgagcgguuccugaaccagaucaaggugcaggagaaguacguguggaacaagcgcgaguccaccgagaagggcagcccccugggggaggucguggagcagggcaucacccgggugcgcaacgccaccgacgccgucgggaucgugcucaaggagcugaagcggcaguccagccugggcauguuccaccuccugguggccgucgacggcaucaacgcccugugggggcgcacgacccucaagcgggaggacaaguccccgaucgcgcccgaggagcuggcccuggugcacaaccuccgcaagaugaugaagaacgacuggcacggcggggccaucgugagcgcccugucccagaccggcagccuguucaagccccggaaggccuaccucccccaggagcugcugggcaaggagggguucgacgcgcucgacccguucauccccauccuggucuccaacuacaaccccaaggaguucgagagcugcauccaguacuaccuggagaacaacuggcuccagcacgagaaggcccccaccgaggagggcaagaaggagcugcuguuccucagcaacgccaacccgucccugcuggagcgccacugcgccuaccucuga

SEQ ID NO: 28985 - RNA, 615 nt, Artificial Sequence
  derived and/or modified sequence opt1 from DAP__Homo_sapiens__NP_001278892
augagcuccccgcccgagggcaagcuggagaccaaggccgggcacccgcccgccgugaaggcgggcgggaugcgcaucguccagaagcacccccacaccggcgacacgaaggaggagaaggacaaggacgaccaggagugggagagcccccgggugaccaagaucagcccccgccggcuccgccgguggcugacccgcucccggaugccgcccuggaccuccauccugccccaggagcccagcacguccagcucccacgccagcgagcccggggugcaccagcccgccccguggccccgccucugcugcaccugguacuuccccgaccgggagaaccagcaguuccgccccaacccgacccugcugggcaaccuccggcagaaccagguccugugcccccugcccuacaucuccaucuucaagacccgcaacagcuccagccccaaccucguguacggcgaguccggguggaugagcuucgaggaccacugcgccccgcggggcgccaucucccgcaucugccaggacccccggaagauccuggcgcugguccucuuccagcagagccccgacgugcugguguacgggcugaagaacaagaaggcccacaucuga

SEQ ID NO: 28986 - RNA, 4293 nt, Artificial Sequence
  derived and/or modified sequence opt1 from DAPK1__Homo_sapiens__NP_004929
augaccguguuccgccaggagaacgucgacgacuacuacgacaccggcgaggagcuggggagcggccaguucgccguggugaagaagugccgggagaaguccacggggcuccaguacgccgcgaaguucaucaagaagcgccggaccaagagcucccgccggggcgucagccgcgaggacaucgagcgggagguguccauccugaaggagauccagcaccccaacgugaucacccugcacgaggucuacgagaacaagaccgacgugauccucauccuggagcugguggccgggggcgagcuguucgacuuccuggccgagaaggagagccugacggaggaggaggccaccgaguuccucaagcagauccugaacggcgucuacuaccugcacucccuccagaucgcccacuucgaccugaagccggagaacaucaugcugcucgaccgcaacgugcccaagccccggaucaagaucaucgacuucgggcuggcgcacaagaucgacuucggcaacgaguucaagaacaucuucgggacccccgaguucguggccccggagaucgucaacuacgagccccugggccucgaggccgacauguggagcaucggggugaucaccuacauccugcuguccggcgccagccccuuccucggcgacacgaagcaggagacccuggcgaacguguccgccgucaacuacgaguucgaggacgaguacuucagcaacaccuccgcccuggccaaggacuucauccgccggcuccuggugaaggaccccaagaagcgcaugaccauccaggacagccugcagcacccguggaucaagcccaaggacacgcagcaggcccucucccggaaggcgagcgccgugaacauggagaaguucaagaaguucgccgcccgcaagaaguggaagcaguccguccggcugaucagccugugccagcgccucucccggagcuuccugagccgcuccaacaugagcguggcccgguccgacgacacccuggacgaggaggacagcuucgugaugaaggcgaucauccacgccaucaacgacgacaacguccccgggcuccagcaccuccugggcucccucagcaacuacgacgugaaccagcccaacaagcacgggaccccgccccugcugaucgccgccggcugcggcaacauccagauccuccagcugcugaucaagcgcgggucccggaucgacgugcaggacaagggcgggagcaacgccgucuacugggcggcccgccacggccacguggacacccucaaguuccuguccgagaacaagugcccccuggacgucaaggacaagagcggggagauggcccuccacguggccgcccgcuacggccacgcggacguggcccagcugcugugcuccuucggcagcaaccccaacauccaggacaaggaggaggagacgccgcuccacugcgccgccuggcacggguacuacuccgucgcgaaggcccugugcgaggccggcugcaacgugaacaucaagaaccgggagggggagacgccccugcugaccgccagcgcccgcggcuaccacgacaucguggagugccucgcggagcacggggccgaccugaacgccugcgacaaggacggccacaucgcccugcaccucgccguccggcgcugccagauggaggugaucaagacccugcugucccagggcugcuucguggacuaccaggaccggcacgggaacacgccccuccacgucgcgugcaaggacggcaacaugcccaucgugguggcccugugcgaggccaacugcaaccuggacaucagcaacaaguacgggcgcaccccgcuccaccuggccgccaacaacggcauccuggacgucgugcgguaccucugccugaugggggcguccguggaggcccugaccaccgacggcaagaccgccgaggaccucgcccgcagcgagcagcacgagcacgucgcgggccugcuggcccggcuccgcaaggacacccaccgggggcuguucauccagcagcugcgccccacccagaaccuccagccccggaucaagcugaagcuguucggccacuccgggagcggcaagaccacgcucguggagagccugaagugcggccugcuccgcuccuucuuccggcgccggcgcccccggcugagcuccaccaacagcucccgcuucccgcccagcccccuggccuccaagcccaccgugagcgucuccaucaacaaccucuacccggggugcgagaacgugagcgugcgcucccggagcaugauguucgagcccggccugaccaaggggaugcuggaggucuucguggcccccacgcaccacccgcacugcuccgccgacgaccagagcaccaaggcgaucgacauccagaacgccuaccucaacggcgugggggacuucuccgucugggaguucagcggcaaccccguguacuucugcugcuacgacuacuucgccgccaacgaccccaccuccauccacguggucguguucagccuggaggagcccuacgagauccagcugaaccaggugaucuucuggcucagcuuccugaagucccuggucccgguggaggagcccaucgccuucggcgggaagcucaagaacccccuccaggugguccugguggcgacccacgccgacaucaugaacgugccccgcccggccggcggggaguucggcuacgacaaggacacgagccuccugaaggagauccggaaccgcuucgggaacgaccugcacaucuccaacaagcuguucguccuggacgccggcgccagcggcuccaaggacaugaaggugcugcggaaccaccuccaggagauccgcagccagaucguguccgucugcccgcccaugacccaccugugcgagaagaucaucagcacccugcccuccuggcggaagcucaacgggcccaaccagcugaugagccugcagcaguucguguacgacgugcaggaccagcucaacccccuggcguccgaggaggaccugcgccggaucgcccagcagcuccacagcaccggcgagaucaacaucaugcaguccgagaccguccaggacgugcugcugcucgacccccgcuggcugugcacgaacgugcuggggaagcuccugagcgucgagacgccccgggcccugcaccacuaccgcggccgguacaccguggaggacauccagcgccucgugccggacuccgacgucgaggagcugcugcagauccucgacgccauggacaucugcgcgcgggaccugagcuccgggaccaugguggacgugcccgcccugaucaagaccgacaaccuccaccgcagcugggccgacgaggaggacgaggucaugguguacggcggcguccggaucgugcccguggagcaccugacccccuucccgugcgggaucuuccacaagguccaggugaaccugugccgcuggauccaccagcaguccaccgagggcgacgccgacauccggcucugggugaacgggugcaagcuggccaaccgcggcgcggagcugcucguccugcuggugaaccacgggcagggcaucgaggugcagguccggggccucgagaccgagaagaucaagugcugccugcugcucgacagcgugugcagcacgaucgagaacgugauggccaccacccugcccgggcugcucaccgucaagcacuaccugagcccccagcagcugcgcgagcaccacgagcccgugaugaucuaccagccgcgcgacuucuuccgggcccagacgcucaaggagaccucccugaccaacaccaugggcggguacaaggaguccuucagcuccaucaugugcuucggcugccacgacguguacagccaggccucccugggcauggacauccacgccagcgaccucaaccugcugacgcgccggaagcugucccgccuccuggacccgcccgacccccuggggaaggacuggugccuccuggcgaugaaccugggccuccccgaccuggucgccaaguacaacaccagcaacggggcccccaaggacuuccugcccuccccgcuccacgcccugcugcgggaguggaccaccuaccccgagagcacggugggcacccucauguccaagcugcgcgagcuggggcggcgcgacgccgcggacuuccuccugaaggccagcuccguguucaagaucaaccuggacggcaacggccaggaggccuacgccagcuccugcaacagcgggaccuccuacaacagcaucagcuccgucgugagccgguga

SEQ ID NO: 28987 - RNA, 1113 nt, Artificial Sequence
  derived and/or modified sequence opt1 from DAPK2__Homo_sapiens__NP_055141
auguuccaggccagcaugcgcucccccaacauggagccguucaagcagcagaagguggaggacuucuacgacaucggcgaggagcuggggagcggccaguucgccaucgucaagaagugccgggagaaguccaccgggcucgaguacgcggccaaguucaucaagaagcgccagagccgggccucccgccggggcgugagccgcgaggagaucgagcgggagguguccauccugcgccagguccugcaccacaacgugaucacccuccacgacguguacgagaaccggacggacgucgugcugauccuggagcucgugagcgggggcgagcuguucgacuuccuggcccagaaggagucccucagcgaggaggaggccaccuccuucaucaagcagauccuggacggcgucaacuaccugcacaccaagaagaucgcgcacuucgaccucaagcccgagaacaucaugcugcuggacaagaacauccccaucccccacaucaagcucaucgacuucgggcuggcccacgagaucgaggacggcguggaguucaagaacaucuucgggaccccggaguucguggcccccgagaucgucaacuacgagccccugggccucgaggccgacauguggagcaucggggugaucacguacauccugcuguccggcgcgagccccuuccucggcgacaccaagcaggagacccuggccaacaucaccgccguguccuacgacuucgacgaggaguucuucagccagacguccgagcuggccaaggacuucauccgcaagcuccuggucaaggagacccggaagcgccugaccauccaggaggcccuccggcacccguggaucacccccguggacaaccagcaggcgauggugcgccgggagagcgucgugaaccuggagaacuuccgcaagcaguacgugcggcgccgguggaagcuguccuucagcaucgucagccucugcaaccaccugacgcgcucccugaugaagaaggugcaccuccggcccgacgaggaccugcgcaacugcgagagcgacaccgaggaggacaucgcccgccggaaggcccugcacccccgccggcgcuccagcaccuccuga

SEQ ID NO: 28988 - RNA, 1365 nt, Artificial Sequence
  derived and/or modified sequence opt1 from DAPK3__Homo_sapiens__XP_005259565
augagcaccuuccgccaggaggacguggaggaccacuacgagaugggcgaggagcugggguccggccaguucgccaucguccggaagugccgccagaaggggaccggcaaggaguacgccgcgaaguucaucaagaagcggcgccucagcuccagccggcgcggggugucccgggaggagaucgagcgcgaggugaacauccugcgggagauccgccaccccaacaucaucacgcugcacgacaucuucgagaacaagaccgacgucgugcucauccuggagcuggugagcggcggcgagcuguucgacuuccucgccgagaaggagucccugaccgaggacgaggccacccaguuccucaagcagauccuggacgggguccacuaccugcacagcaagcggaucgcccacuucgaccucaagcccgagaacaucaugcugcuggacaagaacgugcccaacccccgcaucaagcucaucgacuucggcaucgcccacaagaucgaggcggggaacgaguucaagaacaucuucggcacgcccgaguucguggccccggagaucgucaacuacgagccccuggggcuggaggccgacaugugguccaucggcgugaucaccuacauccuccugagcggcgccucccccuuccugggggagaccaagcaggagacccucacgaacaucagcgcggugaacuacgacuucgacgaggaguacuucuccaacaccagcgagcuggccaaggacuucauccggcgccugcucgucaaggaccccaagcggcgcaugaccaucgcccagucccuggagcacagcuggaucaaggccauccggcgccggaacgugcgcggcgaggacuccgggcggaagccggagcgccgccggcugaagaccacgcgccucaaggaguacaccaucaagagccacuccagccugccgcccaacaacagcuacgccgacuucgagcgguucuccaaggugcuggaggaggcggccgccgccgaggagggccuccgcgagcugcagcggagccgccggcugugccacgaggacgucgaggcccucgcggccaucuacgaggagaaggaggccugguaccgcgaggaguccgacagccugggccaggaccugcggcgccuccggcaggagcugcugaagaccgaggcccucaagcgccaggcccaggaggaggcgaagggggcccugcugggcaccuccgggcucaagcggcgcuucagccggcuggagaaccgcuacgaggcccuggccaagcaggucgccuccgagaugcgguucgugcaggaccucgugcgcgcgcuggagcaggagaagcugcagggcguggagugcgggcuccgguga

SEQ ID NO: 28989 - RNA, 1938 nt, Artificial Sequence
  derived and/or modified sequence opt1 from DARS2__Homo_sapiens__NP_060592
auguacuuccccagcuggcugucccagcucuaccgcggccugagccggccgauccgccggaccacccagcccaucugggggucccuguaccgcagccuccugcaguccagccagcggcgcauccccgaguucuccagcuucgugguccggacgaacacgugcggcgagcugcgcuccagccaccucgggcaggaggugacccugugcggcuggauccaguaccggcgccagaacaccuuccuggugcuccgggacuucgacgggcugguccaggugaucaucccccaggacgaguccgccgccagcgugaagaagauccugugcgaggcgccggucgaguccguggugcaggucagcggcaccgugaucucccgccccgccggccaggagaaccccaagaugcccaccggggagaucgagaucaaggugaagaccgccgagcuccugaacgccugcaagaagcugccguucgagaucaagaacuucgucaagaagaccgaggcccuccggcugcaguaccgcuaccuggaccuccggagcuuccagaugcaguacaaccugcgccugcggucccagauggugaugaagaugcgcgaguaccucugcaaccugcacggcuucguggacaucgagacgcccacccuguucaagcggacccccgggggcgcgaaggaguuccucguccccagccgcgagccggggaaguucuacucccugccccagagcccccagcaguucaagcagcugcucauggugggcggccuggaccgguacuuccagguggcccgcugcuaccgcgacgaggggagccggcccgaccgccagccggaguucacccagaucgacaucgagauguccuucgucgaccagacgggcauccagagccugaucgaggggcuccugcaguacuccuggcccaacgacaaggaccccguggugguccccuucccgaccaugaccuucgccgaggugcuggccaccuacggcacggacaagcccgacacccgguucggcaugaagaucaucgacaucagcgacguguuccgcaacaccgagaucggguuccuccaggacgcgcuguccaagccccacggcaccgucaaggccaucugcauccccgagggggccaaguaccugaagcggaaggacaucgagagcauccgcaacuucgccgccgaccacuucaaccaggagauccucccgguguuccugaacgcgaaccggaacuggaacucccccgucgccaacuucaucauggagagccagcgccuggagcucauccggcugauggagacgcaggaggaggacguggugcugcucaccgccggcgagcacaacaaggccugcucccugcuggggaagcuccgccuggagugcgccgaccugcucgagacccggggcgucgugcugcgcgaccccacccuguucagcuuccuguggguggucgacuucccccucuuccugccgaaggaggagaacccccgggagcuggaguccgcgcaccaccccuucacggccccgcaccccagcgacauccaccuccuguacaccgagcccaagaaggcccgcucccagcacuacgaccuggugcucaacggcaacgagaucgggggcgggagcauccggauccacaacgccgagcugcagcgcuacauccuggccacccuccugaaggaggacgugaagaugcugucccaccuccugcaggcgcuggacuacggcgcgcccccgcacgggggcaucgcccucggccuggaccggcugaucugccucgucaccgggagccccuccauccgcgacgugaucgccuuccccaagagcuuccggggccacgaccugauguccaacacgcccgacagcgugccgcccgaggagcugaagcccuaccacauccgcgucagcaagcccaccgacuccaaggccgagcgcgcccacuga

SEQ ID NO: 28990 - RNA, 1206 nt, Artificial Sequence
  derived and/or modified sequence opt1 from DARS__Homo_sapiens__NP_001280241
auggugaaguucgccgccaacaucaacaaggagagcaucgucgacguggagggcgugguccgcaaggugaaccagaagaucggguccugcacccagcaggacguggagcugcacguccagaagaucuacgugaucagccucgccgagccccggcugccgcugcagcucgacgacgccgugcgccccgaggccgagggcgaggaggaggggcgggccaccgucaaccaggacacgcgccuggacaaccgggugaucgaccugcgcaccuccaccagccaggccguguuccggcuccaguccggcaucugccaccuguuccgcgagacccugaucaacaagggguucgucgagauccagacgcccaagaucaucagcgcggccuccgagggcggcgccaacguguucaccgugagcuacuucaagaacaacgccuaccucgcgcagagcccccagcuguacaagcagaugugcaucugcgccgacuucgagaaggucuucuccaucgggccgguguuccgggccgaggacuccaacacccaccgccaccugaccgaguucgugggccucgacaucgagauggccuucaacuaccacuaccacgaggucauggaggagaucgccgacacgauggugcagaucuucaaggggcugcaggagcgguuccagaccgagauccagaccgugaacaagcaguuccccugcgagcccuucaaguuccuggagcccacccuccgccuggaguacugcgaggcgcuggccaugcuccgggaggccggcgucgagaugggggacgaggacgaccugagcacgccgaacgagaagcugcucggccaccuggugaaggagaaguacgacaccgacuucuacauccuggacaaguacccccucgccgugcgccccuucuacaccaugcccgacccgcggaaccccaagcaguccaacagcuacgacauguucaugcgcggcgaggagauccuguccggggcccagcggauccacgacccccagcugcucaccgagcgcgcgcugcaccacggcaucgaccuggagaagaucaaggccuacaucgacagcuuccgguucggggcgcccccgcacgccggcggcgggaucggccucgagcgcgucacgaugcuguuccuggggcuccacaacgugcggcagaccuccauguucccccgcgaccccaagcgccugacccccuga

SEQ ID NO: 28991 - RNA, 1248 nt, Artificial Sequence
  derived and/or modified sequence opt1 from DAW1__Homo_sapiens__NP_849143
augaagcucaagagccugcugcugcgcuacuacccgcccggcaucaugcucgaguacgagaagcacggggagcugaagaccaaguccaucgaccugcucgaccugggccccagcaccgacguguccgcccuggucgaggagauccagaaggccgagccccuccugacggcgagccggaccgagcaggucaagcugcucauccagcgccugcaggagaagcuggggcagaacuccaaccacaccuucuaccucuucaaggugcugaaggcccacauccugccccucaccaacguggcccugaacaagagcggcuccugcuucaucacggggagcuacgaccggaccugcaagcugugggacaccgccuccggcgaggagcucaacacccuggagggccaccgcaacgugguguacgccaucgcguucaacaacccguacggggacaagaucgccacgggcagcuucgacaagaccugcaagcugugguccgucgagaccgggaagugcuaccacaccuuccggggccacacggccgagaucgugugccucagcuucaacccccaguccacccugguggccaccgggagcauggacaccacggcgaagcugugggacauccagaacggcgaggaggucuacacccuccgcggccacuccgccgagaucaucagccuguccuucaacaccagcggggaccggaucaucaccggcuccuucgaccacacggugguggucugggacgccgacaccgggcgcaaggugaacauccugaucggccacugcgccgagaucagcagcgccuccuucaacugggacugcagccucauccugaccggcuccauggacaagaccugcaagcugugggacgcgacgaacgggaagugcguggccacccucaccggccacgacgacgagauccuggacagcugcuucgacuacaccgggaagcugaucgccacggccuccgccgacggcaccgcgcggaucuucagcgccgccacccgcaagugcaucgccaagcucgaggggcacgagggcgagaucuccaagaucagcuucaacccccagggcaaccaccuccugaccggguccagcgacaagacggcccggaucugggacgcgcagaccggccagugccugcagguccuggaggggcacaccgacgagaucuucuccugcgccuucaacuacaagggcaacaucgugaucaccgggagcaaggacaacacgugccgcaucuggcgguga

SEQ ID NO: 28992 - RNA, 2259 nt, Artificial Sequence
  derived and/or modified sequence opt1 from DAXX__Homo_sapiens__NP_001135442
augcgcggcagcgagaacugcggcgagggccggcuggagcgccgguuccucuccaucaucgugcuggacgacgacgacgaggacgaggccgccgcgcagcccgggccgagccacccccugcccaacgccgccucccccggcgccgaggccccgagcuccagcgagccccacggggcgcgcggcuccagcuccagcggcgggaagaagugcuacaagcucgagaacgagaagcuguucgaggaguuccuggagcucugcaagaugcagaccgccgaccaccccgaggucgugcccuuccuguacaaccggcagcagcgcgcccacucccuguuccucgccagcgcggaguucugcaacauccugucccgggugcugagccgcgcccggucccgcccggccaagcucuacgucuacaucaacgagcugugcaccgugcugaaggcccacagcgccaagaagaagcucaaccuggcgcccgccgccacgaccuccaacgagcccagcggcaacaacccgcccacccaccugucccucgaccccaccaacgccgagaacacggccagccagagcccccggacccgcgggucccggcgccagauccagcggcuggagcagcugcucgcgcuguacguggccgagauccgccggcugcaggagaaggagcucgaccugagcgagcuggacgaccccgacuccgccuaccuccaggaggcccgccugaagcggaagcugauccgccucuucggccggcugugcgagcugaaggacugcagcucccucaccgggcgcgucaucgagcagcgcaucccguaccggggcacccgcuaccccgaggugaaccggcgcaucgagcggcugaucaacaagcccggccccgacacguucccggacuacggggacgugcugcgcgccgucgagaaggcggccgcccggcacagccucggccugccccgccagcagcugcagcucauggcccaggacgccuuccgggacguggggauccgccugcaggagcggcgccaccuggaccucaucuacaacuucggcugccaccugaccgacgacuaccggcccggcguggaccccgcgcuguccgacccgguccucgcccgccggcugcgcgagaaccggagccuggccaugucccgccucgacgaggugaucagcaaguacgccaugcugcaggacaaguccgaggagggggagcggaagaagcgccgcgcgcggcugcagggcaccagcucccacagcgccgacacccccgaggccucccuggacagcggggagggccccuccgggauggccagccagggcugccccuccgccagccgcgcggagacggacgacgaggacgacgaggagagcgacgaggaggaggaggaggaggaggaggaggaggaggaggaggccaccgacuccgaggaggaggaggaccucgagcagaugcaggagggccaggaggacgacgaggaggaggacgaggaggaggaggccgccgccgggaaggacggcgacaagagcccgauguccagccugcagaucuccaacgagaagaaccuggagcccgggaagcagaucagccgguccagcggcgagcagcagaacaaggggcgcaucgugucccccagccuccuguccgaggagccgcuggcgcccagcuccaucgacgccgagagcaacggcgagcagcccgaggagcucacccuggaggaggagucccccgucagccagcuguucgagcucgagaucgaggcccugccgcuggacacccccuccagcguggagacggacaucagcuccagccggaagcaguccgaggagcccuucaccaccgugcucgagaacggcgccgggauggucagcuccaccagcuucaacggcggggugagcccccacaacuggggcgacuccgggccgcccugcaagaagucccgcaaggagaagaagcagacgggcagcggcccccuggggaacuccuacguggagcggcagcgcagcguccacgagaagaacggcaagaagaucugcacccugcccuccccgcccagcccccucgccucccuggcgcccguggccgacagcuccacccggguggacagcccgucccacgggcuggucaccagcagccucugcauccccucccccgcccgccugagccagacgccccacucccagccgccccggcccgggaccugcaagaccagcguggccacccagugcgaccccgaggagaucaucguccuguccgacagcgacuga

SEQ ID NO: 28993 - RNA, 2235 nt, Artificial Sequence
  derived and/or modified sequence opt1 from DAZ1__Homo_sapiens__NP_004072
augagcgccgccaaccccgagaccccgaacuccaccaucagccgcgaggcguccacgcagagcuccagcgccgccgccucccagggcugggugcugcccgaggggaagaucguccccaacaccguguucgugggcgggaucgacgcccggauggacgagaccgagaucggcagcugcuucgggcgcuacggcuccgucaaggaggugaagaucaucaccaaccggacgggcgugagcaagggguacggcuucgucuccuucgugaacgacguggacguccagaagaucguggggagccagauccacuuccacggcaagaagcucaagcuggggcccgcgauccgcaagcagaagcugugcgcccggcacgugcagccgcgcccccucgucgugaacccgcccccgccgccccaguuccagaacguguggcggaaccccaacaccgagaccuaccugcagccccagaucacccccaaccccgucacgcagcacgugcaguccgccgccaaccccgagaccccgaacagcaccaucucccgcgaggcgagcacccaguccagcuccgccgccgccagccagggcugggugcugcccgagggcaagaucguccccaacacgguguucgucgggggcaucgacgcccggauggacgagaccgagaucgggagcugcuucggccgcuacggcuccgugaaggaggugaagaucaucaccaaccggaccggggugagcaagggcuacggguucgucuccuucgugaacgacgucgacgugcagaagaucgugggcagccagauccacuuccacgggaagaagcucaagcugggccccgcgauccgcaagcagaagcugugcgcccggcacguccagccgcgcccccucguggugaacccgccgcccccgccccaguuccagaacgucuggcggaaccccaacacggagaccuaccugcagccccagaucacccccaaccccgugacccagcacgugcaguccgccgccaaccccgagacgcccaacagcaccaucucccgcgaggccagcacccaguccagcuccgcggccgccagccagggcuggguccugcccgaggggaagaucgugcccaacaccguguucgucggcgggaucgacgcccggauggacgagacggagaucggcuccugcuucgggcgcuacggcagcgugaaggaggugaagaucaucaccaaccggaccggcgucuccaagggguacggcuucgugagcuucgugaacgacgucgacgugcagaagaucguggggucccagauccacuuccacggcaagaagcucaagcuggggcccgccauccgcaagcagaagcugugcgcgcggcacguccagccccgcccccucguggugaacccgcccccgccgccccaguuccagaacgucuggcgcaaccccaacaccgagacguaccugcagccccagaucacccccaaccccgugacccagcacgugcaggccuacagcgccuacccccacucccccggccaggucaucaccggcugccagcugcucguguacaacuaccaggaguaccccacguaccccgacagcgccuuccaggugaccaccggguaccagcugccggucuacaacuaccagcccuuccccgccuacccccggagcccguuccaggugaccgcgggcuaccagcugcccguguacaacuaccaggccuuccccgccuacccgaacucccccuuccaggucgccacgggguaccaguuccccguguacaacuaccagcccuucccggcguaccccagcucccccuuccaggugaccgccggcuaccagcuccccgucuacaacuaccaggccuucccggccuaccccaacagccccuuccagguggccaccggcuaccaguuccccguguacaacuaccaggcguucccggccuaccccaacucccccguccaggugaccaccggguaccagcugcccguguacaacuaccaggccuucccggccuaccccagcucccccuuccaggucacgaccggcuaccagcugcccguguacaacuaccaggccuucccggcguaccccaacagcgccgugcaggucaccaccggguaccaguuccacguguacaacuaccagaugccgccccagugccccgugggcgagcagcgccggaaccucuggacggaggccuacaaguggugguaccuggucugccugauccagcgccgggacuga

SEQ ID NO: 28994 - RNA, 1605 nt, Artificial Sequence
  derived and/or modified sequence opt1 from DAZ2__Homo_sapiens__NP_001005785
augagcgccgccaaccccgagaccccgaacuccaccaucagccgcgaggcguccacgcagagcuccagcgccgccgccucccagggcugggugcugcccgaggggaagaucguccccaacaccguguucgugggcgggaucgacgcccggauggacgagaccgagaucggcagcugcuucgggcgcuacggcuccgucaaggaggugaagaucaucaccaaccggacgggcgugagcaagggguacggcuucgucuccuucgugaacgacguggacguccagaagaucguggggagccagauccacuuccacggcaagaagcucaagcuggggcccgcgauccgcaagcagaagcugugcgcccggcacgugcagccgcgcccccucgucgugaacccgccgcccccgccccaguuccagaacguguggcggaaccccaacaccgagaccuaccugcagccccagaucacccccaaccccgucacgcagcacgugcaggccuacuccgccuacccccacagccccggccaggugaucaccggcugccagcugcucgucuacaacuaccaggaguaccccaccuaccccgacuccgcguuccaggugaccacgggguaccagcugcccguguacaacuaccagccguuccccgccuacccccgcagccccuuccaggucaccgccggcuaccagcugccgguguacaacuaccaggccuuccccgccuaccccaacucccccuuccagguggcgaccggguaccaguucccggucuacaacuaccagcccuuccccgccuacccgagcucccccuuccaggugaccgccggcuaccagcuccccgucuacaacuaccaggccuuccccgccuacccgaacagccccuuccagguggcgacgggcuaccaguuccccguguacaacuaccaggccuuccccgccuacccgaacagccccguccaggugaccaccggguaccagcugcccguguacaacuaccaggccuuccccgccuacccguccagccccuuccaggucaccacgggcuaccagcugcccguguacaacuaccaggcguuccccgccuacccguccagccccuuccaggugaccaccggguaccagcuccccgucuacaacuaccaggccuuccccgccuacccguccagccccuuccaggugaccacgggcuaccagcugcccguguacaacuaccaggccuuccccgcguacccguccagccccuuccaggucaccaccggguaccagcugcccguguacaacuaccaggccuucccggccuaccccuccagccccuuccaggugaccacgggcuaccagcuccccgucuacaacuaccaggccuucccggcguaccccuccagccccuuccaggugaccaccggcuaccagcugcccguguacaacuaccaggccuucccggccuaccccaacuccgccguccaggugaccacgggguaccaguuccacguguacaacuaccagaugccgccccagugccccgucggcgagcagcggcgcaaccuguggaccgaggccuacaaguggugguaccucgugugccugauccagcggcgcgacuga

SEQ ID NO: 28995 - RNA, 1317 nt, Artificial Sequence
  derived and/or modified sequence opt1 from DAZ3__Homo_sapiens__NP_065097
augagcgccgccaaccccgagaccccgaacuccaccaucagccgcgaggcguccacgcagagcuccagcgccgccgccucccagggcugggugcugcccgaggggaagaucguccccaacaccguguucgugggcgggaucgacgcccggauggacgagaccgagaucggcagcugcuucgggcgcuacggcuccgucaaggaggugaagaucaucaccaaccggacgggcgugagcaagggguacggcuucgucuccuucgugaacgacguggacguccagaagaucguggggagccagauccacuuccacggcaagaagcucaagcuggggcccgcgauccgcaagcagaagcugugcgcccggcacgugcagccgcgcccccucgucgugaacccgccgcccccgccccaguuccagaacguguggcggaaccccaacaccgagaccuaccugcagccccagaucacccccaaccccgucacgcagcacgugcaggccuacuccgccuacccccacagccccggccaggugaucaccggcugccagcugcucgucuacaacuaccaggaguaccccaccuaccccgacuccgcguuccaggugaccacgggguaccagcugcccguguacaacuaccagccguuccccgccuacccccgcagccccuuccaggucaccgccggcuaccagcugccgguguacaacuaccaggccuuccccgccuaccccaacucccccuuccagguggcgaccggguaccaguucccggucuacaacuaccaggccuuccccgccuaccccaacagcccggugcaggucaccacgggcuaccagcuccccguguacaacuaccaggccuuccccgccuaccccaacuccccguuccagguggcgaccggcuaccaguuccccgucuacaacuaccaggccuuccccgccuaccccaacagcccgguccaggugaccaccggguaccagcugcccguguacaacuaccaggccuuccccgccuaccccaacagcccguuccagguggcgacgggcuaccaguuccccguguacaacuaccaggccuuccccgccuaccccaacuccccgguccaggugaccaccggguaccagcugcccguguacaacuaccaggccuuccccgccuaccccaacagcgcgguccaggugaccacgggcuaccaguuccacguguacaacuaccagaugccgccccagugccccgucggggagcagcggcgcaaccucuggaccgaggccuacaaguggugguaccuggugugccugauccagcggcgcgacuga

SEQ ID NO: 28996 - RNA, 1740 nt, Artificial Sequence
  derived and/or modified sequence opt1 from DAZ4__Homo_sapiens__NP_001005375
augagcgccgccaaccccgagaccccgaacuccaccaucagccgcgaggcguccacgcagagcuccagcgccgccgccucccagggcugggugcugcccgaggggaagaucguccccaacaccguguucgugggcgggaucgacgcccggauggacgagaccgagaucggcagcugcuucgggcgcuacggcuccgucaaggaggugaagaucaucaccaaccggacgggcgugagcaagggguacggcuucgucuccuucgugaacgacguggacguccagaagaucguggggagccagauccacuuccacggcaagaagcucaagcuggggcccgcgauccgcaagcagaagcugugcgcccggcacgugcagccgcgcccccucgucgugaacccgcccccgccgccccaguuccagaacguguggcggaaccccaacaccgagaccuaccugcagccccagaucacccccaaccccgucacgcagcacgugcaguccgccgccaaccccgagaccccgaacagcaccaucucccgcgaggcgagcacccaguccagcuccgccgccgccagccagggcugggugcugcccgagggcaagaucguccccaacacgguguucgucgggggcaucgacgcccggauggacgagaccgagaucgggagcugcuucggccgcuacggcuccgugaaggaggugaagaucaucaccaaccggaccggggugagcaagggcuacggguucgucuccuucgugaacgacgucgacgugcagaagaucgugggcagccagauccacuuccacgggaagaagcucaagcugggccccgcgauccgcaagcagaagcugugcgcccggcacguccagccgcgcccccucguggugaacccgccgcccccgccccaguuccagaacgucuggcggaaccccaacacggagaccuaccugcagccccagaucacccccaaccccgugacccagcacgugcaggccuacuccgccuacccccacagccccggccaggucaucacggggugccagcugcucguguacaacuaccaggaguaccccaccuaccccgacuccgccuuccaggugaccaccggcuaccagcugcccgucuacaacuaccagcccuuccccgcguacccccgcagcccguuccaggugacggccggguaccagcugcccguguacaacuaccaggccuuccccgccuaccccaacuccccguuccaggucgccaccggcuaccaguuccccguguacaacuaccagcccuuccccgcguacccgagcucccccuuccaggugaccgccggguaccagcuccccgucuacaacuaccaggccuuccccgccuacccgaacagccccuuccagguggccaccggcuaccaguuccccguguacaacuaccaggcguuccccgccuacccgaacucccccguccaggugacgaccggcuaccagcugcccguguacaacuaccaggccuucccggccuaccccagcucccccuuccaggucaccaccggguaccagcugcccguguacaacuaccaggcguucccggccuaccccaacagcgccgugcaggucacgaccggcuaccaguuccacguguacaacuaccagaugccgccccagugccccgugggggagcagcggcgcaaccucuggaccgaggccuacaaguggugguaccuggucugccugauccagcggcgcgacuga

SEQ ID NO: 28997 - RNA, 1224 nt, Artificial Sequence
  derived and/or modified sequence opt1 from DAZAP1__Homo_sapiens__NP_061832
augaacaacagcggcgccgacgagaucgggaagcuguucgugggcgggcucgacugguccaccacccaggagacgcugcgcagcuacuucucccaguacggcgaggucguggacugcgugaucaugaaggacaagaccaccaaccagagccggggguucggcuucgucaaguucaaggaccccaacugcgugggcaccgugcuggccucccgcccgcacacgcucgacgggcggaacaucgaccccaagcccugcaccccccgcggcaugcagccggagcggacccgccccaaggagggguggcagaagggcccccggagcgacaacuccaagagcaacaagaucuucgucgggggcaucccccacaacugcggcgagaccgagcugcgcgaguacuucaagaaguucgggguggugacggaggucgugaugaucuacgacgcggagaagcagcggccgcgcggcuucggguucaucaccuucgaggacgagcaguccguggaccaggccgucaacaugcacuuccacgacaucaugggcaagaagguggaggugaagcgggccgagccccgcgacagcaagucccaggcccccggccagcccggggccagccaguggggcucccgggucgugccgaacgcggccaacgggugggccggccagcccccccccaccuggcagcagggguacggcccgcagggcaugugggugcccgccgggcaggcgaucggcggguacggcccccccccggccgggcgcggcgcccccccccccccgccccccuucaccagcuacaucgucuccacgcccccgggcggguucccccccccgcagggcuucccccagggguacggcgcccccccccaguucagcuucggguacggcccgcccccccccccgcccgaccaguucgccccccccggcgugccgcccccccccgcgaccccgggggccgccccccuggccuucccccccccgcccucccaggccgcgcccgacaugagcaagcccccgaccgcccagcccgacuuccccuacggccaguacgccggguacggccaggaccucuccggcuucgggcagggcuucagcgacccgagccagcagccccccuccuacgggggccccagcgugccgggguccggcggcccccccgccgggggcagcggguucggccgggggcagaaccacaacguccagggcuuccaccccuaccgccgguga

SEQ ID NO: 28998 - RNA, 441 nt, Artificial Sequence
  derived and/or modified sequence opt1 from DAZAP2__Homo_sapiens__NP_001129736
augaacagcaagggccaguaccccacccagccgaccuaccccgugcagccccccgggaacccggucuacccccagacgcugcaccucccccaggcccccccguacaccgacgccccccccgcguacuccgagcuguaccgccccagcuucgugcacccgggcgccgccaccgugcccaccauguccgccgccauccccauggcguacuaccccgucgggccgaucuacccccccggcagcacggugcugguggaggggggcuacgacgccggcgcccgguucggggccggcgcgaccgccgggaacauccccccgcccccccccggcugcccgcccaacgccgcccagcucgccgucaugcagggggcgaacgugcuggugacccagcgcaagggcaacuucuucaugggcggguccgacggcggguacaccaucugguga

SEQ ID NO: 28999 - RNA, 948 nt, Artificial Sequence
  derived and/or modified sequence opt1 from DAZL__Homo_sapiens__NP_001177740
auggccgcccccagcugcggcggggaccgcaaggcgcggcugaccccgucccucccccacgagagcaccgccaaccccgagacccccaacuccaccaucagccgcgaggccuccacccagagcuccagcgccgccaccucccagggcuacauccugccggaggggaagaucaugcccaacacgguguucgucggcgggaucgacgugcggauggacgagaccgagauccgcagcuucuucgcgcgguacggcuccgugaaggaggucaagaucaucaccgaccgcaccggcgugagcaagggguacggcuucguguccuucuucaacgacgucgacgugcagaagaucguggagagccagaucaacuuccacgggaagaagcugaagcucggccccgccauccggaagcagaaccugugcgccuaccacguccagccccgcccgcugguguucaaccacccgcccccgccccaguuccagaacguguggacgaaccccaacaccgagaccuacaugcagcccaccacgaccaugaaccccaucacccaguacguccaggccuaccccaccuaccccaacucccccguccaggugaucacgggguaccagcuccccgucuacaacuaccagaugccgccccaguggcccgugggcgagcagcggagcuacguggugcccccggcguacuccgccgugaacuaccacugcaacgagguggaccccggcgccgaggucgugcccaacgagugcagcgugcacgaggccacgcccccguccgggaacggcccccagaagaaguccgucgaccgcagcauccagaccguggucagcugccuguucaaccccgagaaccggcugcgcaacagcguggugacccaggacgacuacuucaaggacaagcggguccaccacuuccgccggucccgcgccaugcucaagagcguguga

SEQ ID NO: 29000 - RNA, 2025 nt, Artificial Sequence
  derived and/or modified sequence opt1 from DBF4__Homo_sapiens__NP_006707
augaacagcggcgccaugcgcauccacuccaaggggcacuuccagggcgggauccaggugaagaacgagaagaaccggcccagccugaagucccucaagaccgacaaccgcccggagaaguccaagugcaagccccuguggggcaaggucuucuaccuggaccuccccuccgugaccaucagcgagaagcugcagaaggacaucaaggaccucgggggccggguggaggaguuccuguccaaggacaucagcuaccugaucuccaacaagaaggaggccaaguucgcgcagacgcugggccgcaucagccccgucccgucccccgagagcgccuacaccgccgagaccaccagcccccaccccagccacgacggguccagcuucaaguccccggacacggugugccucagccggggcaagcugcugguggagaaggccaucaaggaccacgacuucauccccuccaacagcauccucagcaacgcccuguccuggggcgucaagauccugcacaucgacgacauccgcuacuacaucgagcagaagaagaaggagcucuaccugcugaagaaguccagcaccagcgugcgggacggcgggaagcgcgugggguccggcgcgcagaagacccggaccgggcgccucaagaagcccuucgucaagguggaggacaugagccagcuguaccggcccuucuaccugcagcucacgaacaugccguucaucaacuacuccauccagaagcccugcagccccuucgacguggacaagcccuccagcaugcagaagcagacccaggucaagcugcgcauccagaccgacggcgacaaguacgggggcaccuccauccagcugcagcucaaggagaagaagaagaagggcuacugcgagugcugccugcagaaguacgaggaccuggagacgcaccuccugagcgagcagcaccggaacuucgcccaguccaaccaguaccaggugguggacgacaucgucagcaagcugguguucgacuucguggaguacgagaaggacaccccgaagaagaagcgcaucaaguacuccgucgggagccucucccccgugagcgccuccgugcugaagaagaccgagcagaaggagaaggucgagcugcagcacaucagccagaaggacugccaggaggacgacaccacggugaaggagcagaacuuccucuacaaggagacccaggagaccgagaagaagcugcuguucaucagcgagcccaucccccacccguccaacgagcuccggggccugaacgagaagaugagcaacaagugcuccaugcugagcaccgccgaggacgacauccgccagaacuucacgcagcucccccugcacaagaacaagcaggagugcauccuggacaucuccgagcacacccucagcgagaacgaccuggaggagcugcggguggaccacuacaagugcaacauccaggcguccguccacgugagcgacuucuccaccgacaacagcgggucccagcccaagcagaaguccgacaccguccucuuccccgccaaggaccugaaggagaaggaccugcacagcaucuucacgcacgacagcggccucaucaccaucaacuccagccaggagcaccugaccgugcaggccaaggccccguuccacaccccgcccgaggagcccaacgagugcgacuucaagaacauggacucccugcccagcgggaagauccaccgcaaggugaagaucauccugggccggaaccgcaaggagaaccucgagcccaacgccgaguucgacaagcggacggaguucaucacccaggaggagaaccgcaucugcagcucccccguccagagccugcuggaccucuuccagaccuccgaggagaaguccgaguuccugggcuucaccagcuacacggagaaguccgggaucugcaacgugcuggacaucugggaggaggagaacagcgacaaccuccugaccgcguucuucagcuccccgagcaccuccaccuucacgggcuucuga

SEQ ID NO: 29001 - RNA, 1854 nt, Artificial Sequence
  derived and/or modified sequence opt1 from DBH__Homo_sapiens__NP_000778
augcccgcccugagccgcugggccucccucccgggccccagcaugcgggaggcggccuucauguacuccaccgccguggccaucuuccuggucauccugguggccgcgcuccaggggagcgcgccccgcgagagcccccugccguaccacaucccccuggaccccgagggcucccucgagcuguccuggaacgugagcuacacccaggaggccauccacuuccagcugcucguccggcgccugaaggccggggugcuguucggcauguccgaccgcggggagcucgagaacgccgaccuggugguccuguggacggacggcgacaccgccuacuucgccgacgccuggagcgaccagaagggccagauccaccucgacccccagcaggacuaccagcugcuccaggugcagcggaccccggaggggcucacccugcuguucaagcggcccuucggcacgugcgaccccaaggacuaccucaucgaggacgggaccgugcaccuggucuacggcauccuggaggagcccuuccgcucccucgaggccaucaacgggagcggccugcagaugggccugcagcgggugcagcuccugaagccgaacauccccgagcccgagcugcccuccgacgcgugcaccauggaggugcaggccccgaacauccagauccccagccaggagaccacguacuggugcuacaucaaggagcuccccaagggguucucccgccaccacaucaucaaguacgagcccaucgucaccaagggcaacgaggcccuggugcaccacauggagguguuccagugcgccccggagauggacagcgucccccacuucuccgggcccugcgacagcaagaugaagcccgaccggcugaacuacugccgccacgugcucgccgcgugggcccugggcgccaaggccuucuacuacccggaggaggccggccuggcguucgggggccccggguccagccgguaccuccgccuggaggugcacuaccacaacccccuggucaucgagggccggaacgacagcuccgggauccgccucuacuacaccgccaagcugcggcgcuucaacgccggcaucauggagcugggccucguguacacccccgugauggccaucccgccccgggagacggccuucauccugaccggguacugcaccgacaagugcacccagcuggcgcugcccccgagcggcauccacaucuucgccucccagcugcacacgcaccugaccgggcgcaaggucgugaccgugcucguccgggacggccgcgagugggagaucgugaaccaggacaaccacuacagcccccacuuccaggagauccgcaugcugaagaaggucguguccgugcaccccggggacguccugaucaccagcugcacguacaacaccgaggaccgggagcuggccaccgugggcggcuucgggauccucgaggagaugugcgugaacuacguccacuacuacccccagacccagcuggagcugugcaaguccgccguggacgcgggcuuccuccagaaguacuuccaccugaucaaccgcuucaacaacgaggacgugugcacgugcccgcaggccagcgucucccagcaguucaccagcgugcccuggaacuccuucaaccgggacgugcugaaggcccucuacagcuucgcccccaucuccaugcacugcaacaagagcuccgccguccgcuuccagggggaguggaaccugcagccccugccgaaggugaucagcacccucgaggagcccacgccccagugccccaccucccagggccggagcccggcggggcccaccguggucuccaucggcggcgggaagggcuga

SEQ ID NO: 29002 - RNA, 264 nt, Artificial Sequence
  derived and/or modified sequence opt1 from DBI__Homo_sapiens__NP_001073331
augagccaggccgaguucgagaaggccgcggaggaggugcgccaccugaagaccaagcccuccgacgaggagaugcuguucaucuacggccacuacaagcaggccaccgucggggacaucaacacggagcggccgggcaugcucgacuucaccgggaaggccaagugggacgccuggaacgagcugaagggcaccagcaaggaggacgccaugaaggcguacaucaacaagguggaggagcucaagaagaaguacgggaucuga

SEQ ID NO: 29003 - RNA, 1950 nt, Artificial Sequence
  derived and/or modified sequence opt1 from DBN1__Homo_sapiens__NP_004386
auggccggcgugagcuucuccgggcaccgccuggagcuccuggccgcguacgaggaggucauccgggaggagagcgccgccgacugggcccuguacaccuacgaggacggcuccgacgaccucaagcuggccgcgagcggggagggcgggcugcaggagcucuccggccacuucgagaaccagaaggugauguacggcuucugcagcgugaaggacucccaggccgcccugcccaaguacguccugaucaacugggugggggaggacgugcccgacgcccgcaagugcgcgugcgccagccacgucgccaagguggccgaguucuuccagggcguggacgucaucgugaacgccuccagcguggaggacaucgacgcgggggccaucggccagcggcucuccaacgggcuggcccgccugagcucccccguccuccaccggcugcgccugcgggaggacgagaacgccgagcccgugggcaccacguaccagaagaccgacgccgcgguggagaugaagcgcaucaaccgggagcaguucugggagcaggccaagaaggaggaggagcuccgcaaggaggaggagcggaagaaggcccuggacgagcgccugcgguucgagcaggagcgcauggagcaggagcggcaggagcaggaggagcgcgagcggcgcuaccgggagcgcgagcagcagaucgaggagcaccggcgcaagcagcagacccucgaggccgaggaggccaagcgccggcugaaggagcagagcaucuucggcgaccaccgcgacgaggaggaggagacccacaugaagaaguccgagagcgaggucgaggaggcggccgccaucaucgcccagcggcccgacaacccgcgcgaguucuucaagcagcaggagcggguggccuccgcgagcgccggguccugcgacgugcccagccccuucaaccaccgccccggcagccaccuggacucccaccggcgcauggccccgacgcccauccccacccggagccccuccgacagcuccaccgccagcaccccggucgcggagcagaucgagcgcgcccucgacgaggugacguccagccagcccccgccccugcccccgccgccgccgcccgcccaggagacccaggagcccucccccauccuggacagcgaggagacccgggccgccgcgccccaggccugggccgggcccauggaggagccgccccaggcccaggccccgccccgcggccccggcucccccgcggaggaccucauguucauggagagcgccgagcaggccgugcuggccgcccccgucgagcccgcgaccgccgacgccacggagauccacgacgccgcggacaccaucgagaccgacaccgccacggccgacaccaccguggccaacaacgugccgcccgccgcgaccucccugaucgaccucuggcccgggaacggcgagggggccagcacgcugcagggcgagccccgggcccccaccccgcccuccgggaccgaggucacccuggccgaggugccccuccuggacgaggucgcccccgagccccugcuccccgcgggcgagggcugcgccacgcugcugaacuucgacgagcuccccgagccgcccgccaccuucugcgaccccgaggagguggagggggagccccuggccgcgccccagacccccacccugcccagcgcccucgaggagcuggagcaggagcaggagcccgagccccaccuccugacgaacggcgagaccacccagaaggaggggacccaggccuccgagggcuacuucagccagucccaggaggaggaguucgcccagagcgaggagcugugcgccaaggcgccgccgcccguguucuacaacaagccgcccgagaucgacaucacgugcugggacgccgaccccguccccgaggaggaggagggguucgagggcggcgacuga

SEQ ID NO: 29004 - RNA, 1293 nt, Artificial Sequence
  derived and/or modified sequence opt1 from DBNL__Homo_sapiens__NP_001014436
auggccgccaaccugagccgcaacggccccgcgcuccaggaggccuacgugcgggucgugaccgagaagucccccaccgacugggcccuguucacguacgaggggaacagcaacgacauccgcguggccggcaccggggagggcgggcuggaggagauggucgaggagcucaacuccggcaaggugauguacgccuucugccgggugaaggaccccaacagcggccugcccaaguucguccugaucaacuggaccggggagggcgugaacgacgugcgcaagggggcgugcgccucccacgucagcaccauggccuccuuccucaagggcgcccacgugacgaucaacgcgcgggccgaggaggacguggagcccgagugcaucauggagaaggucgccaaggccagcggggccaacuacuccuuccacaaggagagcggccgcuuccaggacgugggcccgcaggcgcccgugggguccgucuaccagaagaccaacgccgugagcgagaucaagcgggugggcaaggacuccuucugggccaaggccgagaaggaggaggagaaccgccggcuggaggagaagcgccgggccgaggaggcgcagcgccagcuggagcaggagcggcgcgagcgggagcuccgcgaggccgcccggcgcgagcagcgguaccaggagcagggcggggaggccagcccccagcgcaccugggagcagcagcaggaggucgugucccggaaccgcaacgagcaggagagcgccgugcacccccgcgagaucuucaagcagaaggagcgggcgauguccaccacgagcaucuccagcccgcagcccggcaagcugcgcagccccuuccugcagaagcagcucacccagcccgagacccacuucgggcgggagccggccgccgccaucucccgcccccgggccgaccugcccgcggaggagcccgccccgagcaccccgcccugccugguccaggccgaggaggaggccguguacgaggagccgcccgagcaggagacguucuacgagcagccgccccucgugcagcagcagggcgcgggguccgagcacaucgaccaccacauccagggccaggggcugagcggccagggccugugcgcccgcgcccucuacgacuaccaggccgccgacgacaccgagaucuccuucgaccccgagaaccugaucaccgggaucgaggucaucgacgagggcugguggcggggguacggccccgacgggcacuucggcauguuccccgcgaacuacguggagcugaucgaguga

SEQ ID NO: 29005 - RNA, 978 nt, Artificial Sequence
  derived and/or modified sequence opt1 from DBP__Homo_sapiens__NP_001343
auggcccgccccgugagcgaccggaccccggcgccccugcuccugggcgggcccgccggcaccccgcccgggggcggggcccugcucggccugcgcucccugcuccagggcacgagcaagcccaaggagcccgccuccugccugcugaaggagaaggagcggaaggccgcccuccccgcggccaccaccccggggcccggccuggagaccgccgggcccgccgacgcgcccgccggcgccgucgucgggggcggcagcccgcgcgggcggcccggccccgugcccgccccggggcugcucgcgccccugcugugggagcgcacgcuccccuucggcgacguggaguacguggaccuggacgccuuccugcucgagcacggccugcccccguccccgcccccgcccgggggccccagccccgagcccucccccgcccggacccccgcccccagcccggggcccggcuccugcgggagcgccagcccccgcuccucccccggccacgccccggcgcgggccgcccugggcaccgccagcgggcaccgcgccggccucaccucccgggacacgcccagccccguggaccccgacaccgucgaggugcugaugaccuucgagccggaccccgcggaccuggcccucuccagcauccccgggcacgagaccuucgacccccgccggcaccgcuucuccgaggaggagcugaagccgcagcccaucaugaagaaggcccggaagauccaggugcccgaggagcagaaggacgagaaguacuggagccgccgguacaagaacaacgaggccgccaagcgcagccgggacgcgcgccggcugaaggagaaccagaucuccguccgcgccgccuuccucgagaaggagaacgcccugcugcgccaggaggugguggcgguccggcaggagcucagccacuaccgcgccgugcugucccgguaccaggcccagcacggcgcccuguga

SEQ ID NO: 29006 - RNA, 1635 nt, Artificial Sequence
  derived and/or modified sequence opt1 from DBR1__Homo_sapiens__NP_057300
augcgcguggccgucgccggcugcugccacggggagcuggacaagaucuacgagacccucgcgcuggccgagcggcgcggccccgggccgguggaccugcuccugugcugcggcgacuuccaggccgugcggaacgaggccgaccugcgcugcauggccgucccgcccaaguaccggcacaugcagaccuucuaccgcuacuacagcggggagaagaaggcgcccgugcucacgcuguucaucggcggcaaccacgaggccuccaaccaccuccaggagcugccguacgggggcuggguggcccccaacaucuacuaccuggggcuggccggcgucgugaaguaccgcggggugcggaucggcggcaucagcgggaucuucaagucccacgacuaccggaagggccacuucgagugcccgcccuacaacagcuccaccauccgcagcaucuaccacguccggaacaucgagguguacaagcucaagcagcugaagcagcccaucgacaucuuccugucccacgacuggccccgcagcaucuaccacuacgggaacaagaagcagcuccugaagaccaaguccuucuuccggcaggagguggagaacaacacccugggcagccccgcggccuccgagcuccuggagcaccugaagcccacguacugguucagcgcccaccuccacgucaaguucgccgcccugaugcagcaccaggcgaaggacaagggccagaccgcccgcgccaccaaguuccuggcccucgacaagugccugccgcaccgggacuuccugcagauccucgagaucgagcacgaccccuccgcccccgacuaccuggaguacgacaucgaguggcugaccauccuccgcgcgacggacgaccugaucaacgugaccgggcggcuguggaacaugcccgagaacaacggccuccacgcccgcugggacuacagcgccaccgaggaggggaugaaggaggugcuggagaagcugaaccacgaccucaaggucccgugcaacuucuccgugaccgccgccugcuacgaccccagcaagccccagacgcagaugcagcugauccaccggaucaacccccagaccaccgaguucugcgcgcagcugggcaucaucgacaucaacgugcgccuccagaaguccaaggaggagcaccacgucugcggggaguacgaggagcaggacgacguggagagcaacgacuccggcgaggaccagagcgaguacaacaccgacacgagcgcccuguccagcaucaacccggacgagaucaugcuggacgaggaggaggacgaggacuccaucgugagcgcccacuccggcaugaacacccccagcgucgagcccuccgaccaggccagcgaguucuccgccagcuucuccgacgugcggauccuccccgggagcaugaucguguccagcgacgacaccgucgacuccaccaucgaccgcgagggcaagcccgggggcacgguggagagcgggaacggcgaggaccugaccaaggucccccugaagcgccucuccgacgagcacgagcccgagcagcggaagaagaucaagcgccggaaccaggcgaucuacgccgccguggacgacgacgacgacgacgccgcguga

SEQ ID NO: 29007 - RNA, 1032 nt, Artificial Sequence
  derived and/or modified sequence opt1 from DBX1__Homo_sapiens__NP_001025036
augauguuccccggccugcucgccccgcccgccggguaccccagccugcugcgccccaccccgacccucacgcugccccagucccugcagagcgcguucuccggccacagcuccuuccucguggaggaccugauccggaucagccgcccgcccgccuaccugccccgguccguccccaccgccagcauguccccgccccgccagggggcccccaccgcccucaccgacacgggcgcgagcgaccuggggucccccggccccggcagccggcgcgggggcuccccgcccaccgccuucagccccgccuccgagaccaccuuccugaaguucggggugaacgccauccucagcuccggcccccggacggagaccagccccgcgcugcugcaguccgugccgcccaagaccuucgccuuccccuacuucgaggggagcuuccagcccuucauccgcagcuccuacuucccggccagcuccagcgucgugcccauccccggcaccuucuccuggccccucgccgcccggggcaagccgcgccgggggaugcugcgccgggcgguguucagcgacguccagcgcaaggcccuggagaagauguuccagaagcagaaguacaucuccaagcccgaccggaagaagcucgccgccaagcugggccugaaggacagccaggugaagaucugguuccagaaccgccggaugaaguggcgcaacuccaaggagcgggagcuccugagcuccgggggcugccgcgagcagacgcugcccaccaagcucaacccgcaccccgaccugagcgacgugggccagaaggggcccggcaacgaggaggaggaggaggggcccggcuccccgagccaccggcuggccuaccacgcguccagcgacccccagcaccuccgcgacccccgccugcccgggccgcugccgcccucccccgcccacagcuccagccccggcaagcccagcgacuucuccgacagcgaggaggaggaggagggcgaggagcaggaggagaucaccgucuccuga

SEQ ID NO: 29008 - RNA, 1362 nt, Artificial Sequence
  derived and/or modified sequence opt1 from DCAF12__Homo_sapiens__NP_056212
auggcccgcaagguggucagccggaagcgcaaggcccccgcguccccgggcgccgggagcgacgcccagggcccccaguucgggugggaccacucccugcacaagcggaagcgccucccgcccgugaagcggagccugguguacuaccugaagaaccgcgagguccggcuccagaacgagaccuccuacagccgcgugcugcacggcuacgccgcccagcagcugcccucccuccugaaggagcgggaguuccaccuggggacccucaacaagguguucgcgagccaguggcugaaccaccgccaggucgugugcggcacgaagugcaacacccuguucguggucgacgugcagaccucccagaucaccaagauccccauccucaaggaccgggagcccggcggggugacgcagcagggcugcgggauccacgccaucgagcugaaccccagccgcacccugcucgccaccggcggggacaacccgaacucccuggccaucuaccggcugcccacccucgaccccgucugcgugggcgacgacggccacaaggacuggaucuucagcaucgcguggaucuccgacacgauggccgugagcgggucccgcgacggcagcauggggcugugggaggucaccgacgacgugcugaccaaguccgacgcccggcacaacgugagccgcguccccguguacgcccacaucacccacaaggcccucaaggacaucccgaaggaggacacgaaccccgacaacugcaaggugcgggcgcuggccuucaacaacaagaacaaggagcugggcgccgucucccucgacggcuacuuccaccuguggaaggccgagaacacccugagcaagcuccugagcaccaagcugcccuacugccgcgagaacgugugccucgccuacggguccgaguggagcguguacgcggucggcucccaggcccacgugagcuuccuggacccccggcagccguccuacaacgucaagagcgugugcucccgcgagcgggggagcggcauccgcuccgugagcuucuacgagcacaucaucaccgucgggacgggccagggcucccuccuguucuacgacauccgcgcccagcgguuccuggaggagcgccugagcgccugcuacggguccaagccccggcucgccggcgagaaccugaagcugaccaccgggaagggcuggcucaaccacgacgagaccuggcgcaacuacuucagcgacaucgacuucuuccccaacgcgguguacacgcacugcuacgacuccagcgggaccaagcuguucguggccggcggcccccugccguccgggcuccacggcaacuacgccgggcuguggagcuga

SEQ ID NO: 29009 - RNA, 1794 nt, Artificial Sequence
  derived and/or modified sequence opt1 from DCAF13__Homo_sapiens__NP_056235
augcaguggcccccgcccuggcgccggagcccccugguguccgccacgcccccgcccggccccacccgcgggcugcugugcccccggcgcgucagcgaggccggcgacuccagcaccgagggggcgcggaccggccaccgccacuacgugaccccggccgaguccgccauggaggggcggagccagccccugcccucccuccgccccgccagcccgaccaacgcccccgcgcacggccggggcuccgacugcacggccaaggagccgccccuggccaacgugugccgccagaacuacggggccgcgcaggaccccgucgagcccgccggccggcgcagcgccucccacgugaccgggagcucccugggcaaggccgagguggccugcgggcggcgcuggcggugggcggagcuccuggccgacaccagcuggucccccgccggccgcgccaccgagaugaaggucaagaugcugagccggaaccccgacaacuacgugcgcgagacgaagcucgaccugcagcgggugccgcgcaacuacgaccccgcccugcaccccuucgaggucccccgggaguacauccgcgcgcucaacgccaccaagcuggagcgcguguucgccaagccguuccuggccucccucgacggccaccgggacggggugaacugccuggccaagcaccccgagaagcuggcgaccguccucagcggcgccugcgacggggaggugcgcaucuggaaccugacccagcggaacugcauccgcacgauccaggcccacgagggcuucgugcggggcaucugcacccgcuucugcgggaccuccuucuucaccgucggcgacgacaagacggugaagcaguggaagauggacgggcccggcuacggggacgaggaggagccccugcacaccauccucggcaagaccguguacaccggcaucgaccaccacuggaaggaggccgucuucgccacgugcgggcagcaggucgacaucugggacgagcagcggaccaacccgaucugcagcaugaccuggggcuucgacagcaucuccagcgugaaguucaaccccaucgagaccuuccugcugggguccugcgcgagcgaccgcaacaucgugcucuacgacaugcggcaggccacgccccugaagaaggugauccuggacaugcgcaccaacaccaucugcuggaacccgauggaggccuucaucuucaccgccgcgaacgaggacuacaaccucuacacguucgacaugcgggcccuggacacccccgugaugguccacauggaccacguguccgccguccuggacguggacuacagccccaccggcaaggaguucguguccgccagcuucgacaaguccauccgcaucuuccccgucgacaagagccggucccgcgagguguaccacaccaagcggaugcagcacgugaucugcgucaaguggacgagcgacuccaaguacaucaugugcgggagcgacgagaugaacauccgccucuggaaggccaacgcguccgagaagcugggcgugcugaccagccgggagaaggccgccaaggacuacaaccagaagcucaaggagaaguuccagcacuacccgcacaucaagcgcaucgcccggcaccgccaccuccccaaguccaucuacagccagauccaggagcagcgcaucaugaaggaggcccggcgccggaaggaggugaaccgcaucaagcacuccaagcccggcagcgucccccuggugagcgagaagaagaagcacguggucgcgguggugaaguga

SEQ ID NO: 29010 - RNA, 1362 nt, Artificial Sequence
  derived and/or modified sequence opt1 from DCAF17__Homo_sapiens__NP_001158293
augggccccacccgcaagccgaacgugugcagccggcugucccgccgggcccucgggugcuucagccgcgacgccggcgucgugcagcggaccaaccuggggauccugcgcgcgcucgugugccaggaguccacgaaguucaagaacgucuggaccacccacagccggucccccaucgccuacgagcgcggccggaucuacuucgacaacuaccgccggugcgugagcuccguggccagcgagccccgcaagcuguacgagaugcccaagugcuccaagagcgagaagaucgaggacgcccugcucugggagugcccggucggggacauccugcccaacuccagcgacuacaaguccagccugaucgcccucaccgcgcacaacuggcugcugcggaucuccgccacgaccggcaagauccucgagaagaucuaccuggcccccuacugcaaguuccgcuaccugagcugggacacgccccaggaggugaucgccgugaaguccgcgcagaaccggggcagcgccgucgcccgccaggccgggauccagcagcacgugcuccuguaccuggccguguuccggguccucccguucucccuggugggcauccuggagaucaacaagaagaucuucgggaacgugaccgacgcgacccucagccacggcauccugaucgucauguacagcuccgggcuggugcgccucuacagcuuccagaccaucgccgagcaguucaugcagcagaagcuggaccugggcugcgccugccgguggggcgggaccaccggcacggugggggaggcccccuucggcauccccugcaacaucaagaucaccgacaugcccccgcuccuguucgaggucuccagccuggagaacgccuuccagaucggcgggcaccccuggcacuacaucgugacccccaacaagaagaagcagaagggcguguuccacaucugcgcgcucaaggacaacucccugaacgagaacguccugaccgugacggccagcgggcgcguggucaagaaguccuucaaccuccuggacgacgaccccgagcaggagaccuucaagaucguggacuacgaggacgagcuggaccuccugagcgucguggccgugacccagaucgacgccgagggcaaggcccaccuggacuuccacugcaacgaguacgggacccuccugaaguccaucccgcuggucgagagcugggacgugacguacucccacgagguguacuucgaccgggaccucguccugcacaucgagcagaagcccaaccgcguguucagcugcuacguguaccagaugaucugcgacaccggcgaggaggaggagaccaucaaccgcuccugcuga

SEQ ID NO: 29011 - RNA, 1470 nt, Artificial Sequence
  derived and/or modified sequence opt1 from DCAF4__Homo_sapiens__NP_001156980
augaacaagagccgguggcagucccggcgccggcacggccgccggagccaccagcagaaccccugguuccgccugcgggacuccgaggaccgcagcgacucccgggccgcccagccggcgcacgacagcgggcacggcgacgacgagucccccagcaccuccagcgggaccgccggcacguccagcgugcccgagcuccccggguucuacuucgacccggagaagaagcgcuacuuccggcugcugcccggccacaacaacugcaacccccucaccaaggaguccauccgccagaaggagauggagagcaagcggcugcgccugcuccaggaggaggaccggcgcaagaagaucgcccggaugggcuucaacgccuccagcaugcugcgcaagucccagcugggguuccucaacgucaccaacuacugccaccuggcccacgagcugcggcucagcugcauggagcgcaagaaggugcagauccgguccauggaccccagcgcgcuggccagcgaccgcuucaaccugauccucgccgacaccaacuccgaccgccuguucacggugaacgacgucaaggugggcgggagcaaguacggcaucaucaaccugcagucccucaagaccccgacccugaagguguucaugcacgagaaccuguacuucaccaaccggaaggucaacagcgugugcugggccucccucaaccaccuggacagccacauccugcucugccugauggggcuggcggagacgcccggcugcgccacccuccugcccgccucccuguucgugaacagccaccccgccggcaucgaccgcccggggaugcucugcuccuuccggauccccggcgccuggagcugcgcguggucccugaacauccaggccaacaacugcuucagcaccgggcugucccgccggguccuccugaccaacguggugacgggccaccgccagagcuucggcaccaacuccgacguccuggcgccccuccuguucaacgggugccggagcggcgagaucuucgccaucgaccugcgcugcgggaaccagggcaagggguggaaggccacccggcuguuccacgacuccgccgugaccagcgugcgcauccugcaggacgagcaguaccugauggccuccgacauggccggcaagaucaagcucugggaccugcggacgaccaagugcguccgccaguacgagggccacgugaacgaguacgccuaccugccccuccacgugcacgaggaggaggggauccuggucgccgugggccaggacugcuacacccggaucuggagccugcacgacgcgcgccuccugcggaccaucccgagccccuaccccgccuccaaggccgacauccccagcguggccuucuccagccgccucgggggcucccgcggggccccgggccugcucauggcggucggccaggaccuguacugcuacagcuacuccuga

SEQ ID NO: 29012 - RNA, 2583 nt, Artificial Sequence
  derived and/or modified sequence opt1 from DCAF5__Homo_sapiens__NP_001271136
auggagcaggccauccacagccgcgugaagcccauccagcugaagggcgagcaccacuccaacaucuucugccucgccuucaacagcgggaacaccaaggucuucuccggcgggaacgacgagcaggucauccugcacgacguggagagcuccgagacccuggacgucuucgcgcacgaggacgccguguacggccucagcguguccccggucaacgacaacaucuucgccagcuccagcgacgacgggcgggugcugaucugggacauccgcgagagcccccacggcgagcccuucugccuggccaacuaccccuccgccuuccacuccgugauguucaacccggucgagccccggcuccuggcgacggccaacagcaaggagggcguggggcugugggacauccgcaagccccaguccagccuccugcgguacggcgggaaccugucccuccagagcgccauguccgugcgcuucaacagcaacggcacccagcugcuggcccuccggcgccggcugcccccgguccuguacgacauccacagccgccuccccguguuccaguucgacaaccagggguacuucaacuccugcaccaugaaguccugcugcuucgcgggcgaccgggaccaguacauccuguccggcagcgacgacuucaaccuguacauguggcgcauccccgccgaccccgaggccgggggcaucgggcggguggucaacggcgccuucauggugcucaagggccaccgcuccaucgugaaccagguccgguucaacccgcacaccuacaugaucugcagcuccgggguggagaagaucaucaagaucuggagccccuacaagcagcccggcugcacgggggaccuggacggccgcaucgaggacgacagccggugccuguacacccacgaggaguacaucagccucgugcugaacuccgggagcggccugucccacgacuacgccaaccagagcgugcaggaggacccccgcaugauggcguucuucgacucccucgugcggcgcgagaucgagggcuggagcuccgacagcgacuccgaccugagcgagagcaccauccugcagcuccacgccgggguguccgagcggagcggcuacaccgacuccgagagcuccgccagccugccgcgcuccccgccgcccacggucgacgagagcgccgacaacgccuuccaccuggggccccuccgcgugaccaccaccaacacggucgcguccaccccgcccaccccgaccugcgaggacgccgccagccggcagcagcgccuguccgcccugcggcgcuaccaggacaagcggcuccuggcccugagcaacgaguccgacagcgaggagaacgugugcgagguggagcucgacacggaccuguucccccgcccccggucccccagccccgaggacgaguccagcagcuccagcuccagcuccagcuccgaggacgaggaggagcugaacgagcgccgggcgagcaccuggcagcgcaacgccaugcggcgccggcagaagaccacccgcgaggacaagcccuccgcccccaucaagcccacgaacaccuacaucggcgaggacaacuacgacuacccccagaucaaggucgacgaccucagcuccagccccaccuccagccccgagcgguccaccagcacgcuggagauccagcccucccgcgccagcccgaccuccgacaucgagagcguggagcggaagaucuacaaggccuacaaguggcugcgcuacagcuacaucuccuacagcaacaacaaggacggggagaccucccucgugaccggcgaggcggacgagggccgggccgggacgagccacaaggacaaccccgcccccuccagcuccaaggaggccugccugaacaucgcgauggcccagcgcaaccaggaccugcccccggagggcugcagcaaggacaccuucaaggaggagacgccccgcacccccuccaacgggcccggccacgagcacagcucccacgccugggccgaggucccggaggggaccagccaggacaccggcaacuccggcagcguggagcaccccuucgagaccaagaagcucaacgggaaggcccuguccagccgggcggaggagccgcccuccccgcccgugcccaaggccagcggcuccacccugaacagcgggagcggcaacugcccccgcacgcaguccgacgacagcgaggagcggucccuggagaccaucugcgccaaccacaacaacggccgccuccacccccggccgccccacccccacaacaacgggcagaaccugggcgagcuggaggucguggccuacagcucccccgggcacagcgacaccgaccgcgacaacuccagccucaccggcacccugcugcacaaggacugcugcggguccgagauggccugcgagacgcccaacgcgggcacccgggaggaccccaccgacaccccggccacggacagcucccgcgccgugcacggccacagcgggcucaagcggcagcgcaucgagcuggaggacaccgacuccgagaacagcuccagcgagaagaagcugaagaccuga

SEQ ID NO: 29013 - RNA, 2583 nt, Artificial Sequence
  derived and/or modified sequence opt1 from DCAF6__Homo_sapiens__NP_001017977
augagccgcggcggguccuacccccaccuccugugggacgugcggaagcgcagccugggccuggaggacccgucccggcuccgcagccgguaccuggggcgccgggaguucauccagcgccugaagcucgaggccacccugaacguccacgacggcugcgugaacaccaucugcuggaacgacacgggggaguacauccuguccggcagcgacgacaccaagcucgugaucuccaaccccuacagccggaagguccugaccaccauccgcuccggccaccgggccaacaucuucagcgcgaaguuccugcccugcacgaacgacaagcagaucguguccugcagcggggacggcgugaucuucuacaccaacgucgagcaggacgccgagaccaaccgccagugccaguucacgugccacuacgggaccaccuacgagaucaugaccgugcccaacgacccguacaccuuccucuccugcggcgaggacgggacggugcggugguucgacacccgcaucaagaccagcugcaccaaggaggacugcaaggacgacauccugaucaacugccggcgcgccgccacguccgucgccaucugcccgcccauccccuacuaccuggcggugggcugcagcgacuccagcgugcggaucuacgaccgccggaugcucggcacccgcgccaccgggaacuacgccggccgggggaccacgggcauggucgcccgcuucauccccucccaccugaacaacaagagcugccgcgugaccagccugugcuacuccgaggacggccaggagauccucgugagcuacuccagcgacuacaucuaccuguucgaccccaaggacgacaccgcgcgggagcugaagacccccuccgccgaggagcgccgggaggagcuccgccagcccccggucaagcggcugcgccugcgcggggacuggagcgacacgggcccccgggcccggcccgaguccgagcgcgagcgggacggggagcagagccccaacgugucccucaugcagcgcaugagcgacaugcugucccggugguucgaggaggccagcgagguggcccaguccaaccgcggccgggggcgcagccggccgcgcggcggcaccucccagagcgacaucuccacccugcccaccguccccagcucccccgaccucgaggugagcgagacggcgauggagguggacaccccggccgagcaguuccugcagcccagcaccuccagcaccauguccgcccaggcccacagcacguccagccccaccgagagcccccacuccaccccgcugcucuccagccccgacuccgagcagcggcagagcgucgaggccuccgggcaccacacccaccaccagagcgacaacaacaacgagaagcugucccccaagcccggcacgggggagccggugcugagccuccacuacuccaccgagggcaccaccaccagcacgaucaagcugaacuucaccgacgaguggagcuccaucgcgagcuccagccgcgggaucggcucccacugcaagagcgagggccaggaggaguccuucgugccccagagcuccguccagcccccggagggggacagcgagaccaaggcccccgaggaguccagcgaggacgugaccaaguaccaggagggcgucuccgccgagaaccccguggagaaccacaucaacaucacgcagagcgacaaguucaccgccaagccccuggacuccaacagcggggagcgcaacgaccucaaccuggaccgguccugcggcgugccggaggagagcgccuccagcgagaaggcgaaggagcccgagaccagcgaccagaccuccacggagagcgccaccaacgagaacaacaccaaccccgagccccaguuccagaccgaggccacggggccguccgcccacgaggagaccagcacccgcgacuccgcccugcaggacaccgacgacagcgacgacgaccccguccucauccccggcgcgcgguaccgcgccggccccggggaccggcgcuccgccguggcccggauccaggaguucuuccgccggcgcaaggagcggaaggagauggaggagcuggacacgcugaacauccgccggccgcucgugaagauggucuacaagggccaccgcaacagccggaccaugaucaaggaggcgaacuucuggggcgccaacuucgugauguccgggagcgacugcggccacaucuucaucugggaccgccacaccgccgagcaccugaugcugcucgaggccgacaaccacguggucaacugccugcagccccaccccuucgaccccauccuggccuccagcgggaucgacuacgacaucaagaucugguccccgcucgaggagagccggaucuucaaccgcaagcuggcggacgaggugaucacccggaacgagcugaugcuggaggagacgcgcaacaccaucaccgugcccgccuccuucaugcuccggaugcuggccagccugaaccacauccgcgccgaccgccucgagggcgaccgguccgaggggagcggccaggagaacgagaacgaggacgaggaguga

SEQ ID NO: 29014 - RNA, 1029 nt, Artificial Sequence
  derived and/or modified sequence opt1 from DCAF7__Homo_sapiens__NP_005819
augagccugcacggcaagcgcaaggagaucuacaaguacgaggcccccuggaccguguacgccaugaacugguccguccggccggacaagcgcuuccggcucgcgcuggggagcuucguggaggaguacaacaacaaggugcagcuggucggccucgacgaggaguccagcgaguucaucugccgcaacaccuucgaccaccccuaccccacgaccaagcugauguggauccccgacaccaaggggguguacccggaccugcucgccaccuccggcgacuaccugcggguguggcgcgucggggagacggagacccggcuggagugccuccugaacaacaacaagaacagcgacuucugcgcgccccugaccuccuucgacuggaacgagguggaccccuaccuccugggcaccagcuccaucgacacgaccugcaccaucuggggccuggagaccggccaggugcucgggcgcgucaaccuggugagcgggcacgugaagacgcagcugaucgcccacgacaaggaggucuacgacaucgccuucucccgggccggcgggggccgcgacauguucgccagcgugggcgccgacggguccgugcggauguucgaccuccgccaccuggagcacagcaccaucaucuacgaggacccccagcaccacccgcugcuccggcugugcuggaacaagcaggaccccaacuaccuggccaccauggcgauggacggcauggaggucgugauccucgacgugcgcguccccugcacccccguggcccggcugaacaaccaccgcgccugcgugaacgggaucgccugggccccgcacuccagcugccacaucugcacggcggccgacgaccaccaggcccugaucugggacauccagcagaugccccgggccaucgaggaccccauccucgccuacaccgcggagggcgagaucaacaacguccagugggccuccacccagcccgacuggaucgccaucugcuacaacaacugccuggagauccugcgcguguga

SEQ ID NO: 29015 - RNA, 1794 nt, Artificial Sequence
  derived and/or modified sequence opt1 from DCAF8__Homo_sapiens__NP_056541
augagcuccaagggcagcuccaccgacgggcgcaccgaccuggccaacggcagccuguccagcucccccgaggagaugagcggggccgaggagggccgggagacguccagcgggaucgagguggaggcguccgaccugagccugucccucaccggcgacgacggcgggccgaaccgcaccagcaccgagucccggggcacggacaccgagagcuccggggaggacaaggacagcgacuccauggaggacaccggccacuacagcaucaacgacgagaaccgcguccacgaccggagcgaggaggaggaggaggaggaggaggaggaggaggaggagcagccccgccggcgcgugcagcggaagcgcgccaaccgggaccaggacuccagcgacgacgagcgcgcccuggaggacuggguguccagcgagaccuccgcccugccccggccccgcuggcaggcccucccggcgcugcgggagcgcgagcuggggagcuccgcccgguucgucuacgaggccugcggcgcccgcguguucgugcagcgguuccgccuccagcacggccuggaggggcacacgggcugcgucaacacccugcacuucaaccagcgggggaccuggcucgcgagcggcuccgacgaccugaaggugguggucugggacugggugcgccgccagcccgugcuggacuucgagagcggccacaaguccaacgucuuccaggccaaguuccuccccaacagcggggacuccacccuggccaugugcgcccgggacggccaggugcgcguggccgagcugagcgcgacgcagugcugcaagaacaccaagcgggucgcccagcacaagggggccucccacaagcucgcccuggagcccgacagcccgugcaccuuccuguccgccggcgaggacgcggugguguucaccaucgaccuccgccaggaccggcccgccagcaagcuggucgugacgaaggagaaggagaagaagguggggcuguacaccaucuacgucaaccccgccaacacccaccaguucgccgugggcggccgcgaccaguucgugcggaucuacgaccagcgcaagaucgacgagaacgagaacaacgggguccucaagaaguucugcccccaccaccuggugaacuccgagagcaaggccaacaucacgugccuggucuacagccacgacggcaccgagcuccuggcguccuacaacgacgaggacaucuaccuguucaacagcucccacagcgacggggcccaguacgugaagcgguacaagggccaccgcaacaacgccaccgugaagggggucaacuucuacggcccgaaguccgaguucguggugagcggcuccgacugcgggcacaucuuccucugggagaaguccagcugccagaucauccaguucauggagggcgacaagggcggggucgugaacugccuggagccccacccccaccuccccgugcuggccaccagcgggcuggaccacgacgucaagaucugggccccgaccgcggaggccuccacggagcugaccggccucaaggacgugaucaagaagaacaagcgggagcgcgacgaggacagccugcaccagaccgaccuguucgacucccacaugcucugguuccugaugcaccaccuccggcagcgccggcaccaccgccgguggcgcgagcccggcgugggggccaccgacgccgacagcgacgagucccccagcuccagcgacacgagcgacgaggaggagggccccgaccggguccagugcaugccguccuga

SEQ ID NO: 29016 - RNA, 735 nt, Artificial Sequence
  derived and/or modified sequence opt1 from DCANP1__Homo_sapiens__NP_570900
augcacuacggcgccgccacccacauccagaacagccgcucccacgggcuggagaccgugcccggccaccagcggcucgagcgcggggcgggcggggagacgccggaguuccccggcugccacagccccgcgcccccggagaacuucggcaacgagcugcugccccucuccgcgccccugcaggggcugagcgagggccucuacccgcccgggcggaacaagacccugcccgccggcguccugcgcgagggggccgugcaguuccuccaccggggccugugcaacuccaaccugagcuccgaggccagcgcccgccccuccggcacccaggacgagcuccacagcucccggcgcaagaccgggcagacgcggcgcgagggcgcccggaagcaccuggugugcagcuuccgccuguaccccuucaccguccacaccguguccccggggaacagccaccucgcccuguaccagguguucaaggccgucaagcugugccccuccgagaccagcuucuuccucucccgcaagagccugaaguccagcgaccccuggcacccgcccagccugucccccaacagcuggaaccggcaggccggcuuccgggccugguccagccaccucaucucccugagccugacgugcuccgacagccagucccgccgggugagcuccagccagcagccgccccuccacucccugagcucccaccgccgggccgcccacgugcccgaguga

SEQ ID NO: 29017 - RNA, 1620 nt, Artificial Sequence
  derived and/or modified sequence opt1 from DCBLD1__Homo_sapiens__NP_775945
auggugcccggcgcccgcgggggcggggcccuggcgcgggccgccggccgcgggcuccuggcccugcuccuggccgucagcgcgccgcugcggcuccaggccgaggagcugggcgacggcugcgggcaccuggugaccuaccaggacuccggcaccaugacgagcaagaacuaccccgggaccuaccccaaccacaccgugugcgagaagaccaucacgguccccaagggcaagcgccucauccugcggcugggggaccucgacaucgagucccagaccugcgccagcgacuaccugcuguucaccuccagcuccgaccaguacggcccguacugcggcagcaugaccgugcccaaggagcuccugcugaacacguccgaggugaccguccgcuucgagagcgggucccacaucagcggccggggguuccuccugaccuacgccuccagcgaccaccccgaccugaucacgugccucgagcgcgcgucccacuaccugaagaccgaguacagcaaguucugccccgccggcugccgggacguggccggcgacaucuccgggaacaugguggacggcuaccgcgacaccagccugcucugcaaggccgccauccacgcggggaucaucgccgacgagcugggcgggcagaucuccguccugcagcggaagggcaucagccgcuacgagggcauccucgccaacggggugcugagccgggacggcucccugagcgacaagcgcuuccucuucaccuccaacgggugcagccggucccugagcuucgagccggacggccagauccgcgccuccagcuccuggcagagcgugaacgaguccggggaccagguccacuggagccccggccaggcccggcugcaggaccagggccccuccugggcgagcggggacuccagcaacaaccacaagccccgcgaguggcucgagaucgaccugggcgagaagaagaagaucaccgggauccggacgaccggcuccacccagagcaacuucaacuucuacgugaaguccuucgugaugaacuucaagaacaacaacagcaaguggaagaccuacaaggggaucgucaacaacgaggagaagguguuccagggcaacagcaacuuccgcgacccggugcagaacaacuucaucccgcccaucgucgcccgguacgugcgcguggucccccagacguggcaccagcgcaucgcccugaagguggagcucaucggcugccagaucacccaggggaacgacucccugguguggcggaagaccagccaguccaccagcgucuccacgaagaaggaggacgagaccaucacccgccccauccccagcgaggagaccuccacgggcaucaacaucaccaccguggccaucccccugguccuccugguggugcuggucuucgccgggaugggcaucuucgcggccuuccggaagaagaagaagaagggcagccccuacggguccgccgaggcccagaagaccgacugcuggaagcagaucaaguacccguucgcccgccaccagagcgcggaguucacgaucuccuacgacaacgagaaggagaugacccagaagcucgaccugaucaccagcgacauggccggcuga

SEQ ID NO: 29018 - RNA, 2328 nt, Artificial Sequence
  derived and/or modified sequence opt1 from DCBLD2__Homo_sapiens__NP_563615
auggccagccgcgccgugguccgggcgcgccggugcccccagugcccccaggugcgcgccgccgccgccgcgcccgccugggccgcccugccccucucccggagccugcccccgugcuccaacagcuccagcuucuccaugccccuguuccuccugcugcuccuggugcugcuccugcugcucgaggacgcgggcgcccagcagggggacggcugcgggcacaccguccugggccccgagagcgggacccugacguccaucaacuacccccagaccuacccgaacagcaccgugugcgagugggagauccgcgugaagaugggcgagcggguccgcaucaaguucggcgacuucgacaucgaggacuccgacagcugccacuucaacuaccuccggaucuacaacgggaucggcgugucccgcaccgagaucgggaaguacugcggccuggggcugcagaugaaccacagcaucgaguccaagggcaacgagaucacgcuccuguucaugagcggcauccacguguccgggcggggcuuccuggccagcuacuccgucaucgacaagcaggaccucaucacgugccuggacaccgccagcaacuuccuggagcccgaguucagcaaguacugccccgccgggugccuccugcccuucgcggagaucuccggcaccaucccgcacggcuaccgcgacagcagcccccugugcauggccggggugcacgccggcguggucuccaacacccucgggggccagaucuccguggugaucagcaaggggauccccuacuacgaguccagccuggccaacaacgucaccuccguggugggccaccugagcaccucccucuucaccuucaagacgagcggcugcuacgggacccugggcauggaguccggggucaucgccgacccccagaucaccgcgagcuccgugcuggaguggaccgaccacacgggccaggagaacagcuggaagccgaagaaggcccggcucaagaagcccgggccgcccugggccgccuucgccaccgacgaguaccaguggcugcagaucgaccugaacaaggagaagaagaucaccggcaucaucaccacgggcuccaccaugguggagcacaacuacuacgucagcgcguaccgcauccucuacuccgacgacgggcagaaguggaccguguaccgggagccgggcguggagcaggacaagaucuuccaggggaacaaggacuaccaccaggacguccgcaacaacuuccugccgcccaucaucgcccgguucauccgcgugaaccccacccaguggcagcagaagaucgccaugaagauggagcugcucggcugccaguucauccccaaggggcggccgcccaagcugacgcagccgccgccgccccgcaacagcaacgaccugaagaacaccaccgccccgcccaagaucgccaagggccgggcgcccaaguucacccagccccuccagccccgcagcuccaacgaguuccccgcccagacggagcagaccaccgccagccccgacauccgcaacaccacggucacccccaacgugaccaaggacguggcccuggcggccguccuggugcccgugcucgucauggugcugaccacgcugauccucauccuggugugcgccuggcacuggcggaaccgcaagaagaagaccgagggcaccuacgaccugcccuacugggaccgggccgggugguggaagggcaugaagcaguuccugcccgccaaggcggucgaccacgaggagacccccgugcgcuacuccagcuccgaggugaaccaccucagcccccgggaggucaccacggugcugcaggccgacuccgccgaguacgcccagccccuggucgggggcaucgugggcacccuccaccagcgcagcaccuucaagcccgaggaggggaaggaggccggcuacgcggaccuggaccccuacaacuccccggggcaggagguguaccacgccuacgccgagccccugcccaucaccggccccgaguacgccacgccgaucaucauggacaugagcgggcaccccaccaccuccgugggccagcccagcaccuccacguucaaggccaccggcaaccagcccccgccccucgucgggaccuacaacacccugcugagccggacggacuccugcagcuccgcgcaggcccaguacgacacccccaaggccggcaagccggggcuccccgcccccgacgagcugguguaccaggugccccagagcacccaggaggucagcggcgcggggcgcgacggcgagugcgacguguucaaggagauccuguga

SEQ ID NO: 29019 - RNA, 4344 nt, Artificial Sequence
  derived and/or modified sequence opt1 from DCC__Homo_sapiens__NP_005206
auggagaacagccugcgcugcguguggguccccaagcucgccuucgugcuguucggcgccucccuguucagcgcgcaccuccaggugaccggguuccagaucaaggccuucaccgcccugcgguuccuguccgagccgagcgacgccgucacgaugcgcggcgggaacgugcuccuggacugcuccgccgagagcgaccggggcgugcccgucaucaaguggaagaaggacgggauccaccuggcgcucggcauggacgagcgcaagcagcagcuguccaacggcagccugcucauccagaacauccugcacucccggcaccacaagcccgacgaggggcuguaccagugcgaggccagccucggcgacuccgggagcaucaucucccgcaccgccaagguggccguggcgggcccccugcgguuccugagccagaccgaguccgucaccgccuucaugggggacacggugcuccugaagugcgaggugaucggcgagccgaugcccaccauccacuggcagaagaaccagcaggaccugacccccauccccggcgacagccgcgucguggugcucccguccggggcccugcagaucagccggcugcagcccggcgacaucgggaucuaccgcugcuccgcccggaaccccgccagcagccgcaccggcaacgaggcggagguccggauccucuccgaccccggccugcaccgccagcuguacuuccuccagcggccgagcaacgugguggccaucgaggggaaggacgccguccuggagugcugcguguccggcuacccgccgcccagcuucacguggcugcgcggggaggaggugauccagcuccgguccaagaaguacagccugcugggcggguccaaccuccugaucagcaacgucaccgacgacgacuccggcauguacacgugcguggugaccuacaagaacgagaacaucagcgccuccgccgagcugacgguccucgugccgcccugguuccugaaccaccccagcaaccuguacgcguacgaguccauggacaucgaguucgagugcaccgucagcggcaagcccgugcccaccgugaacuggaugaagaacggggacgucgugauccccuccgacuacuuccagaucgugggcgggagcaaccuccgcauccugggcgucgugaaguccgacgagggguucuaccagugcguggccgagaacgaggccggcaacgcccagaccagcgcccagcugaucguccccaagcccgcgauccccuccagcagcgugcuccccuccgcgccccgggacgugguccccgugcuggugagcucccgcuucguccggcugagcuggcgcccgcccgccgaggccaagggcaacauccagacguucaccguguucuucucccgcgagggggacaaccgggagcgcgcccucaacaccacccagcccggcagccugcagcugaccguggggaaccucaagccggaggccauguacaccuuccgggucguggccuacaacgaguggggccccggggaguccagccagcccaucaagguggccacccagcccgagcugcaggucccgggccccguggagaaccugcaggccguguccaccagccccacguccauccugaucaccugggagcccccggcguacgccaacggccccguccagggguaccgccucuucugcaccgaggugagcaccggcaaggagcagaacaucgagguggacgggcuguccuacaagcuggagggccucaagaaguucacggaguacagccugcgguuccuggccuacaaccgcuacggccccggggucuccaccgacgacaucaccguggugacccucagcgacguccccuccgccccgccccagaacgugagccuggagguggucaacagccgguccaucaaggugagcuggcugcccccgcccuccggcacgcagaacggguucaucaccggcuacaagauccgccaccggaagaccacccgccgcggggagauggagacgcucgagcccaacaaccugugguaccuguucaccggccucgagaagggcagccaguacuccuuccaggugagcgccaugaccgucaacgggaccggcccgcccuccaacugguacaccgcggagacgcccgagaacgaccuggacgagagccaggugcccgaccagcccuccagccugcacgugcgcccccagaccaacugcaucaucauguccuggaccccgccccucaaccccaacaucgucgugcggggguacaucaucggcuacggggugggcagcccguacgccgagaccguccgcguggacuccaagcagcgguacuacagcaucgagcgccuggaguccagcucccacuacgugaucagccugaaggccuucaacaacgccggcgagggggucccccucuacgaguccgccacgacccggagcaucaccgaccccaccgaccccguggacuacuacccgcugcuggacgacuuccccacgagcgugcccgaccucuccacccccaugcugccgcccgucggcgugcaggcgguggcccugacccacgacgccguccgcgugagcugggccgacaacuccguccccaagaaccagaagaccagcgaggugcggcucuacacggugcgcuggcgcaccuccuucagcgccuccgcgaaguacaagagcgaggacaccaccucccugagcuacacggccaccgggcugaagcccaacaccauguacgaguucuccgucauggugaccaagaaccggcgcagcuccacguggagcaugaccgcccacgccaccaccuacgaggcggccccgacguccgcccccaaggaccucaccgugaucacccgggagggcaagccccgcgccgucaucgugagcuggcagcccccgcuggaggccaacgggaagaucaccgcguacauccuguucuacacgcucgacaagaacauccccaucgacgacuggaucauggagaccaucuccggcgaccggcugacccaccagaucauggaccugaaccucgacaccauguacuacuuccgcauccaggcccggaacagcaagggcguggggccccuguccgaccccauccuguuccgcacgcucaaggucgagcacccggacaagauggccaacgaccagggccggcacggggacggcggguacuggcccguggacaccaaccugaucgaccgcagcacccugaacgagccgcccaucggccagaugcacccgccccacggcagcgugacgccccagaagaacuccaaccuccuggucaucaucguggugaccgucggggugaucaccgugcuggucguggugaucgucgccgugaucugcacccggcgcagcuccgcccagcagcggaagaagcgcgcgacccacagcgccggcaagcggaaggggucccagaaggaccuccggccgcccgaccuguggauccaccacgaggagauggagaugaagaacaucgagaagcccagcggcaccgaccccgccggccgggacucccccauccagagcugccaggaccugacgcccgugucccacagccaguccgagacccagcucgggagcaaguccaccagccacuccggccaggacaccgaggaggccgggagcuccaugagcacgcuggagcgcucccuggccgcgcggcgcgcgccccgggccaagcucaugauccccauggacgcccagagcaacaacccggccgucgugagcgccauccccgugcccacccuggaguccgcccaguaccccggcauccugccgagcccgaccugcggguacccccacccccaguucacccuccgccccguccccuuccccacgcuguccguggaccgcggcuucggcgccgggcggagccaguccgugagcgagggccccaccacccagcagccgcccaugcugccgcccucccagcccgagcacagcuccagcgaggaggcccccucccgcaccauccccacggcgugcguccggcccacccacccgcuccgcagcuucgccaacccccugcugccgccgcccauguccgccaucgagcccaaggugcccuacacgccccuccugagccagcccgggcccacccugcccaagacccacgugaagaccgccucccucggccuggccgggaaggcgcggagcccgcugcuccccgucuccgugcccaccgcccccgaggugagcgaggagucccacaagccgaccgaggacagcgccaacgucuacgagcaggacgaccugagcgagcagauggccucccuggagggccucaugaagcagcugaacgccaucacgggcagcgcguucuga

SEQ ID NO: 29020 - RNA, 1095 nt, Artificial Sequence
  derived and/or modified sequence opt1 from DCDC2C__Homo_sapiens__NP_001274373
augggcacccgcgggcccagcgccccgguggacaccacgcccgccaagaccaucgucguguaccggaacggcgaccccuucuacguggggaagaaguucguccugucccgccggcgcgcggccaccuucgaggcccuccuggagcagcugaccgagcaggucgacgugcccuucggcgugcggcgccucuucacgccgacccgggggcaccgcgugcugggccuggacgcccuccaggccggcgggaaguacguggcggccggccgggagcgcuucaaggagcuggacuacauccacaucgucccccggaagcccgccaagauccgcaagcugaaggagaucaagcccguggugcacugcgacaucaacgucccgagcaaguggcagaccuaccaccggaucucccgccacaucaacguguucaccaacgggcggcuguucaucccgcccgccaagaucaucauccccaaguucagccuguccgacugggacaucgugcuggcgacgaucggcgagaaggucuucccccucgggggcgugcgcaagcuguucaccaugaacggccaccuccucggggacagcaaggaccugcaggacaaccacuucuacguggccgucggccuggagaccuucaaguacuuccccuacuggaaguccccgcgggugcccagcgaggugcagcagcgcuacgccaacgucgagaagaacucccagcggaagaagaagguggacagcaaggggaaggagcccugcaaguacgacggcaucccgcccaagacccaggacuccguguacuacgccaaggaggagaagaagaagacgcucgccgagccccugguccagcgcggcgcggagggggacguguacaaggcccccacccccagcaaggagacccagggcgcccuggacgucaaggaggagcacaacgugcagcucgaggugcccgucgaccagcggcaggccgagaucgugaaggaggacgaggagauccacgagaacacccccgacuucgaggggaacaaggacaaggaggacgcccgccugugcgaggacguggagcgcaagauggcgcgggaguggaagccggucgacuga

SEQ ID NO: 29021 - RNA, 1431 nt, Artificial Sequence
  derived and/or modified sequence opt1 from DCDC2__Homo_sapiens__NP_057440
augagcggcuccagcgcccgcuccagccaccugucccagcccguggucaagagcgugcucguguaccggaacggggacccguucuacgccggccgccgggucgugauccacgagaagaagguguccagcuucgaggucuuccugaaggaggugaccgggggcgugcaggcgcccuucggggccguccgcaacaucuacacgccccggacgggccaccgcauccggaagcuggaccagauccaguccggcgggaacuacguggccggcgggcaggaggccuucaagaagcucaacuaccuggacaucggcgagaucaagaagcgccccauggagguggucaacaccgaggugaagccggugauccacagccggaucaacgucuccgcccgcuuccggaagccccugcaggagcccugcaccaucuuccucaucgcgaacggggaccugaucaaccccgccagccgccugcucaucccgcggaagacccugaaccagugggaccacgugcugcagauggugacggagaagaucacccuccgcuccggcgccguccaccggcuguacacccuggagggcaagcucguggagagcggggccgagcuggagaacggccaguucuacguggcggucgggcgcgacaaguucaagaagcugcccuacuccgagcuccuguucgacaagagcaccaugcggcgccccuucggccagaaggccuccagccugcccccgaucgugggcucccgcaagagcaaggggagcggcaacgaccggcacuccaagagcacggugggguccagcgacaacuccagcccccagccccucaagcggaagggcaagaaggaggacgucaacuccgagaagcugaccaagcugaagcagaacgugaagcucaagaacagccaggagaccauccccaacuccgacgaggggaucuucaaggccggcgccgagcgcagcgagacccgcggcgccgcggagguccaggaggacgaggacacccagguggaggugccggucgaccagcggcccgccgagaucguggacgaggaggaggacggggagaaggccaacaaggacgccgagcagaaggaggacuucuccggcaugaacggggaccuggaggaggagggcgggcgcgaggccaccgacgcgcccgagcaggucgaggagauccuggaccacagcgagcagcaggcccggcccgcccgcgugaacggcggcaccgacgaggagaacggggaggagcuccagcaggucaacaacgagcugcagcuggugcucgacaaggagcggaagucccagggcgccgggagcggccaggacgaggccgacguggacccgcagcgcccgccccggcccgaggugaagaucaccucccccgaggagaacgagaacaaccagcagaacaaggacuacgcggccguggccuga

SEQ ID NO: 29022 - RNA, 333 nt, Artificial Sequence
  derived and/or modified sequence opt1 from DCD__Homo_sapiens__NP_444513
augcgcuucaugacccuccuguuccugaccgcccuggccggcgcgcucgugugcgccuacgaccccgaggccgccagcgccccgggguccggcaaccccugccacgaggcgagcgccgcccagaaggagaacgccggggaggaccccggccuggcgcggcaggcccccaagccgcgcaagcagcgguccagccugcucgagaaggggcuggacggcgccaagaaggccgucggcgggcugggcaagcucgggaaggacgccguggaggaccuggaguccgugggcaagggggcgguccacgacgugaaggacgugcuggacagcguccucuga

SEQ ID NO: 29023 - RNA, 9897 nt, Artificial Sequence
  derived and/or modified sequence opt1 from DCHS1__Homo_sapiens__NP_003728
augcagaaggagcugggcaucgugcccagcugcccggggaugaaguccccccgcccccaccuccugcugccccuccugcugcuccugcugcuccugcugggcgccggggucccgggcgccugggggcaggcgggcagccucgaccugcagaucgacgaggagcagcccgccggcacccugaucggggacaucuccgccggccuccccgccgggaccgccgcgccccugauguacuucaucagcgcccaggagggcuccggggugggcacggaccuggccaucgacgagcacagcggcgugguccggaccgcccgcgugcucgaccgggagcagcgcgaccgguaccgcuucaccgcggugaccccggacggggccacggucgaggugaccgugcgggucgccgacaucaacgaccacgcccccgccuucccccaggcgcgcgccgcccugcaggugcccgagcacaccgccuucggcacccgguacccgcuggagcccgcccgcgacgcggacgccgggcggcucggcacgcagggcuacgcccuguccggggacggcgccggggagaccuuccgccuggagacccggcccggccccgacgggaccccggugcccgagcucgucgugacgggcgagcuggaccgcgagaaccggagccacuacaugcugcagcucgaggccuacgacggcgggucccccccccgccgggcgcaggcccugcuggacgugacccuccuggacaucaacgaccacgccccggccuucaaccagagccgcuaccacgccgucguguccgagagccuggcgcccggcucccccgugcuccaggucuucgccagcgacgccgacgccggggugaacggcgcggugaccuacgagaucaaccggcgccaguccgagggggacggccccuucagcaucgacgcccacaccggccugcugcagcucgagcggccgcuggacuucgagcagcgccgcguccacgagcugguggugcaggcccgggacgggggcgcccaccccgagcucggguccgccuucgucacggugcacguccgcgacgcgaacgacaaccagcccagcaugaccgugaucuuccuguccgccgacggcagcccccaggugagcgaggccgccccgcccgggcagcuggucgcccggaucuccgugagcgaccccgacgacggcgacuucgcgcacgugaacgucucccucgagggcggggagggccacuucgcccugagcacccaggacuccgugaucuaccuggugugcgucgcccgccggcucgaccgcgaggagcgggacgccuacaaccugcgcgugaccgccacggacagcggguccccgccccugcgggcggaggccgccuucgugcuccacgucaccgacgugaacgacaacgcccccgcguucgaccgccagcuguaccggcccgagccgcugcccgagguggcccugcccggcagcuucgucgugcgcgugaccgcccgggaccccgaccagggcaccaacgggcaggucacguacucccucgccccgggcgcccacacccacugguucagcaucgaccccaccuccgggaucaucaccacggcggccagccuggacuacgagcuggagccccagccccagcucaucgugguggccaccgacggcgggcugccgccccuggccuccagcgccaccgucuccguggcgcuccaggacgugaacgacaacgagccccaguuccagcgcaccuucuacaacgccagccugcccgagggcacgcagccgggcaccugcuuccugcaggucaccgccaccgacgccgacuccgggcccuucggccuccugagcuacucccugggggccggccucgggagcagcggcuccccccccuuccggaucgacgcgcacagcggcgacgugugcacgacccgcacccuggaccgggaccaggggccguccagcuucgacuucaccgugaccgccgucgacggcgggggccugaaguccaugguguacgugaaggucuuccucagcgacgagaacgacaaccccccccaguucuacccccgcgaguacgccgccuccaucagcgcgcaguccccgcccgggacggccgugcugcggcugcgcgcccacgaccccgaccagggcagccacggccgccucuccuaccacauccuggccgggaacagcccgccccuguucacccucgacgagcaguccggccugcugaccguggccuggccccucgcgcggcgcgccaacagcgucgugcagcuggagaucggggccgaggacggcgggggccugcaggccgagcccuccgcccggguggacaucagcaucgucccgggcacccccacgccccccaucuucgagcagcuccaguacguguucuccgugccggaggacgucgcgcccgggaccagcgugggcaucgugcaggcccacaacccccccgggcgccuggccccggucacccugagccucuccggcggcgacccccgggggcuguucagccuggacgccguguccggccuccugcagacccugcgcccccucgaccgggagcugcuggggcccgugcucgagcuggagguccgcgccggcagcggggugccgcccgcguucgccguggcccggguccgcgugcugcucgacgacgugaacgacaacucccccgccuuccccgccccggaggacacgguccugcugccccccaacaccgcgcccggcaccccgaucuacacccuccgggcccuggaccccgacagcggcgugaacucccgcgucacguucacccugcucgccgggggcgggggcgccuucaccguggaccccaccacggggcacgugcggcugaugcgcccccugggcccgagcggcgggcccgcgcacgagcucgagcuggaggcccgggacggcgggucccccccgcgcaccagccacuuccggcugcgcgucguggugcaggacgucggcacccgggggcucgccccccgcuucaacucccccaccuaccggguggaccugcccagcggcacgaccgccggcacccaggugcugcagguccaggcccaggcgccggacgggggccccaucaccuaccaccucgccgccgagggggccuccagccccuucggccuggagccccaguccggcuggcugugggugcgcgccgcgcucgaccgcgaggcccaggagcuguacauccugaaggugauggccgucagcggguccaaggccgagcucggccagcagacggggaccgccaccgugcgggugagcauccugaaccagaacgagcacuccccgcgccugagcgaggaccccaccuuccucgcggucgccgagaaccagccccccggcacgagcguggggcggguguucgccaccgaccgcgacuccggcccgaacggccggcugaccuacagccugcagcagcucuccgaggacagcaaggccuuccgcauccacccccagaccggggaggucacgacccugcagacccuggaccgggagcagcaguccagcuaccagcuccuggugcaggugcaggacggcgggucccccccccgcagcaccacgggcaccguccacguggcggugcuggaccucaacgacaacuccccgaccuuccugcaggccagcggggccgccggcggcgggcugcccauccagguccccgaccgggugcccccgggcacccucgugaccacgcugcaggccaaggaccccgacgagggggagaacggcaccauccuguacacccucaccgggcccggcuccgagcuguucagccugcacccccacuccggcgagcuccugacggcggccccgcugauccgcgccgagcggccccacuacguccucacccugagcgcccacgaccaggggucccccccccgcagcgccucccugcagcuccuggugcaggugcugccgagcgcgcggcucgccgagccccccccggaccuggccgagcgcgaccccgccgcccccguccccguggugcugaccgucaccgcggccgagggccugcggccggggucccuccugggcagcguggccgcccccgagcccgcgggggugggcgcccugacguacacccucgucggcggggccgaccccgagggcaccuucgcccuggacgccgcgagcgggcgccuguaccucgcccggccgcuggacuucgaggccggcccccccuggcgcgcccugaccgugcgggccgagggccccgggggcgcgggggcccgccuccugcgcgugcagguccaggugcaggacgagaacgagcacgccccggccuucgcccgggacccccuggcgcucgcccugcccgagaaccccgagccgggcgccgcccuguacacguuccgcgccuccgacgcggacgggcccggccccaacagcgacgugcgguaccgccuccugcggcaggagcccccgguccccgcccugcgccucgacgcccggaccggcgcccuguccgcgccccgcgggcuggaccgggagaccacccccgcccuccugcugcucguggaggccacggaccgcccggccaacgccagccggcgccgggcggcccgcguguccgcccgggucuucgugaccgacgagaacgacaacgcccccguguucgccagccccucccgcguccggcugccggaggaccagccccccggccccgcggcccugcacgugguggcccgcgacccggaccucggggaggccgcccgggucagcuaccgccuggcguccggcggggacggccacuuccggcugcacagcuccaccggcgcccucagcgugguccgcccccuggaccgcgagcagcgggccgagcacgugcugaccguggucgccuccgaccacgggagccccccccgcuccgcgacgcaggugcucaccgugagcgucgccgacgugaacgacgaggccccgaccuuccagcagcaggaguacuccgugcugcugcgggagaacaacccccccggcaccagccuccugacgcugcgcgccaccgaccccgacgucggggccaacggccaggugaccuacgggggcguguccagcgagagcuucucccucgacccggacaccggcguccugacgacccugcgggcgcucgaccgcgaggagcaggaggagaucaaccugaccguguacgcccaggaccgggggagccccccccagcugacccacgugacgguccgcguggccguggaggacgagaacgaccacgcccccaccuucggcuccgcccaccucagccuggaggucccggaggggcaggacccccagacccugaccaugcuccgggcguccgaccccgacgugggcgccaacgggcagcugcaguaccgcauccuggacggcgaccccagcggcgccuucgugcucgaccuggccuccggggaguucggcacgaugcggccgcuggaccgcgaggucgagcccgccuuccagcuccggaucgaggcgcgcgacgggggccagcccgcccugagcgccacccugcuccugaccgugaccgugcuggacgccaacgaccacgcgcccgccuucccgguccccgccuacuccguggaggugcccgaggacguccccgccggcacccuccugcugcagcuccaggcccacgacccggacgcgggggccaacggccacgugacguacuaccugggggccggcaccgccggggccuuccugcucgagcccagcuccggcgagcugcggaccgcggccgcccuggaccgcgagcagugccccagcuacaccuucuccgugagcgccgucgacggcgccgcggccgggccgcucuccacgaccgugagcgugaccaucaccguccgggacgugaacgaccacgcccccacguuccccaccuccccccugcgccugcggcucccgcgccccggccccagcuucuccacccccacccuggcccuggccacgcuccgcgcggaggaccgggacgccggggccaacgccagcauccuguaccgccuggcgggcaccccgccccccgggaccaccguggacagcuacacgggcgagauccgggucgcccgcucccccguggcccucggcccgcgggaccgcgugcuguucaucgucgccaccgaccuggggcggcccgcccgcagcgcgaccggcgugaucaucguggggcuccagggcgaggccgagcgggggccccgcuucccccgggccuccagcgaggccaccauccgcgagaacgccccgcccggcacgcccaucgucuccccccgggcggugcacgccggcgggaccaacggcccgaucaccuacagcauccuguccgggaacgagaagggcaccuucagcauccagcccuccacgggcgccaucaccgugcgcagcgccgaggggcuggacuucgaggucuccccccggcuccgccuggugcugcaggccgagagcggcggggcguucgccuucaccgugcucacccugacgcugcaggacgccaacgacaacgccccccgguuccuccgcccgcacuacgucgcguuccugcccgagucccggccccuggagggcccccuccugcagguggaggccgacgaccuggaccaggggagcggcggccagaucuccuacagccucgccgccucccagccggcccgcgggcuguuccacguggaccccaccaccggcaccaucacgaccaccgcgauccuggaccgggagaucugggccgagacccgccucguccugauggccacggaccgcgggagccccgcccuggugggcuccgccacccugaccgucauggugaucgacaccaacgacaaccggccgacgaucccccagcccugggagcuccgcgugagcgaggacgcgcugcuggggagcgagaucgcccaggucaccggcaacgacguggacuccggccccgugcucugguacguccugagcccguccgggccccaggaccccuucagcgugggccgguacgggggccgcgugucccugaccgggccccucgacuucgagcagugcgaccgguaccagcugcagcugcucgcccacgacggcccgcacgagggccgcgccaaccugaccguccugguggaggacgugaacgacaacgcccccgcguucagccagucccucuaccaggucaugcugcuggagcacaccccccccgggagcgccauccucuccgugagcgccacggaccgggacuccggcgccaacgggcacaucagcuaccaccuggccuccccggcggacggcuucagcguggaccccaacaacgggacccuguucaccaucgucggcaccguggcccucggccacgacggguccggcgccguggacgucgugcuggaggcccgcgaccacggggcgcccggccgggccgcccgcgccacggugcacguccagcugcaggaccagaacgaccacgcccccagcuucacccucucccacuaccggguggcggugaccgaggaccugccgcccggcagcacccugcucacgcuggaggccaccgacgccgacgggagccgcucccacgccgccgucgacuacagcaucaucuccggcaacugggggcggguguuccagcuggagccccgccucgcggaggccggcgagagcgccgggcccggcccgcgggcccugggcugccuggugcuccuggagccccuggacuucgagucccucacccaguacaaccugaccgucgccgcggccgaccgcgggcagcccccccagagcuccguggugccggucacggugaccgugcuggacgucaacgacaacccccccguguucacccgggccagcuaccgcgugaccguccccgaggacacgccggugggcgccgagcuccugcacguggaggcguccgacgccgaccccgggccccacggccugguccgguucaccgugagcuccggggacccgagcggccucuucgagcuggacgaguccagcggcacccugcgccucgcccacgcccuggacugcgagacccaggcccgccaccagcuggugguccaggcggccgaccccgccggggcccacuucgcccucgcgcccgugacgaucgaggugcaggacgucaacgaccacggccccgccuucccgcugaaccugcucuccaccagcguggccgagaaccagccccccgggacccuggugaccacgcugcacgccaucgacggcgacgccggggcguucggccggcuccgcuacucccugcuggaggccggccccgggccggagggccgggaggccuucgcccucaacagcuccaccggggagcugcgcgcgcggguccccuucgacuacgagcacaccgagagcuuccgccugcucgugggcgccgccgacgccggcaaccugagcgccuccgugaccgucagcgugcuggucacgggggaggacgaguacgaccccguguuccucgcgcccgccuuccacuuccaggugccggagggcgcccggcgcgggcacucccugggccacguccaggccaccgacgaggacgggggcgccgacggccuggugcucuacagccuggcgaccuccagccccuacuucgggaucaaccagaccacgggcgcccuguaccuccggguggacucccgcgcccccgggagcggcaccgccaccuccgggggcggcgggcggacccgccgggaggccccccgcgagcugcggcuggaggucaucgcgcgcggcccgcuccccgggagccgguccgccacggugcccgugaccgucgacaucacccacaccgcccugggccuggcccccgaccucaaccugcugcucgugggggccguggcggccagccugggcgucguggugguccuggcccucgccgcgcuggugcugggccucgugcgcgcccggucccgcaaggccgaggccgccccggggcccaugagccaggcggccccccuggccuccgacagccugcagaagcucggccgggagcccccguccccccccccgagcgagcaccuguaccaccagacccugcccuccuacgggggccccggggccggcggccccuacccgcgcgggggcagccucgaccccagccacuccagcgggcgcggcuccgccgaggcggccgaggacgacgagauccggaugaucaacgaguucccccgcgucgccagcguggccuccagccuggccgcgcggggccccgacuccgggauccagcaggacgccgacggccugagcgacacguccugcgagccgcccgcccccgacaccugguacaaggggcgcaaggccggccuccugcugcccggggcgggcgccacccucuaccgggaggagggcccgcccgccaccgccacggccuuccuggggggcugcgggcugagccccgcgcccaccggcgacuacggguucccggccgacggcaagcccugcguggccggcgcccucaccgccaucgucgcgggggaggaggagcugcgcggcuccuacaacugggacuaccugcugagcuggugcccccaguuccagccccucgccuccguguucaccgagaucgcccggcugaaggacgaggcccgcccgugcccccccgccccccggaucgacccgcccccccugaucacggcgguggcccaccccggggccaagagcgucccgcccaagcccgccaacaccgcggccgcccgcgccaucuucccgcccgccucccaccggagccccaucucccacgagggcagccucuccagcgcggccaugagccccuccuucagcccgucccugagcccccuggccgcccgcucccccguggugagccccuucggggucgcccagggcccguccgcgagcgcccucuccgccgagagcggccuggagccccccgacgacaccgagcugcacaucuga

SEQ ID NO: 29024 - RNA, 4110 nt, Artificial Sequence
  derived and/or modified sequence opt1 from DCHS2__Homo_sapiens__NP_001136024
augagccccugcggccgcaagaugggggagggccggcagcagcgccgggccccgguggggaagcugcuccugcugcccggccgccgggacacgccccacgggcgcuccggcagcuccggcgcccggacccagcgcagccuccuguggcugcucguccacguguggcugugggcggccuccgggagcuccgcccagcuguucaaccucacccugagcguggacgagggccugcccccggacacccucgucggggacauccgggccggccugcccgccgcgcagcagcaggagggguccggcuucuuccugagcgaggacuccgacgacagcccccuccuggacgacuuccacgugcaccccgacaccggcaucauccgcaccgcccggcgccuggaccgggagcgccgggaccacuacuccuucguggccgccacgcuccugggggcggucguccagguggagauccgcgugaacgacgugaacgaccacagcccgcgguucccccuggacucccuccagcuggacgugagcgagcuguccccgcccggcaccgccuuccgccucccggucgcccacgaccccgacgccgggcuguucagcacccagggcuacacccuggugcagcccuccgaccuccccaaggacccggccggccccuucuuccagcugcgguaccgcacgcccgggccccugccgagcccccuccugcccggcagcuccagcccccuggagccgcucgaccuggugcugcuccggcgccuggaccgcgaggaggcggccgcccaccggcugcagaucgaggccugggacgggggccgcccccggcgcaccgggcuccuguccgucgagcugcgggugcucgacgagaacgacaacccgcccguguucgagcaggacgaguaccgcgccgcgguccgggaggacgcccagcccggcgccgaggugugccgcgugcgggccaccgaccgcgaccugggccccaacggguucguccgguacagcgugcgcgcccgccaggugcccggcgcgggguccggcgggggcgcccugggcgacgccgccuacuucgccgucgaggagcucagcggggugguccggguguggcggccgcuggaccgcgaggcgcaggccuggcaccagcugguggucgaggcccgggacggcggggccgagcccgagguggcgaccgugcgcgucuccaucgccgugcucgacgugaacgacaaccggcccgccauccacguccuguuccugacggagggcgggguggcccgcgugagcgagggcgcccgccccggcgacuacgucgcgcggguguccgugagcgacgccgacggggacugggagaaggaggacgaggccaccggcgagcugggggucggccucggcgacggguccaucagccugucccuggagggcggggagggcgacuucgcccuccugcccgggggcccgcccggcguguucuuccugugcguggaggggccccucgaccgcgagagccgggaccuguacgagcugcuccuggucgccaccgacgcgggcuccccgccccugagcaccgaggagacgcuccugcugcgcguggccgaccucaacgaccagccgccccuguucucccagcagcacuacaaggccagcguguccgaggccgccgcgcccgggaccgucgugaugugggugagcgccagcgacgccgacgaggccggcuccgaccacgcguggcugcgguacaccgucgugcagcucagcgcccccugcaaccuggggucccugcagagcaagauggugcacaccgccgagugcggccccuccuucgccaucgacagcgaguccggcgccaucagcacgauccgcacccucgaccgggagguccaggaggcgguggagcugaagguggucgcccaggaccugggggagccgccccucuccgcgaccugccuggugagcaucaccguggacgacgucaacgacaacgagcccaucuucuggcgccagguguacaacgccacgaucgccgagcacgcccccgugggccacugcuuccugcaggucaccgccuccgacgccgacagcgggcucuacggcuucaucgaguacucccuguacgacggguuccugagcuacgaggcgccccaggccuuccggaucgacccccacgacggccagaucugcgugucccaggacaucgaccgcgagcgggaccccgccaccuacgaccuccugguggaggccaaggacggcgggggccugagcgcccaggccuucguccgcguggaccucgaggacgugaacgacaaccaccccgucuucaaccccuccaccuacgugacgagcaucagcgacgagacccagccggggaccgagaucaucaacgugcuggcgaccgaccaggacuccggcaucuacgggacggucgccuacgagcugauccccggcaacgugagcucccucuucaccaucgacagcaccaccggcaucaucuaccugacgcugccccucucccaccuggagagcaccacccugucccucauggugagcgcccaggacgggggcgggcugaccgccgucaucaacgccgacgugaccauccacaucuuccagacgacccuggcgccggccgaguucgagcggcccaaguacaccuuccucguguacgaggacguccccgaggacucccccaucggcaccgugaaggcccgcgagccgcugaacagcuccgagcccaucuucuaccggaucagcuccggcgaccucgggggcaaguucagcauccacccccgccuggggacgauccggacccgcaagccccuggaccacgagacccagccggucguggugcugaccguccaggcccagcucggcuccgcccccgcgugcagcuccacggaggugaacaucaccgugauggacgucaacgacaaccaccccgccuuccugcggaccagcgacgagauccgcaucucccagaccacgcccccggggaccgcccuguaccucgcccgggccgaggaccgcgacagcggccgcaacggccugauccgguacagcaucgcgagcccccagcccgggguguucgccaucgaccgcgcccugggcguccucuuccugaacgggucccugggcgccggggagcagcgggagcucacccugacccugcgcgccgaggaccagggcgugcacccccaggcggcccuccuggugcugacgguggucaucgagaagcgggagcacuccccgagcuggaccuucgagcaccucguguaccagguggaggucuccgagagccugucccccaugacccagaugcugcagacccaggcccacccccucggcccccagcgcgccgcgagcccgcugcgguacucccuggagcccagcguggacuccgccauguucgggauccgccccuacacgggcuggaucuaccuccggcgccaguucgacuacgagagcacccagaccuacaacuuccggguguucgccuggauccccgaggacggguuccugcagaacgucuccaccacggugaucgugcgcgucugggacgagaacgacaacagcccgaccuuccugcacgacguccucuuccugaagguggaggagucccccgugccccagggcgugaucgggaagaucaccgccaucgacauggacagcggcaagaacggccagcugcucuacuuccugcuguccgacgggaaguucuucaagaugaaccccaacaccggcgagcucaucaacuggguggcccuggaccgggagcaccgcgggcaccacgagaugacgguccuggugaccgaccggggcagcccgccccgcaacgcgaccauggccguguacgucuccgugaccgacaucaacgacaaccggcccuucuucccgcagugccuccccggcaaggagcugcacgugaagguccuggaggggcagcccgugaacaugcucgugacgaccgucuucgccaaggaccccgacgagggcaacaacgccgaggugaccuacagcgugagcuccgcccgcccgaugccccugaaggggaagaccgcguucggcaagcagagcugcaagaagcagacgaacaagcagaccaacaagauccugaccuga

SEQ ID NO: 29025 - RNA, 783 nt, Artificial Sequence
  derived and/or modified sequence opt1 from DCK__Homo_sapiens__NP_000779
auggccacgcccccgaagcgcagcugccccuccuucagcgccuccagcgagggcacccggaucaagaagaucuccaucgaggggaacaucgcggccggcaagagcaccuucgugaacauccugaagcagcucugcgaggacugggaggucgugcccgagcccguggcccgcuggugcaacguccaguccacccaggacgaguucgaggagcugaccaugagccagaagaacgggggcaacgugcugcagaugauguacgagaagccggagcggugguccuucaccuuccagacguacgccugccucagccgcauccgggcccagcuggcgucccugaacgggaagcucaaggacgccgagaagcccgugcuguucuucgagcgcagcgucuacuccgaccgguacaucuucgccagcaaccuguacgaguccgagugcaugaacgagaccgaguggaccaucuaccaggacuggcacgacuggaugaacaaccaguucggccagagccucgagcuggacggcaucaucuaccugcaggccacccccgagacgugccuccaccgcaucuaccugcgggggcgcaacgaggagcagggcaucccccuggaguaccucgagaagcugcacuacaagcacgaguccuggcugcuccaccggacccugaagaccaacuucgacuaccugcaggaggugccgauccucacccuggacgugaacgaggacuucaaggacaaguacgagagccuggucgagaaggugaaggaguuccucuccacgcuguga

SEQ ID NO: 29026 - RNA, 1269 nt, Artificial Sequence
  derived and/or modified sequence opt1 from DCLK1__Homo_sapiens__NP_001182344
augcuggagcucaucgaggugaacggcacccccgggagccagcuguccacgccccgcagcggcaagucccccagccccucccccaccagcccggggucccugcggaagcagcgcagcucccagcacggcgggagcuccaccagccucgccuccaccaaggucugcagcuccauggacgagaacgacggccccggcgaggaggugagcgaggagggguuccagauccccgccaccaucacggagcgguacaaggugggccgcaccaucggggacggcaacuucgcggucgugaaggagugcguggagcgguccaccgcccgcgaguacgcccugaagaucaucaagaaguccaagugccgggggaaggagcacaugauccagaacgaggucagcauccugcgccgggugaagcaccccaacaucgugcuccugaucgaggagauggacgucccgaccgagcuguaccucgugauggagcuggugaagggcggcgaccuguucgacgccaucacgagcaccaacaaguacaccgagcgcgacgccagcgggaugcucuacaaccuggcguccgccaucaaguaccugcacagccucaacaucguccaccgggacaucaagcccgagaaccugcugguguacgagcaccaggacggcuccaagagccucaagcugggggacuucggccuggccaccaucguggacggcccccucuacacggucugcgggacccccaccuacguggccccggagaucaucgcggagaccggcuacgggcugaagguggacaucugggccgccggcgucaucacguacauccugcucugcggguucccgcccuuccgcggcuccggcgacgaccaggaggugcuguucgaccagauccugaugggccagguggacuuccccagccccuacugggacaacgucuccgacagcgccaaggagcucaucaccaugaugcugcugguggacguggaccagcgguucuccgccguccaggugcucgagcaccccugggucaacgacgacgggcugcccgagaacgagcaccagcugagcguggcggggaagaucaagaagcacuucaacaccggccccaagccgaacuccaccgccgccggggugagcgucaucgcccucgaccacggcuucacgaucaagcgcuccggcagccuggacuacuaccagcagcccgggauguacuggauccggccgccccugcucauccgccggggccgcuucuccgacgaggacgccacccggauguga

SEQ ID NO: 29027 - RNA, 2301 nt, Artificial Sequence
  derived and/or modified sequence opt1 from DCLK2__Homo_sapiens__NP_001035350
auggccagcacccgcuccaucgagcuggagcacuucgaggagcgggacaagcgcccccggcccggcagccgccgcggggcccccuccagcuccggcgggagcuccagcuccggccccaaggggaacggccucauccccagcccggcgcacuccgcccacugcagcuucuaccggacccggacgcugcaggcccuguccagcgagaagaaggccaagaaggcccgcuucuaccggaacggcgaccgcuacuucaaggggcucguguucgcgaucuccagcgaccgguuccgcuccuucgacgcccugcugaucgagcucacccggagccuguccgacaacgucaaccugccccagggcgugcgcaccaucuacaccaucgacgggagccggaaggugacgagccucgacgagcugcuggagggcgaguccuacgucugcgccagcaacgagcccuuccgcaagguggacuacaccaagaacaucaaccccaacugguccgugaacaucaagggcgggaccagccgggcccucgcggccgccuccagcgucaaguccgaggugaaggagagcaaggacuucaucaagccgaagcuggugaccgucauccgcuccggcgugaagccccggaaggccgugcgcauccugcucaacaagaagacggcccacagcuucgagcagguccugaccgacaucaccgaggcgaucaagcuggacuccgggguggugaagcggcucugcacccuggacggcaagcaggucacgugccugcaggacuucuucggggacgacgacguguucaucgccugcggccccgagaaguuccgcuacgcccaggacgacuucgugcucgaccacagcgagugccgcguccugaaguccagcuacucccggagcuccgccgugaaguacagcggcuccaagagccccgggccgagccgccgguccaagagccccgccuccgugaacggcacccccagcucccagcugagcacccccaaguccaccaagagcuccagcuccagcccgacgucccccgggagcuuccgcggccucaagcagaucuccgcgcacgggcggagcuccagcaacgucaacggcggccccgagcuggaccgcugcaucagccccgagggggugaacggcaaccggugcuccgagagcuccacccugcucgagaaguacaagaucgggaaggugaucggcgacgggaacuucgccgucgugaaggagugcaucgaccgcagcaccggcaaggaguucgcccugaagaucaucgacaaggccaagugcugcggcaaggagcaccugaucgagaacgaggucuccauccuccggcgcgugaagcacccgaacaucaucaugcugguggaggagauggagaccgccacggagcuguuccucgucauggagcuggugaagggcggggaccuguucgacgcgaucaccagcuccaccaaguacaccgagcgggacgggagcgccaugguguacaaccucgccaacgcccugcgcuaccugcacggccucuccaucguccaccgggacaucaagcccgagaaccugcuggugugcgaguaccccgacgggaccaagagccucaagcugggcgacuucggccuggccaccguggucgaggggccccucuacaccgugugcggcaccccgacguacguggcgcccgagaucaucgccgagaccggguacggccugaaggucgacaucugggccgccggcgugaucaccuacauccugcucugcggguucccgcccuuccgcuccgagaacaaccugcaggaggaccuguucgaccagauccuggcgggcaagcucgaguuccccgcccccuacugggacaacaucaccgacagcgccaaggagcugaucucccagaugcuccaggugaacgucgaggcccggugcacggccgggcagauccugagccaccccuggguguccgacgacgcgagccaggagaacaacaugcaggccgaggugaccggcaagcugaagcagcacuucaacaacgcccugccgaagcagaacuccaccaccacgggggucagcgugaucaugaacaccgcccucgacaaggagggccagaucuucugcuccaagcacugccaggacagcggccgccccgggauggagcccaucagccccgugccgcccuccgucgaggagauccccgugcccggcgaggccgugccggcgcccaccccgcccgagagccccacgccccacccgccgcccgccgcccccgggggcgagcgggccgggaccuggcgccggcaccgcgacuga

SEQ ID NO: 29028 - RNA, 1947 nt, Artificial Sequence
  derived and/or modified sequence opt1 from DCLK3__Homo_sapiens__NP_208382
augggcaaggagccccugacccucaagagcauccagguggccgucgaggagcuguacccgaacaaggcccgcgcgcugacccucgcccagcacucccgggcccccagcccccgccugcggucccgccuguucagcaaggcccucaagggggaccaccggugcggcgagacggagacccccaaguccugcagcgagguggccgggugcaaggcggccaugcgccaccagggcaagaucccggaggagcugucccuggacgaccgggcccgcacccagaagaagugggggcggggcaagugggagcccgagcccagcuccaagcccccgcgcgaggccacccucgaggagcggcacgcgcgcggcgagaagcaccuggggguggagaucgagaagacgagcggcgagaucauccggugcgagaagugcaagcgcgagcgggagcugcagcagucccucgagcgcgagcggcugagccuggggaccuccgagcucgacaugggcaaggggcccauguacgacgucgagaagcuggugcgcacccggagcugccgccggucccccgaggccaaccccgccagcggcgaggagggcuggaagggggacucccaccgcagcuccccgcgcaaccccacccaggagcugcggcgccccagcaagagcauggacaagaaggaggaccggggccccgaggaccaggagucccacgcccagggggccgcgaaggccaagaaggaccucguggagguccugccggugacggaggagggccugcgcgaggugaagaaggacacccggcccaugagccgcuccaagcacggcggguggcuccugcgggagcaccaggccggcuucgagaagcugcgccggacccgcggggaggagaaggaggccgagaaggagaagaagcccugcaugagcggcgggcggcgcaugacccuccgggacgaccagcccgccaagcuggagaaggagccgaagacgcgccccgaggagaacaagcccgagcggcccuccggccgcaagccgcggcccaugggcaucaucgcggccaacgucgagaagcacuacgagaccgggcgcgugaucggcgacgggaacuucgccguggucaaggagugccggcaccgcgagacccgccaggccuacgccaugaagaucaucgacaagagccggcugaagggcaaggaggacaugguggacuccgagauccucaucauccagagccugucccaccccaacaucgugaagcugcacgaggucuacgagaccgacauggagaucuaccucauccuggaguacgugcagggcggggaccuguucgacgcgaucaucgagagcgugaaguuccccgagccggacgccgcccucaugaucauggaccugugcaaggcccugguccacaugcacgacaaguccaucgugcaccgcgaccucaagcccgagaaccugcuggugcagcggaacgaggacaagagcacgacccucaagcuggccgacuucggccuggcgaagcacgucgugcgccccaucuucaccgugugcgggaccccgacguacgucgcccccgagauccucuccgagaagggcuacgggcuggagguggacaugugggccgccggcgucauccuguacauccuccugugcggguucccgcccuuccggagccccgagcgcgaccaggacgagcuguucaacaucauccagcucggccacuucgaguuccugccgcccuacugggacaacaucuccgacgcggccaaggaccuggugagccggcugcucguggucgaccccaagaagcgcuacaccgcccaccaggugcugcagcaccccuggaucgagaccgccggcaagaccaacacggugaagcggcagaagcaggucucccccagcuccgaggggcacuuccgcagccagcacaagcgggugguggagcaggucagcuga

SEQ ID NO: 29029 - RNA, 3123 nt, Artificial Sequence
  derived and/or modified sequence opt1 from DCLRE1A__Homo_sapiens__NP_055696
augcuggaggacaucagcgaggaggacaucugggaguacaaguccaagcgcaagcccaagcggguggacccgaacaacggcagcaagaacauccucaaguccgucgagaaggccaccgacgggaaguaccagagcaagcgcucccggaaccgcaagcgggccgcggaggccaaggaggugaaggaccacgaggugccccugggcaacgccgggugccagaccagcgucgccuccagccagaacuccagcugcggcgacgggauccagcagacgcaggacaaggagaccacccccggcaagcugugccgcacccagaagucccagcacgugagccccaagauccggccgguguacgacggcuacugccccaacugccagaugcccuucuccagccucaucgggcagacgccccgcuggcacgucuucgagugccuggacuccccgccccggagcgagaccgagugccccgacggccugcucugcaccuccaccauccccuuccacuacaagcgcuacacgcacuuccugcuggcccagagccgggcgggggaccacccguucuccagccccagccccgccuccggcgggagcuucuccgagaccaagagcggcgugcucugcucccuggaggagcgcuggagcuccuaccagaaccagaccgacaacagcguguccaacgacccccugcucaugacccaguacuucaagaaguccccgagccugacggaggccagcgagaagaucuccacccacauccagaccagccagcaggcccugcaguucaccgacuucgucgagaacgacaagcucgugggcguggcgcugcggcuggccaacaacuccgagcacaucaaccucccccugcccgagaacgacuucagcgacugcgagaucuccuacagcccccugcaguccgacgaggacacgcacgacaucgacgagaagccggacgacagccaggagcagcuguucuucaccgagagcuccaaggacgggagccucgaggaggacgacgacuccugcggcuucuucaagaagcgccacgggccccugcucaaggaccaggacgagagcugccccaaggucaacuccuuccugacccgggacaaguacgacgagggccuguaccgcuucaacagccucaacgaccugucccagcccaucagccagaacaacgaguccacccugccguacgaccucgccugcacgggcggggacuucgugcuguucccgcccgcccuggccggcaagcucgcggccagcgugcaccaggccaccaaggccaagcccgacgagcccgaguuccacuccgcccagagcaacaagcagaagcaggucaucgaggaguccagcguguacaaccaggugucccugccccuggucaagagccucaugcugaagcccuucgagucccagguggagggguaccugagcagccagccgacccagaacaccauccggaagcucuccagcgagaaccugaacgcgaagaacaacacgaacuccgccugcuucugccgcaaggcccuggagggcgugcccgucgggaaggccaccauccucaacaccgagaaccugagcuccacccccgcccccaaguaccugaagauccucccgagcggccugaaguacaacgcgcggcaccccuccacgaaggugaugaagcagauggacaucggcguguacuucgggcugccgcccaagcgcaaggaggagaagcuccugggcgagagcgcccuggaggggaucaaccugaaccccguccccucccccaaccagaagcggagcucccagugcaagcgcaaggccgagaagucccucagcgaccuggaguucgacgccagcacccugcacgagucccagcucagcguggagcuguccagcgagcgcucccagcggcagaagaagcgcugccgcaagagcaacagccugcaggagggcgccugccagaagcgguccgaccaccucaucaacaccgagagcgaggcggucaaccuguccaaggugaagguguucaccaagagcgcccacgggggccugcagcggggcaacaagaagauccccgaguccagcaacgucgggggcucccgcaagaagacgugcccguucuacaagaagauccccgggaccggcuucaccguggacgccuuccaguacgggguggucgagggcugcaccgccuacuuccucacgcacuuccacagcgaccacuacgcgggccuguccaagcacuucaccuuccccguguacugcagcgagaucaccgggaaccugcucaagaacaagcugcacgugcaggagcaguacauccacccccugccgcucgacaccgagugcaucgucaacggcgugaaggugguccugcuggacgccaaccacugccccggggccgugaugauccucuucuaccugcccaacggcaccgugauccugcacacgggcgacuuccgggccgaccccuccauggagcgcagccuccuggccgaccagaagguccacaugcuguaccucgacaccaccuacugcuccccggaguacaccuuccccagccagcaggaggugauccgguucgcgaucaacacggccuucgaggccgugacccugaacccccacgcccuggucgugugcgggaccuacuccaucggcaaggagaagguguuccucgccaucgcggacguccuggggagcaaggugggcaugucccaggagaaguacaagacccugcagugccucaacauccccgagaucaacagccugaucacgaccgacaugugcuccagccuggugcaccuccugccgaugaugcagaucaacuucaaggggcugcagagccaccucaagaagugcggcggcaaguacaaccagauccuggccuuccgccccaccggguggacccacuccaacaaguucacgcggaucgccgacgucaucccccagaccaagggcaacaucagcaucuacgggaucccguacuccgagcacagcuccuaccuggagaugaagcgcuucgugcaguggcucaagccccagaagaucauccccaccgugaacgucggcaccuggaagucccggagcacgauggagaaguacuuccgcgaguggaagcuggaggccggguacuga

SEQ ID NO: 29030 - RNA, 2079 nt, Artificial Sequence
  derived and/or modified sequence opt1 from DCLRE1C__Homo_sapiens__NP_001029027
augagcuccuucgagggccagauggccgaguaccccaccaucagcaucgaccgcuucgaccgggagaaccugcgcgcccgggcguacuuccucucccacugccacaaggaccacaugaaggggcugcgcgccccgacccugaagcggcgccucgagugcagccugaagguguaccuguacugcucccccgucacgaaggagcuccugcugaccagccccaaguaccgguucuggaagaagcgcaucaucuccaucgagaucgagacccccacccagaucagccucguggacgaggccuccggcgagaaggaggagaucguggucacgcugcugccggccgggcacugccccggcagcgugauguuccucuuccaggggaacaacggcaccgugcuguacaccggcgacuuccggcuggcccagggggaggcggcccgcauggagcuccugcacuccggcgggcgggucaaggacauccagagcguguaccuggacaccacguucugcgacccccgcuucuaccagauccccucccgggaggagugccucagcggcgugcuggagcugguccgcuccuggaucacccggagcccguaccacgugguguggcucaacugcaaggccgccuacggguacgaguaccuguucaccaaccuguccgaggagcucggcguccaggugcacgugaacaagcuggacauguuccgcaacaugcccgagauccugcaccaccucaccacggaccggaacacccagauccacgcgugccgccaccccaaggccgaggaguacuuccaguggagcaagcugcccugcggcaucaccucccggaaccgcaucccgcugcacaucaucagcaucaagcccagcaccaugugguucggggagcggucccgcaagacgaacgucaucgugcgcaccggcgagagcuccuaccgggccugcuucagcuuccacuccagcuacuccgagaucaaggacuuccucagcuaccugugccccgugaacgccuaccccaacgucaucccgguggggaccaccauggacaagguggucgagauccugaagccccucugccgcuccagccaguccacggagcccaaguacaagccccugggcaagcugaagcgggcccgcaccgugcaccgggacagcgaggaggaggacgacuaccucuucgacgacccgcugcccaucccccugcgccacaaggugcccuacccggagaccuuccaccccgaggucuucuccaugaccgcggugagcgagaagcagcccgagaagcuccggcagacgcccggcugcugccgcgccgagugcaugcaguccagccgguucaccaacuucgucgacugcgaggaguccaacagcgaguccgaggaggagguggggaucccggccagccugcagggcgaccuggggagcgugcuccaccuccagaaggccgacggcgacgucccccagugggagguguucuucaagcgcaacgacgagaucaccgacgagucccuggagaacuuccccagcuccaccguggccgggggcagccaguccccgaagcuguucagcgacuccgacggcgagagcacgcacaucuccagccagaacuccagccaguccacccacaucaccgagcaggggagccagggcugggacucccagagcgacaccguccugcuguccagccaggagcggaacagcggggacaucacgucccucgacaaggcggacuaccgccccaccaucaaggagaacauccccgccagccugauggagcagaacgugaucugccccaaggacaccuacuccgaccucaagagccgggacaaggacgugaccaucgucccguccacgggcgagcccaccacccugagcuccgagacccacauccccgaggagaagucccugcugaaccugagcaccaacgccgacagccaguccagcuccgacuucgaggugcccagcacgccggaggccgagcuccccaagcgcgagcaccuccaguaccuguacgagaagcuggccaccggggaguccaucgcggugaagaagcggaagugcagccugcuggacaccuga

SEQ ID NO: 29031 - RNA, 1080 nt, Artificial Sequence
  derived and/or modified sequence opt1 from DCN__Homo_sapiens__NP_598010
augaaggccaccaucauccugcuccugcuggcccaggugagcugggcgggccccuuccagcagcgcggccucuucgacuucaugcuggaggacgaggccuccgggaucgggccggagguccccgacgaccgggacuucgagcccagccugggccccgugugcccguuccgcugccagugccaccuccgggugguccagugcuccgaccuggggcuggacaaggugcccaaggaccucccgcccgacaccacgcugcuggaccuccagaacaacaagaucaccgagaucaaggacggcgacuucaagaaccugaagaaccugcacgcccucauccuggugaacaacaagaucagcaaggucucccccggcgccuucacgccccuggugaagcucgagcgccuguaccugagcaagaaccagcucaaggagcugcccgagaagaugcccaagacccugcaggagcuccgggcccacgagaacgagaucaccaaggugcgcaaggucaccuucaacgggcugaaccagaugaucgugaucgagcugggcaccaacccgcucaaguccagcgggaucgagaacggcgcguuccaggggaugaagaagcuguccuacauccggaucgccgacaccaacaucacgagcaucccccagggccugccgcccucccucaccgagcugcaccuggacggcaacaagaucagccgcguggacgccgccucccucaaggggcugaacaaccuggcgaagcucggccugagcuucaacuccaucagcgccgucgacaacgggucccuggccaacacgccccaccuccgggagcugcaccuggacaacaacaagcucacccgcgugcccggcggccuggccgagcacaaguacauccagguggucuaccugcacaacaacaacaucagcguggugggguccagcgacuucugcccgcccggccacaacaccaagaaggccagcuacuccggggucagccucuucuccaaccccgugcaguacugggagauccagcccagcaccuuccggugcguguacguccgcuccgcgauccagcugggcaacuacaaguga

SEQ ID NO: 29032 - RNA, 1272 nt, Artificial Sequence
  derived and/or modified sequence opt1 from DCP1A__Homo_sapiens__NP_001277136
auggccgacguggucgaggaggagacccgccggagccagcaggccgcgcgcgacaagcagucccccagccaggccaacggcugcuccgaccaccggccgaucgacauccuggagaugcucagccgcgccaaggacgaguacgagcgguccgcccccagcgggcacaagcaccugaccguggaggagcuguucggcacgucccuccccaaggagcagcccgccguggucgggcuggacagcgaggagauggagcgccugccgggcgacgcgucccagaaggagcccaacagcuuccuccccuuccccuucgagcagcucgggggcgccccgcaguccgagacccugggcgugcccagcgccgcccaccacuccgugcagcccgagaucaccacccccguccugaucacgccggcgagcaucacccaguccaacgagaagcacgcccccaccuacaccaucccccugagccccgugcuguccccgacgcuccccgccgaggcccccaccgcccaggugcccccgagccugccccggaacuccaccaugaugcaggcggucaagaccacgccccgccagcggagcccccugcucaaccagccggugcccgagcugagccacgccucccugaucgccaaccagagccccuuccgcgcgccccucaacgugaccaacaccgccgggaccucccugccgagcgucgaccugcuccagaagcugcggcugacgccccagcacgaccagauccagacccagccccucggcaagggggccaugguggccuccuucagcccggccgccggccagcuggccacccccgaguccuucaucgagccgcccagcaagaccgcggccgcccgcguggccgccuccgcgagccuguccaacaugguccucgcgccccugcagagcaugcagcagaaccaggaccccgagguguucgugcagcccaagguccuguccagcgccauccccguggccggggccccgcucgugacggccaccaccaccgccgucuccagcgugcugcuggcccccuccguguuccagcagacggucacccggagcuccgaccucgagcgcaaggccagcagccccagcccccugaccaucggcaccccggagucccagcggaagcccuccaucauccugagcaagucccagcuccaggacacgcugauccaccugaucaagaacgacagcuccuuccucagcacccugcacgagguguaccugcagguccucaccaagaacaaggacaaccacaaccuguga

SEQ ID NO: 29033 - RNA, 1854 nt, Artificial Sequence
  derived and/or modified sequence opt1 from DCP1B__Homo_sapiens__NP_689853
auggccgccguggcggccggcgggcuggucggcaaggggcgcgacaucagccucgccgcccugcagcggcacgaccccuacaucaaccgcaucguggacguggccucccaggucgcgcuguacaccuucggccaccgggccaacgagugggagaagaccgacguggaggggacccucuucguguacacccgcagcgccuccccgaagcacggcuucaccaucaugaaccggcugagcauggagaaccgcaccgagcccaucacgaaggaccuggacuuccagcuccaggaccccuuccugcuguaccggaacgcccgccucuccaucuacggcaucugguucuacgacaaggaggagugccagcggaucgcggagcugaugaagaaccugacccaguacgagcagcucaaggcccaccaggggaccggcgccgggaucagccccgucauccugaacuccggcgaggggaaggagguggacauccugcgcaugcucaucaaggccaaggacgaguacaccaagugcaagacgugcagcgagccgaagaagaucaccuccagcuccgccaucuacgacaaccccaaccugaucaagcccauccccgugaagccgagcgagaaccagcagcagcggaucccccagcccaaccagacccuggaccccgagccgcagcaccucucccugaccgcgcuguucggcaagcaggacaaggccacgugccaggagaccgucgagccgccccagacccuccaccagcagcagcagcagcagcagcagcagcaggagaagcugcccauccgccagggcguggugcggagccuguccuacgaggagccccgccggcacagcccgcccaucgagaagcagcucugccccgccauccagaagcugaugguccgcuccgccgaccugcacccccucagcgagcugcccgagaaccggcccugcgagaacggguccacccacagcgccggcgaguucuucacggggcccgugcagccgggcagcccccacaacaucggcaccucccgcggggugcagaacgcgagccggacccagaaccuguucgagaagcuccaguccacccccggcgccgccaacaagugcgaccccagcacgccggcccccgccuccagcgcggcccugaaccgcucccgggcccccaccagcgucaccccgguggcccccgggaagggccuggcccagccgccccaggcguacuucaacgggucccucccgccccagaccgugggccaccaggcccacggccgcgagcagagcacgcugccccgccagacccugcccaucuccgggagccagaccggcuccagcggggucaucagcccccaggagcuccugaagaagcugcagaucgugcagcaggagcagcagcuccacgccuccaaccggcccgcccuggcggccaaguuccccgugcuggcccaguccagcggcaccgggaagccccucgaguccuggaucaacaagacgccgaacaccgagcagcagacgccccuguuccaggucaucagcccccagcgcauccccgccaccgccgcgccgagccugcucaugucccccaugguguucgcccagcccacgagcgugcccccgaaggagcgggaguccggccugcugcccgucggcgggcaggagccgcccgccgccgccaccagccuccugcugcccauccagucccccgagcccagcgugaucaccuccagcccgcugaccaagcuccagcugcaggaggcgcugcucuaccugauccagaacgacgacaacuuccugaacaucaucuacgaggccuaccucuucuccaugacgcaggccgccaugaagaagaccauguga

SEQ ID NO: 29034 - RNA, 1014 nt, Artificial Sequence
  derived and/or modified sequence opt1 from DCPS__Homo_sapiens__NP_054745
auggccgacgccgcgccccagcugggcaagcgcaagcgggagcucgacguggaggaggcccacgccgccagcaccgaggagaaggaggccggggucggcaacgggaccugcgcgccggugcgccugcccuucuccggcuuccggcugcagaaggugcuccgcgagagcgcccgggacaagaucaucuuccugcacgggaaggucaacgaggccuccggcgacggcgacggggaggacgccguggugauccuggagaagacgcccuuccaggucgagcaggucgcgcagcuccugaccggcagccccgagcugcagcuccaguucuccaacgacaucuacagcaccuaccaccuguucccgccccgccagcugaacgacgugaagaccacggugguguaccccgccaccgagaagcaccuccagaaguaccugcggcaggaccugcgccucauccgggagaccggggacgacuaccgcaacaucacccugccccaccuggagucccagagccucuccauccaguggguguacaacauccuggacaagaaggccgaggccgaccggaucgucuucgagaacccggaccccagcgacggcuucgugcugauccccgaccucaaguggaaccagcagcagcuggacgaccuguaccucaucgccaucugccaccgccgggggauccgcucccugcgggaccugacgcccgagcaccucccgcugcugcgcaacauccuccaccagggccaggaggcgauccugcagcgguaccgcaugaagggcgaccaccuccggguguaccugcacuaccugcccagcuacuaccaccuccacguccacuucaccgcccugggguucgaggcccccggcuccgggguggagcgcgcccaccuccuggccgaggugaucgagaaccuggagugcgacccccggcacuaccagcagcgcacccugaccuucgcgcugcgcgccgacgacccgcuccugaagcugcuccaggaggcccagcagagcuga

SEQ ID NO: 29035 - RNA, 2046 nt, Artificial Sequence
  derived and/or modified sequence opt1 from DCST1__Homo_sapiens__NP_001137159
auggacaucaagcaccaccagaacggcacccgcgggcagcggcgcaagcagccccacaccacggugcagcggcugcucaccuggggccugccggucagcugcuccugguuccuguggcgccagcccggggaguuccccgugaccgcccuccugcugggcgccggggcgggcggccuccuggccaucgggcugggcgccaugggguggggcaccagcccccacauccggugcgccucccuccugcuggugccgaagaugcucgggaaggagggccgccuguucguccugggcuacgcccucgcggccaucuacguggggcccguggccaaccugcggcacaaccugaacaacgucaucgccagccucggcugcacgguggagcugcagaucaacaacacccgcgcggccuggcggaucuccaccgcgccccugcgcgccauguucaaggaccuccugagcuccaaggagcugcuccgggccgagacccgcaacaucagcgccacguucgaggaccuggacgcccaggugaacuccgagaccggguacacccccgaggacaccauggacagcggcgagacggcccagggccgggaggcccgccaggccccggcgucccggcugcaccucagcacccagaagauguacgagcugaagaccaagcugcgcugcuccuacgucgugaaccaggccauccucagcugccggcgcugguucgaccggaagcacgagcagugcaugaagcacaucugggugccccugcugacccaccuccugugccugcccaugaaguucaaguucuucugcgggaucgccaaggucauggagguguggugccgcaaccggauccccguggagggcaacuucgggcagacguacgacucccucaaccagagcauccgcggccuggacggggaguucuccgccaacaucgacuucaaggaggagaagcaggccggcguccugggccucaacaccagcugggagcgcguguccaccgaggugcgggacuacgucuaccgccaggaggcgcggcuggagugggcccuggggcuccugcacgugcugcucagcugcaccuuccugcuggugcuccacgccagcuucuccuacauggacagcuacaaccacgacauccgcuucgacaacaucuacaucuccacguacuucugccagaucgacgaccggcgcaagaagcugggcaagcggacccugcugccgcuccgcaaggccgaggagaagaccgucaucuuccccugcaagcccaccauccaggccagcgagauguccaacguggugcgggagcugcuggagacgcuccccauccugcugcuccuggucgugcugugcgggcucgacugggcgcuguacagcaucuucgacaccauccgccaccacuccuuccugcaguacagcuuccgguccagccacaagcucgaggucaaggugggcggggacuccaugcuggcccgccugcuccggaagaccaucggcgcccugaacaccagcuccgagacggugauggagagcaacaacaugccgugccugccccagcccgucggccucgacgcccgcgcguacuggcgggccgccgugcccaucgggcugcuggugugccucugccugcugcaggccuucggcuaccgccuccggcgcgucaucgccgcguucuacuucccgaagcgggagaagaagcgcauccuguuccuguacaacgaccuccugaagaagcgcgccgccuucaccaagcugcggcgcgccgccauccuccggcgcgagcggcagcagaaggcgccccgccacccccuggccgacauccugcaccgggggugcccccuccugcgccgguggcugugccgccggugcguggugugccaggccccggagacccccgaguccuacgucugccgcacccucgacugcgaggccguguacugcuggagcugcugggacgacaugcggcagcgcugccccgugugcacgccccgggaggagcuguccagcuccgccuucagcgacagcaacgacgacaccgcguacgccggcuga

SEQ ID NO: 29036 - RNA, 2322 nt, Artificial Sequence
  derived and/or modified sequence opt1 from DCST2__Homo_sapiens__NP_653223
augcccaaggugaugaaggacgucgugcacccccugggcggggaggagcccagcauggcccgcgccgugguccgcuccgugggcggguucacccucggccugagccuggcgaccgccuacgggcuccuggagcugcucguggagggccacucccccuggggcugccuggucgggacgcugacccucgccgccuuccugagccugggcaugggguucucccgccaggugcgggccaccgugcuccugcugcucccccaggcguucagccgccagggccggacccugcugcucgucgccgccuucgggcuggugcugcagggccccugcgccaacacgcuccgcaacuucacccgggcguccgaggccguggccugcggcgccgagcuggcccugaaccagaccgcggagguccuccagcgcgccaagcagccccuggugagcgcccugaacaagaucaaggccaucgcccggaagaccaaggagguggcggaccgcguccggaaguucuuccgcuccaucauggacggggugaagcacaucgcccgggcccuccgcaacguguggcaguggcugcugcacaucggcgacgucugcaacagcgagcucgggaaccccuaccugaagugcgcccggguguucgacgacgccaaggacuccugcaugauggugaucccccaggcguaccaccugugcuacguccucaugccguucaagcuggcccugugcggccucgccagccugguccagguguucugcgugauccccaaguacauccagcccuuccugcgccagacgaucggcacccccgugauccagcuccugaaccggguccgccaggaguucgaguucaacaugaccgccacccaccacuucuccguggaccugaacgccagccggucccucagccagguggcgauggaccugcacgaggccgucuccaugaagcugcaccgcgugcgggaggcccucgcccugaugggguucacgaccccgcugcuccuggugcugcuguaccuccaggcgcuguucuaccgcuacugcuaccugaacugggaccacuacgacaacaucuacaucaccagccgcuuccuccggauggaggccguccgcuccaccgccggccugcccacggugcugccccucagcgcccacgaggcccggcgcuacaucccgcccgggagcaucuuccugucccagugggagaaguucuucuacauccuggagaccuucaaccucauccggcaccuccugcuggugcuguuccuggucuuccucgacuacgcgguguucugggugcuggaccuggcccgccaccagcuccagggcgagaucgucgcccggagccccgugcuggugucccugaccgucgaggggaccggcuacgccggcaacaucuaccgcgaccucgugagcgccuucgacgugcugcagcaggggaacaucuccauccugagccggcgcugccuccugcggcccuccgagcccgacagcacgggcuacaucgucaucggggugauguacggccugugcuucuucaucacccucuucggguccuacgugagccgccugcggcgcgucaucugcgcguccuacuacccgagccgggagcaggagcgcaucuccuaccuguacaacgugcuccugagccggcgcaccaaccugcucgccgcccugcaccgguccgugcgccgccgggccgccgaccagggccaccgcagcgcguuccugguccucgccucccggugccccugccugggccccuucgugagccacuucuggcugcaccaggccuacugccucgggugcggccagccccaggacgagggggacauggagaacaccguguccugcagcacgccgggcugccaggggcuguacugccugaccugcuuccgccuccuggacaacacgugcagcgucugcgccagcccccuguccuaccagggcgaccucgaccuggagcuggacuccagcgacgaggagggcccccagcucuggcuggcggccgcccagcggaaggaccccgagcaggccuggcugcuccagcagcagcugcaggaggugcuggggcgcucccucagcauggaguccaccagcgaguccagcgaccuggacgaggagaagggcccgcagcagcggaagcacgggcagcagccccugcccgaggcccaccagccgguguccauccucaccagccccgagccccaccggcccccggagaccuccagcgcgaccaagggcgcccccacccccgccuccgagcccagcgucccgcuguccccgcccagccugcccgaccccagccacccgccgcccaaguga

SEQ ID NO: 29037 - RNA, 1413 nt, Artificial Sequence
  derived and/or modified sequence opt1 from DCSTAMP__Homo_sapiens__XP_005251132
augggcaucuggaccagcgggaccgacaucuuccugucccucugggagaucuacgugagcccccgcuccccgggcuggauggacuucauccagcaccugggggucugcugccugguggcccucaucagcgugggccugcuguccgucgccgcgugcugguuccuccccagcaucaucgccgccgccgccuccuggaucaucacgugcgugcugcugugcugcagcaagcacgcgcggugcuucauccuccugguguuccuguccugcgggcuccgcgagggccggaacgcccugaucgccgccggcaccgggaucgucauccugggccacguggagaacaucuuccacaacuucaaggggcuccuggacggcaugaccugcaaccugcgcgccaagagcuucuccauccacuucccccuccugaagaaguacaucgaggcgauccaguggaucuacgggcuggccacgccccucagcguguucgacgaccuggucuccuggaaccagacccuggccgugagccucuucuccccgagccacgugcuggaggcccagcugaacgacuccaagggcgagguccucagcgugcuguaccagauggcgaccaccaccgaggugcuguccagccucggccagaagcugcuggccuucgccgggcucagccugguccugcucggcacggggcuguucaugaagcgguuccugggccccugcggcuggaaguacgagaacaucuacaucacccgccaguucgugcaguucgacgagcgggagcgccaccagcagcggcccugcgugcucccccugaacaaggaggagcgccggaaguacgucaucaucccgaccuucuggcccacccccaaggagcgcaagaaccugggccucuucuuccugcccauccugauccaccucugcaucugggugcuguucgccgccguggacuaccugcucuaccggcugaucuucuccgucagcaagcaguuccagucccugccgggguucgaggugcaccugaagcuccacggggagaagcagggcacgcaggacaucauccacgacagcuccuucaacaucagcguguucgagcccaacugcauccccaagcccaaguuccugcuguccgagaccugggucccgcucagcgugauccugcugauccucgucaugcuggggcugcucuccagcauccugaugcagcugaagauccucguguccgcgagcuucuaccccuccguggagcgcaagcggauccaguaccugcacgccaagcugcucaagaagcgcagcaagcagccccugggcgaggucaagcggcgccugucccucuaccugaccaagauccacuucuggcugcccgugcucaagaugauccggaagaagcagauggacauggccagcgccgacaaguccuga

SEQ ID NO: 29038 - RNA, 570 nt, Artificial Sequence
  derived and/or modified sequence opt1 from DCTD__Homo_sapiens__NP_001012750
auggugggcgggggccagcccugcgggccgaacaugagcgaggucuccugcaagaagcgcgacgacuaccuggaguggcccgaguacuucauggccguggccuuccucagcgcgcagcgguccaaggaccccaacagccaggugggcgccugcaucgucaacuccgagaacaagaucguggggaucggcuacaacggcaugcccaacgggugcagcgacgacgugcugccguggcgccggaccgccgagaacaagcuggacaccaaguaccccuacgucugccacgccgagcucaacgccaucaugaacaagaacuccacggacgugaagggcugcagcauguacguggcgcuguuccccugcaacgagugcgccaagcugaucauccaggccgggaucaaggaggucaucuucauguccgacaaguaccacgacagcgacgaggccaccgcggcccgccuccuguucaacauggccggcgugaccuuccggaaguucauccccaagugcuccaagaucgugaucgacuucgacagcaucaacucccgcccgagccagaagcugcaguga

SEQ ID NO: 29039 - RNA, 1659 nt, Artificial Sequence
  derived and/or modified sequence opt1 from DCT__Homo_sapiens__NP_001123361
augagcccccugugguggggcuuccuccuguccugccuggggugcaagauccucccgggcgcccaggggcaguucccccgcgugugcaugaccgucgacagccuggugaacaaggagugcugcccccggcugggcgccgaguccgcgaacgugugcgggagccagcagggccgcggccagugcaccgagguccgggccgacacgcgccccugguccgggccguacauccuccggaaccaggacgaccgcgagcuguggccccggaaguucuuccaccggaccugcaagugcaccggcaacuucgccggguacaacugcggcgacugcaaguucggguggaccggccccaacugcgagcgcaagaagcccccggugauccgccagaacauccacagccugagcccccaggagcgggagcaguuccucggcgcccuggaccuggccaagaagcgcgugcaccccgacuacgucaucacgacccagcacuggcucgggcugcugggccccaacgggacccagccgcaguucgcgaacugcuccguguacgacuucuucguguggcuccacuacuacuccguccgggacacccugcugggccccggccgccccuaccgggccaucgacuucagccaccaggggcccgccuucgugacguggcaccgcuaccaccuccugugccuggagcgggaccuccagcgccugaucggcaacgaguccuucgcccugccguacuggaacuucgcgaccgggcggaacgagugcgacgugugcaccgaccagcuguucggcgccgcccgccccgacgaccccacccucaucagccggaacucccgcuucagcuccugggagacggucugcgacagccuggacgacuacaaccaccucgugacccugugcaacgggaccuacgagggccugcuccgccggaaccagaugggccgcaacuccaugaagcugcccacccugaaggacauccgggacugccucagccugcagaaguucgacaacccgcccuucuuccagaacuccacguucagcuuccgcaacgcccuggagggguucgacaaggccgacggcacccucgacagccaggugaugucccugcacaaccugguccacagcuuccucaacgggaccaacgcgcugccccacuccgccgccaacgaccccaucuucguggugaucagcaaccggcugcucuacaacgccaccacgaacauccuggagcacguccgcaaggagaaggccaccaaggagcugccgucccuccacgugcuggugcugcacagcuucaccgacgcgaucuucgacgaguggaugaagcgguucaacccgcccgccgacgccuggccccaggagcucgcccccaucggccacaaccgcauguacaacaugguccccuucuucccgcccgugaccaacgaggagcuguuccugacguccgaccagcugggguacagcuacgccaucgaccuccccguguccgucgaggagacccccggcuggcccaccacccugcugguggucaugggcacgcucguggcgcugguggggcuguucguccuccuggccuuccugcaguaccggcgccuccggaagggcuacaccccgcugauggagacccaccugagcuccaagcgcuacaccgaggaggccuga

SEQ ID NO: 29040 - RNA, 3762 nt, Artificial Sequence
  derived and/or modified sequence opt1 from DCTN1__Homo_sapiens__NP_001128512
auggcccagagcaagcgccacguguacucccggacccccagcggcucccgcaugagcgccgaggcguccgcccggccgcugcgcgucgggagccggguggaggugaucggcaaggggcaccgcggcaccgucgccuacgugggggccacccucuucgccaccggcaagugggugggcgucauccuggacgaggcgaaggggaagaacgacggcaccgugcaggggcggaaguacuucacgugcgacgagggccacgggaucuucgugcgccagucccagauccaggucuucgaggacggcgccgacacgaccagccccgagacccccgacuccagcgccuccaaggugcugaagcgggagggcaccgacacgaccgccaagaccagcaagcuccccacccgcccggcguccacggggguggccggcgccagcuccagccuggggcccuccggcagcgccuccgccggcgagcugagcagcuccgagcccagcacccccgcgcagaccccgcucgccgcccccaucauccccacccccguccugacguccccgggggccgugccgccccugcccagccccuccaaggaggaggagggccuccgggcccaggugcgcgaccuggaggagaagcuggagacccuccggcugaagcgcgcggaggacaaggccaagcugaaggagcucgagaagcacaagauccagcuggagcagguccaggaguggaaguccaagaugcaggagcagcaggccgaccugcagcggcgccucaaggaggcccggaaggaggccaaggaggcgcuggaggccaaggagcgcuacauggaggagauggccgacaccgccgacgccaucgagauggcgacccuggacaaggagauggccgaggagcgggccgagucccuccagcaggagguggaggcccugaaggagcgcguggacgagcugacgaccgaccucgagauccugaaggcggagaucgaggagaaggggagcgacggcgccgccuccagcuaccagcugaagcagcucgaggagcagaacgcccggcugaaggacgcccugguccgcaugcgcgaccucuccagcuccgagaagcaggagcacgugaagcugcagaagcugauggagaagaagaaccaggagcucgaggugguccggcagcagcgcgagcggcugcaggaggagcugagccaggcggaguccaccaucgacgagcucaaggagcaggucgacgccgcccugggggccgaggagaugguggagaugcugacggaccgcaaccucaaccuggaggagaaggugcgggagcugcgcgagaccgugggcgaccucgaggccaugaacgagaugaacgacgagcugcaggagaacgcgcgggagaccgagcuggagcuccgcgagcagcuggacauggccggcgcccggguccgcgaggcccagaagcggguggaggccgcgcaggagaccguggccgacuaccagcagaccaucaagaaguaccgccagcugacggcccaccuccaggacgucaaccgggagcugaccaaccagcaggaggccagcguggagcgccagcagcagcccccgcccgagaccuucgacuucaagaucaaguucgcggagaccaaggcccacgccaaggccaucgagauggagcugcggcagauggagguggcccaggcgaaccgccacaugagccugcucacggccuucaugcccgacagcuuccugcggcccgggggcgaccacgacugcguccuggugcuccugcugaugccccgccucaucugcaaggccgagcugauccggaagcaggcccaggagaaguucgagcuguccgagaacugcagcgagcgccccgggcuccgcggcgccgcgggggagcagcugagcuucgccgccggccugguguacucccucagccugcugcaggccacccuccaccgguacgagcacgcccugucccagugcagcgucgacguguacaagaaggugggcucccuguacccggagaugagcgcgcacgagcgcucccucgacuuccugaucgagcugcuccacaaggaccagcuggacgagaccgucaacguggagccccugaccaaggccaucaaguacuaccagcaccucuacagcauccaccuggccgagcagcccgaggacugcacgaugcagcuggccgaccacaucaaguucacccaguccgcgcucgacugcaugagcguggaggucgggcggcugcgcgccuuccugcagggcgggcaggaggccaccgacaucgcccuccugcugcgggaccucgagaccuccugcagcgacauccgccaguucugcaagaagauccggcgccggaugcccggcaccgacgccccggggauccccgcggcccuggccuucggcccccagguguccgacacgcugcucgacugccgcaagcaccugaccuggguggucgccgugcugcaggagguggccgcggccgccgcccagcucaucgccccgcuggcggagaacgagggccugcucgucgccgcccuggaggagcuggccuucaaggccagcgagcagaucuacgggacccccuccagcucccccuacgagugccuccggcagagcugcaacauccugaucagcaccaugaacaagcuggcgacggccaugcaggagggcgaguacgacgccgagcggcccccguccaagcccccgcccguggagcuccgcgccgcggcccugcgcgccgagaucaccgacgccgaggggcugggccucaagcuggaggaccgggagaccgugaucaaggagcugaagaagucccucaagaucaagggcgaggagcugagcgaggccaacguccgccugagccuccuggagaagaagcuggacuccgcggccaaggacgccgacgagcggaucgagaaggugcagacccgccucgaggagacgcaggcccugcugcggaagaaggagaaggaguucgaggagaccauggacgcccuccaggcggacaucgaccagcuggaggccgagaaggccgagcugaagcagcgccucaacagccaguccaagcggaccaucgaggggcugcgcgggcccccgcccagcggcaucgccacccugguguccggcaucgccgggggcgcgauccccggccaggcccccgggagcguccccggccccgggcucgugaaggacagcccccugcugcuccagcagaucuccgccaugcgccugcacaucucccagcugcagcacgagaacagcauccucaagggcgcccagaugaaggcgucccuggccagccugccgccccuccacguggccaagcugucccacgaggggcccggcagcgagcugcccgccggcgcccucuaccggaagacgucccagcugcuggagacccucaaccagcugagcacccacacccacgucguggacaucacgcgcaccagcccggcggccaagucccccagcgcccagcugauggagcaggucgcccagcucaagucccugagcgacaccguggagaagcugaaggacgaggugcucaaggagaccgugucccagcggcccggggccacgguccccaccgacuucgcgaccuucccgagcuccgccuuccugcgcgccaaggaggagcagcaggacgacaccguguacaugggcaaggugacguucagcugcgccgccggguucggccagcggcaccgccugguccucacccaggagcagcugcaccagcugcacucccggcugaucagcuga

SEQ ID NO: 29041 - RNA, 1212 nt, Artificial Sequence
  derived and/or modified sequence opt1 from DCTN2__Homo_sapiens__NP_001248341
auggccgaccccaaguacgccgaccugccgggcaucgcgcgcaacgagcccgacguguacgagaccagcgaccuccccgaggacgaccaggccgaguucgacgccgagcuggaggagcugaccuccacgagcgucgagcacaucaucgugaaccccaacgccgccuacgacaaguucaaggacaagcggguggggaccaagggccucgacuucuccgaccgcaucgggaagaccaagcggaccggcuacgagagcggggaguacgagaugcugggcgagggccugggggucaaggagacgccgcagcagaaguaccagcgccuccugcacgaggugcaggagcugaccaccgagguggagaagaucaagaccacggucaaggaguccgcgaccgaggagaagcucacccccgugcugcuggccaagcagcucgccgcccugaagcagcagcugguggcgagccaccucgagaagcugcugggccccgacgccgccaucaaccucaccgaccccgacggggcccuggccaagcggcugcuccugcagcuggaggcgacgaagaacuccaagggcgggagcggcggcaagaccaccgggaccccgcccgacuccagccucgucacguacgagcugcacucccgccccgagcaggacaaguucagccaggccgccaagguggccgagcuggagaagcggcucaccgagcuggagaccgccgugcgcugcgaccaggacgcgcagaacccccuguccgccggccuccagggggccugccugauggagaccgucgagcugcuccaggccaaggugagcgcccuggaccuggcggugcucgaccaggucgaggcccggcugcaguccgugcugggcaaggugaacgagaucgccaagcacaaggccagcgucgaggacgccgacacgcaguccaaggugcaccagcucuacgagaccauccagcgcuggagcccgaucgcguccacccugcccgagcuggugcagcggcucgucaccaucaagcagcugcacgagcaggccaugcaguucggccagcugcucacgcaccuggacaccacccagcagaugaucgccaacagccugaaggacaacaccacgcuccugacccaggugcagaccaccaugcgcgagaaccuggccacgguggaggggaacuucgcgagcaucgacgagcggaugaagaagcugggcaaguga

SEQ ID NO: 29042 - RNA, 477 nt, Artificial Sequence
  derived and/or modified sequence opt1 from DCTN3__Homo_sapiens__NP_001268354
auggccggccugaccgaccuccagcgccugcaggcccggguggaggagcuggagcgcugggucuacgggcccggcggggcgcggggcagccgcaagguggccgacgggcucgugaagguccagguggcccugggcaacaucuccagcaagcgggagcgcgugaagauccuguacaagaagaucgaggaccucaucaaguaccuggacccggaguacaucgaccggaucgccauccccgacgccuccaagcugcaguucauccucgcggccguccccgagcacgccgcccgccugcagcggcuggcgcagauccacauccagcagcaggaccagugcguggagaucaccgaggagagcaaggcccuccuggaggaguacaacaagacgaccaugcugcucuccaagcaguucgugcagugggacgagcugcugugccagcucgaggccgccacccaggucaagcccgccgaggaguga

SEQ ID NO: 29043 - RNA, 1404 nt, Artificial Sequence
  derived and/or modified sequence opt1 from DCTN4__Homo_sapiens__NP_001129115
auggccagccugcuccaguccgaccgcgugcuguaccugguccagggcgagaagaaggugcgggcgccccucagccagcuguacuucugccgcuacugcuccgagcugcggagccucgagugcgugucccacgaggucgacagccacuacugcccguccugccuggagaacaugcccagcgccgaggccaagcugaagaagaaccgcugcgccaacugcuucgacugccccgggugcaugcacacccucuccacccgggccacgagcaucuccacccagcugcccgacgacccggccaagaccaccaugaagaaggcguacuaccuggccugcggcuucugccgcuggacgagccgggacguggggauggccgacaaguccguggccagcggcggguggcaggagcccgagaacccccacacccagcgcaugaacaagcucaucgaguacuaccagcagcuggcgcagaaggagaaggucgagcgggaccgcaagaagcuggcccggcgccggaacuacaugccccucgccuucucccagcacaccauccacgugguggacaaguacggccugggcacccgccugcagcggccgcgcgccggggccagcaucuccacgcucgcgggccugagccugaaggagggggaggaccagaaggagaucaagaucgagcccgcccaggccgucgacgagguggagccccuccccgaggacuacuacacccggccggugaaccugaccgaggucaccacgcugcagcagcgccuccugcagcccgacuuccagcccgugugcgccucccagcuguacccccggcacaagcaccuccugaucaagcgcagccugcggugccgcaagugcgagcacaaccucagcaagccggaguucaaccccaccuccaucaaguucaagauccagcugguggccgucaacuacauccccgaggugcgcaucaugagcauccccaaccugcgguacaugaaggagucccaggugcuccugacccugaccaacccggucgagaaccucacgcacgugacccuguucgagugcgaggagggcgaccccgacgacaucaacagcaccgcgaagguggucgugccgcccaaggagcuggugcucgccgggaaggacgccgccgccgaguacgacgagcuggcggagccccaggacuuccaggacgaccccgacaucaucgccuuccgcaaggccaacaaggucggcaucuucaucaaggugacgccccagcgggaggagggcgaggucaccgugugcuucaagaugaagcacgacuucaagaaccuggccgcccccauccgcccgaucgaggaguccgaccaggggaccgaggugaucuggcucacccagcacgucgagcugagccugggcccccuccugcccuga

SEQ ID NO: 29044 - RNA, 255 nt, Artificial Sequence
  derived and/or modified sequence opt1 from DCTN5__Homo_sapiens__NP_001185940
auggagcugggcgagcuccuguacaacaagagcgaguacaucgagaccgccuccgggaacaaggugagccgccaguccguccugugcggcagccagaacaucgugcucaacgggaagaacuucgugaucuccgucuuccugagccccuacauccggugccacuccgccugccgcgaccggaagcgcagcgacgaguccgugcggcugagcgugaacaaccgcgagugguggggccucgucaacuggcggauguga

SEQ ID NO: 29045 - RNA, 573 nt, Artificial Sequence
  derived and/or modified sequence opt1 from DCTN6__Homo_sapiens__NP_006562
auggccgagaagacccagaaguccgugaagaucgcccccggcgcggucgugugcguggagagcgagauccgcggggacgucaccaucggcccgcggacggugauccaccccaaggcccgcaucaucgccgaggccgggcccaucgugaucggcgaggggaaccugaucgaggagcaggcccucaucaucaacgcguaccccgacaacaucaccccggacaccgaggaccccgagcccaagcccaugaucaucggcaccaacaacgucuucgaggugggcugcuacagccaggccaugaagaugggggacaacaacgugaucgaguccaaggccuacgucggccggaacgugauccugacgagcgggugcaucaucggcgccugcugcaaccugaacaccuucgaggugaucccggagaacaccgucaucuacggggcggacugccuccgccgggugcagaccgagcgcccccagccccagacgcugcagcuggacuuccucaugaagauccugcccaacuaccaccaccugaagaagaccaugaagggcuccagcaccccggugaagaacuga

SEQ ID NO: 29046 - RNA, 780 nt, Artificial Sequence
  derived and/or modified sequence opt1 from DCUN1D1__Homo_sapiens__NP_065691
augaacaagcucaagagcucccagaaggacaaggugcgccaguucaugaucuucacccagagcuccgagaagaccgccgucagcugccugucccagaacgacuggaagcuggacguggccacggacaacuucuuccagaaccccgagcuguacauccgggagagcgugaagggcucccucgaccgcaagaagcuggagcagcuguacaaccgguacaaggacccgcaggacgagaacaagaucgggaucgacggcauccagcaguucugcgacgaccucgcgcuggaccccgccagcaucuccguccugaucaucgccuggaaguuccgcgccgccacccagugcgaguucagcaagcaggaguucauggacgggaugaccgagcucggcugcgacuccaucgagaagcugaaggcgcagauccccaagauggagcaggagcugaaggagcccgggcgguucaaggacuucuaccaguucaccuucaacuucgccaagaacccgggccagaagggccucgaccuggagauggccaucgccuacuggaaccuggugcucaacgggcgcuucaaguuccuggaccuguggaacaaguuccuccuggagcaccacaagcggagcauccccaaggacacguggaaccugcuccuggacuucuccaccaugaucgcggacgacaugagcaacuacgacgaggagggcgccuggcccgugcugaucgacgacuucgucgaguucgcccgcccccagaucgccgggaccaaguccaccacgguguga

SEQ ID NO: 29047 - RNA, 1326 nt, Artificial Sequence
  derived and/or modified sequence opt1 from DCX__Homo_sapiens__NP_000546
augaagacccugccccuccacagccacugcaccgagaugcagcgccugcugccgaagcucgagaugcugacgcugggcuccagcuucugcucccuccagggggaguucugccaggccauggacagcuucaccaccgugucccacgucggcaugugcgaggagaccgacgccagcuucaacguguucucccccaaguuccaguucgaccggagccacugccagucccugcgcuuccaccagaacauggagcuggacuucgggcacuucgacgagcgggacaagacgagccgcaacaugcggggcucccgcaugaacgggcuccccagccccacccacuccgcgcacugcagcuucuaccggacccgcacccugcaggcccuguccaacgagaagaaggccaagaaggugcgguucuaccgcaacggcgaccgguacuucaagggcaucgucuacgccgugagcuccgaccgcuuccggagcuucgacgcccuccuggcggaccugacgcgcucccucagcgacaacaucaaccugccgcagggggugcgguacaucuacaccaucgacggcagccgcaagaucggguccauggacgagcuggaggagggcgagagcuacgucugcuccagcgacaacuucuucaagaagguggaguacaccaagaacgugaaccccaacugguccgucaacgugaagaccagcgccaacaugaaggccccccagucccucgccagcuccaacagcgcgcaggcccgggagaacaaggacuucgugcgccccaagcuggucacgaucauccgguccggggugaagccgcgcaaggccgugcggguccugcucaacaagaagaccgcccacagcuucgagcaggugcugaccgacaucaccgaggccaucaagcuggagacgggcguggucaagaagcucuacacccuggacggcaagcaggugaccugccugcacgacuucuucggggacgacgacguguucaucgcgugcggccccgagaaguuccgcuacgcccaggacgacuucucccucgacgagaacgagugccgcgucaugaaggggaaccccagcgccaccgccggccccaaggccuccccgacgccccagaagaccagcgcgaagucccccggccccaugcggcgcagcaaguccccggccgacagcgccaacgggaccagcuccagccagcuguccacccccaagagcaagcagucccccaucagcacgcccaccuccccgggcagccugcggaagcacaaggaccucuaccugccccugucccucgacgacagcgacucccugggggacagcauguga

SEQ ID NO: 29048 - RNA, 735 nt, Artificial Sequence
  derived and/or modified sequence opt1 from DCXR__Homo_sapiens__NP_057370
auggagcuguuccucgccggccgccgggugcuggucaccggggccggcaaggggaucggccgcgggaccgugcaggcgcugcacgccacgggcgcccggguggucgccgugagccgcacccaggccgaccucgacucccuggugcgggagugccccggcaucgagccggucugcguggaccugggggacugggaggcgaccgagcgcgcccucggcagcguggggcccgucgaccugcuggugaacaacgccgccguggcgcuccugcagcccuuccuggaggucaccaaggaggccuucgaccgguccuucgaggugaaccuccgcgccgugauccaggucagccagaucguggcccggggccugaucgcccgcggggugcccggcgcgaucgucaacguguccagccagugcucccagcgggccgugacgaaccacagcgucuacugcuccaccaagggcgcccuggacaugcucaccaaggugauggcccuggagcuggggccgcacaagauccgcgugaacgccgucaaccccaccguggucaugacgagcaugggccaggcgaccugguccgacccccacaaggccaagaccaugcucaaccggaucccccuggggaaguucgccgagguggagcacguggucaacgccauccuguuccuccugagcgaccgcuccggcaugaccacgggcagcacccugccgguggagggcggguucugggccugcuga

SEQ ID NO: 29049 - RNA, 558 nt, Artificial Sequence
  derived and/or modified sequence opt1 from DDAH1__Homo_sapiens__XP_011539460
augguggacaugaugaaggaggcccuggagaagcuccagcugaacaucgucgagaugaaggacgagaacgccacccuggacggcggggacguccucuucaccggccgcgaguucuucguggggcugagcaagcggacgaaccagcgcggcgcggagauccuggccgacaccuucaaggacuacgccguguccaccgugcccguggccgacgggcuccaccucaagagcuucugcuccauggccggcccgaaccugaucgcgaucggcagcuccgagagcgcccagaaggcccucaagaucaugcagcagauguccgaccaccgguacgacaagcugaccguccccgacgacaucgccgcgaacugcaucuaccugaacauccccaacaaggggcacgugcuccugcaccgcacgcccgaggaguacccggagagcgccaagguguacgagaagcugaaggaccacaugcucauccccgucuccaugagcgagcuggagaagguggacggccugcugaccugcugcuccgugcugaucaacaagaaggucgacagcuga

SEQ ID NO: 29050 - RNA, 858 nt, Artificial Sequence
  derived and/or modified sequence opt1 from DDAH2__Homo_sapiens__NP_001289937
augggcacccccggggagggccuggggcgcugcagccacgcccucauccggggcgugccggagucccuggccagcggggagggcgcgggcgccgggcugcccgcccucgaccuggccaaggcccagcgcgagcacggcguccucgggggcaagcuccggcagcgccuggggcugcagcuccuggagcugccgcccgaggagucccucccccugggcccccugcucggcgacaccgcggugauccagggggacacggcccugaucacccggcccuggagccccgcccgccggccggagguggacggcguccgcaaggcccugcaggaccucgggcugcggaucguggagaucggcgacgagaacgcgacccuggacggcaccgacgugcuguucacggggcgcgaguucuucgucggccuguccaaguggaccaaccaccgcggggccgagaucguggccgacaccuuccgggacuucgccgugagcaccguccccguguccggccccagccaccuccgggggcugugcggcaugggcgggccccgcacgguggucgccggcuccagcgacgcggcccagaaggccgugcgggccauggccgugcugaccgaccacccguacgcgucccugacccuccccgacgacgccgccgccgacugccuguuccugcgccccgggcuccccggcgucccgcccuuccugcugcaccgcgggggcggcgaccuccccaacagccaggaggcccugcagaagcuguccgacgugacccucgugcccgucagcugcuccgagcuggagaaggcgggggccggccugagcucccucugccuggugcugagcacgcggccgcacuccuga

SEQ ID NO: 29051 - RNA, 3423 nt, Artificial Sequence
  derived and/or modified sequence opt1 from DDB1__Homo_sapiens__NP_001914
augagcuacaacuacguggucaccgcccagaagcccaccgccgugaacggcugcgugacggggcacuucaccuccgcggaggaccugaaccuccugaucgccaagaacacccgccuggagaucuacgucgugaccgccgagggccuccggccggugaaggaggucgggauguacggcaagaucgccgugauggagcuguuccgccccaagggggagagcaaggaccugcuguucauccugacggccaaguacaacgcgugcauccuggaguacaagcaguccggcgagagcaucgacaucaucacccgggcccacggcaacgugcaggaccgcaucgggcggcccuccgagaccggcaucaucgggaucaucgaccccgagugccgcaugaucggccuccggcuguacgacgggcuguucaaggucaucccgcucgaccgcgacaacaaggagcugaaggccuucaacauccggcuggaggagcuccacgugaucgacgugaaguuccuguacggcugccaggcccccaccaucugcuucgucuaccaggacccccagggccgccacgugaagacguacgaggugagccugcgggagaaggaguucaacaaggggcccuggaagcaggagaacgucgaggcggaggccuccauggugaucgccgugccggagcccuucggcggggccaucaucaucggccaggagagcaucaccuaccacaacggcgacaaguaccucgccaucgcgccgcccaucaucaagcaguccaccaucgucugccacaaccgcguggaccccaacgggagccgguaccugcugggcgacauggaggggcgccucuucaugcugcugcucgagaaggaggagcagauggacggcaccgugacgcugaaggaccugcgggucgagcuccugggggagaccuccaucgccgagugccugaccuaccucgacaacggcgugguguucgucggcagccgccugggggacucccagcuggugaagcucaacgucgacagcaacgagcagggcuccuacgugguggccauggagaccuucacgaaccuggggcccaucgucgacaugugcgugguggaccuggagcggcagggccaggggcagcucgugaccugcagcggcgccuucaaggagggcucccugcgcaucauccggaacgggaucggcauccacgagcacgccagcaucgaccugcccgggaucaagggccucuggccccugcgcuccgacccgaaccgggagaccgacgacacccuggugcucagcuucguggggcagacgcgcguccugaugcugaacggcgaggagguggaggagaccgagcucaugggcuucguggacgaccagcagaccuucuucugcgggaacgucgcgcaccagcagcugauccagaucaccagcgccuccgugcgccuggugagccaggagcccaaggcccucgucuccgaguggaaggagccccaggccaagaacaucagcguggccuccugcaacagcucccagguggucguggcggugggccgggcccuguacuaccugcagauccacccccaggagcugcgccagaucagccacacggagauggagcacgaggucgccugccucgacaucaccccgcugggggacuccaacggccugagcccccucugcgccaucggccuguggaccgacaucuccgcccggauccugaagcuccccagcuucgagcugcugcacaaggagaugcucgggggcgagaucaucccccgcuccauccugaugaccacguucgagagcucccacuaccugcucugcgcgcugggggacggcgcccuguucuacuucgggcucaacaucgagaccggccugcugagcgaccggaagaaggugacccucggcacccagccgacggugcugcgcaccuuccggucccugagcaccaccaacgucuucgccugcuccgaccgccccacggugaucuacagcagcaaccacaagcucguguucuccaacgucaaccugaaggaggugaacuacaugugcccccugaacagcgacggguaccccgacucccucgcccuggcgaacaacagcacccugaccaucggcaccaucgacgagauccagaagcuccacauccggaccgugccgcuguacgagagcccccgcaagaucugcuaccaggaggucucccagugcuucggggugcuguccagccggaucgaggugcaggacacguccggcgggaccaccgcccuccgccccagcgccuccacccaggcccugagcuccagcgucuccagcuccaagcuguucagcagcuccacggccccgcacgagaccagcuucggcgaggagguggaggugcacaaccuccugaucaucgaccagcacaccuucgagguccugcacgcgcaccaguuccuccagaacgaguacgcccugucccuggugagcugcaagcucggcaaggaccccaacaccuacuucaucguggggacggccauggucuaccccgaggaggccgagcccaagcagggccggaucgugguguuccaguacuccgacgggaagcugcagaccgucgccgagaaggaggugaagggcgcgguguacagcauggucgaguucaacgggaagcugcucgccuccaucaacagcaccgugcgccuguacgaguggaccacggagaaggagcugcggaccgagugcaaccacuacaacaacaucauggcccucuaccugaagaccaagggcgacuucauccuggugggcgaccucaugcgcuccguccugcugcucgccuacaagccgauggaggggaacuucgaggagaucgcccgggacuucaaccccaacuggaugagcgcgguggagauccuggacgacgacaacuuccugggcgccgagaacgccuucaaccucuucgugugccagaaggacuccgccgcgaccacggacgaggagcgccagcaccuccaggaggucgggcuguuccaccucggcgaguucgugaacgucuucugccacgggagccuggugaugcagaaccugggcgagaccuccacccccacccagggcagcguccucuucgggacggucaacggcaugaucgggcuggugaccucccugagcgaguccugguacaaccuccugcuggacaugcagaaccggcucaacaaggugaucaagagcgucggcaagaucgagcacuccuucuggcgcagcuuccacaccgagcgcaagaccgagcccgccacgggcuucaucgacggggaccugaucgagagcuuccuggacaucucccggccgaagaugcaggaggugguggccaaccuccaguacgacgacggcagcgggaugaagcgcgaggccaccgccgacgaccugaucaaggucguggaggagcugacccggauccacuga

SEQ ID NO: 29052 - RNA, 1284 nt, Artificial Sequence
  derived and/or modified sequence opt1 from DDB2__Homo_sapiens__NP_000098
auggcccccaagaagcgcccggagacccagaagaccagcgagaucgugcugcggccccgcaacaagcggucccgcagcccccucgagcuggagcccgaggccaagaagcugugcgcgaagggcuccgggccgagccggcgcugcgacuccgacugccucugggucggccuggccgggccccagauccugccgcccugccggagcaucgugcgcacgcuccaccagcacaagcugggccgggccuccuggcccagcgugcagcaggggcugcagcaguccuuccuccacacccuggacagcuaccgcauccugcagaaggccgcccccuucgaccggcgcgcgaccucccucgccuggcaccccacccaccccagcacggucgccgugggcuccaagggcggggacaucaugcuguggaacuucggcaucaaggacaagccgaccuucaucaaggggaucggcgccgggggcagcaucaccggccugaaguucaacccccucaacaccaaccaguucuacgcguccagcauggaggggacgacccggcugcaggacuucaagggcaacauccugcgcguguucgccuccagcgacaccaucaacaucugguucugcucccucgacgucagcgccagcucccggaugguggugaccggggacaacgucggcaacgugauccugcugaacauggacggcaaggagcucuggaaccugcgcaugcacaagaagaaggugacgcacgucgcccugaaccccugcugcgacugguuccucgccaccgcgagcguggaccagaccgugaagaucugggaccugcggcagguccgcgggaaggccuccuuccuguacagccucccccaccggcacccggugaacgccgccugcuucucccccgacggcgcccgccugcugaccacggaccagaaguccgagauccggguguacagcgcgagccagugggacugcccccucgggcugaucccccacccgcaccgccacuuccagcaccugacccccaucaaggccgccuggcacccccgcuacaaccucaucgucgugggccgguaccccgacccgaacuucaaguccugcacccccuacgagcugcgcaccaucgacguguucgacgggaacagcggcaagaugaugugccagcuguacgaccccgaguccagcggcaucuccagccucaacgaguucaaccccaugggggacacgcuggccuccgccaugggcuaccacauccugaucuggagccaggaggaggcgcggacccgcaaguga

SEQ ID NO: 29053 - RNA, 1443 nt, Artificial Sequence
  derived and/or modified sequence opt1 from DDC__Homo_sapiens__NP_000781
augaacgccagcgaguuccgccggcgcggcaaggagaugguggacuacgucgccaacuacauggaggggaucgagggccgccagguguaccccgacguggagccgggguaccugcggccccucauccccgcggccgcgccccaggagccggacaccuucgaggacaucaucaacgacgucgagaagaucaucaugcccggcgugacccacuggcacucccccuacuucuucgccuacuuccccacggccagcuccuacccggccaugcuggccgacaugcugugcggggccaucggcugcaucggcuucagcugggccgcgucccccgccugcaccgagcucgagaccgugaugauggacuggcuggggaagaugcuggagcuccccaaggccuuccugaacgagaaggccggcgagggcggcggggucauccaggggagcgccuccgaggcgacccugguggcccuccuggccgcccggacgaaggugauccaccgccugcaggccgcgagccccgagcucacccaggccgccaucauggagaagcuggucgccuacuccagcgaccaggcccacuccagcguggagcgggcgggccugaucgggggcgugaagcucaaggccaucccguccgacgggaacuucgccaugcgcgccagcgcccugcaggaggcgcuggagcgggacaaggccgccggccucauccccuucuucauggucgccacccugggcaccacgaccugcugcuccuucgacaaccugcucgagguggggcccaucugcaacaaggaggacaucuggcugcacguggacgcggccuacgccggcagcgccuucaucugccccgaguuccgccaccuccugaacggggucgaguucgccgacuccuucaacuucaacccgcacaaguggcugcuggugaacuucgacugcagcgcgaugugggugaagaagcggaccgaccucaccggcgccuuccgccuggaccccacguaccugaagcacucccaccaggacagcgggcucaucaccgacuaccggcacuggcagaucccccugggccgccgguuccgcagccugaagaugugguucgucuuccggauguacggcgugaaggggcuccaggccuacauccgcaagcacgugcagcugucccacgaguucgagagccugguccggcaggacccccgcuucgagaucugcguggaggugauccucggccuggucugcuuccggcugaagggguccaacaaggugaacgaggcccuccugcagcgcaucaacagcgccaagaagauccaccuggucccgugccaccuccgcgacaaguucgugcugcgguucgcgaucugcucccgcaccguggagagcgcccacguccagcgggccugggagcacaucaaggagcuggccgccgacgugcuccgcgcggagcgggaguga

SEQ ID NO: 29054 - RNA, 2640 nt, Artificial Sequence
  derived and/or modified sequence opt1 from DDHD1__Homo_sapiens__NP_001153619
augaacuaccccggccgcgggagcccgcggucccccgagcacaacggccgcgggggcgggggcggcgccugggagcuggggagcgacgcccggcccgcguucggcgggggcgugugcugcuucgagcaccuccccgggggcgacccggacgacggcgacgucccccuggcccugcuccgcggggagcccggccugcaccuggcccccgggaccgacgaccacaaccaccaccucgcccuggacccgugccuguccgacgagaacuacgacuucagcuccgccgagagcggcuccagccuccgguacuacuccgagggcgagagcgggggcgggggcuccagccugucccugcacccgccccagcagccgccccucgugcccaccaacagcgggggcggcggggcgacgggcgggucccccggcgagcgcaagcggacccgccucgggggccccgccgcccggcaccgcuacgagguggucaccgagcugggccccgaggaggugcggugguucuacaaggaggacaagaagaccuggaagcccuucaucggguacgacagccugcgcaucgagcuggccuuccggacgcugcuccagaccaccggcgcgcgcccccagggcggggaccgggacggggaccacgugugcucccccaccggcccggccagcuccagcggcgaggacgacgacgaggaccgcgccugcggguucugccagagcacgaccggccacgagcccgagauggucgagcuggugaacaucgagcccgugugcguccgcgggggccuguacgagguggacgugacccagggcgagugcuaccccgucuacuggaaccaggccgacaagaucccggugaugcgggggcagugguucaucgacggcaccuggcagccccucgaggaggaggaguccaaccugaucgagcaggagcaccugaacugcuuccgggggcagcagaugcaggagaacuucgacaucgaggugagcaaguccaucgacggcaaggacgggagcggcaucaacuacuccgccguccacagcuucaagcucucccgcaaccacguggacuggcacagcguggacgaggucuaccuguacuccgacgcgacgaccagcaagaucgcccggaccgugacccagaagcugggcuucuccaaggccagcuccagcgggacgcgccuccaccgcggcuacguggaggaggccacccuggaggacaagcccucccagaccacccacaucgucuucguggugcacgggaucggccagaagauggaccaggggcggaucaucaagaacacggccaugaugcgcgaggcggcccggaagaucgaggagcgccacuucagcaaccacgccacccacgucgaguuccugcccguggaguggcgguccaagcucacccuggacggcgacaccgucgacagcaucacgccggacaaggugcgcggccugcgggacaugcucaacuccagcgccauggacaucauguacuacaccagcccccuguaccgcgacgagcuggugaaggggcuccagcaggagcugaaccggcuguacucccucuucugcagccgcaaccccgacuucgaggagaagggcgggaaggucuccaucgugagccacucccugggcugcgugaucaccuacgacaucaugaccggguggaacccgguccggcuguacgagcagcuccugcagaaggaggaggagcugcccgacgagcgcuggaugagcuacgaggagcggcaccuccuggacgagcuguacaucacgaagcgccggcucaaggagaucgaggagcgccugcacggccugaaggccuccagcaugacccagacccccgcgcugaaguucaagguggagaacuucuucugcaugggcagcccccucgccguguuccuggcccugcgggggauccgcccgggcaacaccgggucccaggaccacauccucccccgggagaucugcaaccgccugcugaacaucuuccaccccacggaccccgucgccuaccgccucgagccgcugauccugaagcacuacuccaacaucagccccgugcagauccacugguacaacaccuccaacccccuccccuacgagcacaugaagccgagcuuccugaaccccgccaaggagcccaccuccgugagcgagaacgagggcaucuccaccauccccagcccggucacgagccccgugcugucccggcgccacuacggggagagcaucaccaacaucggcaaggcguccauccucggcgccgccagcaucgggaagggccucgggggcaugcuguucucccgguucggccgcagcuccaccacccagagcuccgagaccagcaaggacuccauggaggacgagaagaagcccguggccagccccuccgcgacgaccgucgggacccagacccugccgcacagcuccagcggcuuccuggacuccgcccuggagcucgaccaccggaucgacuucgagcugcgcgaggggcugguggagagccgguacugguccgccgugacgagccacaccgccuacuggagcucccucgacgucgcccuguuccugcucaccuucauguacaagcacgagcacgacgacgacgcgaagcccaaccuggaccccaucuga

SEQ ID NO: 29055 - RNA, 684 nt, Artificial Sequence
  derived and/or modified sequence opt1 from DDHD2__Homo_sapiens__NP_001157706
augagcuccgugcagagccagcaggagcagcugucccagagcgaccccuccccgagccccaacuccugcagcuccuucgagcucaucgacauggacgccggcagccuguacgagcccgucagcccccacugguucuacugcaagaucaucgacuccaaggagaccuggaucccguucaacuccgaggacagccagcagcuggaggaggccuacuccagcgggaagggcugcaacgggcgcguggugcccaccgacggcgggcgguacgacguccaccucggcgagcgcaugcgguacgcgguguacugggacgagcuggccuccgaggugcgccggugcacgugguucuacaagggcgacaaggacaacaaguacguccccuacagcgaguccuucagccaggugcuggaggagaccuacaugcucgccgugacccuggacgaguggaagaagaagcuggagagccccaaccgcgagaucaucauccuccacaacccgaagcugaugguccacuaccagcccguggccggguccgacgacuggggcagcacccccacggagcaggggcggccccgcaccgugaagcggggcgucgagaacaucuccguggacauccacugcgggaacgugaaccgccuguucuuccucaccuucggcugcaucugccugcugcucaagcuguga

SEQ ID NO: 29056 - RNA, 1191 nt, Artificial Sequence
  derived and/or modified sequence opt1 from DDI1__Homo_sapiens__NP_001001711
augcugaucaccguguacugcguccgccgggaccucagcgaggugaccuucucccuccaggugagccccgacuucgagcugcgcaacuucaagguccugugcgaggccgagucccgggugccgguggaggagauccagaucauccacauggagcgccugcugaucgaggaccacugcagccucggcuccuacgggcugaaggacggcgacaucgucgugcugcuccagaaggacaacguggggccccgggcccccggccgcgcgcccaaccagccgcgggucgacuucagcgggaucgccgugcccggcacguccagcucccgcccccagcaccccggccagcagcagcagcggaccccggccgcccagcgcagccaggggcuggccuccggcgagaagguggcggggcugcagggccucgggagccccgcccugauccgguccaugcugcucagcaacccccacgaccugucccugcucaaggagcgcaacccgccccuggccgaggcccugcucagcggcucccuggagaccuucagccagguccugauggagcagcagcgggagaaggcgcuccgcgagcaggagcggcugcgccuguacaccgccgacccccucgaccgggaggcccaggccaagaucgaggaggagauccgccagcagaacaucgaggagaacaugaacaucgccaucgaggaggcgcccgaguccuucggccaggugacgaugcuguacaucaacugcaaggugaacgggcacccccugaaggccuucgucgacagcggcgcccagaugaccaucaugagccaggccugcgccgagcggugcaacaucaugcgccucguggaccggcgcugggcggggguggccaagggcgucggcacccagcgcaucaucgggcgggugcaccuggcccagauccagaucgagggcgacuuccugcagugcuccuucagcauccucgaggaccagccgauggacaugcugcuggggcucgacaugcugcgccggcaccagugcuccaucgaccugaagaagaacgugcucgucaucggcaccacggggacccagaccuacuuccugcccgagggcgagcugccccucugcagccgcaugguguccggccaggacgagagcuccgacaaggagaucacccacagcgugauggacuccgggcggaaggagcacuga

SEQ ID NO: 29057 - RNA, 2997 nt, Artificial Sequence
  derived and/or modified sequence opt1 from DDIAS__Homo_sapiens__NP_659455
augaaccgccggcgcaaguuccuccucgccagcgugcuggcccugcagaacuccagcuucaucuaccccuccugccagaagugcuucagccggaucauccucgucuccaagcgcagcaacugcccgaagugcggcuccaccggggagagcggcaacgcgaacuaccgguacaagcugucccugaagguggccgagagcaacaagcuguucgugaucaccgucuucggguccugccuggacacguucuucggccugaccgccaccgggcuccaccgcuacauccaggaccccaacaagauccccgagacccuggacaacgacacgacccagaaccugcucaccaaggccguggagaccugcuucgugggccagagcuucaucuucggcgucacgaacuucgagaaccagcccgggcagggcuccgacgccagcaacuuccugcagcagugcuccgaccacaagcggaaggcgaaggcccugguggccugccagaucgugcucccggaccccgggaucgccggcuucaccgucaucgacuacuuccaccagcugcugcagaccuucaacuuccgcaagcuccagugcgacagccaggcgcccaacaaccaccuccuggcccucgaccacuccaacagcgaccuguccagcaucuacaccagcgacuccacgagcgacuucuucaaguccugcagcaaggacaccuucuccaaguucuggcagcccagccuggaguucacgugcaucgugucccagcucaccgacaacgacgacuucagcgccuccgagcagagcaaggccuucgggacccugcagcagaaccggaaguccaucagcaucgccgaggcgaccggcuccagcuccugccacgacccgauccaggacagcuggucccuggugagcuacauggacaagaaguccaccgccgagaagcucggcaaggagcuggggcugcaggccaaggagcucagcgccguccacagcucccaccacgagaucggcgugaacgacagcaaccuguucucccuggagaugcgcgagccccucgagagcuccaacaccaagagcuuccacuccgccguggagaucaagaaccggagccagcacgagcugcccugcuuccagcaccacgggaucgacacgcccaccucccugcagaagcgcagcgcgugcugcccgcccucccuccugcggcuggaggagaccgccagcuccagccaggacggcgacccccagaucugggacgaccuccccuucuccgagagccugaacaaguuccuggccguccucgaguccgagaucgccgugacccaggccgacgugagcagccgcaagcaccacgucgacaacgacaucgacaaguuccacgcggaccacucccggcugagcgugacgccgcagcgcaccaccggcgcccugcacaccccgcccaucgcccuccgguccagccaggugaucgucaaggccaacugcuccaaggacgacuuccuguucaacugcaaggggaaccugagccccuccguggagaaggagagccagcccgacaacaagguggaggccgucuccgugaaccacaacggccgcgacaugagcgaguacuuccuccccaaccccuaccuguccgcgcugagcuccagcuccaaggaccuggagacgaucgucacccucaagaagaccauccggaucagcccccaccgcgaguccgaccacagcucccugaacaacaaguaccugaacgggugcggcgagaucagcgugagcgagaugaacgagaagcucaccacgcugugcuaccggaaguacaacgacguguccgaccugugcaagcucgagaacaagcaguacugccgcuggagcaagaaccaggacgacuccuucaccaucugccgcaagcugaccuacccgcuggagacccucugcaacagccccaaccgguccacgaacacccugaaggagaugcccugggggcacaucaacaacaacgucacccagagcuacuccaucggcuacgagggcagcuacgacgccuccgccgaccuguucgacgacaucgccaaggagauggacaucgcgaccgagaucaccaagaagucccaggacauccuccugaagugggggacgagccuggccgagagccaccccuccgagagcgacuucucccuccgcagccuguccgaggacuucauccagccgagccagaagcugucccuccagagccugagcgacucccggcacagccggaccugcucccccacgccccacuuccagagcgacuccgaguacaacuucgagaacagccaggacuucgugccgugcucccagagcacccccaucuccggcuuccaccagacccgcauccacgggaucaaccgcgccuucaagaagcccguguucuacagcgaccuggacggcaacuacgagaagauccggaucuuccccgagaacgacaagcagcaggccuccccgagcugccccaagaacaucaagacccccucccagaagauccgcagccccaucgucuccggggugagccagccggacguguucaaccacuaccccuucgccgagugccacgagaccgacuccgacgagugggucccgcccaccacgcagaagaucuuccccagcgacaugcucggcuuccagggcaucgggcugggcaagugccuggcggccuaccacuuccccgaccagcaggagcucccccggaagaagcugaagcacauccgccaggggaccaacaagggccugaucaagaagaagcucaagaacaugcuggccgccguggugaccaagaagaagacccacaaguacaacugcaaguccagcggguggaucagcaagugccccgacauccagguccuggccgcgccgcagcuccaccccauccugggccccgacuccugcagcgaggugaagugcugccugcccuucuccgagaagggcccgcccagcgugugcgagacgcgguccgccuggagccccgagcuguucuccuga

SEQ ID NO: 29058 - RNA, 579 nt, Artificial Sequence
  derived and/or modified sequence opt1 from DDIT3__Homo_sapiens__NP_001181983
auggagcuggugcccgccaccccgcacuaccccgccgacguccucuuccagaccgaccccacggcggagauggccgccgagagccugcccuucuccuucggcacccugagcuccugggagcucgaggccugguacgaggaccugcaggaggugcugagcuccgacgagaacgggggcaccuacgugagcccgcccgggaacgaggaggaggaguccaagaucuucaccacgcucgaccccgccagccuggcguggcugaccgaggaggagcccgagccggccgaggucaccuccaccagccagagcccccacucccccgacuccagccaguccagccucgcccaggaggaggaggaggaggaccagggccgcacgcggaagcgcaagcaguccgggcacagccccgcccgggcgggcaagcagcgcaugaaggagaaggagcaggagaacgagcggaagguggcccagcuggccgaggagaacgagcgccugaagcaggagaucgagcggcucacccgcgagguggaggccacccggcgcgcccugaucgaccggauggucaaccugcaccaggcguga

SEQ ID NO: 29059 - RNA, 699 nt, Artificial Sequence
  derived and/or modified sequence opt1 from DDIT4__Homo_sapiens__NP_061931
augcccagccugugggaccgcuucuccagcuccagcaccuccagcuccccgagcucccucccccggacccccacgcccgaccgcccgccccggagcgccuggggcuccgccacccgcgaggagggguucgaccggagcaccucccuggagagcuccgacugcgagagccuggacuccagcaacuccggcuucgggcccgaggaggacaccgcguaccucgacggcgugagccugcccgacuucgagcugcucagcgacccggaggacgagcaccugugcgccaaccugaugcagcuccugcaggagucccuggcccaggcccgccucgggagccggcgccccgcccggcugcugaugcccucccagcucgucagccaggugggcaaggagcugcugcgccucgcguacuccgagcccugcggccugcgcggggcccugcucgacgugugcgucgagcagggcaagagcugccacuccguggggcagcuggcccuggacccgagccucgugcccacguuccagcugacccugguccuccggcuggacucccggcuguggcccaagauccagggccucuucagcuccgccaacagccccuuccugccgggguucucccagagccugacccucuccaccggcuuccgcgugaucaagaagaagcuguacagcuccgagcagcugcucaucgaggagugcuga

SEQ ID NO: 29060 - RNA, 582 nt, Artificial Sequence
  derived and/or modified sequence opt1 from DDIT4L__Homo_sapiens__NP_660287
augguggccaccggcagccuguccagcaagaaccccgccuccaucagcgagcuccuggacugcggguaccacccggagucccugcucagcgacuucgacuacugggacuacgucgugcccgagcccaaccugaacgaggugaucuucgaggaguccacgugccagaaccuggucaagaugcucgagaacugccugagcaaguccaagcagaccaagcugggcugcagcaaggugcucgugcccgagaagcugacccagcgcaucgcgcaggacguccugcggcucuccagcaccgagccgugcgggcugcgcggcugcgugaugcacgugaaccuggagaucgagaacgucugcaagaagcucgaccggaucgugugcgacuccagcgugguccccaccuucgagcugacgcugguguucaagcaggagaacugcuccuggaccagcuuccgcgacuucuucuucucccgggggcgcuucagcuccggcuuccggcgcacccucauccugagcagcggcuuccggcuggugaagaagaagcucuacucccugaucgggaccacggucaucgagggcagcuga

SEQ ID NO: 29061 - RNA, 2136 nt, Artificial Sequence
  derived and/or modified sequence opt1 from DDN__Homo_sapiens__NP_055901
augcuggacggcccccucuucagcgaggggccggacagcccccgcgagcugcaggacgaggaguccggcuccugccugugggugcagaaguccaagcuccuggucaucgaggugaagaccaucuccugccacuacagccggcgcgcccccucccggcagcccauggacuuccaggccagccacugggcgcgcggguuccagaaccggaccugcggcccgcgccccgggagcccccagcccccgccccggcgccccugggccucccgggugcugcaggaggccacgaacuggcgcgccggcccccucgccgagguccgggcgcgcgagcaggagaagcggaaggccgccucccaggagcgcgaggccaaggagaccgagcggaagcgccggaaggcgggcggggcccgccggagcccgcccggccgcccccggcccgagccgcgcaacgccccgcgcguggcccagcuggccgggcugcccgcgccccuccggccggagcgccuggcccccgugggccgggcgccccgccccuccgcccagccgcagagcgaccccggguccgccugggccggccccuggggcgggcggcgccccggcccgcccagcuacgaggcccaccuccuccugcggggguccgccggcaccgcgccccgccggcgcugggaccggccgccgcccuacgucgccccgcccagcuacgagggcccccaccgcacccuggggacgaagcggggccccgggaacagccaggugcccaccagcagcgcccccgccgccacccccgcccgcaccgacggcgggcggacgaagaagcgccuggacccccggaucuaccgcgacgugcugggcgccuggggccugcggcaggggcagggccuccucgggggcucccccgggugcggcgcggcccgcgcccgcccggagcccggcaagggggugguggagaagucccugggccuggccgcggccgaccugaacagcgggagcgacucccacccccaggccaaggccaccggcagcgccgggaccgagaucgcgcccgccggcuccgccaccgccgccccgugcgcgccccaccccgcgccccggagccgccaccaccugaagggcucccgggaggggaaggagggcgagcagaucugguucccgaagugcuggauccccagccccaagaagcagcccccgcgccacucccagacgcucccccggcccugggcccccgggggcaccggcuggcgcgagagccuggggcugggcgagggggccggccccgagacccucgagggguggaaggccacccggcgcgcccacacgcugccccgguccagccagggccugucccgcggcgaggggguguucgucaucgacgcgaccugcguggugauccggagccaguacguccccaccccgcgcacccagcagguccagcuccugcccuccggcgugacgcggguggugggggacagccccucccagagcaagcccggcaaggaggagggggagggcgccaccguguucccgagccccugccagaagcgccuguccagcucccggcuccugcaccagcccggcgggggccgcgggggcgaggccgagggcgggcggcccggcgacagcacccuggaggagcgcaccuuccggauccucgggcugccggcccccgaggucaaccugcgcgacgcccccacgcagcccggcuccccggagcaccaggcccucgggcccgccgccagcggcgcgcaggggcgggccgagggcuccgagguggccgugguccagcgccgcgccggccgggggugggcccgcacccccggccccuacgcgggggcccugcgggaggccgugagccgcauccggcgccacaccgccccggacuccgacaccgacgaggccgaggagcugagcguccacuccggcagcuccgacggcagcgacacggaggcgcccggggccuccuggcggaacgagcgcacccuccccgaggugggcaacagcucccccgaggaggacgggaagaccgccgagcugagcgacagcgugggcgagauccuggacgucaucucccagaccgaggagguccucuucggggugcgggacauccgcggcacgcagcagggcaaccggaagcgccaguga

SEQ ID NO: 29062 - RNA, 1110 nt, Artificial Sequence
  derived and/or modified sequence opt1 from DDO__Homo_sapiens__NP_003640
augcgccccgcccggcacugggagacccgcuucggcgcccgggacuucgggggcuuccaggacugcuucuuccgcgaccggcugauggacaccgcgcgcaucgccguggucggggccggcgugguggggcucagcacggccgucugcaucuccaagcuggugccgcggugcagcgugaccaucaucuccgacaaguucacccccgacaccacgagcgacgucgccgcgggcaugcugaucccccacaccuaccccgacaccccgauccacacccagaagcagugguuccgcgagacguucaaccaccucuucgccaucgccaacuccgccgaggcgggcgacgccggggugcaccuggugagcggcuggcagaucuuccaguccacccccaccgaggagguccccuucugggccgacguggugcugggguuccggaagaugaccgaggccgagcucaagaaguucccccaguacgucuucggccaggccuucacgacccugaagugcgagugcccggcguaccugcccuggcucgagaagcgcaucaaggggagcggcggcuggacccugacccggcgcaucgaggaccugugggagcuccaccccuccuucgacaucguggugaacugcagcgggcugggcucccggcagcuggccggggacagcaagaucuuccccguccgcggccaggugcuccaggugcaggccccgugggucgagcacuucauccgggacggcuccgggcugacguacaucuaccccggcaccagccacgugacccucgggggcacccgccagaagggggacuggaaccugucccccgacgccgagaacagccgggagauccugucccgcugcugcgcccuggagcccagccuccacggcgcgugcaacauccgggagaaggugggccugcgcccguaccggcccgggguccgccugcagacggagcuccuggcccgcgacggccagcggcugcccguggugcaccacuacgggcacggcuccgggggcaucagcguccacuggggcaccgcccucgaggccgcccgccuggugagcgagugcguccacgcgcugcggacccccaucccgaaguccaaccucuga

SEQ ID NO: 29063 - RNA, 1527 nt, Artificial Sequence
  derived and/or modified sequence opt1 from DDR1__Homo_sapiens__NP_001189450
augggccccgaggcccugagcucccuccugcugcuccugcugguggccagcggggacgcggacaugaagggccacuucgacccggccaagugccgcuacgcccucgggaugcaggaccggaccauccccgacuccgacaucagcgccuccagcuccuggagcgacuccaccgccgcgcgccacagccggcuggaguccagcgacggcgacggggccuggugccccgccggcuccgucuuccccaaggaggaggaguaccuccagguggaccuccagcgccugcaccugguggcccucgucggcacgcaggggcggcacgcgggcgggcugggcaaggaguucagccgcuccuaccggcugcgcuacagccgggacgggcgccgguggaugggcuggaaggaccgcuggggccaggaggugaucuccgggaacgaggacccggagggcgugguccucaaggaccuggggccgcccaugguggcccggcuggugcgcuucuacccccgggccgaccgcgucaugagcgugugccugcggguggagcuguacggcugccuguggcgcgacggccuccuguccuacaccgcccccgucgggcagaccauguaccugagcgaggccguguaccucaacgacagcaccuacgacggccacacggucgggggccugcaguacgggggccugggccagcucgcggacgggguggugggccuggacgacuuccggaagucccaggagcugcgcguguggcccggguacgacuacgucggcuggagcaaccacuccuucagcuccggguacguggagauggaguucgaguucgaccggcuccgcgccuuccaggccaugcagguccacugcaacaacaugcacacccugggcgcccgccugcccggcgggguggagugccgguuccgccggggccccgccauggcgugggagggggagccgaugcgccacaaccucggcgggaaccugggcgacccccgggcccgcgccgugagcgugccccugggcgggcgggucgcccgcuuccuccagugccgguuccuguucgccggccccuggcuccuguucuccgagaucagcuucaucuccgacguggucaacaacagcuccccggcgcucgggggcaccuucccgcccgcccccugguggccgcccgggcccccgcccaccaacuucagcucccuggagcuggagccccgcggccagcagcccguggccaaggccgagggcagccccacggccauccugaucgggugccugguggcgaucauccuccugcugcuccugaucaucgcccugaugcuguggcggcuccacuggcgccggcugcuguccaaggccgagcgccggguccucgaggaggagcugaccgugcaccugagcgugcccggcgacaccauccucaucaacaaccgccccgggccccgggagccgccgcccuaccaggagccccgcccccggggcaacccgccccacuccgcccccugcguccccaacggcagcggggcgcccguguga

SEQ ID NO: 29064 - RNA, 2568 nt, Artificial Sequence
  derived and/or modified sequence opt1 from DDR2__Homo_sapiens__XP_011507889
augauccugaucccccgcaugcuccuggugcuguuccuccugcugccgauccucagcuccgccaaggcccaggucaaccccgcgaucugccgguacccccugggcaugagcgggggccagauccccgacgaggacaucaccgccuccagccagugguccgagagcaccgccgccaaguacgggcgccuggacuccgaggagggcgacggggccuggugcccggagauccccguggagcccgacgaccucaaggaguuccugcagaucgaccugcacacgcuccacuucaucacccuggugggcacccagggccggcacgccgggggccacgggaucgaguucgcgcccauguacaagaucaacuacagccgcgacggcacccgguggaucuccuggcgcaaccggcacgggaagcagguccuggacggcaacagcaacccguacgacaucuuccucaaggaccuggagccgcccaucguggcccgcuucgugcgguucauccccgucacggaccacuccaugaacgugugcaugcgcguggagcuguacggcugcgucuggcucgacgggcuggugagcuacaacgcccccgcgggccagcaguucgugcugcccgggggcuccaucaucuaccucaacgacagcgucuacgacggcgccgugggguacuccaugaccgagggccuggggcagcugaccgacggcgugagcgggcucgacgacuucacccagacgcacgaguaccacgucuggcccggcuacgacuacgugggcuggcggaacgaguccgccaccaacggguacaucgagaucauguucgaguucgaccgcauccggaacuucaccaccaugaaggugcacugcaacaacauguucgccaagggcgucaagaucuucaaggaggugcagugcuacuuccgcagcgaggccuccgagugggagcccaacgcgaucagcuucccgcuggugcuggacgacgucaaccccagcgcccgguucgugacggugccccuccaccaccgcauggccuccgccaucaagugccaguaccacuucgccgacaccuggaugauguucagcgagaucaccuuccaguccgacgcggccauguacaacaacagcgaggcccugcccaccuccccgauggcccccacgaccuacgaccccaugcugaaggucgacgacagcaacacccggauccucaucgggugccugguggccaucaucuucauccugcucgcgaucaucgucaucauccuguggcgccaguucuggcagaagaugcuggagaaggccucccggcgcaugcucgacgacgagaugaccgugagccugucccugcccagcgacuccagcauguucaacaacaaccgguccagcuccccgagcgagcagggcuccaacagcacguacgaccgcaucuucccccuccgccccgacuaccaggagcccucccggcugauccgcaagcugccggaguucgcccccggggaggaggagagcggcugcagcggcguggucaagcccgugcagccguccgggcccgagggcgugccccacuacgccgaggccgacaucgucaaccuccagggggugaccggcgggaacaccuacagcgugcccgcggucaccauggaccugcuguccggcaaggacguggccguggaggaguucccgcggaagcuccugacguucaaggagaagcugggcgaggggcaguucggcgagguccaccucugcgagguggaggggauggagaaguucaaggacaaggacuucgcccuggacgugagcgccaaccagcccguccugguggcggugaagaugcugcgcgccgacgccaacaagaacgcccggaacgacuuccucaaggagaucaagaucaugucccgccugaaggaccccaacaucauccaccuccuggccgucugcaucaccgacgacccccugugcaugaucaccgaguacauggagaacggcgaccugaaccaguuccucagccggcacgagccgcccaacuccagcuccagcgacgugcgcaccguguccuacacgaaccugaaguucauggcgacccagaucgccagcggcaugaaguaccuguccagccucaacuucguccaccgggaccuggccacccgcaacugccugguggggaagaacuacaccaucaagaucgccgacuucggcaugucccggaaccucuacagcggggacuacuaccgcauccagggccgggccgugcugcccauccgcuggauguccugggagagcauccugcucgggaaguucacgaccgcgagcgacgucugggccuucggcgugacccugugggagaccuucacguucugccaggagcagcccuacucccagcugagcgacgagcaggucaucgagaacaccggcgaguucuuccgggaccaggggcgccagaccuaccucccgcagcccgccaucugccccgacuccguguacaagcugaugcugagcugcuggcggcgcgacaccaagaaccggcccuccuuccaggagauccaccuccugcugcuccagcagggcgacgaguga

SEQ ID NO: 29065 - RNA, 945 nt, Artificial Sequence
  derived and/or modified sequence opt1 from DDRGK1__Homo_sapiens__NP_076424
augguggcccccgucugguaccugguggccgcggcccuccuggugggcuucauccuguuccucacccgcagccgggggcgcgccgccuccgccggccaggagccgcugcacaacgaggagcuggcgggggccggccgggucgcccagcccgggccccucgagcccgaggagccgcgcgccggcggccggccccgccggcgccgggaccuggggagccgccugcaggcgcagcggcgcgcccagcggguggccugggccgaggccgacgagaacgaggaggaggcggugauccucgcccaggaggaggagggcgucgagaagcccgccgagacccaccuguccgggaagaucggcgccaagaagcugcgcaagcucgaggagaagcaggcccggaaggcgcagcgcgaggccgaggaggccgagcgggaggagcgcaagcggcuggagagccagcgcgaggccgaguggaagaaggaggaggagcggcugcgccucgaggaggagcagaaggaggaggaggagcgcaaggcccgggaggagcaggcgcagcgcgagcacgaggaguaccugaagcugaaggaggccuucgugguggaggaggagggggucggcgagacgaugaccgaggagcagucccagagcuuccucaccgaguucaucaacuacaucaagcaguccaagguggugcugcuggaggaccucgccagccaggucggccugcggacccaggacacgaucaaccgcauccaggaccugcucgccgaggggaccaucaccggcgugaucgacgaccgggggaaguucaucuacaucacccccgaggagcuggccgcgguggccaacuucauccgccagcggggccgcgucuccaucgccgagcuggcccaggcgagcaacucccucaucgccuggggccgggagagcccggcccaggcccccgccuga

SEQ ID NO: 29066 - RNA, 357 nt, Artificial Sequence
  derived and/or modified sequence opt1 from DDT__Homo_sapiens__NP_001077861
augcccuuccuggagcucgacaccaaccugccggccaaccgcgugcccgccggccuggagaagcggcucugcgcggccgccgccagcauccuggggaagcccgccgaccgcgucaacgugaccgugcggcccggccuggcgauggcccucuccgggagcacggagccgugcgcccagcuguccaucagcuccaucggcgucguggggaccgccgaggacaaccgcagccacuccgcgcacuucuucgaguuccugaccaaggagcucgcccugggccaggaccggauccugauccgcuucuucccccucgagagcuggcagaucggcaagaucgggaccgugaugacguuccuguga

SEQ ID NO: 29067 - RNA, 405 nt, Artificial Sequence
  derived and/or modified sequence opt1 from DDTL__Homo_sapiens__NP_001077862
augcccuuccuggagcucgacaccaaccugccggccaaccgcgugcccgccggccuggagaagcggcucugcgcggccgccgccagcauccuggggaagcccgccgaccgcgucaacgugaccgugcggcccggccuggcgauggcccucagcgggagcacggagccgugcgcccagcuguccaucagcuccaucggcgucguggggaccgccgaggacaaccgcagccacuccgcgcacuucuucgaguuccugaccaaggagcucgcccugggccaggaccgguuccccaccgugcugagcacgucccccgccgcccacggcgggccccgcugcccgggcgagaucaucgaggggaagaaguccugccucaacgaggaggcccuguucaucuacuucaucuga

SEQ ID NO: 29068 - RNA, 2628 nt, Artificial Sequence
  derived and/or modified sequence opt1 from DDX10__Homo_sapiens__NP_004389
augggcaagaccgccaacagccccggguccggcgcccgcccggaccccgugcggagcuucaaccgcuggaagaagaagcacucccaccggcagaacaagaagaagcagcugcgcaagcagcucaagaagcccgaguggcaggucgagcgggagagcaucucccgccugaugcagaacuacgagaagaucaacgugaacgagaucacccgguucagcgacuucccccuguccaagaagacgcucaaggggcugcaggaggcgcaguaccgccuggugaccgagauccagaagcagaccaucggccucgcccugcaggggaaggacguccugggcgccgccaagaccggcagcgggaagacgcucgccuuccuggugccggugcuggaggcgcucuaccggcugcaguggaccuccaccgacggccuggggguccucaucaucagccccacccgcgagcuggccuaccagacguucgaggugcugcggaaggugggcaagaaccacgacuucuccgccgggcucaucaucggcggcaaggaccugaagcacgaggccgagcgcaucaacaacaucaacauccuggucugcacccccgggcggcuccugcagcacauggacgagaccgugagcuuccacgcgaccgaccugcagaugcucgugcuggacgaggccgaccgcauccuggacaugggcuucgccgacacgaugaacgccgucaucgagaaccuccccaagaagcggcagacccugcuguucuccgccacccagaccaagagcgugaaggaccucgcgcgccugucccugaagaacccggaguacguguggguccacgagaaggccaaguacagcacgcccgccacccucgagcagaacuacaucgugugcgagcugcagcagaagaucuccgugcuguacagcuuccuccggucccaccugaagaagaaguccaucgucuucuucagcagcugcaaggaggugcaguaccuguaccgcguguucugccggcuccgccccggggucagcauccuggcccugcacggccggcagcagcagaugcgccgcauggagguguacaacgaguucgugcggaagcgcgccgcgguccucuucgccaccgacaucgccgcccggggccuggacuuccccgccgugaacuggguccugcaguucgacugcccggaggacgcgaacaccuacauccaccgcgccgggcggacggcccgcuacaaggaggacggcgaggcccuccugauccugcuccccuccgagaaggccauggugcagcagcugcugcagaagaaggugcccgucaaggagaucaagaucaaccccgagaagcugaucgacgugcagaagaagcucgagagcauccuggcgcaggaccaggaccugaaggagcgggcccagcgcugcuucguguccuacguccggagcguguaccucaugaaggacaaggagguguucgacgucuccaagcugccgauccccgaguacgcccugagccucgggcuggccguggcgccccgcgugcgguuccugcagaagaugcagaagcagcccaccaaggagcucguccgcucccaggccgacaaggugaucgagccgcgggcccccagccugaccaacgacgagguggaggaguuccgcgccuacuucaacgagaagauguccauccugcagaagggcgggaagcggcucgagggcaccgagcaccgccaggacaacgacacgggcaacgaggagcaggaggaggaggaggacgacgaggaggagauggaggagaagcuggccaaggcgaaggggagccaggcccccucccugcccaacaccagcgaggcccagaagaucaaggaggucccgacccaguuccucgaccgggacgaggaggaggaggacgccgacuuccugaaggugaagcgccacaacguguucggccuggaccucaaggacgagaagacccugcagaagaaggagcccuccaagagcuccaucaagaagaagaugacgaaggucgccgaggcgaagaaggugaugaagcggaacuucaaggugaacaagaagaucaccuucaccgacgagggggagcugguccagcaguggccccagaugcagaaguccgccaucaaggacgccgaggaggacgacgacaccggcgggaucaaccuccacaaggccaaggagcgccugcaggaggaggacaaguucgacaaggaggaguaccgcaagaagaucaaggccaagcaccgggagaagcgccugaaggagcgggaggcgcgccgggaggccaacaagcgccaggccaaggccaaggacgaggaggaggcguuccucgacuggagcgacgacgacgacgacgacgacgacggcuucgaccccagcacgcugccggaccccgacaaguaccggagcuccgaggacagcgacuccgaggacauggagaacaagaucagcgacaccaagaagaagcagggcaugaagaagcgcuccaacagcgagguggaggacguggggcccaccucccacaaccggaagaaggcccgcugggacacccuggagccgcucgacacgggccugagccuggccgaggacgaggagcucguccugcaccuccugcggucccagagcuga

SEQ ID NO: 29069 - RNA, 2643 nt, Artificial Sequence
  derived and/or modified sequence opt1 from DDX11__Homo_sapiens__NP_001244074
auggccgagcuguaccgcgugcucgaggccggcaagaucgggaucuucgagagccccaccggcaccgggaagucccugagccugaucugcggcgcgcucuccuggcugcgggacuucgagcagaagaagcgcgaggaggaggcccggcugcucgagacggggaccggcccgcugcacgacgagaaggacgagagccugugccucuccagcuccugcgagggcgccgccgggacgccccgccccgccggcgagcccgcgugggucacccaguucgugcagaagaaggaggagcgggaccugguggaccgccugaaggccgagcaggcccggcgcaagcagcgggaggagcgccuccagcagcugcagcaccggguccagcugaaguacgccgcgaagcgccuccggcaggaggaggaggagcgcgagaaccugcugcggcucagccgcgagaugcuggagaccgggccggaggccgagcggcuggagcagcucgaguccggcgaggaggagcuggugcuggccgaguacgagagcgacgaggagaagaagguggccucccgcgucgacgaggacgaggacgaccucgaggaggagcacaucaccaagaucuacuacugcagccggacccacucccagcuggcccaguucgugcacgaggugaagaagucccccuucgggaaggacguccgccuggugagccucggcagccggcagaaccugugcgugaacgaggacgucaagucccugggcagcgugcagcucaucaacgaccgcugcguggacaugcagcgcucccggcacgagaagaagaagggggcggaggaggagaagcccaagcgccggcgccaggagaagcaggccgccugccccuucuacaaccacgagcagaugggccugcugcgggacgaggcccucgccgaggucaaggacauggagcagcugcuggcgcucgggaaggaggcccgcgccugcccguacuacggcagccggcuggccauccccgccgcgcagcugguggugcuccccuaccagaugcugcugcacgccgccacccgccaggccgccggcauccggcuccaggaccaggucgugaucaucgacgaggcgcacaaccugaucgacacgaucaccgggaugcacagcguggaggucuccggcagccagcugugccaggcccacucccagcuccugcaguacguggagcgcuacgggaagcggcugaaggccaagaaccucauguaccugaagcagauccuguaccugcucgagaaguucguggccguccugggcgggaacaucaagcagaaccccaacacccagagccugucccagaccggcacggagcucaagaccaucaacgacuuccuguuccagagccagaucgacaacaucaaccuguucaaggugcagcgcuacugcgagaaguccaugaucagccggaagcuguucggcuucaccgagcgcuacggggcggucuucuccagccgggagcagccgaagcucgccggcuuccagcaguuccugcagucccuccagccccgcaccacggaggcccuggccgcccccgcggacgagagccaggccuccacccugcggcccgccagcccgcucaugcacauccagggguuccuggccgcccugaccaccgcgaaccaggacggccgcgugauccucucccggcaggggagccugucccagagcacgcugaaguuccuccugcugaaccccgccgugcacuucgcccaggucgugaaggagugccgcgccguggucaucgccggcggcaccaugcagcccguguccgacuuccgccagcagcuccuggcgugcgccgggguggaggccgagcgggucguggaguucagcugcggccacgugaucccgcccgacaacauccugccccucgucaucugcagcgggaucuccaaccagccccuggaguucaccuuccagaagcgcgagcugccccagaugauggacgaggugggccggauccucugcaaccugugcgggguggucccgggcggcguggugugcuucuuccccagcuacgaguaccugcgccagguccacgcccacugggagaagggcgggcuccuggggcggcuggcggcccgcaagaagaucuuccaggagcccaaguccgcccaccagguggagcagguccuccuggccuacagccggugcauccaggccugcggccaggagcgcggccaggugaccggggcgcugcuccuguccguggugggcgggaagaugagcgagggcaucaacuucuccgacaaccuggggcggugcgucgugauggugggcaugcccuucccgaacauccgcagcgccgagcuccaggagaagauggccuaccuggaccagacgcugccccgggcccccggccaggccccgcccgggaaggcgcucgucgagaaccugugcaugaaggccgugaaccaguccaucggccgcgccauccggcaccagaaggacuucgccagcgugguccugcucgaccagcgcuacgcccggccgcccgugcuggcgaagcugcccgccuggauccgcgcccggguggaggucaaggccaccuucgggcccgcgaucgccgccgugcagaaguuccaccgcgagaaguccgccagcuccuga

SEQ ID NO: 29070 - RNA, 2196 nt, Artificial Sequence
  derived and/or modified sequence opt1 from DDX17__Homo_sapiens__NP_001091974
augcccaccggcuucguggccccgauccugugcguccuccugcccagccccacccgcgaggccgcgacgguggccuccgccaccggggacagcgccuccgagcgggagagcgccgcgcccgccgccgccccgaccgcggaggcccccccccccuccguggucacccgcccggagccccaggcccugcccagccccgccauccgggccccgcuccccgaccuguaccccuucggcacgaugcgcgggggcggguucggcgaccgggaccgcgaccgggaccgcggcggguucggcgcgcgggggggcgggggccugcccccgaagaaguucggcaaccccggggagcgccuccggaagaagaagugggaccuguccgagcugcccaaguucgagaagaacuucuacguggagcaccccgagguggcccgccucaccccguacgaggucgacgagcugcggcgcaagaaggagaucaccgugcggggcggggacgugugccccaagcccgucuucgccuuccaccacgccaacuucccccaguacgugauggacgugcugauggaccagcacuucaccgagccgacgcccauccagugccagggcuucccccucgcccugagcggccgcgacauggucgggaucgcgcagaccggcuccgggaagacccuggccuaccuccugcccgccaucgugcacaucaaccaccagccguaccuggagcggggcgacgggcccaucugccucgugcuggcccccacccgcgagcuggcccagcagguccagcagguggcggacgacuacggcaagugcagccggcucaaguccacgugcaucuacggcggggccccgaagggcccccagauccgcgaccuggagcgggggguggagaucugcaucgccacccccggccgccugaucgacuuccucgagagcgggaagaccaaccugcgccggugcaccuaccugguccucgacgaggccgaccgcaugcuggacaugggcuucgagccccagauccggaagaucguggaccagauccgcccggaccggcagacgcugaugugguccgccaccuggcccaaggaggugcgccagcucgcggaggacuuccugcgggacuacacccagaucaacgucggcaaccuggagcucagcgccaaccacaacauccugcagaucguggacgugugcauggaguccgagaaggaccacaagcugauccagcucauggaggagaucauggccgagaaggagaacaagaccaucaucuucgucgagacgaagcgccggugcgacgaccugacccgccggaugcgccgggacggguggcccgccaugugcauccacggcgacaagagccagcccgagcgcgacugggugcugaacgaguuccgguccgggaaggcgccgauccucaucgccaccgacgucgccagccgcggccuggacguggaggacgugaaguucgucaucaacuacgacuaccccaacuccagcgaggacuacgugcaccggaucgggcgcaccgcccggagcacgaacaagggcaccgccuacaccuucuucacccccggcaaccugaagcaggcgcgcgagcucaucaaggugcuggaggaggccaaccaggccaucaaccccaagcugaugcagcucgucgaccaccgcgggggcgggggcggcgggggcaaggggggccggucccgcuaccggacgaccagcuccgccaacaacccgaaccugauguaccaggacgagugcgaccgccggcugcgcggggugaaggacggcggccggcgcgacagcgccuccuaccgggaccgcagcgagaccgaccgggcgggguacgccaacggcuccggguacggcagccccaacuccgccuucggggcccaggccggccaguacaccuacggccaggggacguacggcgcggccgccuacgggaccagcuccuacaccgcccaggaguacggcgcggggaccuacggcgccagcuccacgaccagcaccggccgcuccagccaguccagcucccagcaguucagcgggaucggccggagcgggcagcagccccagccccucaugucccagcaguucgcccagccgcccggcgccaccaacaugaucggguacaugggccagaccgccuaccaguacccccccccgcccccccccccgccccccagccgcaaguga

SEQ ID NO: 29071 - RNA, 2013 nt, Artificial Sequence
  derived and/or modified sequence opt1 from DDX18__Homo_sapiens__NP_006764
augagccaccuccccaugaagcuccugcgcaagaagaucgagaagcggaaccugaagcuccgccagcggaaccugaaguuccagggcgccuccaaccugacccucagcgagacccagaacggggacguguccgaggagacgaugggcagccgcaaggucaagaaguccaagcagaagccgaugaacguggggcugagcgagacccagaacggcgggaugucccaggaggccgugggcaacaucaaggucaccaagagcccccagaaguccaccgugcugacgaacggcgaggcggccaugcagagcuccaacagcgaguccaagaagaagaagaagaagaagcggaagauggugaacgacgccgagcccgacaccaagaaggccaagaccgagaacaagggcaagagcgaggaggaguccgccgagaccacgaaggagaccgagaacaacgucgagaagcccgacaacgacgaggacgagagcgaggugccgucccucccccuggggcugaccggggcguucgaggacaccagcuucgccucccucugcaaccuggugaacgagaacacgcugaaggccaucaaggagaugggcuucaccaacaugaccgagauccagcacaagagcauccgcccccuccuggaggggcgggaccugcucgccgcggccaagaccggcagcggcaagacgcuggccuuccugauccccgccgucgagcucaucgugaagcugcgcuucaugccgcggaacgggaccggcgugcugauccucucccccacccgcgagcuggccaugcagaccuucgggguccugaaggagcucaugacgcaccacgugcacaccuacggccugaucaugggcgggagcaaccgguccgcggaggcccagaagcugggcaacgggaucaacaucaucguggccacccccggccgccuccuggaccacaugcagaacacccccggguucauguacaagaaccugcagugccucgucaucgacgaggccgaccggauccuggacgugggcuucgaggaggagcugaagcagaucaucaagcuccugccgacgcgccggcagaccaugcuguucagcgccacccagacccgcaagguggaggaccucgcgcggaucucccugaagaaggagccccuguacgucggcguggacgacgacaaggccaacgccacgguggacgggcucgagcagggcuacgucgugugccccagcgagaagcgcuuccugcugcuguucaccuuccugaagaagaaccggaagaagaagcugaugguguucuucuccagcugcauguccgucaaguaccacuacgagcuccugaacuacaucgaccugcccgugcuggccauccacgggaagcagaagcagaacaagcgcaccaccacguucuuccaguucugcaacgccgacagcggcacccuccugugcaccgacgucgcggcccgggggcuggacaucccggagguggacuggaucgugcaguacgacccgcccgacgaccccaaggaguacauccaccgcgucggccgcaccgcccggggccucaacgggcgcggccacgcccugcugauccuccggcccgaggagcugggguuccugcgcuaccucaagcaguccaaggugccccugagcgaguucgacuucuccuggagcaagaucuccgacauccagagccagcuggagaagcucaucgagaagaacuacuuccugcacaaguccgcccaggaggcguacaagagcuacauccgggccuacgacucccacagccugaagcagaucuucaacgugaacaaccucaaccugccccaggucgcccugagcuucggcuucaaggugcccccguucguggaccucaacgucaacuccaacgaggggaagcagaagaagcgcggcggcgggggcggguucggcuaccagaagacgaagaagguggagaaguccaagaucuucaagcacaucagcaagaaguccagcgacagccggcaguucucccacuga

SEQ ID NO: 29072 - RNA, 1437 nt, Artificial Sequence
  derived and/or modified sequence opt1 from DDX19A__Homo_sapiens__NP_060802
auggccaccgacagcugggcccuggcgguggacgagcaggaggccgccgucaaguccaugaccaaccuccagaucaaggaggagaaggugaaggccgacacgaacggcaucaucaagaccagcaccaccgccgagaagacggacgaggaggagaaggaggaccgcgcggcccagucccugcugaacaagcucauccggagcaaccugguggacaacaccaaccaggucgaggugcugcagcgcgaccccaacuccccgcucuacagcgugaaguccuucgaggagcugcggcugaagccccagcuccugcagggggucuacgccaugggcuucaaccgccccagcaagauccaggagaacgcccugcccaugaugcucgcggagccgccccagaaccugaucgcccagucccagagcgggaccggcaagaccgccgccuucgugcuggccaugcucucccggguggagcccagcgaccgcuacccccagugccugugccuguccccgacguacgagcucgcgcugcagaccgggaaggucaucgagcagaugggcaaguucuaccccgagcugaagcucgccuacgccgugcggggcaacaagcuggagcgcgggcagaagaucagcgagcagaucgugaucggcacccccgggaccguccuggacuggugcuccaagcucaaguucaucgaccccaagaagaucaagguguucgugcuggacgaggccgacgucaugaucgccacgcagggccaccaggaccagagcauccggauccagcgcaugcugccgcggaacugccagaugcuccuguucuccgcgaccuucgaggacagcguguggaaguucgcccagaaggugguccccgaccccaacgugaucaagcugaagcgcgaggaggagacccucgacaccaucaagcaguacuacgugcugugcuccagccgggacgagaaguuccaggcccugugcaaccucuacggggccaucacgaucgcccaggcgaugaucuucugccacacccgcaagaccgccagcuggcuggccgccgagcuguccaaggagggccaccaggucgcccuccugagcggcgagaugaugguggagcagcgggcggccgugaucgagcgcuuccgggaggggaaggagaagguccuggugaccacgaacgucugcgcccgcggcaucgacguggagcaggucuccguggugaucaacuucgaccuccccguggacaaggacgggaacccggacaacgagaccuaccugcaccggaucggccgcaccggccgguucgggaagcgcggccuggccgucaacaugguggacagcaagcacuccaugaacauccucaaccgcauccaggagcacuucaacaagaagaucgagcggcuggacaccgacgaccuggacgagaucgagaagaucgcgaacuga

SEQ ID NO: 29073 - RNA, 2223 nt, Artificial Sequence
  derived and/or modified sequence opt1 from DDX1__Homo_sapiens__NP_004930
auggccgccuucagcgagaugggcgugaugcccgagaucgcgcaggccgucgaggagauggacuggcugcucccgaccgacauccaggccgaguccaucccccugauccucgggggcggggacgugcugauggccgccgagaccggcagcgggaagacgggcgcguucuccauccccgugauccagaucgucuacgagacccugaaggaccagcaggagggcaagaaggggaagaccaccaucaagacgggcgccagcgugcugaacaaguggcagaugaaccccuacgaccgcggguccgccuucgccaucggcagcgacgggcucugcugccagucccgggaggugaaggaguggcacggcugccgcgcgaccaagggccugaugaaggggaagcacuacuacgaggucagcugccacgaccagggccugugccggguggggugguccaccaugcaggccagccucgaccugggcaccgacaaguucggcuucggguucggcgggacgggcaagaagucccacaacaagcaguucgacaacuacggggaggaguucaccaugcacgacaccaucggcugcuaccuggacaucgacaagggccacgugaaguucagcaagaacgggaaggaccucggccuggccuucgagaucccgccccacaugaagaaccaggcccuguuccccgccugcguccucaagaacgcggagcugaaguucaacuucggggaggaggaguucaaguucccgcccaaggacggcuucguggcccuguccaaggcccccgacggguacaucgucaagagccagcacuccggcaacgcccaggugacccagacgaaguuccuccccaacgcccccaaggcgcugaucguggagccgagccgcgagcuggccgagcagacccucaacaacaucaagcaguucaagaaguacaucgacaaccccaagcugcgggagcugcucaucaucggcgggguggccgcccgcgaccagcuguccguccuggagaacggcguggacaucguggucgggacccccggccggcucgacgaccuggugagcaccgggaagcugaaccucucccaggugcgcuuccugguccuggacgaggccgacggccuccugagccagggcuacagcgacuucaucaaccggaugcacaaccagaucccccaggugacguccgacgggaagcgccuccaggugaucgucugcagcgcgacccugcacuccuucgacgugaagaagcugagcgagaagaucaugcacuucccgaccugggucgaccugaagggcgaggacuccgugcccgacaccgugcaccacgucguggugcccgucaaccccaagacggaccggcucugggagcgccugggcaagagccacauccggaccgacgacgugcacgccaaggacaacacccgcccgggggccaacucccccgagauguggagcgaggccaucaagauccugaagggcgaguacgccgugcgggcgaucaaggagcacaagauggaccaggccaucaucuucugccgcaccaagaucgacugcgacaaccucgagcaguacuucauccagcagggcggcgggcccgacaagaaggggcaccaguucuccugcgucugccugcacggggaccggaagccccacgagcgcaagcagaaccuggagcgguucaagaagggcgacgugcgcuuccucaucugcacggacguggccgcccggggcaucgacauccacggggucccguacgugaucaacgugacccugcccgacgagaagcagaacuacguccaccgcaucggccgcguggggcgggcggagcgcaugggccuggccaucagccucguggccaccgagaaggagaaggucugguaccacgugugcuccagccgggggaagggcugcuacaacacccgccugaaggaggacggcgggugcacgaucugguacaacgagaugcagcugcuguccgagaucgaggagcaccucaacugcaccaucagccagguggagcccgacaucaagguccccguggacgaguucgacggcaaggugaccuacgggcagaagcgggccgccggcgggggcuccuacaagggccacgucgacauccuggcgccgaccgugcaggagcuggccgcccucgagaaggaggcccagacgagcuuccugcaccugggguaccuccccaaccagcuguuccgcaccuucuga

SEQ ID NO: 29074 - RNA, 2352 nt, Artificial Sequence
  derived and/or modified sequence opt1 from DDX21__Homo_sapiens__NP_004719
augcccggcaagcugcgcagcgacgccgggcucgaguccgacaccgccaugaagaagggcgagacccugcggaagcagacggaggagaaggagaagaaggagaagcccaagagcgacaagaccgaggagaucgcggaggaggaggagaccguguuccccaaggccaagcaggucaagaagaaggccgagcccuccgagguggacaugaacagccccaaguccaagaaggccaagaagaaggaggagccgagccagaacgacaucucccccaagaccaagagccugcgcaagaagaaggagcccaucgagaagaagguggucuccagcaagacgaagaaggugaccaagaacgaggagcccuccgaggaggagaucgacgccccgaagcccaagaagaugaagaaggagaaggagaugaacggggagacccgggagaagucccccaagcucaagaacggcuucccccacccggagcccgacugcaaccccuccgaggcggccagcgaggaguccaacagcgagaucgagcaggagauccccguggagcagaaggagggggccuucuccaacuucccgaucagcgaggagaccaucaagcugcugaagggccgcggcgucacguuccucuuccccauccaggccaagaccuuccaccacguguacuccgggaaggaccugaucgcgcaggcccggaccggcaccgggaagacguucagcuucgccaucccccugaucgagaagcuccacggcgagcugcaggaccgcaagcgggggcgcgcgccccaggugcugguccucgccccgacccgggagcuggccaaccaggugagcaaggacuucuccgacaucaccaagaagcugagcguggccugcuucuacggcggcacccccuacgggggccaguucgagcgcaugcggaacgggaucgacauccucgucggcacgcccggccgcaucaaggaccacauccagaacgggaagcuggaccugaccaagcucaagcacguggugcuggacgaggucgaccagaugcuggacaugggcuucgccgaccagguggaggagauccucuccguggccuacaagaaggacagcgaggacaacccccagacccugcuguucuccgcgaccugcccgcacugggucuucaacguggccaagaaguacaugaaguccacguacgagcaggucgaccucaucgggaagaagacccagaagaccgccaucaccgucgagcaccuggccaucaagugccacuggacgcagcgggccgccgugaucggcgacgugauccgcgucuacagcgggcaccagggccggaccaucaucuucugcgagaccaagaaggaggcgcaggagcugagccagaacuccgccaucaagcaggacgcccagagccuccacggcgacaucccccagaagcagcgcgagaucacccugaagggguuccggaacggcuccuucggggugcuggucgccacgaacguggccgcgcgcggccucgacauccccgagguggaccuggucauccagagcagcccgccgaaggacguggagagcuacauccaccgguccgggcgcaccggccgggccggccgcaccggggugugcaucugcuucuaccagcacaaggaggaguaccagcugguccagguggagcagaaggccggcaucaaguucaagcgcaucggggugcccagcgccaccgagaucaucaaggcguccagcaaggacgccauccggcuccuggacuccgugcccccgacggccaucagccacuucaagcagagcgccgagaagcugaucgaggagaagggcgccguggaggcgcucgccgccgcccuggcccacaucuccggggcgaccagcguggaccagcgcucccugaucaacagcaacgucggcuucgugaccaugauccuccagugcuccaucgagaugcccaacaucagcuacgccuggaaggagcugaaggagcagcugggcgaggagaucgacuccaaggugaaggggauggucuuccucaagggcaagcugggggugugcuucgacgugcccaccgccagcgucacggagauccaggagaaguggcacgacucccggcgcuggcagcugagcguggccaccgagcagcccgagcucgagggcccgcgggagggcuacgggggcuuccgcgggcagcgggagggcucccgcggguuccggggccagcgcgacggcaaccggcgcuuccgggggcagcgcgagggcagccgggggccccgcggccagcgguccgggggcggcaacaagagcaaccgcucccagaacaaggggcagaagcggagcuucuccaaggccuucggccaguga

SEQ ID NO: 29075 - RNA, 1452 nt, Artificial Sequence
  derived and/or modified sequence opt1 from DDX25__Homo_sapiens__NP_037396
auggccagccugcucuggggcggggacgccggcgcggccgaguccgagcgccugaacagccacuucuccaaccugagccagccccggaagaaccucugggggaucaaguccaccgccgugcgcaacaucgacggcagcaucaacaacaucaacgaggacgacgaggaggacgucguggaccuggccgccaacucccugcucaacaagcugauccaccagagccugguggaguccagccaccgggucgaggugcuccagaaggacccguccagcccccuguacuccgugaagaccuucgaggagcugcgccucaaggaggagcugcugaaggggaucuacgcgaugggcuucaaccggcccagcaagauccaggagauggcccuccccaugaugcuggcccacccgccccagaaccugaucgcccagucccagagcggcacggggaagaccgcggccuucguccucgccaugcugucccgcgugaacgcccuggagcuguucccccagugccugugccuggcccccaccuacgagcucgcgcugcagaccggccggguggucgagcagauggggaaguucugcguggacgugcaggucauguacgccauccgcggcaaccggaucccgcgcgggacggacaucaccaagcagaucaucaucggcacccccggcaccgugcuggacuggugcuucaagcucaagcugaucgaccugacgaagauccggguguucguccucgacgaggccgacgugaugaucgacacccagggguucagcgaccacuccauccgcauccagcgggcccugcccagcgagugccagaugcuccucuucagcgccaccuucgaggacuccguguggcacuucgcggagcgcaucauccccgacccgaacgucaucaagcugcggaaggaggagcugacccucaacaacauccgccaguacuacgugcugugcgagcaccggaaggacaaguaccaggcccugugcaacaucuacggcagcaucacgaucgggcaggccaucaucuucugccagacccgccggaacgccaaguggcucaccguggagaugauccaggacggccaccaggucucccugcugagcggcgagcucaccguggagcagcgcgccuccaucauccagcgguuccgcgacgggaaggagaaggugcugaucacgaccaacgucugcgcgcgcggcaucgacgugaagcaggucaccaucguggugaacuucgaccugcccgucaagcagggggaggagcccgacuacgagaccuaccuccaccggaucggccgcacggggcgguucggcaagaagggccuggccuucaacaugaucgagguggacgagcugcccagccucaugaagauccaggaccacuucaacuccagcaucaagcagcugaacgccgaggacauggacgagaucgagaagaucgacuacuga

SEQ ID NO: 29076 - RNA, 2391 nt, Artificial Sequence
  derived and/or modified sequence opt1 from DDX27__Homo_sapiens__NP_060365
auggugcuggcccagcgccggcgcggcgggugcgagaagcuccgggccggcccccaggcgguccuggccagcggguccggcuucugcgacaacaugcuggccgaccucgggcugaucggcaccaucggcgaggacgacgaggugccgguggagcccgagagcgacuccggggacgaggaggaggagggccccaucguccuggggcgccggcagaaggcccucggcaagaaccgcagcgccgacuucaaccccgacuucguguucaccgagaaggaggggacguacgacggcuccugggcgcuggccgacgugaugagccagcugaagaagaagcgggccgccaccacccucgacgagaagaucgagaagguccgcaagaagcggaagaccgaggacaaggaggcgaaguccggcaagcuggagaaggagaaggaggccaaggaggggagcgagccgaaggagcaggaggaccugcaggagaacgacgaggagggcuccgaggacgaggccagcgagacggacuacuccagcgccgacgagaacauccucaccaaggccgacacccugaaggugaaggaccgcaagaagaagaagaagaaggggcaggaggcgggcggcuucuucgaggacgccucccaguacgacgagaaccugagcuuccaggacaugaaccucucccggccccugcugaaggccaucaccgccaugggguucaagcagcccacgcccauccagaaggccugcaucccggugggccuccuggggaaggacaucugcgcgugcgccgccaccggcaccgggaagaccgccgccuucgcgcugcccguccucgagcgccugaucuacaagccccggcaggcccccgugacgcgcgugcugguccucgugccgacccgggagcugggcauccaggugcacagcgucacccgccagcuggcccaguucugcaacaucaccacgugccucgccgugggcgggcuggacgugaagucccaggaggccgcgcugcgggccgcccccgacauccucaucgccacccccggccgccugaucgaccaccuccacaacugccccagcuuccaccuguccagcaucgagguccugauccuggacgaggcggaccggaugcucgacgaguacuucgaggagcagaugaaggagaucauccgcaugugcagccaccaccggcagaccaugcuguucuccgccaccaugacggacgaggugaaggaccuggccagcgugucccucaagaacccgguccgcaucuucgugaacagcaacaccgacguggcccccuuccugcgccaggaguucauccggauccgccccaaccgggagggggaccgcgaggccaucgucgcggcccugcucacccggaccuucacggaccacgugaugcuguucacccagaccaagaagcaggcccaccgcaugcacauccugcucggccugauggggcugcaggucggcgagcuccacggcaaccugucccagacccagcggcuggaggcccugcgccgguucaaggacgagcagaucgacauccucguggccacggacguggcggcccgcgggcuggacaucgagggcgucaagaccgugaucaacuucaccaugcccaacaccaucaagcacuacgugcaccgggucgggcgcacggcccgggccggccgcgccgggcggagcgugucccuggugggcgaggacgagcgcaagaugcucaaggagaucgucaaggcggccaaggccccggugaaggcccggauccugccccaggacgugauccugaaguuccgcgacaagaucgagaagauggagaaggacgucuacgcggugcuccagcuggaggccgaggagaaggagaugcagcagagcgaggcccagaucaacaccgccaagcggcugcucgagaagggcaaggaggccgugguccaggagcccgagcgcuccugguuccagaccaaggaggagcgcaagaaggagaagaucgcgaaggcccugcaggaguucgaccuggcccuccgggggaagaagaagcgcaagaaguucaugaaggacgccaagaagaagggcgagaugaccgccgaggagcggagccaguucgagauccugaaggcgcagauguucgccgagcgccuggccaagcggaaccgccgggccaagcgcgcccgggcgaugcccgaggaggagccggugcgcgggcccgccaagaagcagaagcagggcaagaaguccguguucgacgaggagcucacgaacaccagcaagaaggcccugaagcaguaccgggccggccccuccuucgaggagcgcaagcagcuggggcucccccaccagcggcgcggcgggaacuucaagagcaagucccgguacaagcgccggaaguga

SEQ ID NO: 29077 - RNA, 1623 nt, Artificial Sequence
  derived and/or modified sequence opt1 from DDX28__Homo_sapiens__NP_060850
auggcccugacccgccccgugcggcuguucagccuggucacccgccugcuccuggccccgcggcgcggccugacggugcggucccccgacgagccccuccccgugguccgcaucccgguggcgcugcagcggcagcuggagcagcgccagagccggcgccggaaccucccccgccccgugcugguccggcccgggccgcugcucguguccgcccgccggcccgagcugaaccagcccgcccgccugacccucggccggugggagcgcgcgccccuggccagccagggguggaagucccggcgcgcccggcgcgaccacuucagcaucgagcgcgcccagcaggaggccccggccgugcggaagcuguccagcaagggcuccuucgcggaccucgggcuggagccccgcguccugcacgcccuccaggaggccgcccccgagguggugcagcccaccaccguccagagcuccacgaucccgagccugcugcggggccgccacguggugugcgccgcggagaccggcuccgggaagacccucagcuaccugcugccccuccugcagcggcugcucggccagcccucccuggacagccugcccaucccggcgccccgcgggcucguccuggugcccucccgggagcuggcccagcagguccgcgccguggcccagccccucggccggagccuggggcugcucgugcgcgaccuggagggcggccacgggaugcggcgcauccggcugcagcucucccgccagccgagcgccgacgugcuggucgccacccccggcgcccuguggaaggcccucaagagccggcugaucucccuggagcagcucagcuuccuggugcuggacgaggccgacacgcugcucgacgaguccuuccuggagcugguggacuacauccucgagaagucccacaucgcggaggggcccgccgaccuggaggaccccuucaacccgaaggcccagcugguccucgugggcgccaccuuccccgagggcgucgggcagcugcugaacaagguggccagccccgacgcggugaccaccaucacgagcuccaagcuccacugcaucaugccgcacgucaagcagaccuuccugcgccugaagggcgccgacaagguggccgagcucgugcacauccugaagcaccgggaccgcgccgagcggaccgggcccagcggcaccguccugguguucugcaacuccagcuccacggugaacuggcucggguacauccuggacgaccacaagauccagcaccuccgccuccagggccagaugcccgcgcugaugcgcgucggcaucuuccagagcuuccagaaguccagccgggacauccugcucugcaccgacaucgccucccgcgggcuggacagcaccggcguggagcugguggucaacuacgacuucccgcccacccuccaggacuacauccaccgggccgggcgcgugggccgggugggguccgagguccccggcacggugaucagcuucgugacccaccccugggacgucucccuggugcagaagaucgagcuggccgcccgccggcgccggagccuccccggccuggcgagcuccgugaaggagccgcugccccaggccaccuga

SEQ ID NO: 29078 - RNA, 2556 nt, Artificial Sequence
  derived and/or modified sequence opt1 from DDX31__Homo_sapiens__NP_073616
auggcccccgaccuggccagccagcgccacuccgagagcuucccguccgugaacagccggcccaacgucauccuccccggccgcgaggggcggcgcgagggccugccgcccgggggcgggacccggggcucccuggugcccacccgccccgugcccccgagccccgcgccccucggcacgucccccuacagcuggucccggagcgggccgggccgcgggggcggggccggcuccagccgggucccccgcggcgugcccgggcccgccgugugcgccccgggcucccugcugcaccacgccagccccacccagaccauggcggccgccgacgggucccucuucgacaacccccggaccuucagccgccggcccccggcccaggcgucccgccaggccaaggccacgaagcggaaguaccaggccagcuccgaggccccgcccgcgaagcgccggaacgagaccagcuuccugcccgccaagaagaccagcgucaaggagacccagcgcacguucaagggcaacgcccagaagauguucuccccgaagaagcacagcguguccaccagcgaccggaaccaggaggagcgccagugcaucaagaccuccagccuguucaagaacaaccccgacauccccgagcuccaccggcccguggucaagcagguccaggagaagguguucaccuccgccgccuuccacgagcugggccugcacccgcaccucaucagcacgaucaacaccgugcugaagauguccagcaugaccuccgugcagaagcagagcauccccgugcugcucgaggggcgcgacgcgcugguccgcucccagaccggcagcgggaagacgcuggccuacugcauccccguggugcagucccuccaggccauggagagcaagauccagcgguccgacggccccuacgcccugguccuggugcccacccgcgagcucgcccugcagagcuucgacaccgugcagaagcugcucaagcccuucaccuggaucguccccggggugcugaugggcggcgagaagcggaaguccgagaaggcgcgccugcggaaggggaucaacauccucaucagcacgccgggccgccugguggaccacaucaagagcaccaagaacauccacuucucccggcugcgcuggcucgucuucgacgaggccgaccggauccuggaccugggguucgagaaggacaucaccgugauccucaacgccgucaacgccgagugccagaagcgccagaacgugcugcugagcgccacccucacggagggcgugacccggcuggcggacaucucccugcacgaccccgucagcaucuccgugcucgacaagagccacgaccagcugaaccccaaggacaaggccgugcaggaggucugcccgccgcccgccggggacaagcuggacuccuucgccauccccgagagccucaagcagcacgugaccgugguccccuccaagcugcgccuggugugccucgcggccuucauccugcagaagugcaaguucgaggaggaccagaagaugguggucuucuucagcuccugcgagcugguggaguuccacuacagccucuuccugcagacccugcuguccagcuccggcgcccccgccagcggccagcuccccuccgccagcaugcggcugaaguuccugcgccuccacgggggcauggagcaggaggagcggacggcgguguuccaggaguucagccacucccgccgcgggguccugcugugcaccgacguggccgcccggggccucgaccugccccaggugaccuggaucguccaguacaacgcccccagcuccccggccgaguacauccaccggaucgggcgcaccgcgcgcaucggcugccacggcagcucccugcucauccuggcccccagcgaggccgaguacgugaacucccuggccagccacaagaucaacguguccgagaucaagauggaggacauccucugcguccugacgcgggacgacugcuucaaggggaagcgcuggggcgcccagaagucccacgcgguggggccccaggagauccgggagcgcgccaccgugcugcagaccgucuucgaggacuacgugcacagcagcgagcggcgcguguccugggccaagaaggcccuccagagcuucauccaggcguacgccaccuacccccgggagcugaagcacaucuuccacguccgcucccugcaccucggccacguggccaagagcuucggccugcgggacgccccgcgcaaccuguccgcccucacgcggaagaagcgcaaggcgcacgugaagcggcccgaccugcacaagaagacccagagcaagcacucccuggccgagauccuccgcagcgaguacagcuccgggauggaggccgacaucgccaaggucaagaagcagaacgcccccggcgagcccgggggccggccgcugcagcacagccugcagcccacccccugcuucgggcgcggcaagacccucaaguggcggaagacccagaagggcgugcagcgcgacuccaagacgagccagaagguguga

SEQ ID NO: 29079 - RNA, 1284 nt, Artificial Sequence
  derived and/or modified sequence opt1 from DDX39A__Homo_sapiens__NP_005795
auggccgagcaggacguggagaacgaccugcucgacuacgacgaggaggaggagccccaggccccgcaggagagcacccccgcgccgcccaagaaggacaucaagggcuccuacgucagcauccacuccagcggguuccgcgacuuccugcugaagcccgagcuccugcgggccaucguggacugcggcuucgagcaccccuccgaggugcagcacgagugcaucccccaggccauccuggggauggacguccucugccaggccaagagcggcauggggaagaccgccguguucgugcuggcgacgcugcagcagaucgagcccgucaacggccaggugaccgugcucgucaugugccacacccgcgagcuggccuuccagaucuccaaggaguacgagcgguucagcaaguacaugccguccgugaaggugagcgucuucuucggcgggcuguccaucaagaaggacgaggaggugcucaagaagaacugcccccacguggucgugggcacccccgggcgcauccuggcccuggugcggaaccgcagcuucucccucaagaacgucaagcacuucgugcuggacgagugcgacaagaugcuggagcagcucgacaugcggcgcgacgugcaggagaucuuccggcugacgccccacgagaagcagugcaugauguucagcgccacccuguccaaggacauccgcccggucugccggaaguucaugcaggaccccauggagguguucguggacgacgagaccaagcucacccugcacggccugcagcaguacuacgucaagcucaaggacagcgagaagaaccgcaagcuguucgaccugcucgacgugcuggaguucaaccaggucaucaucuucgugaaguccgugcagcggugcauggcgcuggcccagcuccuggucgagcagaacuuccccgccaucgccauccaccgcgggauggcccaggaggagcggcugagccgcuaccagcaguucaaggacuuccagcggcgcauccucguggcgacgaaccuguucggccggggcauggacaucgagcgcgugaacaucgucuucaacuacgacaugcccgaggacuccgacaccuaccugcaccggguggcccgcgccgggcgcuucggcaccaaggggcucgccaucaccuucgugagcgacgagaacgacgccaagauccugaacgacguccaggaccgguucgaggugaacguggcggagcugccggaggagaucgacaucagcacguacaucgagcagucccgcuga

SEQ ID NO: 29080 - RNA, 1287 nt, Artificial Sequence
  derived and/or modified sequence opt1 from DDX39B__Homo_sapiens__NP_542165
auggccgagaacgacguggacaacgagcugcucgacuacgaggacgacgaggucgagaccgccgcgggcggggacggcgccgaggcccccgccaagaaggacgugaaggggagcuacguguccauccacagcuccggcuuccgcgacuuccugcugaagccggagcuccugcgggccaucgucgacugcggguucgagcaccccagcgaggugcagcacgagugcaucccccaggcgauccugggcauggacgugcucugccaggccaaguccggcauggggaagaccgccgucuucgugcuggccacgcugcagcagcucgagcccgugaccggccaggucagcgugcuggugaugugccacacccgcgagcuggcguuccagaucuccaaggaguacgagcgguucagcaaguacaugccgaacgucaagguggccguguucuucgggggccucuccaucaagaaggacgaggagguccugaagaagaacugcccccacaucgugguggggacccccggccgcauccuggcccucgcccggaacaagagccugaaccugaagcacaucaagcacuucauccucgacgagugcgacaagaugcuggagcagcuggacaugcgccgggacguccaggagaucuuccgcaugacgccccacgagaagcaggucaugauguucuccgccacccucagcaaggagauccggccggugugccgcaaguucaugcaggaccccauggagaucuucguggacgacgagaccaagcugacccugcacggccuccagcaguacuacgugaagcugaaggacaacgagaagaaccggaagcuguucgaccuccuggacgugcuggaguucaaccaggucgugaucuucgucaaguccgugcagcgcugcaucgcgcucgcccagcugcugguggagcagaacuuccccgccaucgccauccaccgggggaugccccaggaggagcgccucagccgguaccagcaguucaaggacuuccagcgccggauccuggucgccacgaaccuguucggccgcgggauggacaucgagcgggugaacaucgcguucaacuacgacaugccggaggacuccgacaccuaccuccaccgcguggcccgggccggccgcuucggcaccaaggggcuggccaucaccuucgucagcgacgagaacgacgccaagauccugaacgacgugcaggaccgcuucgaggugaacaucuccgagcuccccgacgagaucgacaucagcuccuacaucgagcagacgcgguga

SEQ ID NO: 29081 - RNA, 1986 nt, Artificial Sequence
  derived and/or modified sequence opt1 from DDX3X__Homo_sapiens__NP_001180345
augagccacguggccgucgagaacgcccugggccucgaccagcaguucgcggggcuggaccugaacuccagcgacaaccaguccggcgggagcaccgccuccaagggccgcuacaucccgccccaccuccggaaccgcgaggccaccaagggguucuacgacaaggacagcuccggcuggagcuccagcaaggacaaggacgccuacuccagcuucggcucccggagcgacucccgcggcaagagcuccuucuucagcgaccggggguccgggagccgcggccgguucgacgaccgcgggcggagcgacuacgacggcaucggcucccgcggggaccggagcggcuucgggaaguucgagcgcggcggcaacucccgguggugcgacaagagcgacgaggacgacugguccaagccccugccgcccagcgagcgccuggagcaggagcuguucuccgggggcaacacggggaucaacuucgagaaguacgacgacauccccguggaggccaccggcaacaacugcccgccccacaucgagagcuucuccgacguggagaugggggagaucaucaugggcaacaucgagcugacccgguacacccgccccacgcccguccagaagcacgcgauccccaucaucaaggagaagcgggaccugauggccugcgcccagaccggcagcgggaagaccgccgcguuccuccugcccauccugucccagaucuacagcgacggccccggggaggcccuccgcgccaugaaggagaacggccgguacgggcgccggaagcaguacccgaucucccuggugcuggcccccacccgcgagcucgccgugcagaucuacgaggaggcgcgcaaguucagcuaccggucccgcguccggcccugcgugguguacggcggcgccgacaucgggcagcagauccgcgaccuggagcggggcugccaccuccucgucgccacgcccgggcgccugguggacaugauggagcggggcaagaucgggcuggacuucugcaaguaccucgugcuggacgaggccgaccgcaugcuggacaugggcuucgagccgcagauccggcgcaucgucgagcaggacaccaugccgcccaagggcgugcggcacaccaugauguucagcgccaccuuccccaaggagauccagaugcucgcgcgcgacuuccuggacgaguacaucuuccuggccguggggcgggucggcuccacgagcgagaacaucacccagaagguggugugggucgaggaguccgacaagcgcagcuuccuccuggaccugcucaacgccaccgggaaggacagccugacccugguguucguggagacgaagaagggcgccgacucccucgaggacuuccuguaccacgagggcuacgccugcaccagcauccacggggaccggucccagcgcgaccgggaggaggcgcugcaccaguuccgcagcggcaagucccccauccucgucgccaccgccguggccgcccgggggcuggacaucagcaacgugaagcacgucaucaacuucgaccugcccuccgacaucgaggaguacgugcaccgcaucggccgcaccgggcgggucggcaaccucggccuggcgacgagcuucuucaacgagcgcaacaucaacaucaccaaggaccugcucgaccugcugguggaggccaagcaggaggugcccuccuggcucgagaacauggccuacgagcaccacuacaaggggagcucccggggccgcagcaagucccgguucagcgggggcuucggggcccgcgacuaccggcaguccagcggcgcguccagcagcuccuucagcuccagccgcgccuccagcucccggagcggcgggggcgggcacggcuccagccgcggguucggcggcgggggcuacgggggcuucuacaacuccgacggguacggcggcaacuacaacagccagggggucgacugguggggcaacuga

SEQ ID NO: 29082 - RNA, 1974 nt, Artificial Sequence
  derived and/or modified sequence opt1 from DDX3Y__Homo_sapiens__NP_001289481
auggagaucggccgcccccggaaggacaccuggaagcuggccaaccucgaccugaacagcgagaagcaguccgggggcgccagcaccgcguccaaggggcgcuacaucccgccccaccuccggaaccgcgaggccagcaagggcuuccacgacaaggacuccagcgggugguccugcagcaaggacaaggacgccuacuccagcuucggcucccgggacagccgcggcaagcccggguacuucuccgagcggggcagcgggucccgcggccgguucgacgaccgcgggcggagcgacuacgacggcaucggcaaccgcgagcggcccggguucggccgcuucgagcgguccgggcacagccgcuggugcgacaaguccguggaggacgacuggagcaagccgcugccgcccagcgagcggcuggagcaggagcuguucuccggcggcaacacggggaucaacuucgagaaguacgacgacauccccgucgaggccaccggcagcaacugcccgccccacaucgagaacuucuccgacaucgacaugggggagaucaucaugggcaacaucgagcucacccgcuacacccggcccacgcccgugcagaagcacgccauccccaucaucaaggggaagcgcgaccugauggcgugcgcccagaccggcagcggcaagaccgccgccuuccugcuccccauccugucccagaucuacaccgacgggcccggcgaggcgcugaaggccgugaaggagaacgggcgguacggccgccgcaagcaguaccccaucagccucguccuggccccgacgcgggagcuggccgugcagaucuacgaggaggcccgcaaguucuccuaccggagccgcgugcggcccugcgucguguacgggggcgcggacaucggccagcagauccgcgaccucgagcgggggugccaccuccugguggccacccccggccgccuggucgacaugauggagcgggggaagaucggccuggacuucugcaaguaccuggugcucgacgaggccgaccgcaugcuggacaugggguucgagccccagauccggcgcaucguggagcaggacaccaugccgcccaagggcguccggcacaccaugauguucuccgccacguuccccaaggagauccagaugcuggcccgcgacuuccucgacgaguacaucuuccuggcggugggccggguggggagcaccuccgagaacaucacccagaaggucguguggguggaggaccuggacaagcgcagcuuccuccuggacauccugggcgccaccggguccgacagccucacgcuggucuucguggagaccaagaagggcgccgacucccuggaggacuuccucuaccacgagggcuacgccugcaccagcauccacggggaccggucccagcgcgaccgggaggaggcccugcaccaguuccgcagcggcaagucccccauccugguggcgaccgccgucgccgcccgcgggcucgacaucagcaacgugcggcacgugaucaacuucgaccugccgagcgacaucgaggaguacguccaccgcaucggccggacggggcgcgugggcaaccugggccucgccaccuccuucuucaacgagaagaacaugaacaucaccaaggaccugcuggaccuccuggucgaggcgaagcaggaggugcccagcuggcuggagaacauggccuacgagcaccacuacaagggcgggucccgggggcgcagcaaguccaaccgguucagcggcggguucggcgcccgcgacuaccggcaguccagcggcuccagcuccagcggguucggcgccucccgcgggagcuccagccgguccggcgggggcggcuacgggaacagccgcggcuucgggggcgggggcuacggcggguucuacaacagcgacggcuacgggggcaacuacaacucccagggcguggacuggugggggaacuga

SEQ ID NO: 29083 - RNA, 1869 nt, Artificial Sequence
  derived and/or modified sequence opt1 from DDX41__Homo_sapiens__NP_057306
auggaggagagcgagcccgagcgcaagcgggcccgcaccgacgaggugccggccggcgggucccggagcgaggcggaggacgaggacgacgaggacuacgugcccuacgugccccugcgccagcggcgccagcuccugcugcagaagcuccugcagcggcgccggaagggcgccgccgaggaggagcagcaggacuccgggagcgagccccgcggcgacgaggacgacaucccgcuggggccccaguccaacgugagccuccuggaccagcaccagcaccugaaggagaaggccgaggcccggaaggaguccgcgaaggagaagcagcucaaggaggaggagaagauccuggagagcgucgccgagggccgcgcccugauguccgugaaggagauggccaagggcaucaccuacgacgaccccaucaagacgagcuggacgcccccgcgguacgugcucuccaugagcgaggagcgccacgagcggguccgcaagaaguaccacauccugguggagggggacggcaucccgccgcccaucaaguccuucaaggagaugaaguuccccgcggccauccugcgggggcucaagaagaagggcauccaccaccccacccccauccagauccaggggauccccaccauccugagcggccgcgacaugaucggcaucgccuucaccggguccggcaagacccugguguucacccuccccgucaucauguucugccuggagcaggagaagcggcugcccuucagcaagcgcgaggggcccuacggccucaucaucugccccucccgggagcuggcccgccagacccacggcauccuggaguacuacugccgccuccugcaggaggacagcuccccgcugcuccggugcgcccugugcaucgggggcaugagcgugaaggagcagauggagacgauccgccacggggugcacaugauggucgcgacccccggccggcugauggaccuccugcagaagaagauggugagccuggacaucugccgcuaccucgcccuggacgaggccgaccggaugaucgacaugggguucgagggcgacauccgcaccaucuucuccuacuucaagggccagcggcagacccugcuguucagcgccacgaugcccaagaagauccagaacuucgccaaguccgcgcuggugaagcccgucaccaucaacguggggcgcgccggcgccgccagccuggacgugauccaggaggucgaguacgugaaggaggaggccaagaugguguaccuccuggagugccugcagaagaccccgccgcccguccucaucuucgcggagaagaaggccgacguggacgccauccacgaguaccugcugcucaaggggguggaggccgucgccauccacggcgggaaggaccaggaggagcggaccaaggcgaucgaggccuuccgcgagggcaagaaggacgugcuggucgccacggacguggccuccaagggccuggacuuccccgcgauccagcacgugaucaacuacgacaugcccgaggagaucgagaacuacguccaccggaucgggcgcaccggccggagcgggaacaccggcaucgccaccacguucaucaacaaggccugcgacgaguccgugcucauggaccugaaggcccugcugcucgaggccaagcagaaggugccgcccguccuccaggugcugcacugcggggacgagagcaugcucgacaucggcggcgagcgcgggugcgcguucugcggcgggcugggccaccggaucaccgacugccccaagcuggaggccaugcagaccaagcaggucuccaacaucggccgcaaggacuaccucgcccacagcuccauggacuucuga

SEQ ID NO: 29084 - RNA, 2817 nt, Artificial Sequence
  derived and/or modified sequence opt1 from DDX42__Homo_sapiens__NP_987095
augaacuggaacaagggcgggcccggcaccaagcgcggguucggcuucgggggcuucgccaucagcgccggcaagaaggaggagcccaagcugccccagcagucccacagcgcguucggggccaccuccagcuccagcggcuucgggaaguccgccccgccccagcuccccagcuucuacaagaucggcuccaagcgggccaacuucgacgaggagaacgccuacuucgaggacgaggaggaggacagcuccaacguggaccugcccuacauccccgcggagaacagccccacgcgccagcaguuccacuccaagccggucgacagcgacuccgacgacgacccccuggaggccuucauggccgagguggaggaccaggccgcgcgggacaugaagcgccucgaggagaaggacaaggagcggaagaacgugaaggggauccgcgacgacaucgaggaggaggacgaccaggaggccuacuuccgguacauggccgagaaccccaccgccggcgucgugcaggaggaggaggaggacaaccuggaguacgacagcgacggcaaccccaucgccccgaccaagaagaucaucgacccccugccgcccaucgaccacuccgagaucgacuacccgcccuucgagaagaacuucuacaacgagcacgaggagaucaccaaccucacgccccagcagcugaucgaccugcgccacaagcucaaccugcgggugagcggggcggcgcccccgcgccccggcuccagcuucgcccacuucggguucgacgagcagcugaugcaccagauccgcaagagcgaguacacccagcccacccccauccagugccagggcgucccgguggcccucuccggccgggacaugaucgggaucgccaagaccggcagcgggaagacggccgccuucaucuggcccaugcugauccacaucauggaccagaaggagcuggagcccggcgacgggcccaucgccgugaucgucugccccacccgggagcucugccagcagauccacgccgagugcaagcgcuucggcaaggccuacaaccugcgguccguggcgguguacggcgggggcagcaugugggagcaggccaaggcccugcaggagggggccgagaucgucgugugcacccccggccgccucaucgaccacgugaagaagaaggccaccaaccugcagcgggucuccuaccugguguucgacgaggcggaccgcauguucgacaugggguucgaguaccaggugcggagcaucgccucccacguccgccccgaccggcagacgcuccuguucagcgccaccuuccgcaagaagaucgagaagcuggcccgcgacauccucaucgacccgauccggguggugcagggcgacaucggcgaggcgaacgaggacgucacccagaucguggagauccugcacuccgggcccagcaaguggaacuggcugacccgccggcucguggaguucacguccagcggcuccguccugcuguucgugaccaagaaggccaacgccgaggagcucgccaacaaccugaagcaggaggggcacaaccugggccuccugcacggggacauggaccagagcgagcgcaacaaggucaucuccgacuucaagaagaaggacauccccgugcugguggccaccgacgucgcggcccggggccucgacauccccagcaucaagaccgugaucaacuacgacguggcccgcgacaucgacacgcacacccaccggaucggccgcaccgggcgggccggcgagaagggggucgccuacacccugcugacgccgaaggacuccaacuucgcgggcgaccucgugcgcaaccuggagggcgccaaccagcacgugagcaaggagcugcucgaccuggccaugcagaacgccugguuccggaagucccgcuucaagggcgggaaggggaagaagcugaacaucggcgggggcggccucggguaccgggagcgccccggccuggggagcgagaacauggaccggggcaacaacaacgucaugagcaacuacgaggccuacaagcccuccaccggggcgaugggcgaccgccugaccgccaugaaggccgccuuccagagccaguacaagucccacuucguggcggccagccucuccaaccagaaggccggcagcuccgccgccggggcgagcggcuggaccuccgccgggagccugaacuccgugcccacgaacagcgcccagcagggccacaacuccccggacagccccgucaccuccgccgccaaggggauccccggcuucggcaacaccgggaacaucagcggcgcgcccgugaccuacccguccgccggggcccagggcgugaacaacacggccagcgggaacaacagccgggagggcaccggcggguccaacggcaagcgcgagcgguacaccgagaaccgcgggagcucccgccacagccacggcgagaccggcaaccggcacuccgacagcccccgccacggggacggcgggcggcacggcgacggguaccgccaccccgaguccagcucccggcacacggacggccaccgccacggcgagaaccggcacgggggcagcgccgggcgccacggcgagaaccgcggggcgaacgacggccggaacggcgagucccggaaggaggccuucaaccgcgagagcaagauggagcccaagauggagccgaaggucgacuccagcaagauggacaagguggacuccaagaccgacaagaccgccgacggguucgccgugcccgagccgcccaagcggaagaagucccgcugggacagcuga

SEQ ID NO: 29085 - RNA, 1947 nt, Artificial Sequence
  derived and/or modified sequence opt1 from DDX43__Homo_sapiens__NP_061135
augagccaccacggcggggcccccaaggccuccaccuggguggucgcgagccgccgguccagcaccgugucccgcgccccggagcggcgccccgccgaggagcugaaccggacgggccccgagggguacagcgugggccgcgggggccgguggcgcggcaccucccggcccccggaggccgucgccgcggggcacgaggagcucccccugugcuucgcccucaagagccacuucgugggcgccgugaucgggcgcggcggguccaagaucaagaacauccagagcaccaccaacacgaccauccagaucauccaggagcagcccgagucccuggucaagaucuucggcagcaaggccaugcagaccaaggcgaaggccgugaucgacaacuucgugaagaagcuggaggagaacuacaacuccgagugcggcaucgacaccgccuuccagcccagcgucgggaaggacggcuccacggacaacaacgugguggccggggaccggccgcugaucgacugggaccagauccgcgaggagggccucaaguggcagaagaccaagugggccgaccugccgcccaucaagaagaacuucuacaaggagagcaccgcgaccuccgccaugagcaaggucgaggccgacuccuggcggaaggagaacuucaacaucacgugggacgaccugaaggacggcgagaagcgccccauccccaacccgaccugcaccuucgacgacgccuuccagugcuaccccgaggugauggagaacaucaagaaggccggguuccagaagcccacccccauccagagccaggcguggcccaucgugcuccagggcaucgaccugaucggggucgcccagacgggcaccgggaagacccugugcuaccucaugcccggcuucauccaccuggugcugcagcccagccucaagggccagcggaaccgcccggggaugcuggugcugacccccacgcgggagcucgcccugcaggucgagggcgagugcugcaaguacuccuacaaggggcugcgcagcgugugcguguacggcgggggcaaccgggacgagcagaucgaggagcucaagaagggcgucgacaucaucaucgccacccccgggcgccugaacgaccugcagauguccaacuucgugaaccucaagaacaucaccuaccuggugcuggacgaggccgacaagaugcucgacaugggcuucgagccccagaucaugaagauccugcuggacguccggccggaccgccagaccgugaugacgagcgcgaccuggccccacuccguccaccgccucgcccagagcuaccugaaggagcccaugaucguguacguggggacccuggaccucgucgccguguccagcgugaagcagaacaucaucgucaccacggaggaggagaaguggucccacaugcagaccuuccugcagagcauguccagcaccgacaaggugaucguguucgucucccggaaggccguggccgaccaccugagcuccgaccucauccugggcaacaucagcguggagucccugcacggggaccgcgagcagcgggaccgcgagaaggcgcucgagaacuucaagaccggcaagguccggauccugaucgccacggaccuggccagccgcggccucgacgugcacgacgugacccacgucuacaacuucgacuucccccggaacaucgaggaguacgugcaccgcaucgggcggaccggccgcgccgggcggaccggcguguccaucacgacccugacccgcaacgacuggcgggucgcgagcgagcugaucaacauccucgagcgcgccaaccagagcaucccggaggagcugguguccauggccgagcgguucaaggcccaccagcagaagcgcgagauggagcggaagauggagcgcccccagggccggcccaagaaguuccacuga

SEQ ID NO: 29086 - RNA, 3099 nt, Artificial Sequence
  derived and/or modified sequence opt1 from DDX46__Homo_sapiens__NP_001287789
augggccgcgagagccggcacuaccgcaagcgguccgccagccgcgggcgguccggcagccgcucccggagccgcucccccagcgacaagcgguccaagcgcggggacgaccggcgcagccggucccgcgaccgggaccgccggcgcgagcggagccgcucccgggacaagcgccgcagccggucccgcgaccggaagcgccugcggcgcagccggucccgcgagcgggaccgcagccgggagcgccggcgcucccggagccgcgaccggcgccggagccgcucccgcagccggggccgccggucccgcagcuccagcccggggaacaaguccaagaagaccgagaaccggagccgcuccaaggagaagaccgacggcggcgagagcuccaaggagaagaagaaggacaaggacgacaaggaggacgagaaggagaaggacgccgggaacuucgaccagaacaagcucgaggaggagaugcggaagcgcaaggagcggguggagaaguggcgcgaggagcagcggaagaaggcgauggagaacaucggcgagcugaagaaggagaucgaggagaugaagcaggggaagaaguggagccuggaggacgacgacgacgacgaggacgaccccgccgaggccgagaaggagggcaacgagauggagggggaggagcucgacccccuggacgccuacauggaggaggucaaggaggaggugaagaaguucaacaugcgcuccgugaagggcggcgggggcaacgagaagaaguccgggcccacggucaccaagguggugaccgucgugaccacgaagaaggccguggucgacagcgacaagaagaagggcgagcugauggagaacgaccaggacgcgauggaguacagcuccgaggaggaggagguggaccuccagaccgcccugaccggcuaccagaccaagcagcggaagcugcucgagccgguggaccacgggaagaucgaguacgagcccuuccgcaagaacuucuacgucgaggugcccgagcuggccaagaugagccaggaggaggugaacgucuuccggcuggagauggagggcaucacggugaaggggaagggcugccccaagccgaucaaguccugggugcagugcgggaucagcaugaagauccucaacagccugaagaagcacggcuacgagaagcccacccccauccagacccaggccauccccgcgaucauguccggccgcgaccugaucgggaucgccaagaccggcagcgggaagacgaucgccuuccuccugccgauguuccggcacaucauggaccagcgcucccuggaggagggcgaggggcccaucgccgucaucaugacccccacccgggagcucgcccugcagaucaccaaggagugcaagaaguucagcaagacgcugggccuccgcguggugugcgucuacggcgggaccggcaucuccgagcagaucgcggagcugaagcggggcgccgagaucaucgugugcacccccggccgcaugaucgacaugcuggccgccaacagcgggcgcgugaccaaccuccggcgcgucacguacgugguccuggacgaggccgaccggauguucgacaugggcuucgagccccaggugaugcgcaucguggacaacguccggcccgaccgccagaccgugauguucuccgcgaccuucccccgggccauggaggcccuggcccgccggauccucagcaagcccaucgaggugcaggucggcgggcgcuccguggugugcagcgacgucgagcagcaggucaucgugaucgaggaggagaagaaguuccugaagcugcucgagcugcugggccacuaccaggaguccgggagcgugaucaucuucguggacaagcaggagcacgccgacggccuccugaaggaccugaugcgggcguccuacccgugcaugagccuccacggcgggaucgaccaguacgaccgcgacuccaucaucaacgacuucaagaacgggaccugcaagcugcugguggccacgagcgucgccgcccgggggcucgacgugaagcaccugauccugguggucaacuacuccugccccaaccacuacgaggacuacgugcaccgcgccggccggaccgggcgcgcgggcaacaagggcuacgccuacaccuucaucaccgaggaccaggcccgguacgccggggacaucaucaaggcgcucgagcugagcggcacggccgugccgcccgaccuggagaagcucuggagcgacuucaaggaccagcagaaggccgaggggaagaucaucaagaaguccagcggcuucuccgggaagggcuucaaguucgacgagaccgagcaggcccuggccaacgagcgcaagaagcugcagaaggcggcccucggccugcaggacagcgacgacgaggacgccgccgucgacaucgacgagcagaucgaguccauguucaacagcaagaagcgggugaaggacauggccgcgccggggaccuccagcgugcccgcccccaccgccggcaacgccgagaagcuggagaucgccaagcgccuggcgcuccgcaucaacgcccagaagaaccuggggaucgagucccaggucgacgugaugcagcaggccacgaacgccauccugcggggcgggaccauccucgcgcccaccgugagcgccaagaccaucgccgagcagcuggccgagaagaucaacgccaagcugaacuacgucccgcucgagaagcaggaggaggagcgccaggacggcggccagaacgaguccuucaagcgguacgaggaggagcuggagaucaacgacuucccccagacggcgcgcuggaaggugaccagcaaggaggcccugcagcggaucuccgaguacagcgaggccgccaucaccauccgcgggaccuacuucccgcccggcaaggagcccaaggagggggagcggaagaucuaccucgccaucgaguccgcgaacgagcuggccgugcagaaggccaaggccgagaucacccgccugaucaaggaggagcucauccggcugcagaacagcuaccagcccacgaacaagggccgcuacaagguccuguga

SEQ ID NO: 29087 - RNA, 2073 nt, Artificial Sequence
  derived and/or modified sequence opt1 from DDX4__Homo_sapiens__NP_001136021
augggcgacgaggacugggaggccgagaucaacccccacaugagcuccuacgugccgaucuucgagaaggaccgcuacagcggggagaacggcgacaacuucaaccggacccccgccuccagcuccgagauggacgacgggcccagccgccgggaccacuucaugaaguccggcuucgcgagcgggcgcaacuucggcaaccgggacgccggcgagugcaacaagcgcgacaacaccuccacgaugggcggguucggggucggcaagagcuucgggaaccggggcuucuccaacagccgcuucgaggacggcgacuccagcggguucuggcgggaguccagcaacgacugcgaggacaaccccacccgcaaccggggcuucuccaagcgcggggacaacgaccuggacccggacgagugcaugcagcggaccggcggccucuucgggagccgccggcccgugcuguccggcaccgggaacggcgacacgagccagagccgcuccgggagcggcuccgagcggggcggguacaagggccugaacgaggaggugaucaccgggagcggcaagaacuccuggaaguccgaggccgagggcggggagagcagcgacacccagggccccaaggucaccuacaucccgcccccgccgcccgaggacgaggacuccaucuucgcccacuaccagacggggaucaacuucgacaaguacgacaccauccucguggaggugagcggccacgacgccccgcccgcgauccugaccuucgaggaggccaaccugugccagacccucaacaacaacaucgccaaggccggguacacgaagcugacccccguccagaaguacuccauccccaucauccuggcgggccgcgaccucauggccugcgcccagaccgggagcggcaagaccgccgccuuccugcugcccauccucgcgcacaugaugcacgacggcaucacggccucccgguucaaggagcugcaggagcccgagugcaucaucguggcccccacccgcgagcuggugaaccagaucuaccucgaggcccggaaguucagcuucgggaccugcguccgcgccguggugaucuacggcgggacccagcugggccacuccauccgccagaucguccagggcugcaacauccugugcgcgacgcccgggcggcucauggacaucaucggcaaggagaagaucgggcugaagcagaucaaguaccuggugcucgacgaggccgaccgcaugcuggacaugggcuucgggcccgagaugaagaagcugaucagcugccccggcaugcccuccaaggagcagcggcagacccucauguucagcgccaccuuccccgaggagauccagcgccuggccgccgaguuccugaaguccaacuaccucuucguggcggucggccaggucgggggcgccugccgggacgugcagcagaccgugcuccagguggggcaguucagcaagcgcgagaagcugguggagauccugcggaacaucggcgacgagcgcacgauggucuucguggagaccaagaagaaggccgacuucaucgccaccuuccugugccaggagaagaucagcaccacguccauccacggggaccgggagcagcgcgagcgggagcaggcccugggcgacuuccgcuucggcaagugcccggugcucgucgcgaccagcguggccgcccgggggcuggacaucgagaacguccagcacgugaucaacuucgaccugcccuccaccaucgacgaguacgugcaccgcaucggccggaccgggcgcugcggcaacacggggcgggccaucagcuucuucgaccucgaguccgacaaccaccuggcgcagccccuggucaaggugcucaccgacgcccagcaggacgugcccgccuggcuggaggagaucgccuucagcaccuacaucccgggcuucuccggcagcacccgcgggaacgucuucgccuccguggacacgcggaagggcaagagcacccugaacaccgcgggguucuccagcucccaggcccccaaccccguggacgacgagagcugggacuga

SEQ ID NO: 29088 - RNA, 2214 nt, Artificial Sequence
  derived and/or modified sequence opt1 from DDX50__Homo_sapiens__NP_076950
augcccggcaagcugcucuggggcgacaucauggagcuggaggccccgcuggaggagagcgagucccagaagaaggagcgccagaaguccgaccggcgcaagagccggcaccacuacgacagcgacgagaaguccgagacccgcgagaacggggugaccgacgaccucgacgcccccaaggcgaagaaguccaagaugaaggagaagcugaacggggacacggaggagggcuucaaccggcugagcgacgaguucagcaagucccacaagagccgccggaaggaccuccccaacggggacaucgacgaguacgagaagaaguccaagcgcgucagcucccuggacaccagcacccacaaguccagcgacaacaagcuggaggagacccucacgcgggagcagaaggagggcgccuucuccaacuuccccaucagcgaggagaccaucaagcugcugaagggccgcggggugaccuaccucuucccgauccaggugaagaccuucggccccgucuacgaggggaaggaccugaucgcccaggcccggacgggcaccgggaagaccuucuccuucgccaucccccugaucgagcgccuccagcggaaccaggagaccaucaagaagucccgcagccccaaggugcuggugcuggcgccgacgcgggagcucgccaaccaggucgccaaggacuucaaggacaucacccgcaagcugagcguggccugcuucuacggcggcaccagcuaccagucccagaucaaccacauccggaacgggaucgacauccuggugggcacccccgggcgcaucaaggaccaccuccagagcggccggcuggaccuguccaagcuccgccacgucgugcuggacgagguggaccagaugcuggaccucggcuucgcggagcaggucgaggacaucauccacgagagcuacaagacggacuccgaggacaacccccagacccugcuguucagcgcgaccugcccccaguggguguacaagguggccaagaaguacaugaagucccgguacgagcaggucgaccucguggggaagaugacccagaaggccgccacgaccguggagcaccuggccauccagugccacuggagccagcgcccggccgucaucggcgacgugcuccagguguacuccgggagcgagggccgcgccaucaucuucugcgagaccaagaagaacgucaccgagauggccaugaacccccacaucaagcagaacgcccagugccugcacggggacaucgcgcagucccagcgggagaucacgcugaagggcuuccgcgagggcagcuucaaggugcugguggccaccaacgucgccgcccgggggcucgacauccccgagguggaccuggucauccaguccagcccgccccaggacguggaguccuacauccaccgcagcggccggaccgggcgcgccggccggaccgggaucugcaucugcuucuaccagccccgcgagcggggccagcugcgcuacguggagcagaaggcgggcaucacguucaagcgggucggggugcccuccaccauggaccucgucaagagcaagagcauggacgccauccgcucccuggccagcguguccuacgccgccguggacuucuuccggcccagcgcgcagcgccugaucgaggagaagggcgccguggacgcccucgccgcggcccuggcccacaucuccggggccagcuccuucgagccgcggagccugaucaccuccgacaagggcuucgucaccaugacgcucgagagccuggaggagauccaggacguguccugcgccuggaaggagcugaaccgcaagcucagcuccaacgcggugagccagaucacccggaugugccugcugaaggggaacaugggcgucugcuucgacgugcccaccaccgaguccgagcgccugcaggccgaguggcacgacagcgacuggauccucuccgugcccgccaagcugcccgagaucgaggaguacuacgacggcaacacgagcagcaacucccggcagcgcagcgggugguccagcggccgcuccgggcggagcggccgcuccggcgggcggagcggcgggcgcuccggccggcagagccgccaggggucccggagcggcucccgccaggacggccggcgccggagcgggaaccgcaaccggucccgcagcggcgggcacaagcgguccuucgacuga

SEQ ID NO: 29089 - RNA, 2001 nt, Artificial Sequence
  derived and/or modified sequence opt1 from DDX51__Homo_sapiens__NP_778236
auggcccuguucuacguggcccgcuaccccggcccggacgcggccgccgccgccgggcccgagggcgcggaggccggggcccacggccgggcccgcgcgcuccuggagcggcugcagagccgcgcccgggagcgccagcagcagcgggagcccgcccagaccgaggccgccgcguccaccgagcccgccacgcgccggcgccggcgcccgcggcgccggcgccgggucaacgacgccgagcccgggagccccgaggcgccccagggcaagcgccggaaggccgacggcgaggacgccggggccgaguccaacgaggaggccccgggcgagcccagcgccggguccagcgaggaggcccccggcgagcccuccgcggggagcuccgaggaggccccgggcgagcgcagcaccuccgccagcgccgaggccgcgcccgacggccccgcccucgaggaggccgccgggccccuggugccgggccuggugcucgggggcuucggcaagcggaaggcgcccaagguccagcccuuccugccccgcuggcuggccgagccgaacugcgugcgccggaacgugaccgaggaccucguccccaucgaggacauccccgacgugcaccccgaccugcagaagcagcugcgcgcccacgggaucuccagcuacuucccggugcaggccgccgucauccccgcgcuccuggaguccgccgccugcggcuuccugguggggcggggcggguaccgccccagcgaccucugcguguccgcccccaccggcagcggcaagacgcuggccuucgucaucccgguggugcaggcgcugcucucccgggucgugugccacauccgcgcccuggugguccugcccaccaaggagcucgcccagcaggucagcaagguguucaacaucuacaccgacgccacgccccugcgggugagccuggugaccgggcagaagucccucgccaaggagcaggagagccuggugcagaagaccgcggacggcuaccgcugccuggccgacaucgucguggccaccccggggcggcucgucgaccacaucgaccagacccccggcuucucccugcagcagcugcgcuuccucaucaucgacgaggccgaccggaugaucgacagcaugcaccaguccuggcugccccgcgugguggcggccgccuuccagagcgaggaccccgccgacccgugcgcccugcuccagcggcgccaggcgcaggccgucacggccgccuccacgugcugcccccagaugccccugcagaagcuccuguucagcgccacccugacccagaaccccgagaagcugcagcagcucgggcugcaccagccgcggcuguucuccaccggccucgcgcaccgcggccuggaggacaccgacggggacggcgacagcgggaaguacgccuuccccgugggccugacccaccacuacgugcccugcucccucagcuccaagccccuggucgugcugcaccucgugcuggagaugggguucagccggguccugugcuucaccaacucccgcgagaacagccaccggcuguuccuccuggugcaggccuucggcggcguggacgucgccgaguucuccagccgcuacgggccgggccagcgccggaugauccugaagcaguucgagcaggggaagauccagcuccugaucuccacggacgccaccgcgcgcggcaucgacgugcagggcguggagcuggucgugaacuacgacgcgccccaguaccuccggaccuacgugcaccgcgucgggcggaccgcccgcgccggcaagacggggcaggccuucacccugcugcucaaggugcaggagcggcgcuuccugcggaugcugaccgaggccggcgcccccgagcuccagcgccacgagcugagcagcaagcugcuccagccccuggugccgcgguacgaggaggcccugucccagcucgaggagagcgucaaggaggagcgcaagcagcgggccgcguga

SEQ ID NO: 29090 - RNA, 1800 nt, Artificial Sequence
  derived and/or modified sequence opt1 from DDX52__Homo_sapiens__NP_008941
auggacgugcacgaccuguuccgccggcucggcgccggggccaaguucgacacccgccgguucagcgcggacgccgcccgcuuccagaucggcaagcggaaguacgacuucgacuccagcgagguccugcaggggcuggacuucuucggcaacaagaaguccgugcccggggugugcggcgccagccagacccaccagaagccgcagaacggcgagaagaaggaggagucccucacggagcgcaagcgggagcagagcaagaagaagcgcaagaccaugaccuccgagaucgccagccaggaggagggggcgaccauccaguggauguccagcgucgaggccaagaucgaggacaagaaggugcagcgggaguccaagcugacgagcggcaagcuggagaaccuccgcaaggagaagaucaacuuccugcggaacaagcacaagauccacgugcaggggaccgaccugcccgaccccaucgccaccuuccagcagcucgaccaggaguacaagaucaacucccgccugcugcagaacauccucgacgccggcuuccagaugcccaccccgauccagaugcaggcgauccccgucaugcugcacgggcgggagcugcucgccagcgcccccacgggcuccggcaagacccuggccuucagcauccccauccugaugcagcucaagcagccggccaacaagggguuccgcgcgcugaucaucucccccacccgggagcuggccagccagauccaccgcgagcucaucaagaucuccgagggcaccggguuccggauccacaugauccacaaggccgccguggccgcgaagaaguucggccccaagagcagcaagaaguucgacauccuggugacgacccccaaccgccugaucuaccuccugaagcaggacccgcccggcaucgaccuggccuccgucgaguggcucgugguggacgagagcgacaagcuguucgaggacgggaagaccggcuuccgggaccagcuggccuccaucuuccucgccugcaccagccacaagguccgccgggccauguucuccgcgacguucgccuacgacguggagcaguggugcaagcugaaccuggacaacgugaucagcgucuccaucggggcccgcaacagcgccguggagaccguggagcaggagcuccuguucgucggcuccgagaccgggaagcugcucgccgugcgcgagcuggugaagaagggcuucaacccgcccguccugguguucgugcagagcaucgagcgggcgaaggagcuguuccacgagcucaucuacgagggcaucaacgucgacgugauccacgccgagcgcacccagcagcagcgggacaacacgguccacuccuuccgcgccgggaagaucugggugcugaucugcaccgcccuccuggcgcggggcaucgacuucaagggggugaaccuggucaucaacuacgacuuccccaccagcuccguggaguacauccaccgcaucggccggaccgggcgcgccggcaacaagggcaaggccaucacguucuucaccgaggacgacaagccccuccugcggagcguggccaacgucauccagcaggccgggugccccgugcccgaguacaucaagggcuuccagaagcugcucuccaagcagaagaagaagaugaucaagaagccgcuggagcgcgagagcaucuccaccacccccaagugcuuccuggagaaggcgaaggacaagcagaagaaggugacggggcagaacagcaagaagaaggucgcccuggaggacaaguccuga

SEQ ID NO: 29091 - RNA, 1896 nt, Artificial Sequence
  derived and/or modified sequence opt1 from DDX53__Homo_sapiens__NP_874358
augagccacugggcccccgaguggaagcgcgccgaggcgaacccgcgggaccugggcgccuccugggacgugcgcgggagccggggcuccggguggagcggccccuucgggcaccagggcccccgcgccgccggcucccgggagcccccgcucugcuucaagaucaagaacaacauggucgggguggugaucggcuacagcggguccaagaucaaggaccugcagcacagcaccaacaccaagauccagaucaucaacggcgaguccgaggccaagguccgcaucuucgggaaccgggagaugaaggcgaaggccaaggccgccaucgagacgcugauccgcaagcaggagagcuacaacuccgagagcuccguggacaacgcggccagccagacccccaucggccggaaccucggccgcaacgacaucgugggggaggccgagccccuguccaacugggaccggauccgcgccgccgucguggagugcgagaagcggaagugggcggaccugcccccggugaagaagaacuucuacaucgagagcaaggccaccuccugcaugagcgagaugcaggucaucaacuggcgcaaggagaacuucaacaucacgugcgacgaccucaaguccggcgagaagcggcugauccccaagccgaccugccgcuucaaggacgccuuccagcaguaccccgaccugcucaagagcaucauccggguggggaucgugaagcccacccccauccagagccaggccuggcccaucauccugcagggcaucgaccugaucgucguggcccagaccggcaccgggaagacgcucuccuaccugaugcccggcuucauccaccuggacagccagccgaucucccgcgagcagcggaacgggcccggcaugcucgugcugacccccacccgcgagcuggcgcuccacgucgaggccgagugcagcaaguacuccuacaaggggcucaagagcaucugcaucuacggcggccggaaccgcaacgggcagaucgaggacaucuccaagggcguggacaucaucaucgccacccccgggcgccugaacgaccugcagaugaacaacagcgugaaccugcgguccaucacguaccuggucaucgacgaggccgacaagaugcucgacauggaguucgagccgcagauccgcaagauccugcuggacgugcggcccgaccgccagaccgugaugaccagcgccaccuggcccgacacgguccggcagcucgcgcuguccuaccugaaggaccccaugaucguguacgugggcaaccucaaccuggucgccgugaacaccgucaagcagaacaucaucgugaccaccgagaaggagaagcgcgcccugacgcaggaguucguggagaacaugagcccgaacgacaaggucaucauguucgugucccagaagcacaucgccgacgaccucagcuccgacuucaacauccaggggaucagcgccgagucccugcacggcaacagcgagcaguccgaccaggagcgggcgguggaggacuucaagagcggcaacaucaagauccugaucaccaccgacaucgucagccgcgggcucgaccugaacgacgugacccacguguacaacuacgacuucccccggaacaucgacgucuacgugcaccgcgugggcuacaucgggcggacgggcaagaccgggaccuccgucacccugaucacgcagcgcgacagcaagauggccggcgagcucaucaagauccuggaccgggccaaccaguccgugcccgaggaccugguggucauggccgagcaguacaagcucaaccagcagaagcgccaccgggagacccgcagccggaagcccggccagcgccggaaggaguucuacuuccuguccuga

SEQ ID NO: 29092 - RNA, 2649 nt, Artificial Sequence
  derived and/or modified sequence opt1 from DDX54__Homo_sapiens__NP_001104792
auggccgccgacaagggccccgcggccgggccgcgcagccgggccgccauggcccaguggcgcaagaagaagggccugcggaagcgccgcggggcggccucccaggcccggggcagcgacuccgaggacggggaguucgagauccaggccgaggacgacgcgcgggcccgcaagcucggccccggccggccccugcccaccuucccgaccagcgagugcacguccgacguggagcccgacacccgcgagaugguccgggcccagaacaagaagaagaagaaguccgggggcuuccagagcauggggcugagcuaccccguguucaagggcaucaugaagaagggguacaaggugcccaccccgauccagcgcaagaccauccccgucauccucgacggcaaggacgugguggccauggcccggacgggcuccgggaagaccgcgugcuuccugcugcccauguucgagcgccucaagacccacagcgcccagaccggcgcccgggcccugauccugucccccacgcgcgagcucgcccugcagacccugaaguucaccaaggagcucgggaaguucaccggccugaagacggcgcugauccucggcggggaccggauggaggaccaguucgccgcccugcacgagaacccggacaucaucaucgccacccccggccgccugguccacguggccguggagaugagccucaagcugcaguccgucgaguacgugguguucgacgaggcggaccggcuguucgagaugggguucgccgagcagcuccaggagaucaucgcccgccugcccggcgggcaccagaccguccuguucagcgccacccuccccaagcugcugguggaguucgcccgggcgggccucacggagccggugcugauccgccuggacgucgacaccaagcucaacgagcagcugaagaccuccuucuuccuggugcgcgaggacaccaaggccgccgugcuccugcaccuccuccacaacgucgugcggccccaggaccagacgguggucuucguggccaccaagcaccacgcggaguaccugaccgagcugcucaccacgcagcgcgugagcugcgcccacaucuacuccgcccuggaccccaccgcccggaagaucaaccuggccaaguucacccucggcaagugcagcacccugaucgucacggaccuggcggcccgcgggcucgacaucccccugcuggacaacgugaucaacuacuccuucccggccaagggcaagcuguuccugcaccgggucgggcgcguggcccgggccggccgcagcgggaccgcguacagccugguggcccccgacgagauccccuaccugcucgaccugcaccuguuccucggccggucccugacccuggcccgcccccucaaggagccgagcggcgucgccgggguggacggcaugcuggggcgggugccccaguccgucguggacgaggaggacagcggccugcaguccacccucgaggccagccuggagcugcgcgggcucgcgcggguggccgacaacgcccagcagcaguacguccgcucccggcccgcccccagcccggaguccaucaagcgcgcgaaggagauggaccuggugggccugggccuccacccccuguucagcucccgguucgaggaggaggagcugcagcgccuccggcugguggacagcaucaagaacuaccgcucccgcgccacgaucuucgagaucaacgccagcucccgggaccugugcagccaggucaugcgcgccaagcggcagaaggaccgcaaggccaucgcgcgguuccagcaggggcagcagggccgccaggagcagcaggaggggcccgugggcccggcccccucccggcccgcccuccaggagaagcagcccgagaaggaggaggaggaggaggccggcgagagcguggaggacaucuucuccgaggucguggggcgcaagcggcagcgcagcggcccgaaccgcggggccaagcggcggcgcgaggaggcgcggcagcgcgaccaggaguucuacauccccuaccggcccaaggacuucgacagcgagcgcggccuguccaucagcggggagggcggcgccuucgagcagcaggccgccggggccgugcuggaccucaugggcgacgaggcgcagaaccugacccgggggcgccagcagcugaagugggaccggaagaagaagcgcuucgucggccaguccgggcaggaggacaagaagaagaucaagaccgagagcggccgcuacaucuccagcuccuacaagcgggaccucuaccagaaguggaagcagaagcagaagaucgacgaccgcgacagcgacgaggagggcgccuccgaccggcgcgggcccgagcggcgcggcgggaagcgggaccgcggccaggccggggccagccggccgcacgcgcccggcacccccgccggccgcgugcggcccgagcugaagacgaagcagcagauccugaagcagcgccggcgcgcccagaagcuccacuuccugcagcgcgggggccugaagcagcucuccgcccggaaccggcgccgggugcaggagcugcagcagggggccuucggccgcggggcgcgcagcaagaagggcaagaugcggaagcgcauguga

SEQ ID NO: 29093 - RNA, 1524 nt, Artificial Sequence
  derived and/or modified sequence opt1 from DDX56__Homo_sapiens__NP_001244118
auggaggacagcgaggcccugggcuucgagcacauggggcucgacccccgccugcugcaggccgugaccgaccucggcuggucccggccgacccugauccaggagaaggcgaucccccuggcccucgaggggaaggaccugcuggcccgcgcccggacgggcagcgggaagaccgccgcguacgccauccccaugcuccagcugcugcuccaccgcaaggccaccggccccgucguggagcaggccgugcggggccugguccuggugccgaccaaggagcucgcgcgccaggcccaguccaugauccagcagcuggccacguacugcgcccgggacgugcgcgucgccaacgugagcgcggccgaggacuccgugagccagcgggccguccugauggagaagcccgacgugguggucgggacccccucccgcauccucagccaccuccagcaggacucccugaagcugcgggacagccuggagcugcucgugguggacgaggccgaccugcuguucuccuucggcuucgaggaggagcucaagagccugcugugccaccucccccgcaucuaccaggccuuccugauguccgcgaccuucaacgaggacguccaggcccugaaggagcucauccugcacaacccggugacccugaagcuccaggagagccagcugcccgggcccgaccagcugcagcaguuccagguggucugcgagacggaggaggacaaguuccuccugcuguacgcccuccugaagcugucccucauccggggcaagagccugcuguucgugaacacccucgagcgcuccuaccggcugcgccuguuccuggagcaguucagcaucccgaccugcgugcucaacggggagcugccccugcggucccgcgccagcgaccccgaggccggcgucgcgcggggcaucgacuuccaccacgugagcgccgugcucaacuucgaccugccgcccacccccgaggccuacauccaccgcgccgggcggacggcccgcgcgaacaaccccggcaucguccugaccuucgugcuccccaccgagcaguuccaccuggggaagaucgaggagcugcucuccggcgagaaccgcggccccauccugcugccguaccaguuccggauggaggagaucgagggguuccgcuaccggugccgcgacgccaugcggagcgucaccaagcaggccauccgcgaggcccggcucaaggagaucaaggaggagcugcugcacuccgagaagcucaagacguacuucgaggacaacccccgcgaccugcagcugcuccggcacgaccugccccugcaccccgcgguggugaagccgcaccucggccacguccccgacuaccuggugccgcccgcccugcgcgggcucgugcggccccacaagaagcgcaagaagcugagcuccagcugccggaaggccaagcgcgccaagucccagaacccccugcggagcuucaagcacaagggcaagaaguuccgccccaccgccaagccguccuga

SEQ ID NO: 29094 - RNA, 2778 nt, Artificial Sequence
  derived and/or modified sequence opt1 from DDX58__Homo_sapiens__NP_055129
augaccaccgagcagcgccggagccugcaggccuuccaggacuacauccgcaagacgcucgaccccaccuacauccuguccuacauggccccgugguuccgggaggaggaggugcaguacauccaggcggagaagaacaacaagggccccauggaggccgccacccuguuccucaaguuccugcuggagcuccaggaggaggggugguuccgcggcuuccuggacgcccuggaccacgccggguacagcggccucuacgaggcgaucgaguccugggacuucaagaagaucgagaagcuggaggaguaccggcugcuccugaagcgccugcagcccgaguucaagacccggaucauccccacggacaucaucagcgaccucuccgagugccugaucaaccaggagugcgaggagauccugcagaucugcagcaccaaggggaugauggccggcgccgagaagcucgucgagugccugcugcgcuccgacaaggagaacuggccgaagacccucaagcuggcccuggagaaggagcggaacaaguucagcgagcucuggaucguggagaagggcaucaaggacguggagaccgaggaccuggaggacaagauggagacguccgacauccagaucuucuaccaggaggaccccgagugccagaaccugagcgagaacuccugcccgcccagcgaggucuccgacaccaaccucuacagccccuucaagccccgcaacuaccagcuggagcuggcgcuccccgccaugaaggggaagaacaccaucaucugcgcccccaccggcugcgggaagacguucgugucccugcugaucugcgagcaccaccucaagaaguucccgcagggccagaaggggaagguggucuucuucgccaaccagauccccguguacgagcagcagaaguccguguucagcaaguacuucgagcggcacggcuaccgcgucaccggcaucagcggggccaccgcggagaacgugcccguggagcagaucgucgagaacaacgacaucaucauccugacgccccagauccuggugaacaaccucaagaagggcaccaucccgucccugagcaucuucacccugaugaucuucgacgagugccacaacaccagcaagcagcaccccuacaacaugaucauguucaacuaccucgaccagaagcucgggggcuccagcggcccccugccccaggugaucgggcucaccgccuccgucggcgugggggacgccaagaacacggacgaggcccuggacuacaucugcaagcugugcgccagccucgacgcguccgugaucgccaccgucaagcacaaccuggaggagcuggagcaggucguguacaagccgcagaaguucuuccggaagguggagagccgcaucuccgacaaguucaaguacaucaucgcccagcucaugcgggacaccgagagccuggccaagcgcaucugcaaggaccuggagaaccugucccagauccagaaccgggaguucggcacccagaaguacgagcaguggaucgugacggugcagaaggccugcauggucuuccagaugcccgacaaggacgaggagagccgcaucugcaaggcgcuguuccuguacaccucccaccuccggaaguacaacgacgcccugaucaucagcgagcacgcccgcaugaaggacgcccuggacuaccugaaggacuucuucuccaacgugcgggccgcgggguucgacgagaucgagcaggaccucacccagcgcuucgaggagaagcugcaggagcuggagagcgucucccgcgaccccagcaacgagaaccccaagcucgaggaccugugcuucauccugcaggaggaguaccaccucaacccggagaccaucacgauccuguucgugaagacccgggcccugguggacgcccucaagaacuggaucgagggcaaccccaagcuguccuuccugaagcccggcauccucaccgggcgcggcaagaccaaccagaacacggggaugacccugcccgcccagaagugcauccuggacgcguucaaggccagcggcgaccacaacauccucaucgccaccuccgucgccgacgaggggaucgacaucgcccagugcaaccuggugauccuguacgaguacgugggcaacgucaucaagaugauccagacccggggccgcgggcgggcgcgcggcagcaagugcuuccuccugacgagcaacgccggggugaucgagaaggagcagaucaacauguacaaggagaagaugaugaacgacuccauccugcggcuccagaccugggacgaggccguguuccgcgagaagauccugcacauccagacccacgagaaguucauccgggacagccaggagaagccgaagcccguccccgacaaggagaacaagaagcugcucugccgcaagugcaaggcccuggccugcuacaccgcggacgugcgggugaucgaggagugccacuacaccguccugggcgacgccuucaaggagugcuucgugucccgcccgcaccccaagcccaagcaguucagcuccuucgagaagcgggccaagaucuucugcgcccgccagaacugcagccacgacugggggauccacgugaaguacaagacguucgagauccccgucaucaagaucgaguccuucgugguggaggacaucgccaccggcguccagacccucuacagcaaguggaaggacuuccacuucgagaagaucccguucgaccccgcggagauguccaaguga

SEQ ID NO: 29095 - RNA, 1860 nt, Artificial Sequence
  derived and/or modified sequence opt1 from DDX59__Homo_sapiens__NP_001026895
auguucgugccccgcagccugaagaucaagcggaacgccaacgacgacggcaaguccugcgucgccaagaucaucaagccggaccccgaggaccuccagcuggacaagagccgcgacgugcccguggacgcggucgccaccgaggccgccaccaucgaccggcacaucuccgagagcugccccuucccgucccccgggggccagcuggccgaggugcacagcgugucccccgagcagggggcgaaggacagccaccccuccgaggagccggucaagagcuucuccaagacgcagcgcugggccgagcccggcgagcccaucugcguggugugcgggcgguacggcgaguacaucugcgacaagaccgacgaggacgucugcagccucgagugcaaggccaagcaccuccuccaggugaaggagaaggaggagaaguccaagcucagcaacccccagaaggccgacuccgagccggagagcccccugaacgcguccuacguguacaaggagcaccccuucauccugaaccuccaggaggaccagaucgagaaccugaagcagcagcugggcauccucguccaggggcaggaggugacccgccccaucaucgacuucgagcacugcagccugccggaggugcugaaccacaaccucaagaaguccggcuacgagguccccacccccauccagaugcagaugauccccguggggcugcugggccgggacauccucgccagcgccgacacggggagcggcaagaccgccgccuuccugcugccggugaucaugcgcgcgcuguucgaguccaagacccccagcgcccugauccugacccccacgcgggagcucgccauccagaucgagcgccaggccaaggagcugauguccggccugccccggaugaagaccguccuccuggucgggggccugccgcucccgccccagcuguaccgccugcagcagcacgugaaggugaucaucgccacccccgggcggcuccuggacaucaucaagcagagcuccguggagcugugcggcgugaagaucgucguggucgacgaggcggacaccaugcucaagaugggcuuccagcagcagguccuggacauccuggagaacauccccaacgacugccagacgauccucgugagcgccaccauccccaccuccaucgagcagcuggccagccagcugcuccacaaccccgugcgcaucaucaccggggagaagaaccugccgugcgccaacgugcggcagaucauccuguggguggaggaccccgccaagaagaagaagcuguucgagauccugaacgacaagaagcuguucaagccgcccguccucguguucguggacugcaagcugggcgcggaccugcuguccgaggccguccagaagaucacggggcucaagagcaucuccauccacagcgagaagucccagaucgagcgcaagaacauccugaagggccugcucgagggggacuacgaggugguggucagcaccggcgugcugggccgggggcuggaccucaucuccgugcgccuggucgugaacuucgacaugcccagcuccauggacgaguacgugcaccagaucggccgggucgggcgccugggccagaacgggaccgccaucaccuucaucaacaacaacagcaagcgccucuucugggacaucgccaagcgggugaagcccacgggcuccauccugccgccccagcugcucaacagccccuaccugcacgaccagaagcgcaaggagcagcagaaggacaagcagacccagaacgaccuggugaccggcgccaaccucauggacaucauccggaagcacgacaagagcaacucccagaaguga

SEQ ID NO: 29096 - RNA, 1845 nt, Artificial Sequence
  derived and/or modified sequence opt1 from DDX5__Homo_sapiens__NP_004387
augagcggcuacuccagcgaccgcgaccgggggcgcgaccggggcuucggggcgccccgcuucggcgggucccgggccggcccgcugagcggcaagaaguucgggaaccccggcgagaagcucgugaagaagaaguggaaccuggacgagcugcccaaguucgagaagaacuucuaccaggagcaccccgaccucgcccgccggaccgcccaggaggucgagaccuaccgccgguccaaggagaucacggugcgcgggcacaacugcccgaagcccgugcugaacuucuacgaggccaacuuccccgccaacgucauggacgugaucgcccggcagaacuucaccgagcccaccgcgauccaggcccagggcuggccgguggcccugagcgggcucgacauggucggcguggcccagaccggcuccgggaagacgcugagcuaccugcuccccgcgaucgugcacaucaaccaccagcccuuccuggagcgcggcgacgggcccaucugccugguccucgccccgacccgggagcuggcccagcagguccagcaggucgccgccgaguacugccgcgcgugccggcugaaguccacgugcaucuacggcggcgcccccaaggggccccagauccgcgaccucgagcggggcguggagaucugcaucgccacccccgggcgccugaucgacuuccuggagugcggcaagaccaaccuccggcgcaccaccuaccuggugcuggacgaggccgaccggaugcucgacaugggguucgagccgcagauccgcaagaucguggaccagauccgccccgaccggcagacccugauguggagcgccacguggcccaaggaggugcgccagcuggcggaggacuuccucaaggacuacauccacaucaacaucggcgcccuggagcuguccgccaaccacaacauccuccagaucguggacgugugccacgacgucgagaaggacgagaagcugauccggcugauggaggagaucaugagcgagaaggagaacaagaccaucguguucguggagaccaagcgccggugcgacgagcucacccgcaagaugcggcgcgacggcuggcccgccauggggauccacggcgacaagucccagcaggagcgggacuggguccugaacgaguucaagcacgggaaggccccgauccugaucgcgacggacguggccagccgcggccucgacguggaggacgucaaguucgugaucaacuacgacuaccccaacuccagcgaggacuacauccaccggaucgggcgcaccgcccgguccaccaagaccggcacggccuacaccuucuucacccccaacaacaucaagcaggucagcgaccugaucuccgugcugcgcgaggccaaccaggcgaucaaccccaagcuccugcagcugguggaggaccggggcagcgggcgcagccggggccgcgggggcaugaaggacgaccggcgcgaccgcuacuccgccgggaagcggggcggcuucaacaccuuccgcgaccgggagaacuacgaccgcggguacagcucccuccugaagcgggacuucggcgccaagacgcagaacggggucuacagcgccgcgaacuacaccaacggcuccuucggcagcaacuucguguccgccgggauccagaccagcuuccgcaccggcaacccgacggggaccuaccagaacggcuacgacuccacccagcaguacgggagcaacgugcccaacaugcacaacggcaugaaccagcaggccuacgccuaccccgccaccgcggccgcccccaugaucggcuacccgaugcccacgggguacucccaguga

SEQ ID NO: 29097 - RNA, 5139 nt, Artificial Sequence
  derived and/or modified sequence opt1 from DDX60__Homo_sapiens__NP_060101
auggagcgcaacgugcugacgaccuucagccaggagaugagccagcugauccugaacgagaugcccaaggccgaguacagcagccuguucaacgacuucguggagagcgaguucuuccucaucgacggcgacucccugcugaucacgugcaucugcgagaucagcuucaagcccgggcagaaccuccacuucuucuaccugguggagcgguaccugguggaccucaucuccaagggcgggcaguucaccaucgucuucuucaaggacgccgaguacgcguacuucaacuuccccgagcugcugagccuccgcaccgcccugauccugcaccuccagaagaacaccacgaucgacgugcggaccaccuucucccgcugccugagcaaggaguggggcuccuuccuggaggagagcuaccccuacuuccucaucguggccgacgaggggcugaacgaccugcagacccagcuguucaacuuccugaucauccacuccugggcccggaaggucaacguggugcugagcuccggccaggagagcgacguccucugccuguacgccuaccugcuccccuccauguaccgccaccagaucuucagcuggaagaacaagcagaacaucaaggacgcguacacgacccugcugaaccagcucgagcgguucaagcuguccgcccuggcgccccuguucggcagccugaaguggaacaacaucaccgaggaggcccacaagaccgugagccugcucacccagguguggcccgagggguccgacauccgccgggucuucugcgugaccagcugcucccugagccugcgcauguaccaccgguuccucggcaaccgcgagcccuccagcgggcaggagaccgagauccagcaggucaacuccaacugccugacccugcaggagauggaggaccucugcaagcugcacugccugacggucguguuccuccugcaccucccccucagccagcgggccugcgcccgcgugaucaccucccacugggccgaggacaugaagccgcugcugcagaugaagaaguggugcgaguacuucauccugcggaacauccacaccuucgaguucuggaaccucaaccugauccaccugagcgaccucaacgacgagcugcugcucaagaacaucgccuucuacuacgagaacgagaacgucaagggccugcaccugaaccucggggacaccaucaugaaggacuacgaguaccuguggaacacgguguccaagcuggugcgcgacuucgaggucggccagcccuucccccuccggaccaccaaggugugcuuccuggagaagaagcccagcccgaucaaggacuccagcaacgagauggugcccaaccugggcuucauccccaccuccagcuucgucguggacaaguucgccggggacauccucaaggaccugcccuuccugaaguccgacgacccgaucgucacgagccucgugaagcagaaggaguucgacgagcuggugcacuggcacucccacaagccccugagcgacgacuacgaccgcagccggugccaguucgacgagaagucccgcgacccccggguccuccgcagcgugcagaaguaccacguguuccagcgcuucuacggcaacucccuggagaccgucagcuccaagaucaucgugacccagaccaucaagagcaagaaggacuucuccgggcccaagagcaagaaggcgcacgagacgaaggccgagaucaucgcccgggagaacaagaagcgccuguucgcccgggaggagcagaaggaggagcagaaguggaacgcccucuccuucagcaucgaggagcagcugaaggagaaccugcacuccggcaucaagagccucgaggacuuccugaaguccugcaagagcuccugcgugaagcugcaggucgagauggugggccucaccgcgugccugaaggccuggaaggagcacugccgcagcgaggaggggaagaccaccaaggaccuguccaucgccgugcaggucaugaagcggauccacagccucauggagaaguacagcgagcugcugcaggaggacgaccgccagcucaucgcccggugccugaaguaccugggcuucgacgagcucgccuccagccugcacccggcgcaggacgccgagaacgacgugaaggugaagaagcgcaacaaguacuccgucgggaucggccccgcccgguuccagcugcaguacauggggcacuaccucauccgcgacgagcggaaggaccccgacccccgcgugcaggacuucaucccggacacguggcagcgggagcugcuggacguggucgacaagaacgagagcgccgugaucguggcccccaccuccagcggcaagaccuacgcguccuacuacugcauggagaagguccucaaggagagcgacgacggcgugguggucuacguggcccccaccaaggcccuggugaaccaggucgccgcgacggugcagaaccgcuucaccaagaaccugcccuccggggaggugcucugcggcgucuucacccgggaguaccgccacgacgcccugaacugccaggugcugaucaccgugccggccugcuucgagauccuccugcuggcgccccaccggcagaacugggucaagaagauccgcuacgugaucuucgacgaggugcacugccucgggggcgagaucggggccgagaucugggagcaccuccuggucaugauccggugccccuuccucgcccugagcgccaccaucuccaacccggagcaccugacggaguggcuccagagcgugaagugguacuggaagcaggaggacaagaucaucgagaacaacaccgccuccaagcgccacgugggccgccaggccggcuuccccaaggacuaccugcaggucaagcagagcuacaaggugcggcuggugcucuacggggagcgcuacaacgaccuggagaagcacgucugcuccaucaagcacggcgacauccacuucgaccacuuccaccccugcgccgcgcugaccaccgaccacaucgagcgguacggguucccgccggaccucacgcugagcccccgcgaguccauccagcuguacgacgccauguuccagaucuggaaguccuggccccgggcccaggagcucugccccgagaacuucauccacuucaacaacaagcuggugaucaagaagauggacgcccgcaaguacgaggagucccugaaggccgagcucaccagcuggaucaagaacggcaacguggagcaggcgcggaugguccugcagaaccugagcccggaggccgaccucucccccgagaacaugaucaccauguucccccugcugguggagaagcuccgcaagauggagaagcugcccgcccuguucuuccucuucaagcugggggccguggagaacgcggccgagagcgucuccaccuuccugaagaagaagcaggagacgaagcggccgcccaaggccgacaaggaggcccacgugauggccaacaagcuccgcaaggugaagaaguccaucgagaagcagaagaucaucgacgagaagucccagaagaagacccggaacgucgaccagagccugauccacgaggcggagcacgacaaccuggugaagugccucgagaagaaccuggagaucccccaggacugcaccuacgccgaccagaaggccgucgacaccgagacgcugcagaagguguucggccgcgugaaguucgagcggaagggcgaggagcucaaggcccuggccgagcgcgggaucggcuaccaccacuccgcgaugagcuucaaggagaagcagcuggucgagauccucuuccggaagggguaccugcgcguggugaccgccaccggcacccuggcccugggcgucaacaugcccugcaaguccgugguguucgcccagaacagcgucuaccucgacgcccugaacuaccggcagauguccgggcgcgcgggccggcgcgggcaggaccugaugggcgacguguacuucuucgacaucccguuccccaagaucgggaagcucaucaagagcaacgugcccgagcugcggggccacuucccccuguccaucacgcucguccugcgccugaugcuccuggccagcaagggcgacgacccggaggacgccaaggccaaggugcuguccgugcucaagcacagccugcuguccuucaagcagccccgcgucauggacaugcucaagcuguacuuccuguucagccuccaguuccuggugaaggagggguaccuggaccaggagggcaaccccaugggguucgcgggccucgugucccaccuccacuaccacgagcccagcaaccuggucuucgugagcuuccucgugaacgggcuguuccacgaccugugccagccgacccggaagggcuccaagcacuucagccaggacgucauggagaagcucgugcuggugcuggcccaccucuucggccgccgguacuucccgcccaaguuccaggacgcccacuucgaguucuaccaguccaaggucuuccuggacgaccugccggaggacuucagcgacgcccucgacgaguacaacaugaagaucauggaggacuucaccaccuuccugcgcaucguguccaagcuggccgacaugaaccaggaguaccagcucccccugagcaagaucaaguucacggggaaggagugcgaggacucccagcuggugagccaccucauguccugcaaggagggccgggucgcgaucagccccuucgugugccuguccgggaacuucgacgacgaccugcuccgccuggagacccccaaccacgugacccugggcaccaucggggucaaccggagccaggccccggugcuccugucccagaaguucgacaaccgcggccggaagaugagccugaacgccuacgcccucgacuucuacaagcacggcucccugaucgggcuggugcaggacaaccgcaugaacgagggcgacgccuacuaccuccugaaggacuucgcgcugacgaucaagagcaucuccgucagccuccgggagcugugcgagaacgaggacgacaacguggugcuggccuucgagcagcucuccaccaccuucugggagaagcugaacaaggucuga

SEQ ID NO: 29098 - RNA, 1452 nt, Artificial Sequence
  derived and/or modified sequence opt1 from DDX6__Homo_sapiens__NP_004388
augagcaccgcccgcaccgagaaccccgugaucaugggccuguccagccagaacgggcagcuccggggcccggucaagcccaccgggggccccgggggcggcgggacgcagacccagcagcagaugaaccagcugaagaacaccaacacgaucaacaacggcacccagcagcaggcccaguccaugaccaccacgaucaagcccggggacgacuggaagaagacccugaagcucccgcccaaggaccugcgcaucaagaccagcgacgugaccuccacgaagggcaacgaguucgaggacuacugccugaagcgggagcuccugauggggaucuucgagaugggcugggagaagcccagccccauccaggaggaguccaucccgaucgcgcugagcggccgcgacauccucgcccgggccaagaacgggaccggcaaguccggggccuaccugaucccccugcucgagcgccuggaccugaagaaggacaacauccaggccauggugaucguccccacccgggagcucgcgcuccaggugagccagaucugcauccagguguccaagcacaugggcggcgccaaggucauggccaccaccgggggcacgaaccugcgcgacgacaucaugcggcuggacgacaccgugcacguggucaucgccacccccgggcgcauccuggaccugaucaagaagggcguggcgaagguggaccacguccagaugaucgugcucgacgaggccgacaagcugcugagccaggacuucgugcagaucauggaggacaucauccucacgcugccgaagaaccggcagauccugcucuacuccgccaccuucccccugagcguccagaaguucaugaacucccaccuccagaagcccuacgagaucaaccugauggaggagcugacccugaagggggugacccaguacuacgccuacgugacggagcgccagaagguccacugccucaacacccuguucagccggcugcagaucaaccaguccaucaucuucugcaacagcucccagcgcguggagcuccuggccaagaagaucagccagcugggcuacagcugcuucuacauccacgcgaagaugcggcaggagcaccgcaaccggguguuccacgacuuccgcaacggccucugccggaaccuggucugcaccgaccuguucacccgcgggaucgacauccaggccgugaacguggucaucaacuucgacuuccccaagcucgccgagacguaccugcaccggaucggccgcuccgggcgcuucggccaccuggggcucgccaucaaccugaucaccuacgacgaccgguucaaccucaagagcaucgaggagcagcugggcaccgagaucaagccgauccccuccaacaucgacaagagccuguacguggccgaguaccacuccgagcccgucgaggacgagaagcccuga

SEQ ID NO: 29099 - RNA, 1473 nt, Artificial Sequence
  derived and/or modified sequence opt1 from DEAF1__Homo_sapiens__NP_001280563
auggaggacagcgacuccgccgccaagcagcugggccucgcggaggccgccgccguggccgcggccgccgccgucgcggccgccgccgccgcggccgccgggggcgaggccgaggagcccgugcugagccgcgacgaggacuccgaggaggacgccgacagcgaggcggagcgggagaccccgcgcgugaccgccgucgccgugauggccgccgagcccgggcacauggacaugggcgcggaggcccugcccgggcccgacgaggccgccgccgcggccgccuucgccgaggugacgaccgucaccguggcgaacgugggcgccgccgccgacaacgucuucaccacguccguggccaacgcggccagcaucuccggccacgugcucagcgggcggaccgcccugcagaucggcgacucccugaacaccgagaaggccacccucaucgucgugcacacggacgggagcaucguggagaccaccggccugaaggggccggccgcgccccugacccccggcccccaguccccgcccacgccccucgcccccggccaggagaagggcgggaccaaguacaacugggacccgagcgucuacgacuccgagcugcccgugcgcugccggaacaucagcgggacccuguacaagaaccgccucggcuccggcugggaccugaagcccagccggugccugcuccaccugugcugccugcuccgccggcacgaccugaucaccgugacgcccuccgggcagaucaccaccagcggcgcccugaccuucgaccgcgccuccacggucgaggccaccgcggugaucagcgagagcccggcccagggggacguguucgccggcgccaccguccaggaggcguccgugcagccgcccugccgggccagccaccccgagccccacuaccccggguaccaggacuccugccagaucgcccccuuccccgaggccgcccucccgaccagccaccccaagaucgugcugacgucccugcccgcgcucgccgugcccccgcccacccccaccaaggccgccccgcccgcccuggucaacggccuggagcucagcgagccccgcuccuggcuguaccuggaggagauggucaacagccuccugaacaccgcgcagcagcugaagacccucuucgagcaggccaagcacgccuccacguaccgggaggccgccaccaaccaggcgaagauccacgccgacgccgagcgcaaggaggugauccacccgccccggcugcccaaggugcugggccuccagcagagcugcgucaacugcgggcgcgaggccauguccgagugcaccggcugccacaaggugaacuacugcagcacguucugccagcggaaggacuggaaggaccaccagcacaucugcgggcaguccgcggccgugaccguccaggccgacgaggugcacguggccgagagcgucauggagaaggugaccguguga

SEQ ID NO: 29100 - RNA, 213 nt, Artificial Sequence
  derived and/or modified sequence opt1 from DEC1__Homo_sapiens__XP_011517055
augaccaugaacgugcuggaggccggcaaguggaaguccaucguccccgccccgggggagggccuccuggcggugcugcacaugaugguguucaccgacgcccuccaccgcgagcggagcgucaaguggcaggccggggugugcuacaacggcgggaaggacuucgccgugagccuggcccgccccaaggcggccgagggcaucgccgacuga

SEQ ID NO: 29101 - RNA, 1008 nt, Artificial Sequence
  derived and/or modified sequence opt1 from DECR1__Homo_sapiens__NP_001350
augaagcugcccgcccgcguguucuucacccucggcagccggcugccgugcgggcuggcgccccgccgguucuucuccuacggcaccaagauccucuaccagaacacggaggcccugcagagcaaguucuucagcccccugcagaaggccaugcugcccccgaacuccuuccaggggaaggucgccuucaucaccggcgggggcaccggccucgggaagggcaugaccacgcugcucuccagccugggggcccagugcgugaucgccucccgcaagauggacgugcugaaggcgaccgccgagcagaucagcucccagaccggcaacaagguccacgccauccagugcgacgugcgggaccccgacauggugcagaacaccgucagcgagcucaucaagguggccgggcaccccaacaucgugaucaacaacgcggccggcaacuucaucucccccacggagcgccugagcccgaacgccuggaagaccaucaccgacaucguccugaacggcaccgccuucgugacgcucgagaucgggaagcagcugaucaaggcccagaagggcgcggccuuccuguccaucaccaccaucuacgccgagaccgggagcggcuucgugguccccuccgccagcgccaaggcgggcguggaggccauguccaagagccucgccgccgagugggggaaguacggcaugcgguucaacgugauccagcccgggcccaucaagacgaagggcgccuucucccgccuggacccgaccgggaccuucgagaaggagaugaucggccggauccccugcggccgccuggggaccgucgaggagcucgcgaaccuggccgccuuccugugcagcgacuacgccagcuggaucaacggcgccgugaucaaguucgacgggggcgaggaggugcucaucuccggggaguucaacgaccugcggaaggucacgaaggagcagugggacaccaucgaggagcugauccgcaagaccaagggcagcuga

SEQ ID NO: 29102 - RNA, 957 nt, Artificial Sequence
  derived and/or modified sequence opt1 from DEDD__Homo_sapiens__NP_001034801
auggccggccugaagcgccgggccagccagguguggcccgaggagcacggggagcaggagcacggccucuacucccugcaccgcauguucgacaucgucgggacccaccugacccaccgggacgugcgcgugcucagcuuccuguucgucgacgugaucgacgaccacgagcggggccugauccgcaacgggcgggacuuccuccuggcgcuggagcgccagggccggugcgacgaguccaacuuccgccaggugcuccagcugcugcggaucaucacgcgccacgaccuccugccguacgucacccugaagcggcgccgggccgugugccccgaccucguggacaaguaccuggaggagaccagcauccgcuacgucacgccccgggcccuguccgaccccgagccgcgcccgccccagcccagcaagaccgugccgccccacuaccccguggucugcugccccaccuccggcccccagaugugcagcaagcggcccgcccgcgggcgggccacccucggcucccagcgcaagcgccgcaagagcgugacccccgaccccaaggagaagcagacgugcgacauccggcugcgggugcgcgcggaguacugccagcacgagaccgcccugcaggggaacgucuucuccaacaagcaggacccgcucgagcggcaguucgagcgcuucaaccaggccaacaccauccucaagagccgggaccugggcuccaucaucugcgacaucaaguucagcgagcugaccuaccuggacgccuucuggcgcgacuacaucaacgggucccugcucgaggcgcugaagggcguguucaucacggacagccugaagcaggccgugggccacgaggccaucaagcuccuggucaacguggacgaggaggacuacgagcuggggcggcagaagcuccugcgcaaccugaugcuccaggcccugcccuga

SEQ ID NO: 29103 - RNA, 1896 nt, Artificial Sequence
  derived and/or modified sequence opt1 from DEF6__Homo_sapiens__NP_071330
auggcccugcgcaaggagcuccucaagagcaucugguacgccuucaccgcgcuggacguggagaaguccggcaaggucagcaagucccagcucaaggugcugagccacaaccuguacaccgugcuccacaucccccacgacccggucgcccuggaggagcacuuccgggacgacgacgacgggcccguguccagccagggcuacaugcccuaccugaacaaguacauccucgacaagguggaggagggggccuucgucaaggagcacuucgacgagcugugcuggacccugaccgccaagaagaacuaccgcgccgacuccaacggcaacagcaugcucuccaaccaggacgcguuccggcuguggugccuguucaacuuccucagcgaggacaaguacccccugaucauggugccggacgagguggaguaccugcucaagaagguccuguccagcaugucccuggaggugagccucggggagcuggaggagcugcucgcccaggaggcccagguggcccagaccaccggcggccuguccgucuggcaguuccuggagcuguucaacagcgggcgcugccugcggggcguggggcgcgacacgcuguccauggcgauccacgagguguaccaggagcucauccaggacguccugaagcagggcuaccuguggaagcgggggcaccuccgccggaacugggccgagcgcugguuccagcugcagcccagcugccugugcuacuucggcuccgaggagugcaaggagaagcggggcaucaucccccucgacgcccacugcugcguggaggugcugcccgaccgcgacgggaagcggugcauguucugcgucaagaccgccaaccgcaccuacgagaugagcgccagcgacacccggcagcgccaggaguggacggcggccauccagauggccauccggcugcaggccgagggcaagaccucccuccacaaggaccugaagcagaagcgccgggagcagcgcgagcagcgggagcgccgccgggccgcgaaggaggaggagcugcuccgccugcagcagcugcaggaggagaaggagcggaagcuccaggagcuggagcugcuccaggaggcccagcgccaggccgagcggcugcugcaggaggaggaggagcgccggcgcagccagcaccgggagcugcagcaggcccucgaggggcagcugcgcgaggccgagcaggcgcgggccuccaugcaggccgagauggagcugaaggaggaggaggccgcccgccagcggcagcgcaucaaggagcucgaggagaugcagcagcggcugcaggaggcgcugcagcucgaggugaaggcccgccgggacgaggagagcgugcgcaucgcccagacccggcugcuggaggaggaggaggagaagcucaagcagcugaugcagcugaaggaggagcaggagcgcuacaucgagcgcgcccagcaggagaaggaggagcuccagcaggagauggcgcagcagucccggagccugcagcaggcccagcagcagcuggaggagguccgccagaaccggcagcgcgccgacgaggacguggaggccgcccagcggaagcuccgccaggcguccaccaacgugaagcacuggaacguccagaugaaccggcugaugcacccgaucgagcccggcgacaagcgccccgugacgagcuccagcuucuccggcuuccagcccccgcugcucgcccaccgggacagcucccugaagcgccugacccggugggggagccagggcaaccgcacccccucccccaacagcaacgagcagcagaagucccucaacgggggcgacgaggcccccgccccggccagcacgccccaggaggacaagcuggaccccgcgcccgagaacuga

SEQ ID NO: 29104 - RNA, 285 nt, Artificial Sequence
  derived and/or modified sequence opt1 from DEFA1B__Homo_sapiens__NP_001035965
augcgcacccuggccauccucgccgcgauccugcugguggcccuccaggcccaggccgagccccugcaggcccgggcggacgaggucgccgccgccccggagcagaucgcggccgacauccccgaggugguggucagccuggccugggacgagucccucgcccccaagcaccccggcagccgcaagaacauggccugcuacugccggaucccggcgugcaucgccggggagcgccgguacgggaccugcaucuaccagggccgccugugggccuucugcugcuga

SEQ ID NO: 29105 - RNA, 285 nt, Artificial Sequence
  derived and/or modified sequence opt1 from DEFA3__Homo_sapiens__NP_005208
augcgcacccuggccauccucgccgcgauccugcugguggcccuccaggcccaggccgagccccugcaggcccgggcggacgaggucgccgccgccccggagcagaucgcggccgacauccccgaggugguggucagccuggccugggacgagucccucgcccccaagcaccccggcagccgcaagaacauggacugcuacugccggaucccggccugcaucgcgggggagcgccgguacgggaccugcaucuaccagggccgccugugggccuucugcugcuga

SEQ ID NO: 29106 - RNA, 294 nt, Artificial Sequence
  derived and/or modified sequence opt1 from DEFA4__Homo_sapiens__NP_001916
augcgcaucaucgcccugcucgccgcgauccugcugguggcccuccagguccgggccggcccccugcaggcccgcggggacgaggccccgggccaggagcagcgggggcccgaggaccaggacaucagcaucuccuucgcgugggacaagagcuccgcccuccaggugagcggcuccacccgcgggauggugugcagcugccggcuggucuucugccgccggaccgagcugcgcgugggcaacugccugaucggcgggguguccuucacguacugcugcacccgggucgacuga

SEQ ID NO: 29107 - RNA, 285 nt, Artificial Sequence
  derived and/or modified sequence opt1 from DEFA5__Homo_sapiens__NP_066290
augcgcaccaucgccauccuggccgccauccuccugguggcccugcaggcccaggccgagagccuccaggagcgggccgacgaggcgaccacgcagaagcaguccggcgaggacaaccaggaccuggccaucagcuucgccgggaacggccuguccgcccuccgcaccagcgggucccaggcgcgggcgaccugcuacugccgcaccggccggugcgccacgcgcgagagccuguccggggucugcgagaucagcggccggcuguaccgccucugcugccgguga

SEQ ID NO: 29108 - RNA, 303 nt, Artificial Sequence
  derived and/or modified sequence opt1 from DEFA6__Homo_sapiens__NP_001917
augcgcacccugaccauccucacggccgugcugcuggucgcccuccaggcgaaggccgagccccugcaggccgaggacgacccgcugcaggccaaggccuacgaggcggacgcccaggagcagcggggcgccaacgaccaggacuucgccgugagcuucgcggaggacgccuccagcucccuccgcgcccuggggagcacccgggccuucacgugccacugccgccgguccugcuacagcaccgaguacuccuacgggaccugcaccgugaugggcaucaaccaccgcuucugcugccuguga

SEQ ID NO: 29109 - RNA, 204 nt, Artificial Sequence
  derived and/or modified sequence opt1 from DEFB103B__Homo_sapiens__NP_061131
augcgcauccacuaccuccuguucgcccugcuguuccucuuccuggugcccgucccgggccacgggggcaucaucaacacccugcagaaguacuacugccgggugcgcgggggccggugcgccgugcucagcugccugcccaaggaggagcagaucgggaagugcuccacccgcggccggaagugcugccgccggaagaaguga

SEQ ID NO: 29110 - RNA, 219 nt, Artificial Sequence
  derived and/or modified sequence opt1 from DEFB104B__Homo_sapiens__NP_001035792
augcagcgccuggugcuccugcuggccaucagccuccugcuguaccaggaccuccccguccgguccgaguucgagcuggaccgcaucugcggcuacgggaccgcccggugccgcaagaagugccggagccaggaguaccgcaucggccggugcccgaacaccuacgcgugcugccugcgcaagugggacgagucccuccugaaccggacgaagcccuga

SEQ ID NO: 29111 - RNA, 237 nt, Artificial Sequence
  derived and/or modified sequence opt1 from DEFB105A__Homo_sapiens__NP_689463
auggcccugauccgcaagaccuucuacuuccucuucgccauguucuucauccuggugcagcugcccagcggcugccaggcggggcucgacuucucccagccguuccccagcggcgaguucgccgucugcgaguccugcaagcuggggcggggcaagugccgcaaggagugccuggagaacgagaagcccgacgggaacugccggcucaacuuccugugcugccgccagcggaucuga

SEQ ID NO: 29112 - RNA, 198 nt, Artificial Sequence
  derived and/or modified sequence opt1 from DEFB106A__Homo_sapiens__NP_689464
augcgcaccuuccuguuccucuucgccgugcuguucuuccugacccccgccaagaacgcguucuucgacgagaagugcaacaagcucaagggcacgugcaagaacaacugcgggaagaacgaggagcugaucgcccugugccagaagucccucaagugcugccggaccauccagccgugcggcagcaucaucgacuga

SEQ ID NO: 29113 - RNA, 222 nt, Artificial Sequence
  derived and/or modified sequence opt1 from DEFB108B__Homo_sapiens__NP_001002035
augcgcaucgccgugcuccuguucgccaucuucuucuucaugagccagguccugcccgcgcggggcaaguucaaggagaucugcgagcgcccgaacggguccugccgggacuucugccuggagaccgagauccacgugggccgcugccucaacagccagcccugcugccugccccuggggcaccagccccggaucgaguccaccacgccgaagaaggacuga

SEQ ID NO: 29114 - RNA, 342 nt, Artificial Sequence
  derived and/or modified sequence opt1 from DEFB112__Homo_sapiens__NP_001032587
augaagcugcucaccaccaucugccgccugaagcuggagaagauguacagcaagacgaacaccuccagcaccaucuucgagaaggcccggcacggcaccgagaagaucuccacggcccgcagcgaggggcaccacaucaccuucucccgguggaaguccugcaccgcgaucggcgggcgcugcaagaaccagugcgacgacagcgaguuccggaucagcuacugcgcccgccccaccacgcacugcugcgugaccgagugcgacccgaccgaccccaacaacuggauccccaaggacuccgucggcacccaggagugguaccccaaggacagccggcacuga

SEQ ID NO: 29115 - RNA, 471 nt, Artificial Sequence
  derived and/or modified sequence opt1 from DEFB125__Homo_sapiens__NP_697020
augaacauccugaugcucaccuucaucaucugcggccugcugacccgcgugacgaaggggagcuucgagccccagaagugcuggaagaacaacgucggccacugccggcgccggugccucgacaccgagcgcuacauccugcugugccggaacaagcucuccugcugcaucagcaucaucucccacgaguacacccgccggcccgccuuccccgugauccaccuggaggacaucacccuggacuacagcgacguggacuccuucacggggagccccgucuccaugcucaacgaccugaucaccuucgacaccaccaaguucggcgagacgaugacccccgagaccaacaccccggagacgaccaugccgcccagcgaggccaccacccccgagacgaccaugccgcccuccgagaccgcgaccagcgagacgaugcccccgcccucccagaccgcccugacccacaacuga

SEQ ID NO: 29116 - RNA, 336 nt, Artificial Sequence
  derived and/or modified sequence opt1 from DEFB126__Homo_sapiens__NP_112193
augaagucccuccuguucacccuggccguguucaugcugcucgcccagcuggucagcggcaacugguacgugaagaagugccugaacgacguggggaucugcaagaagaagugcaagcccgaggagaugcacgucaagaacggcugggcgaugugcgggaagcagcgcgacugcugcgugccggccgaccggcgcgccaacuaccccguguucugcguccagaccaagacgacccggaucagcaccgugaccgccacgaccgccaccaccacgcucaugaugaccaccgcguccaugagcuccauggcccccacccccgugagcccgacgggcuga

SEQ ID NO: 29117 - RNA, 207 nt, Artificial Sequence
  derived and/or modified sequence opt1 from DEFB1__Homo_sapiens__NP_005209
augcgcaccagcuaccugcuccuguucacccugugccuccugcuguccgagauggccagcggcggcaacuuccucacgggccuggggcaccgguccgaccacuacaacugcgugagcuccggcgggcagugccuguacagcgccugccccaucuucaccaagauccaggggaccugcuaccgcggcaaggcgaagugcugcaaguga

SEQ ID NO: 29118 - RNA, 195 nt, Artificial Sequence
  derived and/or modified sequence opt1 from DEFB4A__Homo_sapiens__NP_004933
augcgcgugcuguaccuccuguucagcuuccuguucaucuuccucaugccccugccgggcgucuucgggggcaucggggaccccgugaccugccugaaguccggcgccaucugccaccccguguucugcccccggcgcuacaagcagaucgggaccugcggccucccgggcacgaagugcugcaagaagcccuga

SEQ ID NO: 29119 - RNA, 972 nt, Artificial Sequence
  derived and/or modified sequence opt1 from DEGS1__Homo_sapiens__NP_003667
augggcagccgcgugucccgggaggacuucgagugggucuacaccgaccagccccacgccgaccgccggcgcgagauccuggccaaguacccggagaucaagagccucaugaagcccgaccccaaccugaucuggaucaucaucaugauggugcugacccagcucggggcguucuacaucgugaaggaccuggacuggaagugggucaucuucggcgccuacgccuucggguccugcaucaaccacagcaugacgcuggccauccacgagaucgcccacaacgcggccuucggcaacugcaaggccauguggaaccggugguucgggauguucgccaaccuccccaucggcaucccguacuccaucagcuucaagcgcuaccacauggaccaccaccgguaccugggcgcggacgggguggacguggacauccccaccgacuucgagggcugguucuucugcaccgccuuccgcaaguucaucugggucauccugcagccccucuucuacgccuuccggccccuguucaucaacccgaagcccaucaccuaccuggaggugaucaacacgguggcccaggucaccuucgacauccucaucuacuacuuccuggggaucaagucccugguguacaugcucgccgcgagccugcugggccucgggcugcaccccaucuccggccacuucaucgccgagcacuacauguuccugaagggccacgagaccuacagcuacuacgggccccucaaccugcugaccuucaacgugggcuaccacaacgagcaccacgacuucccgaacauccccgggaagucccucccccugguccgcaagaucgccgccgaguacuacgacaaccugccccacuacaacagcuggaucaaggugcucuacgacuucgugauggacgacacgaucuccccguacagccggaugaagcgccaccagaagggcgagaugguccuggaguga

SEQ ID NO: 29120 - RNA, 972 nt, Artificial Sequence
  derived and/or modified sequence opt1 from DEGS2__Homo_sapiens__NP_996801
augggcaacagcgccucccgcagcgacuucgaguggguguacaccgaccagccccacacccagcggcgcaaggagauccuggccaaguacccggcgaucaaggcccucaugcggcccgacccccgccugaagugggccguccuggugcucgugcugguccagaugcuggccugcuggcucgugcgggggcuggccuggcgcuggcugcuguucugggcguacgccuucggcgggugcgugaaccacucccugacgcuggccauccacgacaucagccacaacgccgcguucggcaccgggcgggccgcccgcaaccgguggcucgccgucuucgccaaccugcccgugggcgugccguacgcggccuccuucaagaaguaccacgucgaccaccaccgcuaccugggcggggacggccucgacguggacgugcccacccggcuggaggggugguucuucugcacccccgcccgcaagcugcucuggcugguccugcagcccuucuucuacagccuccggccgcugugcgugcaccccaaggccgugacgcgcauggagguccugaacacccucgugcagcuggccgcggaccuggccaucuucgcccucuggggccugaagcccguggucuaccugcucgccuccagcuuccuggggcugggccuccaccccaucuccggccacuucguggccgagcacuacauguuccugaaggggcacgagaccuacagcuacuacggcccgcugaacuggaucaccuucaacgugggguaccacgucgagcaccacgacuuccccuccauccccggcuacaaccucccccuggugcggaagaucgcgccggaguacuacgaccaccucccccagcaccacagcugggugaagguccucugggacuucguguucgaggacucccugggccccuacgcccgcgucaagcggguguaccgccuggccaaggacgggcucuga

SEQ ID NO: 29121 - RNA, 1026 nt, Artificial Sequence
  derived and/or modified sequence opt1 from DEK__Homo_sapiens__NP_001128181
augagcgccuccgcccccgcggccgagggcgaggggaccccgacccagcccgccagcgagaaggagcccgagaugcccggcccgcgcgaggaguccgaggaggaggaggacgaggacgacgaggaggaggaggaggaggagaaggggaagggccagaagcugugcgagaucgagcggauccacuucuuccucagcaagaagaagacggacgagcugcgcaaccugcacaagcuccuguacaaccggcccgggaccguguccagccugaagaagaacgucggccaguucuccggcuuccccuucgagaaggggagcgugcaguacaagaagaaggaggagaugcucaagaaguuccgcaacgccaugcugaaguccaucugcgaggugcuggaccucgagcggagcggcgucaacuccgagcuggugaagcgcauccugaacuuccucaugcaccccaagccgagcgggaagccccugcccaaguccaagaagaccugcagcaagggcuccaagaaggagcggaacagcuccgggauggcccgcaaggcgaagcggaccaagugccccgagauccugagcgacgaguccagcagcgacgaggacgagaagaagaacaaggaggaguccagcgacgacgaggacaaggaguccgaggaggagccgcccaagaagacggccaagcgcgagaagcccaagcagaaggccaccagcaaguccaagaaguccgucaagagcgccaacgugaagaaggcggacagcuccaccaccaagaagaaccagaacagcuccaagaaggagagcgaguccgaggacagcuccgacgacgagccccucaucaagaagcugaagaagccgcccacggacgaggagcugaaggagaccaucaagaagcuccuggccagcgccaaccuggaggaggugaccaugaagcagaucugcaagaagguguacgagaacuaccccaccuacgaccucacggagcggaaggacuucaucaagaccaccgucaaggagcugaucuccuga

SEQ ID NO: 29122 - RNA, 3030 nt, Artificial Sequence
  derived and/or modified sequence opt1 from DENND1A__Homo_sapiens__NP_065997
augggcagccgcaucaagcagaaccccgagaccaccuucgagguguacgucgagguggccuacccgcggaccgggggcacccuguccgaccccgaggugcagcgccaguuccccgaggacuacagcgaccaggagguccuccagacccugaccaaguucugcuuccccuucuacguggacucccugacggugagccaggucgggcagaacuucaccuucgugcucaccgacaucgacuccaagcagcgguucggcuucugccgccugagcuccggggccaagagcugcuucugcauccuguccuaccucccgugguucgagguguucuacaagcugcugaacauccucgcggacuacaccacgaagcggcaggagaaccaguggaacgagcugcuggagacccuccacaagcugcccauccccgaccccggcgucagcgugcaccuguccgugcacagcuacuucaccgucccggacacccgcgagcuccccuccauccccgagaaccggaaccugacggaguacuucguggccguggacgucaacaacaugcugcaccucuacgccagcaugcuguacgagcgccggauccugaucaucugcuccaagcucagcacccugaccgccugcauccacggcuccgccgcgaugcuguaccccauguacuggcagcacguguacaucccggugcucccgccccaccuccuggacuacugcugcgcccccaugcccuaccucaucgggauccaccugagccugauggagaagguccgcaacauggcccucgacgacguggugauccugaacgucgacaccaacacgcuggagacccccuucgacgaccuccagucccugcccaacgacgugaucagcagccugaagaaccggcucaagaagguguccaccaccacgggcgacggggucgcccgcgcguuccugaaggcccaggccgccuucuucggcagcuaccggaacgcccugaagaucgagcccgaggagccgaucaccuucugcgaggaggcguucgugucccacuaccgcagcggggccaugcggcaguuccugcagaacgccacccagcugcagcuguucaagcaguucaucgacggccgccucgaccugcugaacuccggcgagggguucagcgacgucuucgaggaggagaucaacaugggcgaguacgccggguccgacaagcucuaccaccaguggcugagcaccgugcggaagggcuccggcgccauccugaacacggugaagaccaaggcgaaccccgccaugaagaccgucuacaaguucgccaaggaccacgccaagauggggaucaaggaggugaagaaccgccucaagcagaaggacaucgccgagaacggcugcgcgcccacccccgaggagcagcugccgaagacggcccccagcccccugguggaggccaaggaccccaagcugcgggaggaccgccggccgaucaccguccacuucggccaggugcgcccgccccgcccccacguggucaagcggcccaaguccaacaucgccguggaggggcgccggaccagcgugcccucccccgagcagccgcagcccuaccgcacccuccgggagagcgacuccgccgagggggacgaggcggagagccccgagcagcagguccgcaaguccacgggccccgugccggccccgcccgaccgggccgccagcaucgaccugcuggaggacguguucuccaaccucgacauggaggcggcccugcagccccugggccaggccaagagccucgaggaccugcgcgcccccaaggaccugcgggagcagcccgggaccuucgacuaccagcgccucgaccugggcgggagcgagcggucccgcggcgucaccguggcccugaagcucacccaccccuacaacaagcuguggagccuggggcaggacgacauggcgauccccuccaagccgcccgccgccagccccgagaagcccuccgcccuccugggcaacagccuggcccucccgcggcgcccccagaaccgggacuccauccugaaccccagcgacaaggaggaggugcccacgccgacccugggcuccaucaccaucccccgcccccaggggcggaagaccccggagcucggcaucgucccgccgccgcccaucccccgccccgcgaagcugcaggccgccggggccgcccugggcgacgugagcgagcggcuccagaccgaccgcgaccgccgggcggcccugucccccgggcugcuccccggcguggucccccagggccccacggagcugcugcagccccucagccccgggcccggcgccgccgggaccuccagcgacgcgcugcuggcccuccuggacccccuguccaccgccuggagcggcuccacccuccccagccgcccggccacgcccaacguggccacccccuucacgccccaguucagcuucccgcccgcgggcacccccacgcccuucccgcagccgccccugaaccccuucgugcccuccaugcccgccgcgcccccgacccugccccucgucagcacccccgccgggcccuucggcgccccgcccgccucccuggggcccgccuucgccagcggccugcuccuguccagcgccggguucugcgcgccccaccggucccagccgaaccugagcgcccucuccaugcccaaccuguucggccagaugcccaugggcacccacacgagcccccugcagccgcucgggccgcccgccguggcccccucccgcauccggacccugccccuggcccgcagcuccgcgcgggccgccgagaccaagcagggccucgcccugcgccccggggacccgccccugcucccgccccggccgccccagggccuggagcccacccugcagcccagcgcgccccagcaggcccgcgaccccuucgaggaccuccugcagaagacgaagcaggacgugucccccagccccgcccuggcccccgccccggacuccgucgagcagcuccggaagcagugggagaccuucgaguga

SEQ ID NO: 29123 - RNA, 1191 nt, Artificial Sequence
  derived and/or modified sequence opt1 from DENND1B__Homo_sapiens__NP_001287787
auggccgccgcgccccgcgaggagaagcgguggccgcagcccguguucagcaaccccgucgugcuguggaaguuccccgaggacuucggcgaccaggagauccuccaguccgugccgaaguucugcuuccccuucgacgucgagcgcgugagccagaaccagguggggcagcacuucaccuucguccugaccgacaucgaguccaagcagcgguucggcuucugccgccugacgagcgggggcaccaucugccucugcauccuguccuaccugcccugguucgagguguacuacaagcuccugaacacccuggccgacuaccucgccaaggagcuggagaacgaccugaacgagacccuccggagccuguacaaccaccccgugccgaaggccaacacgcccgucaaccuguccgugcacagcuacuucaucgcccccgacgugaccgggcuccccaccaucccggagucccgcaaccugaccgaguacuucgucgcgguggacgugaacaacaugcugcagcucuacgccagcaugcugcacgagcggcgcaucgucaucaucuccagcaagcuguccacgcucaccgccugcauccacggcagcgccgcgcugcuguaccccauguacuggcagcacaucuacauccccgugcugcccccgcaccuccuggacuacugcugcgcccccaugcccuaccucaucggcauccacuccagccugaucgagcgggugaagaacaagucccuggaggacgucgugaugcucaacguggacaccaacacccuggagagccccuucuccgaccugaacaaccucccgagcgacgucgugagcgcccugaagaacaagcugaagaagcaguccacggccaccggggacggcguggcccgcgcguuccuccgggcccaggccgcccuguucgggagcuaccgcgacgcccugcgguacaagcccggcgagcccaucaccuucugcgaggaguccuucgucaagcaccgcagcuccgugaugaagcaguuccucgagaccgcgaucaaccugcagcuguucaagcaguucaucgacgggcggcucgccaagcugaacgccggccgcggcuucagcgacgucuucgaggaggagaucacguccgggggcuucugcgggggcaaggacaagcugcaguacgacuaccccuucagccaguga

SEQ ID NO: 29124 - RNA, 3030 nt, Artificial Sequence
  derived and/or modified sequence opt1 from DENND2A__Homo_sapiens__NP_056504
auggacauguucagccuggacaugaucaucuccgaccccgccgccgaggcgagccgcgccggcaagaagcagcuccgcggggugcagaacccgugccccuccgcccgggcccggccccgccacaagagccugaacaucaaggacaagaucuccgagugggagggcaagaaggagguccccaccccggcccccagccggcgcgcggacgggcaggaggacuaccugcccuccagcaccguggagcggcgcuccagcgacggcgugcggacgcaggucaccgaggccaagaacgggaugcgccccggcaccgaguccaccgagaaggagcggaacaagggcgccgugaacgucgggggccaggacccggagcccgggcaggaccucagccagcccgagcgcgagguggaccccuccuggggccgggggcgcgagccgcggcugggcaagcugcgcuuccagaacgacccccucagcgugcugaagcaggucaagaagcuggagcaggcccucaaggacggcuccgcggggcuggacccccagcugcccggcacgugcuacagcccgcacugcccgcccgacaaggccgaggccggguccacccuccccgagaaccugggcggcgggagcggcuccgaggucagccagcgggugcaccccagcgaccuggaggggcgcgagcccacccccgagcucguggaggaccggaagggcuccugccgccggcccugggaccgcagccuggagaacgucuaccgcggguccgagggcagcccgaccaagcccuucaucaacccccugcccaagccgcggcgcacguucaagcacgccggcgagggggacaaggacggcaagcccgggaucggcuuccggaaggagaagcgcaaccugcccccgcuccccucccugcccccgccgccccuccccagcagcccgccgcccuccuccgugaaccggcgccuguggaccgggcggcagaaguccuccgccgaccaccgcaagagcuacgaguucgaggaccugcuccagagcagcuccgagagcucccggguggacugguacgcgcagaccaagcugggccugacccgcacgcucagcgaggagaacguguacgaggacauccuggacccgcccaugaaggagaaccccuacgaggacaucgagcugcacggccggugccucgggaagaagugcgugcugaacuuccccgccucccccaccagcagcauccccgacacccugaccaagcagucccucagcaagcccgccuucuuccgccagaacuccgagcggcgcaacuucaagcugcuggacacgcggaagcucagccgcgacggcaccgggucccccagcaagaucuccccgcccagcacccccuccagccccgacgacaucuucuucaaccugggcgacccccagaacgggcggaagaagcgcaagauccccaagcuggugcuccggaucaacgccaucuacgagguccgccgcggcaagaagcgggugaagcgccugucccagagcauggaguccaacagcggcaaggugaccgacgagaacuccgagagcgacuccgacacggaggagaagcugaaggcccacagccagcggcucgucaacgucaagagccgccugaagcaggcgccccgguaccccucccuggcccgcgagcucaucgaguaccaggagcggcagcuguucgaguacuucgugguggugagccugcacaagaagcaggccggggccgccuacguccccgagcucacccagcaguucccgcugaagcuggagcgcuccuucaaguucaugcgggaggcggaggaccagcugaaggccaucccccaguucugcuuccccgacgccaaggacugggugcccgugcagcaguucaccagcgagaccuucuccuucguccucacgggcgaggacgggagccgccgguucggcuacugccgccggcugcugccgggcgggaagggcaagcgccuccccgagguguacugcaucgugucccggcuggggugcuucagccuguucucccgcauccucgacgaggucgagaagcggcgcggcaucagccccgcccuggugcagccccugaugcgguccgugauggaggccccguuccccgcgcucgggaagaccauccuggucaagaacuuccugcccggcagcggcaccgaggugaucgagcucugccgcccccuggacucccggcuggagcacguggacuucgagagccucuucuccagccuguccguccgccaccuggugugcguguucgccagccuccugcuggagcgccgggucaucuucaucgccgacaagcucuccauccugagcaagugcugccacgccaugguggcgcugaucuacccguucgccuggcagcacaccuacauccccgugcucccgcccgccauggucgacaucgugugcagccccacgcccuuccugaucgggcugcucuccagcucccugccccugcuccgcgagcugccccuggaggaggugcucgucguggaccuggugaacagccgguuccugcgccagauggacgacgaggacuccauccucccgcggaagcugcaggucgcccuggagcacauccucgagcagcgcaacgagcuggccugcgagcaggacgagggcccccuggacgggcggcacggccccgagagcagcccccucaacgaggugguguccgaggcguucguccgcuucuucguggagaucguggggcacuacucccuguuccugaccagcggcgagcgggaggagcgcacccuccagcgggaggccuuccgcaaggccgucuccagcaagucccugcggcacuuccuggagguguucauggagacccagauguuccgcggcuucauccaggagcgggagcuccgccggcaggacgccaaggggcuguucgaggugcgcgcccaggaguaccuggagacgcucccgagcggcgagcacuccggggucaacaaguuccugaagggccuggggaacaagaugaaguuccuccacaagaaguga

SEQ ID NO: 29125 - RNA, 5721 nt, Artificial Sequence
  derived and/or modified sequence opt1 from DENND4A__Homo_sapiens__NP_001138295
augaucgaggacaagggcccccgcguggccgacuacuucgugguggccgggcugaccgacgugagcaagccccuggaggaggagauccacuucaacgacgcgugccacaagguggccaagcccaaggagcccaucaccgacguguccgugaucaucaagagccugggcgaggaggucccccaggacuacaucugcaucgacgugacgcccaccgggcuguccgccgaccugaacaacggcagccugguggggccccagaucuaccugugcuaccgccgcggccgggacaagccgccccugaccgaccugggcguccuguacgacuggaaggagcgccucaagcaggggugcgagaucauccaguccacccccuacggccggcccgccaacaucagcggguccaccagcucccagcgcaucuacaucaccuaccggcgcgccagcgagaacaugacccagaacacccuggcggugacggacaucugcaucaucauccccuccaagggcgaguccccgccccacaccuucugcaagguggacaagaaccugaacaacuccaugugggggagcgccgucuaccucugcuacaagaaguccguggccaagaccaacaccgugagcuacaaggccggccugaucugccgguacccccaggaggacuacgaguccuucagccugcccgaguccgucccccucuucugccugcccaugggcgcgacgaucgagugcuggcccagcaacagcaaguacccccugcccguguucuccaccuucgugcucaccggggccagcgccgagaaggucuacggcgccgccauccaguucuacgagcccuacuccgaggagaaccugaccgagaagcagcgccugcuccuggggcugacgagcgcggacggcaaguccgacagcuccaagaccauccacaccaacaagugcaucugccuccugagccacuggcccuucuucgacgccuuccggaaguuccugaccuuccucuaccgcuacuccaucagcggcccccacgugcugcccaucgagaagcacaucucccacuucaugcacaaggugcccuuccccagcccccagcggccccgcauccugguccagcucagcccccacgacaaccugauccugucccagcccguguccagcccccucccgcuguccgggggcaaguucagcacgcugcuccagaaccuggggcccgagaacgccgugacccugcucgucuucgccgugaccgagcacaagauccugauccacucccugcggcccagcguccucaccagcgugacggaggcccugguguccaugaucuuccccuuccacuggccgugccccuacgucccccugugcccccucgcgcuggccgacgugcugagcgccccgugccccuucaucgugggcaucgacucccgcuacuucgaccucuacgacccgccgcccgacgucagcugcguggacguggacaccaacaccaucucccagaucggggacaagaagaacgucgccuggaagauccugcccaagaagcccugcaagaaccugaugaacacccugaacaaccuccaccagcagcuggccaagcugcagcagcggccccgcgacgacggccucauggaccuggcgaucaacgacuacgacuucaacagcggcaagcggcugcacaugaucgaccucgagauccaggaggccuuccuguucuucauggccuccauccugaagggguaccgcagcuaccuccggcccaucacgcaggcccccuccgagaccgccaccgacgcggccagccuguucgcccugcaggccuuccuccgcucccgcgaccggagccaccagaaguucuacaacaugaugaccaagacgcagauguucauccgcuucaucgaggagugcuccuucgugagcgacaaggacgcgucccuggccuucuucgacgacugcguggacaaggucgacauggacaagagcggcgaggugcggcugaucgagcucgacgaguccuucaagagcgagcacaccguguucgucacgccgcccgagaucccgcaccuccccaacggggaggagccgccccugcaguacagcuacaacggcuucccggugcuccgcaacaaccuguucgagcggcccgagggguuccugcaggccaagaagaacaagcuccccuccaagagcuccagcccgaacagcccccugcccauguuccgccggaccaagcaggagaucaagagcgcccacaagaucgccaagcgcuacuccagcaucccccagauguggucccggugccugcuccgccacugcuacggccugugguucaucugccugccggcguacgugaaggucugccacagcaaggugcgggcccucaagacggccuacgacgugcugaagaagaugcaguccaagaagauggacccgcccgacgaggucugcuaccgcauccugaugcagcucugcggccaguacgaccagcccgugcuggccgugcggguccuguucgagaugcagaaggccgggaucgacccgaacgcgaucaccuacggcuacuacaacaaggccgugcucgagagcaccuggcccucccgcagccgguccggguacuuccuguggaccaaggugcgcaacgucgugcugggcgugacccaguucaagcgggcccucaagaagcacgcccaccugagccagacgacccuguccgacgggagcgaccucgacgccgucucccacggcagcauggacagcggccacgggacccacaccguggagcaggcgcccuucaacacgggccugaucaagguguacgccaccgacgaccgcuccagcaccgggggccaguccgaccugggcuacaacagccucuccaaggacgagguccggcgcggggacaccagcacggaggacauccaggaggagaaggacaagaagggcuccgacugcagcucccugagcgaguccgagagcaccaagggguccgccgacugccugcccaagcucagcuaccagaacuccagcuccaucgugcgccugaccggcaccagcaacaacuccgccgggaagaucagcggcgagagcauggaguccacgccggagcugcuccugaucagcucccuggaggacaccaacgagacccggaacauccagagccgcugcuuccggaagcgccacaaguccgacaacgagaccaaccuccagcagcaggucgucuggggcaaccggaaccgcaaccugagcgggggcgugcugaugggguucaugcucaaccggaucaaccaggaggcgacgcccggcgacaucguggagaagcugggggccgacgccaagauccuguccaacgucaucagcaaguccacccgccccaacacccucgacaucggcaagcccccgcugcggagcaagcgcgacucccuggagaaggagagcuccgacgacgacacccccuucgacggcagcaacuaccucgccgacaagguggacucccccgugaucuucgaccuggaggaccuggacagcgagacggacgucuccaaggccgggugcguggcgacccagaaccccaagcggauccagcgcaugaacagcuccuucagcgugaagccguucgagaagaccgacgucgccaccggcuucgacccccucagccugcugguggccgagacggagcagcagcagaaggaggaggaggaggaggacgaggacgacuccaagagcaucuccacccccagcgcccggcgcgaccucgccgaggagaucgugauguacaugaacaacauguccagcccccugaccucccggaccccgagcaucgaccugcagcgcgcgugcgacgacaagcucaacaagaaguccccgccccuggucaaggccugccggcgcagcagccugcccccgaacagccccaagcccgugcggcucacgaaguccaagagcuacaccaaguccgaggagaagccgcgcgaccggcuguggagcucccccgccuucagcccgaccugccccuuccgcgaggagucccaggacacccugacgcacagcagcccguccuucaaccucgacacccugcuggugcccaagcucgacguccugcgcaacagcauguucaccgccgggaagggcguggccgagaaggcguccaagugguacagccgguucaccauguacacgaccuccagcaaggaccaguccagcgaccgcaccucccugagcuccgucggggcccaggacagcgaguccaccagccucaccgacgaggacgugugccacgagcuggagggccccaucuccagccaggagacguccgccaccagcggcaccaagcggaucgaccugucccgcaucagccucgagagcuccgccagccuggaggggucccugagcaaguucgcgcuccccggcaaguccgaggugaccagcuccuucaacgccagcaacacgaacaucuuccagaacuacgccauggagguccugaucuccagcugcucccggugccggaccugcgacugccuggugcacgacgaggagaucauggccggguggaccgccgacgacagcaaccucaacaccacgugcccguucugcggcaacaucuuccugcccuuccugaacaucgagauccgggaccuccgccggcccgggcgcuacuuccugaaguccagccccuccaccgagaacaugcacuucccgagcuccaucagcagccagacccggcaguccugcaucagcaccuccgcgagcggccuggacacguccgcccugagcgugcagggcaacuucgaccucaacuccaagagcaagcugcaggagaacuucugcacccgcuccauccagauccccgccaaccggagcaagaccgccauguccaagugccccaucuuccccauggcccgcagcaucuccaccagcgggccgcuggacaaggaggacacgggccggcagaagcucaucuccaccgggagccugcccgcgacccugcagggcgccaccgacucccucggccuggaguggcaccuccccagccccgacccggucacggugcccuaccucagcccccugguggucuggaaggagcuggagagccuccuggagaacgagggggaccacgccaucaccguggccgacuucguggaccaccaccccaucgucuucuggaaccuggugugguacuuccgccggcucgaccugccgagcaaccugcccggccucauccuguccagcgagcacugcaacaaguacuccaagaucccccgccacugcaugagcgaggacuccaaguacgugcugauccagaugcucugggacaacaugaagcugcaccaggaccccgggcagccgcuguacauccucuggaacgcccacacccagaaguaccccaugguccaccuccugcagaaguccgacaacuccuucaaccaggagcuccugaaguccauggugaaguccaucaagaugaacgacguguacggccccaugagccagauccuggagacccucaacaagugcccgcacuucaagcggcagcgcucccuguaccgcgagauccuguuccucagccuggucgcgcuggggcgggagaacaucgacaucgacgccuucgacaaggaguacaagauggccuacgaccgccucacgcccucccaggucaagagcacccacaacugcgaccggccgcccuccaccggcgugauggagugccgcaagaccuucggcgagccguaccuguga

SEQ ID NO: 29126 - RNA, 597 nt, Artificial Sequence
  derived and/or modified sequence opt1 from DENR__Homo_sapiens__NP_003668
auggccgccgacaucagcgaguccagcggcgcggacugcaagggggacccccgcaacuccgccaagcuggacgccgacuacccgcuccgggugcuguacugcggcgucugcagccugcccaccgaguacugcgaguacaugcccgacguggccaagugccgccaguggcucgagaagaacuuccccaacgaguucgccaagcugaccguggagaacuccccgaagcaggaggcggggaucagcgagggccaggggacggccggcgaggaggaggagaagaagaagcagaagcggggcgggcgcggccagaucaagcagaagaagaagaccgucccccagaaggugaccaucgccaagaucccccgggccaagaagaaguacgugacccgcgucugcgggcuggcgacguucgagaucgaccucaaggaggcccagcgguucuucgcccagaaguucuccugcggcgccagcgugaccggggaggacgagaucaucauccagggcgacuucaccgacgacaucaucgacgugauccaggagaaguggcccgaggucgacgacgacuccaucgaggaccugggcgaggugaagaaguga

SEQ ID NO: 29127 - RNA, 1404 nt, Artificial Sequence
  derived and/or modified sequence opt1 from DEPDC1B__Homo_sapiens__NP_001138680
auggagcaccgcaucgugggccccgggccguaccgggccacccgccuguggaacgagaccgucgagcuguuccgggccaagaugccccugcgcaagcaccggugccgcuucaagagcuacgagcacugcuucacggcggccgaggccguggacuggcugcacgagcuccugcggugcucccagaacuucggccccgaggugacccgcaagcagaccguccagcugcucaagaaguuccugaagaaccacgugaucgaggacaucaaggggaaguggggcgaggaggacuucgaggacaaccggcaccuguaccgcuucccgcccagcagcccccucaagcccuaccccaagaagccgcccaaccagaaggacgugaucaaguuccccgaguggaacgaccugcccccggggaccagccaggagaacauccccguccggcccguggugaugaacuccgagaugugguacaagcgccacagcaucgccaucggcgagguccccgccugccggcuggugcaccgccggcagcucacggaggcgaacguggaggagaucuggaaguccaugacccugagcuaccugcagaagauccucggccuggacucccuggaggagguccucgacgugaagcuggugaacagcaaguucaucauccacaacgucuacuccgugagcaagcaggggguggucauccuggacgacaaguccaaggagcucccgcacugggugcugagcgccaugaagugccuggccaacuggcccaacugcuccgaccucaagcagcccauguaccugggcuucgagaaggacguguucaagaccaucgccgacuacuacgggcaccugaaggagccccuccugaccuuccaccuguucgacgcguucgucagcgugcucggccugcugcagaaggagaagguggccgucgaggccuuccagaucugcugccuccugcugccgcccgagaaccgccggaagcuccagcugcugaugcgcaugauggcccggaucugccucaacaaggagaugccgccccugugcgacggguucggcacgcgcacccugauggugcagaccuucucccggugcauccucugcagcaaggacgaggucgaccuggacgagcugcucgccgcgcgccuggugaccuuccugauggacaacuaccaggagauccucaaggugccccuggcccugcagacguccaucgaggagcgcgucgcccaccuccggcgcgugcaguuccagaaguccuaccccgagguguaccaggagcgguuccccacccccgagagcgccgcccuccuguucccggagaagcccaagcccaagccgcagcugcucaugugggcgcugaagaagcccuuccagcccuuccagcgcacccgguccuuccgcauguga

SEQ ID NO: 29128 - RNA, 1680 nt, Artificial Sequence
  derived and/or modified sequence opt1 from DEPDC5__Homo_sapiens__NP_001007189
augcgcaccaccaagguguacaagcuggucauccacaagaagggcuucgggggcagcgacgacgagcucguggugaaccccaaggucuucccgcacaucaagcugggggacaucguggagaucgcccaccccaacgacgaguacagcccccugcuccugcaggucaagagccugaaggaggaccuccagaaggagacgaucuccguggaccagaccgugacccagguguuccggcugcgccccuaccaggacgucuacgugaacguggucgacccgaaggacgugacccuggaccucguggagcugacguucaaggaccaguacaucggccgcggggacauguggcggcugaagaagucccucgucuccacgugcgccuacaucacccagaagguggaguucgcgggcauccgggcccaggccggcgagcugugggugaagaacgagaaggucaugugcggguacaucagcgaggacacccgcgugguguuccgguccaccagcgccauggucuacaucuucauccagauguccugcgagaugugggacuucgacaucuacggcgaccuguacuucgagaaggccgugaacggguuccucgcggaccuguucaccaaguggaaggagaagaacugcagccacgaggugaccgucgugcuguucucccgcaccuucuacgacgccaagagcgucgacgaguuccccgagaucaaccgggccuccauccgccaggaccacaagggccgguucuacgaggacuucuacaagguggugguccagaacgagcgccgggaggaguggacgagccuccuggugaccaucaagaagcuguucauccaguaccccgugcucguccgccuggagcaggccgagggguucccccagggcgacaacuccaccagcgcgcagggcaacuaccuggaggccaucaaccucuccuucaacguguucgacaagcacuacaucaaccggaacuucgaccgcaccgggcagaugagcguggucaucacgccgggcguggggguguucgaggucgaccggcugcugaugauccucaccaagcagcgcaugaucgacaacggcaucggcguggaccuggugugcaugggggagcagccccugcacgccgucccccucuucaagcugcacaaccgguccgcgccccgcgacagccggcugggcgacgacuacaacaucccgcacuggaucaaccacagcuucuacaccuccaagagccagcuguucugcaacuccuucacgccccgcaucaagcuggccgggaagaagcccgccagcgagaaggccaagaacggccgcgacaccucccuggggagccccaaggaguccgagaacgcccucccgauccagguggacuacgacgccuacgacgcccagguguuccggcugcccggccccagccgcgcgcagugccugacgaccugccgguccguccgcgagcgggagagccacucccgcaagagcgccuccagcugcgacguguccagcucccccagccucccgucccggacccugcccaccgaggaggugcgcagccaggccagcgacgacuccagccugggcaaguccgccaacauccucaugaucccccacccccaccuccaccaguacgaggucagcuccagccugggguacaccuccacccgggagcaccucggcuga

SEQ ID NO: 29129 - RNA, 1230 nt, Artificial Sequence
  derived and/or modified sequence opt1 from DEPTOR__Homo_sapiens__NP_073620
auggaggagggcgggagcaccggcuccgccgggagcgacuccagcaccuccggcagcgggggcgcccagcagcgcgagcuggagcggauggcggaggugcucgucacgggcgagcagcugcgccugcggcuccacgaggagaaggugaucaaggaccgccggcaccaccugaagaccuaccccaacugcuucguggccaaggagcugaucgacuggcucaucgagcacaaggaggccuccgaccgcgagaccgccaucaagcugaugcagaagcuggccgaccgggggaucauccaccacgucugcgacgagcacaaggaguucaaggacgugaagcuguucuaccgcuuccggaaggacgacggcaccuucccgcucgacaacgaggugaaggcguucaugcgcgggcagcggcuguacgagaagcucaugagccccgagaacacgcugcugcagccccgcgaggaggagggcgucaaguacgagcggaccuucauggccuccgaguuccucgacuggcuggugcaggagggggaggccaccacccgcaaggaggccgagcagcugugccaccggcucauggagcacggcaucauccagcacgugagcaacaagcaccccuucgucgacuccaaccugcuguaccaguuccgcaugaacuuccggcgccggcgccggcucauggagcugcugaacgagaaguccccgagcagccaggagacgcacgacucccccuucugccuccgcaagcagagccacgacaaccgcaaguccaccagcuucauguccgugagccccagcaaggagaucaagaucguguccgcgguccggcgcagcuccaugagcuccugcggcagcuccggguacuucagcuccagccccacccuguccagcuccccgcccgugcugugcaaccccaagagcgugcucaagcggcccgucaccuccgaggagcugcugacgccgggcgcccccuacgcccgcaagaccuucaccaucgugggggacgccgugggcuggggcuucgucgugcgggggagcaagcccugccacauccaggccguggaccccuccggcccggcggccgccgccgggaugaaggucugccaguucguggugagcgucaacggccucaacgugcugcacgucgacuaccgcaccguguccaaccugauccucacggggccccggaccaucgugauggaggucauggaggagcuggagugcuga

SEQ ID NO: 29130 - RNA, 957 nt, Artificial Sequence
  derived and/or modified sequence opt1 from DERA__Homo_sapiens__NP_057038
augagcgcccacaaccgcggcaccgagcuggaccucuccuggaucagcaagauccaggugaaccaccccgccguccugcggcgcgcggagcagauccaggcccggcgcaccgugaagaaggaguggcaggccgccuggcugcucaaggccgugacguucaucgaccugaccacccuguccggggacgacaccagcuccaacauccagcggcucugcuacaaggcgaaguacccgauccgcgaggaccugcugaaggcccucaacaugcacgacaagggcaucacgaccgccgccgucugcguguaccccgcgcgggugugcgacgccgucaaggcccugaaggccgccgggugcaacauccccguggcgagcguggccgccggcuuccccgccgggcagacccaccugaagacccgccucgaggagauccggcuggccgucgaggacggcgcgacggagaucgacguggugaucaaccgcucccugguccucaccggccagugggaggcccuguacgacgagauccggcaguuccgcaaggccugcggggaggcccaccugaagaccauccucgccaccggcgagcuggggacgcugaccaacguguacaaggcgagcaugaucgccaugauggccggcuccgacuucaucaagaccagcaccgggaaggagacggugaacgccaccuucccggucgccaucgugaugcuccgggcgauccgcgacuucuucuggaagaccggcaacaagaucggcuucaagcccgccgggggcauccgguccgccaaggacagccuggccuggcugucccucgugaaggaggagcugggggacgaguggcugaagcccgagcuguuccgcaucggcgcgagcacccuccuguccgacaucgagcggcagaucuaccaccacgucacgggccgcuacgccgccuaccacgaccuccccaugagcuga

SEQ ID NO: 29131 - RNA, 696 nt, Artificial Sequence
  derived and/or modified sequence opt1 from DERL1__Homo_sapiens__NP_001128143
augagcgacaucggcgacugguuccgcuccauccccgccaucacccgguacugguucgccgcgaccguggccgucccgcugguggggaagcucggccugaucagccccgccuaccuguuccucuggcccgaggccuuccuguaccgcuuccagaucuggcggcccaucaccgccaccuucuacuucccgguggggcccggcaccggguuccuguaccucgucaaccuguacuuccuguaccaguacuccacccgccucgagacgggcgcguucgacggccggcccgccgacuaccuguucaugcuccuguucaacuggaucugcaucgugaucaccgggcuggccauggacaugcagcugcucaugaucccccugaucaugagcgugcuguacgucugggcccagcucaaccgcgacaugaucguguccuucugguucggcacccgguucaaggcgugcuaccugccgugggugauccugggguucaacuacaucaucggcgggagcuaccccauggaccucggcggccgcaacuuccuguccacgccccaguuccuguaccgguggcuccccagccgccgcgggggcgucuccggguucggcgugccgcccgccagcaugcggcgggccgccgaccagaacggcgggggcgggcgccacaacuggggccagggguuccggcugggcgaccaguga

SEQ ID NO: 29132 - RNA, 720 nt, Artificial Sequence
  derived and/or modified sequence opt1 from DERL2__Homo_sapiens__NP_057125
auggccuaccagagccugcgccucgaguaccugcagaucccgcccgugucccgggccuacaccaccgcgugcguccugacgaccgccgccgugcagcucgagcugaucacccccuuccagcuguacuucaaccccgagcucaucuucaagcacuuccagaucuggcgccugaucaccaacuuccuguucuucggccccgugggguucaacuuccucuucaacaugaucuuccuguaccgguacugccgcaugcuggaggagggcagcuuccgggggcgcacggccgacuucgucuucauguuccucuucggcggguuccugaugacccuguucggccucuucgugucccugguguuccugggccaggccuucaccaucaugcucgucuacguguggagccggcgcaacccguacgugcggaugaacuucuucgggcugcugaacuuccaggcgcccuuccuccccuggguccugaugggcuucucccugcuccuggggaacagcaucaucguggaccugcucggcaucgccguggggcacaucuacuucuuccuggaggacgucuuccccaaccagccgggcggcauccgcauccugaagacccccuccauccucaaggccaucuucgacacgcccgacgaggaccccaacuacaacccgcugcccgaggagcggcccgggggcuucgccuggggcgaggggcagcgccugggcggguga

SEQ ID NO: 29133 - RNA, 708 nt, Artificial Sequence
  derived and/or modified sequence opt1 from DERL3__Homo_sapiens__NP_001002862
auggccuggcagggccuggccgcggaguuccuccaggugcccgccgucacccgcgccuacaccgccgccugcgugcugacgaccgcggccgugcagcuggagcuccugagcccguuccagcuguacuucaacccccaccucgucuuccggaaguuccagguguggcgccuggugaccaacuuccuguucuucgggccccucggcuucuccuucuucuucaacaugcuguucgucuuccgguacugccgcaugcuggaggaggggagcuuccggggccgcaccgccgacuucguguucauguuccucuucgggggcgugcugaugacgcugcucggccugcuggggucccucuucuuccugggccaggcccugauggcgaugcucgucuacguguggagccggcgcuccccccgggugcgcgucaacuucuucgggcugcugaccuuccaggccccguuccuccccugggcccugaugggcuucagccugcuccuggggaacuccauccugguggaccuccugggcaucgccgugggccacaucuacuacuuccuggaggacgucuuccccaaccagcccgggggcaagcggcuccugcagaccccgggguuccugaagcuccugcuggacgcccccgcggaggaccccaacuaccucccccugccggaggagcagcccggcccccaccugcccccgccccagcaguga

SEQ ID NO: 29134 - RNA, 1413 nt, Artificial Sequence
  derived and/or modified sequence opt1 from DES__Homo_sapiens__NP_001918
augagccaggccuacuccagcucccagcgcgugagcuccuaccggcgcaccuucggcggggcccccggcuucccgcuggggagcccccucuccagccccgucuucccccgggcgggcuucggguccaagggcagcuccagcuccgugaccagccgcguguaccaggucucccggacgagcggcggggccggcgggcugggcucccugcgcgccagccggcucgggaccacccgcaccccguccagcuacggcgccggcgagcugcuggacuucagccucgccgacgcggugaaccaggaguuccugacgacccggaccaacgagaagguggagcugcaggagcucaacgaccgcuucgccaacuacaucgagaagguccgguuccuggagcagcagaacgccgcccuggcggccgaggugaaccgccucaaggggcgggagcccacccgcguggccgagcuguacgaggaggagcugcgggagcuccgccggcaggucgaggugcugacgaaccagcgcgcccggguggacgucgagcgcgacaaccugcucgacgaccugcagcggcugaaggccaagcuccaggaggagauccagcugaaggaggaggcggagaacaaccuggccgccuuccgcgccgacguggacgccgcgacccucgcccgcaucgaccuggagcggcgcaucgagucccugaacgaggagaucgccuuccucaagaaggugcacgaggaggagauccgggagcugcaggcccagcugcaggagcagcagguccagguggagauggacaugagcaagcccgaccucaccgccgcgcugcgcgacauccgggcccaguacgagaccaucgccgccaagaacaucuccgaggccgaggagugguacaagagcaagguguccgaccugacgcaggcggccaacaagaacaacgacgcccuccgccaggccaagcaggagaugauggaguaccggcaccagauccagagcuacacgugcgagaucgacgcgcugaagggcaccaacgacucccugaugcgccagaugcgggagcucgaggaccgcuucgccagcgaggccuccggguaccaggacaacaucgcccggcuggaggaggagauccgccaccugaaggacgagauggcccggcaccuccgcgaguaccaggaccugcugaacgucaagauggcgcucgacguggagaucgccaccuaccggaagcugcuggagggcgaggagagccgcaucaaccuccccauccagaccuacuccgcccugaacuuccgggagaccagcccggagcagcgcggcuccgaggugcacaccaagaagaccgucaugaucaagacgaucgagacccgggacggggagguggugagcgaggccacccagcagcagcacgagguccuguga

SEQ ID NO: 29135 - RNA, 486 nt, Artificial Sequence
  derived and/or modified sequence opt1 from DESI2__Homo_sapiens__NP_001284675
augggcgccaaccagcuggugguccucaacguguacgacauguacuggaugaacgaguacaccagcuccaucgggaucggcguguuccacagcgggaucgaggucuacggccgcgccguggugcugggguccaccgacuuccuggaggacgacaucgagaagaucgucgaggagcucggcaaggaguacaagggcaacgcguaccaccugaugcacaagaacugcaaccacuucagcuccgcccugagcgagauccucugcgggaaggagaucccccgguggaucaaccgccuggccuacuucuccagcugcaucccguuccugcaguccugccuccccaaggaguggcugacgcccgccgcccugcagagcuccgugagccaggagcuccaggacgagcuggaggaggcggaggacgccgccgccuccgcgagcguggccuccaccgccgccggcagccggcccgggcgccacaccaagcuguga

SEQ ID NO: 29136 - RNA, 288 nt, Artificial Sequence
  derived and/or modified sequence opt1 from DEXI__Homo_sapiens__NP_054734
augcugggcgcccgcguggccgcgcaccucgacgcccuggggccccuggucccguacgugcccccgccccuccugcccagcauguucuacgugggccuguucuucgucaacgugcucauccuguacuacgccuuccugauggaguacaucgugcucaacgucgggcugguguuccugcccgaggacauggaccaggcccucguggaccugggcguccuguccgaccccgggagcggccucuacgacgccgacuccgagcuggacguguucgacgcguaccuggaguga

SEQ ID NO: 29137 - RNA, 885 nt, Artificial Sequence
  derived and/or modified sequence opt1 from DFFB__Homo_sapiens__XP_011539165
augcugcagaagcccaagagcgugaagcuccgcgcccugcgguccccgcgcaaguucggcgucgccgggcggagcugccaggaggugcugcgcaagggcugccuccgguuccagcugcccgagcgcgggucccggcugugccucuacgaggacggcaccgagcugaccgaggacuacuuccccagcgugcccgacaacgcggagcugguccuccugacgcuggggcaggccuggcagggcugcgaguggcagggccucuggcgcaugugccugcugcucgaccggcaccuccuguucgugccgcugguggccgacgucuccgacauccgccgguuccugagcgccuuccacgagccccagguggggcugauccaggccgcgcagcagcuccugugcgacgagcaggcgccccagcgccagcggcugcucgccgaccugcugcacaacgugucccagaacaucgccgccgagacccgcgccgaggacccgcccugguucgagggccucgagagccgguuccaguccaagagcggguaccugcgcuacuccugcgagagccggauccgcuccuaccugcgggaggucagcuccuaccccagcaccgugggcgccgaggcccaggaggaguuccuccgcgugcugggguccaugugccagcggcugcgcagcaugcaguacaacggcuccuacuucgaccgcggcgccaagggcgggagccggcucugcacccccgaggggugguucagcugccagggccccuucgacauggacuccugccugagccgccacuccaucaacccguacagcaaccgggagucccgcauccuguucagcacguggaaccucgaccacaucgacggcguccugcugugcgggcccggcuga

SEQ ID NO: 29138 - RNA, 1491 nt, Artificial Sequence
  derived and/or modified sequence opt1 from DFNA5__Homo_sapiens__NP_001120925
auguucgccaaggccacccgcaacuuccugcgggagguggacgcggacggcgaccucaucgccgucagcaaccugaacgacuccgacaagcugcagcuccugagccuggugaccaagaagaagcgcuucuggugcuggcagcggcccaaguaccaguuccucucccugacccugggggacgugcucaucgaggaccaguucccgagccccgucgugguggaguccgacuucgucaaguacgagggcaaguucgccaaccacgugagcgggacccuggagaccgcccugggcaaggugaagcucaaccucgggggcuccagccgcgucgagucccagagcuccuucggcacccugcggaagcaggagguggaccuccagcagcugauccgcgacagcgccgagcggacgaucaaccugcgcaaccccgugcuccagcagguccuggaggggcggaacgaggugcugugcgugcucacccagaagaucaccaccaugcagaagugcgucaucuccgagcacaugcaggucgaggagaagugcggcgggaucgugggcauccagacgaagaccguccaggugagcgcgaccgaggacgggaacgugaccaaggacuccaacguggugcuggagauccccgccgccacgaccaucgccuacggcgugaucgagcuguacgucaagcucgacggccaguucgaguucugccugcugcgcgggaagcagggcggguucgagaacaagaagcggaucgacagcguguaccucgacccgcuggucuuccgcgaguucgcguucaucgacaugcccgacgccgcccacggcaucuccagccaggacggcccccuguccgugcucaagcaggccacccugcugcucgagcggaacuuccaccccuucgccgagcugccggagccccagcagaccgcgcugagcgacaucuuccaggccguccucuucgacgacgagcugcugauggugcucgagcccgugugcgacgaccuggugagcgggcugucccccacggucgccgugcucggcgagcugaagccgcgccagcagcaggaccugguggccuuccuccagcuggucgggugcagccugcagggcgggugccccggccccgaggacgccggcuccaagcagcuguucaugaccgcguacuuccuggugagcgcccuggccgagaugcccgacuccgccgccgcgcugcucgggaccugcugcaagcugcagaucaucccgacccugugccaccuccugcgggcccugagcgacgacggcguguccgaccucgaggaccccacgcugacgccccugaaggacaccgagcgcuucgggaucguccagcgccucuucgccagcgccgacaucucccuggagcggcucaagagcuccgugaaggccgugauccugaaggacagcaaggucuucccccugcugcucugcaucacccugaacggccugugcgcgcucgggcgggagcacuccuga

SEQ ID NO: 29139 - RNA, 2724 nt, Artificial Sequence
  derived and/or modified sequence opt1 from DFNB31__Homo_sapiens__NP_056219
augaacgcgccccuggacggccucagcguguccagcuccagcaccgggucccugggcagcgccgccggggccggcgggggcggcggggccggccugcgccuccuguccgccaacguccggcagcugcaccaggcccucaccgcgcugcugagcgaggccgagcgcgagcaguucacgcacugccucaacgccuaccacgcccggcgcaacguguucgaccuggugcggacccugcgcguccuccuggacuccccggugaagcggcgccugcuccccaugcugcggcuggugaucccccgcagcgaccagcuccuguucgaccaguacaccgcggaggggcuguaccuccccgccaccacgccguaccggcagcccgccuggggcgggcccgacuccgccggccccggcgagguccgccuggugagccugcggcgcgccaaggcgcacgaggggcucggcuucuccauccgcgggggcagcgagcacggcguggggaucuacgucucccugguggagccgggcagccuggccgagaaggaggggcuccgcgugggcgaccagauccugcgggucaacgacaagucccuggcccgcgugacccacgccgaggccgugaaggcgcucaaggggagcaagaagcugguccuguccguguacagcgccggccggauccccggcggguacgugaccaaccacaucuacaccugggucgacccccagggccgcagcaucagcccgcccagcgggcucccccagccccacggcggggcccugcggcagcaggagggcgaccgccgcuccacgcugcaccuccugcagggcggggacgagaagaaggugaaccuggugcucggcgacgggcggagccugggccugaccauccgcgggggcgccgaguacggccucgggaucuacaucaccggcgucgaccccggguccgaggccgagggcagcggccugaaggugggggaccagauccuggaggugaacggccgguccuuccucaacauccugcacgacgaggcgguccgccugcucaagagcucccggcaccugauccugaccgugaaggacgucgggcgccugccgcacgcccggacgaccguggacgagaccaaguggaucgccagcucccgcauccgggagaccauggccaacagcgccggcuuccucggggaccugacgaccgagggcaucaacaagcccggcuucuacaaggggcccgcgggcucccaggugacccugagcucccucgggaaccagacccgcguccugcuggaggagcaggcccggcaccuccugaacgagcaggagcacgccacgauggccuacuaccuggacgaguaccgcggcgggagcguguccguggaggcgcucgucauggcccuguucaagcugcucaacacccacgccaaguucagccugcuguccgaggugcggggcaccaucagcccccaggaccucgagcgcuucgaccaccuggugcugcggcgcgagaucgagagcaugaaggcccggcagccgcccggccccggggccggcgacaccuacuccauggucagcuacuccgacacggggagcuccaccggcagccacgggaccuccaccacggugagcuccgcgcgcaacacccucgaccuggaggagaccggcgaggccgugcagggcaacaucaacgcccugcccgacgucagcguggacgacgugcgguccaccagccaggggcucuccagcuucaagccgcugccccggcccccgccccuggcccagggcaacgaccucccccuggggcagccccgcaagcugggccgggaggaccuccagccgcccuccagcaugcccuccugcagcgggacggucuucagcgcgccccagaaccgcuccccgcccgccggcaccgcccccacccccggcaccagcuccgcccaggaccugccgagcucccccaucuacgccagcgugucccccgccaaccccagcuccaagcggccgcuggacgcgcaccucgcccuggugaaccagcaccccaucgggcccuucccccgcguccagagcccgccccaccugaagucccccagcgccgaggccacgguggcgggcgggugccuccugcccccgucccccagcggccaccccgaccagaccggcaccaaccagcacuucgugauggucgaggugcaccggcccgacuccgagccggacgugaacgagguccgcgcccugccccagacccggaccgccagcacgcucucccagcugagcgacuccgggcagacccugagcgaggacagcggcguggacgccggggaggccgaggcguccgcccccggccgcgggcggcagagcguguccaccaagagccgcuccagcaaggagcucccgcggaacgagcgccccaccgacggcgccaacaagccgcccggccugcuggagcccacguccacccucguccgggugaagaaguccgccgccacccuggggaucgcgaucgagggcggggccaacacccgccagccccugccccggaucgugacgauccagcgcggcggguccgcccacaacugcggccagcucaaggucggccacgugauccuggaggugaacgggcugacccuccggggcaaggagcaccgcgaggccgcccggaucaucgcggaggccuucaagaccaaggaccgcgacuacaucgacuuccuggucaccgaguucaacgugaugcuguga

SEQ ID NO: 29140 - RNA, 1059 nt, Artificial Sequence
  derived and/or modified sequence opt1 from DFNB59__Homo_sapiens__NP_001036167
auguucgccgccgcgaccaagagcuucgugaagcaggucggcgacgggggccgccuggugcccgugccgucccucagcgaggccgacaaguaccagccccugucccuggucgugaagaagaagcggugcuuccucuucccccgcuacaaguucaccagcacgcccuucacccugaaggacauccugcucggggaccgggagaucuccgccggcaucagcuccuaccagcugcugaacuacgaggacgagagcgacgugucccucuacgggcgccggggcaaccacaucgucaacgacgugggcaucaacguggccgggagcgacuccaucgccgucaaggcgagcuucggcaucgugaccaagcacgagguggaggucuccacccugcugaaggagaucacgacccgcaagaucaacuucgaccacagccucauccggcagucccgcagcucccggaaggccgugcugugcguggucauggagagcauccgcaccacccggcagugcucccugagcgugcacgccgggauccgcggcgaggccaugcgguuccacuucauggacgagcagaacccgaaggggcgcgacaaggcgaucguguuccccgcccacacgaccaucgccuucagcgucuucgagcuguucaucuaccucgacggcgccuucgaccugugcgugaccuccgugagcaagggcggguucgagcgggaggagaccgccacguucgcgcuccuguaccgccugcggaacauccucuucgagcgcaaccggcgcgucauggacgugaucucccggagccagcuguaccuggacgaccucuucuccgacuacuacgacaagccccugagcaugaccgacaucucccugaaggagggcacccacauccgcgugaaccuccugaaccacaacauccccaaggggccgugcauccugugcggcaugggcaacuucaagcgcgagaccgucuacgggugcuuccagugcagcguggacggccagaaguacguccggcuccacgccgugcccugcuucgacaucuggcacaagcgcaugaaguga

SEQ ID NO: 29141 - RNA, 1467 nt, Artificial Sequence
  derived and/or modified sequence opt1 from DGAT1__Homo_sapiens__NP_036211
augggcgaccgcgggagcucccggcgccggcgcaccggcagccggcccuccagccacgggggcgggggcccggccgccgcggaggaggaggugcgcgacgccgccgccggccccgacgucggggccgcgggcgacgcccccgcccccgccccgaacaaggacggggacgcgggcgugggguccggccacugggagcugcggugccaccgccuccaggacagccuguucuccagcgacuccggcuucagcaacuaccgggggauccugaacuggugcguggucaugcucauccuguccaacgcccgccuguuccucgagaaccugaucaaguacggcauccugguggaccccauccagguggucagccucuuccugaaggaccccuacuccuggcccgccccgugccuggugaucgccgccaacguguucgcggucgccgccuuccagguggagaagcggcucgccgugggggcccugaccgagcaggcgggccugcuccugcacgucgccaaccuggccacgauccucugcuuccccgccgccguggugcugcuggucgagagcaucacccccgugggcucccuccuggcgcugauggcccacaccauccucuuccugaagcuguucagcuaccgcgacgugaacuccuggugccggcgcgcccgggccaaggccgcgagcgccgggaagaaggccuccagcgccgcggcgccccacaccgucagcuacccggacaaccucacguaccgcgaccuguacuacuuccuguucgcccccacccucugcuacgagcugaacuucccccggagcccccgcauccggaagcgcuuccugcuccggcgcauccuggagaugcuguucuucacccagcuccaggugggccugauccagcaguggauggugccgaccauccagaacuccaugaagcccuucaaggacauggacuacucccgcaucaucgagcggcugcucaagcuggccguccccaaccaccugaucuggcucaucuucuucuacuggcuguuccacagcugccugaacgccguggccgagcucaugcaguucggggaccgcgaguucuaccgggacugguggaacuccgagagcgugacguacuucuggcagaacuggaacauccccguccacaaguggugcauccgccacuucuacaagccgaugcugcggcgcggcuccagcaaguggauggcccggaccgggguguuccuggccuccgccuucuuccacgaguaccucgucagcgugccccugcgcauguuccggcugugggccuucaccggcaugauggcgcagaucccccuggccugguucgugggccgcuucuuccaggggaacuacggcaacgccgccgucuggcucucccugaucaucgggcagcccaucgccgugcugauguacgugcacgacuacuacguccucaacuacgaggcgccggccgccgaggccuga

SEQ ID NO: 29142 - RNA, 1038 nt, Artificial Sequence
  derived and/or modified sequence opt1 from DGAT2__Homo_sapiens__NP_001240820
augaagacccugaucgccgccuacagcggcgugcuccgcggggagcggcaggcggaggccgaccgcucccagcggagccacggcgggcccgcccugucccgcgagggcagcgggcgguggggcgucgccugcuccgccauccugauguacaucuucugcaccgacugcuggcucaucgcggugcuguacuucacguggcugguguucgacuggaacaccccgaagaagggcgggcgccggagccaguggguccgcaacugggccguguggcgguacuuccgcgacuacuuccccauccagcucgugaagacccacaaccugcugaccacgcggaacuacaucuucggcuaccacccccacgggaucaugggccucggggccuucugcaacuucuccaccgaggccaccgaggucagcaagaaguuccccggcauccgcccguaccuggcgacccuggccggcaacuuccggaugcccgugcuccgcgaguaccugauguccgggggcaucugccccgugagccgggacacgaucgacuaccugcucuccaagaacgggagcggcaacgccaucaucaucgucgugggcggggccgccgagucccugagcuccaugcccggcaagaacgcggugacccugcgcaaccggaagggguucgucaagcucgcccugcgccacggcgccgaccuggugccgaucuacagcuucggggagaacgagguguacaagcaggucaucuucgaggagggcuccuggggccggugggugcagaagaaguuccagaaguacaucggguucgcccccugcaucuuccacggccgcggccucuucagcuccgacaccugggggcuggugcccuacagcaagcccaucaccacggucgugggggagccgaucaccauccccaagcuggagcaccccacccagcaggacaucgaccucuaccacaccauguacauggaggcccuggugaagcuguucgacaagcacaagacgaaguucggccuccccgagaccgagguccuggaggugaacuga

SEQ ID NO: 29143 - RNA, 1530 nt, Artificial Sequence
  derived and/or modified sequence opt1 from DGCR2__Homo_sapiens__NP_001167004
auggugcccaaggccgacagcggcgccuuccugcuccuguuccugcucguccugaccgugaccgagccgcugcgccccgaggugacgggggagguccggccccaccacggcaaggaggcgguggacccccgccaggggcgggcccgcggcggggacccgucccacuuccacgccgugaacgucgcccagcccgugcgguucagcuccuuccucggcaagugccccaccggcuggcaccacuacgaggggaccgccagcugcuaccgcguguaccuguccggcgagaacuacugggacgcggcccagaccugccagcggcugaacgggagccucgccacguucuccaccgaccaggagcugcgcuucguccuggcccaggagugggaccagcccgagcggagcuucggcuggaaggaccagcgcaagcucugggugggguaccaguacgugaucaccggccggaaccgcucccuggagggccggugggaggucgcguucaaggggagcuccgagguguuccugccgcccgaccccaucuucgccagcgccauguccgagaacgacaacguguucugcgcccagcuccagugcuuccacuuccccacccugcgccaccacgaccugcacagcuggcacgccgaguccugcuacgagaaguccagcuuccucugcaagcggagccagacgugcgucgacaucaaggacaacgugguggacgagggcuucuacuucaccccgaagggggacgaccccugccuguccugcacgugccacggcggcgagcccgagaugugcgucgcggcccugugcgagcgcccccaggggugccagcaguaccggaaggacccgaaggagugcugcaaguucaugugccucgaccccgacggcaacagccuguucgacagcauggccuccgggaugcgccugguggugagcugcaucuccagcuuccucauccugucccugcuccuguucaugguccaccggcugcgccagcggcgccgcgagcggaucgagagccucaucggcgccaaccugcaccacuucaaccuggggcgccggauccccggcuucgacuacggccccgacggguucggcaccgggcucaccccgcugcaccuguccgacgacggcgagggcgggaccuuccacuuccacgacccgcccccgcccuacaccgccuacaaguaccccgacaucggccagcccgacgacccgcccccgcccuacgaggcgagcauccaccccgacuccguguucuacgaccccgccgacgacgacgccuucgagcccguggaggucagccuccccgcccccggggacggcggguccgagggcgcccugcugcgccggcucgagcagccccugcccaccgcgggggccagccuggccgaccucgaggacuccgccgacagcuccagcgcccugcuggugcccccggaccccgcgcaguccggcagcacgcccgccgccgaggcccuccccggcgggggccgccacucccggagcagccugaacaccgucguguga

SEQ ID NO: 29144 - RNA, 663 nt, Artificial Sequence
  derived and/or modified sequence opt1 from DGCR6L__Homo_sapiens__NP_150282
auggagcgcuacgccgccgcgcuggaggagguggccgacggcgcccggcagcaggagcgccacuaccagcugcugagcgcccugcagucccucgucaaggagcugcccagcuccuuccagcagcggcugagcuacaccacccucuccgaccuggcccuggcgcuccuggacgggacgguguucgagaucgugcagggccugcucgagauccagcaccugaccgagaagucccuguacaaccagcgccuccggcugcagaacgagcaccgcguccugcggcaggcccuccgccagaagcaccaggaggcccagcaggccugccggccccacaaccugcccguggugcaggcggcccagcagcgcgagcuggaggccgucgagcaccggauccgcgaggagcagcgggccauggaccagaagaucauccucgagcuggaccgcaagguggccgaccagcagagcacccuggagaaggcggggguggccggcuucuacgucaccacgaacccccaggagcucaugcugcagaugaaccugcucgagcugauccggaagcugcagcagcgcgggugccgggccggcaacgccgcccucggccucgggggccccuggcagagcccggcggcccagugcgaccagaaggggucccccgugccgcccuga

SEQ ID NO: 29145 - RNA, 2223 nt, Artificial Sequence
  derived and/or modified sequence opt1 from DGCR8__Homo_sapiens__NP_001177255
auggagaccgacgagagccccuccccgcugcccugcggccccgccggggaggccgugauggagagccgcgcgcggcccuuccaggcccucccgcgcgagcaguccccgccgccgccccugcagaccagcuccggcgccgaggucauggacguggggagcggcggggacggccaguccgagcugcccgccgaggaccccuucaacuucuacggcgccagccuccuguccaaggggagcuucuccaagggccggcugcucaucgaccccaacugcagcgggcacagcccccgcacggcgcggcacgcccccgccgugcgcaaguucucccccgaccugaagcugcucaaggacgucaagaucuccgugagcuucaccgaguccugccggagcaaggaccgcaaggugcuguacaccggcgccgagcgggacguccgcgcggagugcgggcugcuccugucccccgugagcggcgacgugcacgccugccccuucggcgggagcgucggcgacggggugggcaucggcggggaguccgccgacaagaaggacgaggagaacgagcuggaccaggagaagcggguggaguacgccguccucgacgagcuggaggacuucaccgacaaccuggagcucgacgaggagggcgccgggggcuucacggcgaaggccaucgugcagcgcgaccggguggacgaggaggcccugaacuuccccuacgaggacgacuucgacaacgacgucgacgcccugcucgaggaggggcugugcgcccccaagaagcgccggaccgaggagaaguacggcggcgacagcgaccaccccuccgacggggagaccagcgugcagccgaugaugaccaagaucaagacggugcugaagucccgcggccggccgcccaccgagccccuccccgacggguggaucaugaccuuccacaacagcggcguccccguguaccugcaccgcgagucccggguggucaccuggagccgccccuacuuccuggggacgggcuccauccggaagcacgacccgccccucagcuccauccccugccugcacuacaagaagaugaaggacaacgaggagcgcgagcagagcuccgaccugacccccagcggcgacguguccccggugaagccccucagccgcuccgcggagcuggaguucccccuggacgagcccgacagcaugggggccgacccgggcccgcccgacgagaaggacccccucggggccgaggccgcccccggcgcgcuggggcaggucaaggccaagguggaggucugcaaggacgaguccguggaccuggaggaguuccggagcuaccucgagaagcgcuucgacuucgagcaggucaccgugaagaaguuccggaccugggccgagcgccggcaguucaaccgcgagaugaagcggaagcaggccgagagcgagcgccccauccugcccgccaaccagaagcugaucacgcucuccgugcaggacgcgcccaccaagaaggaguucgugaucaacccgaacggcaagagcgaggucugcauccugcacgaguacaugcagcgggugcugaaggugcgccccgucuacaacuucuucgagugcgcccgggccacccucgagauccugauccccgacuucgugaagcagaccuccgaggagaagcccaaggacagcgaggagcuggaguacuucaaccacaucuccaucgaggacagccgcguguacgagcucacguccaaggccggccugcugagcccguaccagauccuccacgagugccugaagcggaaccacgggaugggcgacaccuccaucaaguucgaggucgugcccgggaagaaccagaaguccgaguacgugauggcgugcggcaagcacaccguccgcggcuggugcaagaacaagcggguggggaagcagcuggccagccagaagauccugcagcuccugcacccccacgugaagaacuggggcagccugcuccgcauguacgggcgggaguccagcaagauggucaagcaggagaccuccgacaagagcgugaucgagcugcagcaguacgccaagaagaacaagcccaaccugcacauccucuccaagcugcaggaggagaugaagcgccuggccgaggagcgggaggagacgcgcaagaagccgaagaugagcaucguggccagcgcgcagcccggcggggagccccucugcaccgucgacguguga

SEQ ID NO: 29146 - RNA, 2208 nt, Artificial Sequence
  derived and/or modified sequence opt1 from DGKA__Homo_sapiens__NP_958853
auggccaaggagcgcggccugaucagccccuccgacuucgcccagcuccagaaguacauggaguacagcaccaagaagguguccgacguccugaagcuguucgaggacggggagauggcgaaguacgugcagggcgacgccaucggguacgagggcuuccagcaguuccucaagaucuaccuggagguggacaacgucccccggcaccugagccucgcccuguuccaguccuucgagaccgggcacugccugaacgagacgaacgugaccaaggacguggucugccucaacgacgugagcugcuacuucucccugcuggagggcggccgccccgaggacaagcucgaguucaccuucaagcuguacgacaccgaccggaacgggauccuggacagcuccgagguggacaagaucauccuccagaugaugcgcgucgccgaguaccuggacugggacgugagcgagcugcggcccauccuccaggagaugaugaaggagaucgacuacgacggcuccgggagcgugucccaggccgaguggguccgcgcgggcgccacgaccgugccccugcuggugcuccuggggcuggagaugacccucaaggacgacggccagcacauguggcggccgaagcgcuucccccggcccgucuacugcaaccugugcgagagcuccaucggccuggggaagcagggccucagcugcaaccugugcaaguacaccgugcacgaccagugcgccaugaaggcccugcccugcgagguguccacguacgccaagagccgcaaggacaucgggguccagucccacgugugggugcggggcggcugcgagagcgggcgcugcgaccggugccagaagaagauccgcaucuaccacagccucaccggccugcacugcgucuggugccaccuggagauccacgacgacugccuccaggcgguggggcacgagugcgacugcggccugcugcgggaccacauccucccgcccuccagcaucuaccccuccgugcuggccagcgggcccgaccgcaagaacuccaagaccagccagaagaccauggacgaccugaaccucuccacgagcgaggcccugcggaucgacccgguccccaacacccacccccugcucguguucgucaaccccaaguccggcggcaagcaggggcagcgcgugcuguggaaguuccaguacauccugaacccgcgccagguguucaaccuccugaaggacggccccgagaucgggcugcgccucuucaaggacguccccgacagccggauccuggugugcggcggggacggcaccgugggcuggauccuggagaccaucgacaaggccaaccugcccguccucccgcccguggcggugcugccccuggggacgggcaacgaccucgcccgcugccugcgcuggggcggcggguacgagggccagaaccuggccaagauccucaaggaccuggagauguccaaggucgugcacauggaccgguggagcguggaggucaucccccagcagaccgaggagaaguccgacccggugcccuuccagaucaucaacaacuacuucagcaucggcguggacgccuccaucgcccaccgcuuccacaucaugcgggagaaguaccccgagaaguucaacagccgcaugaagaacaagcugugguacuucgaguucgcgaccuccgagagcaucuucuccacgugcaagaagcucgaggagagccugaccgucgagaucugcgggaagccccuggaccucagcaaccugucccuggagggcaucgccgugcucaacaucccgagcaugcacgggggcuccaaccuguggggcgacacccggcgcccccacggggacaucuacggcaucaaccaggcccugggggccaccgccaaggugaucaccgaccccgacauccucaagacgugcgucccggaccugagcgacaagcggcuggagguggugggccucgagggggcgaucgagaugggccagaucuacaccaagcugaagaacgccggccgccggcuggccaagugcuccgagaucaccuuccacaccacgaagacccuccccaugcagaucgacggggagcccuggaugcagacccccugcaccaucaagaucacgcacaagaaccagaugccgaugcugauggggcccccgccccggagcaccaacuucuucggguuccuguccuga

SEQ ID NO: 29147 - RNA, 2415 nt, Artificial Sequence
  derived and/or modified sequence opt1 from DGKB__Homo_sapiens__NP_004071
augaccaaccaggagaagugggcccaccugagccccuccgaguucagccagcuccagaaguacgccgaguacuccaccaagaagcugaaggacgugcuggaggaguuccacggcaacgggguccucgcgaaguacaaccccgagggcaagcaggacauccugaaccagacgaucgacuucgagggguucaagcuguucaugaagaccuuccucgaggccgagcugcccgacgacuucaccgcccaccuguucaugagcuucuccaacaaguucccccacagcucccccauggucaagagcaagcccgcccuccuguccggcgggcugcgcaugaacaagggcgccaucaccccgccccggacgaccagccccgcgaacacgugcucccccgaggugauccaccucaaggacaucgucugcuaccugagccugcucgagcgcggccggcccgaggacaagcuggaguucauguuccgccuguacgacaccgacgggaacggcuuccucgacuccagcgagcuggagaacaucaucucccagaugaugcacguggccgaguaccuggagugggacgugacggagcucaaccccauccugcacgagaugauggaggagaucgacuacgaccacgacgggaccgucagccuggaggaguggauccagggcgggaugaccaccaucccccuccuggugcugcucggccuggagaacaacgugaaggacgacggccagcacgucuggcggcugaagcacuucaacaagccggccuacugcaaccucugccugaacaugcugaucggggugggcaagcaggggcucugcugcuccuucugcaaguacaccgugcacgagcgcugcguggcccgggcgccgcccagcugcaucaagaccuacgugaaguccaagcgcaacaccgacgugaugcaccacuacugggucgagggcaacugccccaccaagugcgacaagugccacaagacggugaagugcuaccagggccugaccgggcugcacugcguguggugccagaucacccuccacaacaagugcgccagccaccugaagcccgagugcgacugcggcccccugaaggaccacauccucccgcccaccacgaucugccccgucgugcugcagacccugcccaccagcgggguguccguccccgaggagcggcagagcaccgugaagaaggagaaguccggcagccagcagcccaacaaggugaucgacaagaacaagaugcagcgcgccaacuccgucacgguggacgggcagggccuccaggucaccccggugcccggcacccacccccugcugguguucgucaaccccaagagcgggggcaagcagggggagcggaucuaccgcaaguuccaguaccuccugaacccgcgccagguguacucccugagcggcaacgggcccaugcccggccucaacuucuuccgggacgugccggacuuccggguccuggccugcggcggggacggcaccguggggugggugcuggacugcaucgagaaggccaacgucggcaagcacccgcccguggcgauccugccccucgggacgggcaacgaccuggcccgcugccugcgguggggcgggggcuacgagggggagaaccucaugaagauccugaaggacaucgagaacuccaccgagaucaugcuggaccgcuggaaguucgaggugauccccaacgacaaggacgagaagggcgaccccguccccuacagcaucaucaacaacuacuucuccaucggcguggacgccagcaucgcccaccgguuccacaucaugcgcgagaagcaccccgagaaguucaacucccggaugaagaacaaguucugguacuucgaguucgggaccagcgagaccuucuccgccacgugcaagaagcuccacgagagcguggagaucgagugcgacggcguccagaucgaccugaucaacaucucccuggaggggaucgcgauccucaacaucccgagcaugcacggcggguccaaccuguggggcgagagcaagaagcgccgcagccaccggcgcaucgagaagaagggcuccgacaagcggaccaccgugaccgacgccaaggagcugaaguucgccagccaggaccucuccgaccagcugcuggagguggucgggcucgagggcgccauggagauggggcagaucuacacgggccucaagagcgccgggcgccggcuggcgcagugcuccugcguggugauccgcaccagcaagucccugcccaugcagaucgacggcgagcccuggaugcagacccccugcaccaucaagaucacccacaagaaccaggccccgaugcugaugggcccgccgcccaagacggggcuguucugcagccucgucaagcggacccgcaaccgguccaaggaguga

SEQ ID NO: 29148 - RNA, 3513 nt, Artificial Sequence
  derived and/or modified sequence opt1 from DGKD__Homo_sapiens__NP_003639
augaacauguuccuguacuuccagaccaucaucaaggagggcaugcucaccaagcagaacaacagcuuccagcgcuccaagcggcgcuacuucaagcugcgggggcgcacgcuguacuacgccaagaccgccaagagcaucaucuucgacgagguggaccucaccgacgcguccgucgccgagagcuccaccaagaacgugaacaacagcuucacggugaucacccccugccggaagcugauccugugcgccgacaaccgcaaggagauggaggacuggaucgccgcccucaagaccguccagaaccgggagcacuucgagccgacccaguacuccauggaccacuucagcggcaugcacaacugguacgcgugcucccacgcccgccccacguacugcaacgugugccgggaggcccugagcggggugaccucccacggccugagcugcgaggucugcaaguucaaggcccacaagcgcugcgcggugcgggccaccaacaacugcaaguggaccacgcucgccuccaucgggaaggacaucaucgaggacgccgacggcaucgccaugccccaccaguggcuggagggcaaccugcccgugagcgcgaagugcaccgucugcgacaagaccugcggguccgugcuccgccugcaggacuggcggugccuguggugcaaggccauggugcacaccagcugcaaggagucccuccugacgaagugcccgcugggccucugcaaggucagcgugaucccgcccaccgcccugaacuccaucgacagcgacggguucuggaaggccagcugcccgcccuccugcaccagcccccugcucguguucgucaacuccaagagcggcgacaaccagggggugaaguuccugcgccgguucaagcagcugcucaaccccgcccagguguucgaccugaugaacggcggcccccaccuggggcuccgccuguuccagaaguucgacaccuuccggauccuggucugcggcggggacggcuccgugggcugggugcucagcgagaucgacucccugaaccugcacaagcagugccagcucgggguccugccgcugggcacggggaacgaccucgcgcgcgugcugggcugggggagcgccugcgacgacgacacccagcugccccagauccucgagaagcuggagcgggccuccaccaagaugcuggaccgcuggagcgugauggccuacgaggccaagcucccccggcaggcguccagcuccaccgucacggaggacuucagcgaggacuccgaggugcagcagauccuguucuacgaggacagcgucgccgcccaccuguccaagauccucaccagcgaccagcacuccguggugaucagcagcgccaagguccugugcgagaccgugaaggacuucguggcccgcgucggcaaggcguacgagaagaccacggaguccagcgaggaguccgaggugauggccaagaagugcagcgugcugaaggagaagcucgacucccugcugaagacccuggacgacgagagccaggccuccagcucccuccccaacccgccgcccaccaucgccgaggaggcggaggacggcgacgggagcggcuccaucugcgggagcaccggcgaccgccuggucgccuccgccugccccgcccggccccagaucuuccgcccccgggagcagcugaugcuccgcgccaacagccugaagaaggcgauccggcagaucaucgagcacacggagaaggccguggacgagcagaacgcccagacccaggagcaggagggguucgugcugggccucuccgagagcgaggagaagauggaccaccgcgucugcccgccccugucccacagcgagagcuucggcgugcccaaggggcggucccagcgcaaggugagcaagucccccugcgagaagcugaucagcaagggcucccucagccugggguccagcgccucccugccgccccagcccggcagccgggacgggcuccccgcccugaacaccaagauccuguaccccaacguccgcgcgggcauguccggcagccuccccgggggcuccgugaucagccggcugcugaucaacgccgaccccuucaacuccgagcccgagacccucgaguacuacacggagaagugcgugaugaacaacuacuucgggaucggccuggacgccaagaucagccuggacuucaacaacaagcgcgacgagcaccccgagaagugccggucccgcaccaagaacaugaugugguacggcguccucgggaccaaggagcugcugcaccggaccuacaagaaccucgagcagaaggugcugcuggagugcgacggccgcccgaucccccuccccagccugcaggggaucgccgugcugaacauccccuccuacgccggcgggaccaacuucuggggcggcacgaaggaggacgacaccuucgcggccccgagcuucgacgacaagauccucgaggucguggccguguucgggagcaugcagauggccgucucccgggugauccgccugcagcaccaccggaucgcgcagugccgcaccgugaagaucagcauccugggcgacgaggggguccccguccagguggacggcgaggccugggugcagccgcccggguacauccgcaucgugcacaagaaccgggcccagacccucacgcgcgaccgggccuucgaguccacccucaagagcugggaggacaagcagaagugcgagcugccccgcccgcccuccugcagccugcaccccgagaugcuguccgaggaggaggccacccagauggaccaguucggccaggcggccggcgugcugauccacagcauccgggagaucgcccagucccaccgcgacauggagcaggagcucgcccacgccgucaacgcgagcuccaagagcauggaccggguguacgggaagccccgcaccacggagggccugaacugcuccuucgugcuggagauggucaacaacuuccgggcccuccgcagcgagaccgagcugcugcucuccgggaagauggcccugcagcuggacccgccccagaaggagcagcucggcagcgcccuggccgagauggaccggcagcugcgccggcucgcggacacccccuggcugugccaguccgccgagcccggggacgaggagagcgugaugcuggaccucgccaagcgcucccggagcggcaaguuccgccuggugaccaaguucaagaaggagaagaacaacaagaacaaggaggcccacagcucccugggcgcgcccguccaccucugggggacggaggagguggccgccuggcuggagcaccugagccucugcgaguacaaggacaucuucacccggcacgacauccgcggcuccgagcugcugcaccucgagcggcgcgaccugaaggaccugggggugaccaaggucggccacaugaagcggauccucugcgggaucaaggagcugagccgcuccgcccccgccguggaggcguga

SEQ ID NO: 29149 - RNA, 1704 nt, Artificial Sequence
  derived and/or modified sequence opt1 from DGKE__Homo_sapiens__NP_003638
auggaggccgagcgccggcccgccccgggcagccccuccgaggggcuguucgcggacggccaccucauccuguggacccugugcagcgugcuccugcccgucuucaucaccuucuggugcucccugcagcgcagccggcgccagcuccaccggcgcgacaucuuccggaaguccaagcacggguggcgcgacacggaccuguucagccagcccaccuacugcugcgugugcgcccagcacauccugcagggcgccuucugcgacugcugcgggcuccggguggacgagggcugccugcgcaaggccgacaagcgguuccagugcaaggagaucaugcugaagaacgacaccaagguccucgacgccaugccgcaccacuggauccgcggcaacgugccccugugcuccuacugcauggugugcaagcagcagugcgggugccagcccaagcugugcgacuaccggugcaucuggugccagaagaccguccacgacgagugcaugaagaacagccucaagaacgagaagugcgacuucggcgaguucaagaaccugaucaucccgcccuccuaccugacgagcaucaaccagaugcgcaaggacaagaagaccgacuacgaggugcucgcguccaagcuggggaagcaguggacgccccugaucauccucgccaacagccgguccggcaccaacaugggggagggccugcugggcgaguuccgcauccuccugaaccccgugcaggucuucgacgugaccaagacgcccccgaucaaggcccugcagcucugcacccugcugcccuacuacagcgcccgggugcucgucugcgggggcgacgggaccgugggcugggugcuggacgcggucgacgacaugaagaucaagggccaggagaaguacaucccccagguggccgugcugccccucgggaccggcaacgaccuguccaacacccugggguggggcaccggguacgccggcgagaucccggucgcccaggugcuccgcaacgugauggaggccgacggcaucaagcuggaccgguggaagguccaggugaccaacaagggguacuacaaccugcgcaagcccaaggaguucacgaugaacaacuacuucagcgugggccccgacgcgcucauggcccugaacuuccacgcccaccgggagaaggcccccucccuguucagcucccgcauccucaacaaggccgucuaccuguucuacgggaccaaggacugccuggugcaggagugcaaggaccucaacaagaaggucgagcuggagcuggacggcgagcgcguggcgcucccgagccuggaggggaucaucgugcugaacaucggcuacuggggcgggggcugccggcugugggaggggaugggcgacgagaccuacccccucgcccgccacgacgacgggcugcuggaggucgugggcguguacggcagcuuccacugcgcccagauccaggucaagcucgccaaccccuuccggaucgggcaggcccacaccgugcgccugauccugaagugcuccaugaugcccaugcaggucgacggcgagccgugggcgcaggggcccugcacggugaccaucacccacaagacccacgccaugaugcucuacuucagcggcgagcagacggacgacgacaucuccagcaccuccgaccaggaggacaucaaggccaccgaguga

SEQ ID NO: 29150 - RNA, 2301 nt, Artificial Sequence
  derived and/or modified sequence opt1 from DGKG__Homo_sapiens__NP_001074213
augggcgaggagcgcugggugagccugacccccgaggaguucgaccagcuccagaaguacuccgaguacagcuccaagaagaucaaggacgcccugaccgaguucaacgagggcgggagccugaagcaguacgacccccacgagcccaucuccuacgacguguucaagcuguucaugcgggccuaccuggagguggaccugccccagccccucagcacgcaccuguuccuggcguucucccagaagccgcgccacgagaccagcgaccaccccaccgagggggccuccaacagcgaggccaacuccgccgacaccaacauccagaacgccgacaacgcgacgaaggccgacgaggccugcgcccccgacaccgagagcaacauggcggagaagcaggcccccgccgaggaccagguggccgccaccccgcucgagccgcccgucccccgguccagcuccagcgagucccccgugguguaccugaaggacgucgugugcuaccugagccuccuggagaccggccgcccccaggacaagcuggaguucauguuccggcucuacgacuccgacgagaacgggcugcuggaccaggcggagauggacugcaucgugaaccagaugcuccacaucgcccaguaccuggagugggaccccacggagcugcgccccauccucaaggagaugcugcagggcauggacuacgaccgggacggcuucgucagccugcaggagugggugcacgggggcaugaccaccaucccgcuccuggugcugcucgggauggacgacagcggcuccaagggggacggccgccacgccuggaccaugaagcacuucaagaagcccacguacugcaacuucugccacaucaugcugaugggcguccggaagcaggggcugugcugcaccuacugcaaguacaccgugcacgagcgcugcgugagccggaacauccccggcugcgucaagaccuacuccaaggccaagcgcagcggggaggugaugcagcacgccuggguggagggcaacuccagcgucaagugcgaccggugccacaaguccaucaagugcuaccagagcgugacggcgcgccacugcguguggugccggaugaccuuccaccgcaagugcgagcucuccacccugugcgacggcggggagcugcgggaccacauccuccugcccaccagcaucugcccgaucacgcgcgaccggcccggcgagaaguccgacgggugcgucagcgccaagggcgagcuggugaugcaguacaagaucauccccacccccgggacccacccgcuccuggugcuggucaaccccaaguccggcggccgccagggggagcggcucaacuucuuccgcgacacccccgacuuccgcgugcuggccugcggcggggacggcacggucggguggauccuggacugcaucgacaaggccaacuucgccaagcacccgcccguggcggugcucccccugggcaccggcaacgaccuggcccggugccuccgcuggggcggcggguacgagggcgggagccugaccaagauccugaaggacaucgagcagagcccccucgucaugcuggaccgguggcaccuggaggugaucccgcgcgaggagguggagaacggggaccagguccccuacagcaucaugaacaacuacuucuccaucggcguggacgccagcaucgcccaccgguuccacgugaugcgcgagaagcaccccgagaaguucaacucccggaugaagaacaagcugugguacuucgaguucgggaccagcgagacguucgccgcgaccugcaagaagcuccacgaccacaucgagcuggagugcgacggcgucgggguggaccugagcaacaucuuccucgagggcaucgccauccugaacauccccuccauguacggcgggaccaaccuguggggcgagaacaagaagaaccgcgccgugauccgggagagccgcaagggggucaccgacccgaaggagcucaaguucugcgugcaggaccuguccgaccagcugcucgagguggucggccuggagggggccauggagaugggccagaucuacacgggccucaagagcgcggggcggcgccucgcccagugcgccuccgugaccauccggaccaacaagcugcugcccaugcaggucgacggcgagcccuggaugcagcccugcugcaccaucaagaucacgcacaagaaccaggccccgaugaugauggggccgccccagaaguccuccuucuucagccuccgccggaagucccgcagcaaggacuga

SEQ ID NO: 29151 - RNA, 3495 nt, Artificial Sequence
  derived and/or modified sequence opt1 from DGKH__Homo_sapiens__NP_001191433
auggccggcgccgggggccagcaccacccgcccggggcggccggcggggccgccgccggcgcgggcgccgccgugaccagcgccgcggccuccgccgggcccggcgaggacagcuccgacagcgaggccgagcaggaggggccccagaagcugauccgcaaggucuccaccagcggccagauccggacgaagaccuccaucaaggaggggcagcuccugaagcagaccagcuccuuccagcgcuggaagaagcgguacuucaagcugcgcggccggacccucuacuacgccaaggacagcaagucccugaucuucgacgagguggaccugagcgacgcguccguggccgaggccagcacgaagaacgccaacaacuccuucaccaucaucacccccuuccgccggcucaugcugugcgccgagaaccgcaaggagauggaggacuggaucagcucccucaagagcguccagacccgggagccguacgagguggcgcaguucaacguggagcacuucuccggcaugcacaacugguacgccugcagccacgcccgccccacguucugcaacgucugccgggagagccuguccggggugaccagccacggccuguccugcgaggugugcaaguucaaggcccacaagcgcugcgccguccgggcgaccaacaacugcaaguggaccacgcuggccagcaucgggaaggacaucaucgaggacgaggacggcguggccaugccccaccaguggcucgagggcaaccugcccguguccgccaagugcgccgucugcgacaagaccugcgggagcgugcugcgccuccaggacuggaagugccuguggugcaagaccauggugcacaccgcgugcaaggaccuguaccacccgaucugcccccucggccagugcaaggucuccaucaucccgcccaucgcccugaacagcacggacuccgacggguucugccgggccaccuucagcuucugcgugagcccccugcucguguucgucaacuccaaguccggcgacaaccagggggugaaguuccugcgccgguucaagcagcugcucaaccccgcccagguguucgaccugaugaacggcggcccccaccuggggcuccgccuguuccagaaguucgacaacuuccggauccuggucugcggcggggacggcagcguggggugggugcucuccgagaucgacaagcugaaccugaacaagcagugccagcucggcguccugccccugggcaccgggaacgaccucgcgcgcgugcugggcuggggcgggagcuacgacgacgacacccagcugccgcagauccucgagaagcuggagcgggccuccacgaagaugcuggaccgcuggagcaucaugaccuacgagcucaagcugccgcccaaggccucccugcuccccgggccgcccgaggccagcgaggaguucuacaugaccaucuacgaggacagcgucgccacccaccugacgaagauccugaacuccgacgagcacgcgguggugaucagcuccgccaagacccucugcgagaccgucaaggacuucguggccaagguggagaagaccuacgacaagacgcuggagaacgccgucguggccgacgcgguggccagcaagugcuccguccugaacgagaagcuggagcagcuccugcaggcccugcacaccgacagccaggccgcccccgugcuccccggccugagcccccugaucguggaggaggacgcggucgaguccuccagcgaggagucccucggcgagagcaaggagcagcugggggacgacgugaccaagcccuccagccagaaggccgugaagccccgcgagaucaugcugcgggccaacucccucaagaaggccguccgccaggugaucgaggaggcgggcaaggugauggacgaccccaccguccacccgugcgagcccgccaaccagagcuccgacuacgacagcacggagaccgacgagagcaaggaggaggccaaggacgacggggccaaggaguccaucaccgugaagaccgcgccccggagcccggacgcccgcgccuccuacggccacagccagacggacuccgugcccggccccgccgucgccgccagcaaggagaaccugcccgugcugaacacccggaucaucugcccggggcuccgcgcgggccuggccgccuccaucgccgggagcuccaucaucaacaagaugcugcucgccaacaucgaccccuucggcgcgacccccuucaucgaccccgaccuggacagcguggacggguacuccgagaagugcgucaugaacaacuacuucggcaucggccuggacgccaagaucagccucgaguucaacaacaagcgggaggagcacccggagaagugccgcucccggaccaagaaccugaugugguacggggugcugggcacccgcgagcuccugcagcggagcuacaagaaccuggagcagcgcgugcagcucgagugcgacgggcaguacaucccccugcccucccugcagggcaucgccguccucaacauccccagcuacgccgggggcacgaacuucuggggcgggaccaaggaggacgacaucuucgcggccccguccuucgacgacaagauccuggaggugguggccaucuucgacagcaugcagauggccgucucccgggugaucaagcugcagcaccaccgcaucgcccagugccggaccgugaagaucaccaucuucggcgacgaggggguccccguccagguggacggcgaggcgugggugcagccgcccgggaucaucaagaucgugcacaagaaccgcgcccagaugcucacgcgggaccgcgccuucgagagcacccucaagagcugggaggacaagcagaagugcgacuccggcaagcccgugcugcggacccaccuguacauccaccacgccaucgaccuggccaccgaggaggucagccagaugcagcugugcucccaggcggccgaggagcucaucacgcgcaucugcgacgccgccaccauccacugccugcuggagcaggagcucgcccacgcggugaacgccugcagccacgcccugaacaaggccaacccccgcugccccgagucccugacccgggacaccgccacggagaucgcgaucaacgugaaggcccucuacaacgagaccgagagccugcuggucggccgcgugccccuccagcuggaguccccgcacgaggagcgggugagcaacgcccugcacuccgucgagguggagcuccagaagcugaccgagauccccuggcuguacuacauccuccaccccaacgaggacgaggagcccccgauggacugcaccaagcgcaacaaccggagcacgguguuccgcaucguccccaaguucaagaaggagaaggugcagaagcagaagaccuccagccagcccggguccggcgacaccgagagcggguccugcgaggccaacagcccgggcaacuga

SEQ ID NO: 29152 - RNA, 3198 nt, Artificial Sequence
  derived and/or modified sequence opt1 from DGKI__Homo_sapiens__NP_004708
auggacgccgccggccgcgggugccaccuccugccccugccggcggcccggggccccgcccgcgcccccgccgcggccgccgccgcggccgccagcccgcccgggcccugcuccggcgccgccugcgcgcccagcgccgccgccggggccggcgcgaugaaccccuccagcuccgccggcgaggagaagggggccaccggcgggagcuccagcuccggcagcggggccggcuccugcugccugggcgccgagggcggggcggacccgcgcggggccggcagcgccgccgccgcgggcgccgccgcccucgacgagcccgcggccgccgggcagaaggagaaggacgaggcccuggaggagaagcugcggaaccucaccuuccggaagcaggucuccuaccgcaaggccaucagccgggcgggccugcagcaccuggcccccgcccacccccucucccugccgguggccaacgggcccgccaaggagccccgcgcgacgcuggacuggagcgagaacgccgugaacggcgagcaccucuggcuggagaccaacguguccggggaccugugcuaccucggcgaggagaacugccagguccgguucgccaagagcgcccugcgccggaagugcgccgugugcaagaucgugguccacaccgcgugcaucgagcagcuggagaagaucaacuuccgcugcaagcccaccuuccgggagggcgggucccgcagcccgcgggagaacuucgugcgccaccacugggugcaccggcgccggcaggagggcaagugcaagcagugcgggaagggcuuccagcagaaguucagcuuccacuccaaggagaucgucgccaucagcugcuccuggugcaagcaggccuuccacaacaaggugacgugcuucaugcuccaccacaucgaggagcccugcagccugggggcccacgcggccgugaucgucccgcccaccuggaucaucaaggugaagaagccccagaacucccugaaggccagcaaccgcaagaagaagcggaccuccuucaagcgcaaggccagcaagcgcggcauggagcaggagaacaagggccggcccuucgugaucaagcccaucuccagcccccucaugaagccgcugcuggucuucgugaaccccaaguccgggggcaaccaggggaccaaggugcuccagauguucaugugguaccugaacccccgccaggucuucgaccugagccaggagggccccaaggacgcccucgagcuguaccggaaggugccgaaccugcgcauccucgcgugcgggggcgacggcacggugggguggauccuguccauccuggacgagcuccagcugagcccccagcccccggucggcgugcugccccucgggaccggcaacgaccuggcccggacccugaacuggggcgggggcuacaccgacgagcccguguccaagauccucugccaggucgaggacgggacggugguccagcuggaccgcuggaaccugcacguggagcggaaccccgaccucccgcccgaggagcuggaggacggcgugugcaagcugccccucaacgucuucaacaacuacuucagccugggguucgacgcccacgugacccuggaguuccacgagucccgcgaggccaaccccgagaaguucaacagccgguuccgcaacaagauguucuacgccggcgcggccuucuccgacuuccuccagcggagcagccgcgaccuguccaagcacgugaaggucgugugcgacggcaccgaccugaccccgaagauccaggagcugaaguuccagugcaucguguuccucaacaucccccgguacugcgccgggacgaugcccuggggcaaccccggggaccaccacgacuucgagccgcagcgccacgacgacggcuacaucgaggucaucggguucaccauggccagccuggccgcgcuccaggugggcggccacggggagcggcugcaccagugccgcgaggugaugcugcugaccuacaaguccauccccaugcaggucgacggcgagcccugccggcucgcccccgccaugauccgcaucagccugcggaaccaggccaacauggugcagaaguccaagcgccgcaccagcaugccgcugcucaacgacccccaguccgugcccgaccggcugcgcauccgggucaacaagaucagccugcaggacuacgagggguuccacuacgacaaggagaagcuccgcgaggcguccaucagcgacuggcugcggacgaucgccggcgagcuggugcaguccuucggggccaucccccucggcauccuggugguccgcggcgacugcgaccuggagaccugccggauguacaucgaccgccuccaggaggaccugcagagcguguccagcgggucccagcgggugcacuaccaggaccacgagaccagcuucccgcgcgcccuguccgcccagcggcucagcccccgcuggugcuuccuggacgaccggagccaggagcaccuccacuucgucauggagaucucccaggacgagaucuucauccuggaccccgacaugguggugagccagcccgcgggcaccccgcccgggaugcccgaccuggucguggagcaggccuccggcaucagcgacugguggaacccggcccugcgcaagcggaugcucuccgacagcgggcugggcaugaucgcccccuacuacgaggacuccgaccugaaggaccucagccacucccgcgugcugcagagccccgucuccagcgaggaccacgccauccugcaggcggugaucgccggcgaccucaugaagcugaucgaguccuacaagaacgggggcagccugcucauccaggggcccgaccacugcucccugcugcacuacgccgccaagacgggcaacggcgagaucgugaaguacauccucgaccacgggccgagcgagcugcuggacauggccgacuccgagaccggcgagaccgcgcuccacaaggccgccugccagcggaaccgcgccgucugccagcugcugguggacgccggggcgagccuccggaagaccgacuccaagggcaagacgccccaggagcgcgcccagcaggccggggaccccgaccuggccgcguaccuggagagccggcagaacuacaaggugaucggccacgaggaccucgagaccgccgucuga

SEQ ID NO: 29153 - RNA, 3816 nt, Artificial Sequence
  derived and/or modified sequence opt1 from DGKK__Homo_sapiens__NP_001013764
auggaccgcggcgccgccgcggcccaggggaccgcccccccgcaggacggcgagcagcccgccgagagccccgagcccccgccccccuggcccccgcccccccccccgcccgccccccccccggcgcccccccugcucuccgaggccagccccgagccgauccccgagcccugccccgagcuggccccggggcccugccccgaggccaccuccgagagcgcgacggagcuguacaccgagcccaccccggagcccgccaccgagcccgccuccgagccggcccccgagcccgccacggagcccgcgccggagcccgccaccgagcccgcccccgagccggcccccgagcccgccaccgagagcgcgcccgagccgacccccgagcccgcccucgaguccgugcccgagccggcccccgagcugacgcccgaggucgcccccgagcuggccccggagcccacccccgagcccgugaccgagcucgcgccggaguucugccccgaggccgcccccgaguuccggccgagccccgcccccugccugcugcagugccccguggacacccgcgagcggggccucaagacguccccgagccccucccccagccccuccccgcgcacccccaugagcuggucccggaucaagaagauccugaaggaggggcccaugcugaagaacugcaacagcuucaagcgcuggaagcuccgguacuuccugguccagggccagaagcuguacuucgcccaccaccccgcguucgcccacuucgagaccaucgaccucucccaggccaccguggccgagagcuccugccgcaaccugugccacagcuucugcgugaucacgccgcagcggaagaucacccuggcggcccccaaccgcaaggacauggaggaguggaucaacaucaucaagaccauccagcagggcgagaucuacaagauccccgccgccgagaacaaccccuuccucgucgggaugcacugcugguacagcuccuacagccaccggacccagcacugcaacgugugccgcgaguccaucccggcccugagccgggacgcgaucaucugcgaggugugcaaggucaagucccaccgccugugcgcccuccgggccagcaaggacugcaaguggaacacgcuguccaucaccgacgaccugcuccugcccgccgacgaggugaacaugccccaccaguggguggagggcaacaugcccgucagcucccagugcgccgugugccacgagagcugcggguccuaccagcgccugcaggacuuccggugccucuggugcaacagcaccgugcacgacgacugccgccggcgcuucuccaaggagugcugcuuccggagccaccgcuccagcgucaucccgcccaccgcgcuguccgaccccaagggcgacgggcagcugguggugagcuccgacuucuggaaccucgacuggagcagcgccugcuccugcccccugcugaucuucaucaacagcaaguccggcgaccaccagggcaucgucuuccuccgcaaguucaagcaguaccugaacccgagccagguguucgaccugcucaaggggggccccgaggccgggcuguccauguucaagaacuucgcccgguuccgcauccuggugugcggcggcgacgggagcgucuccugggugcucagccugaucgacgccuucggccugcacgagaagugccagcucgcggugaucccccuggggacgggcaacgaccuggcccggguccucggguggggcgccuucuggaacaaguccaagagcccccuggacauccugaaccgcguggagcaggccuccguccggauccucgaccgcuggagcgugaugauccgggagaccccgcgccagaccccccugcugaagggccagguggagauggacgucccccgguucgaggcggccgccauccagcaccuggaguccgccgccaccgagcucaacaagauccugaaggcgaaguacccgacggagaugaucaucgccacccgcuuccugugcagcgccguggaggacuucguggucgacaucgugaaggccugggggcagaucaagcagaacaacaccgccaucguguccgucauccucaagagcgaccugauguacgaccggcuguccgugcucaucgacgugcuggcggaggaggccgccgccaccagcgccgagaagagcgcgacggaguacgccgacuccagcaaggccgaccgcaagcccuucaucccccagaucgaccacaucgccaagugcaagcuggagcucgcgaccaaggcccagucccugcagaagagccugaagcucaucaucuuccaggucgagcaggcccuggacgaggagucccggcagaccaucagcgugaagaacuucuccagcaccuucuuccuggaggacgaccccgaggacaucaaccagacguccccgcgccggcgcagccggcgcggcacccucuccagcaucuccagccugaaguccgaggaccuggacaaccucaaccuggaccaccugcacuucacccccgagagcauccgguucaaggagaagugcgugaugaacaacuacuucgggaucggccucgacgccaagaucucccuggacuucaacacccgccgcgacgagcaccccgggcaguacaacagccggcugaagaacaagaugugguacggccuccugggcaccaaggagcugcuccagcgcuccuaccggaagcuggaggagcgcguccaccuggagugcgacggggagacgaucagccuccccaaccugcagggcaucguggugcugaacaucaccagcuacgccgggggcaucaacuucuggggguccaacaccgcgaccacggaguacgaggccccggccaucgacgacggcaagcucgaggucguggccaucuucggcagcgugcagauggccaugucccggaucaucaaccugcaccaccaccgcaucgcgcagugccacgaggucaugaucaccaucgacggggaggagggcauccccgugcagguggacggggaggccuggauccagcggcccggccugaucaagauccgcuacaagaacgccgcccagaugcucacccgggaccgcgacuucgagaacagcaugaagaugugggaguacaagcacaccgagauccaggccgcgccccagccgcagcuggacuuccaggacucccaggagagccuguccgacgaggaguacgcccagaugcagcaccucgcccggcuggccgagaaccugaucagcaagcucaacgaccuguccaagauccaccagcacgucagcgugcugaugggcuccgugaacgccagcgcgaacauccucaacgacaucuucuacgggcaggacuccggcaacgagaugggggccgccagcugcauccccaucgagacgcugucccgcaacgacgccgucgacgugaccuucagccugaagggccucuacgacgacaccaccgcguuccuggacgagaagcugcuccgguccgccgaggacgagacggcccugcagagcgcccuggacgccaugaacaaggaguucaagaagcucuccgagaucgacuggaugaaccccaucuucgugcccgaggagaagagcagcgacaccgacucccgcagccugcggcugaagaucaaguucccgaagcucgggaagaagaaggucgaggaggagcgcaagcccaaguccggccagagcgugcaguccuucaucggcaaccuguggcaccggcgccaccgggaggacgaggcggagggggacgacccccugacccccagccgcucccagcucuga

SEQ ID NO: 29154 - RNA, 2829 nt, Artificial Sequence
  derived and/or modified sequence opt1 from DGKQ__Homo_sapiens__NP_001338
auggccgccgcggccgagcccggcgcccgcgccuggcucgggggcgggagcccgcggcccggcucccccgccugcagccccgugcugggguccggcggccgcgcgcggccggggcccggccccgggcccggcccggagcgcgccgggguccgggcccccggccccgccgcggcccccggccacagcuuccgcaaggugacccugaccaagccgacguucugccaccugugcuccgacuucaucugggggcucgccggcuuccugugcgacgugugcaacuucaugagccacgagaagugccugaagcacguccggauccccugcaccuccguggcccccagccucgugcgcguccccguggcccacugcuucgggccgcggggccugcacaagcgcaaguucugcgcggugugccggaagguccuggaggcccccgcccuccacugcgaggugugcgagcugcaccuccaccccgacugcgugcccuucgccugcuccgacugccgccagugccaccaggacggccaccaggaccacgacacccaccaccaccacuggcgggaggggaaccugccgagcggcgcccgcugcgaggucugccggaagaccugcggguccagcgacgugcuggcgggcgugcgcugcgaguggugcgggguccaggcccacucccugugcagcgccgcccucgcccccgagugcggcuucggccggcugcgcucccuggugcucccgcccgcgugcgugcggcugcugcccgggggcuucagcaagacgcaguccuuccgcaucgucgaggccgccgagcccggggagggcggggacggcgccgacggcagcgccgcgguggggcccggccgggagacccaggccacccccgaguccgggaagcagacccucaagaucuucgacggcgacgacgccgugcgccgcagccaguuccggcuggucacggugagccgccuggccggggcggaggaggugcucgaggccgcccugcgggcccaccacaucccggaggaccccggccaccuggagcucugccgccugcccccguccagccaggccugcgacgcgugggccggcgggaaggccggcuccgccgucaucagcgaggaggggcggucccccggcagcggcgaggccacccccgaggcgugggugauccgcgcccugccccgggcccaggagguccucaagaucuacccgggguggcugaaggugggcguggccuacgucuccgugcgcgugacccccaagagcaccgcccgguccgucgugcuggaggugcucccccugcuggggcgccaggcggagagccccgaguccuuccagcucgucgagguggccaugggcugccggcacgugcagcgcacgaugcugauggacgagcagccgcugcucgaccggcugcaggacauccgccagaugagcguccgccaggugucccagacccgguucuacguggccgagagccgggacgucgcgccccacgugucccuguucgucgggggccucccgcccggccugagccccgaggaguacuccagccugcuccacgaggccggggccaccaaggccaccgugguguccgugagccacaucuacagcucccagggcgccgucgugcuggacguggccugcuucgcggaggccgagcgccuguacaugcuccugaaggacauggccguccgggggcgccugcugacggcccucgugcugcccgaccugcuccacgccaagcugccgcccgacagcugcccccugcucguguucgucaaccccaaguccggcgggcugaagggccgcgaccugcucugcagcuuccggaagcugcugaacccccaccagguguucgaccucaccaacggcgggccccugccgggccugcaccucuucucccaggugcccugcuuccgcguccuggugugcgggggcgacgggaccgugggcuggguccugggcgcgcucgaggagacccgguaccgccuggccugccccgagcccagcguggccauccugccgcucgggacgggcaacgaccuggggcgggugcugcgcuggggcgccggguacuccggcgaggaccccuucagcguccuccuguccguggacgaggccgacgcggugcugauggaccgguggaccauccuccuggacgcccacgaggccggcagcgccgagaacgacaccgcggacgccgagcccccgaagaucguccagauguccaacuacugcgggaucggcaucgacgccgagcugagccucgacuuccaccaggcccgcgaggaggagcccgggaaguucaccucccggcugcacaacaagggcguguacgugcgcgucggccugcagaagaucagccacucccggagccuccacaagcagauccgccuccagguggagcggcaggagguggagcugcccuccaucgaggggcugaucuucaucaacauccccagcuggggcagcggggccgaccuguggggcuccgacagcgacacgcgcuucgagaagccgcggauggacgacgggcugcucgaggucgugggcgugaccggcgucgugcacauggggcagguccagggcgggcugcgcuccggcauccggaucgcgcaggggagcuacuuccgcgugacccugcucaaggccacccccgugcaggucgacggcgagcccugggugcaggcccccggccacaugaucaucuccgccgccgggccgaaggugcacaugcugcggaaggcgaagcagaagccccgccgggccggcacgacccgcgacgcccgcgccgacgccgcgcccgcccccgagagcgacccgcgguga

SEQ ID NO: 29155 - RNA, 3354 nt, Artificial Sequence
  derived and/or modified sequence opt1 from DGKZ__Homo_sapiens__NP_001099010
auggagaccuucuuccgccggcacuuccgcggcaaggugcccgggccgggcgaggggcagcagcggcccagcuccgucggccugcccaccgggaaggcccgccggcgcagccccgccggccaggcguccagcucccucgcccagcggcgccggagcuccgcccagcugcagggcugccugcucagcugcggggugcgcgcccagggcuccagccggcgccgguccagcacggugccgcccuccugcaacccccgcuucaucgucgacaaggugcugaccccccagccgaccaccgugggggcccagcugcucggcgcgccccugcugcucacggggcuggucggcaugaacgaggaggagggcgugcaggaggacguggucgccgaggccagcuccgccauccagcccgggaccaagacccccggcccgccccccccccggggggcgcagccgcugcucccccugccccgcuaccugcggcgcgccagcucccaccuccugcccgccgacgccguguacgaccacgcccuguggggccuccacggcuacuaccggcgccugagccagcggcgcccguccgggcagcaccccggccccgggggccgccgggcgagcgggaccacggccggcaccaugcugcccacccgcgugcggccgcucagccgccggcgccaggucgcccugcggcgcaaggccgccggcccccaggcgugguccgcccugcucgccaaggccaucaccaagagcgggcugcagcaccuggccccccccccgcccacgcccggcgcgccgugcuccgagagcgagcggcagauccgcuccaccguggacuggagcgaguccgccaccuacggggagcacaucugguucgagaccaacgugagcggcgacuucugcuacgucggggagcaguacugcguggcccggaugcucaaguccgugagccgccggaagugcgccgccugcaagaucgucgugcacacgcccugcaucgagcagcuggagaagaucaacuuccgcugcaagcccuccuuccgggagagcggcucccgcaacgugcgggagcccaccuucguccgccaccacugggugcaccggcgccgccaggacggcaagugccggcacugcgggaagggcuuccagcagaaguucaccuuccacagcaaggagaucguggcgaucuccugcagcuggugcaagcaggccuaccacuccaaggucagcugcuucaugcugcagcagaucgaggagccgugcucccucggggugcacgccgccgucgugaucccccccaccuggauccugcgcgcgcggcgcccccagaacacgcugaaggccagcaagaagaagaagcgggccagcuucaagcgcaaguccagcaagaagggcccggaggaggggcgguggcgccccuucaucauccggcccacccccuccccgcucaugaagccccugcugguguucgucaaccccaagagcggcggcaaccagggggccaagaucauccaguccuuccucugguaccugaacccccgccagguguucgaccugagccagggcgggccgaaggaggcccucgagauguaccggaaggugcacaaccugcgcauccuggcgugcggcggcgacgggaccgucggcuggauccucuccacccuggaccagcugcggcucaagcccccccccccgguggccauccugccccuggggacgggcaacgaccucgcccgcacccugaacugggggggcggcuacaccgacgagcccgugagcaagauccugucccacgucgaggaggggaacguggugcagcuggaccggugggaccuccacgccgagcccaacccggaggccggccccgaggaccgcgacgagggggcgaccgaccggcugccccuggacgucuucaacaacuacuucagccucggcuucgacgcccacgugacgcuggaguuccacgagucccgcgaggccaacccggagaaguucaacagccgguuccgcaacaagauguucuacgccgggaccgccuucuccgacuuccugaugggcagcuccaaggaccucgcgaagcacauccggguggucugcgacggcauggaccugacccccaagauccaggaccugaagccccagugcgugguguuccucaacaucccccgcuacugcgccgggaccaugccguggggccaccccggggagcaccacgacuucgagccccagcgccacgacgacggcuaccuggaggucaucggguucacgaugaccagccuggccgcccuccaggugggcggccacggggagcggcugacccagugccgcgaggugguccugaccacguccaaggcgauccccgugcagguggacggcgagccgugcaagcucgccgccagccggauccgcaucgcccugcggaaccaggccaccaugguccagaaggcgaagcgccggagcgccgccccccugcacuccgaccagcagcccgugcccgagcagcuccgcauccaggugagccgggucuccaugcacgacuacgaggcccugcacuacgacaaggagcagcugaaggaggccagcgugccgcucgggaccguggucgugcccggcgacuccgaccuggagcugugccgcgcgcacaucgagcggcuccagcaggagcccgacggggccggcgccaagagccccaccugccagaagcuguccccgaaguggugcuuccuggacgccaccacggccagccgcuucuaccggaucgaccgcgcgcaggagcaccucaacuacgugaccgagaucgcccaggacgagaucuacauccuggaccccgagcugcucggcgccuccgcccggcccgaccugcccaccccgaccagcccccugcccacgucccccugcagcccgaccccccgcucccuccagggggacgcggcccccccccagggcgaggagcugaucgaggccgccaagcggaacgacuucugcaagcugcaggagcuccaccgcgccgggggcgaccugaugcaccgggacgagcagagccgcacccugcuccaccacgcggucuccaccggcagcaaggacguggugcgcuaccugcuggaccacgccccgcccgagauccucgacgccgucgaggagaacggggagacgugccugcaccaggccgccgcgcugggccagcggaccaucugccacuacaucguggaggccggggccucccucaugaagaccgaccagcagggcgacaccccccgccagcgggccgagaaggcccaggacacggagcuggcggccuaccuggagaaccgccagcacuaccagaugauccagcgggaggaccaggagaccgccguguga

SEQ ID NO: 29156 - RNA, 834 nt, Artificial Sequence
  derived and/or modified sequence opt1 from DGUOK__Homo_sapiens__NP_550438
auggccgccggccgccuguuccucagccggcugcgcgcgcccuucuccagcauggccaaguccccgcuggagggggugagcuccagccggggccuccacgccgggcgcggcccccggcgccuguccaucgaggggaacaucgccgucggcaagagcaccuucgugaagcugcucaccaagacguaccccgaguggcacguggccaccgagcccgucgcgaccuggcagaacauccaggccgccggcacccagaaggccugcacggcgcagucccuggggaaccugcucgacaugauguaccgggagccggcccgcuggagcuacaccuuccagaccuucuccuuccugagccggcugaaggugcagcucgagcccuuccccgagaagcugcugcaggcccgcaagcccgugcagaucuucgagcgguccgucuacagcgaccgcuacaucuucgccaagaaccucuucgagaacggcucccugagcgacaucgaguggcacaucuaccaggacuggcacuccuuccugcucugggaguucgccagccggaucacccugcacggguucaucuaccugcaggcguccccgcaggucugccucaagcgccuguaccagcgggcccgcgaggaggagaagggcaucgagcuggccuaccucgagcagcugcacgggcagcacgaggccuggcugauccacaagacgaccaagcuccacuucgaggcccugaugaacauccccgugcuggugcucgacgugaacgacgacuucagcgaggaggugaccaagcaggaggaccugaugcgggaggucaacaccuucgugaagaaccuguga

SEQ ID NO: 29157 - RNA, 1428 nt, Artificial Sequence
  derived and/or modified sequence opt1 from DHCR7__Homo_sapiens__NP_001157289
auggccgccaagagccagcccaacaucccgaaggcgaagucccuggacggcgugaccaacgaccgcaccgccagccaggggcaguggggccgggccugggaggucgacugguucucccucgccagcgugaucuuccugcugcuguucgcccccuucaucguguacuacuucaucauggcgugcgaccaguacuccugcgcccugacggggcccgucguggacaucgugaccggccacgcccgccugagcgacaucugggccaagacgcccccgaucacccggaaggcggcccagcucuacacccugugggucaccuuccaggugcugcucuacaccucccugcccgacuucugccacaaguuccugcccggguacgugggcggcauccaggagggggccgucacccccgccggcguggugaacaaguaccagaucaacgggcuccaggccuggcugcugacgcaccuccugugguucgcgaacgcccaccuccucagcugguucuccccgaccaucaucuucgacaacuggaucccccugcuguggugcgccaacauccucggcuacgccgucagcaccuucgccauggugaagggguacuucuuccccaccuccgcgcgcgacugcaaguucacgggcaacuucuucuacaacuacaugaugggcaucgaguucaacccccggaucgggaagugguucgacuucaagcuguucuucaacggccgcccggggaucguggccuggacccugaucaaccucagcuucgccgccaagcagcgggagcugcacucccacgucaccaacgccauggugcuggugaacguccuccaggcgaucuacgugaucgacuucuucuggaacgagaccugguaccugaagacgaucgacaucugccacgaccacuucggcugguaccugggcuggggcgacugcguguggcuccccuaccuguacacccugcaggggcucuaccuggucuaccaccccgugcagcugagcacgccccacgccguggggguccuccugcugggccucgugggguacuacaucuuccgcgucgccaaccaccagaaggaccuguuccggcgcaccgacggccggugccugaucuggggccgcaagccgaaggugaucgagugcuccuacaccagcgccgacgggcagcggcaccacuccaagcuccuggugagcggcuucuggggcgucgcccgccacuucaacuacgugggggaccugauggggucccucgcguacugccuggccugcggcggcgggcaccuccugcccuacuucuacaucaucuacauggccauccugcugacccaccggugccugcgcgacgagcaccggugcgccagcaaguacggccgcgacugggagcgguacaccgcggccgugcccuaccgccuccugcccgggaucuucuga

SEQ ID NO: 29158 - RNA, 1005 nt, Artificial Sequence
  derived and/or modified sequence opt1 from DHDH__Homo_sapiens__NP_055290
auggcccugcgcuggggcaucgugagcgucgggcucaucuccagcgacuucaccgccgugcugcagacccugccccgguccgagcaccagguggucgcgguggccgcccgcgaccucagccgggccaaggaguucgcccagaagcacgacaucccgaaggcguacggcuccuacgaggagcuggccaaggaccccagcguggaggucgccuacaucgggacgcagcacccccagcacaaggccgcggugaugcugugccucgccgccggcaaggccgugcugugcgagaagcccaccggggucaacgccgcggaggugcgcgagaugguggccgaggcccggucccgcgcccuguuccucauggaggccaucuggacccgguucuucccggcgagcgaggcccugcgcuccguccuggcccagggcacccucggcgaccugcggguggcccgcgccgaguucgggaagaaccugauccacgugccccgggcggucgaccgcgcccaggccggcggggcccuccuggacaucggcaucuacugcgugcaguucacgagcaugguguucgggggccagaagcccgagaagaucuccgucgugggccggcgccacgagaccgggguggacgacaccgucaccgugcugcuccaguaccccggcgaggugcacgggagcuucacgugcuccaucaccguccagcugagcaacaccgccuccgugagcggcaccaagggcaugguccagcugcucaacccgugcuggugccccacggagcugguggugaagggggagcacaaggaguucccccugcccccgguccccaaggacugcaacuucgacaacggcgcggggauguccuacgaggccaagcacgugugggagugccuccggaagggcaugaaggagagccccgugaucccccuguccgagagcgagcugcucgccgacauccuggaggagguccgcaaggccaucggggugaccuucccgcaggacaagcgguga

SEQ ID NO: 29159 - RNA, 564 nt, Artificial Sequence
  derived and/or modified sequence opt1 from DHFR__Homo_sapiens__NP_000782
auggugggcagccugaacugcaucgucgccgugucccagaacauggggaucggcaagaacggggaccuccccuggccgccccugcgcaacgaguuccgguacuuccagcgcaugaccaccacgagcuccguggagggcaagcagaaccuggucaucauggggaagaagaccugguucagcauccccgagaagaaccggccccucaagggccgcaucaaccuggugcugucccgggagcucaaggagccgccccagggcgcccacuuccugagccgcucccuggacgacgcgcucaagcugaccgagcagcccgagcuggccaacaagguggacauggucuggaucgucgggggcagcuccguguacaaggaggccaugaaccaccccgggcaccucaagcuguucgugacccggaucaugcaggacuucgagagcgacacguucuucccggagaucgaccuggagaaguacaagcuccugcccgaguaccccggcgugcuguccgacgugcaggaggagaaggggaucaaguacaaguucgaggucuacgagaagaacgacuga

SEQ ID NO: 29160 - RNA, 564 nt, Artificial Sequence
  derived and/or modified sequence opt1 from DHFRL1__Homo_sapiens__NP_001182572
auguuccugcuccugaacugcaucguggccgucagccagaacaugggcaucgggaagaacggcgaccugccccgcccgccccuccggaacgaguuccgcuacuuccagcggaugaccaccacguccagcguggaggggaagcagaaccuggugaucaugggccgcaagaccugguucuccauccccgagaagaaccggccccugaaggaccgcaucaaccucguccugagccgggagcugaaggagccgccccagggggcccacuuccucgcgcgcucccuggacgacgcccugaagcucaccgagcggcccgagcuggccaacaagguggacaugaucuggaucgugggcggcagcuccgucuacaaggaggccaugaaccaccuggggcaccucaagcuguucgugacccgcaucaugcaggacuucgagagcgacacguucuucuccgagaucgaccuggagaaguacaagcuccugcccgaguacccgggcgugcugagcgacguccaggaggggaagcacaucaaguacaaguucgaggugugcgagaaggacgacuga

SEQ ID NO: 29161 - RNA, 1191 nt, Artificial Sequence
  derived and/or modified sequence opt1 from DHH__Homo_sapiens__NP_066382
auggcccugcucaccaaccugcugccccucugcugccuggcccugcucgcgcugccggcccagagcugcggccccgggcgcggccccguggggcggcgccgguacgcccgcaagcagcuggucccccuccuguacaagcaguucgugccgggcgugcccgagcggacccugggggccuccggccccgccgagggccgcgucgcgcgggggagcgagcgcuuccgggaccucgugcccaacuacaacccggacaucaucuucaaggacgaggagaacuccggcgccgaccgccugaugacggagcggugcaaggagcgcgugaacgcccuggccaucgcggucaugaacauguggcccggggugcggcuccgcgugaccgagggcugggacgaggacgggcaccacgcccaggacagccugcacuacgagggccgggcccuggacaucaccaccuccgaccgcgaccggaacaaguacggccuccuggcccgccuggccgucgaggcgggguucgacuggguguacuacgagagccggaaccacgugcacgucuccgugaaggccgacaacagccucgccgugcgcgccggcgggugcuuccccggcaacgccacgguccggcugugguccggcgagcgcaaggggcugcgcgagcuccaccggggcgacugggugcuggcggccgacgccagcgggcgcgugguccccaccccggugcuccuguuccuggaccgggaccugcagcgccgggccuccuucguggccgucgagaccgaguggccgccccgcaagcuccugcugacccccuggcaccucguguucgcggcccggggcccggcccccgcccccggggacuucgcccccguguucgcgcgccggcugcgcgccggcgacagcguccuggccccgggcggggacgcccuccggcccgcgcgcguggcccgggucgcccgcgaggaggccgugggcguguucgcgccccugacggcccacgggacccugcucgucaacgacgugcuggccuccugcuacgccgugcuggagagccaccagugggcccaccgggccuucgcgccccuccgccugcugcacgcccucggcgcccugcugcccgggggcgccguccagcccaccggcaugcacugguacucccggcuccuguaccgccuggccgaggagcugcucggguga

SEQ ID NO: 29162 - RNA, 1188 nt, Artificial Sequence
  derived and/or modified sequence opt1 from DHODH__Homo_sapiens__NP_001352
auggccuggcgccaccugaagaagcgggcccaggacgcggugaucauccucggcgggggcgggcugcuguucgccagcuaccucauggccaccggcgacgagcgcuucuacgccgagcaccugaugcccacccugcaggggcuccuggacccggaguccgcccaccggcuggcgguccgcuucacgagccucggccugcugccccgggcccgcuuccaggacuccgacaugcucgaggugcgggugcugggccacaaguuccgcaaccccgucgggaucgccgccggcuucgacaagcacggggaggcgguggacggccuguacaagaugggguucggcuucguggagaucggcagcgucacccccaagccgcaggaggggaacccccggccccgcguguuccggcuccccgaggaccaggccgugaucaaccgcuacggcuucaacucccacgggcugagcgucguggagcaccggcugcgcgcccggcagcagaagcaggccaagcucaccgaggacggccugccgcugggcgugaaccucgggaagaacaagaccuccgucgacgccgcggaggacuacgccgagggcgugcgcgugcuggggccccuggccgacuaccucgucgugaacgugagcucccccaacacggccggccugcggagccugcaggggaaggccgagcuccgccggcugcugaccaagguccuccaggagcgcgacggccugcggcgcgugcaccgccccgcggugcuggucaagaucgccccggaccucaccucccaggacaaggaggacaucgccagcguggugaaggagcugggcaucgacgggcugaucgucaccaacacgaccgugucccggcccgccggccuccagggggcccugcgcagcgagaccggcgggcuguccggcaagccccuccgggaccugagcacccagacgauccgcgagauguacgcgcugacccagggccggguccccaucaucggggugggcgggguguccagcggccaggacgcccucgagaagauccgcgccggggccucccugguccagcuguacaccgcccucaccuucuggggcccgcccguggugggcaaggucaagcgggagcuggaggcgcugcucaaggagcagggguucggcggggugacggacgccaucggcgccgaccaccgccgguga

SEQ ID NO: 29163 - RNA, 984 nt, Artificial Sequence
  derived and/or modified sequence opt1 from DHPS__Homo_sapiens__NP_001193903
augcccaucaucccggccuucugggaggccgaggcgggcgggagccgcgaggaggaguucgagaccucccuggccaacaugaucgagaagaagcucgagccccugagccaggacgaggaccagcacgccgaccugacccagucccggcgcccccucacgagcugcaccaucuuccugggcuacaccuccaaccugaucagcuccgggauccgggagaccauccgcuaccucgugcagcacaacauggucgacgugcuggugacgaccgccggcggggucgaggaggaccugaucaagugccucgcccccaccuaccugggcgaguucagccugcggggcaaggagcuccgcgagaacgggaucaaccggaucggcaaccugcuggugccgaacgagaacuacugcaaguucgaggacuggcucaugcccauccuggaccagauggugauggagcagaacaccgagggggucaaguggacgcccuccaagaugaucgcgcgccugggcaaggagaucaacaaccccgagagcguguacuacugggcccagaagaaccacaucccgguguucucccccgcccucaccgacgggagccugggcgacaugaucuucuuccacuccuacaagaaccccggccugguccucgacaucguggaggaccugcggcugaucaacacccaggccaucuucgcgaagugcaccgggaugaucauccucggcgggggcguggucaagcaccacaucgccaacgccaaccugaugcgcaacggcgccgacuacgccguguacaucaacacggcgcaggaguucgacgggagcgacuccggcgcccggcccgacgaggccgugagcugggggaagauccgcgucgacgcccagccggugaagguguacgccgacgcgucccuggucuucccccuccugguggccgagaccuucgcccagaagauggacgccuucaugcacgagaagaacgaggacuga

SEQ ID NO: 29164 - RNA, 783 nt, Artificial Sequence
  derived and/or modified sequence opt1 from DHRS11__Homo_sapiens__NP_077284
auggcccgccccggcauggagcgguggcgcgaccggcuggcccucgugaccggggcgagcggcgggaucggcgccgccguggcccgcgcccuggugcagcaggggcugaagguggucggcugcgcgcggaccgugggcaacaucgaggagcucgccgccgagugcaaguccgccggguacccgggcacgcugauccccuaccgcugcgaccugagcaacgaggaggacauccucuccauguucagcgcgauccggucccagcacagcgggguggacaucugcaucaacaacgccggccuggcccgccccgacacccugcucuccgggagcaccuccggcuggaaggacauguucaacgucaacgugcuggcccugagcaucugcacccgggaggccuaccaguccaugaaggagcgcaacguggacgacggccacaucaucaacaucaacagcauguccgggcaccggguccucccccugagcgugacgcacuucuacuccgcgaccaaguacgccgugaccgcccugaccgagggccuccgccaggagcugcgggaggcccagacgcacauccgcgcgaccugcaucagcccgggggucguggagacccaguucgccuucaagcugcacgacaaggaccccgagaaggccgccgccaccuacgagcagaugaagugccucaagcccgaggacguggccgaggcggucaucuacgugcuguccacgcccgcccacauccagaucggcgacauccagaugcggccgaccgagcaggucaccuga

SEQ ID NO: 29165 - RNA, 843 nt, Artificial Sequence
  derived and/or modified sequence opt1 from DHRS2__Homo_sapiens__NP_005785
augcugagcgccguggcccgcggcuaccaggggugguuccaccccugcgcgcggcucuccguccgcaugagcuccaccggcaucgaccggaagggggugcuggccaaccgcguggccgucgugaccggcagcacguccgggaucggcuucgccaucgcccggcgccuggcgcgggacggcgcccacguggucaucagcucccgcaagcagcagaacguggaccgggccauggccaagcuccagggggagggccugagcguggcggggaucgucugccacgugggcaaggccgaggaccgcgagcagcugguggccaaggcccucgagcacugcgggggcgucgacuuccuggugugcuccgccggcgugaacccgcuggucgggagcacccucggcaccuccgagcagaucugggacaagauccugagcgugaacgugaagucccccgcgcugcuccugagccagcugcuccccuacauggagaaccggcgcggggccgucauccugguguccagcaucgccgccuacaaccccguggucgcccugggcguguacaacguguccaagaccgcgcuccugggccugacgcggacccucgcccuggagcuggccccgaaggacauccgcgucaacugcgugguccccgggaucaucaagaccgacuucagcaagguguuccacggcaacgagucccucuggaagaacuucaaggagcaccaccagcugcagcggaucggggagagcgaggacugcgccggcaucgugagcuuccugugcucccccgacgccagcuacgucaacggggagaacaucgcgguggccggcuacuccacccgccucuga

SEQ ID NO: 29166 - RNA, 567 nt, Artificial Sequence
  derived and/or modified sequence opt1 from DHRS4__Homo_sapiens__NP_001269916
augcacaaggccggccugcucgggcugugcgcccgcgcguggaacagcgugcggauggccuccagcggcaugacccgccgggacccccuggccaacaaggucgcccucgugaccgccuccacggacgggaucggcuucgcgaucgcccgccggcuggcccaggacggggcccacguggucgugagcucccgcaagcagcagaacguggaccaggcggucgccacccugcagggcgagggccucagcgugaccgggaccgugugccacgucggcaaggccgaggaccgggagcgccugguggccacggccgugaagcugcacgggggcaucgacauccucgucuccaacgcggccgugaacccguucuucgggagcaucauggacgugaccgaggaggucugggacaagcggcgccuguccggcgaccggguguuccacagcucccugcagagcaucuccagccucgacggccaggggaagcgcggcaagcacgagcggaaccccgccgacaagaaggugcgccgggcccgcgggcugugcuggcaccgggucuuccccgugcuguga

SEQ ID NO: 29167 - RNA, 936 nt, Artificial Sequence
  derived and/or modified sequence opt1 from DHRS7C__Homo_sapiens__NP_001099041
augggcgugauggccaugcugaugcucccccugcugcuccuggggaucagcggccuccuguucaucuaccaggaggucucccgccuguggagcaaguccgccgugcagaacaagguggucgugaucaccgacgcgaucagcgggcugggcaaggagugcgcccggguguuccacaccgggggcgcccgccucguccugugcggcaagaacugggagcggcuggagaaccucuacgacgcccugaucuccguggccgacccgagcaagacguucacccccaagcuggugcuccuggaccuguccgacaucagcugcguccccgacguggcgaaggaggugcucgacugcuacgggugcgucgacauccugaucaacaacgccuccgugaaggugaagggccccgcccacaagaucagccuggagcucgacaagaagaucauggacgccaacuacuucgggccgaucacccugaccaaggcgcugcuccccaacaugaucucccgccggacgggccagaucguccuggugaacaacauccaggggaaguucggcauccccuuccgcaccaccuacgccgccagcaagcacgccgcccugggcuucuucgacugccuccgggcggagguggaggaguacgacgucgugaucuccaccgugagccccacguucauccgcuccuaccacgucuacccggagcaggggaacugggaggccagcaucuggaaguucuucuuccggaagcugaccuacggcgugcaccccguggaggucgccgaggaggugaugcgcaccguccggcgcaagaagcaggagguguucauggccaaccccauccccaaggccgcgguguacguccggaccuucuucccggaguucuucuucgccgugguggccugcggggucaaggagaagcugaacgugcccgaggagggcuga

SEQ ID NO: 29168 - RNA, 1140 nt, Artificial Sequence
  derived and/or modified sequence opt1 from DHRS9__Homo_sapiens__NP_001276692
augcccgagggccgcagccacugcgccugcuccaucaccagccugacccuccuggugucccugacgcgggucacccucgacauccugcagaagcuggacccgccccagcccgcccacuggcgccaccaccuccuggugcuguacaagaaggggguguaccucagccacaccggcgggaagaugcuguucuggguccugggccuccugauccugugcggguuccucuggacccggaagggcaagcugaagaucgaggacaucacggacaaguacaucuucaucaccggcugcgacuccggguucggcaaccuggcggcccgcaccuucgacaagaagggguuccacgugaucgccgccugccucaccgagagcggcuccacggcccugaaggcggagaccagcgagcggcugcgcaccgugcuccuggacgucaccgaccccgagaacgugaagcggacggcccagugggugaagaaccaggucggggagaagggccuguggggccucaucaacaacgccggggugccgggcgugcuggcccccaccgacuggcugacccucgaggacuaccgcgagcccaucgaggucaaccuguucgggcugaucuccgugacccucaacaugcugccccuggugaagaaggcgcagggccgggucaucaacgugagcuccgugggcgggcgccucgccaucgucggcgggggcuacacgccgagcaaguacgccguggagggguucaacgacucccugcggcgcgacaugaaggccuucggcgugcacgucagcugcaucgagcccggccuguucaagaccaaccucgccgaccccgugaaggugaucgagaagaagcuggcgaucugggagcagcugucccccgacaucaagcagcaguacggggagggcuacaucgagaagucccucgacaagcugaaggggaacaagagcuacgucaacauggaccugagcccgguggucgagugcauggaccacgcccucaccucccuguuccccaagacccacuacgccgccggcaaggacgccaagaucuucuggaucccccugagccacaugcccgcggcccuccaggacuuccugcugcucaagcagaaggccgagcuggccaacccgaaggccguguga

SEQ ID NO: 29169 - RNA, 2760 nt, Artificial Sequence
  derived and/or modified sequence opt1 from DHTKD1__Homo_sapiens__NP_061176
auggccagcgccaccgcggccgccgcccgccggggccuggggcgcgcccucccccugcuguggcggggcuaccagaccgagcgcgggguguacggcuaccggccgcgcaagcccgagucccgggagccccagggggcgcucgagcggcccccggucgaccacggccuggcccgccuggugacgguguacugcgagcacggccacaaggccgccaagaucaacccccucuucaccgggcaggcgcugcuggagaacguccccgagauccaggcccucgugcagacccugcagggccccuuccacaccgccgggcugcucaacaugggcaaggaggaggccagccuggaggaggugcuggucuaccucaaccagaucuacugcgggcagaucuccaucgagacgagccagcugcagucccaggacgagaaggacugguucgccaagcgcuucgaggagcugcagaaggagaccuucaccaccgaggagcggaagcaccucagcaagcugaugcuggagucccaggaguucgaccacuuccucgcgacgaaguucagcaccgugaagcgcuacggcggcgagggggccgaguccaugaugggcuucuuccacgagcugcugaagaugagcgccuacuccgggaucaccgacgugaucaucggcaugccgcaccggggccgccucaaccugcugaccgggcuccugcaguucccgcccgagcugauguuccggaagaugcgcggccucagcgaguuccccgagaacuucuccgccacgggggacguccugagccaccugaccuccagcguggaccucuacuucggcgcccaccacccccugcacgugaccaugcugcccaaccccucccaccucgaggcggucaaccccguggccguggggaagacccggggccgccagcagagccggcaggacggcgacuacuccccggacaacagcgcccagcccggggaccgcgucaucugccuccaggugcacggcgacgccagcuucugcgggcagggcaucgugcccgagacguucacccuguccaaccugccccacuuccggaucgggggcagcguccaccugaucgugaacaaccagcugggcuacaccaccccggccgagcgcgggcgcuccagccucuacugcuccgacaucggcaagcugguggggugcgcgaucauccacgucaacggcgacagccccgaggagguggugcgggccacgcgccuggccuucgaguaccagcggcaguuccgcaaggacgucaucaucgaccuccugugcuaccggcagugggggcacaacgagcuggacgagcccuucuacaccaaccccaucauguacaagaucauccgcgcccggaaguccaucccggacaccuacgccgagcaccucaucgcgggcggccugaugacccaggaggaggugagcgagaucaaguccagcuacuacgccaagcugaacgaccaccugaacaacauggcccacuaccgcccgcccgcccucaaccugcaggcgcacuggcaggggcuggcccagcccgaggcccagaucacgaccugguccaccggcgucccccucgaccugcugcgguucguggggaugaaguccguggaggucccccgcgagcuccagaugcacucccaccuccugaagacccacgugcagagccggauggagaagaugauggacggcaucaagcuggacugggccacggccgaggcgcuggcccugggcucccuccuggcccagggguucaacgugcgccugagcggccaggacgucgggcggggcaccuucucccagcgccacgccaucguggugugccaggagaccgacgacaccuacaucccccucaaccacauggacccgaaccagaagggguuccuggaggucagcaacagcccccugagcgaggaggccgugcucggcuucgaguacggcaugagcaucgagucccccaagcugcugccccucugggaggcgcaguucggggacuucuucaacggcgcccagaucaucuucgacacguucaucagcgggggcgaggccaaguggcugcugcaguccgggaucgugauccuccugccgcacggcuacgacggcgccgggcccgaccacagcuccugccggaucgagcgcuuccugcagaugugcgacagcgccgaggagggcgucgacggggacaccgugaacauguucgugguccaccccaccacccccgcgcaguacuuccaccuccugcggcgccagauggugcggaacuuccgcaagccgcugaucguggccucccccaagaugcuccugcgccugcccgccgccgucagcacgcuccaggagauggcgcccggcaccaccuucaacccggugaucggggacuccagcguggaccccaagaaggucaagacccugguguucugcuccggcaagcacuucuacagccuggugaagcagcgggagucccucggcgccaagaagcacgacuucgccaucauccgcgucgaggagcugugccccuucccccuggacagccuccagcaggagauguccaaguacaagcacgugaaggaccacaucuggagccaggaggagccgcagaacauggggcccugguccuucgugagcccccgguucgagaagcagcuggccugcaagcugcgccucgucggccggcccccgcugcccgugcccgccguggggaucggcaccguccaccuccaccagcacgaggacauccuggcgaagacguucgccuga

SEQ ID NO: 29170 - RNA, 2388 nt, Artificial Sequence
  derived and/or modified sequence opt1 from DHX15__Homo_sapiens__NP_001349
augagcaagcgccaccggcuggaccucggcgaggacuaccccuccgggaagaagcgcgccggcaccgacgggaaggaccgggaccgcgaccgggaccgcgaggaccggagcaaggaccgcgaccgggagcgcgaccggggcgaccgcgagcgggagcgcgagaaggagaaggagaaggagcugcgggccuccaccaacgcgaugcugaucagcgccgggcucccgccccugaaggccucccacagcgcccacuccacgcacagcgcccacuccacccacagcacccacuccgcgcacagcacccacgccggccacgccggccacacgucccugccccagugcaucaaccccuucaccaaccucccgcacacgccccgcuacuacgacauccugaagaagcggcugcagcuccccgugugggaguacaaggaccgcuucaccgacauccugguccggcaccagagcuucgugcuggugggggagaccggcuccgggaagaccacccagaucccccaguggugcgucgaguacaugcgcagccucccgggccccaagcgcgggguggccugcacccagccccgccgcguggcggccauguccgucgcccagcggguggccgacgagauggacgugaugcugggccaggaggucggcuacagcauccgcuucgaggacugcuccagcgccaagacgauccugaaguacaugaccgacgggaugcuccugcgggaggcgaugaacgacccccugcucgagcgcuacggcgugaucauccuggacgaggcccacgagcggacccuggccaccgacauccucaugggggugcugaaggaggucgugcgccagcggagcgaccugaaggugaucgucauguccgccacgcucgacgccggcaaguuccagaucuacuucgacaacugcccgcugcugaccauccccggccgcacccaccccguggagaucuucuacacccccgagccggagcgggacuaccucgaggcggccauccgcacggugauccagauccacaugugcgaggaggaggagggggaccugcuccuguuccugaccggccaggaggagaucgacgaggccugcaagcggaucaagcgcgaggucgacgaccuggggcccgaggugggcgacaucaagaucaucccccucuacagcacccugcccccgcagcagcagcagcggaucuucgagcccccgccgcccaagaagcagaacggggccaucggccgcaagguggucguguccaccaacaucgccgagacgagccugaccaucgacggcguggucuucgugaucgaccccggguucgcgaagcagaaggucuacaacccccggauccgcguggagucccuccuggugaccgccaucagcaaggccuccgcccagcagcgggccggccgcgcggggcggacccgccccggcaagugcuuccgccuguacacggagaaggccuacaagaccgagaugcaggacaacaccuaccccgagauccuccggagcaaccugggguccgucgugcugcagcucaagaagcugggcaucgacgaccuggugcacuucgacuucauggacccgcccgcccccgagacccucaugcgcgcccuggagcugcucaacuaccuggcggcccugaacgacgacggcgaccugacggagcucgggagcaugauggccgaguucccccuggacccccagcuggccaagauggucaucgccuccugcgacuacaacugcagcaacgaggugcucuccaucaccgcgaugcugagcgugccccagugcuucguccggccgaccgaggccaagaaggccgccgacgaggccaagaugcgcuucgcgcacaucgacggcgaccaccugacccuccugaacguguaccacgccuucaagcagaaccacgaguccgugcaguggugcuacgacaacuucaucaacuaccggagccugauguccgccgacaacguccgccagcagcucagccggaucauggaccgcuucaaccugccccggcgcuccacggacuucaccagccgggacuacuacaucaacauccgcaaggcccuggugaccggguacuucaugcaggucgcccaccucgagcggaccggccacuaccugaccgugaaggacaaccagguggugcagcugcaccccagcacgguccucgaccacaagcccgagugggugcuguacaacgaguucgugcugaccaccaagaacuacauccggaccugcacggacaucaagccggaguggcucgucaagaucgcgccccaguacuacgacauguccaacuucccccagugcgaggccaagcggcagcuggaccgcaucaucgccaagcugcagagcaaggaguacucccaguacuga

SEQ ID NO: 29171 - RNA, 2946 nt, Artificial Sequence
  derived and/or modified sequence opt1 from DHX16__Homo_sapiens__NP_001157711
augagcgaggacccccgcggcccgaaggugccccggaaggccgucguggagaagcccgcccgcgcggccgagcgggaggcccgcgcccugcucgagaagaaccgguccuaccgccugcuggaggacagcgaggaguccagcgaggagaccgugucccgggccgggagcucccuccagaagaagcgcaagaagcggaagcaccuccgcaagaagcgggaggaggaggaggaggaggaggcgagcgagaagggcaagaagaagaccgggggcuccaagcagcagacggagaagcccgagagcgaggacgagugggagcgcaccgagcgggagcgccugcaggaccuggaggagcgggacgccuucgccgagcgcguccggcagcgcgacaaggaccggacccgcaacgugcuggagcgguccgacaagaaggccuacgaggaggcgcagaagcgccugaagauggccgaggaggaccgcaaggccauggugccggagcuccggaagaagucccgccgggaguaccuggccaagcgcgagcgggagaagcuggaggaccucgaggccgagcuggcggacgaggaguuccuguucggggacgucgagcucagccgccacgagcggcaggagcugaaguacaagcgccgggugcgcgaccuggcccgggaguaccgcgccgccggcgagcaggagaagcucgaggccaccaaccgguaccacaugcccaaggagacgcgcggccagcccgcgcgggccguggaccuggucgaggaggagagcggggcccccggcgaggagcagcgccggugggaggaggcccgccugggggccgcgucccucaaguucggcgcccgggacgccgccagccaggagccgaaguaccagcuggugcuggaggaggaggagaccaucgaguucgugcgcgccacccagcuccagggggacgaggagcccuccgcgccgcccaccagcacgcaggcccagcagaaggaguccauccaggccguccgccggagccugcccguguuccccuuccgcgaggagcugcucgccgcgaucgccaaccaccaggugcugaucaucgagggcgagaccggcagcgggaagaccacccagaucccccaguaccuguucgaggagggcuacacgaacaaggggaugaagaucgccugcacccagccccggcgcgucgccgccauguccguggcggcccggguggcccgcgagaugggcgucaagcucggcaacgaggugggguacagcauccgguucgaggacugcaccuccgagcgcaccgugcugcgguacaugacggacggcaugcugcuccgcgaguuccugagcgagccggaccuggccuccuacagcgucgugaugguggacgaggcccacgagcggacccuccacaccgacauccuguucgggcugaucaaggacgucgcgcgcuuccggcccgagcucaaggugcuggucgccuccgccaccauggacacggcccgcuucagcaccuucuucgacgacgcccccguguuccggauccccggccgccgguucccgguggacaucuucuacaccaaggcgcccgaggccgacuaccuggaggccugcgucguguccgugcuccagauccacgucacccagccgcccggggacauccugguguuccugacgggccaggaggagaucgaggccgcgugcgagaugcuccaggaccgcugccggcgccugggcagcaagauccgggagcugcucgugcugcccaucuacgccaaccugcccuccgacaugcaggcccgcaucuuccagcccacgcccccgggggcccgcaaggucgugguggccaccaacaucgcggagaccagccugaccaucgagggcaucaucuacguccucgaccccggguucugcaagcagaaguccuacaacccccggaccggcauggagagccugaccgugaccccgugcuccaaggccagcgccaaccagcgcgccgggcgggccggccgcguggcggccggcaagugcuuccggcuguacacggccugggccuaccagcacgagcucgaggagaccaccguccccgagauccagcgcaccucccuggggaacguggugcugcuccucaagagccugggcauccacgaccugaugcacuucgacuuccuggacccgccgcccuacgagacgcugcuccuggcccuggagcagcucuacgcgcugggggcccugaaccaccucggcgagcugaccaccuccgggcggaagauggccgagcugcccgucgaccccaugcucagcaagaugauccuggccagcgagaaguacuccugcagcgaggagauccugaccguggcggccaugcucuccgugaacaacagcaucuucuaccgccccaaggacaaggucgugcacgccgacaacgcccgggugaacuucuuccugcccggcggcgaccaccugguccuccugaacguguacacccagugggccgaguccggguacagcucccaguggugcuacgagaacuucgugcaguuccgcagcaugcggcgcgcgcgggacguccgcgagcagcuggagggccuccuggagcggguggagguggggcuguccagcugccagggcgacuacauccgcguccggaaggccaucacggccggcuacuucuaccacaccgcccgccucacccgguccggguaccgcaccgugaagcagcagcagacgguguucauccaccccaacagcucccuguucgagcagcagccccgcuggcugcucuaccacgagcugguccugaccaccaaggaguucaugcgccaggugcucgagaucgagagcuccuggcugcuggagguggcgccccacuacuacaaggccaaggagcucgaggacccgcacgccaagaagaugcccaagaagaucggcaagacccgggaggagcugggguga

SEQ ID NO: 29172 - RNA, 2232 nt, Artificial Sequence
  derived and/or modified sequence opt1 from DHX32__Homo_sapiens__NP_060650
auggaggaggagggccuggagugccccaacagcuccagcgagaagcgcuacuucccggagucccucgacagcuccgacggggacgaggaggaggugcuggccugcgaggaccuggagcucaaccccuucgacggccugcccuacagcucccgguacuacaagcugcucaaggagcgcgaggaccugcccaucuggaaggagaaguacagcuucauggagaaccugcuccagaaccagaucgucaucguguccggggacgccaagugcggcaagagcgcccaggugccgcaguggugcgcggaguacugccuguccauccacuaccagcacgggggcgucaucugcacccaggugcacaagcagaccgugguccagcuggcccuccggguggccgacgagauggacgugaacaucggccacgaggucggguacgugauccccuucgagaacugcugcacgaacgagaccauccugcgcuacugcaccgacgacaugcugcagcgggagaugaugagcaaccccuuccucggcuccuacggggugaucauccuggacgacauccacgagcgcagcaucgccaccgacguccugcucggccugcugaaggacgugcuccuggcgcggcccgagcugaagcucaucaucaacuccagcccgcaccugaucuccaagcugaacagcuacuacgggaacgugcccgucaucgaggugaagaacaagcaccccguggaggucguguaccucuccgaggcccagaaggacagcuucgagagcauccugcgccugaucuucgagauccaccacuccggcgagaagggcgacaucguggucuuccucgccugcgagcaggacaucgagaaggugugcgagacgguguaccaggggagcaaccugaaccccgaccugggcgagcucgucguggucccgcuguaccccaaggagaagugcucccuguucaagccccucgacgagaccgagaagcggugccagguguaccagcgccgggugguccugaccaccagcuccggggaguuccugaucuggagcaacuccgugcgcuucgugaucgacgucggcguggagcggcgcaagguguacaacccccggauccgcgccaacagccucgucaugcagccgaucucccagagccaggcggagauccggaagcagauccugggcuccagcuccagcgggaaguucuucugccuguacacggaggaguucgccuccaaggacaugacgccccucaagcccgccgagaugcaggaggccaaccugaccagcauggugcuguucaugaagcgcaucgacaucgccggccucgggcacugcgacuucaugaaccggcccgcgccggagucccugaugcaggcccuggaggaccucgacuaccuggccgcccuggacaacgacggcaaccugagcgaguucgggaucaucauguccgaguucccccucgacccccagcugagcaagagcauccuggccuccugcgaguucgacugcguggacgagguccucaccaucgcggccauggugaccgcccccaacugcuucagccacgugccgcacggcgccgaggaggccgcgcugaccugcuggaagaccuuccugcaccccgagggcgaccacuucacccucaucuccaucuacaaggccuaccaggacacgacccugaacagcuccagcgaguacugcgucgagaaguggugccgcgacuacuuccugaacugcuccgcccuccggauggccgacgugauccgcgccgagcugcuggagaucaucaagcgcaucgagcuccccuacgcggagcccgccuucgggagcaaggagaacacccugaacaucaagaaggcccugcucuccggcuacuucaugcagaucgcccgggacguggacgggagcggcaacuaccugaugcugacccacaagcaggucgcgcagcuccacccgcuguccggguacagcaucacgaagaagaugcccgagugggugcuguuccacaaguucuccaucagcgagaacaacuacauccgcaucaccuccgagaucagccccgagcuguucaugcagcucgugccgcaguacuacuucuccaaccugccgcccagcgagagcaaggacauccuccagcaggucguggaccaccugucccccgugagcaccaugaacaaggagcagcagaugugcgagaccugccccgagacggagcagcggugcacccugcaguga

SEQ ID NO: 29173 - RNA, 3432 nt, Artificial Sequence
  derived and/or modified sequence opt1 from DHX34__Homo_sapiens__NP_055496
augcccccgccccgcacccgggagggccgcgaccggcgcgaccaccaccgggcccccagcgaggaggaggcccuggagaagugggacuggaacugccccgagacccgccggcuccuggaggacgcguucuuccgcgaggaggacuacauccggcagggguccgaggagugccagaaguucuggaccuucuucgagcgccugcagcgguuccagaaccucaagaccagccgcaaggaggagaaggacccgggccagcccaagcacuccauccccgcccuggccgaccugccccggaccuacgacccgcgcuaccggaucaaccucagcgugcuggggcccgccacccgcggcucccaggggcugggccggcaccuccccgccgagcgcgucgcggaguuccggcgcgcccugcugcacuaccucgacuucggccagaagcaggccuucgggcggcuggccaagcugcagcgcgagcgcgcggcccuccccaucgcccaguacggcaaccggauccugcagacgcugaaggagcaccaggugguggucguggccggggacaccggcugcggcaagagcacccaggugccgcaguaccuccuggccgcgggcuucucccacgucgccugcacccagccccgccggaucgccugcaucagccuggccaagcgcgugggcuucgagucccucagccaguacgggucccaggugggcuaccagauccgguucgagagcacgcgcuccgccgcgaccaagaucgucuuccugaccguggggcugcuccugcggcagauccagcgcgagcccagccugccccaguacgaggugcucaucgucgacgaggugcacgagcggcaccuccacaacgacuuccugcucggcgugcugcagcgccugcucccgacccggcccgaccugaaggucauccugauguccgccacgaucaacaucagccucuucuccagcuacuucuccaacgcccccguggugcagguccccggccgccuguucccgaucaccgugguguaccagccccaggaggccgagcccaccaccagcaagagcgagaagcuggacccccggccguuccuccgcguccuggaguccaucgaccacaaguacccgcccgaggagcgcggggaccugcucguguuccugagcgggauggccgagaucuccgcggugcuggaggccgcccagacguacgccagccacacccagcggugggucgugcugccccugcacuccgcccugagcgucgcggaccaggacaagguguucgacguggccccgcccgggguccggaagugcauccucuccaccaacaucgccgagaccagcgugacgaucgacggcauccgcuucguggucgacuccgggaaggugaaggagaugagcuacgacccccaggccaagcugcagcggcugcaggaguucuggaucucccaggcgagcgccgagcagcgcaagggccgcgccggccggaccgggccgggcgugugcuuccgccuguacgccgaguccgacuacgacgccuucgcgcccuaccccguccccgagauccggcgcguggcccucgacagccuggugcugcagaugaaguccaugagcgucggggacccgcggaccuuccccuucaucgagccgccgccgcccgccucccucgagaccgccauccuguaccugcgcgaccagggcgcccucgacagcuccgaggcgcugacgcccaucgggagccugcucgcccagcugcccguggacguggucaucggcaagaugcugauccucggcagcauguucucccugguggagcccgugcugaccaucgccgccgcccucagcguccagucccccuucacccggagcgcgcaguccagccccgagugcgccgccgcccgccggccccuggaguccgaccagggggaccccuucacccuguucaacguguucaacgcgugggugcaggucaagagcgagcgcucccggaacagccgcaaguggugccggcgccggggcaucgaggagcaccgccucuacgagauggccaaccugcggcgccaguucaaggagcugcucgaggaccacgggcugcuggccggcgcccaggccgcccaggugggggacuccuacagccggcuccagcagcgccgggagcgccgcgcgcugcaccagcugaagcggcagcacgaggagggcgccggccgccggcgcaaggugcuccggcugcaggaggagcaggacgggggcuccagcgacgaggaccgcgccgggcccgccccgcccggcgcguccgacggcgucgacauccaggacgugaaguucaagcugcggcacgaccucgcccagcugcaggccgccgccagcuccgcgcaggaccugagccgcgagcagcucgcccugcugaagcucgugcuggggcggggccuguacccccagcucgccguccccgacgccuucaacagcucccgcaaggacagcgaccagaucuuccacacgcaggcgaagcagggggccgugcugcacccgaccugcguguucgccggcucccccgagguccugcacgcccaggagcucgaggccagcaacugcgacgggucccgggacgacaaggacaagaugagcuccaagcaccagcugcugagcuucgugucccuccuggagaccaacaagcccuaccuggugaacugcguccgcauccccgcgcuccagagccugcuccuguucucccggagccuggacaccaacggcgacugcucccgccugguggccgacggcuggcucgagcugcagcuggccgacagcgaguccgccauccggcuccuggccgcgagccugcgccuccgggcccgcugggaguccgcccuggaccggcagcuggcccaccaggcccagcagcagcucgaggaggaggaggaggacacgcccgugagccccaaggaggucgcgacccuguccaaggagcugcuccaguucaccgccagcaagauccccuacagccugcgccgccugaccgggcucgaggugcagaacauguacgugggcccccagacgauccccgccaccccgcaccuccccgggcuguucggcuccagcacccugagcccccaccccaccaagggcggguacgccgucaccgacuuccugacguacaacugccugaccaacgacaccgaccucuacuccgacugccugcggaccuucuggacgugcccgcacugcggccugcacgcgccccucacgccccuggagcgcaucgcccacgagaacacgugcccccaggccccgcaggacgggccgcccggcgccgaggaggccgcgcuggagacccuccagaagaccuccgugcugcagcggcccuaccacugcgaggccugcgggaaggacuuccuguucacccccaccgaggugcuccgccaccggaagcagcacgucuga

SEQ ID NO: 29174 - RNA, 2985 nt, Artificial Sequence
  derived and/or modified sequence opt1 from DHX36__Homo_sapiens__NP_001107869
augagcuacgacuaccaccagaacuggggccgcgacgggggcccccgguccagcgggggcggguacggcggcgggccggccggcgggcacggcgggaaccgcggcuccggcgggggcgggggcggcgggggcgggggccgcgggggccggggccggcaccccgggcaccugaagggccgcgagaucgggaugugguacgccaagaagcagggccagaagaacaaggaggcggagcggcaggagcgcgccgugguccacauggacgagcggcgcgaggagcagaucgugcagcuccugaacagcgugcaggccaagaacgacaaggaguccgaggcccagaucagcugguucgcccccgaggaccacggguacggcaccgaggucuccaccaagaacacccccugcagcgagaacaagcuggacauccaggagaagaagcucaucaaccaggagaagaagauguuccggauccgcaaccgguccuacaucgaccgcgacagcgaguaccugcugcaggagaacgagccggacggcacccucgaccagaagcugcuggaggaccuccagaagaagaagaacgaccugcgguacaucgagaugcagcacuuccgcgagaagcugcccuccuacgggaugcagaaggagcucgugaaccugaucgacaaccaccaggugaccgucaucagcggcgagaccgggugcggcaagacgacccaggugacccaguucauccuggacaacuacaucgagcgggggaagggcuccgcgugccgcaucgugugcacccagccccggcgcaucagcgccaucuccgucgccgagcggguggccgcggagcgcgccgagagcugcggcuccgggaacagcacgggcuaccagauccgccuccagucccggcugccccgcaagcaggggagcauccuguacugcaccaccggcaucauccuccaguggcugcagagcgacccguaccuguccagcgugucccacaucguccucgacgagauccacgagcggaaccugcagagcgacgugcugaugaccguggucaaggaccuccugaacuuccgcuccgaccugaaggugauccucaugagcgccacgcugaacgccgagaaguucuccgaguacuucggcaacugccccaugauccacauccccggguucaccuuccccguggucgaguaccugcucgaggacgugaucgagaagauccgguacgugccggagcagaaggagcaccgcagccaguucaagcggggcuucaugcaggggcacgucaaccgccaggagaaggaggagaaggaggccaucuacaaggagcgguggcccgacuacgugcgcgagcugcggcgccgguacuccgcgagcaccguggacgucaucgagaugauggaggacgacaagguggaccugaaccucaucgucgcccugauccgcuacaucgugcuggaggaggaggacggcgccauccucguguuccugcccgggugggacaacaucuccacccugcacgaccuccugaugagccaggucauguucaaguccgugaaccagacccagguguucaagcggacgcccccgggcguccgcaagaucgugaucgccaccaacaucgccgagaccagcaucacgaucgacgacguggucuacgugaucgacggcgggaagaucaaggagacccacuucgacacccagaacaacaucuccaccaugagcgcggaguggguguccaaggccaacgccaagcagcggaagggccgcgccgggcggguccagcccggccacugcuaccaccuguacaacgggcuccgcgccagccugcuggacgacuaccagcuccccgagauccugcgcacgccccuggaggagcucugccugcagaucaagauccugcggcugggcggcaucgcguacuuccucucccgccugauggacccgcccagcaacgaggccgugcugcucagcauccggcaccugauggagcugaacgcccucgacaagcaggaggagcugacgccccugggggugcaccucgcccgccugcccgucgagccgcacaucggcaagaugauccuguucggggcccucuucugcugccuggaccccgugcugaccaucgcggccucccucagcuucaaggaccccuucgugaucccccugggcaaggagaagaucgccgacgcccggcgcaaggagcuggcgaaggacacccgguccgaccaccucaccgucgugaacgccuucgaggggugggaggaggcccgccggcgcggcuuccgguacgagaaggacuacugcugggaguacuuccugagcuccaacacccugcagaugcuccacaacaugaagggccaguucgccgagcaccuccugggggccggcuucgugagcucccgcaacccgaaggaccccgagagcaacaucaacuccgacaacgagaagaucaucaaggcggucaucugcgccgggcuguaccccaagguggccaagauccggcugaaccugggcaagaagcgcaagauggugaaggucuacaccaagaccgacgggcucguggccgugcaccccaagagcgucaacguggagcagacggacuuccacuacaacuggcugaucuaccaccugaagaugcggaccuccagcaucuaccucuacgacugcaccgaggugucccccuacugccugcuguucuucggcggcgacaucagcauccagaaggacaacgaccaggagaccaucgccgucgacgaguggaucguguuccagucccccgcgcgcaucgcccaccucgugaaggagcugcggaaggagcuggacauccuccugcaggagaagaucgagagcccccacccggucgacuggaacgacacgaagucccgcgacugcgccgugcugagcgccaucaucgaccucaucaagacccaggagaaggccacgccccggaacuucccgccccgcuuccaggacggguacuacagcuga

SEQ ID NO: 29175 - RNA, 3684 nt, Artificial Sequence
  derived and/or modified sequence opt1 from DHX38__Homo_sapiens__NP_054722
augggcgacaccagcgaggacgccuccauccaccgccuggaggggaccgaccucgacugccaggugggcgggcugaucugcaagagcaaguccgccgcgagcgagcagcacgucuucaaggcccccgccccgcggcccucccugcucggccuggaccugcucgccagccugaagcgccgggagcgcgaggagaaggacgacggggaggacaagaagaaguccaaggugagcuccuacaaggacugggaggagagcaaggacgaccagaaggacgccgaggaggagggcggcgaccaggcggggcagaacauccggaaggaccgccacuaccgguccgcccgcguggagacgcccagccaccccggcggggucuccgaggaguucugggagcggagccgccagcgggagcgcgagcggcgcgagcacggcguguacgccuccagcaaggaggagaaggacuggaagaaggagaagucccgggaccgcgacuacgaccggaagcgcgaccgggacgagcgcgaccggagccgccacuccagccgcagcgagcgggacgggggcuccgagcgcagcucccggcgcaacgagccggagagcccccggcaccgccccaaggacgccgcgacccccucccggagcaccugggaggaggaggacuccggcuacgggagcucccgccggagccagugggaguccccgagccccacccccuccuaccgcgacagcgagcggucccaccgccugagcacgcgggaccgcgaccgguccgugcgcggcaaguacagcgacgacacgccccucccgacccccuccuacaaguacaacgagugggccgacgaccggcgccaccuggggagcacgccccggcugagccgcggccgcggccggcgcgaggagggggaggagggcaucuccuucgacaccgaggaggagcggcagcagugggaggacgaccagcgccaggccgaccgggacugguacaugauggacgagggguacgacgaguuccacaacccccucgccuacagcuccgaggacuacguccgccggcgcgagcagcaccuccacaagcagaagcagaagcggaucagcgcccagcgccggcagaucaacgaggacaacgagcgcugggagaccaaccggaugcugaccuccggcguggugcaccgccuggaggucgacgaggacuucgaggaggacaacgcggccaaggugcaccugauggugcacaaccuggucccgcccuuccucgacgggcggaucguguucaccaagcagcccgagcccgugaucccggucaaggacgccaccagcgaccuggccaucaucgcccgcaagggcucccagaccgugcggaagcaccgcgagcagaaggagcggaagaaggcgcagcacaagcacugggagcuggccggcaccaagcucggggacaucaugggcgugaagaaggaggaggagcccgacaaggccgucaccgaggacgggaagguggacuaccgcacggagcagaaguucgccgaccacaugaagcgcaagagcgaggccuccagcgaguucgcgaagaagaaguccauccuggagcagcggcaguaccugcccaucuucgccgugcagcaggagcuccugaccaucauccgcgacaacagcaucgucaucguggugggcgagaccggguccggcaagaccacgcagcugacccaguaccuccacgaggacggcuacaccgacuacgggaugaucggcugcacccagccccggcgcgucgccgccaugagcguggccaagcgggucuccgaggagaugggcgggaaccugggggaggaggugggcuacgcgauccgcuucgaggacugcacgagcgagaacacccugaucaaguacaugaccgacggcauccuccugcgggagucccugcgcgaggccgaccucgaccacuacagcgccaucaucauggacgaggcccacgagcggagccugaacaccgacgugcuguucgggcuccugcgcgaggucguggcgcggcgcuccgaccugaagcucaucgugacgagcgccaccauggacgccgagaaguucgccgccuucuucggcaacgucccgaucuuccacauccccgggcggaccuuccccguggacauccuguucuccaagacgccccaggaggacuacguggaggcggccgucaagcagagccuccaggugcaccuguccggcgccccgggcgacauccugaucuucaugcccgggcaggaggacaucgaggugaccagcgaccagaucgucgagcaccuggaggagcucgagaacgcccccgcccuggcggugcugccgaucuacucccagcuccccagcgaccugcaggccaagaucuuccagaaggcccccgacggcgugcgcaagugcaucgucgccaccaacaucgccgagaccucccugaccguggacgggaucauguucgugaucgacagcggcuacugcaagcugaaggucuucaacccccggaucgggauggacgcgcuccagaucuacccgaucucccaggccaacgccaaccagcgcagcggccgggccggccgcacggggcccggccagugcuuccggcuguacacccaguccgcguacaagaacgagcugcucaccaccaccgugcccgagauccagcgcacgaaccuggccaacgugguccugcuccucaagagccugggggugcaggaccugcugcaguuccacuucauggacccgccgcccgaggacaacaugcugaacuccauguaccagcucuggauccugggcgcccuggacaacaccgggggccucaccagcaccggccggcugaugguggaguucccccuggaccccgcccucuccaagaugcugaucgucagcugcgacauggggugcuccagcgagauccugcucaucgugagcaugcuguccgugcccgccaucuucuaccgccccaagggccgcgaggaggagagcgaccagauccgggagaaguucgcgguccccgaguccgaccaccugacguaccucaacguguaccugcaguggaagaacaacaacuacagcaccaucuggugcaacgaccacuucauccacgccaaggccaugcgcaaggugcgggagguccgcgcccagcugaaggacaucauggugcagcagcggaugucccucgccagcugcgggaccgacugggacaucgugcgcaagugcaucugcgcggccuacuuccaccaggccgccaagcugaagggcaucggggaguacgucaacauccggaccggcaugcccugccaccuccacccgacguccagccuguucggcaugggguacacccccgacuacaucguguaccacgagcuggugaugaccaccaaggaguacaugcagugcgucacggccguggacggcgaguggcuggcggagcucgggcccauguucuacuccgugaagcaggccggcaagagccgccaggagaaccggcgccgggccaaggaggaggccuccgcgauggaggaggagauggcccuggccgaggagcagcugcgcgcccggcgccaggagcaggagaagcggagcccccucggguccguccgcagcaccaagaucuacaccccgggccggaaggagcagggcgagcccaugacgccccgccggacccccgcccgcuucgggcuguga

SEQ ID NO: 29176 - RNA, 2109 nt, Artificial Sequence
  derived and/or modified sequence opt1 from DHX40__Homo_sapiens__NP_001159773
augagccgcuuccccgccguggccggccgggcgccgcgccggcaggaggagggggagcgcucccgggaccugcaggaggagcgccucagcgccgucugcaucgccgaccgggaggagaagggcugcaccucccaggagggcgggaccacgcccaccuuccccauccagaagcagcgcaagaagaucauccaggccgagaccgccaucaaguacaugaccgacgggugccugcugaagcacauccucggcgaccccaaccugacgaaguucagcgugaucauccuggacgaggcgcacgagcggacccucaccaccgacauccuguucggccugcucaagaagcuguuccaggagaaguccccgaaccgcaaggagcaccugaagguggucgugaugagcgccacgauggagcucgccaagcuguccgccuucuucgggaacugccccaucuucgacauccccggccggcuguaccccgugcgcgagaaguucugcaaccucaucgggccgcgggaccgcgagaacaccgcguacauccaggccaucgucaaggugaccauggacauccaccugaacgagauggccggcgacauccugguguuccucaccgggcaguucgagaucgagaaguccugcgagcugcuguuccagauggccgagagcgucgacuacgacuacgacgugcaggacacgacccucgacggccugcugauccuccccugcuacggcagcaugaccaccgaccagcagcggcgcaucuuccugccgccgccgcccgggauccggaagugcgugaucuccacgaacaucagcgccaccucccugaccaucgacggcauccgcuacgucguggacgggggcuucgugaagcagcucaaccacaacccccggcugggccuggacauccucgaggucgugcccaucagcaaguccgaggcgcugcagcgcagcgggcgggccggccgcaccuccagcgggaagugcuuccgcaucuacuccaaggacuucuggaaccagugcaugcccgaccacgugauccccgagaucaagcggacgagccugaccagcgucgugcucacccugaagugccuggccauccacgacgugauccgcuuccccuaccucgacccgcccaacgagcggcugauccuggaggcccucaagcagcuguaccagugcgacgccaucgaccgcuccggccacgucacccggcuggggcucagcaugguggaguucccccugccgccccaccugacgugcgcggugaucaaggccgccucccucgacugcgaggaccugcugcuccccaucgccgccaugcugagcgucgagaacguguucauccgccccgucgaccccgaguaccagaaggaggcggagcagcggcaccgcgagcuggccgccaaggccggcggcuucaacgacuucgccacccuggcggugaucuucgagcagugcaaguccagcggggcccccgccuccuggugccagaagcacuggauccacuggcggugccucuucagcgccuuccgcguggaggcgcagcugcgggagcugauccgcaagcucaagcagcaguccgacuuccccaaggagaccuucgagggccccaagcacgagguccugcggcgcugccugugcgccggguacuucaagaacguggcccggcgcagcgugggccggaccuucugcacgauggacgggcgcggcucccccguccacauccacccgagcuccgcccuccacgagcaggagaccaagcuggaguggaucaucuuccacgaggugcuggugaccaccaaggucuacgcccggaucgugugccccauccgcuacgagugggugcgcgaccuccugcccaagcugcacgaguucaacgcgcacgaccucagcuccgucgcccggcgcgaggugcgggaggacgcccgccggcgcuggacgaacaaggagaacgugaagcagcugaaggacggcaucagcaaggacguccugaagaagaugcagcggcgcaacgacgacaaguccaucagcgacgcccgggcccgcuuccucgagcggaagcagcagcgcacccaggaccacuccgacacccggaaggagaccggguga

SEQ ID NO: 29177 - RNA, 2037 nt, Artificial Sequence
  derived and/or modified sequence opt1 from DHX58__Homo_sapiens__NP_077024
auggagcugcgcagcuaccagugggaggugaucaugcccgcccucgagggcaagaacaucaucaucuggcugccgaccggggccggcaagacccgggcggccgccuacgucgccaagcgccaccuggagacgguggacggggccaagguggucgugcucgugaaccggguccaccuggugacccagcacggcgaggaguuccgccggaugcuggacgggcgcuggaccgugaccacgcucuccggcgacaugggcccccgggcgggguucggccaccuggcccgcugccacgaccugcucaucugcaccgccgagcugcugcagauggcccucaccagccccgaggaggaggagcacgucgagcugaccguguucucccugaucguggucgacgagugccaccacacgcacaaggacaccguguacaacgugaucaugagccaguaccucgagcugaagcugcagcgggcgcagccccucccgcagguccuggggcugaccgccucccccggcaccgggggcgccagcaagcucgacggcgccaucaaccacgugcugcagcugugcgccaaccucgacacguggugcaucaugagcccccagaacugcugcccccagcugcaggagcacucccagcagccgugcaagcaguacaaccugugccaccgccggucccaggaccccuucggggaccuccugaagaagcugauggaccagauccacgaccaccucgagaugcccgagcugagccgcaaguucggcacccagauguacgagcagcaggucgugaagcuguccgaggcggccgcccucgccgggcugcaggagcagcggguguacgcccugcaccuccgccgguacaacgacgcgcugcugauccacgacaccgugcgcgccgucgacgcccucgccgcccugcaggacuucuaccaccgggagcacgugaccaagacgcagauccugugcgcggagcgccggcuccuggcccuguucgacgaccgcaagaacgagcucgcccaccuggccacccacggccccgagaacccgaagcuggagaugcucgagaagauccugcagcggcaguucagcuccagcaacagcccccgcggcaucaucuucacccgcacccggcaguccgcccacucccugcugcucuggcugcagcagcagcaggggcugcagacgguggacauccgcgcgcagcuccugaucggcgccgggaacagcucccagagcacccacaugacccagcgggaccagcaggaggucauccagaaguuccaggacggcacccugaaccuccugguggccacgagcgucgccgaggaggggcuggacaucccccacugcaacguggugguccgcuacggccuccugaccaacgagaucuccauggugcaggcgcggggccgcgcccgggccgaccagagcguguacgccuucgucgccaccgaggggucccgcgagcugaagcgggagcucaucaacgaggcgcuggagacccugauggagcaggccguggccgccgugcagaagauggaccaggccgaguaccaggcgaagauccgcgaccuccagcaggccgcccugacgaagcgggccgcccaggcggcccagcgcgagaaccagcggcagcaguuccccgucgagcacgugcagcugcucugcaucaacugcaugguggccgucggccacgggagcgaccugcgcaagguggagggcacccaccacgugaacgucaacccgaacuucuccaacuacuacaacgugagccgggaccccguggucaucaacaagguguucaaggacuggaagcccgggggcgugaucuccugccgcaacugcggcgaggucugggggcugcagaugaucuacaagagcgugaagcuccccgugcugaagguccgguccaugcugcucgagaccccgcagggccgcauccaggccaagaaguggagccgggugcccuucuccgugcccgacuucgacuuccugcagcacugcgcggagaaccugagcgaccucucccuggacuga

SEQ ID NO: 29178 - RNA, 3546 nt, Artificial Sequence
  derived and/or modified sequence opt1 from DHX8__Homo_sapiens__NP_001289552
auggccguggccgucgcgauggccggcgcccugaucgggagcgagcccggcccggccgaggagcucgccaagcuggaguaccugucccucgugagcaaggugugcaccgagcuggacaaccaccuggggaucaacgacaaggaccucgcggaguucgucaucucccuggccgagaagaacaccacguucgacaccuucaaggccagccuggugaagaacggcgccgaguucaccgacucccucaucagcaaccugcugcgccucauccagaccaugcggccgcccgcgaagcccuccacgagcaaggaccccguggucaagcccaagaccgagaaggagaagcugaaggagcuguuccccgugcucugccagcccgacaacccguccgugcgcaccaugcuggacgaggacgacgucaagguggccguggacguccugaaggagcucgaggcccugaugcccagcgccgccgggcaggagaagcagcgggacgcggagcaccgcgaccggaccaagaagaagaagcgcucccggagccgcgaccggaaccgcgaccgggaccgcgaccgggagcgcaaccgggaccgcgaccacaagcggcgccaccggucccgcagccggucccgcagccgcacgcgggagcgcaacaaggugaagucccgguaccgcagccggucccgcagccagagcccgcccaaggaccggaaggaccgcgacaaguacggcgagcggaaccuggaccgcuggcgggacaagcacguggaccggcccccgcccgaggagcccaccaucggcgacaucuacaacgggaaggucaccuccaucaugcaguucggcugcuucgugcagcucgaggggcugcgcaagcgcugggagggccuggugcacaucagcgagcuccggcgcgaggggcgggucgccaacguggccgacguggucuccaagggccagcgcgugaaggugaagguccugagcuucaccggcacgaagaccucccugagcaugaaggacguggaccaggagaccggggaggaccucaaccccaaccggcgccgcaaccuggucggcgagaccaacgaggagacguccaugcggaaccccgaccgccccacccaccugagccucguguccgcccccgagguggaggacgacagccuggagcggaagcgccugacccggaucuccgacccggagaagugggagaucaagcagaugaucgccgcgaacguccucagcaaggaggaguuccccgacuucgacgaggagaccgggauccugcccaagguggacgacgaggaggacgaggaccuggagaucgagcucguggaggaggagcccccguuccugcgcggccacacgaagcaguccauggacaugagccccaucaagaucgucaagaaccccgacggcucccugagccaggccgccaugaugcaguccgcccucgccaaggagcggcgcgagcugaagcaggcgcagcgggaggccgagauggacagcauccccauggggcugaacaagcacuggguggacccgcuccccgacgccgagggccgccagaucgccgccaacaugcgggggaucggcaugaugcccaacgacaucccggaguggaagaagcacgcguucgggggcaacaaggccuccuacggcaagaagacccagaugagcauccuggagcagcgcgagagccugcccaucuacaagcucaaggagcagcuggugcaggccguccacgacaaccagauccugaucgugaucggggagaccggcuccgggaagaccacgcagaucacccaguaccucgccgaggcgggcuacaccagccgggggaagaucggcugcacccagccccgccggguggccgccauguccgucgccaagcgcgugagcgaggaguucggcugcugccuggggcaggaggugggcuacacgauccgguucgaggacugcaccucccccgagaccgucaucaaguacaugaccgacgggaugcugcugcgcgagugccucaucgacccggaccugacgcaguacgccaucaucaugcuggacgaggcgcacgagcggaccauccacaccgacguccucuucggccugcugaagaagaccgugcagaagcgccaggacaugaagcucaucgugacgagcgccacccuggacgccgugaaguucucccaguacuucuacgaggcccccaucuucaccauccccgggcggaccuaccccguggagauccuguacaccaaggagccggagacggacuaccucgacgccagccugaucaccgucaugcagauccaccugaccgagccgcccggcgacauccucguguuccugaccggccaggaggagaucgacacggcgugcgagauccuguacgagcgcaugaagucccucgggcccgacgugcccgagcugaucauccugcccgucuacagcgcccuccccuccgagaugcagacccgcaucuucgaccccgccccgcccggcagccggaagguggugaucgccaccaacaucgccgagaccucccugacgaucgacgggaucuacuacgucguggaccccggcuucgugaagcagaaggucuacaacagcaagaccggcaucgaccagcugguggugacccccaucucccaggcgcaggccaagcagcgcgccgggcgggccggccgcaccgggccgggcaagugcuaccggcucuacacggagcgcgcguaccgggacgagaugcugaccaccaacguccccgagauccagcgcaccaaccuggccagcacggugcucucccugaaggccauggggaucaacgaccugcucagcuucgacuucauggacgccccgcccauggagacccugaucaccgccauggagcagcuguacacccucggcgcgcuggacgacgagggccugcucacgcggcuggggcgccggauggccgaguucccccuggagcccaugcucugcaagaugcugaucaugagcgugcaccugggcugcuccgaggagaugcucaccaucgucagcaugcuguccgugcagaacguguucuaccgccccaaggacaagcaggcccuggccgaccagaagaaggccaaguuccaccagaccgagggggaccaccucacccugcuggcggucuacaacagcuggaagaacaacaaguucuccaacccguggugcuacgagaacuucauccaggcccggagccuccgccgggcccaggacauccgcaagcagaugcugggcaucauggaccggcacaagcuggacgugguguccugcggcaagagcacgguccgcgugcagaaggccaucugcuccggguucuuccggaacgccgcgaagaaggacccccaggagggcuaccgcacccucaucgaccagcaggucguguacauccaccccagcuccgcccuguucaaccgccagcccgagugcccgaagcacuuccugcccgugguggccgucgccgugagccucgagcagugccuguccaaguucgaggaccugaacaaggagcucgggcuggugaccugcuga

SEQ ID NO: 29179 - RNA, 3813 nt, Artificial Sequence
  derived and/or modified sequence opt1 from DHX9__Homo_sapiens__NP_001348
augggcgacgugaagaacuuccuguacgccuggugcgggaagcgcaagaugacccccagcuacgagauccgggccgucggcaacaagaaccgccagaaguucaugugcgaggugcagguggagggguacaacuacaccggcauggggaacuccacgaacaagaaggacgcgcagagcaacgccgcccgggacuucgucaacuaccucgugcgcaucaacgagaucaaguccgaggaggugccggccuucggcgucgccagcccccccccccugaccgacaccccggacaccacggcgaacgccgagggcgaccugcccaccaccauggggggcccccuccccccgcaccuggcccugaaggccgagaacaacuccgaggugggggcgagcggcuacggggugcccggccccaccugggaccggggcgccaaccucaaggacuacuacucccgcaaggaggagcaggagguccaggccacgcuggagagcgaggagguggaccugaacgccgggcuccacggcaacuggacccuggagaacgccaaggcgcggcugaaccaguacuuccagaaggagaagauccagggggaguacaaguacacccaggugggccccgaccacaaccgcuccuucaucgccgagaugaccaucuacaucaagcagcucggccggcgcaucuucgcccgggagcacgggagcaacaagaagcuggccgcccaguccugcgcgcugagccucguccgccagcuguaccaccugggcgugguggaggccuacuccgggcucacgaagaagaaggagggcgagaccgucgagccguacaaggugaaccugagccaggaccuggagcaccagcuccagaacaucauccaggagcugaaccuggagauccuccccccccccgaggacccguccgugcccgucgcccugaacaucgggaagcuggcccaguucgagcccagccagcggcagaaccaggugggcgugguccccugguccccgccccagagcaacuggaaccccuggaccuccagcaacaucgacgagggcccccucgccuucgcgaccccggagcagaucagcauggaccugaagaacgagcugauguaccagcucgagcaggaccacgaccugcaggccauccugcaggagcgcgagcuccugcccgugaagaaguucgaguccgagauccuggaggccaucagccagaacuccguggucaucauccggggggccacgggcugcgggaagaccacccaggugccccaguucauccucgacgacuucauccagaacgaccgcgccgcggagugcaacaucgucgugacccagccccggcgcaucagcgccguguccgucgccgagcggguggccuucgagcgcggcgaggagccggggaagagcugcggcuacuccgugcgguucgagagcauccugccccgcccccacgcguccaucauguucugcacggucggcgugcugcuccgcaagcuggaggccgggauccggggcaucagccacgugaucgucgacgagauccacgagcgcgacaucaacaccgacuuccugcucguggugcugcgggacgucgugcaggccuacccggaggugcgcaucguccugauguccgccaccaucgacaccagcauguucugcgaguacuucuucaacugccccaucaucgagguguacgggcggacguaccccgugcaggaguacuuccucgaggacugcauccagaugacccacuucguccccccgcccaaggacaagaagaagaaggacaaggacgacgacggcggggaggacgacgacgccaacugcaaccugaucugcggcgacgaguacggccccgagacccgccuguccaugagccagcucaacgagaaggagacccccuucgagcugaucgaggcgcugcugaaguacaucgagacgcucaacgugccgggggccgugcuggucuuccugcccggcuggaaccucaucuacaccaugcagaagcaccuggagaugaacccccacuucgggucccaccgguaccagauccugccccuccacagccagaucccgcgcgaggagcagcggaagguguucgaccccgugcccgucggcgugaccaaggugauccuguccaccaacaucgccgagacgagcaucaccaucaacgacgucguguacgugaucgacuccugcaagcagaaggucaagcuguucaccgcccacaacaacaugaccaacuacgccacggugugggcgagcaagaccaaccucgagcagcgcaagggccgggccgggcgcgugcggcccggcuucugcuuccaccugugcagccgcgcccgguucgagcgccuggagacccacaugaccccggagauguuccggaccccccuccacgagaucgcccuguccaucaagcugcuccgccuggggggcaucgggcaguuccuggccaaggcgaucgagccccccccgcucgacgccgucaucgaggccgagcacacgcugcgggagcuggacgcccucgacgcgaacgacgagcugaccccccugggccgcauccucgccaagcugcccaucgagccccgcuucggcaagaugaugaucauggggugcaucuucuacgugggcgacgccaucugcaccaucgccgccgcgaccugcuucccggagcccuucaucaacgaggggaagcggcugggcuacauccaccgcaacuucgccgggaaccgguucagcgaccacguggcccuccuguccgucuuccaggccugggacgacgcccgcaugggcggcgaggaggcggagauccgguucugcgagcacaagcgccugaacauggccacgcuccggaugaccugggaggccaaggugcagcugaaggagauccugaucaacagcggguuccccgaggacugccuccugacccagguguucaccaacacgggcccggacaacaaccuggacgucgugaucucccuccuggccuucgggguguaccccaacgucugcuaccacaaggagaagcgcaagauccugaccaccgagggccggaacgcccucauccacaagagcuccgugaacugccccuucagcucccaggacaugaaguaccccagcccguucuucguguucggggagaagauccgcacccgggcgaucuccgccaagggcaugacgcuggucaccccccugcagcuccugcuguucgccagcaagaaggugcaguccgacggccagaucgugcucgucgacgacuggaucaagcugcagaucagccacgaggccgcggccugcaucaccgggcugcgcgccgccauggaggcccucgugguggaggucaccaagcagcccgcgaucaucucccagcuggaccccgugaacgagcggaugcugaacaugauccgccagaucagccggccguccgccgccggcaucaaccucaugaucgggagcacgcgcuacggcgacgggccccggccccccaagauggcccgcuacgacaacggcagcggcuaccggcgcgggggcuccagcuacuccgggggcggcuacgggggcggguacagcuccggcggguacggcagcggcggguacggcggguccgccaacagcuuccgggcgggcuacggggccggcgucggcgggggcuaccgcggggugucccgcggcggguuccggggcaacagcggcggggacuaccgcggcccguccgggggcuaccggggcagcgggggcuuccagcgcgggggcgggcggggcgccuacggcaccggguacuucggccaggggcgcggcgggggcggcuacuga

SEQ ID NO: 29180 - RNA, 561 nt, Artificial Sequence
  derived and/or modified sequence opt1 from DIABLO__Homo_sapiens__NP_001265233
augaaguccgacuucuacuuccagaaguccgagccccacagccugagcagcgaggcccucaugcgccgggccgugucccuggucaccgacagcaccuccacguuccugagccagaccaccuacgcgcucaucgaggccaucaccgaguacacgaaggccguguacacccugaccucccuguaccgccaguacaccagccuccugggcaagaugaacuccgaggaggaggacgagguguggcaggucaucaucggggcccgggccgagaugacgagcaagcaccaggaguaccugaagcucgagaccaccuggaugaccgcggugggccuguccgagauggccgccgaggccgcguaccagacgggggccgaccaggccagcaucaccgcccgcaaccacauccagcuggugaagcuccaggucgaggaggugcaccagcugucccggaaggccgagaccaagcuggcggaggcccagaucgaggagcuccgccagaagacccaggaggagggcgaggagcgggccgagagcgagcaggaggccuaccugcgcgaggacuga

SEQ ID NO: 29181 - RNA, 3792 nt, Artificial Sequence
  derived and/or modified sequence opt1 from DIAPH1__Homo_sapiens__NP_001073280
auggagcccccgggcgggagccugggccccgggcgcggcacccgggacaagaagaaggggcgcucccccgacgagcuccccagcgccggcggcgacgggggcaaguccaagaaguuccuggagcgguucaccagcaugcgcaucaagaaggagaaggagaagccgaacuccgcccaccggaacagcuccgcgagcuacggggacgaccccacggcccagucccugcaggacgugagcgacgagcagguccucgugcuguucgagcagaugcugcucgacaugaaccugaacgaggagaagcagcagccccugcgcgagaaggacaucaucaucaagcgggagauggugucccaguaccucuacaccagcaaggccggcaugucccagaaggagagcuccaagagcgccaugauguacauccaggagcugcgcuccgggcugcgggacaugccccuccugagcugccuggagucccuccgcgucagccugaacaacaacccggugagcugggugcagaccuucggcgccgagggccuggcgucccuccuggacauccugaagcggcuccacgacgagaaggaggagaccgccgggagcuacgacucccgcaacaagcacgagaucauccggugccugaaggccuucaugaacaacaaguucggcaucaagacgaugcuggagaccgaggaggggauccuccugcugguccgcgccauggaccccgcggugcccaacaugaugaucgacgccgccaagcuccugagcgcccugugcauccucccccagccggaggacaugaacgagcgggugcuggaggccaugaccgagcgcgcggagauggacgaggucgagcgguuccagccccugcucgacggccugaaguccggcaccacgaucgcccugaagguggggugccuccagcugaucaacgcccugaucacccccgccgaggagcucgacuuccgcgugcacauccggagcgagcugaugcgccugggccuccaccagguccugcaggaccugcgggagaucgagaacgaggacaugcgcgugcagcucaacguguucgacgagcagggggaggaggacuccuacgaccugaagggccgccuggacgacauccggauggagauggacgacuucaacgaggucuuccagauccuccugaacaccgugaaggacagcaaggccgagccccacuuccuguccauccugcagcaccuccugcuggugcgcaacgacuacgaggcgcggccgcaguacuacaagcucaucgaggagugcaucagccagaucguccugcacaagaacggggccgaccccgacuucaagugccgccaccugcagaucgagaucgagggccucaucgaccagaugaucgacaagaccaagguggagaaguccgaggccaaggccgccgagcuggagaagaagcuggacagcgagcucacggcgcggcacgagcugcagguggagaugaagaagauggaguccgacuucgagcagaagcugcaggaccuccagggcgagaaggacgcccugcacagcgagaagcagcagaucgccaccgagaagcaggaccuggaggccgaggucucccagcucaccggggagguggccaagcugaccaaggagcuggaggacgcgaagaaggagauggccagccucuccgccgccgcgaucacggugccccccagcgucccgucccgcgcccccgugccccccgccccgccccugcccggcgacagcgggaccaucauccccccgccccccgccccgggcgacagcaccacccccccccccccgcccccccccccgcccccccccccgccccugcccgggggcgucugcaucuccagccccccgucccuccccggcgggacggccaucagcccccccccgccccuguccggcgacgcgaccaucccccccccgcccccccugccggagggggugggcauccccagccccuccagccuccccgggggcaccgccaucccgcccccccccccgcugcccggcuccgcccggaucccccccccgccccccccccugccggggagcgccggcauccccccccccccgcccccccuccccggggaggccggcaugccgcccccccccccgccccugcccggcgggccgggcauccccccccccccgcccuuccccgggggccccgggaucccgcccccccccccgggcaugggcaugcccccccccccgcccuucggguucggcgugcccgcggcccccguccugccguucgggcucacccccaagaagcuguacaagcccgaggugcagcugcgccggcccaacugguccaagcucguggccgaggaccugagccaggacugcuucuggacgaaggucaaggaggaccgcuucgagaacaacgagcuguucgccaagcucacccugaccuucuccgcccagaccaagacgagcaaggcgaagaaggaccaggagggcggggaggagaagaaguccgugcagaagaagaaggugaaggagcugaagguccucgacagcaagaccgcccagaaccuguccaucuuccugggcagcuuccggaugccguaccaggagaucaagaacgugauccucgaggugaacgaggccguccugaccgagagcaugauccagaaccugaucaagcagaugcccgagcccgagcagcucaagaugcuguccgagcugaaggacgaguacgacgaccucgccgagagcgagcaguucggcguggugauggggaccgucccccgccugcggccgcgccugaacgcgauccucuucaagcugcaguucuccgagcagguggagaacaucaagcccgagaucgugagcgucacggccgccugcgaggagcugcggaaguccgagagcuucuccaaccuccuggagaucacccugcucgugggcaacuacaugaacgccgggagccgcaacgccggcgcguucggguucaacaucuccuuccugugcaagcugcgggacaccaagagcaccgaccagaagaugacgcuccugcacuuccuggccgagcucugcgagaacgacuaccccgacgugcugaaguucccggacgagcuggcccacgucgagaaggccucccgcgugagcgccgagaaccuccagaagaaccuggaccagaugaagaagcagaucuccgacguggagcgggacguccagaacuuccccgcggccaccgacgagaaggacaaguucguggagaagaugaccagcuucgugaaggacgcccaggagcaguacaacaagcugcgcaugaugcacuccaacauggagacccucuacaaggagcugggcgaguacuuccuguucgaccccaagaagcucagcgucgaggaguucuucauggaccugcacaacuuccgcaacauguuccugcaggccgugaaggagaaccagaagcggcgcgagaccgaggagaagaugcggcgcgccaagcucgcgaaggagaaggccgagaaggagcggcuggagaagcagcagaagcgcgagcagcugaucgacaugaacgccgagggcgacgagacgggggugauggacucccuccuggaggcccugcagagcggcgcggccuuccggcgcaagcgggggccccgccaggccaaccggaaggccggcugcgccgucaccucccuccuggcgagcgagcugaccaaggacgacgccauggccgccgugccggccaaggugagcaagaacuccgagaccuuccccacgauccucgaggaggcgaaggagcuggucgggcgcgccagcuga

SEQ ID NO: 29182 - RNA, 3306 nt, Artificial Sequence
  derived and/or modified sequence opt1 from DIAPH2__Homo_sapiens__NP_006720
auggagcagcccggcgccgccgccagcggggccggcgggggcuccgaggagcccggcggcggccgcagcaacaagcgguccgccgggaaccgcgccgccaacgaggaggagacgaagaacaagcccaagcugaacauccagaucaagacccucgcggacgacgugcgggaccgcaucacgagcuuccggaaguccacggucaagaaggagaagccccugauccagcaccccaucgacagccagguggccauguccgaguuccccgccgcccagccccuguacgacgagcgcagccucaaccuguccgagaaggaggugcuggaccucuucgagaagaugauggaggacaugaaccugaacgaggagaagaaggcgccccugcggaacaaggacuucaccaccaagcgcgagauggucgugcaguacaucagcgccacggccaaguccggcgggcucaagaacagcaagcacgagugcacccuguccagccaggaguacgugcacgagcugcgguccggcaucagcgacgagaagcuccugaacugccuggagucccuccgcgucagccugaccuccaaccccgugagcugggugaacaacuucgggcacgagggccugggccuccugcuggacgagcucgagaagcugcuggacaagaagcagcaggagaacaucgacaagaagaaccaguacaagcucauccagugccugaaggccuucaugaacaacaaguucgggcugcagcggauccucggcgacgagcgcagccugcugcuccuggcccgggccaucgaccccaagcagcccaacaugaugaccgagaucgucaagauccuguccgccaucugcaucgugggggaggagaacauccucgacaagcugcugggcgccaucacgaccgccgccgagcgcaacaaccgggagcgcuucagccccaucguggagggccucgagaaccaggaggcccugcagcugcaggucgccugcaugcaguucaucaacgcccucgugaccucccccuacgagcuggacuuccggauccaccuccgcaacgaguuccuccggagcgggcugaagaccaugcugcccgaccucaaggagaaggagaacgacgagcuggacauccagcugaagguguucgacgagaacaaggaggacgaccucacggagcugucccaccgccugaacgacauccgggccgagauggacgacaugaacgaggucuaccaccuccuguacaacaugcugaaggacaccgccgcggagaacuacuuccugagcauccugcagcacuuccugcugauccgcaacgacuacuacauccgcccccaguacuacaagaucaucgaggagugcgugucccagaucgugcuccacugcagcggcauggaccccgacuucaaguaccggcagcgccuggacaucgaccugacccaccucaucgacuccugcgucaacaaggccaagguggaggagagcgagcagaaggccgccgaguucuccaagaaguucgacgaggaguucaccgcccggcaggaggcgcaggccgagcugcagaagcgcgacgagaagaucaaggagcuggaggccgagauccagcagcuccggacgcaggcccaggugcugagcuccagcuccgggauccccggcccgcccgcggcgccgccccugcccggggucgggcccccgcccccgccgcccgcgccgccccuccccggcggggcgccccugccgcccccgcccccgccccugcccggcaugauggggaucccgcccccgcccccgccgccccuccuguucggcgggcccccgccgccgccgccccugggcggcgugcccccgccgcccgggaucagccucaaccugcccuacggcaugaagcagaagaagauguacaagcccgagguguccaugaagcgcaucaacuggagcaagaucgagcccaccgagcuguccgagaacugcuucuggcuccgggucaaggaggacaaguucgagaaccccgaccuguucgccaagcuggcgcucaacuucgccacccagaucaaggugcagaagaacgccgaggcccuggaggagaagaagaccgggcccacgaagaagaaggucaaggagcugcgcauccucgaccccaagaccgcccagaaccugagcaucuuccugggcagcuaccggaugcccuacgaggacauccgcaacgugauccucgaggugaacgaggacaugcuguccgaggcgcugauccagaaccucgucaagcaccuccccgagcagaagauccugaacgagcuggccgagcugaagaacgaguacgacgaccugugcgagcccgagcaguucgggguggugaugagcuccgucaagaugcuccagccccggcugagcuccauccuguucaagcucaccuucgaggagcacaucaacaacaucaagcccagcaucaucgccgugacccuggccugcgaggagcugaagaaguccgagagcuucaaccgccuccuggagcuggugcuccuggucggcaacuacaugaacuccggcagccggaacgcccagucccugggguucaagaucaacuuccucugcaagauccgcgacaccaagagcgcggaccagaagaccacccugcugcacuucaucgccgacaucugcgaggagaaguaccgggacauccucaaguuccccgaggagcuggagcacguggaguccgccagcaagguguccgcccagauccucaagagcaaccucgcguccauggagcagcagaucguccaccuggagcgcgacaucaagaaguucccccaggccgagaaccagcacgacaaguucguggagaagaugaccagcuucacgaagaccgcccgggagcaguacgagaagcugagcaccaugcacaacaacaugaugaagcucuacgagaaccugggcgaguacuucaucuucgacuccaagaccgugagcaucgaggaguucuucggggaccugaacaacuuccgcacccuguuccuggaggccguccgggagaacaacaagcgccgcgagauggaggagaagacccggcgcgccaagcuggcgaaggagaaggccgagcaggagaagcucgagcggcagaagaagaagaagcagcugaucgacaucaacaaggagggcgacgagaccggcgugauggacaaccugcucgaggcccugcaguccggggccgccuuccgcgaccggcgcaagcggaucccccgcaaccccgacaaccggcgcgugccccuggagcggagccgcucccggcacaacggcgcgaucagcuccaaguga

SEQ ID NO: 29183 - RNA, 3582 nt, Artificial Sequence
  derived and/or modified sequence opt1 from DIAPH3__Homo_sapiens__NP_001035982
auggagcgccaccagccccggcugcaccaccccgcccagggcagcgccgcggggacccccuaccccagcagcgccagccugcgcggcugccgggagagcaagaugccccgccggaaggggccccagcacccgccgccgcccuccggccccgaggagcccggggagaagcgccccaaguuccaccugaacauccggacccugacggacgacaugcucgacaaguucgccagcauccgcauccccggcuccaagaaggagcggccgccccugcccaaccugaagaccgccuucgccagcuccgacugcagcgcggcgccccucgagaugauggagaacuuccccaagccccuguccgagaacgagcugcucgagcuguucgagaagaugauggaggacaugaaccugaacgaggacaagaaggcgccccugcgcgagaaggacuucagcaucaagaaggagauggugaugcaguacaucaacaccgccuccaagaccggcagccugaagcggucccgccagaucagcccccaggaguucauccacgagcugaagaugggguccgccgacgagcggcucgucacgugccuggagagccugcgcgugucccucaccagcaaccccgugagcugggucgaguccuucggccacgaggggcugggccugcuccuggacauccuggagaagcucaucagcgggaagauccaggagaagguggugaagaagaaccagcacaaggucauccagugccugaaggcccugaugaacacccaguacggccucgagcggaucauguccgaggagcgcagccugucccugcucgccaaggccguggacccccggcaccccaacaugaugaccgacguggucaagcugcugagcgccgugugcaucgugggcgaggaguccauccucgaggagguccuggaggcccugacgagcgccggggaggagaagaagaucgaccgcuucuucugcaucguggagggccuccggcacaacuccgugcagcugcaggucgccugcaugcagcugaucaacgcccucgugaccagccccgacgaccuggacuuccgccugcacauccggaacgaguucaugcgcugcgggcucaaggagauccugcccaaccugaagugcaucaagaacgacggccucgacauccagcugaagguguucgacgagcacaaggaggaggaccuguucgagcucucccaccgccuggaggacauccgggccgagcuggacgaggcguacgacgucuacaacaugguguggagcaccgugaaggagacccgcgccgagggcuacuucaucuccauccugcagcaccuccugcugauccggaacgacuacuucauccgccagcaguacuucaagcucaucgacgagugcgucagccagaucgugcugcaccgggacgggauggaccccgacuucacguaccgcaagcggcuggaccucgaccugacccaguucguggacaucugcaucgaccaggccaagcuggaggaguucgaggagaaggccuccgagcucuacaagaaguucgagaaggaguucaccgaccaccaggagacccaggccgagcugcagaagaaggaggcgaagaucaacgagcugcaggccgagcuccaggccuucaagagccaguucggcgcccugcccgccgacugcaacaucccccugccgcccuccaaggagggcgggacggggcacagcgcgcugcccccgccgccgccccuccccuccggcggcggggugcccccgcccccgcccccgcccccgcccccgccccugcccggcaugcgcaugcccuucagcgggcccgugcccccgcccccgccccucggcuuccucgggggccagaacuccccgccccugcccauccuccccuucggccugaagcccaagaaggaguucaagcccgagaucuccaugcggcgccugaacuggcucaagauccggccccacgagaugaccgagaacugcuucuggaucaaggucaacgagaacaaguacgagaacguggaccugcugugcaagcucgagaacaccuucugcugccagcagaaggagcgccgggaggaggaggacaucgaggagaagaaguccaucaagaagaagaucaaggagcugaaguuccuggacuccaagaucgcccagaaccucagcaucuuccuguccagcuuccgcgugcccuacgaggagauccggaugaugauccuggaggucgacgagacccgccucgccgaguccaugauccagaaccugaucaagcaccuccccgaccaggagcagcucaacagccugucccaguucaagagcgaguacuccaaccugugcgagcccgagcaguucgugguggucaugagcaacgugaagcggcuccgcccgcggcuguccgccauccuguucaagcuccaguucgaggagcaggucaacaacaucaagcccgacaucauggcggucagcacggccugcgaggagaucaagaaguccaagagcuucuccaagcugcuggagcucgugcugcugauggggaacuacaugaacgccggcagccgcaacgcccagaccuucggguucaaccucagcucccugugcaagcugaaggacaccaagagcgccgaccagaagaccacgcuccugcacuuccugguggagaucugcgaggagaaguaccccgacauccucaacuucgucgacgaccuggagccccuggacaaggcguccaaggugagcguggagacccucgagaagaaccugcgccagaugggccggcagcugcagcagcucgagaaggagcuggagaccuucccgccgcccgaggaccugcacgacaaguucgucaccaagaugucccgcuucgugaucagcgccaaggagcaguacgagacgcucuccaagcugcacgagaacauggagaagcuguaccagagcaucaucggguacuacgccaucgacgugaagaaggucuccguggaggacuuccucaccgaccugaacaacuuccggaccaccuucaugcaggccaucaaggagaacaucaagaagcgcgaggccgaggagaaggagaagcgggugcgcaucgcgaaggagcuggccgagcgggagcgccucgagcggcagcagaagaagaagcgccugcuggagaugaagacggagggcgacgagaccggcgucauggacaaccuccuggaggcccugcagagcggggccgccuuccgggaccgccggaagcgcacccccaugccgaaggacgugcggcagucccucagccccaugucccagcgccccgugcugaaggucugcaaccacgagaaccagaaggugcagcugaccgagggcagccggucccacuacaacaucaacugcaacagcacgcgcacccccguggcgaaggagcucaacuacaaccuggacacccacaccuccaccgggcggaucaaggccgccgagaagaaggaggccugcaacgucgagagcaaccgcaagaaggagacggagcugcucggcuccuucagcaagaacgagagcgugccggagguggaggcgcugcuggcccggcuccgcgcccuguga

SEQ ID NO: 29184 - RNA, 5490 nt, Artificial Sequence
  derived and/or modified sequence opt1 from DICER1__Homo_sapiens__NP_001182502
augaagucccccgcccugcagccgcucagcauggccggccugcagcugaugacccccgcgagcagccccauggggcccuucuucggccuccccuggcagcaggaggccauccacgacaacaucuacacgccccggaaguaccagguggagcugcuggaggccgcccucgaccacaacaccaucgugugccugaacaccgggagcggcaagaccuucaucgccgugcugcucaccaaggagcugagcuaccagauccgcggggacuucagccgcaacggcaagcggaccguguuccuggucaacagcgcgaaccagguggcccagcaggucagcgccguccgcacccacagcgaccucaaggugggcgaguacagcaaccuggaggugaacgccuccuggaccaaggagcgguggaaccaggaguucaccaagcaccagguccugaucaugaccugcuacguggcgcucaacgugcugaagaacggguaccugagccucuccgacaucaaccugcuggucuucgacgagugccaccucgccauccuggaccaccccuaccgcgagaucaugaagcugugcgagaacugccccagcugcccgcggauccucggccugaccgccuccauccugaacgggaagugcgaccccgaggagcucgaggagaagauccagaagcuggagaagauccucaagagcaacgccgagaccgccaccgaccucguggugcuggaccgcuacacgucccagcccugcgagaucgucguggacugcggccccuucaccgaccggagcgggcuguacgagcgccuccugauggagcuggaggaggcgcucaacuucaucaacgacugcaacaucuccgugcacagcaaggagcgggacagcacccugaucuccaagcagauccugagcgacugccgcgccguccucguggugcugggcccguggugcgccgacaaggucgccggcaugauggugcgggagcugcagaaguacaucaagcacgagcaggaggagcuccaccgcaaguuccugcuguucaccgacacguuccuccggaagauccacgcccugugcgaggagcacuucucccccgcgagccuggaccucaaguucgugacccccaaggucaucaagcugcuggagauccugcgcaaguacaagcccuacgagcggcagcaguucgaguccguggagugguacaacaaccgcaaccaggacaacuacgucagcugguccgacagcgaggacgacgacgaggacgaggagaucgaggagaaggagaagccggagaccaacuuccccucccccuucaccaacauccucugcgggaucaucuucguggagcggcgcuacacggccgugguccugaaccggcugaucaaggaggccggcaagcaggaccccgagcucgccuacaucagcuccaacuucaucaccgggcacggcaucggcaagaaccagccgcgcaacaagcagauggaggccgaguuccgcaagcaggaggaggugcugcggaaguuccgcgcgcacgagaccaaccugcucaucgccaccagcaucguggaggagggggucgacauccccaagugcaaccugguggugcgguucgaccugcccacggaguaccgcuccuacguccagagcaagggccgggcccgcgcccccaucuccaacuacaucaugcucgccgacaccgacaagaucaagagcuucgaggaggaccugaagaccuacaaggcgaucgagaagauccugcggaacaagugcuccaagagcguggacaccggggagacggacaucgacccggugauggacgacgacgacgucuucccgcccuacgugcuccgccccgacgacggcgggccgcgggugaccaucaacaccgccaucggccacaucaaccgcuacugcgcccggcugcccuccgaccccuucacccaccuggccccgaagugccgcacgcgggagcuccccgacggcaccuucuacagcacccuguaccugcccaucaacagcccccuccgcgcguccaucgucgggccgcccaugagcugcgugcggcuggccgagcgcguggucgcccugaucugcugcgagaagcuccacaagaucggcgagcuggacgaccaccugaugcccguggggaaggagaccgugaaguacgaggaggagcucgaccugcacgacgaggaggagacguccguccccggccggccggggagcaccaagcgccggcagugcuaccccaaggccauccccgagugccugcgcgacuccuacccccgcccggaccagcccugcuaccucuacgugaucggcauggugcugaccacgccccugcccgacgagcucaacuuccggcgccggaagcuguacccgcccgaggacaccacgcgcugcuucggcauccugaccgccaagcccaucccccagaucccgcacuuccccgucuacacccggagcggggaggugaccaucuccaucgagcucaagaaguccggcuucaugcugucccugcagaugcucgagcugaucacgcgccugcaccaguacaucuucagccacauccuccggcuggagaagcccgcgcuggaguucaagcccaccgacgccgacuccgccuacugcgugcucccgcugaacgucgugaacgacagcuccacccuggacaucgacuucaaguucauggaggacaucgagaaguccgaggcccgcaucgggauccccuccaccaaguacacgaaggagacccccuucguguucaagcucgaggacuaccaggacgccgucaucaucccgcgguaccgcaacuucgaccagccccaccgguucuacguggcggacguguacaccgaccugacgccccugagcaaguuccccuccccggaguacgagacguucgccgaguacuacaagaccaaguacaaccucgaccugaccaaccugaaccagccccuccuggacgucgaccacaccagcagccgccugaaccuccugacgccccggcaccugaaccagaagggcaaggcccucccccuguccagcgccgagaagcgcaaggccaagugggagucccugcagaacaagcagauccucgugccggagcugugcgcgauccaccccauccccgccagccuguggcggaaggccgugugccuccccuccauccuguaccgccugcacugccuccugaccgccgaggagcugcgggcgcagaccgccagcgacgccggggucggcgugcgcucccucccggccgacuuccgguaccccaaccuggacuucggcuggaagaaguccaucgacuccaagagcuucaucuccaucagcaacuccagcuccgccgagaacgacaacuacugcaagcacagcaccaucgugcccgagaacgcggcccaccagggggccaaccgcacguccagccuggagaaccacgaccagauguccgucaacugccggacccuccugagcgagagccccggcaagcugcacguggagguguccgccgaccucaccgccaucaacgggcugagcuacaaccagaaccuggcgaacggcuccuacgaccucgccaaccgcgacuucugccagggcaaccagcugaacuacuacaagcaggagaucccgguccagcccaccacgagcuacuccauccagaaccuguacagcuacgagaaccagccccagcccuccgacgagugcacccuccugagcaacaaguaccuggacgggaacgccaacaaguccaccagcgacggcuccccggugauggccgugaugcccgggaccacggacaccauccagguccucaagggccgcauggacagcgagcagucccccagcaucggguacuccagccggacccugggccccaacccgggccugauccuccaggcccugacccuguccaacgcgagcgacggguucaaccucgagcgccuggagaugcugggcgacuccuuccucaagcacgccaucacgaccuaccuguucugcaccuaccccgacgcccacgaggggcggcugagcuacaugcgcagcaagaagguguccaacugcaaccuguaccggcucggcaagaagaaggggcugcccagccgcaugguggucuccaucuucgacccgcccgugaacuggcugccgcccggcuacguggucaaccaggacaagagcaacaccgacaagugggagaaggacgagaugacgaaggacugcaugcucgccaacggcaagcuggacgaggacuacgaggaggaggacgaggaggaggagucccugauguggcgggcgcccaaggaggaggccgacuacgaggacgacuuccucgaguacgaccaggagcacauccgcuucaucgacaacaugcugauggggagcggcgccuucgugaagaagaucucccugagccccuucuccaccaccgacagcgccuacgaguggaagaugcccaagaaguccagccucggguccaugcccuucagcuccgacuucgaggacuucgacuacagcuccugggacgccaugugcuaccuggacccgagcaaggcggucgaggaggacgacuucguggugggcuucuggaaccccuccgaggagaacugcggggucgacaccggcaagcagagcaucagcuacgaccugcacaccgagcagugcaucgccgacaaguccaucgccgacugcguggaggcccuccugggcugcuaccugacgagcugcggggagcgggccgcgcagcuguuccugugcucccugggccucaaggugcugcccgucaucaagcgcaccgaccgggagaaggcccugugccccacccgcgagaacuucaacagccagcagaagaaccucuccgugagcugcgccgccgccuccguggcgagcucccggagcuccguccugaaggacagcgaguacgggugccugaagaucccgccccgcugcauguucgaccaccccgacgccgacaagacccucaaccaccugaucuccggcuucgagaacuucgagaagaagaucaacuaccgguucaagaacaaggccuaccugcuccaggccuucacgcacgccagcuaccacuacaacaccaucaccgacugcuaccagcgccuggaguuccugggggacgcgauccucgacuaccugaucaccaagcaccuguacgaggacccccggcagcacuccccgggcgugcucacggaccugcgcagcgcccuggugaacaacaccaucuucgccucccucgccgucaaguacgacuaccacaaguacuucaaggcggugagccccgagcuguuccacgugaucgacgacuucguccaguuccagcuggagaagaacgagaugcagggcauggacuccgagaaguccuuccuccagauguaccccgugccccugugcgagaacugccugaaguggaaccagaagcucccgaaccuggcccggcugcgcgagcucaccaccgggcgcagcgagucccuguggaaguga

SEQ ID NO: 29185 - RNA, 1689 nt, Artificial Sequence
  derived and/or modified sequence opt1 from DIDO1__Homo_sapiens__NP_071388
auggacgacaagggcgaccccagcaacgaggaggccccgaaggccaucaagcccaccuccaaggaguuccgcaagaccuggggguuccggcgcacgaccaucgcgaagcgggagggcgccggggacgccgaggccgacccccuggagcccccgccgccccagcagcagcucggccugagccugcgccgguccgggcgccagcccaagcggaccgagcgcguggagcaguuccucaccaucgcccggcgccggggccgccggagcaugcccgucucccuggaggacagcggcgagcccacguccugccccgcgaccgacgccgagaccgccagcgagggguccguggagagcgccuccgagacccgcagcggcccccaguccgcgagcacggccgugaaggagcggccggccuccagcgagaaggucaagggcggggacgaccacgacgacaccuccgacagcgacuccgacgggcugacccucaaggagcugcagaaccgccugcggcgcaagcgggagcaggagcccaccgagcgcccccucaagggcauccagagccggcugcgcaagaagcgccgggaggagggccccgccgagacgguggggagcgaggccuccgacaccguggagggcguccugccgagcaagcaggagcccgagaacgaccaggggguggugucccaggcgggcaaggacgaccgcgagagcaagcucgagggcaaggccgcccaggacaucaaggacgaggagcccggggaccugggccggcccaagccggagugcgagggguacgaccccaacgcccuguacugcaucugccgccagccccacaacaaccgguucaugaucugcugcgaccgcugcgaggagugguuccacggcgacugcgucgggaucuccgaggcccggggccgccuccuggagcggaacggcgaggacuacaucugccccaacugcaccauccuccaggugcaggacgagacccacagcgagacggcggaccagcaggaggccaaguggcgcccgggggacgccgacggcaccgacugcaccuccaucgggaccaucgagcagaaguccagcgaggaccagggcaucaaggggcggaucgagaaggccgccaaccccagcggcaagaagaagcugaagaucuuccagcccgugaucgaggcgcccggcgccuccaagugcaucgggccgggcugcugccacgucgcccagcccgacagcguguacugcuccaacgacugcauccugaagcacgccgccgcgacgaugaaguuccugagcuccgggaaggagcagaagcccaagccgaaggagaagaugaagaugaagcccgagaagcccagccuccccaagugcggcgcccaggccgggaucaagaucuccagcgugcacaagcgcccggcccccgagaagaaggagaccaccgucaagaaggcgguggugguccccgcccgguccgaggcccugggcaaggaggccgccugcgagagcagcacccccuccugggcgagcgaccacaacuacaacgccgugaagccggagaagacggccgcccccucccccagccugcucuacaagugcauguaccaccugggcguggggcugcucgaccccucccgcagcuucuggaucgccaucccgugggcgugccccggccugggggucgccgcccugugcuga

SEQ ID NO: 29186 - RNA, 2271 nt, Artificial Sequence
  derived and/or modified sequence opt1 from DIEXF__Homo_sapiens__NP_055203
augggcaagcgcgggagccggucccagagccagcugcucaacacccugaccaagaagcagaagaagcaccuccgcgacuucggcgaggagcaccccuucuacgaccgggugucccgcaaggaggccaagccgcagaucugccagcucagcgaguccagcgacuccagcgacuccgagagcgacuccgagagcgagccccagcaggucuccggguaccaccggcugcuggccacgcucaagaacgugagcgaggaggaggaggaggacgaggaggaggaggaggaggaggacuccaucguggacgacgcggagaugaacgacgaggacggcgggagcgacgucuccguggaggaggagauggccgccgagagcaccgagucccccgagaacguggcccugagcgccgaccccgagggcaaggaggacggcgaggagccgcccgggaccagccagaccucccccgaggaguucacggacgcgaagcacgagagccuguucucccucgagaccaacuuccuggaggaggagagcggcgacaacuccagccugaaggccucccaggaccccuuccuccagcacgucaacaaggagcugaaggagaaggccauccaggccguggcgaccaacccgaagaccacgcacgagcugaaguggcccauccucgggcagcuguucuucagcuccaaguuccagaagcuggagaccuucaagccgcccaaggacaucgaccucaagagccugcaccuccagaagccccuggaguccaccuggaccaagacgaacagccaguuccuguccggcccccagaaguccagcagccccuucacgccccugcagaaggagcuguuccugaucaugaacuccuaccgcgaccuguucuacccggagcggaccgcccucaagaacggggaggagauccgccacguguacugccugcacgucaucaaccacauccugaaggccaacgcccaggugcucggcaacaacagccggcgccggucccagaaguucggcgugggggacgacgacgacuuccgcgaccagggccugacccggcccaagguccugaucguggugcccuuccgcgaggccgcgcuccgggucgugcagcuguucaucagccugcucgagggggacagcaagaagaagaucaucguguccaacaagaagcgcuuccagggcgaguacggcagcgaccccgaggagcggccgcccaaccugaagcgccccgaggacuacgaggccgucuucguggggaacaucgacgaccacuuccggaucggcguggccauccugcagcgcuccauccggcucuacgcccccuucuacagcuccgacauccugaucgccagcccgcuggggcuccgcaccaucaucggcggggagggcgagaagaagcgcgacuucgacuuccuguccagcaucgagcugcucaucaucgaccaggcggacaucuaccugaugcagaacugggagcacguccugcaccucaugaaccacaugaaccugcugccccuggacucccacggcguggacuucagccgggugcgcauguggucccucaacaacuggagcaaguacuaccggcagacccugcuguucggggcccuccaggacgcccagaucaacuccgucuucaacaaguacugcgugaacaugcagggccaggucgccgugcgcaacgugcccaugaccgggagcaucucccacguccuggugcagcugccccacguguuccagcggauggaggccgagaaccucgcgagcgucaucgacgcccgcuucaacuucuucgugaacaagauccugccgcaguaccgggacgccgugaugucccacacccugaucuacauccccagcuacuucgacuucguccgccuccggaacuacuucaagaaggaggagcugaacuucacgcacaucugcgaguacacccagaaguccggcgugagccgcgcccggcacuucuuccugcagggggagaagcaguuccuccuguucaccgagcgcuuccacuucuacaagcgguacaccaucaagggcauccgcaaccugaucuucuacgagcuccccacguacccgcacuucuacagcgagaucugcaacaugcugcgggccaccaaccgcggcgaggaggcgaccuggaccugcacggugcuguacuccaaguacgacgcccagcggcucgccgccgucguggggguggagcgcgcggcccagaugcugcagagcaacaagaacguccaccuguucaucaccggcgagaaguga

SEQ ID NO: 29187 - RNA, 2397 nt, Artificial Sequence
  derived and/or modified sequence opt1 from DIP2A__Homo_sapiens__NP_001139587
auggccgaccgcggcugcccccuggaggccgcgccgcuccccgccgaggugcgggagagccuggccgagcuggagcucgagcuguccgagggggacaucacccagaagggcuacgagaagaagcgcgccaagcugcucgcccgguacaucccccugauccaggggaucgaccccagccugcaggcggagaaccgcaucccgggccccucccagaccacggccgccgcccccaagcagcagaagucccggcccaccgcgagccgcgacgagcgguuccgcagcgacguccacaccgaggccgugcaggccgcccucgccaaguacaaggagcggaagaugccgaugcccuccaagcgccggagcgugcugguccacuccagcguggagaccuacacgccgcccgacaccuccagcgcguccgaggacgaggggagccugcgccggccgggccgccucaccuccacgccccugcagagccacuccagcguggagcccuggcuggaccgggucauccagggcuccagcaccagcuccagcgccuccagcaccuccagccaccccgggggccgcccgaccaccgcccccuccgccgccgcgacgcccggggccgccgccaccaccgcccucgcgggccuggaggcccacacccacaucggggugcccgugaacagccgggucuccagcaagauccagcagcugcucaacacgcugaagcgcccgaagcggccgccccugaaggaguucuucguggacgacuucgaggagcuccuggaggugcagcagcccgaccccaaccagcccaagcccgagggcuccgagaccagcguccugcgcggcgagccccucaccgccggggugccgcggccgcccucccugcuggccacccuccagcgcuggggcacgacccagcccaagagccccugccugaccgcccuggacaccacggggaaggcgguguacacccucaccuacggcaagcuguggucccgcagccugaagcucgccuacacccugcugaacaagcucacguccaagaacgagccccugcugaagcccggcgaccgggucgcccucguguuccccaacagcgaccccgugauguucauggucgccuucuacgggugccugcuggcggagcucgugcccgugcccaucgaggucccgcugacccgcaaggacgccggcucccagcaggucggguuccugcucggcagcugcgggguguuccuggcccugaccaccgacgccugccagaagggccuccccaaggcccagacgggcgagguggcggccuucaagggguggccgccccugagcuggcuggugaucgacggcaagcaccuggccaagccgcccaaggacuggcacccccucgcccaggacaccgggaccggcaccgccuacaucgaguacaagacguccaaggaggggagcaccgucggcgugaccgugucccacgcgagccugcuggcccagugccgggcccucacccaggccugcggcuacuccgaggccgagacccugacgaacguccuggacuucaagcgcgacgcggggcucuggcacggcgugcugaccagcgugaugaaccggaugcacgucguguccgugcccuacgcccugaugaaggccaacccccucagcuggauccagaaggucugcuucuacaaggcccgcgcggcccuggugaagucccgggacaugcacuggagccugcucgcccagcgcgggcagcgggacgugucccugagcucccugcgcaugcucaucgucgccgacggcgccaaccccuggagcaucuccagcugcgacgcguuccugaacguguuccagucccgggggcugcgccccgaggugaucugccccugcgccagcagcccggaggcccucaccgucgccauccggcgcccgcccgaccugggcggcccgccgccccggaaggccgugcuguccaugaacgggcucagcuacggcgugauccgcgucgacaccgaggagaagcuguccgugcugacggugcaggacgucggccaggugaugcccggggcgaacgugugcgucgugaagcucgagggcacccccuaccugugcaagaccgacgaggugggggagaucugcgucagcuccagcgccaccggcacggccuacuacgggcugcucggcaucaccaagaacguguucgaggccgugcccgucaccaccgggggcgcccccaucuucgaccggcccuucacgcgcaccggccugcugggguucaucggccccgacaaccucguguucaucguggggaagcuggacggccugauggucaccggggugcggcgccacaacgcggacgacguggucgccaccgcccucgccguggagcccaugaaguucguguaccgcggccgguga

SEQ ID NO: 29188 - RNA, 4731 nt, Artificial Sequence
  derived and/or modified sequence opt1 from DIP2B__Homo_sapiens__NP_775873
auggccgagcgcggccuggagcccagcccggccgcgguggccgcccucccgcccgagguccgggcccagcuggccgagcuggagcucgagcuguccgagggggacaucacccagaagggcuacgagaagaagcgcagcaagcugcucucccccuacagcccccagacccaggagacggacuccgcggugcagaaggagcugcggaaccagacccccgcccccagcgccgcccagaccuccgcgcccagcaaguaccaccgcacccgguccgggggcgcccgcgacgagcgguaccgcagcgacauccacacggaggccgugcaggccgcccuggcgaagcacaaggagcagaagauggcccucccgaugcccaccaagcggcgcuccaccuucguccagagccccgccgacgccugcacgcccccggacaccuccagcgccuccgaggacgaggggagccugcggcgccaggcggcccuguccgccgcccuccagcagagccugcagaacgccgaguccuggaucaaccggagcauccagggcagcuccaccagcuccagcgcguccagcacccugucccacggcgaggugaaggggaccagcggcucccucgccgacguguucgccaacacgcgcaucgagaacuucagcgccccgcccgacgucaccaccaccacguccagcuccagcuccagcuccagcauccggcccgccaacaucgaccugccgcccuccgggaucgugaagggcaugcacaaggggagcaaccgcagcucccugauggacaccgcggacggcgugcccgucagcucccgggugagcaccaagauccagcagcuccugaacacccugaagcgccccaagcggccgccccucaaggaguucuucguggacgacuccgaggagaucgucgaggugccccagcccgacccgaaccagcccaagcccgagggccgccagaugacgcccgugaagggggagccgcugggcgucaucugcaacuggccgcccgcccuggagagcgcccuccagcggugggggaccacccaggccaagugcuccugccugaccgcgcuggacaugacgggcaagcccguguacacccucaccuacggcaagcuguggagccgcucccugaagcucgccuacacccugcugaacaagcucgggacgaagaacgagcccgugcugaagcccggcgaccgcgucgcccugguguaccccaacaacgacccggugauguucauggucgccuucuacgggugccuccuggccgaggugauccccgugcccaucgaggucccccugacccggaaggacgcgggcgggcagcagaucggcuuccuccugggcagcugcgggaucgcccuggcccucaccuccgaggugugccugaagggccugccgaagacccagaacggggagaucguccaguucaagggcuggccccgccucaaguggguggugacggacagcaaguaccuguccaagccgcccaaggacuggcagccccacaucagccccgccgggaccgagcccgccuacaucgaguacaagaccuccaaggagggcagcgucaugggcgugaccgugucccggcuggcgaugcucagccacugccaggcccugagccaggccugcaacuacuccgagggggagacgaucgucaacgugcuggacuucaagaaggacgccggccuguggcacgggauguucgccaacgugaugaacaagaugcacaccaucagcguccccuacuccgugaugaagaccugcccccucagcugggugcagcgcguccacgcgcacaaggccaagguggcccuggugaagugccgggaccugcacugggccaugauggcgcaccgcgaccagcgggacgucucccucagcucccugcgcaugcugaucgugaccgacggcgccaaccccuggagcguguccagcugcgacgccuuccucucccuguuccagagccacgggcugaagcccgaggccaucugccccugcgccaccuccgcggaggccaugacggucgccauccggcgcccgggcgugcccggcgcgccccuccccgggcgggccauccugagcaugaacggccuguccuacggggugauccgcgucaacaccgaggacaagaacagcgcccucaccgugcaggacgugggccacgucaugccgggcgggaugaugugcaucgugaagcccgacgggcccccgcagcugugcaagaccgacgagaucggcgagaucugcguguccagccggacgggcgggaugauguacuucggccuggccggcgucaccaagaacaccuucgaggugauccccgugaacuccgccgggagccccgucggcgacgugcccuucauccgcagcgggcuccugggcuucguggggccgggcucccuggucuucguggugggcaagauggacgggcuccugauggucagcggccggcgccacaacgccgacgacaucguggccaccgggcuggcgguggaguccaucaagacggucuaccggggccgcaucgccguguucagcguguccgucuucuacgacgagcggaucgugguggucgccgagcagcgccccgacgccagcgaggaggacuccuuccaguggaugagccgcgugcuccaggcgaucgacuccauccaccaggugggggucuacugccuggcccuggugcccgccaacacccuccccaagaccccgcugggcggcauccacaucagccagaccaagcagcuguuccucgaggggucccugcaccccugcaacauccugaugugcccccacacgugcgugaccaaccuccccaagccgcggcagaagcagcccggcgucgggcccgccagcgugauggucggcaaccugguggccgggaagcgcaucgcgcaggccgccggccgggaccugggccagaucgaggagaacgaccucgugcgcaagcaccaguuccuggccgagauccugcaguggcgggcccaggcgacccccgaccacguccucuucaugcugcugaacgccaaggggaccacggugugcaccgccuccugccuccagcugcacaagcgcgccgagcggaucgccagcgugcugggcgacaaggggcaccucaacgcgggcgacaacgucgugcugcuguacccgcccggcaucgagcucaucgccgccuucuacgggugccuguacgccggcugcauccccgugaccguccggcccccgcacgcccagaaccugaccgcgacgcuccccaccgugcgcaugaucguggacgucuccaaggccgccugcauccugaccagccagacccugaugcgccuccugcggucccgcgaggccgcggccgccguggacgugaagacguggcccaccaucaucgacaccgacgaccugccccggaagcgccucccgcagcuguacaagccgcccacccccgagaugcuggccuaccucgacuucagcgucuccacgaccgggaugcugaccggcgugaagaugagccacagcgccgugaacgcgcugugccgggccaucaagcuccagugcgagcuguacuccagccgccagaucgccaucugccuggaccccuacugcgggcucggcuucgcccuguggugccugugcuccgucuacagcggccaccaguccgugcucaucccgcccauggagcuggagaacaaccuguuccucuggcugagcaccgugaaccaguacaagauccgggacacguucugcuccuacagcgucauggagcugugcaccaaggggcucggcaaccagguggaggugcugaagacccgcgggaucaaccuguccugcguccggaccugcgugguggucgccgaggagcgcccccggguggcgcuccagcagagcuucuccaagcuguucaaggacaucggccugagcccccgcgccguguccacgaccuucgggagccgcgucaacguggccaucugccuccagggcaccuccggccccgaccccaccaccguguacgucgaccucaagagccugcggcacgaccgcgugcggcugguggagcgcggggccccgcagucccugcugcucagcgaguccggcaagauccugcccggggucaagguggugaucgucaaccccgagacgaagggccccgugggggacagccaccugggcgagaucugggugaacagcccgcacaccgccuccggcuacuacaccaucuacgacagcgagacccuccaggcggaccacuucaacacgcggcuguccuucggggacgccgcccagacccugugggcccgcaccggcuaccucggguucguccggcgcaccgagcugacggcggccaccggcgagcggcacgacgcccuguacguggugggcgcccucgacgagacccuggagcugcgcgggcugcgguaccaccccaucgacaucgagaccagcgucucccgcauccaccggagcaucgccgagugcgcgguguucacguggaccaaccuccugguggucgugguggagcugugcggcuccgagcaggaggcccucgaccuggucccccuggugaccaacgucgugcucgaggagcacuaccugaucgugggggucgugguggucguggaccccggcgugaucccgaucaacagccgcggggagaagcagcggaugcaccuccgcgacuccuuccuggccgaccagcuggaccccaucuacgucgccuacaacauguga

SEQ ID NO: 29189 - RNA, 4671 nt, Artificial Sequence
  derived and/or modified sequence opt1 from DIP2C__Homo_sapiens__NP_055789
auggccgaccgcagccuggagggcauggcccucccccuggaggugcgggcgcgccuggccgagcucgagcuggagcuguccgagggggacaucacccagaagggcuacgagaagaagcggagcaagcucaucggggccuaccugccgcagccgccccgcgucgaccaggcccugccccaggagcggcgcgcccccgugacccccuccagcgcgucccgguaccaccgccggcgcagcuccggcagccgggacgagcgcuaccgguccgacgugcacacggaggccguccaggccgcccucgcgaagcacaaggagcgcaagauggccgugcccaugcccagcaagcggcgcucccuggugguccagaccagcauggacgccuacaccccgcccgacaccuccagcggguccgaggacgagggcagcgugcagggcgacucccaggggacgcccaccagcucccagggcagcaucaacauggagcacuggaucagccaggccauccacggguccaccaccagcacgaccuccagcuccagcacccaguccggcgggagcggcgccgcgcaccggcuggccgacgugauggcccagacccacaucgagaaccacuccgcgcccccggacgucacgaccuacaccagcgagcacuccauccagguggagcgcccccagggcagcaccgggucccggacggcccccaaguacggcaacgccgagcucauggagaccggggacggcgugcccgucagcucccgcgugagcgccaagauccagcagcuggugaacacccugaagcggccgaagcgcccgccccuccgcgaguucuucgucgacgacuucgaggagcugcuggaggugcagcagcccgaccccaaccagcccaagcccgagggcgcccagaugcucgccaugcgcggggagcagcugggcguggucaccaacuggcccccgucccuggaggccgcgcuccagcggugggggacgaucagccccaaggcccccugccugaccaccauggacaccaacggcaagccccuguacauccucacguacgggaagcuguggacccgguccaugaagguggccuacagcauccugcacaagcucggcaccaagcaggagccgauggugcgccccggcgaccgggucgcccugguguuccccaacaacgacccggccgcguucauggccgccuucuacgggugccugcucgccgaggugguccccgugcccaucgaggucccccugacccgcaaggacgcgggcagccagcagaucggguuccugcucggcuccugcggggugacgguggcccugaccagcgacgccugccacaagggccugccgaagucccccaccggcgagaucccccaguucaagggguggcccaagcuccugugguucgucaccgagagcaagcaccuguccaagccgccccgggacugguucccccacaucaaggacgccaacaacgacacggccuacaucgaguacaagaccugcaaggacggcagcgugcucggggugaccgucacccgcacggcgcugcugacccacugccaggcccucacccaggccugcggcuacaccgaggccgagaccaucgugaacgugcuggacuucaagaaggacgucgggcuguggcacggcauccucacguccgugaugaacaugaugcacgugaucagcauccccuacucccugaugaaggucaacccgcugagcuggauccagaaggugugccaguacaaggccaagguggcgugcgucaagucccgggacaugcacugggcccucguggcccaccgcgaccagcgggacaucaaccugagcucccugcgcaugcugaucguggccgacggcgccaaccccuggagcaucuccagcugcgacgcguuccucaacgucuuccaguccaaggggcugcggcaggaggugaucugccccugcgccagcagccccgaggcccugaccguggccauccgccggccgaccgacgacuccaaccagccgcccggccgcgggguccucagcaugcacggccugaccuacggcgugauccggguggacuccgaggagaagcugagcguccucacggugcaggacguggggcuggucaugcccggcgcgaucaugugcuccgugaagcccgacggggugccccagcugugccgcaccgacgagaucggcgagcucugcgucugcgccguggccaccgggaccagcuacuacggccuguccggcaugacgaagaacaccuucgagguguuccccaugaccagcuccggggcccccaucagcgaguacccguucauccggaccggccugcucggguucgucggccccgggggccugguguucguggucggcaagauggacgggcugauggugguguccggccgccgccacaacgccgacgacaucgucgcgacggcccucgccguggagcccaugaaguucguguaccgggggcgcaucgccgucuucagcgugaccgugcugcacgacgagcggaucgucaucguggccgagcagcgcccggacuccaccgaggaggacagcuuccaguggaugucccgggugcugcaggcgaucgacagcauccaccaggucggcguguacugccucgcccuggugcccgccaacacccugcccaagacgccccucgggggcauccaccuguccgagaccaagcagcuguuccucgagggcagccugcacccgugcaacguccugaugugcccccacacgugcgugaccaaccuccccaagccccgccagaagcagccggagaucgggcccgccuccgucauggugggcaaccuggugagcgggaagcggaucgcccaggcgagcggccgcgaccuggggcagaucgaggacaacgaccaggcccggaaguuccucuuccuguccgagguccugcaguggcgcgcccagaccacccccgaccacauccucuacacccugcugaacugccggggcgccaucgcgaacagccugaccugcgugcagcugcacaagcgcgccgagaagaucgccgugaugcugauggagcggggccaccuccaggacggggaccacgucgcccugguguacccgcccggcaucgaccugaucgccgcguucuacgggugccucuacgccggcugcgugcccaucacgguccgcccgccccacccccagaacaucgccaccacccugcccaccgugaagaugaucguggaggucucccggagcgccugccugaugacgacccagcucaucugcaagcugcugcgcucccgggaggccgcggccgccguggacgugcgcaccuggccccucauccuggacaccgacgaccugcccaagaagcggccggcccagaucugcaagcccugcaaccccgacacgcucgccuaccuggacuucagcgucuccaccaccggcaugcuggcgggggugaagaugagccacgccgccaccuccgccuucugccgcagcaucaagcuccagugcgagcuguaccccucccgggagguggccaucugccuggacccguacugcggccucggguucguccuguggugccugugcagcguguacuccggccaccagagcauccucaucccgcccuccgagcuggagacgaaccccgcgcuguggcuccuggccgugagccaguacaagguccgcgacaccuucugcuccuacagcgugauggagcugugcaccaaggggcucggcucccagaccgagagccugaaggcccgcggccuggaccucagccgggugcggaccugcgucgugguggccgaggagcgcccccgcaucgcgcugacgcaguccuucagcaagcuguucaaggaccucgggcugcacccccgggccgucuccaccagcuucggcugccgcgugaaccuggccaucugccuccaggggaccuccggccccgacccgaccacgguguacgucgacaugcgggcccugcgccacgaccgggugcgccugguggagcgggggagcccccacucccucccccugauggagagcggcaagauccugcccggcguccgcaucaucaucgccaacccggagaccaaggggccccucggcgacucccaccugggggagaucugggugcacagcgcgcacaacgccuccggcuacuucaccaucuacggggacgagagccugcaguccgaccacuucaacagccggcucuccuucggcgacacccagacgaucugggcccgcaccggcuaccugggguuccugcggcgcaccgagcucaccgacgccaacggcgagcggcacgacgcccuguacguggucggggcgcuggacgaggccauggagcuccgcggcaugcgguaccaccccaucgacaucgagacgagcgugauccgcgcccacaaguccgugaccgagugcgccgucuucaccuggaccaaccugcuggugguggucguggagcucgacggcagcgagcaggaggcccuggaccuggugccccuggucacgaacguggugcucgaggagcacuaccugaucgucggggugguggucguggucgacaucggcgugaucccgaucaacucccgcggggagaagcagcggaugcaccuccgcgacggcuuccucgcggaccagcuggaccccaucuacguggccuacaacauguga

SEQ ID NO: 29190 - RNA, 597 nt, Artificial Sequence
  derived and/or modified sequence opt1 from DIRAS1__Homo_sapiens__NP_660156
augcccgagcagagcaacgacuaccgcguggucguguucggcgccgggggcguggggaaguccagccugguccuccgguucgugaagggcaccuuccgcgacaccuacaucccgacgaucgaggacaccuaccgccaggugaucuccugcgacaagagcgucugcacccugcagaucaccgacacgaccgggucccaccaguuccccgccaugcagcggcugagcaucuccaagggccacgcguucauccucguguucagcgugaccuccaagcagagccuggaggagcugggccccaucuacaagcucaucguccagaucaagggguccguggaggacauccccgugaugcuggucggcaacaagugcgacgagacccagcgggagguggacacgcgcgaggcccaggccguggcccaggaguggaagugcgccuucauggagaccagcgcgaagaugaacuacaacgucaaggagcuguuccaggagcuccugacccuggagacccggcgcaacaugucccucaacaucgacgggaagcggagcggcaagcagaagcgcacggaccgggugaaggggaagugcacccugauguga

SEQ ID NO: 29191 - RNA, 600 nt, Artificial Sequence
  derived and/or modified sequence opt1 from DIRAS2__Homo_sapiens__NP_060064
augcccgagcagagcaacgacuaccgcguggccgucuucggcgccgggggcguggggaaguccagccuggugcuccgguucgucaagggcaccuuccgcgaguccuacaucccgaccguggaggacacguaccgccaggugaucagcugcgacaaguccaucugcacccugcagaucaccgacaccacggggagccaccaguuccccgcgaugcagcggcuguccaucagcaagggccacgccuucauccucgucuacuccaucaccagccggcagucccuggaggagcugaagcccaucuacgagcagaucugcgagaucaagggcgacguggagagcauccccaucaugcucguggggaacaagugcgacgaguccccgagccgcgagguccaguccagcgaggccgaggcccuggcccggaccuggaagugcgcguucauggagaccuccgccaagcugaaccacaacgugaaggagcuguuccaggagcuccugaaccucgagaagcgccggacggugagccugcagaucgacggcaagaaguccaagcagcagaagcgcaaggagaagcugaaggggaagugcgucaucauguga

SEQ ID NO: 29192 - RNA, 315 nt, Artificial Sequence
  derived and/or modified sequence opt1 from DIRC1__Homo_sapiens__XP_011508847
augcccgaggcccacaugcagccggccaagcugcagaccagccuccccaccacggaccacggcuccaagaagcccgugagcugcuaccugcccccgcuguccaacgcgcaccccaugugcaucgagguccagaacgcccagaacugcagcuccgccgccgccacccucgagcccagcaucaucuccgacacgugcuucuacaagcccaucaccaaggaccagcugagcucccgcagcgagcugaacaccgugcggcucaagugccugaacucccugcgcggguggaagauccucaaccagcugagccugaccuga

SEQ ID NO: 29193 - RNA, 1437 nt, Artificial Sequence
  derived and/or modified sequence opt1 from DIRC2__Homo_sapiens__NP_116228
augggcagccgcugguccagcgaggaggagcggcagccccugcucgggccgggccuggggcccggccugggggccuccuggcgcagccgggaggccgcggccgccgcccuccccgccgcggugcccggcccgggccgcgucuacgggcggcgcuggcuggugcugcuccuguucucccugcucgccuucgugcagggccuggucuggaacaccugggggcccauccagaacagcgcccggcaggccuacggcuucuccagcugggacaucgcgcugcucgugcugugggggcccaucggcuuccugcccugcuucgccuucauguggcuccuggacaagcgcggccugcggaucaccgugcuccugacguccuuccugaugguccucgggaccggccugcgcugcaucccgaucagcgaccugauccucaagcggcgccugauccacgggggccagaugcugaacggccucgccgggcccaccgugaugaacgccgcccccuuccuguccaccacgugguucagcgcggacgagcgggccaccgccaccgccaucgccuccaugcugagcuaccucggcggggcgugcgccuuccuggugggcccccuggucgugccggcccccaacgggaccagcccccuccuggccgccgaguccucccgcgcgcacaucaaggaccggaucgaggccgugcuguacgccgaguucggcgucgugugccucaucuucagcgccacgcuggccuacuucccgccccgcccgccccugccgcccuccguggcggccgccagccagcggcucagcuaccgccgguccgucugccgccugcugagcaacuuccgguuccucaugaucgcccuggcguacgccaucccccugggcguguucgccgggugguccggcgugcucgaccugauccugacccccgcccacgucagccagguggacgccggguggaucggcuucugguccaucgucgggggcugcguggugggcaucgcgauggcccgcuucgccgacuucauccgcgggaugcucaagcugauccugcugcuccuguucagcggcgccacccuguccagcaccugguucacgcugaccugccugaacuccaucacccaccucccccucaccacggugacccuguacgccagcugcauccugcucggggucuuccugaacuccagcgugcccaucuucuucgagcuguucgucgagaccguguaccccgugcccgagggcaucacgugcggggucgugaccuuccucuccaacauguucaugggcgugcugcuguucuuccucaccuucuaccacaccgagcugagcugguucaacuggugccugcccggcuccugccuccugagccugcuccugauccugugcuuccgggaguccuacgaccgccucuaccuggacgucguggugagcgucuga

SEQ ID NO: 29194 - RNA, 2787 nt, Artificial Sequence
  derived and/or modified sequence opt1 from DIS3__Homo_sapiens__NP_001121698
augcucaagagcaagaccuuccucaagaagacccgcgccggcggggugaugaagaucguccgggagcacuaccugcgcgacgacaucggcugcggggcccccggcugcgcggccugcgggggcgcccacgagggcccggcccuggagccccagccccaggaccccgccuccagcgugugcccgcagccccacuaccuccugcccgacacgaacgugcugcuccaccagaucgucuccgcguggcggcccgggaccugggccagcguggccuccagccugcgccugccgggcucccucgagaccuacguggagcaggagcagggggagaacgccaacgaccggaacgaccgcgcgauccgggucgccgccaagugguacaacgagcaccugaagaagaugagcgccgacaaccagcuccaggugaucuucaucaccaacgaccgccggaacaaggagaaggccaucgaggagggcauccccgcguucacgugcgaggaguacgugaagucccugaccgccaaccccgagcugaucgaccgccuggccugccucagcgaggaggggaacgagaucgaguccggcaagaucaucuucagcgagcaccucccccuguccaagcugcagcagggcaucaagagcgggaccuaccugcagggcaccuuccgggccucccgcgagaacuaccuggaggccacggucuggauccacggggacaacgaggagaacaaggagaucauccuccagggccugaagcaccugaaccgggcggugcacgaggacaucguggccgucgagcuccugcccaagagccaguggguggcccccuccagcgugguccugcacgacgagggccagaacgaggaggacguggagaaggaggaggagaccgagcgcaugcucaagaccgccguguccgagaagaugcugaagcccaccgggcgggucgugggcaucaucaagcgcaacuggcggcccuacugcgggaugcugagcaagagcgacaucaaggagucccgccggcaccucuucacgccggccgacaagcgcaucccccggauccgcaucgagacccgccaggcgagcacccuggagggccggcgcaucaucguggccaucgacggguggccccggaacucccgcuaccccaacggccacuucguccggaaccugggcgacgugggggagaaggagaccgagacggaggugcuccugcuggagcacgacgucccgcaccagcccuucagccaggccgugcucuccuuccugcccaagaugcccuggagcaucaccgagaaggacaugaagaaccgcgaggaccugcggcaccucugcaucugcuccgucgacccgcccggcugcaccgacaucgacgacgcccugcacugccgcgagcuggagaacgggaaccucgaggugggcgugcacaucgccgacgucagccacuucauccggcccgggaacgcgcuggaccaggaguccgcccgccggggcaccacgguguaccugugcgagaagcgcaucgacauggugcccgagcuccugagcuccaaccugugcagccucaagugcgacgucgaccggcuggccuucuccugcaucugggagaugaaccacaacgccgagauccugaagaccaaguucaccaagagcgugaucaacuccaaggcgagccugaccuacgccgaggcccagcuccgcaucgacuccgccaacaugaacgacgacaucacgaccagccugcggggccugaacaagcucgccaagauccugaagaagcgccggaucgagaagggggcgcugacccucuccagcccggaggugcgcuuccacauggacagcgagacccacgaccccaucgaccugcagacgaaggagcugcgggagaccaacuccauggucgaggaguucaugcuccuggccaacaucagcguggccaagaagauccacgaggaguucuccgagcacgcccugcuccgcaagcaccccgccccgccgcccagcaacuacgagauccuggugaaggcggcccgcucccggaaccuggagaucaagaccgacaccgccaagagccucgccgagucccuggaccaggccgagagccccacguucccguaccugaacacccuccugcgcauccuggcgacccggugcaugaugcaggccgucuacuucugcuccggcauggacaacgacuuccaccacuacgggcucgccagccccaucuacacccacuucacgucccccauccgccgguacgccgacgugaucgugcaccgccugcuggcggucgccaucggcgccgacugcaccuaccccgagcucaccgacaagcacaagcuggccgacaucugcaagaaccugaacuuccggcacaagauggcccaguacgcgcagcgcgccagcguggccuuccacacccagcuguucuucaaguccaaggggaucgugagcgaggaggccuacauccuguucguccggaagaacgccaucguggugcugaucccgaaguacggccucgagggcaccgucuucuucgaggagaaggacaagcccaacccccagcugaucuacgacgacgagauccccucccugaagaucgaggacacgguguuccacguguucgacaaggucaaggugaagaucaugcucgacagcuccaaccugcagcaccagaagauccgcaugagccugguggagccgcagauccccgggaucagcauccccaccgacaccuccaacauggaccucaacggccccaagaagaagaagaugaagcuggggaaguga

SEQ ID NO: 29195 - RNA, 1812 nt, Artificial Sequence
  derived and/or modified sequence opt1 from DIS3L2__Homo_sapiens__NP_001244210
augagccaccccgacuaccgcaugaaccugcggccgcugggcacgccccgcgggguguccgccgucgccggcccccacgacaucggggcgagccccggcgacaagaaguccaagaaccggagcacccgcgggaagaagaaguccaucuucgagaccuacaugagcaaggaggacguguccgagggccugaagcggggcacccugauccagggggugcuccgcaucaacccgaagaaguuccacgaggccuucauccccagccccgacggcgaccgggacaucuucaucgacggggucguggcccgcaaccgggcccugaacggcgaccugguggucgugaagcuccugcccgaggagcacuggaagguggucaagccggaguccaacgacaaggagaccgaggccgcguacgagagcgacauccccgaggagcugugcgggcaccaccucccccagcagucccucaagagcuacaacgacucccccgacgugaucguggaggcccaguucgacggcagcgacuccgaggacggccacgggaucacccagaacguccugguggacggcgugaagaagcucagcgucugcguguccgagaaggggcgcgaggacggcgacgccccggugacgaaggacgagacgaccugcaucagccaggacacccgggcccuguccgagaagucccugcagcgcagcgcgaaggucguguacauccucgagaagaagcacagccgggccgccaccggcuuccugaagcugcucgccgacaagaacagcgagcuguuccgcaaguacgcccuguucucccccagcgaccaccgggugccccgcaucuacgucccccucaaggacugcccgcaggacuucguggcgcggcccaaggacuacgccaacacccuguucaucugccgcaucguggacuggaaggaggacugcaacuucgcccuggggcagcucgccaagucccugggccaggccggggagaucgagcccgagaccgagggcauccugaccgaguacggggucgacuucagcgacuucuccagcgaggugcucgagugccugccccagggccugccguggacgaucccgcccgaggaguucuccaagcggcgcgaccuccggaaggacugcaucuucaccaucgaccccagcaccgcgcgcgaccuggacgacgcccuguccugcaagccccucgccgacggcaacuucaaggucggggugcacaucgccgacgugagcuacuucguccccgagggcuccgaccuggacaagguggccgcggagcgcgccaccagcguguaccugguccagaagguggugcccaugcucccccggcugcugugcgaggagcucugcucccugaacccgaugagcgacaagcugacguucuccgucaucuggacccucacccccgaggggaagauccuggacgagugguucggccgcaccaucauccggagcugcacgaagcuguccuacgagcacgcccagagcaugaucgagagccccaccgagaagaucccggccaaggagcucccgcccaucucccccgagcacagcuccgaggaggugcaccagcagaacgccgacaaggacggggcggcccaccuccaggccagccacucccccagcgccgaggacgcggaggcccagcccuccaccgaggagcgccugcccgagacccggggcaucugcgaccgcgaccccgacacgcggcuguucuuccugcagcagcagagccgcgugcuggaggccaagccgcagaacaccauccgggucgaggagcagaccacccagcugcagaucuga

SEQ ID NO: 29196 - RNA, 3165 nt, Artificial Sequence
  derived and/or modified sequence opt1 from DIS3L__Homo_sapiens__NP_001137160
augcugcagaagcgcgagaaggugcuccugcugcggaccuuccagggccgcacccuccggaucguccgcgagcacuaccugcggcccugcgugccgugccacagcccccugugcccccagcccgccgccugcucccacgacgggaagcuccugagcuccgacgugacgcacuacgucaucccggacuggaagguggugcaggacuaccuggagauccucgaguuccccgagcugaagggcaucaucuucaugcagaccgcgugccaggccguccagcaccagcgcgggcggcgccaguacaacaagcugcggaaccuccugaaggacgcccgccacgacugcauccuguucgccaacgaguuccagcagugcugcuaccucccccgggagcgcggcgagagcauggagaaguggcagacccgguccaucuacaacgccgcggugugguacuaccaccacugccaggaccgcaugcccaucgugauggucaccgaggacgaggaggccauccagcaguacgggagcgagacggagggcguguucgugaucaccuucaagaacuaccuggacaacuucuggccggaccugaaggccgcccacgagcucugcgacuccauccugcagagccggcgcgagcgggagaacgagucccaggagagccacggcaaggaguaccccgagcaccucccccuggagguccuggaggcggggaucaaguccggccgcuacauccaggggauccugaacgugaacaagcaccgggcccagaucgaggccuucgugcgccuccagggcgccagcuccaaggacagcgaccuggucuccgacauccugauccacgggaugaaggcccggaaccgcagcauccacggcgacgugguggucguggagcuccugcccaagaacgaguggaagggccgcaccguggcgcugugcgagaacgacugcgacgacaaggccuccggggagagcccguccgagcccaugcccaccggccgggucguggggauccuccagaagaacuggcgcgacuacguggucacguuccccagcaaggaggaggugcagagccagggcaagaacgcccagaagauccuggucaccccgugggacuaccggauccccaagauccgcaucuccacccagcaggccgagacccugcaggacuuccggguggugguccgcaucgacagcugggaguccacgagcguguaccccaacggccacuucgugcggguccucgggcgcaucggcgaccuggagggggagaucgccaccauccugguggagaacuccaucagcgugauccccuucuccgaggcgcagaugugcgagaugccggucaacacccccgagagccccuggaaggugucccccgaggaggagcagaagcggaaggaccuccgcaagagccaccugguguucuccaucgacccgaagggcugcgaggacgucgacgacacccugagcgugcggacgcucaacaacgggaaccuggagcugggcgugcacaucgccgacgucacccacuucguggcccccaacuccuacaucgacaucgaggcccgcacccgggccaccacguacuaccucgcggaccgccgguacgacaugcugcccagcgugcuguccgccgaccucugcagccugcugggcggggucgaccgcuacgccguguccaucaugugggagcucgacaaggccagcuacgagaucaagaaggugugguacggccggaccaucauccgcuccgccuacaagcuguucuacgaggcggcccaggagcugcuggacgggaaccucagcgucguggacgacauccccgaguucaaggaccuggacgagaagucccggcaggccaagcuggaggagcucgugugggccaucggcaagcugaccgacaucgcgcgccacguccgcgccaagcgggacgggugcggcgcccuggagcucgagggcguggaggugugcguccagcuggacgacaagaagaacauccacgaccugaucccgaagcagccccucgaggugcacgagaccguggccgagugcaugauccuggccaaccacugggucgcgaagaagaucugggagagcuucccccaccaggcccugcuccgccagcacccgccgccccaccaggaguucuucagcgagcugcgggagugcgccaaggccaagggguucuucaucgacacgcgcuccaacaagacccuggccgacagccucgacaacgcgaacgacccccacgaccccaucgugaaccggcugcugcgcuccauggccacccaggccaugagcaacgcccucuacuucuccaccggcagcugcgccgaggaggaguuccaccacuacgggcuggcgcuggacaaguacacgcacuucaccucccccauccggcgcuacagcgacaucgugguccaccggcuccugauggccgccaucuccaaggacaagaagauggagaucaagggcaaccuguucagcaacaaggaccucgaggagcugugccgccacaucaacaaccggaaccaggccgcgcagcacucccagaagcagagcaccgagcuguuccagugcauguacuucaaggacaaggaccccgccaccgaggagcgcugcaucuccgacggggugaucuacagcauccggacgaacggcgugcuccuguucaucccccgcuucggcaucaagggggccgccuaccugaagaacaaggacggccucgucaucuccugcgggccggacagcugcagcgaguggaagcccggcucccugcagcgguuccagaacaagaucaccagcaccaccacggacggcgaguccgugaccuuccaccuguucgaccacgugaccguccgcaucagcauccaggccucccggugccacagcgacaccauccgccucgagaucaucuccaacaagcccuacaagauccccaacaccgagcugauccaccagagcuccccgcugcucaagagcgagcuggugaaggaggugacgaaguccgucgaggaggcgcagcuggcccaggaggugaaggugaacaucauccaggaggaguaccaggaguaccggcagaccaaggggcgcagccucuacacccugcuggaggagauccgggaccucgcccugcuggacgucuccaacaacuacggcaucuga

SEQ ID NO: 29197 - RNA, 2499 nt, Artificial Sequence
  derived and/or modified sequence opt1 from DISC1__Homo_sapiens__NP_001012975
augcccggcgggggcccgcagggggcccccgccgcggccggcgggggcggcgugagccaccgcgccgggucccgggacugccugccgcccgccgccugcuuccgccggcgccggcucgcgcgccggcccggcuacaugcgcagcuccaccgggcccggcaucggguuccugagccccgccgucggcacccuguuccgguuccccggcgggguguccggcgaggagagccaccacuccgagagccgcgcccggcagugcgggcucgacucccgcggccugcuggugcggagcccggucuccaagagcgccgcggcccccacggugaccuccgugcgcggcaccagcgcccacuucgggauccagcuccggggcgggacccgccugcccgaccggcuguccuggcccugcggcccggggagcgccggcuggcagcaggaguucgccgcgauggacuccagcgagacgcucgacgccuccugggaggccgccugcagcgacggcgcccgccggguccgcgcggccgggagccugcccuccgccgagcugagcuccaacagcugcucccccggcugcgggcccgaggugccgcccaccccgcccggcagccacuccgccuucaccagcuccuucagcuucauccggcucucccuggggagcgccggcgagcgcggcgaggcggaggggugcccgcccucccgcgaggccgagagccacugccagagcccccaggagaugggcgccaaggccgccucccuggacgggccccacgaggacccccggugccucucccgccccuucagccugcuggcgacccggguguccgccgaccucgcccaggccgcgcgcaacagcagccggcccgagcgcgacaugcacucccugcccgacauggacccgggcagcuccagcucccuggaccccagccucgccgggugcggcggcgacggguccagcggcuccggggacgcccacagcugggacacgcugcugcggaagugggagcccguccuccgcgacugccugcugcggaaccgccggcagauggaggugaucucccuccgccugaagcugcagaagcuccaggaggacgccguggagaacgacgacuacgacaaggccgagacccugcagcagcggcuggaggaccucgagcaggagaagaucagccugcacuuccagcugccgucccgccagcccgcgcucagcuccuuccugggccaccuggccgcccagguccaggccgcccuccggcgcggcgcgacccagcaggccagcggggacgacacccacacgccccugcggauggagccccgccugcucgagccgaccgcccaggacucccugcacgugagcaucacccggcgcgacuggcugcuccaggagaagcagcagcugcagaaggagaucgaggcccugcaggcccgcauguucgugcucgaggcgaaggaccagcagcugcggcgcgagaucgaggagcaggagcagcagcugcaguggcagggcugcgaccugacgccccucgucgggcagcugagccugggccagcuccaggagguguccaaggcccugcaggacacccuggccagcgccgggcagauccccuuccacgcggagcccccggagaccauccggucccuccaggagcgcaucaagagccugaaccugucccucaaggagaucaccaccaaggugugcaugagcgagaaguucugcuccacgcugcggaagaaggucaacgacaucgagacccagcugcccgcccuccuggaggccaagaugcacgccaucagcggcaaccacuucuggaccgccaaggaccugaccgaggagauccgcucccucacgagcgagcgggagggccuggaggggcugcucuccaagcugcuggugcucagcucccgcaacgugaagaagcugggcagcgucaaggaggacuacaaccggcugcgccgggagguggagcaccaggagaccgcguacgagaccuccgugaaggagaacaccaugaaguacauggagacgcucaagaacaagcugugcagcugcaagugcccccugcucgggaaggucugggaggccgaccuggaggccugccgccugcucauccagucccugcagcugcaggaggcccggggcagccucuccguggaggacgagcgccagauggacgaccuggagggggccgcgcccccgaucccgccccggcugcacagcgaggacaagcgcaagacgccccucaaggagagcuacauccuguccgccgagcugggcgagaagugcgaggacaucggcaagaagcuccuguaccuggaggaccagcuccacaccgccauccacagccacgacgaggaccugauccagucccugcggcgcgagcuccagauggucaaggagacccugcaggccaugauccugcagcuccagcccgccaaggaggcgggggagcgggaggccgccgccagcugcaugaccgcgggcgugcacgaggcccaggccuga

SEQ ID NO: 29198 - RNA, 4575 nt, Artificial Sequence
  derived and/or modified sequence opt1 from DISP1__Homo_sapiens__NP_116279
auggccaugagcaacggcaacaacgacuucgugguccuguccaacagcuccaucgccaccagcgcggccaaccccuccccgcucacccccugcgacggggaccacgccgcccagcagcugacgcccaaggaggccacccgcaccaaggugagccccaacggcugccugcagcucaacgggaccgugaaguccagcuuccugccgcuggacaaccagcggaugccccagaugcucccccagugcugccaccccugcccguaccaccacccccugacgucccacagcucccaccaggagugccaccccgaggcgggccccgccgccccgagcgcccuggcguccugcugcaugcagccccacagcgaguacuccgccagccucugccccaaccacucccccgucuaccagacgaccugcugccugcagccgagccccuccuucugccugcaccaccccuggcccgaccacuuccagcaccagccggugcagcagcacaucgccaacauccgccccagccggcccuucaagcuccccaagagcuacgccgcccugaucgcggacuggccgguggucgugcuggggaugugcaccauguucaucguggucugcgcccucgugggcgugcugguccccgagcugcccgacuucuccgacccccuccugggcuucgagccgcgcgggaccgccaucggccagcggcuggugaccuggaacaacauggugaagaacaccggguacaaggccacccucgccaacuaccccuucaaguacgcggacgagcaggccaagagccaccgcgacgaccggugguccgacgaccacuacgagcgcgagaagcgggaggucgacuggaacuuccacaaggacagcuucuucugcgacgugcccuccgaccgcuacagccggguggucuucacguccagcggcggggagacccuguggaaccugccggccaucaaguccaugugcaacguggacaacagccgcauccggucccacccccaguucggcgaccucugccagcgcaccaccgccgccagcugcugccccuccuggacgcugggcaacuacaucgcgauccugaacaaccggagcuccugccagaagaucguggagcgcgacgucagccacacccucaagcugcugcggaccugcgccaagcacuaccagaacgggacccucggccccgacugcugggacauggccgcccgccggaaggaccagcugaagugcacgaacgugccgcgcaagugcaccaaguacaacgccguguaccagauccugcacuaccucgucgacaaggacuucaugacccccaagaccgcggacuacgccacgcccgcccugaaguacuccaugcuguucagccccaccgagaagggggaguccaugaugaacaucuaccucgacaacuucgagaacuggaacagcagcgacggcgugaccaccaucacgggcaucgaguucgggaucaagcacucccuguuccaggacuaccugcucauggacaccgucuacccggccaucgcgaucgugaucgugcugcuggucaugugcguguacaccaagagcauguucaucacccucaugacgauguucgccaucaucuccagccugaucguguccuacuuccuguaccgggucguguuccacuucgaguucuuccccuucaugaaccucaccgcccugaucauccuggugggcaucggggccgacgacgccuucguccucugcgacguguggaacuacaccaaguucgacaagccccacgcggagaccagcgagacgguguccaucacccugcagcacgccgcccugagcauguucgucaccuccuucaccaccgccgccgcguucuacgccaacuacgugagcaacaucacggccauccgcugcuucggcguguacgccgggaccgccauccuggucaacuacgugcucauggugaccuggcugcccgcggucguggugcugcacgagcgcuaccuccugaacaucuucacgugcuucaagaagccgcagcagcagaucuacgacaacaaguccugcuggaccgucgccugccagaagugccacaaggugcuguucgccaucagcgaggccucccggaucuucuucgagaaggugcuccccugcaucgucaucaaguuccgcuaccuguggcuguucugguuccucgcgcugaccgugggcggcgccuacaucgugugcaucaaccccaagaugaagcugcccagccucgagcuguccgaguuccaggucuuccggagcucccacccguucgagcgcuacgacgccgaguacaagaagcuguucauguucgagcgggugcaccacggggaggagcuccacaugcccaucaccgugaucuggggcgucagccccgaggacaacgggaacccccugaaccccaagagcaagggcaagcugacccucgacuccagcuucaacaucgccucccccgccagccaggcguggauccugcacuucugccagaagcugcgcaaccagacguucuucuaccagaccgacgagcaggacuucaccuccugcuucaucgagaccuucaagcaguggauggagaaccaggacugcgacgagcccgcccucuaccccugcugcagccacugguccuucccguacaagcaggagaucuucgagcugugcaucaagcgggccaucauggagcuggagcgcagcacgggguaccaccucgacuccaagacccccggcccccgguucgacaucaacgacaccauccgcgccguggugcuggaguuccagagcaccuaccuguucacgcucgccuacgagaagaugcaccaguucuacaaggaggucgacuccuggaucagcuccgagcugagcuccgcgccggagggccugagcaacgggugguucguguccaaccucgaguucuacgaccugcaggacagccuguccgacggcacccucaucgccauggggcugagcguggccgucgccuucagcgugaugcugcucaccaccuggaacaucaucaucucccuguacgccaucaucagcaucgcgggcacgaucuucgugaccgucgggucccuggugcuccugggcugggagcugaacgugcucgagagcgucaccaucuccguggccgugggccugagcgucgacuucgccgugcacuacgggguggccuaccggcuggcgcccgaccccgaccgcgagggcaaggucaucuucucccucagccgggugggguccgccauggccauggccgcccugaccacguucguggcgggcgccaugaugaugcccagcaccguccuggccuacacccagcucggcaccuucaugaugcugaucaugugcaucuccugggccuucgccacguucuucuuccagugcaugugccgcugccuggggccgcaggggaccugcggccagaucccccuccccaagaagcugcagugcagcgcguucucccacgcccugagcaccucccccagcgacaagggccaguccaagacccacacgaucaacgccuaccaccucgacccgcgggggcccaagagcgagcuggagcacgaguucuacgagcuggagccccucgccucccacagcugcaccgcccccgagaagaccaccuacgaggagacgcacaucugcagcgaguucuucaacucccaggcgaagaaccugggcaugccggugcacgccgccuacaacagcgagcuguccaagagcaccgaguccgacgccggcagcgcccuccugcagccgccccuggagcagcacaccgucugccacuucuucucccucaaccagcgcugcagcugccccgacgcguacaagcaccugaacuacgggccgcacuccugccagcagaugggcgacugccugugccaccagugcagccccaccaccuccagcuucgugcagauccagaacgggguggcgccccucaaggccacgcaccaggccgucgagggcuucgugcaccccaucacccacauccaccacugcccgugccugcaggggcgggugaagcccgccggcaugcagaacucccugccccgcaacuucuuccuccaccccguccagcacauccaggcccaggagaagaucggcaagaccaacgugcacagccugcagcgguccaucgaggagcaccucccgaagauggccgagcccagcuccuucgugugccgcagcaccgggucccugcugaagacgugcugcgaccccgagaacaagcagcgcgagcugugcaagaaccgggacgucagcaaccucgagagcuccggcgggaccgagaacaaggccggcgggaagguggagcugagccugucccagaccgacgccagcgugaacuccgagcacuucaaccagaacgagcccaagguccucuucaaccaccugaugggcgaggcgggcugccgcagcugcccgaacaacucccagagcugcgggcggaucgugcgcgugaagugcaacuccgucgacugccagaugcccaacauggaggccaacgugcccgccgugcugacccacagcgagcucuccggcgagagccugcugaucaagacgcucuga

SEQ ID NO: 29199 - RNA, 2052 nt, Artificial Sequence
  derived and/or modified sequence opt1 from DIXDC1__Homo_sapiens__NP_001033043
augcuggccugccucacccgcggcaaccugcuggacgugcuccaggagggguucaacgagcagcagcugcaggccuacgucgcgugggugaacgcccagcugaagaagcggcccgccgugaagccgguccaggaccuccgccaggaccugcgggacggcgugauccuggccuaccucaucgagaucguggccggggagaagcugagcggcguccagcugucccccgggaaccagcaggagaugaagaacaacguggagaaggugcuccaguucgucgcgagcaagaagauccgcaugcaccagaccuccgccaaggacaucguggacggcaaccugaaguccaucaugcggcuggugcucgcccuggccgcgcacuucaagcccggcuccagccgcacggucaaccaggggcgggacucccgcgcgccccugcagagccaccggccgcacugcgccaccgccguggcccagggcgccgccgccgcccucgccgacgugugccacgacaugucccgcagcgggcgggacgucuuccgcuaccggcagcgcaacuccagcauggacgaggagaucgagaaccccuacugguccgugcgggcgcuggugcagcaguacgagggccagcagcgcagccccuccgagagcuccugcagcucccugaccagccccagcccgauccacuccgccaagagcgaguccaucaucacccagagcgaggagaaggccgacuucgucaucauccccgccgaggggaucgagaaccggacggagggcaccgacagcccccucagccgcgacuggcggcccggcuccccggggaccuaccuggagaccagcugggaggagcagcugcucgagcagcaggaguaccuggagaaggagauggaggaggccaagaagaugaucuccggccugcaggcgcuccugcugaacgggagccuccccgaggacgagcaggagcgcccccuggcccugugcgagcccggcgugaacccggaggagcagcucaucaucauccagucccggcuggaccagagcauggaggagaaccaggaccugaagaaggagcuccugaagugcaagcaggaggcccgcaaccugcagggcaucaaggacgcccuccagcagcgccugacgcagcaggacaccuccgugcugcagcucaagcaggagcugcugcgggccaacauggacaaggacgagcuccacaaccagaacgucgaccugcagcgcaagcuggacgagcggaaccgccuccugggggaguacaagaaggagcugggccagaaggaccggcugcuccagcagcaccaggcgaagcuggaggaggcccugcgcaagcucagcgacguguccuaccaccagguggaccuggagcgggagcuggagcacaaggacguccuccuggcccacugcaugaagcgcgaggccgacgaggcgaccaacuacaacagccacaacucccagagcaacggguuccugcuccccaccgccggcaagggggccacguccgugagcaaccggggcaccagcgaccugcagcugguccgcgacgcccuccggucccugcgcaacagcuucuccggccacgacccccagcaccacaccaucgacagccuggagcaggggaucuccagccucauggagcggcugcacgugauggagacccagaagaagcaggagcgcaaggugcgggucaagagcccccgcacccaggugggcuccgaguaccgggaguccuggccgcccaacagcaagcugccccacucccagagcucccccaccgugagcuccacgugcaccaagguccucuacuucacggaccgcagccugaccccguucauggugaacauccccaagcggcuggaggaggugacccucaaggacuucaaggccgcgaucgaccgcgaggggaaccaccgcuaccacuucaaggcccuggaccccgaguucggcaccgucaaggaggagaucuuccacgacgacgacgccauccccgggugggagggcaagaucguggccuggguggaggaggaccacggcgagaacuga

SEQ ID NO: 29200 - RNA, 1545 nt, Artificial Sequence
  derived and/or modified sequence opt1 from DKC1__Homo_sapiens__NP_001354
auggccgacgccgaggugaucauccugcccaagaagcacaagaagaagaaggagcgcaagagccucccggaggaggacgucgcggagauccagcacgccgaggaguuccugaucaagcccgaguccaagguggccaagcuggacaccagccaguggccccuccugcugaagaacuucgacaagcucaacgugcggaccacgcacuacacgccccuggccugcggcuccaacccgcugaagcgcgagaucggggacuacauccggaccggcuucaucaaccucgacaagcccagcaaccccuccagccacgaggucguggccuggauccgccggauccugcgcguggagaagaccgggcacuccggcacccuggaccccaaggucaccgggugccucaucgugugcaucgagcgggcgacccgccuggucaagagccagcaguccgccggcaaggaguacgugggcaucgugcggcugcacaacgccaucgagggcgggacccagcucagccgcgcccuggagacgcugaccggggcccucuuccagcggccgccccugaucgccgccgugaagcgccagcugcggguccgcaccaucuacgaguccaagaugaucgaguacgaccccgagcggcgccucggcaucuucugggugagcugcgaggccgggaccuacauccggacgcugugcgugcaccugggccuccugcugggcgucgggggccagaugcaggagcuccgccgggugcgcuccggggugaugagcgagaaggaccacauggucaccaugcacgacgugcuggacgcccaguggcuguacgacaaccacaaggacgaguccuaccuccggcgcguggucuacccccuggagaagcugcucaccagccacaagcgccuggugaugaaggacuccgcggugaacgccaucugcuacggcgccaagaucaugcugccgggcguccuccgguacgaggacgggaucgaggugaaccaggagaucgucgugaucaccacgaagggcgaggccaucugcauggccaucgcgcugaugaccaccgccgugaucagcacgugcgaccacgggaucgucgccaagaucaagcgcgugaucauggagcgggacaccuacccccgcaaguggggccuggggcccaaggccucccagaagaagcucaugaucaagcagggccugcuggacaagcacggcaagcccaccgacagcaccccggccaccuggaagcaggaguacguggacuacagcgaguccgcgaagaaggaggucguggccgagguggucaaggcgccccaggugguggccgaggccgcgaagacggccaagcggaagcgcgagagcgaguccgagagcgacgagaccccgcccgccgcgccccagcucaucaagaaggagaagaagaaguccaagaaggacaagaaggccaaggccgggcuggagagcggcgccgagcccggggacggcgacuccgacaccaccaagaagaagaagaagaagaagaaggccaaggaggucgagcuggugagcgaguga

SEQ ID NO: 29201 - RNA, 801 nt, Artificial Sequence
  derived and/or modified sequence opt1 from DKK1__Homo_sapiens__NP_036374
augauggcccugggcgccgcgggggccacccgcguguucgucgccaugguggccgccgcgcucggcgggcacccccugcugggcgugagcgccacccucaacuccguccugaacagcaacgccaucaagaaccugccgccgccccucgggggcgccgcgggccaccccggguccgccgugagcgccgcccccggcauccuguaccccgggggcaacaaguaccagaccaucgacaacuaccagcccuaccccugcgccgaggacgaggagugcgggaccgacgaguacugcgcguccccgacccggggcggcgacgccggggugcagaucugccuggccugccgcaagcggcgcaagcggugcaugcgccacgccaugugcugccccggcaacuacugcaagaacgggaucugcgucagcuccgaccagaaccacuuccggggcgagaucgaggagaccaucacggagagcuucggcaacgaccacuccacccucgacggguacagccgccggaccacccuguccagcaagauguaccacacgaagggccaggagggguccgugugccugcgcagcuccgacugcgccagcggccucugcugcgcgcggcacuucugguccaagaucugcaagcccgugcugaaggaggggcaggucugcaccaagcaccgccggaagggcagccacggccuggagaucuuccagcgcugcuacugcggggagggccucuccugccggauccagaaggaccaccaccaggccagcaacagcucccgccugcacacgugccagcggcacuga

SEQ ID NO: 29202 - RNA, 780 nt, Artificial Sequence
  derived and/or modified sequence opt1 from DKK2__Homo_sapiens__NP_055236
auggccgcccugaugcgcagcaaggacuccagcugcugccuccugcugcucgcggccgugcugauggucgaguccagccagaucggcuccagccgggccaagcugaacuccaucaagagcucccucgggggcgagacccccgggcaggccgccaaccgcagcgcgggcauguaccaggggcuggccuucggcggcuccaagaaggggaagaaccugggccaggccuacccgugcagcuccgacaaggagugcgagguggggcgguacugccacagcccccaccagggcuccagcgccugcauggugugccgccggaagaagaagcgcugccaccgggacgggaugugcugccccuccacccgcugcaacaacggcaucugcauccccgucacggagagcauccucaccccgcacauccccgcgcuggacggcacccggcaccgcgaccggaaccacgggcacuacuccaaccacgaccugggcuggcagaaccucgggcgcccccacaccaagaugagccacaucaagggccacgagggcgaccccugccugcggagcuccgacugcaucgagggguucugcugcgcccgccacuucuggacgaagaucugcaagccggugcugcaccagggcgaggugugcaccaagcagcggaagaaggggagccacggccucgagaucuuccagcgcugcgacugcgccaaggggcuguccugcaaggucuggaaggacgccaccuacagcuccaaggcccggcugcacgugugccagaagaucuga

SEQ ID NO: 29203 - RNA, 1053 nt, Artificial Sequence
  derived and/or modified sequence opt1 from DKK3__Homo_sapiens__XP_006718241
augcagcgccugggcgccacccuccugugccugcuccuggccgcggccgugcccaccgccccggcccccgcccccacggcgaccagcgcccccgucaagccggggcccgcccuguccuacccccaggaggaggccacccucaacgagauguuccgggagguggaggagcugauggaggacacccagcacaagcugcgcagcgcgguggaggagauggaggccgaggaggccgccgccaaggcguccagcgaggucaaccucgccaaccugcccccguccuaccacaacgagacgaacaccgacaccaaggugggcaacaacaccauccacgugcaccgggagauccacaagaucacgaacaaccagaccgggcagauggucuucagcgagaccgugaucaccuccgugggcgacgaggaggggcgccggagccacgagugcaucaucgacgaggacugcggccccuccauguacugccaguucgccagcuuccaguacacgugccagcccugccgcggccagcggaugcugugcacccgcgacuccgagugcugcggggaccagcucugcgucuggggccacugcaccaagauggccacccgggggagcaacggcacgaucugcgacaaccagcgcgacugccagcccgggcugugcugcgccuuccagcggggccuccuguucccggugugcacgccccugcccguggagggcgagcugugccacgaccccgcgucccgccuccuggaccugaucaccugggagcucgagccggacggggcccuggaccggugccccugcgccagcggccugcucugccagccccacucccacagccuggucuacgugugcaagcccaccuucguggggucccgcgaccaggacggcgagauccugcucccgcgggagguccccgacgaguacgaggugggcagcuucauggaggaggugcgccaggagcuggaggaccuggagcggucccucaccgaggagauggcccugcgcgagcccgccgcggccgccgccgcccugcucgggggcgaggagaucuga

SEQ ID NO: 29204 - RNA, 675 nt, Artificial Sequence
  derived and/or modified sequence opt1 from DKK4__Homo_sapiens__XP_011542791
augguggccgccguccugcucggccugagcuggcugugcagcccccucggggcgcuggugcuggacuucaacaacauccgcuccuccgccgaccuccacggcgcccggaaggggagccagugccuguccgacaccgacugcaacacccgcaaguucugccugcagccgcgggacgagaagcccuucugcgccacgugccgcggccuccggcgccggugccagcgcgacgccaugugcugccccgggacccugugcgugaacgacgucugcaccaccauggaggacgcgacgcccauccuggagcggcagcucgacgagcaggacggcacccacgccgagggcaccaccgggcacccggugcaggagaaccagcccaagcgcaagcccagcaucaagaagucccagggccggaaggggcaggagggcgagagcugccugcgcacguucgacugcgggcccggccugugcugcgcccggcacuucuggaccaagaucugcaagccggugcuccuggagggccaggucugcucccgccgggggcacaaggacaccgcccaggcgcccgagaucuuccagcgcugcgacugcggccccgggcugcucugccggagccagcugaccuccaaccgccagcacgcccggcugcgcgugugccagaagaucgagaagcucuga

SEQ ID NO: 29205 - RNA, 636 nt, Artificial Sequence
  derived and/or modified sequence opt1 from DKKL1__Homo_sapiens__NP_001184230
augggcgaggccagcccgcccgcccccgcgcgccggcaccuccuggugcugcugcuccugcuguccacccucgucauccccagcgccgccgcccccauccacgacgccgacgcgcaggaguccagccuggggcugaccggccuccagucccugcugcagggguucagccgccucuuccugaagggcaaccugcuccgggggaucgacucccuguucagcgccccgauggacuuccgcggccugcccggcaacuaccacaaggaggagaaccaggagcaccagcucgggaacaacacgcuguccagccaccuccagaucgacaaggugccccggauggaggagaaggaggcccuggugcccauccagaaggccaccgacuccuuccacaccgagcugcacccgcgcgucgcguucuggaucaucaagcugccccggcgccggagccaccaggacgcccucgagggcgggcacuggcuguccgagaagcgccaccggcugcaggccauccgcgacggccuccggaaggggacccacaaggacgugcuggaggagggcacggagagcuccagccacucccgccugagcccccggaagacccaccuccuguacauccugcgccccucccggcagcucuga

SEQ ID NO: 29206 - RNA, 1944 nt, Artificial Sequence
  derived and/or modified sequence opt1 from DLAT__Homo_sapiens__NP_001922
auguggcgcgugugcgcccggcgcgcccagaacgucgcgcccugggccggccuggaggcccgguggaccgcccuccaggaggugccggggacgccccgcgugaccagccgguccggccccgcccccgcgcgccggaacagcgucaccaccggguacggcggggugcgcgcccugugcggcuggaccccguccagcggcgccacgccccggaaccgccugcuccugcagcugcucgggucccccggccggcgcuacuacagccugcccccgcaccagaaggugccccugcccucccucagccccaccaugcaggccgggaccaucgcgcggugggagaagaaggagggcgacaagaucaacgagggggaccugaucgccgaggucgagaccgacaaggccacggugggcuucgagucccuggaggagugcuacauggccaagauccucguggccgagggcacccgcgacgucccgaucggggcgaucaucugcaucaccgugggcaagcccgaggacaucgaggccuucaagaacuacacccuggacagcuccgccgcccccacgccccaggccgcgccggcccccacccccgccgccaccgccagcccgcccacccccuccgcgcaggcccccgggagcuccuacccgccccacaugcagguccugcuccccgcccugagccccacgaugaccaugggcaccgugcagcggugggagaagaaggugggcgagaagcuguccgagggggaccuccuggccgagaucgagaccgacaaggccacgaucggcuucgaggugcaggaggagggguaccuggcgaagauccucguccccgagggcacccgcgacgugccgcuggggacgccccugugcaucaucguggagaaggaggccgacaucagcgccuucgccgacuaccggcccaccgaggucaccgaccucaagccccaggugccgccgcccacgcccccgcccguggcggccgucccgcccacgccccagccccuggcccccacccccuccgcccccugccccgccacccccgcgggcccgaagggccgcguguucgugagcccccuggccaagaagcucgccgucgagaaggggaucgaccugacccaggugaagggcaccgggcccgacggccggaucaccaagaaggacaucgacagcuucguccccuccaagguggccccggcccccgcggccguggucccgcccaccgggcccggcauggcccccgugcccaccggcguguucaccgacaucccgaucagcaacauccgccgggucaucgcccagcgccugaugcaguccaagcagaccaucccccacuacuaccucagcaucgacgugaacaugggggaggugcugcugguccgcaaggagcucaacaagauccuggagggccgguccaagaucagcgugaacgacuucaucaucaaggccuccgcgcuggccugccucaaggugcccgaggccaacagcuccuggauggacacggucauccgccagaaccacgugguggacgucagcguggccguguccacccccgcggggcugaucaccccgaucgucuucaacgcccacaucaagggcguggagaccaucgccaacgacguggucagccuggccaccaaggcccgggaggggaagcuccagccccacgaguuccagggcggcacguucaccaucuccaaccuggggauguucggcaucaagaacuucagcgcgaucaucaacccgccccaggccugcauccuggccaucggggccuccgaggacaagcucgugcccgccgacaacgagaagggcuucgacguggcgagcaugauguccgucacccugagcugcgaccaccgcgugguggacggcgccgucggggcccaguggcuggccgaguuccggaaguaccucgagaagcccaucaccaugcugcuguga

SEQ ID NO: 29207 - RNA, 3276 nt, Artificial Sequence
  derived and/or modified sequence opt1 from DLC1__Homo_sapiens__NP_006085
augugccgcaagaagcccgacaccaugauccugacccagaucgaggccaaggaggccugcgacuggcuccgggcgacgggcuucccgcaguacgcccagcuguacgaggacuuccuguuccccaucgacaucagccucgugaagcgcgagcacgacuuccuggaccgggacgccaucgaggcccugugccgccggcucaacacccugaacaagugcgccgucaugaagcuggagaucagcccccaccgcaagcgguccgacgacuccgacgaggacgagcccugcgcgaucagcgggaaguggaccuuccagcgcgacuccaagcgguggagccgccucgaggaguucgacguguucuccccgaagcaggaccuggugcccggcagccccgacgacucccaccccaaggacgggccgagccccggcgggacccugauggaccucuccgagcggcaggaggucagcuccgugcgcagccuguccagcacgggcucccugcccagccacgcgcccccguccgaggacgccgccacgccccggaccaacagcgugaucagcgucugcuccagcuccaaccucgccggcaacgacgacagcuucgggucccugcccagccccaaggagcuguccagcuucuccuucagcaugaagggccacgagaagaccgccaaguccaagacccgcagccuccugaagcggauggagucccugaagcucaagagcucccaccacagcaagcacaaggccccguccaagcuggggcugaucaucagcggccccauccuccaggaggggauggacgaggagaagcugaagcagcugaacugcguggagaucuccgcccucaacggcaaccgcaucaacgugcccaugguccggaagcgcagcgugagcaacuccacccagaccagcuccagcuccagccaguccgagaccagcuccgccgugagcacgcccuccccggucacccggacccgcagccuguccgcgugcaacaagcgggugggcauguaccuggagggguucgaccccuucaaccagagcaccuucaacaacguggucgagcagaacuucaagaaccgcgaguccuaccccgaggacacgguguucuacauccccgaggaccacaagccgggcaccuuccccaaggcccucaccaacgggagcuucucccccagcggcaacaacggcagcgugaacuggcgcaccggguccuuccacggccccgggcacaucagccugcggcgcgagaacuccagcgacuccccgaaggagcugaagcggcgcaacagcuccagcuccaugagcucccggcucagcaucuacgacaacguccccggcuccauccuguacagcuccagcggggaccuggccgaccucgagaacgaggacaucuuccccgagcuggacgacauccuguaccacgugaagggcaugcagcgcaucgugaaccagugguccgagaaguucagcgacgagggcgacuccgacagcgcccucgacagcgucuccccgugccccagcucccccaagcagauccaccuggacguggacaacgaccggacgacccccagcgaccuggacuccaccgggaacagccucaacgagccggaggagcccuccgagauccccgagcgccgggacagcggcgugggggccucccugacccgcagcaaccggcaccgccugcgguggcacuccuuccagagcucccaccgccccagccucaacuccgucagccugcagaucaacugccaguccguggcgcagaugaaccugcuccagaaguacagccugcugaagcugacggcccuccuggagaaguacaccccguccaacaagcacggcuucagcugggccguccccaaguucaugaagcggaucaaggugcccgacuacaaggaccgcagcguguucggggucccccugaccgugaacgugcagcggaccggccagccgcucccccaguccauccagcaggccaugcgcuaccugcggaaccacugccuggaccaggucggccucuuccgcaagagcggggugaagucccgcauccaggcccugcggcagaugaacgagggcgcgaucgacugcgugaacuacgaggggcagagcgccuacgacgucgccgacaugcugaagcaguacuuccgcgaccuccccgagccccugaugacgaacaagcuguccgagaccuuccuccagaucuaccaguacgugccgaaggaccagcggcugcaggccaucaaggccgcgaucaugcugcuccccgacgagaaccgcgaggugcugcagacccugcucuacuuccugagcgacgucaccgccgccgugaaggagaaccagaugacgcccaccaaccuggccgugugccucgcgcccucccuguuccaccugaacacccucaagcgggagaacagcuccccgcgcgucaugcagcggaagcagagccugggcaagcccgaccagaaggaccugaacgagaaccucgccgccacccaggggcuggcccacaugaucgccgagugcaagaagcuguuccaggugcccgaggagaugucccgcugccggaacagcuacacggagcaggagcucaagccccugacccuggaggcgcucggccaccugggcaacgacgacuccgccgacuaccagcacuuccugcaggacugcguggacggccucuucaaggaggucaaggagaaguucaaggggugggugagcuacuccaccagcgagcaggccgagcuguccuacaagaaggugagcgaggggccgccccugcgccucuggcgguccgucaucgaggugcccgccgugccggaggagauccugaagcgccugcucaaggagcagcaccugugggacgucgaccugcucgacagcaaggugaucgagauccuggacagccagaccgagaucuaccaguacgugcagaacuccauggcgccccaccccgcccgggacuacgucgugcugcgcaccuggcggacgaaccuccccaagggcgccugcgcccugcugcucaccagcguggaccacgaccgcgccccggucgugggcgugcgggucaacgugcugcugucccgcuaccucaucgagcccugcgggcccggcaagagcaagcugaccuacaugugccggguggaccugcgcgggcacaugcccgagugguacaccaaguccuucggccaccucugcgccgcggaggucgugaagauccgggacagcuucuccaaccagaacacggagaccaaggacaccaagagccgcuga

SEQ ID NO: 29208 - RNA, 1530 nt, Artificial Sequence
  derived and/or modified sequence opt1 from DLD__Homo_sapiens__NP_000099
augcagagcuggucccgcguguacugcagccuggccaagcgggggcacuucaaccgcaucucccacgggcuccagggccugagcgccgucccccugcggaccuacgcggaccagccgaucgacgccgacgugaccgugaucggguccggccccgggggcuacgucgccgccaucaaggccgcgcagcucggcuucaagacggugugcaucgagaagaacgagacccugggcgggaccugccugaacguggggugcauccccagcaaggcccuccugaacaacucccacuacuaccacauggcccacggcaaggacuucgccagccgcgggaucgagauguccgagguccggcugaaccucgacaagaugauggagcagaaguccaccgcggugaaggcccugacgggcggcaucgcccaccuguucaagcagaacaaggugguccacgugaacggguacggcaagaucaccgggaagaaccaggugaccgccaccaaggccgacggcggcacgcaggucaucgacaccaagaacauccucaucgcgaccgggagcgaggugacccccuucccgggcaucacgaucgacgaggacaccaucgugagcuccaccggggcccugagccugaagaagguccccgagaagaugguggugaucggcgccggggucaucggcguggagcucggcuccguguggcagcgccugggggccgacgucaccgccguggaguuccugggccacgucgggggcguggggaucgacauggagaucagcaagaacuuccagcggauccuccagaagcagggcuucaaguucaagcugaacacgaaggugaccggcgcgaccaagaaguccgacgggaagaucgacgucagcaucgaggccgccuccggcgggaaggccgaggugaucacgugcgacgugcugcucgucugcaucggccgccggcccuucaccaagaaccuggggcuggaggagcucggcaucgagcuggacccccgcggccggaucccggugaacacccgcuuccagaccaagauccccaacaucuacgccaucggggacguggucgcgggccccaugcuggcccacaaggccgaggacgaggggaucaucugcguggagggcauggccggcggggccgugcacaucgacuacaacugcguccccagcgugaucuacacccacccggagguggcgugggucggcaagagcgaggagcagcucaaggaggaggggaucgaguacaaggugggcaaguuccccuucgccgccaacucccgggccaagacgaacgcggacaccgacgggauggugaagauccugggccagaaguccaccgaccgcguccugggcgcccacauccucgggcccggcgccggggagauggugaacgaggccgcccuggcgcuggaguacggcgccagcugcgaggacaucgcccgggugugccacgcccaccccacccucagcgaggccuuccgcgaggcgaaccuggccgccuccuucggcaagagcaucaacuucuga

SEQ ID NO: 29209 - RNA, 5268 nt, Artificial Sequence
  derived and/or modified sequence opt1 from DLEC1__Homo_sapiens__NP_031361
auggagacgcgcuccuccaagacccgccgcagccuggccucccggacgaacgagugccagggcaccaugugggcccccaccagcccgcccgcgggguccagcucccccagccagcccaccuggaaguccagccucuacuccagccuggccuacuccgaggccuuccacuacagcuucgccgcccgcccccggcgccugacgcagcucgcccuggcccagcggcccgagccccagcugcuccgccugcggcccuccagccugcgcacccaggacaucucccaccuccugaccggcguguuccggaaccuguacagcgccgaggugaucggggacgagguguccgccagccucaucaaggcgcgcggcagcgagaacgagcggcacgaggaguucguggaccagcugcagcagauccgcgagcuguacaagcagcggcucgacgaguucgagaugcuggagcgccacaucacccaggcccaggcccgggccaucgccgagaacgagcgcgucaugucccaggcgggggugcaggaccuggagagccucgugcggcugccgcccgucaaguccgugagccgcuggugcaucgacuccgagcugcuccggaagcaccaccugaucagccccgaggacuacuacacggacaccgugcccuuccacuccgcccccaagggcaucagccugcccggcugcuccaagcucaccuucagcugcgagaagcgcuccguccagaagaaggagcugaacaagaagcuggaggacagcugccgcaagaagcucgccgaguucgaggacgagcuggaccacaccguggacucccugacguggaaccucacccccaaggccaaggagcggacccgcgagccccugaagaaggccagccagccccggaacaagaacuggaugaaccaccuccgcgugccccagcgggagcucgaccgccugcugcucgcgcggauggagucccgcaaccacuuccugaagaacccccgguucuucccgcccaacacccgcuacgggggcaagagccuggucuucccgcccaagaagcccgccccgaucggggaguuccaguccacggagcccgagcagagcugcgccgacacccccguguuccucgccaagcccccgaucggcuucuucaccgacuacgagaucgggcccguguacgagauggucaucgcccugcagaacaccacgaccaccucccgguaccugcgcgugcugccgcccagcacccccuacuucgcgcugggccugggcauguuccccgggaagggcgggaugguggcccccggcaugacgugccaguacaucguccaguucuuccccgacugccucggcgacuucgacgacuucauccugguggagacccagagcgcccacacccugcucaucccccugcaggcccggcggccgccgcccgugcugacccugucccccguccucgacugcggguacugccugaucggcggggugaagaugacgcgguucaucugcaagaacgugggcuucagcgucgggcgcuucugcaucaugcccaagaccuccuggccgccccugagcuucaaggccaucgcgaccgugggcuucgucgagcagccgcccuucggcauccuccccuccguguucgagcuggccccggggcacgccauccugguggagguccucuucagccccaagucccugggcaaggccgagcagaccuucaucaucaugugcgacaacugccagaucaaggagcuggugacgaucgggaucggccagcucaucgcgcuggaccugaucuacaucagcggggagaagucccagcccgaccccggcgagcucaccgaccugaccgcccagcacuucauccgguucgagcccgagaaccugcgcagcaccgcccggaagcagcucaucauccgcaacgccacgcacguggagcuggccuucuacuggcagaucaugaagcccaaccugcagccccucaugcccggcgagaccuucuccauggacagcaucaagugcuacccggacaaggagaccgcguucuccaucaugccccgcaaggggguccugagcccccacaccgaccacgaguucauccuguccuucagcccgcacgagcuccgggacuuccacuccgugcugcagauggugcuggaggagguccccgagcccgugagcagcgaggccgagucccucggccacagcuccuacagcguggacgacgucaucgugcuggagaucgaggugaagggguccgucgagcccuuccaggugcugcucgagccguacgcccugaucauccccggcgagaacuacaucgggaucaacgugaagaaggccuucaagauguggaacaacagcaagucccccauccgcuaccuguggggcaagaucagcgacugccacaucaucgaggucgagcccggcaccggggugaucgagccguccgaggugggcgacuucgagcucaacuucaccgggggcguccccggccccaccagccaggaccugcugugcgagaucgaggacucccccagcccgguggugcuccacaucgaggccgucuucaaggggcccgcgcugaucaucaacguguccgcccugcaguucggccuccugcggcuggggcagaaggccaccaacagcauccagauccgcaacgugucccagcuccccgccaccuggcggaugaaggagagccccgucucccugcaggagcgcccggaggacgugagccccuucgacaucgagcccuccagcggccagcugcacagccucggggagugccggguggacaucacgcuggaggcccugcacugccagcaccucgagaccguccuggagcuggagguggagaacggcgcgugguccuaccuccccguguacgccgagguccagaagccgcacguguaccugcagagcucccagguggagguccgcaaccuguaccucggcgugcccaccaagaccacgaucacccugaucaacgggacccugcuccccacccaguuccacuggggcaagcugcuggggcaccaggccgaguucugcauggugacggucagccccaagcacggccuccuggggccguccgaggagugccagcugaagcucgagcugaccgcccacacccaggaggagcugacccaccucgcgcugcccugccacgugagcggcaugaagaagccccuggugcucggcaucuccgggaagccccagggccugcaggucgccaucacgaucagcaaggaguccagcgacugcuccaccgagcaguggccggggcaccccaaggagcugcggcucgacuucggcagcgccgugccccugcgcacccgggugacccgccagcugauccucacgaaccgguccccgauccgcacccgguucagccugaaguucgaguacuucgggagcccccagaacagccuguccaagaagaccagccuccccaacaugcccccggcccugcugaagaccguccgcaugcaggagcaccucgccaagcgggagcagcuggacuucauggaguccaugcugagccacggcaagggcgcggccuucuucccccacuucagccaggggaugcucggccccuaccagcagcugugcaucgacaucacggggugcgccaacauguggggcgaguacugggacaaccugaucugcaccgugggggaccuccugcccgaggugaucccgguccacauggccgccgugggcugccccaucuccagccugcgcaccaccuccuacacgaucgaccaggcgcagaaggagcccgccaugcgguucggcacccaggugagcgggggcgacaccgucacccgcacgcuccggcugaacaacuccagccccugcgacauccgccuggacugggagaccuacgugccggaggacaaggaggaccgccucgucgagcugcugguguucuacgggccgcccuucccccuccgggaccaggccggcaacgagcuggugugcccggacacccccgagggcgggugccugcuguggucccccggccccagcuccagcuccgaguucagccacgagaccgacuccagcgucgagggguccagcuccgccagcaaccgcguggcccagaagcucaucuccgugauccugcaggcgcacgagggcgucccgagcgggcaccuguacugcaucagccccaagcaggucgugguccccgccggcggcuccagcacgaucuacaucuccuucacccccauggugcucagcccggagauccugcacaagguggagugcaccggguacgcccugggcuucaugucccucgacagcaaggucgagcgggagauccccgggaagcgccaccggcugcaggacuucgccgugggcccccugaagcucgaccugcacuccuacgugcgccccgcgcagcugagcgucgagcucgacuacgggggcuccauggaguuccagugccaggccagcgaccugaucccggagcagcccugcuccggcgugcugagcgagcucgugaccacccaccaccugaagcugacgaacaccaccgagaucccccacuacuuccggcucauggucucccgcccguucagcgugucccaggacggggccagccaggaccaccgggcccccggccccgggcagaagcaggagugcgaggaggagaccgccuccgcggacaagcagcuggugcugcaggcccaggagaacaugcucgucaacgugagcuucucccugagccuggagcuccugagcuaccagaagcugcccgccgaccagacgcucccgggcguggacauccagcaguccgccagcggggagcgcgagauggucuucacccagaaccugcugcucgaguacaccaaccagaccacccagguggugccccugcgggccgucguggcggugcccgagcugcagcucuccaccagcugggucgacuucggcacgugcuucgugucccagcagcgcgugcgggaggucuaccugaugaaccugagcggcugccgcuccuacuggaccaugcucauggggcagcaggagcccgccaaggccgccguggccuuccgggugagcccgaacuccggccugcuggaggcgcgcagcgccaacgcgccgcccacguccaucgcccuccaggucuucuucaccgcccggagcuccgagcuguacgagagcaccauggugguggaggggguccugggcgagaaguccugcacccuccgccugcggggccaggggagcuacgacgagcgcuacaugcugccccaccagccguga

SEQ ID NO: 29210 - RNA, 483 nt, Artificial Sequence
  derived and/or modified sequence opt1 from DLEU7__Homo_sapiens__NP_945340
auggccagccccgccccgcugguggcguccaucagccaccagauggucgcccuccagacccugcagcugcuccagcaggaguggggcuggggcgacgggcccguggcccccgggaacccccgcgacccggaccacguguccaccgcccccgcccggcgcagcggcccgccccgggcgcgccccgggcccggccgggaggagcgcggcgggggcgucgggacgcggucccgccggaccgccgcccgcgccaacagccccgaggaggagguggugcggggcgcggagggcggggccgagcugcugcccuucccgcgcgaccggggccccugcacccucgcccagauggccaugcgcuccgcccuggcgcgggucguggacagcaccuccgagcuggugagcgucgagcagacgcuccuggggccccugcagcaggagcgcuccuuccccauccaccucaagcugcagcugcucgccaacgaguga

SEQ ID NO: 29211 - RNA, 2679 nt, Artificial Sequence
  derived and/or modified sequence opt1 from DLG1__Homo_sapiens__NP_001191315
augcccgugcgcaagcaggacacccagcgggcccugcaccuccuggaggaguaccgcagcaagcugucccagaccgaggaccggcagcuccgcagcuccaucgagcgggucaucaacaucuuccagagcaaccuguuccaggcccugaucgacauccaggaguucuacgaggugacgcuccuggacaacccgaagugcaucgaccgcuccaagcccagcgagcccauccagcccgugaacaccugggagaucuccagccugccguccagcaccgucaccuccgagacgcuccccagcucccugagccccuccguggagaaguaccgguaccaggacgaggacacgcccccgcaggagcacaucagcccccagaucaccaacgaggugaucggccccgagcugguccacguguccgagaagaaccucagcgagaucgagaacgugcacggguucgucucccacagccacaucagccccaucaaggcgaacccgccgcccgugcuggugaacaccgacucccuggagacccccaccuacgucaacggcaccgacgccgacuacgaguacgaggagaucacccucgagcgcgggaacagcggccugggguucuccaucgccggcggcacggacaacccccacaucggggacgacagcuccaucuucaucaccaagaucaucaccggcggggccgccgcgcaggacggccggcugcgcgugaacgacugcauccuccgggugaacgaggucgacgugcgcgacgugacccacagcaaggccgucgaggcccugaaggaggccggguccaucgugcggcuguacgugaagcgccggaagcccgucagcgagaagaucauggagaucaagcucaucaagggccccaagggccugggguucuccaucgcgggcggggugggcaaccagcacauccccggcgacaacagcaucuacgugacgaagaucaucgagggcggggccgcccacaaggacgggaagcugcagaucggcgacaagcuccuggccgucaacaacgugugccuggaggaggucacccacgaggaggccgugaccgcgcucaagaacaccuccgacuucguguaccugaaggucgccaagccgacgagcauguacaugaacgacggguacgccccgcccgacaucaccaacuccagcucccagcccguggacaaccacgugagccccuccagcuuccugggccagacccccgccucccccgcccgcuacagccccgucagcaaggcggugcucggcgacgacgagaucacccgggagccgcgcaaggugguccugcaccggggguccacgggccugggguucaacaucgugggcggggaggacggcgagggcaucuucaucagcuucauccucgccgggggccccgccgaccuguccggggagcugcgcaagggcgaccggaucaucagcgugaacuccgucgaccuccgcgccgccagccacgagcaggcggccgccgcccugaagaacgccgggcaggcggugaccaucguggcccaguaccgccccgaggaguacucccgguucgaggccaagauccacgaccugcgcgagcagaugaugaacagcuccaucagcuccggcagcggcucccuccggaccagccagaagcgcucccuguacguccgggcccuguucgacuacgacaagaccaaggacagcgggcucccgucccagggccugaacuucaaguucggggacauccugcacgugaucaacgcgagcgacgacgagugguggcaggcccgccaggugacgcccgacggcgagagcgacgaggucggcgugauccccuccaagcggcgcguggagaagaaggagcgggcccgccucaagaccgucaaguucaacagcaagacccgggacaagggguccuucaacgacaagcgcaagaagaaccuguucagccggaaguuccccuucuacaagaacaaggaccaguccgagcaggagaccagcgacgccgaccagcacgugacguccaacgccagcgacuccgagagcuccuaccgcggccaggaggaguacgugcugagcuacgagccggucaaccagcaggaggugaacuacacccggcccgugaucauccucgggcccaugaaggaccgcaucaacgacgaccugaucuccgaguuccccgacaaguucggcagcugcgucccgcacaccacccggcccaagcgcgacuacgagguggacgggcgggacuaccacuucgugacgucccgcgagcagauggagaaggacauccaggagcacaaguucaucgaggcgggccaguacaacaaccaccuguacggcaccagcguccaguccgugcgcgagguggccgagaaggggaagcacugcauccuggacgucagcggcaacgccaucaagcggcuccagaucgcccagcuguaccccaucuccaucuucaucaagcccaagagcauggagaacaucauggagaugaacaagcgccugaccgaggagcaggcccggaagaccuucgagcgcgcgaugaagcucgagcaggaguucaccgagcacuucacggccaucgugcagggggacacccuggaggacaucuacaaccaggugaagcagaucaucgaggagcagagcggcuccuacaucugggucccggccaaggagaagcuguga

SEQ ID NO: 29212 - RNA, 2250 nt, Artificial Sequence
  derived and/or modified sequence opt1 from DLG2__Homo_sapiens__NP_001136172
augcagcgccccagcgugucccgggccgagaacuaccagcugcucugggacaccaucgccagccugaagcagugcgagcaggcgaugcagcacgccuucaucccggucaacggcaccgagaucgaguacgaguucgaggagaucacgcuggagcgcgggaacuccggccucggguucagcaucgccggcgggaccgacaacccccacaucggcgacgaccccggcaucuucaucaccaagaucauccccgggggcgccgccgcggaggacgggcggcugcgcgugaacgacugcauccugcgggugaacgaggucgacguguccgaggugagccacuccaaggccgucgaggcccucaaggaggccggcagcaucgugcgccuguacgugcggcgccggcgcccgauccuggagaccgucguggagaucaagcuguucaaggggcccaagggccugggcuucuccaucgccgggggcguggggaaccagcacauccccggcgacaacagcaucuacgucacgaagaucaucgacggcggggcggcccagaaggacggccggcuccaggugggggaccgccuccugauggugaacaacuacucccuggaggaggucacccacgaggaggccguggccauccucaagaacaccagcgagguggucuaccugaaggugggcaagcccaccacgaucuacaugaccgacccguacgggccgcccgacaucacccacuccuacagcccgcccauggagaaccaccuccuguccggcaacaacggcacccuggaguacaagacgagccugccgcccaucucccccgggcgguacagccccauccccaagcacaugcucguggacgacgacuacaccucccacagccagcacagcaccgcgacccgccagcccuccaugacgcugcagcgggccgucagccuggagggcgagccccgcaagguggugcuccacaagggguccaccggccugggguucaacaucgucggcggcgaggacggggagggcaucuucgugagcuucauccuggccgggggccccgccgaccucuccggggagcugcagcggggcgaccagauccugagcgucaacggcaucgaccuccgcggggccucccacgagcaggcggccgccgcccugaagggcgccgggcagaccgugaccaucaucgcgcaguaccagcccgaggacuacgcccgguucgaggccaagauccacgaccugcgcgagcagaugaugaaccacagcauguccagcggcuccggcagccuccggacgaaccagaagcgcucccuguacgugcgcgccauguucgacuacgacaagagcaaggacuccgggcugcccagccagggccucuccuucaaguacggggacauccugcacgucaucaacgccagcgacgacgagugguggcaggcgcggcgcgugaugcuggagggcgacuccgaggagaugggggugauccccagcaagcggcgcgucgagcggaaggagcgcgcccggcucaagaccgugaaguucaacgccaagccgggcgugaucgacagcaagggcgacauccccgggcugggcgacgacggguacggcaccaagacccugcgcgggcaggaggaccucauccuguccuacgagcccgucacgcggcaggagaucaacuacacccgccccgugaucauccugggcccgaugaaggaccggaucaacgacgaccucaucagcgaguuccccgacaaguucggcuccugcgugccccacaccacccgcccgaagcgggacuacgaggucgacgggcgcgacuaccacuucgugaucagccgggagcagauggagaaggacauccaggagcacaaguucaucgaggccggccaguacaacgacaaccuguacgggacguccgugcagagcguccgcuucguggcggagcggggcaagcacugcauccuggacguguccgggaacgccaucaagcgccuccaggucgcccagcuguaccccaucgccaucuucaucaagccccggagccuggagccccugauggagaugaacaagcgccucaccgaggagcaggccaagaagaccuacgaccgcgcgaucaagcuggagcaggaguucggcgaguacuucaccgccaucgugcagggcgacacgcuggaggacaucuacaaccagugcaagcucgugaucgaggagcaguccgggccguucaucuggauccccagcaaggagaagcuguga

SEQ ID NO: 29213 - RNA, 1101 nt, Artificial Sequence
  derived and/or modified sequence opt1 from DLG3__Homo_sapiens__NP_001159750
augaugaacagcuccaugagcuccggcagcgggucccugcgcaccagcgagaagcggucccucuacgugcgcgcccuguucgacuacgaccggacccgcgacagcugccugcccucccagggccucagcuucuccuacggggacauccugcacgucaucaacgccagcgacgacgagugguggcaggcgcggcuggugacgccgcacggcgaguccgagcagaucggggugauccccagcaagaagcgcgucgagaagaaggagcgggcccgccucaagaccgugaaguuccacgcccggaccggcaugaucgaguccaaccgcagcaucaagaccaagcggaagaaguccuuccgccugagccggaaguuccccuucuacaaguccaaggagaacauggcccaggagagcagcauccaggagcagggcgugacguccaacaccagcgacuccgagagcuccagcaaggggcaggaggacgccauccuguccuacgagcccgucacccgccaggagauccacuacgcgcggccggugaucauccucggccccaugaaggaccgcgugaacgacgaccugaucagcgaguucccccacaaguucggguccugcgucccccacaccacgcggccgcgccgggacaacgagguggacggccaggacuaccacuucguggucagccgcgagcagauggagaaggacauccaggacaacaaguucaucgaggccgggcaguucaacgacaaccuguacggcaccuccauccagagcgugcgggccguggccgagcgcggcaagcacugcauccucgacgucuccgggaacgcgaucaagcgccugcagcaggcccagcuguaccccaucgccaucuucaucaagcccaagagcaucgaggcccucauggagaugaaccggcgccagaccuacgagcaggccaacaagaucuacgacaaggcgaugaagcuggagcaggaguucggcgaguacuucaccgccaucgugcagggggacucccuggaggagaucuacaacaagaucaagcagaucaucgaggaccagagcggccacuacaucugggugcccuccccggagaagcucuga

SEQ ID NO: 29214 - RNA, 2166 nt, Artificial Sequence
  derived and/or modified sequence opt1 from DLG4__Homo_sapiens__NP_001122299
auggacugccugugcaucgugaccaccaagaaguaccgcuaccaggacgaggacacgcccccgcucgagcacagccccgcccaccuccccaaccaggccaacuccccgcccgucaucgugaacaccgacacccuggaggcgcccggcuacgugaacgggaccgagggcgagauggaguacgaggagaucacgcuggagcgggggaacagcggccugggguucuccaucgccggcggcaccgacaacccccacaucggggacgaccccagcaucuucaucaccaagaucaucccgggcggggccgccgcccaggacggccgccugcgggucaacgacuccauccucuucgugaacgagguggacguccgcgaggugacccacagcgcggccguggaggcccugaaggaggccggguccaucguccggcuguacgugaugcgccggaagccgcccgcggagaaggugauggagaucaagcucaucaagggccccaagggccugggguucagcaucgccggcggggucggcaaccagcacauccccggcgacaacuccaucuacgugacgaagaucaucgagggcggggccgcccacaaggacgggcgccugcagaucggcgacaagauccucgccgugaacagcgucgggcuggaggacgugaugcacgaggacgcgguggccgcccugaagaacaccuacgacgucguguaccucaagguggccaagcccuccaacgccuaccugagcgacuccuacgcgccgcccgacaucaccaccagcuacucccagcaccuggacaacgagaucagccacuccagcuaccucggcacggacuaccccaccgccaugacccccaccagcccccggcgcuacucccccgucgccaaggaccugcugggcgaggaggacaucccgcgggagccccgccggaucgugauccaccgcgggagcacgggccucggguucaacaucgugggcggggaggacggcgagggcaucuucaucuccuucauccuggccgggggccccgccgaccugagcggggagcuccggaagggcgaccagauccuguccgucaacgggguggaccugcgcaacgcgagccacgagcaggccgccaucgcccucaagaacgccggccagaccgucaccaucaucgcgcaguacaagcccgaggaguacucccgguucgaggccaagauccacgaccugcgcgagcagcugaugaacagcucccucggcagcgggaccgccucccugcggagcaacccgaagcgcggcuucuacauccgggcccuguucgacuacgacaagacgaaggacugcggguuccucucccaggcgcugagcuuccgcuucggcgacgugcugcacgugaucgacgccuccgacgaggagugguggcaggcccgccggguccacagcgacuccgagaccgacgacaucggcuucauccccagcaagcgccggguggagcgccgggaguggucccgccucaaggccaaggacugggggagcuccagcggcagccaggggcgggaggacuccgugcugagcuacgagaccgucacccagauggaggugcacuacgcccgccccaucaucauccugggccccacgaaggaccgggcgaacgacgaccuccuguccgaguucccggacaaguucgggagcugcgugccccacaccacccgccccaagcgggaguacgagaucgacggccgcgacuaccacuucgucuccagccgggagaagauggagaaggacauccaggcccacaaguucaucgaggccggccaguacaacucccaccuguacgggaccagcgugcaguccgugcgcgaggucgccgagcagggcaagcacugcauccucgacgugagcgccaacgcggugcggcgccugcaggccgcccaccuccacccgaucgccaucuucauccggccccgcucccuggagaacguccuggagaucaacaagcggaucacggaggagcaggcccgcaaggcguucgaccgcgccaccaagcuggagcaggaguucaccgagugcuucagcgccaucguggagggggacuccuucgaggagaucuaccacaaggugaagcgggucaucgaggaccucagcggccccuacaucugggugcccgcccgcgagcggcuguga

SEQ ID NO: 29215 - RNA, 5760 nt, Artificial Sequence
  derived and/or modified sequence opt1 from DLG5__Homo_sapiens__NP_004738
auggagccccagcgccgcgagcugcucgcccagugccagcagagccuggcccaggcgaugaccgagguggaggccgugcugggccuccuggaggccgccggggcccugagccccggcgagcgccggcagcucgacgaggaggccggcggggccaaggccgagcugcugcucaagcugcugcucgccaaggagcgcgaccacuuccaggaccugcgggcggcccuggagaagacccagccccaccuccugcccauccuguaccucaacggggugguggggccgccccagcccgccgagggcgccgggagcaccuacagcguccugagcaccaugcccuccgacagcgaguccagcuccagccuguccagcgugggcaccaccgggaaggcccccagcccgccgccccuccugacggaccagcaggucaacgagaagguggagaaccuguccauccagcuccgccugaugacccgggagcgcaacgagcugcggaagcgccucgcguucgccacccacggcaccgccuucgacaagcggcccuaccaccgccugaaccccgacuacgagcggcugaagauccagugcgugcgcgccauguccgaccuccagagccugcagaaccagcacacgaacgcccugaagcggugcgaggagguggcgaaggagaccgacuucuaccacacccuccacucccgccugcugagcgaccagacccggcucaaggacgacgucgacaugcugcgccgggagaacgggcagcugcuccgcgagcggaaccugcugcagcaguccugggaggacaugaagcgccuccacgaggaggaccagaaggagaucggcgaccugcgcgcccagcagcagcagguccugaagcacaacggcagcagcgagauccucaacaagcuguacgacaccgccauggacaagcuggagguggucaagaaggacuacgacgcccuccggaagcgcuacuccgagaagguggccauccacaacgcggaccugagccggcuggagcagcugggggaggagaaccagcgccuccugaagcagaccgagaugcugacccagcagcgggacaccgccauccagcuccagcaccagugcgcccugucccugcgccgguucgaggccauccaccacgagcucaacaaggccaccgcgcagaacaaggaccugcagugggagauggagcugcuccagagcgagcugaccgagcugcgcaccacccaggugaagacggccaaggaguccgagaaguaccgggaggagcgcgacgccgucuacagcgaguacaagcucaucauguccgagcgggaccaggugaucagcgagcuggacaagcugcagaccgagguggagcucgccgaguccaagcugaaguccuccaccagcgagaagaaggcggccaacgaggagauggaggcccugcgccagaucaaggacaccgucaccauggacgccggccgggccaacaaggagguggagauccuccgcaagcagugcaaggcgcugugccaggagcugaaggaggcccuccaggaggccgacguggccaagugccggcgcgacugggccuuccaggagcgggacaagaucgucgcggagcgcgacuccauccggacccugugcgacaaccugcgccgcgagcgggaccgcgccgugagcgagcucgccgaggcccugcggucccuggacgacacccgcaagcagaagaacgacgugagccgggagcucaaggagcugaaggagcagauggagucccagcuggagaaggaggcccgcuuccggcagcucauggcgcacagcucccacgacagcgccaucgacaccgacagcauggagugggagacggaggucguggaguucgagcgcgagaccgaggacaucgaccugaaggcccugggguucgacauggccgagggcgucaacgagcccugcuuccccggcgacugcgggaucuucgugaccaagguggacaagggcuccaucgcggacgggcggcuccgcgucaacgacuggcugcugcggaucaacgacguggaccucaucaacaaggacaagaagcaggccaucaaggcccugcugaacggcgagggggccaucaacauggugguccgccggcgcaagagccucggcggcaagguggugacgccccugcacaucaaccuguccgggcagaaggacagcggcaucucccucgagaacggggucuacgccgcggccgugcugcccggcagccccgccgccaaggaggggucccuggccgugggcgaccggaucgucgcgaucaacggcaucgcccucgacaacaagagccugaacgagugcgagucccugcuccgcagcugccaggacucccugacgcugagccuccugaagguguucccccaguccagcuccuggagcgggcagaacaucuucgagaacaucaaggacuccgacaagaugcugagcuuccgggcccacggccccgaggugcaggcccacaacaagcgcaaccucauccagcacaacaacagcacccagaccgacaucuucuacaccgaccggcuggaggaccgcaaggagcccgggccgcccggcggguccagcuccuuccugcacaagcccuuccccggcggcccccuccaggucugcccccaggccugccccagcgcguccgagcggagccuguccagcuuccgcuccgacgccagcggggaccgcggcuucgggcugguggacgugcggggccgccggccccuccugcccuucgagacggaggucggccccugcggggugggcgaggccucccuggacaaggccgacagcgagggguccaacagcggcgggaccuggcccaaggcgaugcucuccagcaccgccgugcccgagaagcuguccgucuacaagaagcccaagcagcgcaagagcaucuucgaccccaacaccuucaagcggccccagacgccgcccaagaucgacuaccugcuccccggcccgggccccgcccacagcccccagcccagcaagcgcgccgggccgcugacgccgcccaagcccccgcggcgcagcgacuccaucaaguuccagcaccggcuggagaccagcuccgagagcgaggccacccucgugggcuccagccccuccaccuccccgcccuccgcgcugccgcccgacguggaccccggggagcccaugcacgccagcccgccccgcaaggcccggguccgcaucgccuccagcuacuaccccgagggcgacggggacuccagccaccuccccgccaagaaguccugcgacgaggaccugacgagccagaagguggacgagcugggccagaagcggcgccggcccaaguccgcgcccagcuuccgccccaagcuggccccgguggucauccccgcccaguuccucgaggagcagaagugcgugcccgccuccggcgagcugagccccgagcugcaggagugggccccguacagccccgggcacuccagccggcacuccaacccgccccucuacccgagccgccccuccgugggcaccgucccccggagccugacccccuccaccacggugagcuccauccugcgcaacccgaucuacaccgugcgcagccaccgggucgggcccugcuccuccccgcccgcggcccgcgacgccggcccgcaggggcuccaccccuccgugcagcaccagggccggcugagccuggaccucucccaccggaccugcagcgacuacuccgagaugcgggccacccacggcagcaacucccugcccagcagcgcccgccugggguccagcuccaaccuccaguucaaggcggagcggaucaagauccccagcacgccgcgcuacccccgguccguggucggcagcgagcgcggguccgugagccacuccgagugcagcacgccgccccaguccccgcugaacaucgacacccugagcuccugcagccagucccagaccagcgccuccacgcucccccggaucgccgugaaccccgccagccugggcgagcgccggaaggaccgcccguacgucgaggagccccggcacgugaaggugcagaagggguccgagccccugggcaucagcaucgucagcggcgagaagggcgggaucuacguguccaaggugaccgucgggagcaucgcgcaccaggccggccucgaguacggcgaccagcugcuggaguucaacgggaucaaccugcgcuccgccaccgagcagcaggcccggcucaucaucggccagcagugcgacaccaucacgauccuggcccaguacaacccccacgugcaccagcugagcucccacagccgcuccagcucccaccucgacccggcggggacccacagcacccugcagggcuccgggaccacgacccccgagcaccccagcgugaucgacccccugauggagcaggacgagggcccguccacgccgcccgccaagcagagcuccagccggaucgccggcgacgccaacaagaagacccucgagccccgcgucguguucaucaagaagucccagcuggagcugggggugcaccucugcggcgggaaccugcacggcgucuucguggccgaggucgaggacgacagcccggcgaaggggcccgacggccuggugcccggcgaccucauccuggaguacgggucccuggacgugcggaacaagacggucgaggagguguacguggagaugcucaagccccgcgacggcguccgccugaaggugcaguaccggccggaggaguucaccaaggccaaggggcugcccggcgacagcuucuacauccgcgcccucuacgaccggcuggccgacguggagcaggagcugagcuucaagaaggacgacauccucuacgucgacgacacccugccccaggggaccuucggcuccuggauggccuggcagcuggacgagaacgcgcagaagauccagcgcggccagauccccagcaaguacgugauggaccaggaguucucccggcgccucagcauguccgaggugaaggacgacaacagcgccacgaagacccuguccgccgccgcgcggcgcagcuucuuccggcgcaagcacaagcacaagcgguccgggagcaaggacggcaaggaccugcucgcccuggacgccuucuccagcgacuccaucccgcuguucgaggacagcgucucccucgccuaccagcgcgugcagaagguggacugcaccgcccugcggcccguccugauccucgggccccugcuggacguggugaaggagaugcucgucaacgaggcgcccggcaaguucugccgcugcccgcuggaggugaugaaggccagccagcaggccaucgagcggggcgugaaggacugccuguucgucgacuacaagcgccgguccgggcacuucgacgugaccacgguggccagcaucaaggagaucaccgagaagaaccgccacugccuccuggacaucgcgccccacgcgaucgagcggcugcaccacaugcacaucuaccccaucgucaucuucauccacuacaagagcgccaagcacaucaaggagcagcgcgaccccaucuaccuccgcgacaaggugacccagcggcacuccaaggagcaguucgaggccgcccagaagcuggagcaggaguacagccgcuacuucaccggcgugauccagggcggcgcccuguccagcaucugcacccagauccucgcgauggucaaccaggagcagaacaaggugcuguggaucccggccugcccccuguga

SEQ ID NO: 29216 - RNA, 2028 nt, Artificial Sequence
  derived and/or modified sequence opt1 from DLGAP1__Homo_sapiens__NP_001003809
augaaccugaucuuccacaaggacauccucuucggcauccccgccaacaaggugccgcaggacgaguggaccggguacacgccccgcggcaaggacgacgagauccccugccggcgcaugcggagcggguccuacaucaaggccaugggcgacgaggacagcggggacuccgacaccagccccaagccgucccccaaggucgcggcccgccgggagagcuaccugaaggccacccagcccucccugaccgagcucaccacgcugaagaucagcaacgagcacucccccaagcugcagauccgcagccacuccuaccuccgggccgugagcgagguguccaucaaccgcagccuggacucccuggacccggccggccuccugaccagccccaaguuccggucccgcaacgagagcuacaugcgggcgauguccaccaucagccaggucagcgagauggaggugaacggccaguucgaguccgugugcgagagcgucuucuccgagcuggagagccaggccguggaggcccucgaccugcccaugcccgggugcuuccgcaugcggucccacagcuacgugcgcgccaucgagaagggcugcucccaggacgacgagugcgucagccugcgguccagcuccccgccccgcaccacgaccaccgugcggaccauccagagcuccacggugagcuccugcaucaccaccuacaagaagaccccgcccccggucccgccccgcacgaccaccaagcccuucaucagcaucaccgcgcaguccagcacggaguccgcccaggacgccuacauggacgggcagggccagcgcggggacaucaucagccagagcggccucuccaacagcaccgagucccuggacagcaugaaggcccugaccgccgcgaucgaggccgccaacgcccagauccacggccccgccucccagcacauggggaacaacaccgcgacggugaccaccaccacgaccaucgccaccgugaccacggaggaccggaagaaggaccacuucaagaagaaccggugccucagcaucggcauccaggucgacgacgccgaggagcccgacaagaccggggagaacaaggcccccuccaaguuccagagcgugggcgugcaggucgaggaggagaagugcuuccgccgcuucacccgguccaacagcgugaccacggccgugcaggcggaccuggacuuccacgacaaccuggagaacucccucgagagcaucgaggacaacuccugccccggcccgauggcccgccaguucagccgggacgccuccaccagcaccgucuccauccaggggagcggcaaccacuaccacgccugcgccgcggacgacgacuucgacaccgacuucgaccccagcauccugccgccgcccgaccccuggaucgacuccaucaccgaggacccccuggaggccgugcagcgcagcgugugccaccgggacgggcacugguuccucaagcugcugcaggccgagcgcgaccggauggagggcuggugccagcagauggagcgcgaggagcgggagaacaaccuccccgaggacauccuggggaagauccgcacggccgucggcuccgcgcagcugcucauggcccagaaguucuaccaguuccgggagcugugcgaggagaaccugaaccccaacgcccacccccgccccaccagccaggaccucgccggcuucugggacaugcugcagcuguccaucgagaacaucagcaugaaguucgacgagcuccaccagcugaaggccaacaacuggaagcagauggacccccuggacaagaaggagcggcgcgcgcccccgcccgugcccaagaagcccgccaaggggcccgcgccccucauccgggagcgcucccuggagagcucccagcggcaggaggcccgcaagcggcugauggccgccaagcgcgccgccagcguccgccagaacuccgccaccgagagcgccgaguccaucgagaucuacaucccggaggcgcagacccggcucuga

SEQ ID NO: 29217 - RNA, 2928 nt, Artificial Sequence
  derived and/or modified sequence opt1 from DLGAP2__Homo_sapiens__XP_011533064
augaagggccugagcgggucccgcacccagcccccgcucugcagcggccacacgugcgggcuggccccgcccgaggacugcgagcaccuccaccacggccccgacgcccggccgcccuaccuccugucccccgcggacagcugccccgggggccgccaccggugcuccccgcgcagcuccgugcacagcgagugcgucaugaugcccguggugcugggcgaccacgucuccagcuccacguucccccggaugcacuacagcucccacuacgacacccgcgacgacugcgccguggcccacgccggggccaagaucaaccggauccccgcgaaccuccuggaccaguucgagaagcagcugccgcuccaccgcgacggcuuccacacccugcaguaccagcggaccagcgccgccgccgagcagcgcuccgagagccccgggcggauccgccaccuggugcacuccguccagaagcuguucaccaagagccacucccuggagggcagcagcaaguccaacgcgaacgggaccaaggccgacggccgggccgacgaccaccaccacgcccaccacgccaagcacagcaagcgcuccaagagcaaggagcggaagcccgagggcaagccccgcccggggauguccagcuggugguccagcgacgacaaccuggacuccgacagcaccuaccggacccccuccgugcucaaccgccaccaccugggccccguggcgcacugcuaccccgacgcccugcagagcccguucggggaccucucccugaagacgagcaaguccaacaacgacgucaagugcagcgccugcgagggccuggcccucacccccgacgccaaguaccugaagcgguccagcugguccacccugaccgugagccaggcgaaggaggccuaccgcaagagcucccucaaccuggacaagccccugcuccaccaggacgccaagcccgcccugcggccgugccacuaccuccaggugccccaggacgaguggggcggguaccccacgggcgggaaggacgaggagauccccugccgccgcaugcggagcggcuccuacaucaaggccaugggggacgaggagagcggcgaguccgacagcucccccaagaccagccccaaguccgcgauccugcccgagccgcugcucaagagcaucggccagcgcccccugggggagcaccagacccagaccuaccugcaggccgccuccgacguccccgugggccacagccuggaccccgccgccaacuacaacuccccgaaguuccggagccgcaaccaguccuacaugcgggcggugagcacgcucucccaggccagcugcgucagccagguguccgaggccgagaucaacgggcaguucgagagcgugugcgaguccgucuucagcgagguggagucccaggccauggacgcgcuggaccugcccggcugcuuccgcacccggagccacuccuaccuccgcgccauccaggccggguacagccaggacgacgagugcauccccaugaugacccccuccgacaucaccagcacgauccgguccaccgccgccgugagcuacaccaacuacaagaagaccccgccgcccgucccgccccgcacgaccuccaagccccugaucagcgugaccgcgcaguccagcaccgaguccacgcaggacgccuaccaggacagccgggcccagcgcaugucccccuggccccaggacagccggggccuguacaacagcaccgacucccucgacagcaacaaggccaugaaccuggcccuggagaccgcggccgcccagcgccaccuccccgagucccagagcuccagcgugcggaccuccgacaaggccauccuggucagcaaggccgaggagcugcucaagucccgcugcagcuccaucggcauccaggacagcgaguuccccgagcaccagcccuacccccgguccgacguggagacggcgaccgacagcgacaccgagucccgcgggcugcgggaguaccacagcgucggcguccagguggaggacgagaagcgccacgggcgcuucaagcgguccaacagcgugaccgccgccgugcaggccgaccuggagcuggagggcuucccggggcacaucacgaccgaggacaagggccuccaguucggcuccagcuuccagcgccacagcgagcccuccacccccacccaguacagcgcggugcggaccguccgcacgcaggggcuguucuccuaccgggaggacuaccgcacccagguggacaccagcacccugcccccgcccgaccccuggcucgagccggccaucgacacgguggagaccggccggaugucccccugccgccgggacgggagcugguuccugaagcugcuccacgccgagaccaagcgcauggagggcuggugcaaggagauggagcgggaggccgaggagaacgaccuguccgaggagauccugggcaagauccgcagcgccgucggguccgcgcagcuccugaugagccagaaguuccagcaguucuacuggcugugccagcagaacauggaccccuccgccaugccccggccgaccagccaggaccucgccggcuacugggacaugcugcagcuguccaucgaggacgugagcaugaaguucgacgagcuccagcgccugcggcugaacgacuggaagaugauggagucccccgagcgcaaggaggagcggaaggugcccccgcccauccccaagaagccgcccaaggggaaguuccccaucacgcgcgagaagucccucgaccugcccgaccggcagcgccaggaggcccggcgccgccugauggccgcgaagcgggccgccagcuuccgccagaacagcgccuccgagcgggccgacagcaucgagaucuacauccccgaggcgcagacccgccucuga

SEQ ID NO: 29218 - RNA, 2940 nt, Artificial Sequence
  derived and/or modified sequence opt1 from DLGAP3__Homo_sapiens__XP_011540181
augcgcggcuaccacggggaccggggcagccacccccgcccggcccgguucgccgaccagcagcacauggacguggggcccgcggcccgcgcccccuaccugcucggcucccgggaggccuucagcaccgagccccgcuucugcgccccgcgggcggggcugggccacaucucccccgagggcccccugagccucuccgaggggcccagcgucggcccggagggcgggcccgccggggccggcgugggcgggggcuccagcaccuucccccgcauguaccccgggcagggcccguucgacacgugcgaggacugcgugggccacccccaggggaagggcgcgccccggcugcccccgacccugcucgaccaguucgagaagcagcugcccguccagcaggacggguuccacacccugcccuaccagcgcggccccgccggggccggcccgggccccgcccccgggaccggcacggcccccgagccgcgguccgagagccccucccgcauccggcaccucgugcacagcgugcagaagcuguucgccaagucccacagccuggaggcgcccgggaagcgcgacuacaacggccccaaggccgaggggcggggcggcuccgggggcgacagcuacccggggcccggcuccgggggcccccacaccagccaccaccaccaccaccaccaccaccaccaccaccaccagucccgccacggcaagcggagcaagagcaaggaccgcaagggggacggccggcaccaggccaaguccaccgggugguggagcuccgacgacaaccucgacagcgacuccggcuuccuggccggcgggcgcccgcccggcgagcccgggggccccuucugccuggaggggccggacggcagcuaccgggaccucuccuucaagggccgcagcgggggcuccgaggggcgcugccuggccugcaccggcaugagcaugucccuggacgggcagagcgucaagcgguccgcguggcacacgaugauggugagccagggccgcgacggcuaccccggggccggccccgggaagggccuccuggggcccgagaccaaggccaaggcccggaccuaccacuaccuccaggugccgcaggacgacuggggcggcuaccccaccgggggcaaggacggggagauccccugccgccggaugcgcuccggcagcuacaucaaggccaugggggacgaggaguccggcgacagcgacggcucccccaagacgagcccgaaggcggucgcccggcgcuucaccacccggcgcagcuccagcguggaccaggcccggaucaacugcugcgugccgccccgcauccacccccgguccagcauccccggguacucccgcagccugaccacgggccagcuguccgacgagcugaaccagcagcucgaggccgucugcgggagcguguucggcgagcuggagucccaggccguggacgcgcuggaccuccccggcugcuuccggaugcgcagccacuccuaccugcgggccauccaggccgggugcagccaggacgacgacugccugccccuccuggccacccccgcggccgucuccggccgcccggggagcuccuucaacuuccggaaggcgcccccgcccaucccgcccggcagccaggcgccgccccgcaucuccaucaccgcccagagcagcaccgacuccgcccacgagagcuucacggccgccgaggggcccgcccgccggugcuccagcgccgacggccuggacggccccgccaugggggcccgcacccucgagcuggcccccgugccgccccgggccucccccaagccgcccacccugaucaucaagaccauccccggccgcgaggagcuccggagccuggcccgccagcggaaguggcgccccuccaucggggugcaggucgagacgaucagcgacuccgacaccgagaaccggagccgccgggaguuccacuccaucggcguccagguggaggaggacaagcgccgggcgcgcuucaagcggagcaacuccgugaccgccggggugcaggccgaccuggagcucgagggccuggccggccuggcgaccguggccacggaggacaaggcccuccaguucgggcgcagcuuccagcggcacgccuccgagccccagcccggcccccgcgcccccaccuacagcgucuuccggaccgugcacacccaggggcagugggcguaccgcgagggcuacccccugccguacgagccgcccgccacggacgggucccccggccccgcccccgcccccacccccggcccgggggccggccggcgcgacagcuggaucgagcgcgggucccggagccugcccgacagcggccgcgcgucccccugcccccgggacggcgagugguucaucaagaugcuccgcgccgaggucgagaagcuggagcacuggugccagcagauggagcgggaggccgaggacuacgagcugccggaggagauccucgagaagauccgcagcgccgugggguccacccagcugcugcugagccagaaggugcagcaguucuuccggcucugccagcaguccauggaccccaccgccuuccccgucccgacguuccaggaccuggcgggcuucugggaccugcuccagcugagcaucgaggacgugacccugaaguuccucgagcugcagcagcugaaggccaacuccuggaagcuccuggagcccaaggaggagaagaaggugccgccgcccauccccaagaagccccugcgcgggcggggcguccccgugaaggagcgcagccucgacuccguggaccggcagcgccaggaggcccggaagcgccugcuggccgcgaagcgggccgccagcuuccgccacuccagcgccaccgaguccgccgacagcaucgagaucuacauccccgaggcgcagacccggcucuga

SEQ ID NO: 29219 - RNA, 2529 nt, Artificial Sequence
  derived and/or modified sequence opt1 from DLGAP5__Homo_sapiens__NP_001139487
augagcuccagccacuucgccucccgccaccggaaggacaucagcaccgagaugauccgcaccaagaucgcccaccggaagucccugagccagaaggagaaccgccacaaggaguacgagcggaaccgccacuucggccucaaggacgugaacauccccacgcuggaggggcggauccuggucgagcucgacgagaccucccagggccuggugccggagaagaccaacgugaagccccgcgcgaugaagaccauccugggggaccagcggaagcagaugcuccagaaguacaaggaggagaagcagcugcagaagcugaaggagcagcgcgagaaggccaagcggggcaucuucaaggucgggcgcuaccggcccgacaugcccugcuuccuccugagcaaccagaacgccgugaaggccgagccgaagaaggccauccccuccagcgugcgcaucacgcgguccaaggcgaaggaccagauggagcagaccaagaucgacaacgagagcgacguccgcgccauccggcccggcccccgccagaccuccgagaagaaggugagcgacaaggagaagaaggugguccagccggugaugcccaccucccugcggaugacgcgcagcgccacccaggccgcgaagcaggucccccggaccguguccagcaccacggcccgcaagcccgugacccgcgccgccaacgagaacgagccggagggcaaggugcccuccaaggggcggcccgccaagaacgucgagaccaagcccgacaagggcaucagcugcaagguggacagcgaggagaacacccucaacucccagacgaacgcgaccagcgggaugaacccggacggcgugcuguccaagauggagaaccugcccgagaucaacaccgccaagaucaaggggaagaacagcuucgcccccaaggacuucauguuccagccccucgacggccugaagaccuaccaggucacgccgaugacgccccgcuccgccaacgccuuccugacccccagcuacaccuggacgccccucaagaccgagguggacgagucccaggcgaccaaggagauccuggcccagaagugcaagaccuacagcacgaagaccauccagcaggacuccaacaagcugccgugcccccucggcccccugaccguguggcacgaggagcacguccugaacaagaacgaggccaccacgaagaaccucaacgggcugcccaucaaggaggugccgagccuggagcggaacgagggccgcaucgcccagccccaccacggggugcccuacuuccggaacauccuccaguccgagaccgagaagcugaccagccacugcuucgagugggaccgcaagcuggagcucgacaucccggacgacgccaaggaccugauccggaccgcggucggccagacgcgccugcucaugaaggagcgguucaagcaguucgagggccugguggacgacugcgaguacaagcgcgggaucaaggagacgaccugcaccgaccuggacggcuucugggacauggucuccuuccagaucgaggacgugauccacaaguucaacaaccucaucaagcuggaggagagcggguggcaggucaacaacaacaugaaccacaacaugaacaagaacguguuccggaagaaggugguguccggcaucgccagcaagcccaagcaggacgacgccgggcgcaucgccgcccggaaccgccuggcggccaucaagaacgccaugcgggagcgcauccggcaggaggagugcgccgagaccgcggucuccgugauccccaaggagguggacaagaucgucuucgacgccggcuucuuccgcguggagagccccgugaagcuguucuccggccugagcgucagcuccgaggggccgagccagcggcugggcacccccaaguccgugaacaaggccgugagccagucccgcaacgagauggggaucccccagcagaccaccagccccgagaacgccggcccgcagaacaccaaguccgagcacgucaagaagacccucuuccugagcauccccgagucccgcagcuccaucgaggacgcccagugccccgggcugcccgaccucaucgaggagaaccacguggugaacaagaccgaccugaaggucgacugccugagcuccgagcggaugagccucccgcugcuggcgggcggcguggccgacgacaucaacaccaacaagaaggaggggaucuccgacguggucgagggcauggagcugaacagcuccaucaccagccaggacgugcucaugagcucccccgagaagaacacggccagccagaacuccauccuggaggagggggagaccaagaucagccaguccgagcuguucgacaacaagagccucaccaccgagugccaccuccuggacuccgugggcagcugcuacgucgcccgcgccgggcucgaggugcugggcuccagcgaccccacgaccuccgcgagccggguggccggcaccaccgcccgcuccaagcugcaguga

SEQ ID NO: 29220 - RNA, 1152 nt, Artificial Sequence
  derived and/or modified sequence opt1 from DLK1__Homo_sapiens__NP_003827
augaccgccaccgaggcccugcuccgcgugcugcugcuccugcuggcguucggccacagcacguacggggccgagugcuuccccgccugcaacccgcagaacggcuucugcgaggacgacaacgucugccggugccagcccggguggcagggcccccucugcgaccagugcgugaccucccccgggugccugcacggccugugcggcgagccggggcagugcaucugcaccgacggcugggacggggagcucugcgaccgcgacgugcgggccugcagcuccgcccccugcgcgaacaacgggaccugcgucagccuggacgacggccuguacgagugcuccugcgcccccggcuacagcggcaaggacugccagaagaaggacgggcccugcgugaucaacggcuccccgugccagcacgggggcacgugcguggacgacgagggccgcgccagccacgccuccugccucugcccgcccggguucagcggcaacuucugcgagaucgucgcgaacuccugcacccccaaccccugcgagaacgacggggugugcaccgacaucggcggggacuuccggugccgcugccccgccggcuucaucgacaagaccugcagccggcccgugacgaacugcgccuccagccccugccagaacggcgggaccugccugcagcacacccaggucuccuacgagugccugugcaagccggaguucaccggccucacgugcgugaagaagcgcgcccugagcccccagcaggucacccggcugcccuccggguacggccucgccuaccgccugacccccggggugcacgagcugccggugcagcagcccgagcaccggauccucaaggugagcaugaaggagcugaacaagaagacgccccugcucaccgagggccaggcgaucugcuucaccauccugggcguccugaccucccucguggugcuggggaccgucggcaucguguuccugaacaagugcgagacgugggugagcaaccuccgcuacaaccacaugcugcggaagaagaagaaccugcuccugcaguacaacagcggggaggaccuggccgucaacaucaucuuccccgagaagaucgacaugaccaccuucuccaaggaggccggcgacgaggagaucuga

SEQ ID NO: 29221 - RNA, 2172 nt, Artificial Sequence
  derived and/or modified sequence opt1 from DLL1__Homo_sapiens__XP_011534060
augggcagccgcugcgcccuggcccucgcggugcuguccgcccugcucugccaggucuggagcuccgggguguucgagcugaagcugcaggaguucgugaacaagaagggccuccuggggaaccggaacugcugccgcggcggggccgggcccccgcccugcgccugccggaccuucuuccgcgucugccugaagcacuaccaggccagcgugucccccgagcccccgugcaccuacggcagcgcggugacgcccguccucgggguggacuccuucagccugcccgacggcgggggcgccgacuccgccuucagcaaccccauccgguucccguucggguucaccuggcccggcaccuucucccugaucaucgaggcccuccacaccgacagccccgacgaccuggcgacggagaaccccgagcgccugaucucccggcucgccacccagcgccaccugaccgugggcgaggaguggagccaggaccugcacuccagcgggcggaccgaccucaaguacuccuaccgcuucgucugcgacgagcacuacuacggcgaggggugcagcguguucugccggccgcgcgacgacgccuucggccacuucacgugcggcgagcgcggggagaaggugugcaaccccggcuggaaggggcccuacugcaccgagcccaucugccugccgggcugcgacgagcagcacggguucugcgacaagcccggcgagugcaagugccgggucggcuggcaggggcgguacugcgacgagugcauccgcuaccccggcugccugcacgggaccugccagcagcccuggcagugcaacugccaggagggcuggggcggccucuucugcaaccaggaccugaacuacugcacccaccacaagccgugcaagaacggcgccacgugcaccaacaccgggcagggcuccuacacgugcagcugccggcccggguacaccggcgcgaccugcgagcuggggaucgacgagugcgaccccagccccugcaagaacggcggcuccugcaccgaccucgagaacagcuacuccugcacgugcccgcccggguucuacggcaagaucugcgagcugagcgccaugaccugcgccgacgggcccugcuucaacggcggccgcugcuccgacagccccgacgggggcuacuccugccggugcccggugggguacagcggcuucaacugcgagaagaagaucgacuacugcuccagcucccccugcagcaacggggccaagugcguggaccugggcgacgccuaccucugccgcugccaggccggcuucuccgggcggcacugcgacgacaacgucgacgacugcgcgagcucccccugcgccaacggcgggaccugccgcgacggcgugaacgacuucagcugcacgugcccgcccggguacaccggccgcaacugcuccgcccccgugagccggugcgagcacgcccccugccacaacggcgcgaccugccacgagcgcgggcaccgguacgucugcgagugcgcccgcggcuacgggggcccgaacugccaguuccugcugcccgagcucccgcccgggcccgccgugguggaccugaccgagaagcuggagggccagggcgggcccuuccccugggucgccgugugcgccggcgugauccucguccugaugcugcuccuggggugcgccgcgguggucgugugcgugcggcugcgccuccagaagcaccggcccccggccgaccccugccgcggcgagaccgagaccaugaacaaccuggccaacugccagcgggagaaggacaucuccgucagcaucaucggggccacgcagaucaagaacaccaacaagaaggcggacuuccacggcgaccacagcgccgacaagaacggcuucaaggcccgcuaccccgccguggacuacaaccuggugcaggaccucaagggggacgacaccgccguccgggacgcgcacuccaagcgcgacaccaagugccagccccagggcagcuccggggaggagaagggcacgccgaccacccugcggggcggggaggccagcgagcgcaagcggcccgacuccggcugcagcaccuccaaggacacgaaguaccagagcguguacgugaucuccgaggagaaggacgagugcgucaucgccaccgagguguga

SEQ ID NO: 29222 - RNA, 1857 nt, Artificial Sequence
  derived and/or modified sequence opt1 from DLL3__Homo_sapiens__NP_058637
auggugagcccccgcauguccggccugcucagccagaccgucauccuggcccugaucuuccucccgcagacccggcccgccgggguguucgagcugcagauccacuccuucggccccgggcccggcccgggggcgccccgcagccccugcuccgcccggcugcccugccgccucuucuuccgggugugccugaagccgggccugagcgaggaggccgccgagucccccugcgcccucggcgcggcccugagcgcccgcgggcccgucuacacggagcagcccggcgccccggcgcccgaccugccccuccccgacgggcugcuccaggugccguuccgggacgccuggcccggcaccuucuccuucaucaucgagaccuggcgcgaggagcugggggaccagaucggcggccccgccuggagccugcuggcccggguggccgggcgccggcgccucgcggccggcgggcccugggcccgggacauccagcgcgccggcgccugggagcugcgguucuccuaccgcgcgcggugcgagccgcccgccgucggcaccgccugcacgcgccugugccggccccgcagcgcccccucccggugcgggccgggccuccgccccugcgccccgcuggaggacgagugcgaggcgccccuggugugccgcgccgggugcagccccgagcacggcuucugcgagcagcccggggagugccggugccucgagggcuggaccggcccccugugcaccgugccggucuccaccagcuccugccugagcccccgcgggcccuccagcgccacgaccggcugccucgugcccgggccgggccccugcgacgggaaccccugcgccaacggcggcagcugcuccgagaccccgcggagcuucgagugcacgugcccccgcggguucuacggccugcggugcgagguguccggggugaccugcgccgacggccccugcuucaacgggggccugugcgucggcggggcggaccccgacagcgccuacaucugccacugcccgcccggcuuccagggguccaacugcgagaagcgcguggaccggugcagccuccagcccugccgcaacggcggccugugccuggaccucgggcacgcccugcggugccgcugccgggccggcuucgcggggccccgcugcgagcacgaccuggacgacugcgccggccgggccugcgccaacggcgggaccugcgucgagggcgggggcgcccaccgcugcuccugcgcgcucggguucggcgggcgggacugccgcgagcgggccgaccccugcgccgcccgcccgugcgcccacggcggccggugcuacgcgcacuucagcgggcuggugugcgccugcgcccccggcuacaugggggcccgcugcgaguuccccgugcaccccgacggcgccuccgcgcugccggccgccccgcccgggcuccgccccggcgacccccagcgguaccugcugccgcccgcccucggccugcuggucgcggccgggguggccggcgccgcccuccugcuggugcacguccgccggcgcgggcacagccaggacgcgggcucccggcuccuggccgggacccccgagcccagcgugcacgcccugcccgacgcccugaacaaccuccgcacccaggagggcuccggcgacgggcccagcuccagcguggacuggaaccggccggaggacgucgacccccagggcaucuacgugaucuccgcccccagcaucuacgcgcgcgaggucgccacgccccuguucccgccccugcacaccgggcgggccggccagcgccagcaccuccuguuccccuaccccuccagcauccugagcgugaaguga

SEQ ID NO: 29223 - RNA, 2058 nt, Artificial Sequence
  derived and/or modified sequence opt1 from DLL4__Homo_sapiens__NP_061947
auggccgccgcgagccgcuccgccagcggcugggcccugcuccugcugguggcccucuggcagcagcgggccgcgggguccggcgucuuccagcugcagcugcaggaguucaucaacgagcgcggggugcucgccagcggccggcccugcgagccggggugccgcaccuucuuccgggugugccugaagcacuuccaggccgucgugucccccggccccugcaccuucggcacggugagcacccccguccuggggaccaacuccuucgccgugcgcgacgacagcuccggcgggggccggaacccgcuccagcugcccuucaacuucaccuggcccgggacguucagccugaucaucgaggcguggcacgcccccggcgacgaccuccgcccggaggcccugccgcccgacgcccugaucuccaagaucgccauccagggcagccucgcgguggggcagaacuggcugcuggacgagcagaccuccacccucacccggcugcgcuacagcuaccgggucaucugcuccgacaacuacuacggcgacaacugcagccgccugugcaagaagcggaacgaccacuucgggcacuacgugugccagcccgacggcaaccucuccugccugcccggcuggacgggggaguacugccagcagcccaucugccugagcggcugccacgagcagaacggguacugcuccaagcccgccgagugccucugccgccccggcuggcaggggcggcugugcaacgagugcaucccgcacaacggcugccgccacgggaccugcagcacccccuggcagugcacgugcgacgagggcuggggcgggcuguucugcgaccaggaccucaacuacugcacccaccacagccccugcaagaacggcgcgaccugcuccaacagcgggcagcgguccuacacgugcacgugccgccccggcuacaccggcguggacugcgagcuggagcugagcgagugcgacuccaacccgugccggaacgggggcagcugcaaggaccaggaggacggguaccacugccucugcccgcccggcuacuacgggcugcacugcgagcacuccacccugagcugcgccgacucccccugcuucaacggcggcagcugccgcgagcggaaccagggggccaacuacgccugcgagugcccgcccaacuucaccggcuccaacugcgagaagaaggucgaccgcugcaccagcaaccccugcgccaacgggggccagugccucaaccgcggccccucccggaugugccgcugccggcccggguucaccggcaccuacugcgagcugcacgugagcgacugcgcccgcaaccccugcgcccacgggggcacgugccacgaccuggagaacgggcucaugugcacgugccccgccggcuucuccggccggcgcugcgaggugcggaccagcaucgacgcgugcgccuccagcccgugcuucaaccgcgcgaccugcuacaccgaccuguccaccgacaccuucgucugcaacugccccuacggguucgugggcagccggugcgaguuccccguggggcugcccccgagcuuccccugggucgccgugucccucggcguggggcuggccguccugcucgugcugcugggcaugguggccgucgccgugcgccagcuccggcugcgccggcccgacgacggcagccgcgaggccaugaacaaccuguccgacuuccagaaggacaaccucauccccgccgcgcagcugaagaacaccaaccagaagaaggagcuggaggucgacugcgggcuggacaagagcaacugcggcaagcagcagaaccacacccucgacuacaaccuggccccggggccccugggccgggggaccaugcccggcaaguucccccacuccgacaagagccucggcgagaaggccccgcugcgccugcacuccgagaagcccgagugccggaucagcgccaucugcagcccccgcgacuccauguaccaguccgugugccucaucagcgaggagcggaacgagugcgugaucgccacggaggucuga

SEQ ID NO: 29224 - RNA, 1362 nt, Artificial Sequence
  derived and/or modified sequence opt1 from DLST__Homo_sapiens__NP_001924
augcugagccgcucccggugcgugagccgcgccuucucccggagccucuccgccuuccagaagggcaacugcccccuggggcgccggagccugccgggcgucucccucugccaggggcccggcuaccccaacagccgcaagguggugaucaacaacuccgucuucagcgugcgguucuuccgcaccaccgcggugugcaaggacgaccuggucacggugaagacccccgccuucgccgaguccgugaccgagggggacguccggugggagaaggccgugggcgacaccguggccgaggacgaggucgugugcgagaucgagacggacaagaccagcgugcaggucccgucccccgcgaacggcgugaucgaggcccugcucgugcccgacgggggcaaggucgagggcgggacgccccuguucacccugcgcaagaccggggccgccccggcgaaggccaagcccgccgaggcccccgccgcggccgcccccaaggccgagccgaccgccgcggccgugcccccgcccgccgcccccauccccacccagaugccgcccgugcccagccccucccagccgcccagcggcaagcccgucuccgccgugaagcccaccguggcgccgccccucgccgagcccggcgccgggaagggccugcggagcgagcaccgcgagaagaugaaccggaugcgccagcggaucgcccagcgccugaaggaggcccagaacacgugcgcgaugcucaccaccuucaacgagaucgacauguccaacauccaggagaugcgggcccgccacaaggaggccuuccugaagaagcacaaccugaagcucggguucaugagcgccuucgucaaggcgagcgccuucgcccugcaggagcagcccguggucaacgccgugaucgacgacaccacgaaggagguggucuaccgggacuacaucgacaucuccguggccguggcgacgccccgcggccuggucgugccggugauccggaacgucgaggccaugaacuucgccgacaucgagcgcaccaucaccgagcucggcgagaaggcccgcaagaacgagcuggccaucgaggacauggacgggggcaccuucaccaucagcaacgggggcguguucgggucccuguucggcacccccaucaucaacccgccccagagcgcgauccucggcaugcacgggaucuucgaccggcccguggccaucggcgggaaggucgaggugcgccccaugauguacguggcccugaccuacgaccaccggcugaucgacggccgcgaggccgucacguuccuccggaagaucaaggccgcgguggaggacccccgcgugcugcugcucgaccuguga

SEQ ID NO: 29225 - RNA, 390 nt, Artificial Sequence
  derived and/or modified sequence opt1 from DLX1__Homo_sapiens__NP_001033582
augaccaugaccacgaugcccgagagccugaacuccccggugagcggcaaggccgucuucauggaguucgggccgcccaaccagcagaugucccccagccccaugucccacggccacuacagcaugcacugccuccacuccgccgggcacagccagcccgacggcgcguacuccagcgccuccagcuucucccgcccccugggguaccccuacgugaacagcguguccagccacgccuccagcccguacaucuccagcguccagagcuaccccggcuccgccagccuggcccagucccggcucgaggaccccggccaggaccuggugcccaagcaggcgauccaggugcaggaggccgacgaggccggguggggcgggagcggcggguga

SEQ ID NO: 29226 - RNA, 987 nt, Artificial Sequence
  derived and/or modified sequence opt1 from DLX2__Homo_sapiens__NP_004396
augaccggcguguucgacagccuggucgccgacaugcacuccacccagaucgccgcgagcuccacguaccaccagcaccagcagcccccgagcgggggcggggccggccccgggggcaacuccagcuccagcuccagccuccacaagccccaggagucccccacccugccggugagcaccgccaccgacuccagcuacuacacgaaccagcagcaccccgccggcgggggcgggggcgggggcucccccuacgcccacaugggcagcuaccaguaccaggcguccgggcugaacaacgugcccuacagcgccaaguccagcuacgaccucggcuacaccgccgccuacaccagcuacgcgccguacgggaccuccagcucccccgccaacaacgagcccgagaaggaggaccuggagcccgagauccgcaucgucaacggcaagccgaagaaggugcggaagccccgcacgaucuacagcuccuuccagcuggccgcccuccagcggcgcuuccagaagacccaguaccuggcccugcccgagcgggcggagcucgccgccagccugggccugacccagacccaggugaagaucugguuccagaaccgccgguccaaguucaagaagauguggaaguccggggagauccccagcgagcagcacccgggcgccagcgccuccccgcccugcgcgagcccgcccgucuccgcccccgccagcugggacuucggggugccccagcgcauggccggcgggggcggccccggguccggcgggagcggcgccggguccagcggcuccagccccagcuccgcggccagcgccuuccucggcaacuaccccugguaccaccagacguccgggagcgccucccaccuccaggccaccgcgccccugcugcaccccacccagaccccgcagccccaccaccaccaccaccaccacggcgggggcggggcccccgugagcgccggcacgaucuucuga

SEQ ID NO: 29227 - RNA, 864 nt, Artificial Sequence
  derived and/or modified sequence opt1 from DLX3__Homo_sapiens__NP_005211
augagcggcuccuucgaccgcaagcugagcuccauccucaccgacaucagcuccagccuguccugccacgccgggagcaaggacucccccacccugccggagagcuccgugacggaccucggcuacuacagcgcgccccagcacgacuacuacuccgggcagcccuacggccagaccgucaaccccuacaccuaccaccaccaguucaaccugaacgggcuggccggcaccggcgccuacagcccgaaguccgaguacacguacggggccagcuaccggcaguacggcgccuaccgcgagcagccccuccccgcccaggaccccguguccgugaaggaggagccggaggcggagguccggauggugaacgggaagcccaagaaggugcgcaagccccggaccaucuacagcuccuaccagcuggccgcccugcagcgccgguuccagaaggcccaguaccucgcgcugcccgagcgcgccgagcuggccgcccagcucggccugacccagacccaggucaagaucugguuccagaaccggcgcagcaaguucaagaagcuguacaagaacggggaggugccgcucgagcacagccccaacaacuccgacagcauggccugcaacuccccgcccagccccgcgcugugggacacguccagccacuccacccccgcccccgcccggagccagcugcccccgccccuccccuacuccgccagccccuccuaccuggacgacccgaccaacagcugguaccacgcccagaaccuguccggcccccaccuccagcagcagccgccccagcccgcgacccugcaccacgccagccccgggcccccgcccaaccccggcgccguguacuga

SEQ ID NO: 29228 - RNA, 723 nt, Artificial Sequence
  derived and/or modified sequence opt1 from DLX4__Homo_sapiens__NP_612138
augaccucccugcccugcccgcuccccggccgcgacgccuccaaggccguguuccccgaccuggcgcccgucccgagcguggccgccgccuacccccuggggcucucccccaccacggccgcgagccccaaccuguccuacagccggccguacggccaccuccuguccuaccccuacaccgagcccgccaaccccggggacagcuaccuguccugccagcagccggccgcccugagccagccccucugcggccccgcggagcacccccaggagcuggaggccgacuccgagaagccgcgccugagccccgagcccuccgagcggcgcccccaggccccggccaagaagcuccggaagccccgcaccaucuacagcucccugcagcugcagcaccucaaccagcgguuccagcacacccaguaccuggcccugcccgagcgcgcgcagcucgccgcccagcuggggcugacgcagacccaggugaagaucugguuccagaacaagcggagcaaguacaagaagcuccugaagcagaacuccggcggccaggagggggacuuccccggccgcaccuucagcgucuccccgugcagcccgccccugcccagccucugggaccugcccaaggccgggacccugcccacguccggcuacgggaacagcuucggcgccugguaccagcaccacuccagcgacgugcucgcgagcccccagaugauguga

SEQ ID NO: 29229 - RNA, 870 nt, Artificial Sequence
  derived and/or modified sequence opt1 from DLX5__Homo_sapiens__NP_005212
augaccggcguguucgaccgccggguccccagcauccgcuccggggacuuccaggcccccuuccagaccagcgccgcgaugcaccaccccucccaggagagccccacgcugcccgaguccagcgccaccgacuccgacuacuacagcccgaccggcggggcgccccacggcuacugcucccccaccagcgccuccuacgggaaggcccucaaccccuaccaguaccaguaccacggcgugaacggcagcgccggguccuacccggccaaggccuacgccgacuacagcuacgcguccagcuaccaccaguacggcggggccuacaaccgggugcccuccgccacgaaccagcccgagaaggaggucaccgagcccgaggugcgcauggugaacggcaagccgaagaagguccggaagccccgcaccaucuacagcuccuuccagcuggccgcccugcagcggcgcuuccagaagacccaguaccucgcgcugcccgagcgggccgagcuggccgccagccucgggcugacgcagacccaggugaagaucugguuccagaacaagcgcagcaagaucaagaagaucaugaagaacggcgagaugcccccggagcacucccccagcuccagcgaccccauggccugcaacagcccccaguccccggcggugugggagccccagggcuccagccggucccugagccaccacccccacgcccacccgcccaccuccaaccagagccccgccuccagcuaccucgagaacuccgccagcugguacaccuccgccgcgagcuccaucaacagccaccucccgccgcccgggagccugcagcacccccuggcccuggccuccggcacgcuguacuga

SEQ ID NO: 29230 - RNA, 882 nt, Artificial Sequence
  derived and/or modified sequence opt1 from DLX6__Homo_sapiens__NP_005213
augaugaccaugaccacgauggccgacggccuggaggggcaggacagcuccaagagcgccuucauggaguucggccagcagcagcagcagcagcagcagcagcagcagcagcagcagcagcagcagcagcagcccccgcccccgccgcccccgccgccccagccccacucccagcagagcucccccgcgauggccggggcccacuacccccuccacugccugcacagcgccgccgcggccgccgccgcgggcucccaccaccaccaccaccaccagcaccaccaccacgggagccccuacgccuccggcggcgggaacagcuacaaccaccgcucccuggccgccuaccccuacaugagccacucccagcacagccccuaccuccaguccuaccacaacagcuccgccgcggcccagacccggggcgacgacaccgaccagcagaagaccacggugaucgagaacggggagauccgcuucaacggcaaggggaagaagauccggaagccccgcaccaucuacagcucccugcagcugcaggcccucaaccaccgguuccagcagacccaguaccuggcccugcccgagcgcgccgagcucgcggccagccugggccugacccagacgcaggucaagaucugguuccagaacaagcggagcaaguucaagaagcuccugaagcagggcuccaacccccacgagagcgacccccugcagggguccgccgcccucagcccccgcucccccgcccugccgcccgugugggacgugagcgcguccgccaagggcgucagcaugccgcccaacuccuacaugcccggguacagccacugguacuccagcccccaccaggacaccaugcagcggccccagaugauguga

SEQ ID NO: 29231 - RNA, 5358 nt, Artificial Sequence
  derived and/or modified sequence opt1 from DMBT1__Homo_sapiens__NP_004397
augggcaucagcaccgugauccuggagaugugccuccugugggggcagguccuguccaccggcggguggaucccccgcacgaccgacuacgccagccucaucccguccgaggugccccuggaccccaccguggccgagggcagccccuucccguccgagagcacccuggaguccacggucgcggaggggagccccaucucccucgagagcacccuggaguccaccguggccgagggcagccugauccccuccgagagcacccucgaguccacgguggccgagggcagcgacuccgggcuggcccugcggcucgucaacggcgacgggcgcugccagggccggguggagauccuguaccgcgggagcuggggcaccgugugcgacgacuccugggacaccaacgacgccaacgucgugugccggcagcugggcugcgggugggcgaugagcgcccccggcaacgccugguucgggcagggcagcggcccgaucgcccucgacgacgugcgcugcuccgggcacgagagcuaccugugguccugcccccacaacggcuggcugagccacaacugcgggcacggcgaggacgcgggggucaucugcuccgccgcccagccccagagcacccuccggcccgaguccuggccggugcgcaucagcccccccgugcccacggagggcuccgagagcucccuggcccugcggcucgucaacggcggggaccgcugccggggccgcguggaggugcuguaccgggggagcuggggcaccgucugcgacgacuacugggacaccaacgacgccaacguggugugccgccagcuggggugcggcugggcgauguccgccccgggcaacgcccaguucgggcagggcagcgggcccaucguccucgacgacgugcggugcuccggccacgagagcuaccugugguccugcccccacaacggguggcugacccacaacugcggccacagcgaggacgccggcgugaucugcuccgccccccagagccgcccgacgcccagccccgacaccuggcccaccucccacgcgagcaccgccgggccggaguccagccucgcccugcggcuggucaacggcggggaccgcugccagggccggguggagguccucuaccgcggcuccugggggacggugugcgacgacagcugggacaccuccgacgccaacguggucugccggcagcugggcugcgggugggccaccagcgcgcccggcaacgcccgcuucgggcagggcuccggccccaucgugcuggacgacgugcgcugcagcggguacgaguccuaccucuggagcugcccccacaacggcuggcugucccacaacugccagcacagcgaggacgccggggucaucugcuccgccgcccacagcugguccaccccgagccccgacacgcugcccaccaucacccucccggcgagcaccgugggcuccgagagcucccuggcccugcggcucgugaacgggggcgaccgcugccagggccgggucgaggugcuguaccaggggagcuggggcacggugugcgacgacuccugggacaccaacgacgccaacgucgugugccgccagcuggggugcggcugggccaugagcgcgcccgggaacgcccgguucggccagggcuccgggcccaucgugcucgacgacguccgcugcagcggccacgaguccuaccuguggagcugcccccacaacggguggcugucccacaacugcggccacagcgaggacgccggggugaucugcuccgccagccagucccggccgacccccagccccgacaccuggcccacgucccacgccagcaccgcgggcuccgagagcagccucgcccugcgccuggugaacggcggggaccggugccagggccgcgucgaggugcucuaccggggguccuggggcaccgugugcgacgacuacugggacaccaacgacgccaacgucgugugccgccagcugggcugcgggugggccaugagcgccccgggcaacgcgcgguucgggcagggcuccgggcccaucgugcuggacgacguccgcugcagcggccacgaguccuaccuguggagcugcccccacaacggcuggcucucccacaacugcgggcaccacgaggacgccggcgugaucugcagcgccucccagagccagcccacgccgucccccgacaccuggcccaccagccacgccuccaccgccgggagcgaguccagccuggcgcugcggcucgugaacggcggggaccgcugccagggccgggucgaggugcuguaccgcggcuccugggggaccgugugcgacgacuacugggacacgaacgacgccaacgucgugugccggcagcugggcugcgggugggccaccagcgcccccggcaacgcgcgcuucgggcagggcuccggcccgaucgugcucgacgacguccgcugcagcgggcacgagagcuaccugugguccugcccccacaacggcuggcugagccacaacugcgggcaccacgaggacgccggcgugaucugcuccgccagccagucccagcccacccccagcccggacaccuggcccacgucccgggccagcaccgccggcuccgagagcacccucgcgcugcgccuggugaacgggggcgaccggugccgcgggcgggucgaggugcucuaccagggcuccugggggaccgugugcgacgacuacugggacacgaacgacgccaacgucgugugccgccagcugggcugcggcugggccaugagcgcccccgggaacgcccaguucggccagggguccggccccaucgugcuggacgacguccggugcagcgggcacgaguccuaccucuggagcugcccgcacaacggcuggcugucccacaacugcggccaccacgaggacgcgggggugaucugcagcgccgcccagucccagagcaccccccgccccgacaccuggcugaccacgaaccucccggcccugaccgugggcagcgaguccagccuggcccuccggcuggucaacgggggcgaccgcugccgggggcgcguggaggugcuguaccggggcuccuggggcaccgucugcgacgacagcugggacaccaacgacgcgaacguggugugccgccagcucgggugcggcugggccauguccgcccccgggaacgcccgguucggccaggggagcggccccaucguccuggacgacgugcgcugcuccggcaacgagagcuaccugugguccugcccccacaagggguggcucacgcacaacugcggccaccacgaggacgcgggggucaucugcagcgccacccagaucaacuccaccaccacggacugguggcacccgaccaccaccacgaccgcccggcccagcuccaacugcggcggcuuccuguucuacgccagcgggaccuucuccagccccuccuaccccgccuacuacccgaacaacgcgaagugcgugugggagaucgaggugaacagcggcuaccgcaucaaccugggguucuccaaccucaagcuggaggcccaccacaacugcagcuucgacuacgucgagaucuucgacggcagccugaacuccagccuccugcuggggaagaucugcaacgacacccggcagaucuucacguccagcuacaaccgcaugaccauccacuuccgguccgacaucagcuuccagaacaccggcuuccucgccugguacaacuccuuccccagcgacgccacccugcgccuggugaaccucaacuccagcuacggccugugcgccgggcgcguggagaucuaccacggcgggacguggggcaccgucugcgacgacuccuggaccauccaggaggcggagguggugugccggcagcuggggugcggccgcgccgucagcgcccucggcaacgccuacuucggguccggcagcgggcccaucacccuggacgacguggagugcuccggcacggagagcacccuguggcagugccggaaccgcgggugguucucccacaacugcaaccaccgggaggacgccggcgugaucugcagcggcaaccaccucuccacccccgcgccguuccugaacaucacccgccccaacaccgacuacagcugcgggggcuuccugagccagcccuccggggacuucagcucccccuucuacccgggcaacuaccccaacaacgccaagugcgucugggacaucgaggugcagaacaacuaccgggugacggucaucuuccgcgacgugcagcucgaggggggcugcaacuacgacuacaucgagguguucgacggccccuaccggagcuccccccugaucgcccgcgucugcgacggggcccggggcagcuucaccuccagcuccaacuucaugagcauccgcuucaucuccgaccacagcaucacccggcgcggguuccgggccgaguacuacuccagcccguccaacgacagcaccaaccugcucugccugcccaaccacaugcaggcguccgugagccgcagcuaccugcagucccucggcuucagcgccuccgaccuggugaucagcacguggaacggcuacuacgagugccggccccagaucacccccaaccuggucaucuucaccaucccguacuccgggugcggcaccuucaagcaggccgacaacgacacgaucgacuacagcaacuuccucaccgccgcgguguccgggggcaucaucaagcgccggaccgaccugcgcauccacgugagcugccgcaugcugcagaacaccugggucgacacgauguacaucgccaacgacaccauccacguggccaacaacaccauccagguggaggagguccaguacgggaacuucgacgugaacaucuccuucuacaccagcuccagcuuccucuaccccgugacgucccggcccuacuacgucgaccugaaccaggaccuguacgugcaggccgagauccuccacagcgacgccgugcugacccuguucgucgacaccugcguggcgucccccuacagcaacgacuucaccucccucacguacgaccugauccgcagcggcugcgugcgggacgacaccuacggcccguacuccagccccagccugcgcaucgcccgguuccgcuuccgggccuuccacuuccucaaccgcuuccccuccgucuaccugcggugcaagaugguggugugccgcgccuacgacccgagcucccggugcuaccgcgggugcguccugcggagcaagcgcgacgugggcuccuaccaggagaagguggacgucgugcucgggcccauccagcugcagacccccccccggcgcgaggaggagccgcgguga

SEQ ID NO: 29232 - RNA, 1023 nt, Artificial Sequence
  derived and/or modified sequence opt1 from DMC1__Homo_sapiens__NP_008999
augaaggaggaccagguggucgccgaggagcccggcuuccaggacgaggaggagagccuguuccaggacaucgaccuccugcagaagcacgggaucaacguggccgacaucaagaagcugaaguccgugggcaucugcaccaucaaggggauccagaugaccacgcgccgggcgcucugcaacgucaagggccugagcgaggccaagguggacaagaucaaggaggccgccaacaagcugaucgagccgggguuccucaccgccuucgaguacuccgagaagcgcaagaugguguuccacaucaccaccggcagccaggaguucgacaagcugcugggcgggggcaucgaguccauggcgaucacggaggccuucggggaguuccggaccggcaagacccagcucagccacacccugugcgucacggcccagcugcccggggccggcggcuaccccgggggcaagaucaucuucaucgacaccgagaacaccuuccgccccgaccggcuccgcgacaucgcggaccgguucaacguggaccacgacgccgugcuggacaacguccuguacgcccgcgccuacaccuccgagcaccagauggagcuccuggacuacguggccgcgaaguuccacgaggaggccgggaucuucaagcugcucaucaucgacagcaucauggcccuguuccggguggacuucuccggccgcggcgagcuggccgagcggcagcagaagcucgcccagaugcugagccgccugcagaagaucuccgaggaguacaacgucgcgguguucgugacgaaccagaugaccgccgacccgggggccaccaugaccuuccaggccgaccccaagaagcccaucggcgggcacauccucgcccacgcgagcacgacccggaucucccugcgcaagggccgcggggagcugcggaucgccaagaucuacgacagccccgagaugccggagaacgaggccaccuucgccaucaccgccggcggcaucggggacgcgaaggaguga

SEQ ID NO: 29233 - RNA, 11034 nt, Artificial Sequence
  derived and/or modified sequence opt1 from DMD__Homo_sapiens__NP_000100
auggaggacgagcgcgaggacgugcagaagaagaccuucaccaagugggugaacgcccaguucuccaaguucggcaagcagcacaucgagaaccuguucuccgaccuccaggacgggcggcgccugcuggaccuccuggagggccugaccgggcagaagcuccccaaggagaagggcagcacccgggugcacgcccugaacaacgugaacaaggcccugcgcgugcuccagaacaacaacguggaccuggugaacaucggguccaccgacaucguggacggcaaccacaagcugacccucggccugaucuggaacaucauccugcacuggcaggucaagaacgugaugaagaacaucauggccgggcuccagcagacgaacagcgagaagauccugcuguccugggugcggcagagcacccgcaacuacccccaggugaacgugaucaacuucaccaccuccuggagcgacggccucgcccugaacgcccugauccacucccaccggcccgaccucuucgacuggaacagcguggugugccagcaguccgccacgcagcgccuggagcacgcguucaacaucgcccgguaccagcuggggaucgagaagcuccuggaccccgaggacguggacaccaccuaccccgacaagaaguccauccugauguacaucaccucccucuuccagguccugccccagcaggucagcaucgaggccauccaggagguggagaugcugccccggccgcccaaggucacgaaggaggagcacuuccagcuccaccaccagaugcacuacucccagcagaucaccgugagccuggcccagggcuacgagcggaccuccagcccgaagccccgcuucaaguccuacgcguacacccaggccgccuacgugacgaccagcgaccccacccggagccccuuccccucccagcaccuggaggcccccgaggacaagagcuucggguccagccucauggaguccgaggucaaccuggaccgcuaccagaccgcccuggaggaggugcucagcuggcugcuguccgcggaggacacgcuccaggcccagggcgagaucagcaacgacguggaggucgugaaggaccaguuccacacccacgagggcuacaugauggaccugaccgcccaccaggggcgggucggcaacauccugcagcucggguccaagcugaucggcaccggcaagcugagcgaggacgaggagacggaggugcaggagcagaugaaccuccugaacucccgcugggagugccugcggguggccagcauggagaagcaguccaaccuccaccgcguccugauggaccugcagaaccagaagcugaaggagcucaacgacuggcugaccaagaccgaggagcggacccgcaagauggaggaggagccccuggggcccgaccucgaggaccugaagcgccaggugcagcagcacaaggugcugcaggaggaccucgagcaggagcagguccgcgugaacagccugacgcacaugguggucgugguggacgaguccagcggcgaccacgccaccgcggcccuggaggagcagcucaagguccugggggaccgcugggccaacaucugccgguggaccgaggaccgcugggugcugcuccaggacauccugcugaaguggcagcggcucaccgaggagcagugccuguucuccgccuggcugagcgagaaggaggacgccgugaacaagauccacacgaccggcuucaaggaccagaacgagaugcucuccagccugcagaagcuggcgguccucaaggccgaccuggagaagaagaagcagagcauggggaagcuguacucccucaagcaggaccugcugagcacccucaagaacaaguccgugacccagaagacggaggccuggcuggacaacuucgcccgcugcugggacaaccuggugcagaagcucgagaaguccaccgcccagaucagccaggcggucaccaccacccagccgagccugacgcagaccaccgugauggagaccgugacgaccgucaccacccgggagcagauccuggugaagcacgcccaggaggagcugcccccgccgccgccccagaagaagcgccagaucacgguggacuccgagauccggaagcgccuggacgucgacaucaccgagcugcacagcuggaucacccgguccgaggccgugcuccagagccccgaguucgccaucuuccgcaaggagggcaacuucuccgaccugaaggagaaggugaacgcgaucgagcgggagaaggccgagaaguuccgcaagcugcaggacgccagccgguccgcccaggcccucgucgagcagauggugaacgagggcgugaacgcggacagcaucaagcaggccuccgagcagcugaacagccgcuggaucgaguucugccagcugcucuccgagcggcugaacuggcuggaguaccagaacaacaucaucgccuucuacaaccagcuccagcagcuggagcagaugaccacgaccgccgagaacuggcugaagauccagcccaccacccccagcgagcccacggccaucaagagccagcucaagaucugcaaggacgaggucaaccgccuguccgggcugcagccccagaucgagcggcucaagauccagagcaucgcgcugaaggagaagggccaggggcccauguuccuggacgccgacuucguggccuucaccaaccacuucaagcaggucuucuccgacguccaggcccgcgagaaggagcuccagaccaucuucgacacccugccgcccaugcgguaccaggagacgaugagcgccauccgcaccugggugcagcaguccgagaccaagcugagcaucccccagcucuccgugaccgacuacgagaucauggagcagcgccugggcgagcugcaggcgcuccagagcucccugcaggagcagcagagcgggcuguacuaccucuccacgaccgucaaggagaugagcaagaaggccccguccgagaucagccggaaguaccaguccgaguucgaggagaucgagggccgcuggaagaagcugagcucccagcugguggagcacugccagaagcucgaggagcagaugaacaagcugcggaagauccagaaccacauccagacccugaagaaguggauggccgagguggacgucuuccucaaggaggaguggcccgcccugggcgacagcgagauccugaagaagcagcucaagcagugccgccugcugguguccgacauccagaccauccagcccagccucaacagcgugaacgagggcgggcagaagaucaagaacgaggcggagcccgaguucgccucccggcuggagacggagcugaaggagcucaacacccagugggaccacaugugccagcaggucuacgcccgcaaggaggcccugaagggcgggcuggagaagaccgugagccuccagaaggaccuguccgagaugcacgaguggaugacccaggccgaggaggaguaccuggagcgggacuucgaguacaagacgccggacgagcuccagaaggcgguggaggagaugaagcgcgccaaggaggaggcccagcagaaggaggccaaggucaagcugcugaccgagagcgugaacuccgugaucgcccaggcgccgcccgucgcccaggaggcccucaagaaggagcuggagacccugaccacgaacuaccaguggcucugcacccggcugaacgggaagugcaagacccuggaggaggugugggccugcuggcacgagcuccugagcuaccuggagaaggccaacaaguggcugaacgagguggaguucaagcucaagaccaccgagaacauccccggcggcgcggaggagaucuccgagguccuggacagccuggagaaccucaugcgccacuccgaggacaaccccaaccagauccggauccuggcccagacgcugaccgacgggggcgugauggacgagcucaucaacgaggagcuggagaccuucaacagccgcuggcgggagcugcacgaggaggccguccgccggcagaagcuccuggagcaguccauccagagcgcccaggagaccgagaagucccugcaccucauccaggagagccugacguucaucgacaagcagcuggcggccuacaucgccgacaagguggacgccgcccagaugccccaggaggcgcagaagauccaguccgaccucaccagccacgagaucucccuggaggagaugaagaagcacaaccaggggaaggaggccgcccagcgcgugcugagccagaucgacgucgcccagaagaagcuccaggacguguccaugaaguuccggcuguuccagaagcccgccaacuucgagcagcgccugcaggagagcaagaugauccucgacgaggugaagaugcaccuccccgcgcuggagaccaagagcgucgagcaggagguggugcagucccagcucaaccacugcgucaaccuguacaagagccuguccgaggucaagagcgagguggagauggugaucaagaccggccggcagaucgugcagaagaagcagacggagaacccgaaggagcucgacgagcgcgugaccgcccugaagcugcacuacaacgagcucggcgccaaggucaccgagcggaagcagcagcuggagaagugccugaagcucucccgcaagaugcgcaaggagaugaacgugcugaccgaguggcuggccgccacggacauggagcucaccaagcggagcgcgguggaggggaugcccuccaaccuggacagcgaggucgccuggggcaaggccacccagaaggagaucgagaagcagaaggugcaccugaaguccaucaccgaggugggggaggcccucaagacgguccugggcaagaaggagacccugguggaggacaagcucagccugcugaacuccaacuggaucgccgugaccagccgcgcggaggaguggcucaaccugcugcucgaguaccagaagcacauggagaccuucgaccagaacgucgaccacaucacgaaguggaucauccaggccgacacccugcuggacgaguccgagaagaagaagccccagcagaaggaggacgugcucaagcggcugaaggccgagcugaacgacauccgccccaagguggacagcacccgggaccaggccgcgaaccucauggccaaccgcggggaccacugccggaagcuggucgagccgcagaucuccgagcugaaccaccgcuucgccgccaucagccaccggaucaagaccggcaaggccuccaucccccucaaggagcuggagcaguucaacagcgacauccagaagcugcucgagccccuggaggcggagauccagcagggcgugaaccugaaggaggaggacuucaacaaggacaugaacgaggacaacgaggggacggugaaggagcuccugcagcgcggcgacaaccugcagcagcggaucaccgacgagcgcaagcgggaggagaucaagaucaagcagcagcuccugcagaccaagcacaacgcccugaaggaccuccgcucccagcggcgcaagaaggcccuggagaucagccaccagugguaccaguacaagcggcaggccgacgaccugcucaagugccuggacgacaucgagaagaagcuggccagccuccccgagccgcgcgacgagcggaagaucaaggagaucgaccgcgagcugcagaagaagaaggaggagcugaacgcgguccgccggcaggccgaggggcucuccgaggacggcgccgccauggccguggagcccacccagauccagcugagcaagcgcuggcgggagaucgaguccaaguucgcgcaguuccgccggcugaacuucgcccagauccacacggugcgcgaggagaccaugauggucaugaccgaggacaugccccucgagaucagcuacgugcccuccaccuaccugacggagaucacccacgugagccaggcccugcucgaggucgagcagcugcugaacgccccggaccucugcgcgaaggacuucgaggaccuguucaagcaggaggagucccugaagaacaucaaggacagccuccagcaguccagcgggcggaucgacaucauccacuccaagaagaccgccgcccugcagagcgccacccccguggagcgcgugaagcugcaggaggcccucucccagcuggacuuccagugggagaaggucaacaagauguacaaggaccggcagggccgcuucgaccggagcguggagaaguggcgccgguuccacuacgacaucaagaucuucaaccaguggcugacggaggcggagcaguuccuccgcaagacccagauccccgagaacugggagcacgccaaguacaagugguaccugaaggagcugcaggacggcaucgggcagcggcagaccgugguccgcacccucaacgccaccggcgaggagaucauccagcaguccagcaagacggacgccuccauccugcaggagaagcuggggagccugaaccuccgguggcaggaggugugcaagcagcuguccgaccgcaagaagcggcuggaggagcagaagaacauccucagcgaguuccagcgcgaccugaacgaguucgugcuguggcucgaggaggccgacaacaucgcgagcaucccgcuggagcccggcaaggagcagcagcugaaggagaagcucgagcaggucaagcugcugguggaggagcucccccugcggcaggggauccugaagcagcucaacgagaccggcggccccgugcuggucuccgccccgaucagccccgaggagcaggacaagcuggagaacaagcucaagcagaccaaccugcaguggaucaaggugucccgcgcccugcccgagaagcagggggagaucgaggcccagaucaaggaccucggccagcuggagaagaagcuggaggaccucgaggagcagcugaaccaccuccugcuguggcugagccccauccgcaaccagcucgagaucuacaaccagccgaaccaggaggggcccuucgacgugcaggagaccgagaucgccguccaggcgaagcagcccgacguggaggagauccuguccaagggccagcaccuguacaaggagaagcccgccacgcagccggucaagcggaagcucgaggaccugagcuccgaguggaaggccgugaaccgccugcuccaggagcugcgggccaagcagcccgaccuggcgcccgggcucaccaccaucggcgccagccccacccagacggugacccuggucacccagccgguggugaccaaggagacggccaucuccaagcuggagaugcccagcucccucaugcuggagguccccgcccuggccgacuucaaccgcgcguggaccgagcucaccgacuggcugagccugcucgaccaggugaucaagucccagcgggugauggucggcgaccuggaggacaucaacgagaugaucaucaagcagaaggccaccaugcaggaccuggagcagcgccggccccagcucgaggagcugaucacggccgcccagaaccugaagaacaagaccagcaaccaggaggcccgcaccaucaucaccgaccggaucgagcgcauccagaaccagugggacgaggugcaggagcaccuccagaaccggcgccagcagcugaacgagaugcugaaggacuccacgcaguggcucgaggcgaaggaggaggccgagcagguccuggggcaggcccgggccaagcuggagagcuggaaggagggcccguacaccgucgacgccauccagaagaagaucaccgagaccaagcagcucgcgaaggaccugcgccaguggcagacgaacguggacguggccaacgaccuggcccucaagcugcugcgggacuacuccgccgacgacacccgcaagguccacaugaucaccgagaacaucaacgccagcuggcgguccauccacaagcgcgugagcgagcgggaggcggcccucgaggagacccaccgccugcugcagcaguucccccucgaccuggagaaguuccuggccuggcucacggaggccgagaccaccgcgaacgugcugcaggacgccacccgcaaggagcggcugcucgaggacagcaagggggucaaggagcugaugaagcaguggcaggaccugcagggcgagaucgaggcccacacggacguguaccacaaccucgacgagaacucccagaagauccugcgcagccuggagggcuccgacgacgccgugcuccugcagcggcgccuggacaacaugaacuucaaguggagcgagcuccggaagaagucccugaacauccgcagccaccuggaggccuccagcgaccaguggaagcggcuccaccugucccugcaggagcuccuggucuggcugcagcucaaggacgacgagcugagccgccaggcgcccaucgggggcgacuuccccgccgugcagaagcagaacgacgugcaccgggccuucaagcgcgagcugaagaccaaggagccggucaucauguccacccucgagaccgugcggaucuuccugacggagcagccccuggaggggcuggagaagcucuaccaggagccccgcgagcugcccccggaggagcgggcccagaacgugacccgccugcuccggaagcaggccgaggaggucaacaccgagugggagaagcugaaccugcacagcgcggacuggcagcgcaagaucgacgagacccucgagcggcugcaggagcugcaggaggccacggacgagcucgaccugaagcugcgccaggccgaggugaucaagggcuccuggcagcccgugggggaccuccugaucgacagccugcaggaccaccucgagaaggucaaggcccugcggggcgagaucgcgccccugaaggagaacgugucccacgugaacgaccucgcgcgccagcugaccacccugggcauccagcucagcccguacaaccuguccacccuggaggaccucaacacccgguggaagcugcugcaggucgccguggaggaccgcgugcgccagcuccacgaggcccaccgggacuucgggcccgccagccagcacuuccugagcacguccguccagggccccugggagcgcgcgaucagccccaacaaggugccguacuacaucaaccacgagacccagacgaccugcugggaccaccccaagaugacggagcuguaccagucccucgccgaccugaacaacgugcgguucagcgccuaccgcaccgccaugaagcugcggcgccuccagaaggcccugugccuggaccuccugucccugagcgcggccugcgacgcccucgaccagcacaaccugaagcagaacgaccagcccauggacauccugcagaucaucaacugccucaccaccaucuacgaccggcuggagcaggagcacaacaaccuggucaacgugccccucugcguggacaugugccugaacuggcugcucaacgucuacgacacggggcgcaccggccggauccgcgugcuguccuucaagaccgggaucaucagccugugcaaggcccaccucgaggacaaguaccgguaccuguucaagcaggucgccuccagcaccggcuucugcgaccagcgccggcugggccuccugcugcacgacuccauccagaucccgcgccagcucggggaggucgcgagcuucggcggguccaacaucgagcccagcgugcgguccugcuuccaguucgccaacaacaagcccgagaucgaggccgcccuguuccuggacuggaugcgccucgagccccagagcaugguguggcugccgguccugcaccggguggccgcggccgagacggccaagcaccaggccaagugcaacaucugcaaggagugccccaucaucggcuuccgcuaccggucccucaagcacuucaacuacgacaucugccagagcugcuucuucuccgggcgcguggcgaagggccacaagaugcacuaccccauggucgaguacugcacccccaccaccagcggcgaggacgugcgcgacuucgccaagguccugaagaacaaguuccggacgaagcgcuacuucgccaagcacccgcggaugggguaccugcccgugcagaccgugcucgagggcgacaacauggagacccccgucacccugaucaacuucuggcccguggacagcgccccggccuccagcccccagcugucccacgacgacacgcacagccgcaucgagcacuacgcgucccggcucgccgagauggagaacagcaacggguccuaccugaacgacagcaucucccccaacgagagcaucgacgacgagcaccuccugauccagcacuacugccagucccugaaccaggacagcccccugucccagccgcgcagccccgcccagauccucaucucccuggagagcgaggagcggggcgagcuggagcgcauccucgccgaccuggaggaggagaaccggaaccugcaggccgaguacgaccgccucaagcagcagcacgagcacaagggccugagcccccugcccagcccgcccgagaugaugcccaccuccccgcagagcccccgggacgcggagcucaucgccgaggccaagcugcugcgccagcacaaggggcggcucgaggcccgcaugcagauccuggaggaccacaacaagcagcuggagagccagcuccaccggcugcgccagcugcucgagcagccccaggccgaggcgaaggugaacggcaccaccgucuccagccccuccacgagccugcagcgguccgacagcucccagccgaugcugcugcgcgugguggggagccagaccuccgacagcaugggcgaggaggaccuccugagcccgccccaggacaccagcaccgggcuggaggaggucauggagcagcucaacaacuccuuccccagcucccggggccgcaacacgccgggcaagcccaugcgggaggacaccauguga

SEQ ID NO: 29234 - RNA, 2601 nt, Artificial Sequence
  derived and/or modified sequence opt1 from DMGDH__Homo_sapiens__NP_037523
augcugcgccccggcgcccagcuccugcgggggcugcuccugcgcagcugcccgcugcagggcucccccgggcggccccgcagcgugugcggccgggagggggaggagaagcccccgcucuccgccgagacccaguggaaggaccgcgcggagaccgucaucaucggcggcgggugcgugggcgugagccuggccuaccaccuggccaaggccgggaugaaggacgucgugcuccuggagaaguccgagcugacggccggcagcaccuggcacgcggccgggcucaccaccuacuuccaccccggcaucaaccugaagaagauccacuacgacuccaucaagcuguacgagaagcucgaggaggagacgggccagguggucggguuccaccagcccggcagcauccggcuggccaccacccccgugcgcguggacgaguucaaguaccagaugacccggacgggguggcacgccaccgagcaguaccugaucgagccggagaagauccaggagauguucccccuccugaacaugaacaagguccuggcgggccucuacaaccccggcgacgggcacaucgaccccuacucccugaccauggcccuggccgccggcgcccgcaagugcggggcgcuccugaaguacccggcccccgugaccagccugaaggcccgguccgacggcacgugggacguggagacgccccaggggagcaugcgcgccaaccggaucgucaacgccgcgggcuucugggcccgcgaggugggcaagaugaucgggcucgagcacccccugaucccggugcagcaccaguacgucgugaccuccaccaucagcgaggugaaggcccugaagcgggagcuccccguccugcgcgaccuggagggcuccuacuaccuccggcaggagcgcgacgggcugcuguucggccccuacgagagccaggagaagaugaaggugcaggacuccugggugaccaacggggugcccccgggcuucggcaaggagcuguucgagagcgaccucgaccggaucauggagcacaucaaggccgccauggagauggugcccgugcugaagaaggcggacaucaucaacgucgugaacgggcccaucaccuacucccccgacauccucccgauggucggcccccaccagggggugcgcaacuacuggguggccaucggcuucggguacggcaucauccacgccggcggggucggcaaguaccugagcgacuggauccugcacggggagccgcccuucgaccucaucgagcuggaccccaaccgguacggcaaguggaccaccacgcaguacaccgaggccaaggcccgcgagagcuacggcuucaacaacaucgugggguaccccaaggaggagcgcuucgcgggccggcccacccagcgcguguccgggcuguaccagcggcucgagagcaagugcuccaugggcuuccacgccgggugggagcagccgcacugguucuacaagcccggccaggacacccaguaccgccccagcuuccggcgcacgaacugguucgagcccgucggcuccgaguacaagcaggucaugcagcggguggccgucaccgaccugagcccguucgggaaguucaacaucaagggccaggacuccauccgccugcucgaccaccuguucgccaacgugauccccaaggugggguucaccaacaucagccacaugcugacccccaagggccgggucuacgcggagcugacggugucccaccagagccccggggaguuccuccugaucaccggcuccggcagcgagcugcacgaccuccgcuggaucgaggaggaggccgugaagggcggguacgacgucgagaucaagaacaucaccgacgagcugggggugcugggcguggccgggccgcaggcccggaagguccuccagaagcugaccuccgaggaccugagcgacgacguguucaaguuccuccagacgaagucccugaaggugagcaacauccccgucaccgccauccgcaucuccuacaccggcgagcugggcugggagcucuaccaccggcgcgaggacagcguggcgcuguacgacgccaucaugaacgccgggcaggaggagggcaucgacaacuucgggaccuacgccaugaacgcccugcggcucgagaaggcguuccgcgccuggggccuggagaugaacugcgacacgaacccccuggaggccgggcucgaguacuucgugaagcugaacaagcccgccgacuucaucggcaagcaggcccugaagcagaucaaggcgaagggccucaagcggcgccuggucugccugacccucgccaccgacgacguggacccggaggggaacgaguccaucugguacaacggcaagguggucgggaacaccaccagcggcagcuacuccuacagcauccagaagucccuggccuucgccuacgugcccgugcagcugagcgaggucggccagcaggucgagguggagcuccuggggaagaacuaccccgcggugaucauccaggagccccuggugcucacggagccgacccggaaccgccugcagaagaagggcgggaaggacaagaccuga

SEQ ID NO: 29235 - RNA, 273 nt, Artificial Sequence
  derived and/or modified sequence opt1 from DMKN__Homo_sapiens__NP_001030593
augaacaugaagcccgccaccgccagcgcgcugcuccugcugcuccugggccuggccuggacccaggggucccacggcuggggcgccgacgccagcucccuccagaagcgcgccgggcgggcggaccagaacuacaacuacaaccagcacgccuacccgacggccuacgggggcaaguacagcgugaagacccccgccaagggcggggucucccccagcuccagcgcgucccgcgugcagcccggccugcugcagugggugaaguucugguga

SEQ ID NO: 29236 - RNA, 1494 nt, Artificial Sequence
  derived and/or modified sequence opt1 from DMP1__Homo_sapiens__NP_001073380
augaagaucagcauccugcucauguuccuguggggccuguccugcgcccuccccgugacccgcuaccagaacaacgagagcgaggacuccgaggaguggaaggggcaccuggcccaggcgccgaccccgccccuggccaacgaggaccccagcgacuccacgcagagcgaggagggccucggguccgacgaccaccaguacaucuaccggcuggccggcggguucagccgcuccaccggcaagggcggggacgacaaggacgacgacgaggacgacagcggcgacgacaccuucggggacgacgacuccggccccgggcccaaggaccggcaggagggcggcaacagccgccugggguccgacgaggacagcgacgacaccauccaggccuccgaggagagcgcgccccagggccaggacuccgcccaggacacgaccagcgagucccgggagcucgacaacgaggaccgcgucgacagcaagcccgagggcggggacagcacccaggaguccgagagcgaggagcacugggugggcgggggcuccgacggggagagcucccacggcgacgggagcgagcuggacgacgagggcaugcaguccgacgacccggagagcauccgguccgagcgcggcaacagccggaugaacuccgccgggaugaaguccaaggagagcggcgagaacagcgagcaggccaacacccaggacuccgggggcagccagcugcucgagcaccccucccgcaagaucuuccgcaagagccggaucuccgaggaggacgaccggagcgagcuggacgacaacaacacgauggaggaggucaagagcgacuccaccgagaacagcaacucccgcgacaccgggcugagccagccccggcgcgacuccaagggcgacagccaggaggacuccaaggagaaccucagccaggaggagucccagaacguggacggccccagcuccgagagcucccaggaggccaaccugagcucccaggagaacagcuccgagagccaggaggagguggugagcgagucccgcggggacaacccggaccccaccacgagcuacgucgaggaccaggaggacuccgacagcuccgaggaggacagcucccacacccugagccacuccaagagcgagucccgggaggagcaggcggacagcgaguccagcgagucccucaacuucagcgaggagucccccgagagccccgaggacgagaacuccagcagccaggagggccugcagucccacagcuccagcgccgagucccagagcgaggagucccacagcgaggaggacgacuccgacagccaggacuccagccgguccaaggaggacagcaacuccaccgagagcaaguccagcuccgaggaggacgggcagcugaagaacaucgagaucgagagccgcaagcucaccguggacgccuaccacaacaagccgaucggcgaccaggacgacaacgacugccaggacggguacuga

SEQ ID NO: 29237 - RNA, 1875 nt, Artificial Sequence
  derived and/or modified sequence opt1 from DMPK__Homo_sapiens__NP_001075029
augagcgccgaggugcgccugcggcgccuccagcagcugguccuggaccccggcuuccucgggcuggagccgcugcucgaccugcugcucggcgugcaccaggagcugggggccuccgagcuggcgcaggacaaguacguggccgacuuccuccagugggccgagcccaucgucgugcggcugaaggaggugcgccugcagcgggacgacuucgagauccucaaggucaucggccgcggggccuucagcgagguggccguggucaagaugaagcagaccggccagguguacgcgaugaagaucaugaacaagugggacaugcugaagcggggcgagguguccugcuuccgcgaggagcgggacguccuggugaacggggaccgccgguggaucacccagcuccacuucgccuuccaggacgagaacuaccuguaccuggugauggaguacuacgucggcggggaccuccugacgcugcucagcaaguucggcgagcgcauccccgccgagauggcccgguucuaccuggcggagaucgugauggccaucgacuccgugcaccgccugggguacguccaccgggacaucaagcccgacaacauccuccuggaccgcugcggccacauccggcuggccgacuucggcagcugccucaagcugcgcgccgacgggaccgugcggucccugguggccgucggcaccccggacuaccucagccccgagauccugcaggcggucgggggcggccccgggaccggcuccuacgggcccgagugcgacuggugggcccugggcguguucgccuacgagauguucuacgggcagacgccguucuacgccgacagcaccgccgagaccuacggcaagaucgugcacuacaaggagcaccucucccugccccugguggacgagggcguccccgaggaggcgcgcgacuucauccagcggcuccugugcccgcccgagacccgccuggggcgcggcggggccggcgacuuccggacgcaccccuucuucuucgggcucgacugggacggccugcgcgacagcgugccgcccuucacccccgacuucgagggcgccaccgacacgugcaacuucgaccugguggaggacgggcucaccgccauggagacccuguccgacauccgggagggcgcgccccuggggguccaccuccccuucgugggcuacagcuacuccugcauggcccugcgcgacagcgaggugcccgggccgacccccauggagcuggaggccgagcagcugcucgagccccacguccaggcccccucccuggagccgagcgugagcccccaggacgagaccgccgagguggccguccccgcggccgugcccgccgccgaggcggaggccgaggugacgcugcgggagcuccaggaggcccuggaggaggagguccugacccgccagucccucagccgggagauggaggccauccgcaccgacaaccagaacuucgccucccagcugcgggaggcggaggcccgcaaccgggaccuggaggcccacgugcgccagcuccaggagcggauggagcugcugcaggccgagggcgccaccgcggugacgggcgucccgagcccccgcgccaccgacccgcccucccaccucgacgggccgcccgccguggccgugggccagugcccccuggucgggcccggccccaugcaccggcgccaccuccuccugcccgcccgggugccccgcccgggccugagcgaggcgcucucccugcugcuguucgccgugguccugagccgggccgccgcgcuggggugcaucggccucguggcccacgccgggcagcugaccgccguguggcgccgccccggcgccgcgcgggcccccuga

SEQ ID NO: 29238 - RNA, 1122 nt, Artificial Sequence
  derived and/or modified sequence opt1 from DMRT1__Homo_sapiens__NP_068770
augcccaacgacgaggccuucagcaagccguccacccccagcgaggcgccccacgcccccggcgugccgccccaggggcgcgccggcggguucggcaaggccuccggggcccuggucggcgccgcgagcggcuccagcgccgggggcuccagccgcgggggcggguccggcagcggcgccuccgaccucggggccggcagcaagaaguccccgcggcugcccaagugcgcgcggugccgcaaccacggguacgccagcccccugaagggccacaagcgguucugcauguggcgcgacugccagugcaagaagugcaaccucaucgccgagcggcagcgcgugauggccgcccagguggcgcugcggcgccagcaggcccaggaggaggagcugggcaucucccaccccaucccccuccccagcgccgccgagcugcuggucaagcgggagaacaacggguccaacccgugccucaugaccgagugcagcggcacgucccagcccccgcccgccagcgugcccaccaccgcggccagcgaggggcgcauggugauccaggacauccccgccgucaccucccggggccacguggagaacacgcccgaccuggugagcgacuccaccuacuacagcuccuucuaccagcccagccuguucccguacuacaacaaccucuacaacugcccccaguacuccauggcccuggccgcggacagcgccuccggggaggucggcaacccccugggcgggagccccgugaagaacucccuccgcggccugccggggcccuacgugcccggccagaccgggaaccaguggcagaugaagaacauggagaaccggcacgccaugagcucccaguaccgcaugcacagcuacuacccgccgcccuccuaccugggccagagcgucccccaguucuucaccuucgaggacgcccccuccuaccccgaggcccgggcgagcguguucuccccgcccagcagccaggacuccggccucgugagccuguccagcuccagccccaucuccaacaagagcacgaaggccguccuggagugcgagcccgccuccgagcccagcuccuucaccgugacccccgugaucgaggaggacgaguga

SEQ ID NO: 29239 - RNA, 1164 nt, Artificial Sequence
  derived and/or modified sequence opt1 from DMRT2__Homo_sapiens__XP_006716781
auggacaagaagggccugagcgggaagcagaacaacuucgagcgcaaggccguguaccagcggcagguccgcgcccccucccuccuggccaagagcauccuggagggcuaccggccgauccccgcggagaccuacgucgggggcaccuucccccugcccccgcccguguccgaccgcaugcggaagcgccgggccuucgccgacaaggagcucgagaacaucaugcuggagcgcgaguacaaggagcgggagaugcucgagacgagccaggccgcggcccuguuccugcccaaccgcauggugcccgggccggacuacaacuccuacaagagcgccuacucccccagccccguggagcccccguccaaggacuucugcaacuuccucccgaccugccuggaccugaccaugcaguacagcggcuccggcaacauggagcucaucagcuccaacgugagcgucgccaccacguaccggcaguacccccuguccagccgcuuccugguguggcccaagugcgggcccaucuccgacacccuccuguaccagcagugccugcucaacgcgaccaccagcgugcaggcccugaagcccggcgccuccugggaccugaagggggcccggguccaggacggccucagcgccgagcaggacaugaugcccagcaagcuggaggggucccuggugcucccccacacgccggagauccagaccacccgcagcgaccugcagggccaccaggcggugcccgagcgguccgccuucagcccgccccgccggaacuucucccccaucgucgacaccgacagccuggccgcccagggccacgugcucacgaagaucuccaaggagaacacccgccacccccugccccugcggcacaaccccuuccacagccucuuccagcagacccugaccgacaaguccgggccggagcugaagacgcccuucgugaaggaggccuucgaggagacccccaagaagcaccgcgagugccucgucaaggacaaccagaaguacaccuucaccaucgaccggugcgcgaaggaccuguucguggccaagcaggucggcacgaagcugagcgugaacgagccgcucuccuucagcguggaguccauccugaagcgccccagcuccgccaucacccgcgugagccaguga

SEQ ID NO: 29240 - RNA, 1419 nt, Artificial Sequence
  derived and/or modified sequence opt1 from DMRT3__Homo_sapiens__NP_067063
augaacggcuacgggagccccuaccuguacaugggcgggccggugucccagccgccccgcgcgccccuccagcggacccccaagugcgcccgcugccggaaccacggcguccugagcuggcugaaggggcacaagcgcuacugccgguucaaggacugcacgugcgagaagugcauccucaucaucgagcgccagcgggugauggccgcccagguggcccugcgccggcagcaggccaacgagucccuggagagccucauccccgacucccugcgcgcccugcccgggcccccgccgcccggcgacgcggucgccgcgccccagcccccgcccgccagccagcccucccagccccagccgccccggcccgccgccgagcucgccgccgccgcggcccugcgcuggaccgccgagccccagcccggggcccugcaggcccagcucgcgaagcccgaccugaccgaggagcggcugggcgacggcaagagcgccgacaacaccgagguguucuccgacaaggacaccgaccagcgcagcucccccgacguggccaagagcaagggcugcuucacgccggagucccccgagaucgucagcguggaggagggcggguacgccgugcagaagaacggcgggaaccccgagucccggcccgacagcccgaagugccacgccgagcagaaccaccuccugaucgagggccccuccgggaccgucagccugcccuucucccucaaggcgaaccgcccgccccuggaggugcugaagaagaucuuccccaaccagaagcccaccgugcucgagcugauccugaagggcugcggcggggaccucgucagcgccguggaggugcugcugagcucccggagcuccgucaccggcgccgagcgcacgagcgccgagccggagucccucgcccugcccagcaacgggcacaucuucgagcacacccuguccagcuaccccaucuccagcuccaaguggagcgugggcuccgcguuccgggugcccgacacccuccgcuucagcgccgacuccagcaacgucgugccgagcccccuggccgggccccugcagcccccguucccccagccgccccgguacccccucaugcugcgcaacacccuggcccgcucccaguccagccccuuccuccccaacgacgugacgcuguggaacaccaugacccugcagcagcaguaccagcuccggagccaguacgucucccccuucccgagcaacuccaccagcguguuccgcuccagccccgugcugcccgcgcgggccacggaggacccccgcaucuccaucccggacgacggcugccccuucgucagcaagcaguccaucuacaccgaggacgacuacgacgagcggagcgacuccagcgacucccgcacccugaacaccagcuccuga

SEQ ID NO: 29241 - RNA, 1515 nt, Artificial Sequence
  derived and/or modified sequence opt1 from DMRTA1__Homo_sapiens__NP_071443
auggagcgcagccagugcggcucccgggaccgcggggugagcggccggccccaccuggccccggggcucgucguggccgcgcccccgccgcccucccccgcccugcccgugcccagcggcaugcaggucccgcccgccuuccugcgcccgcccucccucuuccugcgggccgccgcggccgccgccgcggccgccgccgccaccagcggguccggcggcugcccgcccgcgcccgggcuggagagcggcgugggggccgugggcugcggguacccccgcacccccaagugcgcccggugccgcaaccacggcgucguguccgcccucaagggccacaagcgguucugccgcuggcgggacugcgccugcgcgaagugcacccugaucgccgagcgccagcgggugauggccgcccaggucgcccugcgccggcagcaggcgcaggaggagagcgaggcccgcgggcuccagcggcugcugugcuccggccucagcuggccgcccgggggccgcgccuccggcgggggcgggcgggccgagaacccccagagcaccggcgggcccgccgcgggcgccgcccugggccugggggcccuccgccaggcguccggcagcgccacccccgccuucgagguguuccagcaggacuaccccgaggagaagcaggagcagaaggaguccaagugcgagagcugccagaacgggcaggaggagcugaucuccaagagccaccagcuguaccucggcagcuccagccgguccaacggggugaucggcaagcagagcaucggcuccagcaucuccgaguacagcaacaagcccgacuccauccugagcccccaccccggggagcaguccggcggggaggagagcccccgcucccugagcuccagcgaccucgaguccggcaacgagagcgagugggucaaggaccugaccgccacgaaggccucccugcccaccgugagcagccgcccgcgggacccccucgacauccugaccaagaucuuccccaacuaccgccggucccgccuggaggggauccuccgguucugcaagggcgacgugguccaggcgaucgagcagguccugaacggcaaggagcacaagccggacaaccgcaaccuggccaacagcgaggagcucgagaacaccgccuuccagcgggccuccagcuucucccuggccgggaucggcuucgggacgcugggcaacaagagcgcguucagcccccuccagaccaccuccgccuccuacggcggggacagcucccuguacggcgugaacccccgcguggggaucagcccccugcggcucgccuacuccagcgccggccgcgggcuguccggcuucaugagcccguaccugacccccggccucgugcccacgcugcccuuccggccggcccuggacuacgcguucuccgggaugauccgcgacagcagcuaccucuccagcaaggacuccaucacgugcggccggcuguacuuccgccccaaccaggacaaccccuga

SEQ ID NO: 29242 - RNA, 2019 nt, Artificial Sequence
  derived and/or modified sequence opt1 from DMTF1__Homo_sapiens__NP_001135798
augaccgccaccacggagguggccgacgacgaggucaccgagggcaccgugacccagauccagauccugcagaacgagcagcucgacgagaucagcccccuggggaacgaggagguguccgcggucagccaggccugguucacgaccaaggaggacaaggacucccugaccaacaagggccacaaguggaagcaggggauguggagcaaggaggagaucgacauccucaugaacaacaucgagcgcuaccugaaggcccggggcaucaaggacgccaccgagaucaucuucgagauguccaaggacgagcgcaaggacuucuaccggacgaucgccugggggcugaaccgcccgcuguucgcgguguaccggcgcgugcugcggauguacgacgaccgcaaccacgucggcaaguacacccccgaggagaucgagaagcugaaggagcuccggaucaagcacggcaacgacugggccaccaucggggccgcccugggccgcagcgcguccagcgugaaggaccggugccgccugaugaaggacacgugcaacaccgggaaguggaccgaggaggaggagaagcggcucgccgaggugguccacgagcugaccuccaccgagcccggcgacaucgugacgcagggggugagcugggccgccgucgccgagcgcgugggcacccgguccgagaagcagugccgcagcaaguggcugaacuaccucaacuggaagcaguccggcgggaccgaguggaccaaggaggacgagaucaaccugauccugcggaucgcggagcucgacguggccgacgagaacgacaucaacugggaccugcuggccgagggcuggagcuccguccgcagcccccaguggcuccgguccaagugguggacgaucaagcgccagaucgccaaccacaaggacgugagcuucccggugcugaucaaggggcugaagcagcuccacgagaaccagaagaacaaccccacccugcuggagaacaaguccggcagcggcguccccaacagcaacaccaacuccagcgugcagcacgugcagauccgggucgcccgccucgaggacaacaccgcgaucuccagcucccccauggccgcccugcagaucccggugcagaucacgcacgugagcuccgccgacagccccgccaccgucgacuccgagaccaucacccugaacagcgggacgcuccagaccuucgagauccugcccuccuuccaccuccagcccaccggcaccccggggacguaccuccugcagaccagcuccagccagggccugccccucacccugaccgcgucccccacggugacccugaccgccgccgcccccgccagcccggagcagaucaucguccacgcgcucucccccgagcaccuccugaacaccagcgacaacgugaccgugcagugccacacgccccgcgucaucauccagaccguggccaccgaggacaucaccuccagcaucagccaggccgagcugacgguggacuccgacauccagagcuccgacuuccccgagccgcccgacgcccuggaggcggacaccuuccccgacgagauccaccaccccaagaugaccgucgagccgagcuucaacgacgcccacguguccaaguucagcgaccagaacuccaccgagcugaugaacagcgugaugguccggacggaggaggagaucuccgacaccgaccucaagcaggaggagagccccuccgaccuggccagcgccuacgugaccgaggggcuggagucccccaccaucgaggagcaggucgaccagacgaucgacgacgagaccauccucaucgugcccagcccgcacggcuucauccaggccuccgacgugaucgacaccgagagcgugcugccccugaccacgcugaccgaccccauccuccagcaccaccaggaggaguccaacaucaucggcagcagccugggguccccggucagcgaggacuccaaggacguggaggaccuggugaacugccacuga

SEQ ID NO: 29243 - RNA, 1077 nt, Artificial Sequence
  derived and/or modified sequence opt1 from DMTN__Homo_sapiens__NP_001107611
auggagcgccugcagaaggccaagauggacaaccaggugcucggcuacaaggaccuggccgcgauccccaaggacaaggccauccuggacaucgagcggcccgaccucaugaucuacgagccccacuucaccuacagccugcuggagcacgucgagcucccccgcucccgggagcgcagccugucccccaagagcaccuccccgccgcccagccccgaggugugggccgacucccggagccccgggaucaucucccaggccagcgcgccccgcacgaccggcacgccccggaccucccugccccacuuccaccacccggagaccagccgccccgacuccaacaucuacaagaagccgcccaucuacaagcagcgggagagcgucgggggcagcccccagaccaagcaccucaucgaggaccugaucaucgaguccuccaaguuccccgccgcccagccgcccgaccccaaccagcccgccaagaucgagaccgacuacuggcccugcccgcccagccuggccgugguggagaccgaguggcgcaagcggaaggcgucccgccgcggggccgaggaggaggaggaggaggaggacgacgacagcggcgaggagaugaaggcccuccgggagcggcagcgcgaggagcugagcaaggugacguccaaccugggcaagaugauccucaaggaggagauggagaagucccugcccauccggcgcaagacccggagccugcccgaccgcacccccuuccacaccagccuccaccaggggacguccaagagcuccagccugccggccuacggccggaccacccugucccgccuccagagcaccgaguucucccccagcggguccgagacgggcagccccgggcugcagaucuacccguacgagaugcuggucgugaccaacaagggccgcaccaagcucccgcccggcguggaccggaugcgccuggagcggcaccuguccgccgaggacuucagccgcgucuucgcgaugucccccgaggaguucgggaagcucgcccuguggaagcggaacgagcugaagaagaaggccagccucuucuga

SEQ ID NO: 29244 - RNA, 2025 nt, Artificial Sequence
  derived and/or modified sequence opt1 from DMWD__Homo_sapiens__NP_004934
auggccgccggcggggcggagggcgggagcggccccggggccgccaugggcgacugcgccgagaucaagucccaguuccgcacccgggagggcuucuacaagcugcucccgggggacggcgccgcgcgccggagcgggcccgccuccgcccagacccccgugcccccgcagccgccccagcccccgcccggccccgccagcgcguccgggcccggcgccgccggcccggccagcuccccgccgcccgccgggcccggccccgggcccgcgcugcccgccguccgccugagccucgugcggcugggcgagcccgacuccgccggcgccggggagccgcccgccacgcccgcgggccuggggagcggcggggaccgcgugugcuucaaccucggccgggagcuguacuucuaccccggcugcugccgccgggggucccagcgcagcaucgaccugaacaagcccaucgacaagcggaucuacaagggcacccagccgaccugccacgacuucaaccaguucaccgccgccacggagaccaucucccuccuggucggguucagcgccggccaggugcaguaccuggaccucaucaagaaggacaccuccaagcuguucaacgaggagcgccugaucgacaagaccaaggugacguaccucaaguggcugcccgagagcgagucccuguuccucgccagccacgcguccgggcaccuguaccuguacaacgucagccaccccugcgccagcgccccgccccaguacucccuccugaagcagggcgagggcuucagcguguacgccgccaaguccaaggcgccccggaacccccuggccaagugggccgugggggagggcccccucaacgaguucgccuucagccccgacgggcgccaccuggcgugcgucucccaggacggcugccugcggguguuccacuucgacagcaugcuccugcgcgggcugaugaaguccuacuucggcggccuccugugcgugugcuggagcccggacgggcgguacgucgugaccggcggggaggacgaccuggugaccgucugguccuucaccgagggccgcgugguggcccggggccacgggcacaagagcugggucaacgccguggccuucgaccccuacacgacccgcgccgaggaggcggccaccgccgccggcgccgacggggagcgguccggcgaggaggaggaggaggagcccgaggcggccgggaccggcagcgccggcggggcgccccucuccccgcugcccaaggccggcagcaucacguaccgcuucggguccgccggccaggacacccaguucugccugugggaccucaccgaggacgugcuguacccccacccgccccuggcccgcacccggacgcuccccgggacccccggcaccacgccgcccgccgccagcuccagccgcggcggggagcccggccccgggccccugccccggucccugagccgcagcaacucccucccccaccccgcgggcgggggcaaggccggcgggcccggcgucgccgccgagccggggacccccuucagcaucggccgguucgccacccugacccugcaggagcgccgggaccgcggggcggagaaggagcacaagcgguaccacucccucggcaacaucagccgcggcggguccggcgggagcggcuccggcggggagaagcccagcggcccggugccccggucccgccuggaccccgccaaggugcuggggaccgcccucugcccccggauccacgaggucccgcugcuggagccccuggugugcaagaagaucgcccaggagcgccucacgguccugcuguuccucgaggacugcaucaucaccgccugccaggagggccugaucugcaccugggcgcggcccgggaaggccuucaccgacgaggagacggaggcccagaccggcgagggcagcuggccccgcuccccgagcaaguccgugguggaggggaucagcucccagcccggcaacagccccuccgggaccgucguguga

SEQ ID NO: 29245 - RNA, 9147 nt, Artificial Sequence
  derived and/or modified sequence opt1 from DMXL1__Homo_sapiens__NP_001277250
augaaccugcaccaggugcucaccggcgccgucaaccccggggaccacugcuucagcgugggcuccaucggggaccagcgcuucaccgccuacgcgagcggcugcgacaucgugauccugggguccgacuucgagcggcugcagaucaucccgggcgccaagcacggcaacauccaggucgggugcguggacugcagcaugcagcagggcaagaucgccgccuccuacgggaacgugaucagcaucuucgagcccgucaaccuccccaagcagaagaagaaccuggagcuguacucccaguggcagaagagcggccaguucuuccucgaguccaucgcccacaacaucacgugggaccccaccgggagccgccugcugaccggcuccagcuaccuccagcugugguccaacaccaaccuggagaagccgacggaggacgagaaccucaacaagaccgaccugaacuucggcgacuggaagugcaucuggcacugcaagaccgcgagccaggugcaccugaugaaguucucccccgacggggaguucuucgccaccgccggcaaggacgacugccuccugaaggugugguacaacgucgagaacuggcggacggccgugaccagccccgacggguccagcgagaagcagucccagggcgagaucgacuucagcuucguguaccuggcgcacccccgcgccgucaacggcuucagcuggcggaagaccuccaaguacaugccgcgcgccagcgugugcaacgugcuccugaccugcugcaaggacaacgucugccggcuguggguggagacguuccuccccaacgacugccugcuguacgggggcgacugcucccacuggaccgagagcaucaaccucaccaacaacuucaagcgcaacgccuccagcaaggagcgggugcagaacgcccuggaggucaaccugcgccacuuccggcgcgggcggcgccggucccucgcgcugguggcccacaccggcuaccugccccaccagcaggacccccaccacgugcaccgcaacacgccgcuccacgccaacgcccugugccacuuccacaucgccgcgagcaucaaccccgccaccgacaucccccugcuccccuccaucaccagccugucccugaacgagaacgaggagaagaccgggccguucgucgugcacuggcucaacaacaaggagcugcacuucacgcugagcauggagguguuccuccagcagcugcggaaguccuucgagcagcccagcuccgaggccagcgucgaggacuccaaccaggccgacgugaagagcgacgaggagaccgacgacggcgucgacgaccugaagaucaaccccgagaagaaggagcucggcugcgacaagauggugcccaacuccagcuucaccagccuguccagcgccgcgaucgaccaccagaucgaggugcugcucuccgaguggagcaagaacgccgacaugcuguucuccauccacccgauggacgggagccugcucgucuggcacguggacuggcuggacgaguaccagcccggcauguuccgccaggugcaggucuccuucgugagccggauccccguggccuuccccaccggggacgccaacucccugugcaagagcaucaugauguacgccugcacgaagaacgucgaccuggcgauccagcagggcaagcagaagccguccgggcucacccgcagcaccuccaugcugaucagcuccggccacaacaagagcuccaacagccugaagcucagcaucuucacccccaacgugaugaugaucuccaagcacgccgacggcagccugaaccaguggcugguguccuucgccgaggagagcgccuucuccacgguccucagcaucucccacaagagccgguacugcgggcaccgcuuccaccugaacgaccuggcgugccacuccgugcucccccugcugcucaccaccagccaccacaacgcccugcgcacccccgacguggacaacccggagcagcccuucgacgcccugaacaucgaggagugcucccucacgcagcagaacaagagcaccgucgacguggccuuccaggaccccuccgccguguacagcgagcugauccuguggcgggucgacccggugggcccccucuccuucagcgggggcguguccgagcuggcgcgcaucaacagccugcacgucuccgccuucagcaacguggccuggcuccccacccugauccccagcuacugccugggggccuacugcaacuccccgagcgccugcuucguggcguccgacggccaguaccuccggcuguacgaggccgucaucgacgccaagaagcugcucagcgagcuguccaaccccgagaucagcaaguacgugggcgagguguucaacaucgucucccagcagagcaccgcccgccccgggugcaucaucgcccuggaccccaucacgaagcuccacggccggaagacccagcugcugcacguguucgaggaggacuucauccucaacaaccuggagaagaagucccuggggaaggacagcauccucuccaacgcgggcagcuccccgaacggcuucagcgagaaguucuaccugaucgugaucgagugcacccaggacaaccgcucccugcuccacauguggaaccugcaccugaagagcauccccgucucccucgacgagaagguggacaccaagcugagcgaggccguguggcagcccgaggagcacuacuccagcagccccgagaagauccuguccccguucagccagaaguaccaggccugccgggccaaccuccaguccaccagccgccugacgcuguucuccgagauggucuacagccaggagcuccaccugcccgaggggguggagaucaucuccaucaagcccagcgcgggccaccuguccagcuccagcaucuaccccgccugcuccgccccguaccuccuggccaccagcugcuccgacgagaaggugcgguucuggcgcugccgggucaccgacggggagagcgccaccuccaagaacggcaagaucgaccuggcguacaucugggaggaguggccccuccugaucgaggacgggcugcagagcaacuccagcaucacggugcccggccgccccguggaggucagcugcgcccacaccaaccggcucgccguggccuacaagcagccggccuccaacagccgcuccagccaggacuucgugaugcacgucuccaucuucgagugcgagagcaccggcggguccugcugggugcuggagcagaccauccaccuggacgagcucagcacggugcuggacuccggcaucagcgucgacuccaaccugguggcguacaacaagcaggacauguaccucagcuccaaggagaacaucaccagcaacaccaagcaccuggugcaccuggacuggaugucccgggaggacgggagccacauccucaccgucggcaucggguccaagcuguucauguacggcccccuggccggcaaggugcaggaccagacggggaaggagacccucgccuucccccugugggagagcaccaagguggucccccuguccaaguucgugcuccugcgcagcgucgaccuggugagcuccguggacggcagcccgcccuuccccgucucccucagcugggugcgggacgggauccugguggucggcauggacugcgagaugcacguguacugccaguggcagccguccagcaagcaggagcccgugaucaccgacuccuacagcggguccacgcccagcaucaccucccugaucaagcagagcaacuccagcuccggccuccaccccccgaagaagacccugacccgcagcaugacgucccuggcccagaagaucugcggcaagaagaccgccuucgaccccagcgucgacauggaggacuccgggcucuucgaggcggcccacgugcugagccccacccugccccaguaccacccgcuccagcugcuggagcucauggaccugggcaaggugcggcgcgccaaggccauccugagccaccucgucaagugcaucgcgggggaggugguggcccugaacgaggccgaguccaaccacgagcgccggcugcgcagccucaccaucuccgccagcggcuccacgacccgggacccccaggccuucaacaaggcggagaacaccgacuacaccgagaucgacagcguccccccccugccgcuguacgcccugcucgccgccgacgacgacuccugcuacagcucccuggagaagagcuccaacgagagcacgcuguccaagagcaaccagcucuccaaggagagcuacgacgagcuguuccagacccagcugcucaugaccgacacccacaugcuggagacggacgaggagaacaccaagccccgcgugaucgaccugucccaguacagccccaccuacuucgggcccgagcacgcccaggugcucagcggccaccugcugcacuccagccucccgggccugucccggauggagcagaugagccugauggcgcucgccgacaccaucgccacgaccuccaccgacaucggggagagccgcgaccggucccagggcggggagacccuggacgagugcggccugaaguuccuccuggccguccgccugcacaccuuccucacgaccagccugcccgccuaccgggcgcagcugcuccaccagggccuguccaccagccacuucgccugggccuuccacuccguggccgaggaggagcugcucaacaugcugcccgccaugcagaaggacgaccccaccuggagcgagcugcgcgcgaugggggugggcugguggguccggaacacgcgcauccuccggaagugcaucgagaagguggccaaggccgccuucuaccgcaagaacgacccgcuggacgcggccaucuucuaccuggccaugaagaagaaggccgugaucugggggcucuaccgggccgagaagaacacccgcaugacccaguucuucggccacaacuucgaggacgagcgguggcgcaaggcggcccugaagaacgccuucucccugcucgggaagcagcgguucgagcacagcgccgccuucuuccugcuggcgggcugccuccgcgacgccaucgaggucugccuggagaagcugaacgacauccagcucgcccuggugaucgcccggcuguacgaguccgaguucgacaccagcgccgcguacaaguccauccuccgcaagaaggugcugggcaucgacagccccgucuccgagcugugcagccucaacaucaacaugcaccacgaccccuuccugcgcagcauggccuacuggauccuggaggacuacuccggggcccucgagacgcugaucaagcagcccauccgggagaacgacgaccaggugcugagcgccuccaacccgaccguguucaacuucuacaacuaccuccgcacccacccccugcugcuccggcgccacuucggcagcuccgacaccuucagcacgcacaugucccugaccgggaagagcggccuggcggggaccaucaaccucuccgagcggcgccuguucuucaccacggccagcgcccaccugaaggccggcugccccaugcucgcccuggagguccuguccaagaugcccaaggugaucaagaagacccggccguucuaccgcgcgagcuccuuccucgacaccagcaaggacugcucccccagcuccccccugaagcuggacgcccgggaggacaagagcuccgccguggacuggagccagagccucaucaacggcuucggguccagcuccgagggcagcuccgagaagcagagcaacuccacccugagcuucgacuggucccagccgagcgucguguuccaggacgacucccuggagcucaagugggacagcgacaacgacgaggagaacgaggacgugcccaucuccaugaaggagcugaagccccugcagcgcaagacggacaagaagcucgacgacaucagcuccaacuacaccgagagcuucuccacccuggacgagaacgaccugcucaaccccagcgaggacaucaucgccguccagcugaaguuccgggccugccugaagauccucaccguggagcugcgcacgcuguccaccggguacgagaucgacggcgggaagcuccgguaccagcuguaccacuggcuggagaaggaggugaucgcgcuccagcgcaccugcgacuucugcagcgacgccgaggagcugcagagcgccuucggccggaacgaggacgaguucggccugaacgaggacgccgaggaccucccgcaccagaccaaggucaagcagcugcgcgagaacuuccaggagaagcggcaguggcugcucaaguaccagucccugcugcgcauguuccucagcuacugcauccugcacgggucccacggcgggggccuggccagcgugcggauggagcucauccugcugcugcaggagucccagcaggagacgagcgagccccucuucuccagcccccuguccgagcagaccagcgugccccugcucuucgcgugcaccgccaacgccaagaccgucguggccaacccgcugcugcaccucuccaaccugacgcacgacauccugcacgcgaucaucaacuucgacagccccccccaccccgacauccaguccaacaagguguacgucaugcacacccucgccgccagccuguccgccugcaucuaccagugccugugcggcagccacaacuacuccagcuuccagaccaaccaguucaccgggaugguguaccagacggugcuccugccgcaccgccccucccugaagaccggcagccucgacgaggcccugacccccaacaccagccccgcgcaguggccggggaucaccugccugauccgccuccugaacuccagcggcgaggaggcccaguccgggcugacgguccuccugugcgagauccugaccgccguguaccucagccuguucauccacggccuggccacccacuccagcaacgagcucuuccggaucguggcccacccccugaacgagaagaugugguccgcggucuucggcgggggcgcccacgugcccagcaaggagcagacccacuccaagacgcugcccgucagcucccucguggaggagggggagaagcagaacaagcgcuuccggccgagcaagauguccugccgcgagagcgccccccugacccccuccagcgcccccgugucccaggagagccuggccgucaaggagaaguucaucccgcccgagcucuccaucugggacuacuucaucgcgaagcccuuccugcccagcagccagucccgggccgaguacgacagcgaggagucccugggcagcgacgacgacgacaacgacgacgacgacgacgugcucgccuccgacuuccaccugcaggagcacagcaacuccaacagcuacuccuggagccugaugcgccucgccauggugcagcugguccugaacaaccucaagaccuucuacccguucgccgggcacgaccuggcggagcugcccguguccagcccccucugccacgccgugcugaagacccugcagugcugggagcagguccuccugcggcgccuggagauccacggcggcccgccccagaacuacaucgccucccacacggccgaggagagccucuccgcggggcccgccauccugcggcacaaggcccugcucgagcccaccaacaccccguucaagagcaagcaccaccuggcccuguccgugaagcgccucuggcaguaccuggugaagcaggaggagauccaggagaccuucaucaagaacaucuucacgaagaagcggugccugaacgagagccucgaggacaacagcgagaccaucaagaacuccaugauggaggagcccaacaucaacaagaucgaggccgaccugggcuaccccgggggcaaggcgcgcaucauccacaaggagagcgacaucaucaccgccuucgccgucaacaaggccaaccggaacugcaucgccaucgcguccagccacgacgugcaggagcuggacguguccgggauccucgccacccaggucuacacguggguggacgacgacaucgagguggagaccaagggcagcgaggacuuccuggucauccacgcccgcgacgaccugaccgccgugcagggcaccacgcccuacacccacuccaacccggggacccccaucaacaugcccuggcucggcagcacccagacggggcggggcgccuccgugaugaucaagaaggcgaucaacaacguccgccggaugaccagccaccccacccugccguacuaccugaccggggcccaggacggcuccgugcgcauguucgaguggggccacagccagcagaucacgugcuuccgguccgggggcaacagccgcgugacccggaugcgcuucaacuaccaggggaacaaguucggcaucgucgacgccgacggcuaccucucccuguaccagaccaacuggaagugcugccccgugaccgggagcaugcccaagcccuaccugacguggcagugccacaacaagaccgccaacgacuucguguucgucuccagcuccagccucaucgcgaccgccggccugagcaccgacaaccgcaacgugugccugugggacacgcucguggccccggccaacucccugguccacgccuucaccugccacgacagcggggcgaccgugcuggccuacgcccccaagcaccagcuccugaucuccggcgggcggaagggcuucaccuacguguucgaccugugccagcgccagcagcggcagcucuuccagagccacgacucccccgucaaggccguggccguggaccccacggaggaguacuucgucaccggcagcgcggaggggaacaucaagaucuggucccugagcaccuucggccugcuccacaccuucguguccgagcacgcccgccagagcaucuuccggaacaucgggaccggcgugaugcagaucgagacggggccggccaaccacaucuucuccugcggcgccgacggcaccaugaagaugcgcauccugcccgaccaguucagcccccugaacgagguccucaagaacgacgugaaguucaugcuguga

SEQ ID NO: 29246 - RNA, 9114 nt, Artificial Sequence
  derived and/or modified sequence opt1 from DMXL2__Homo_sapiens__NP_001167587
augcaccuccaccaggugcugaccggcgccgugaaccccggggacaacugcuacagcgugggcagcgugggggacgugcccuucaccgccuacggcagcgggugcgacaucgugauccuggcgaacgacuucgagugcgugcagaucauccccggcgccaagcacggcaacauccaggucuccugcguggagugcagcaaccagcaggggcgcaucgccgccuccuacggcaacgccgugugcaucuucgagccccuggggaucaacagccacaagcggaacugccagcugaagugccaguggcugaagaccggccaguucuuccuguccagcgucaccuacaaccucgcgugggacccccaggacaaccgccugcugaccgccaccgacuccauccagcucugggccccgcccggggacgacauccuggaggaggaggaggagaucgacaacaccgugccgcccgugcugaacgacuggaagugcgucuggcagugcaagaccagcguguccgugcaccucauggaguggagccccgacggcgaguacuucgccaccgcgggcaaggacgacugccugcugaaggucugguaccccaugaccggguggaaguccagcaucaucccccaggaccaccacgaggugaagcggcgccaguccagcacccaguucuccuucguguaccucgcccacccccgggccgucaccggcuucagcuggcgcaagaccuccaaguacaugccccgggggagcgugugcaacgugcugcugaccagcugccacgacggcgucugccgccucugggccgagacgcugcugcccgaggacugccuccugggcgagcagaucugcgagaccaccaccuccagcaucgccuccagccugucccacgcggggcggcacaaggaccgcauccagcacgcccucgagacgauccaccaccugaagaaccugcggaagggccagcgccggagcuccgugcucgugacccacgccgagcugaugcccgaccagaccgccaugcacgagguccagcgccacaucagccaccacgccaacgcgcugugccacuuccacaucgccgccuccaucaaccccgccaccgacaucccgaacgugcucgucgggacggccuucaacguggacgacggcaacgggggcuucgugguccacuggcugaacaacaaggaguuccacuucaccagcuccaccgagguguucaugcaccagcugcggaagcucagcgacaagcaggucgaccacgagaacgacgacgcggaccgcgaggacgaggagcacucccaggaggaccgggagcgcggccugcacaugaagcuggaccacgaccucagccuggaccgggaguccgaggccgggaccggcagcuccgagcacgaggacggggagcgcgagggcagcccccggacguacucccgccugagcguccccaugccccuccccaccgugcugcuggaccgcaagaucgagacccuccugaccgaguggaacaagaaccccgacaugcuguucacgauccaccccguggacgggaccuuccucgucuggcacgugaaguaccuggacgaguacaaccccggcaucuuccgccaggugcaggucagcuucuccagccgcaucccgguggccuuccccuccggcgacgccagcucccugagcaagaacaucaugauguacgccugcaucaacgcgaccaaggacucccaccacacccuccugcaccaggaggggaugagcgugggcagcccccacgggagccagccccacucccggagccacuccacgcacaugaacauccuggccccgaccgucaugaugaucagcaagcacaucgacggcucccugaaccagugggccgugaccuucgccgacaagagcgcguucaccacggugcucaccgucucccacaaguuccgcuacugcgggcaccgguuccaccugaacgaccuggccugccacagcgugcucccccugcugcucaccagcucccaccacaacgcccugcugacccccgagcucgacugccagugggacagcgacaacaagcugucccgccugauggacccggugaagcacaucaagggcagcuccaagcagccccuccggaacgccgccacccgcacguuccacgaccccaacgcgaucuacagcgagcugauccuguggcgggucgaccccaucggcccgcucuccuacaccgggggcgugagcgagcuggcccgcaucaacucccugcacaccagcgccuucuccaacguggccuggcuccccacccugauccccagcuacugccuggggacguacugcaacuccgccagcgcgugcuucgucgccuccgacggcaagaaccuccggcuguaccaggccgugguggacgcccgcaagcugcucgacgagcugagcgaccccgaguccagcaagcugaucggcgaggucuucaacaucgugucccagcagagcaccgcccggccggggugcaucaucgagcucgacgcgaucaccaaccagugcggcagcaacacccagcugcugcacguguuccaggaggacuucaucaucggguacaagccccacaaggaggacauggagaagaaggagacggagaucuucuuccagcccucccagggcuaccggcccccgcccuucagcgagaaguucuuccucgucgugaucgagaaggacuccaacaacaacagcauccugcacauguggcaccuccaccucaaguccgugcaggccugccuggccaaggccagcgagggggcguccagcgagucccugcucagcguccccggccagaagaacguggacuccagccccgagaccucccccagcgugucccccaugccccacagcuccagcaucgccaaccugcagaccgccuccaagcugauccucagcagccggcuggucuacucccagccccuggaccucccggagagcguggaggugauccgcgccacccccuccgccggccaccugagcuccagcuccaucuaccccgucugccuggcgcccuaccucguggugacgaccugcagcgacaacaagguccgguucuggaagugcugcauggaggccaacccggagugcaacaaguccgacgagaaggagaucuaccacuggaagcgcuggccccugaugaacgacgagggggaggacaacagcuccaccgugagcaucgugggccggcccgucgccguguccugcagcuacaccgggcgccuggccguggccuacaagcagccgauccaccacaacggcuucgucuccaaggaguucagcaugcacgugugcaucuucgagugcgaguccaccggcgggagcgagugggugcucgagcagaccauccaccuggacgaccuggucaaggugggguccguccucgacagccgcgugagcguggacuccaaccuguucgucuacagcaaguccgacgcgcugcucagcaaggaccgguaccugauccccaacaucaagcaccuggugcaccucgacuggguguccaaggaggacgggagccacauccugaccgucggcgugggggccaacaucuucauguacggccgccuguccgggaucgugaccgagcagacgaacagcaaggacggcgucgccgugaucacccucccccugggcggguccaucaagcagggcgugaagucccgguggguccugcuccgcuccaucgaccuggugagcuccguggacgggacccccagccugccggucucccucagcugggugcgggacggcauccugguggucgggauggacugcgagaugcacguguacgcccaguggaagcacgccgugaaguucggcgacaccgaggcggacuccagcaacgccgaggaggccgccaugcaggaccacuccacguucaagagcaacaugcuggcgcgcaagagcgucguggagggcaccgccaucuccgacgacguguucugcagccccaccgucauccaggacgggggccucuucgaggccgcccacgugcugucccccacccugccccaguaccacccgacgcagcuccuggagcugauggaccucgggaaggugcggcgcgccaaggcgauccugagccaccuggucaagugcaucgccggcgagguggccaucgugcgggaccccgacgccggcgaggggaccaagcgccaccucucccggaccaucagcgucuccggcagcaccgccaaggagacggugaccguggggaaggacggcacccgcgacuacaccgagaucgacuccaucccgccccugccgcuguacgcgcuccuggccgccgaccaggacacgagcuaccggaucuccgaggagagcaccaagaucccccaguccuacgaggaccagaccgucagccagcccgaggaccaguacuccgagcuguuccagauccaggacauccccaccgacgacaucgaccucgagccggagaagcgcgagaacaagagcaaggugaucaaccugucccaguacgggcccgccuacuucggccaggagcacgcccgggugcugagcucccaccucaugcacagcagccugcccggccugacccgccucgagcagauguuccuggucgcgcuggccgacacgguggccaccaccuccaccgagcucgacgagagccgggacaaguccugcagcgggcgcgacacgcuggacgagugcggccugcgguaccugcucgccaugcgccugcacacgugccugcucaccucccugcccccgcuguaccgggugcagcuccugcaccagggggucuccacgugccacuucgccugggcguuccacuccgaggccgaggaggagcugaucaacaugauccccgccauccagcgcggcgacccccaguggagcgagcuccgcgccauggggaucggcuggugggugcggaacaucaacacccugcgccggugcaucgagaagguggcgaaggccuccuuccagcgcaacaacgacgcccuggacgccgcccucuucuaccugagcaugaagaagaaggcggucguguggggccuguuccggucccagcacgacgagaagaugaccaccuucuucagccacaacuucaacgaggaccgcuggcggaaggccgcccucaagaacgccuucucccugcuggggaagcagcgcuucgagcagagcgccgcguucuuccuccuggccggcucccugaaggacgccaucgaggugugccucgagaagauggaggacauccagcuggccauggucaucgcccggcuguacgagagcgaguucgagaccuccagcacguacaucagcauccucaaccagaagauccuggggugccagaaggacggcuccggguucagcugcaagcgccugcaccccgacccguuccuccggucccuggcguacugggugaugaaggacuacacccgcgcccuggacacccuccuggagcagacccccaaggaggacgacgagcaccaggugaucaucaagagcugcaaccccgucgccuucuccuucuacaacuaccugcggacgcacccccuccugauccgccggaaccuggccagcccggagggcacccucgcgacccugggccugaagaccgagaagaacuucguggacaagaucaaccucaucgagcgcaagcuguucuucacgaccgccaacgcccacuucaagguggggugccccguccuggcccucgaggugcuguccaagauccccaaggucaccaagaccagcgcccuguccgcgaagaaggaccagccggacuucaucagccaccggauggacgacgugcccucccacagcaaggcccucuccgacggcaacgggagcuccggcaucgaguggagcaacgugacguccagccaguacgacuggucccagcccaucgucaagguggacgaggagccccugaaccuggacuggggcgaggaccacgacagcgcccucgacgaggaggaggacgacgccguggggcuggucaugaaguccaccgacgcccgcgagaaggacaagcaguccgaccagaaggcgagcgacccgaacaugcugcucacgccccaggaggaggacgaccccgagggcgacaccgagguggacgugaucgccgagcagcugaaguuccgggccugccugaagauccucaugacggagcugcgcacccuggccaccggguacgaggucgacggcgggaagcuccgcuuccagcuguacaacuggcuggagaaggagaucgccgcgcuccacgagaucugcaaccacgaguccgugaucaaggaguacagcuccaagaccuacagcaagguggaguccgaccugcuggaccaggaggagauggucgacaagcccgacaucggcagcuacgagcggcaccagaucgagcgccggcgccuccaggccaagcgggagcacgccgagcgccggaaguccuggcugcagaagaaccaggaccugcuccgcguguuccugagcuacugcucccugcacggcgcccagggcggcgggcucgcgagcgugcggauggagcugaaguuccugcuccaggagucccagcaggagacgaccgucaagcagcugcagagcccgcugccccuccccaccacccugccccugcucuccgccagcaucgccuccacgaagaccgugaucgccaacccggugcuguaccugaacaaccacauccacgacauccucuacaccaucguccagaugaagacgccgccccaccccagcaucgaggacgugaaggugcacacccugcacucccuggccgcgagccucagcgccuccaucuaccaggcccugugcgacagccacuccuacagcucccagacggagggcaaccaguucaccgggauggccuaccagggccugcuccugagcgaccgccggcgccugcggaccgaguccaucgaggagcacgccaccccgaacagcucccccgcgcaguggcccggcgucagcucccucaucaaccugcugagcuccgcccaggacgaggaccagcccaagcucaacauccugcugugcgaggccgugguggccgucuaccucagccugcugauccacgcccucgcgacgaacuccagcuccgagcuguuccgccuggccgcccacccgcugaacaaccggaugugggccgccguguucgggggcggggugaagcucgucgugaagccccgccggcagagcgagaacaucuccgcgccgcccgugcugagcgaggacaucgacaagcaccgccggcgcuucaacaugcggaugcuggucccgggccgccccgugaaggacgccacgccgccgcccgugcccgccgagcgccccagcuacaaggagaaguucaucccgcccgagcucuccaugugggacuacuucgucgccaagcccuuccugccccugagcgacuccggggugaucuacgacagcgacgaguccauccacagcgacgaggaggacgacgcguucuucuccgacacccagauccaggagcaccaggaccccaacagcuacuccugggcccuccugcaccugaccauggugaagcucgcccugcacaacgucaagaacuucuuccccaucgccggccuggaguucagcgagcuccccgugacgagcccccugggcaucgccgugaucaagaaccuggagaacugggagcagauccuccaggagaagauggaccaguucgaggggccgccgcccaacuacaucaacaccuaccccaccgaccugagcgucggcgcggggccggccauccugcggaacaaggccaugcucgagcccgagaacacccccuucaagucccgcgacagcuccgccuuccccgugaagcggcuguggcacuuccuggugaagcaggagguccuccaggagacguucauccgcuacaucuucaccaagaagcggaagcagagcgagguggaggccgaccugggcuaccccgggggcaaggcgaaggugauccacaaggaguccgacaugaucauggccuucagcgucaacaaggccaacugcaacgagaucgugcuggccuccacccacgacgugcaggagcucgacgucaccagccugcuggccugccagagcuacaucuggaucggcgaggaguacgaccgcgaguccaagagcuccgacgacguggacuaccgggggagcacgaccacccucuaccagcccuccgcgaccagcuacuccgccagccaggugcacccgcccuccagccugccguggcugggcacggggcagaccuccaccggcgccagcguccucaugaagcgcaaccugcacaacgugaagcggaugaccucccaccccguccaccaguacuaccugacgggcgcccaggacgggagcgugcgcauguucgaguggacccggccccagcagcucgugugcuuccgccaggcgggcaacgcccgggucacccgccuguacuucaacucccaggggaacaagugcggcguggccgacggggagggcuuccugagcaucuggcaggucaaccagaccgccuccaaccccaagccguacaugagcuggcagugccacuccaaggccacgagcgacuucgcguucaucaccagcuccagccucgucgccaccuccggccacagcaacgacaaccggaacgugugccugugggacacccugaucucccccgggaacagccucauccacggcuucacgugccacgaccacggggccaccgugcugcaguacgcccccaagcagcagcugcucaucuccggcgggcgcaagggccacgucugcaucuucgacauccggcagcgccagcugauccacaccuuccaggcccacgacagcgcgaucaaggcccuggcccucgacccguacgaggaguacuucaccacgggcuccgccgaggggaacaucaagguguggcggcugaccggccacgggcugauccacagcuucaaguccgagcacgccaagcagagcaucuuccgcaacaucggcgcgggggugaugcagaucgacaucauccagggcaaccgccucuucuccugcggcgccgacgggacccugaagacccggguccugcccaacgccuucaacauccccaaccgcauccucgacauccuguga

SEQ ID NO: 29247 - RNA, 3183 nt, Artificial Sequence
  derived and/or modified sequence opt1 from DNA2__Homo_sapiens__NP_001073918
auggagcagcugaacgagcucgagcugcugauggagaaguccuucugggaggaggccgagcuccccgccgagcuguuccagaagaagguggucgcgagcuucccccgcaccgugcugagcaccggcauggacaaccgguaccucgugcuggccgucaacacggugcagaacaaggaggggaacugcgagaagcgccuggugaucaccgccucccagagccucgagaacaaggagcugugcauccugcggaacgacuggugcuccguccccguggagcccggcgacaucauccaccucgagggggacugcaccagcgacaccuggaucaucgacaaggacuucggcuaccugauccuguaccccgacaugcucaucuccgggacgagcaucgccuccagcauccgcugcaugcggcgcgccgugcuguccgagaccuuccggagcuccgacccggcgacccgccagaugcugaucggcaccguccuccacgagguguuccagaaggccaucaacaacagcuucgcccccgagaagcugcaggagcuggccuuccagacgauccaggagauccggcaccucaaggagauguaccgccugaaccugucccaggacgagaucaagcaggagguggaggacuaccuccccagcuucugcaagugggcgggcgacuucaugcacaagaacaccuccaccgacuucccccagaugcagcugagccugccguccgacaacagcaaggacaacagcacgugcaacaucgaggucgugaagcccauggacaucgaggaguccaucuggagcccccgguucgggcucaagggcaagaucgacgugaccgucggggugaagauccaccgcggcuacaagaccaaguacaagaucaugccccuggagcugaagaccgggaaggaguccaacagcaucgagcaccggucccaggugguccucuacacccugcugagccaggagcgccgggccgacccggaggccggccuccugcuguaccucaagacgggccagauguaccccgugcccgccaaccaccuggacaagcgcgagcugcucaagcugcggaaccagauggccuucucccuguuccaccgcaucagcaaguccgcgacccggcagaagacccagcucgccagccugccccagaucaucgaggaggagaagaccugcaaguacugcucccagaucgggaacugcgcccuguacagccgcgccguggagcagcagauggacugcuccagcgucccgaucgugaugcuccccaagaucgaggaggagacgcagcaccugaagcagacccaccuggaguacuucucccucuggugccugaugcugacccuggagagccaguccaaggacaacaagaagaaccaccagaacaucuggcucaugcccgccagcgagauggagaaguccggcagcugcaucgggaaccugauccggauggagcacgugaagaucgucugcgacggccaguaccugcacaacuuccagugcaagcacggcgcgauccccgugaccaaccucauggccggggaccgcgucaucgugagcggcgaggagcgcucccuguucgcccugagccggggguacgugaaggagaucaacaugacgaccgugaccugccuccuggaccgcaaccuguccgugcucccggagagcacccuguuccggcuggaccaggaggagaagaacugcgacaucgacacgccccucggcaaccuguccaagcugauggagaacaccuucgugagcaagaagcuccgcgaccugaucaucgacuuccgggagccccaguucaucuccuaccugagcuccguccucccccacgacgccaaggacaccguggccugcauccugaaggggcugaacaagccgcagcgccaggcgaugaagaaggugcuccugagcaaggacuacacccugaucgucggcaugcccggcacggggaagaccaccaccaucugcacgcucgugcggauccuguacgccugcggcuucuccgugcugcucaccagcuacacccacuccgccgucgacaacauccugcugaagcucgccaaguucaagaucggguuccugcgccugggccagauccagaaggugcaccccgccauccagcaguucaccgagcaggagaucugccggagcaaguccaucaagagccucgcgcugcuggaggagcucuacaacucccagcugaucguggccaccacgugcauggggaucaaccaccccaucuucagccgcaagaucuucgacuucugcaucgucgacgaggccagccagaucucccagccgaucugccugggcccccucuucuucagccggcgcuucgugcuggugggcgaccaccagcagcugcccccgcucguccugaaccgggaggcccgcgcgcuggggauguccgagagccucuucaagcggcuggagcagaacaaguccgccguggugcagcugaccguccaguaccgcaugaacagcaagaucaugucccucagcaacaagcugaccuacgagggcaagcuggagugcggguccgacaagguggccaacgccgugaucaaccuccggcacuucaaggacgucaagcuggagcuggaguucuacgccgacuacagcgacaaccccuggcucaugggcguguucgagcccaacaaccccgugugcuuccugaacaccgacaaggucccggcgcccgagcaggucgagaagggcgggguguccaacgucacggaggccaagcugaucguguuccucaccagcaucuucgugaaggccggcugcucccccagcgacaucgggaucaucgcccccuaccgccagcagcugaagaucaucaacgaccugcucgcccgguccaucggcauggucgaggugaacaccguggacaaguaccaggggcgcgacaagagcaucguccugguguccuucgugcgcagcaacaaggacggcaccgucggcgagcugcucaaggacuggcggcgccugaacguggcgaucacgcgggccaagcacaagcugauccuccuggggugcgugccgucccugaacugcuacccgccccucgagaagcugcugaaccaccucaacagcgagaagcugaucaucgaccugcccagccgcgagcacgagucccucugccacauccugggcgacuuccagcgggaguga

SEQ ID NO: 29248 - RNA, 2178 nt, Artificial Sequence
  derived and/or modified sequence opt1 from DNAAF1__Homo_sapiens__NP_848547
augcaccccgagccgagcgagcccgccaccggcggggccgcggagcuggacugcgcccaggagcccggcguggaggaguccgccggggaccacggcagcgccgggcgcggcggcugcaaggaggagaucaacgaccccaaggagaucugcgucggguccagcgacaccuccuaccacagccagcagaagcaguccggcgacaacgggagcggcgggcacuucgcccacccgcgggaggaccgcgaggaccggggcccccgcaugacgaaguccagccuccagaagcugugcaagcagcacaagcuguacaucacccccgcgcucaacgacacccuguaccugcacuucaagggcuucgaccggaucgagaaccucgaggaguacaccgggcugcgcugccuguggcuccaguccaacggcauccagaagaucgagaaccuggaggcccagacggagcugcggugccucuuccugcagaugaaccugcuccgcaagaucgagaaccuggagccccugcagaagcucgacgcccugaaccugagcaacaacuacaucaagaccaucgagaaccucuccugccugccggugcugaacacccuccagauggcccacaaccaccuggagaccguggaggacauccagcaccuccaggagugccuccggcugugcguccuggaccucagccacaacaagcuguccgaccccgagauccugagcauccucgaguccaugcccgaccugcgcgugcugaaccugauggggaaccccgugauccggcagaucccgaacuaccgccggacggucaccgugcgccugaagcaccugaccuaccucgacgaccggcccguguuccccaaggaccgcgcgugcgccgaggccugggcccggggcggcuacgccgcggagaaggaggagcgccagcagugggagagccgggagcgcaagaagaucaccgacuccaucgaggcccuggccaugaucaagcagcgggccgaggagcgcaagcgccagcgggagagccaggagcgcggggagaugacgagcuccgacgacggcgagaacguccccgccagcgcggaggggaaggaggagccgcccggcgaccgggagacccgccagaagauggagcuguucgugaaggaguccuucgaggccaaggacgagcucugccccgagaagcccagcggggaggagccgcccguggaggccaagcgggaggacggcggccccgagcccgaggggacccugccggccgagacccugcuccuguccagccccgucgaggugaagggcgaggacggggacggcgagcccgaggggacgcugcccgccgaggcgccgccgccgcccccgcccguggaggucaagggcgaggacggcgaccaggagcccgaggggacccuccccgccgagacccugcugcuguccccgcccgugaaggugaagggcgaggacggggaccgcgagcccgagggcacccuccccgccgaggccccgccgccgccgccccugggggccgcgcgggaggagcccacgccccaggccgucgccaccgagggcguguucgugaccgagcuggacggcacccgcacggaggaccucgagaccauccggcuggagaccaaggagaccuucugcaucgacgaccugcccgaccucgaggacgacgacgagacgggcaagagccuggaggaccagaacaugugcuuccccaagaucgaggucaucuccagccuguccgacgacagcgaccccgagcucgacuacaccucccugcccgugcuggagaaccuccccaccgacacccugagcaacaucuucgccguguccaaggacacgagcaaggcggcccgcguccccuucaccgacaucuucaagaaggaggccaagcgggaccuggagauccgcaagcaggacaccaagagcccccggccccucauccaggagcuguccgacgaggaccccuccgggcagcugcucaugcccccgaccugccagcgcgacgccgcgccccugacgagcagcggggaccgggacuccgacuuccuggccgccagcucccccgugcccaccgagagcgccgccacgccgcccgagaccugcgucggcguggcccagcccucccaggcgcuccccaccugggaccugaccgccuuccccgcccccaaggccagcuga

SEQ ID NO: 29249 - RNA, 2370 nt, Artificial Sequence
  derived and/or modified sequence opt1 from DNAAF2__Homo_sapiens__NP_001077377
auggccaaggccgcggccagcuccagccuggaggaccucgaccuguccggcgaggaggugcagcgccugaccagcgccuuccaggaccccgaguuccggcgcauguucucccaguacgccgaggagcucaccgacccggagaaccggcgccgguacgaggccgagaucacggcgcuggagcgcgagcgcggggucgaggugcgguucgugcaccccgagcccggccacguccugcggaccagccucgacggggcccgccggugcuucgugaacgugugcuccaacgcccuggucggcgcccccagcucccgcccggggagcggcggcgaccgcggggcggcccccggcucccacuggagccugcccuacucccucgcccccgggcgggaguacgccggccggagcuccagccgcuacaugguguacgacguggucuuccacccggacgcccuggcgcuggcccggcgccacgagggguuccggcagaugcucgacgccaccgcccuggaggccguggagaagcaguucggcgugaagcuggaccgccggaacgcgaagacccucaaggccaaguacaagggcacgcccgaggccgccguccugcgcacgccccugcccggggugaucccggcccgccccgacggcgagcccaaggggccccucccggacuuccccuaccccuaccaguaccccgcggccccgggcccccgggcccccuccccgcccgaggccgcccugcagcccgcgcccaccgagccccgcuacagcgugguccagcggcaccacguggaccugcaggacuaccgcugcucccgggacagcgccccgagccccgugccccacgagcucgucaucaccaucgagcugccgcugcuccgcuccgccgagcaggccgcgcuggaggugacccggaagcugcucugccuggacagccgcaagcccgacuaccggcugcgccucucccugcccuaccccguggacgacggccgggggaaggcccaguucaacaaggcccgccggcagcuggucgugacccucccggugguccugcccgccgcccgccgggagcccgcgguggccgucgccgccgccgcgcccgaggagagcgccgaccgcuccggcaccgacgggcaggccugcgccagcgcccgggagggcgaggcggggccggcccgcucccgggccgaggacggcggccacgacacgugcguggccggggcggccggcagcggggugacgacccugggcgaccccgaggucgccccgccgcccgccgccgcgggggaggagcgcgugcccaagcccggcgagcaggaccucucccgccacgccggcagcccgcccggguccguggaggagcccagccccggcggggagaacucccccggcgggggcggcagccccugccuguccagccggucccuggccugggggagcuccgccggccgcgagagcgcccgcggggacagcuccgucgagacccgggaggagagcgagggcaccggcgggcagcgguccgcgugcgccaugggcgggcccggcaccaagagcggggagccccucugcccgccccugcugugcaaccaggacaaggagacccucacccugcugauccaggugccccgcauccagccccagucccuccagggcgaccugaacccgcugugguacaagcuccgguucagcgcccaggaccugguguacuccuucuuccugcaguucgcccccgagaacaagcugagcaccacggagcccgucaucuccaucagcuccaacaacgccgugaucgagcucgccaagagccccgagucccacggccacuggcgcgagugguacuacggggugaacaacgacagccuggagcugcaggagugcuccaacagcgaccagcuccagggcaaggaggagcgggucaacgaggagucccaccugaccgagaaggaguacaucgagcacugcaacaccccgaccacggacagcgacagcuccaucgccgugaaggcccugcagaucgacagcuucgggcucgugaccugcuuccagcaggagucccuggacgucagccagaugauccugggcaagucccagcagcccgagagcaagaugcaguccgaguucaucaaggagaaguccgcgaccugcagcaacgaggagaaggacaaccucaacgagagcgugaucaccgaggagaaggagacggacggggaccaccuguccagccugcucaacaagaccaccgugcacaacauccccggcuucgacuccaucaaggagaccaacaugcaggacggcagcguccaggugaucaaggaccacgugacgaacugcgcguucuccuuccagaacagccugcuguacgaccucgacuga

SEQ ID NO: 29250 - RNA, 1827 nt, Artificial Sequence
  derived and/or modified sequence opt1 from DNAAF3__Homo_sapiens__NP_001243643
augcugccccuccuggacagcuccaagcgcgccggcacccuggggagcggcugcggggugccgcggguccacuccgccgcccucagccgcgaggagggcgccucccgggacaucuggcgcaucaaggugugggcccgggugaugaccacccccgccgggagcggcuccggcuucgggagcgucuccugguggggccugagccccgcccuggaccuccaggcggagcgcgacgccaccguggacgcccugcccaccaccauggugccgcagcccgccgucauccugcccgggcccccgguggaccccgacucccaggcggacacggugcacagcaaccccgagcucgacguccugcugcucggcuccguggacgggcggcaccuccugcgcacccugagccgggccaaguucuggccccgccggcgcuucaacuucuucgugcuggagaacaaccuggaggccgucgcccggcacaugcucaucuucucccuggcccuggaggagccggagaagaugggccuccaggagcgcagcgagaccuuccuggagguguggggcaacgcgcugcuccggccgcccguggccgccuucguccgcgcccaggccgaccugcuggcgcaccucgugcccgagccggaccggcuggaggagcagcugcccuggcucucccugcgcgcccugaaguuccgggagcgcgacgcccucgaggccguguuccgguucugggccgggggcgagaaggggccccaggcguuccccaugagccgccugugggacucccgccugcggcacuaccucggcagccgcuacgacgcccggcgcggcgucagcgacugggaccugcggaugaagcugcacgaccgcggggcccaggugauccacccgcaggaguuccggcgcuggcgggacaccggcguggccuucgagcuccgcgacuccagcgccuaccacguccccaaccggacgcuggcguccgggcgccugcucagcuaccggggcgagcgcguggccgcccggggguacuggggcgacaucgccaccggccccuucguggcguucgggaucgaggccgacgacgagucccugcugcgcaccagcaacggccagcccgucaagaccgccggggagaucacgcagcacaacgugaccgagcuccugcgggacgucgccgccuggggccgcgcgcgggccaccgggggcgaccuggaggagcagcagcacgccgagggcuccccggagcccgggacccccgcccccacgccggagagcuucaccgugcacuuccucccccugaacuccgcccagacccugcaccacaagagcugcuacaacggccgcuuccagcugcucuacguggcgugcgggaugguccaccuccugauccccgagcugggcgccugcguggcccccgggggcaaccugaucguggagcuggcccgcuaccucgucgacgugcggcaggagcagcugcagggcuucaacacccgcgugcgggagcuggcccaggcggccggguucgcgccccagacgggcgcccgccccuccgagaccuucgcccgguucugcaagagccaggaguccgcccucgggaacaccguccccgccguggagccgggcaccccgccccuggacauccuggcccagccccucgaggccagcaaccccgcgcuggagggccugacgcagccccuccagggcgggacgccccacugcgagcccugccagcugccguccgagagccccgggucccugagcgaggugcucgcccagccccagggcgcccuggcgcccccgaacugcgaguccgacagcaagaccggggucuga

SEQ ID NO: 29251 - RNA, 2568 nt, Artificial Sequence
  derived and/or modified sequence opt1 from DNAAF5__Homo_sapiens__NP_060272
auggccgcccugggcguggcggaggccgucgccgcgccccacccggccgagggggccgagaccgccgaggccguggagcucagccgcgcccugucccggcugcuccccggccuggaggcggacagcaagcccgggcgccggcgcgcccuggaggcccuccggcgcgcccuggaggagcccggcccggccgcggaccccaccgccuuccaggggcccugggcccggcugcuccugccccgccugcuccggugccuguccgacccggccgagggcugccgcgcccuggcggugcaccuccuggaccugggccuccggcgcgccgcccggccccgcgacgcccugccccggcugcuccccgcccuggcggcccgccuggccgggccgguccccgcccggcgcccgcccgaggccugcgaggagcuccggcuggcgcuggugcagcuccugggccuggccguggaccucugcggggccgcccuggcgccgcaccuggacgacgcccuccgcgcccugcggugcagccugcucgaccccuucgccgccguccgccgcgaguccugcagcugcgcggccgcccuggcccaggccacgcccgaccacuuccacaugcaguccgagagccugaucggcccccucaugcagaccaucucccaccagcacuggaaggugcggguggcggccaucgaggccaccggggccgucauccacuucggcaacggcaagagcguggacgacgugcugucccacuucgcccagcgccuguucgacgacgucccccaggugcggcgcgcgguggccagcgucgucgggggcuggcuccugugccugcgggaccgcuacuccuucuuccacaagcucaucccccugcugcucagcucccugaacgacgaggugcccgaggugcggcagcuggccgccagccugugggaggacguggggcuccaguggcagaaggagaacgaggaggaccugaaggacaagcuggacuucgcgcccccgaccccgccccacuacccgccccacgagcgccggcccgugcucggcugccgcgagcuggucuuccggaaccuguccaagauccuccccgcccugugccacgacaucacggacuggguggugggcacccgcgucaagagcgcccagcugcuccccgugcugcugcuccacgccgaggaccacgccacccagcaccuggaggucgugcugcggacccucuuccaggcgugcacggacgaggaggccgccgugguccaguccugcacccgcagcgccgagcugguggggaccuucgugagccccgaggucuuccugaagcucauccuguccacccugaagaagacgcccagcgccuccggccuccuggugcuggcgagcgccaugcgggggugcccccgcgaggcccuccagccgcaccuggccgccaucgcgaccgagcuggcccaggcccacaucugccaggccuccgagaacgaccucuaccuggagcggcugcuccugugcgugcaggcgcuggucagcgugugccacgaggacugcggcguggccucccuccagcugcuggacguccuccugaccaucguggcccuggccggggccaccggccuccgcgacaaggcgcaggagacgauggacagccuggccaugguggagggcgucuccagcugccaggaccuguaccggaagcacaucgggccccuccuggagcgcgugaccgccucccaccuggacuggaccgcccacagccccgagcuccugcaguucuccgugaucgucgcccagagcggccccgcgcugggggaggcccucccgcacguggugcccacccugcgcgccugccugcagcccucccaggacccccagaugcggcucaagcuguucagcauccuguccacgguccuccugcgcgccaccgacaccaucaacagccagggccaguucccguccuaccuggagaccgugacgaaggacauccucgcccccaaccugcaguggcacgcggggcggaccgccgccgccauccgcaccgccgcggugagcugccugugggcccucaccagcuccgagguccugagcgccgagcagauccgggacgugcaggagacgcugaugccccaggugcucaccacccuggaggaggacuccaagaugacccgccugaucagcugccggaucaucaacacguuccucaagaccuccggcggcaugaccgaccccgagaagcugauccgcaucuacccggagcugcucaagcggcuggacgacgucagcaacgacgugcgcauggccgcggccuccacccuggugacguggcuccagugcgucaagggggccaacgccaagagcuacuaccaguccagcgugcaguaccuguaccgggagcugcucgugcaccuggacgaccccgagcgcgccauccaggacgcgauccuggagguccucaaggagggcuccgggcuguuccccgaccugcucgugcgggagaccgaggccgugauccacaagcaccgcagcgccaccuacugcgagcagcugcugcagcacguccaggccgugcccgccacccaguga

SEQ ID NO: 29252 - RNA, 13551 nt, Artificial Sequence
  derived and/or modified sequence opt1 from DNAH11__Homo_sapiens__NP_001264044
auggccgcccagguggccgcccgcgaggcccgggacuuccgcgaggcccccacccugcggcucaccuccggcgccgggcuggaggccgugggcgccguggagcuggaggaggaggaggagaacgaggaggaggccgccgcgcgccgggcccgcuccuucgcccaggacgcccgggugcgcuuccucgggggccggcuggccaugaugcugggguucaccgaggagaaguggagccaguaccucgaguccgaggacaaccgccaggugcugggcgaguuccuggagagcaccucccccgcgugccucguguucagcuucgccgccuccggccggcuggccgccagccaggagaucccccgcgacgcgaaccacaagcugguguucaucuccaagaagaucaccgagagcaucggggugaacgacuucucccaggugguccuguucggcgagcugcccgcccugagccucgggcacguguccgccuuccuggacgagauccuggugcccgugcucagcaacaagaacaaccacaaguccuggagcugcuucaccucccaggacauggaguaccacaucgaggucaugaagaagaagauguacaucuuccggggcaagaugagccgccggacgcugcugcccauccccaccguggccgggaagauggaccucgaccagaacugcuccgagaacaagccgcccagcaacgagcgcaucauccugcacgccaucgagagcguggucaucgaguggucccaccagauccaggagaucaucgagcgggacagcgugcagcgccugcucaacggccugcaccugagcccccaggcggagcucgacuucuggaugaugcggcgcgagaaccugagcugcaucuacgaccagcugcaggcccccgugguccucaagauggugaagauccugaccaccaagcaguccagcuacuuccccacgcugaaggacaucuuccucgccguggagaacgcccugcuggaggcccaggacgucgagcucuaccugcggccccugcgccgccacauccagugccuccaggagaccgaguucccccagacccggauccugaucgcgccccuguuccacaccaucugccucaucuggucccacagcaaguucuacaacacgcccgcccgcgugaucgugcugcugcaggaguucugcaaccucuucaucaaccaggccaccgccuaccugucccccgaggaccugcuccggggcgagaucgaggagagccuggagaagguccagguggcggucaacauccugaagaccuucaagaacuccuucuucaacuaccgcaagaagcuggccagcuacuucauggggcggaagcuccgcccgugggacuuccagucccaccugguguucugccgguucgacaaguuccuggaccgccucaucaagaucgaggacaucuucgccaccacgcuggaguucgagaagcuggagcggcucgaguucggcgggaccaagggcgccauccugaacggccaggugcacgagaugagcgaggagcugauggagcucugcaagcuguucaagcaguccaccuacgaccccagcgacugcaccaacauggaguucgaguccgacuacgucgccuucaagagcaagacgcuggaguucgaccgccggcucgggaccaucaucugcgaggcguucuucaacugcaacggccuggaggccgccuucaagcugcucaccaucuucgggaacuuccuggagaagcccguggugauggagaucuucucccugcacuacagcacccucguccacauguucaacacggagcuggacgugugcaagcagcuguacaacgagcacaugaagcagaucgagugcggccacgugguccucaacaagaacaugcccuucaccagcgggaacaugaagugggcccagcagguccugcagcgccugcagauguucugguccaacuucgccagccuccgguaccuguuccugggcaacccggaccacgcgcucguguaccagaaguacgucgagaugaccacccugcuggaccaguucgagucccgcaucuacaacgaguggaaguccaacguggacgagaucugcgaguucaaccucaaccagccccuggugaaguucuccgccaucaacggccugcucugcgucaacuucgaccccaagcugguggccgugcugcgggaggucaaguaccuccugaugcugaagaagcaggacauccccgacagcgcccucgccaucuucaagaagcgcaacacgauccugaaguacaucgggaaccuggaccuccuggugcagggcuacaacaagcugaagcagacccuccuggagguggaguacccgcugaucgaggacgagcuccgggcgaucgacgagcagcugaccgccgccaccacguggcugaccuggcaggacgacugcuggggguacaucgagcgcguccgggccgcgaccuccgagcucgagcaccgcguggagcgcacccagaagaacgugaaggucauccagcagacgaugcggggcugggcccgcugcgugcugccgccccggcgcgagcaccggcgcgaggccgccuucacccuggaggacaagggggaccucuucaccaagaaguacaagcugauccagggcgacggcugcaagauccacaaccugguggaggagaaccggaagcuguucaaggccaaccccagccuggacaccuggaagaucuacgucgaguucaucgacgacaucgugguggagggguucuuccaggcgaucaugcacgaccuggacuucuuccucaagaacaccgagaagcagcugaagccggcccccuucuuccaggcccagaugauccugcucccgcccgagaucgucuucaagcccucccuggaccgcgaggccggcgacggguucuacgaccugguggaggagaugcucugcaacagcuuccggauguccgcccagaugaaccgcaucgcgacgcaccuggagaucaagaacuaccagaacgacauggacaacaugcugggccucgccgaggugcggcaggagaucaugaaccgcgucgugaacgugaucaacaagguccuggacuuccggaacacccuggagacccacaccuaccucuggguggacgaccgcgccgaguucaugaagcacuuccugcuguacgggcacgccgugagcuccgacgagauggacgcccacgcgaacgaggagauccccgagcagccgcccacgcucgagcaguucaaggagcagaucgacaucuacgaggcccuguacguccagaugagcaaguucgaggacuuccggguguucgacuccugguucaagguggacaugaagcccuucaaggucagccugcucaccaucaucaagaagugguccuggauguuccaggagcaccuccuccgcuucgugaucgacagccucaacgagcugcaggaguucaucaaggagaccgacagcggccugcagcgggagcucaacgagggcgaccacgacgggcugguggacaucaugguccaccuccucgccgugcgcucccggcagcgcgccaccgacgagcuguucgagccccugaaggagacgaucacccuccuggagagcuacggccagaagaugcccgagcaggucuacauccagcuggaggagcuccccgagcggugggagaccaccaagaagaucgcggccacgguccgccacgaggugagcccccugcacaacgccgaggugacccugauccgcaagaagugcauccuguucgacgccaagcaggccgaguuccgggagcgcuuccggcacuacgcgccccucggguucaacgccgagaaccccuacaccgcccuggacaaggccaacgaggagcuggaggcccucgaggaggagaugcugcagaugcaggagagcacccgccuguucgaggucgcgcucccggaguacaagcagaugaagcagugccggaaggagaucaagcugcugaagggccucugggacgugaucaucuacguccgccgguccaucgacaacuggacgaagacccaguggcgccagauccacguggagcagauggacguggagcugcggcgcuucgccaaggagaucuggagccugaacaaggagguccgggugugggacgccuacaccggccucgaggggaccgugaaggacaugacggccucccugcgcgccaucaccgagcugcagagccccgcgcuccgggaccgccacuggcaccagcugaugaaggccaucggcgucaaguuccugaucaacgaggccaccacccucgccgaccugcuggcccuccggcugcaccgcguggaggacgacgugcggcgcaucgucgacaaggcggugaaggagcuggggacggagaaggugaucaccgagaucucccagaccugggccaccaugaaguucagcuacgagguccacuaccggacgggcaucccccuccugaaguccgacgagcagcuguucgagacccucgagcacaaccaggugcagcugcagacccugcuccagagcaaguacguggaguacuucaucgagcagguccuguccuggcagaacaagcugaacaucgccgaccucgugaucuucaccuggauggaggugcagcgcacguggagccaccuggaguccaucuucgucugcagcgaggacauccgcauccagcuggugaaggacgcccggcgcuucgacgggguggacgcggaguucaaggagcucauguucaagaccgccaaggucgagaacgugcuggaggcgaccugccggcccaaccuguacgagaagcucaaggaccugcagucccgccugagccucugcgagaaggcccuggccgaguaccuggagaccaagcggaucgcguucccgcgcuucuacuucguguccagcgccgaccuccuggacauccugagcaagggcgcccagcccaagcaggucacgugccaccucgccaagcuguucgacuccaucgccgaccugcaguucgaggacaaccaggacgugagcgcgcaccgggccgugggcauguacuccaaggagaaggaguacguccccuuccaggccgagugcgagugcguggggcacguggagaccuggcuccugcagcuggagcagaccaugcaggagaccguccgccacagcaucaccgaggccaucguggccuacgaggagaagccccgggagcucuggaucuucgacuucccggcccagguggcccugacguccagccagaucugguggaccaccgacgucggcaucgccuucucccgccuggaggagggguacgagaccgcccucaaggacuuccacaagaagcagaucagccagcugaacacgcugaucacccuccugcugggcgagcugccgcccggggaccggcagaagaucaugaccaucugcaccaucgacgugcacgcgcgcgacguggucgccaagcugaucucccagaagguggugagcccccaggccuucacguggcugucccagcuccggcaccgcugggaggacacccagaagcacugcuucgucaacaucugcgacgcccaguuccaguacuucuacgaguaccugggcaacagcccgcggcuggugaucacgccccucaccgaccgcugcuacaucacgcugacccagucccugcaccucaccaugagcggcgcccccgcggggccggccggcaccgggaagacggagaccaccaaggaccugggccgggcccuggggaugaugguguacgucuucaacugcuccgagcagauggacuacaagagcaucggcaacaucuacaagggccucgugcagaccggggccuggggcugcuucgacgaguucaaccgcaucuccguggagguccugagcgugguggccguccaggugaagaugauccacgacgcgauccggaaccgcaagaagcgguucguguuccugggggaggccaucacgcucaagcccuccgucggcaucuucaucaccaugaaccccggguacgccggccgcaccgagcugcccgagaaccugaaggcccucuuccgcccgugcgccaugguggcgcccgacaucgagcugaucugcgagauccugcucgucgccgagggcuucguggacgcccgggcccuggcgcgcaaguucaucacccuguacacgcucugcaaggagcugcugagcaagcaggaccacuacgacugggggcuccgggccaucaagagcgugcuggucguggccggcucccugaagcgcggggacaagaaccggcccgaggaccaggugcucaugcgcgcccugcgggacuucaacaugcccaagaucgucaccgacgacaucccgguguuccugggccucgugggcgaccuguuccccgcccuggacgucccccgccggcgcaagcuccacuucgagcagauggugcggcagagcacccuggagcugcgccugcagcccgaggaguccuucauccucaaggugguccagcuggaggagcugcucgcggugcggcacagcguguucgucguggggaacgccggcaccgggaaguccaagauccugcgcacgcugaaccggaccuacgugaacaugaagcagaagccggucuggaacgaccucaaccccaaggccgugaccaccgacgagcuguucggcuucauccaccacgccacgcgcgaguggaaggacgggaagaucguguacagcuacuucaucggccuguucuccagcauccuccgggagcaggccaaccugaagcacgacggccccaaguggaucguccuggacggggacaucgaccccauguggaucgagucccucaacaccgugauggacgacaacaaggugcugacccuggcgagcaacgagcgcaucgcccucaccccguucaugcggcugcuguucgagauccaccaccuccgcuccgccacgcccgccaccgucagccgcgccggcauccuguacgugaacccccaggaccugggguggaaccccuacguggcguccuggaucgaccggcgccggcaccagagcgagaaggccaaccucaccauccuguucgacaaguacgucccggccugccuggacaagcuccgcaccuccuucaagaccaucacgagcauccccgaguccagccuggugcagacccugugcgugcuccuggagugccugcucacccccgagaacguccccuccgacagcccgaaggagguguacgagguguacuucgucuucgccugcaucugggccuucggcgggacccugcugcaggaccagaucagcgacuaccaggcggacuucucccggugguggcagaaggagaugaaggccgugaaguuccccagccagggcacgaucuucgacuacuacguggaccacaagaccaagaagcuccugcccugggccgacaagaucgcccaguucaccauggaccccgacgucccgcugcagaccgugcucgugcacacgaccgagaccgcgcgccugcgguacuucauggagcugcuccuggagaagggcaagccccugaugcucgucgggaacgccggcguggggaagaccguguucgucggcgacacgcuggccucccugagcgaggacuacaucgugucccgcgugcccuucaacuacuacaccaccagcaccgcccuccagaagauccuggagaagccgcuggagaagaaggccgggcacaacuacggccccggcgggaacaagaagcucaucuacuucaucgacgacaugaacaugcccgaggucgaccuguacggcacggugcagccccacacccugauccggcagcacaucgacuacgggcacugguacgaccgccagaaggugaugcucaaggagauccacaacugccaguacgucgcgugcaugaacccgauggugggcuccuucaccaucaacccccggcugcagcgccacuucaccguguucgccuucaacuuccccagccuggacgcccucaacacgaucuacggccagaucuucuccuuccacuuccagcagcaggccuucgcccccagcauccugcgguccgggccgacccugauccaggcgaccaucgccuuccaccagaccaugaugugcaacuuccuccccacggccaucaaguuccacuacaucuucaaccugcgcgaccugagcaacgucuuccagggcauccucuucgccucccccgagugccugaaggggccccuggaccucauccaccuguggcugcacgagagcgcccggguguacggcgacaagcucaucgacaagaaggacugcgaccuguuccagcgccggaugcuggagaccgcguacaaguacuucgaggggaucgacucccacaugcuccugcagcagccgcugaucuacugccacuucgccgaccgcggcaaggacccccacuacaugcccgucaaggacugggaggugcucaagaccauccugaccgagacgcuggacaacuacaacgagcucaacgccgccaugcaccuggugcuguucgaggacgcgaugcagcacgucugccggaucagccgcauccuccggacgccccagggcugcgcccugcuggugggggugggcggguccggcaagcagagccucucccgccuggccgccuaccugcgcgggcucgaggucuuccagaucacccugaccgagggcuacggcauccaggagcugcggguggaccucgccaaccuguacauccgcaccggggcgaagaacaugccgaccguguuccugcucaccgacgcccagguccuggacgagagcuuccuggugcucaucaacgaccugcuggccagcggcgagauccccgaccucuucuccgacgaggacguggacaagaucaucagcgggauccacaacgagguccacgcccugggcaugguggacucccgggagaacugcuggaaguucuucauggcccgcgugcggcugcagcugaagaucauccucugcuucagccccgucgggcgcacccugcgggugcgcgcgcggaaguuccccgccaucgugaacugcacggccaucgacugguuccacgccuggccgcaggaggcccuggucuccgugagccgccgguucaucgaggagaccaagggcaucgagcccgugcacaaggacuccaucagccucuucauggcgcacguccacaccaccgugaacgagauguccacgcgcuacuaccagaacgagcggcgccacaacuacaccacccccaagagcuuccuggagcagaucucccuguucaagaaccuccugaagaagaagcagaacgaggugagcgagaagaaggagcggcuggucaacggcauccagaagcucaagaccaccgccucccaggugggggaccugaaggcccgccuggccagccaggaggcggagcuccagcugcggaaccacgacgccgaggcccugaucacgaagaucggccuccagaccgagaaggugucccgcgagaagaccaucgccgacgccgaggagcggaaggucaccgcgauccagacggagguguuccagaagcagcgcgagugcgaggccgaccugcugaaggccgagcccgcccucguggccgcgaccgccgcccugaacacccugaaccgcgucaaccucagcgagcugaaggccuucccgaacccgcccaucgccgugaccaacgugacggcggccgucauggugcugcucgcgccccgggggcgcgugccgaaggaccgguccuggaaggccgccaaggucuucaugggcaagguggacgacuuccugcaggcgcugaucaacuacgacaaggagcacauccccgagaacugccucaagguggucaacgagcacuaccugaaggaccccgaguucaacccgaaccugauccgcaccaagagcuucgccgccgccgggcucugcgcgugggugaucaacaucaucaaguucuacgagguguacugcgacgucgagcccaagcggcaggcccuggcccaggccaaccuggagcucgccgcggccaccgagaagcuggaggccauccgcaagaagcugguggaccucgaccggaaccugucccgccugaccgccagcuucgagaaggccacggcggagaaggugcggugccaggaggaggucaaccagaccaacaagaccaucaagcucgccaaccgccuggugaaggagcuggaggccaagaagauccgguggggccagagcaucaaguccuucgaggcccaggagaagacccucugcggcgacgugcugcugacggccgcguucgucagcuacguggggcccuucacccgccaguaccggcaggagcucgugcacugcaaguggguccccuuccugcagcagaagguguccaucccgcugaccgagggccucgaccugaucagcaugcugaccgacgacgccacgaucgccgccuggaacaacgaggggcuccccuccgaccgcaugagcaccgagaacgcggccauccugacccacugcgagcgguggccccuggucaucgacccccagcagcagggcaucaaguggaucaagaacaaguacggcauggaccucaaggugacccaccuggggcagaagggcuuccugaacgccaucgagacggcccucgccuucggggacgugauccugaucgagaaccuggaggagaccaucgacccgguccucgacccccugcugggccgcaacaccaucaagaaggggaaguacauccggaucggcgacaaggagugcgaguucaacaagaacuuccgccucauccugcacaccaagcuggcgaacccccacuacaagcccgagcuccaggcccagacgacccugcugaacuucaccgugaccgaggacggccucgaggcccagcugcuggccgagguggucuccaucgagcggccggaccucgagaagcugaagcuggugcucacgaagcaccagaacgacuucaagaucgagcugaaguaccuggaggacgaccuccugcugcgccucagcgccgcggagggguccuuccuggacgacaccaagcugguggagcggcucgaggccaccaagaccacggucgccgagaucgagcacaaggugaucgaggccaaggagaacgagcgcaagaucaacgaggcccgcgagugcuaccggcccguggcggcccgcgccagccugcuguacuucgucaucaacgaccuccagaagaucaacccccuguaccaguucucccugaaggccuucaacguccucuuccaccgggccaucgagcaggcggacaagguggaggacaugcagggccgcaucagcauccugauggaguccaucacccacgccgucuuccuguacaccagccaggcccucuucgagaaggacaagcugaccuuccugucccagauggccuuccagauccugcuccggaagaaggagaucgacccccuggagcuggacuuccuccugcgcuucaccguggagcacacgcaccugagcccgguggacuuccucaccucccagagcuggagcgcgaucaaggccaucgccgucauggaggaguuccgggggaucgaccgcgacguggagggcuccgccaagcaguggcggaaguggguggagagcgagugccccgagaaggagaagcugccccaggaguggaagaagaagucccugauccagaagcucauccugcugcgcgccaugcggcccgaccgcaugaccuacgcgcuccggaacuucgucgaggagaagcugggggccaaguacguggagcgcacccggcuggaccucgugaaggccuucgaggagagcuccccggccacgcccaucuucuucauccugagccccggcgucgacgcccugaaggaccucgagauccugggcaagcgccugggguucaccaucgacuccggcaaguuccacaacgugagccucgggcagggccaggagaccguggcggaggucgcccuggagaaggccuccaagggcgggcacugggugauccugcagaacgugcaccucgucgccaaguggcugggcacccuggagaagcuccuggagcgguucagccaggggucccaccgcgacuaccggguguucaugagcgccgaguccgcgcccacgccggacgagcacaucaucccccagggccugcucgagaacagcaucaagaucaccaacgagcccccgaccgggaugcuggccaaccugcacgccgcccucuacaacuucgaccaggacacccuggagaucugcuccaaggagcaggaguucaagagcauccuguucucccucugcuacuuccacgcgugcguggccggccgccugcgcuucgggccccagggcuggagccgguccuaccccuucaaccccggcgaccugacgaucugcgccagcguccucuacaacuaccuggaggccaacagcaaggugccgugggaggaccugcgcuaccucuucggggagaucauguacggcgggcacaucaccgacgacugggaccggaagcugugccgcguguaccuggaggaguucaugaaccccucccucaccgaggacgagcugaugcuggcccccggcuucgcggcgccgcccuaccucgacuacgccggcuaccaccaguacaucgaggagaugcugccgcccgagagccccgcccuguacgggcuccaccccaacgccgagaucgaguuccugaccgucacguccaacacccuguuccggacccuccuggagaugcagccccgcaacgcgcugagcggcgacgagcucgggcaguccaccgaggagaaggugaagaacgugcuggacgacauccuggagaagcuccccgaggaguucaacauggccgagaucaugcagaagaacagcaaccggucccccuacguccuggugugcuuccaggagugcgagcgcaugaacauccugauccgggagauccgcaucagccucgagcagcuggaccugucccucaagggcgagcuggcccugagcccggccguggaggcccagcaguucgcgcucuccuacgacacgguccccgacaccuggagcaagcuggccuaccccuccaccuacgggcuggcccagugguucaacgaccuccugcugcggugccgcgagcucgacaccuggacgcaggaccugacccugcccgccgugguguggcucagcggcuucuucaacccgcaguccuuccugaccgcgaucaugcagaccauggcccggaagaacgaguggccccuggacaagacgcgccucaccgccgacgucaccaagaagaccaaggaggacuacggccacccgccccgggagggggccuaccugcacggccuguucauggagggggcccgcugggacacgcaggcgggcaccaucguggaggcccggcucaaggagcuggccugcccgaugcccgugaucuucgccaaggccacccccgucgaccgccaggagaccaagcagacguacgagugccccguguaccggaccaagcugcgcgggccgagcuacaucuggaccuuccggcucaaguccgaggagaagaccgcgaagugggugcuggccggcgucgcccugcuccuggaggccuga

SEQ ID NO: 29253 - RNA, 11895 nt, Artificial Sequence
  derived and/or modified sequence opt1 from DNAH12__Homo_sapiens__NP_001278590
augagcgacgccaacaaggccgcgaucgccgccgagaaggaggcccugaaccugaagcugccgcccaucgugcaccuccccgagaacaucggcguggacacgcccacccagagcaagcuccugaaguaccgccggagcaaggagcagcagcagaagaucaaccagcuggugaucgacggggccaagcgcaaccucgaccggacgcugggcaagcgcacgccccugcugcccccgcccgacuacccccagaccaugaccagcgagaugaagaagaagggguucaacuacaucuacaugaagcagugcguggagagcagcccccucgugcccauccagcaggaguggcuggaccacaugcuccggcugauccccgagagccugaaggagggcaaggagcgcgaggagcuccuggagucccugaucaacgaggugagcuccgacuucgagaacagcaugaagcgguaccucgugcaguccguccuggugaagccgcccgugaagucccuggaggacgagggcgggccccuccccgagucccccgucggccuggacuacagcaaccccuggcacuccagcuacgugcaggcgcgcaaccagaucuucuccaaccugcacaucauccaccccaccaugaagaugcuccuggaccugggguacaccaccuucgccgacaccgugcuccuggacuucacgggcauccgggccaaggggcccaucgacugcgagagccugaagaccgaccucuccauccagacccgcaacgccgaggagaagaucaugaacaccugguaccccaaggucaucaaccuguucacgaagaaggaggcgcuggagggcgugaagcccgagaagcucgacgccuucuacagcugcgugagcacccugauguccaaccagcugaaggaccuccugcggcgcaccgucgagggguucgugaagcuguucgaccccaaggaccagcagcggcuccccaucuucaagaucgagcugaccuucgacgacgacaagauggaguucuaccccacguuccaggaccuggaggacaacgugcucagccuggucgagcgcaucgccgaggcccugcagaacgugcagaccaucccguccuggcucagcggcaccuccacccccgugaaccuggacacggagcugcccgagcacguccuccacugggccguggacacccugaaggcggccgugcaccggaaccuggagggcgcccgcaagcacuacgagaccuacgucgagaaguacaacuggcugcucgacgggaccgccguggagaacaucgagacguuccagaccgaggaccacaccuucgacgaguacaccgaguucaucgagaaguuccugagccuggccuccgagaucaugcuccugccccaguggauccacuacacgaugguccggcuggacugcgaggaccucaagaccggccugaccaacaaggcgaaggccuucgccaacauccugcucaacgacaucgccagcaaguaccgcaaggagaacgagugcaucugcuccgaguucgaggccaucaaggagcacgcgcugaaggugccggagaccacggaggagaugauggaccugaucagcuacguggagaaggcccggaccgucgggaucgaggagcucauccugcgcauccaggaguccaagcggcagaugagcuacuuccuggacguguuccucuucccccaggaggaccuggcccugaacgccaccgugcucauguggccccgcaagaucaacccgaucuucgacgagaacgacgagcugaucgagaacgccaagcacaagaaggagaacgagcugauggcgaagcgcgagaagcucauccuggagaucgagaaggagucccggcgcauggaggaguucaccgaguucgccgagcuggagcggaugcagcaguacgucacggacgugcgccagcuccagaagcggauccaggagagcgaggaggccgugcaguucaucaacaaggaggaggagcuguucaagugggagcugaccaaguaccccgagcucgacaagcugaaggucaacaucgagcccuaccagaaguucuucaacuucgugcugaaguggcagcgcuccgagaagcgguggauggacggcggcuuccucgaccugaacggggagagcauggaggccgacguggaggaguucucccgcgagaucuucaagacccugaaguucuuccagaccaagcucaagaaggagcugcaggagaagcggaaggcggcccgcaagcggagccuggaggaggagaagaucgaggaggagcccaaggacaacgccaccaucacgaugugcuccaccgucauggagcagaucaaggccuucaaggaguacaucccgaccgugagcauccucugcaaccccggcaugcgcgcccggcacuggaagcagaucagcgagaucgugggguacgaccugacccccgacuccggcacgacccugcgcaagguccucaagcugaaccugacccccuaccucgagcaguucgaggugaucagcgcgggggccuccaaggaguucagccuggagaaggccaugaacaccaugaucggcacgugggaggacaucgccuuccacaucucccuguaccgggacaccggcgugugcauccucagcuccgucgacgagauccaggccauccuggacgaccagaucaucaagacccagaccaugcgcgggagcccguucaucaagcccuucgagcacgagaucaaggcgugggaggaccggcugauccgcauccaggagacgaucgacgaguggcucaaggugcaggcccaguggcuguaccuggagcccaucuucugcuccgaggacaucaugcagcagaugcccgaggagggccggcaguuccagaccguggaccgccacuggcgcgacaucaugaaguucugcgccaaggacccgaagguccucgccgccaccagccugaccgggcugcucgagaagcugcagaacugcaacgagcugcucgagaagaucaugaagggccugaacgcguaccuggagaagaagcggcuguucuucccccgcuucuucuuccuguccaacgacgagaugcuggagauccucagcgagacgaaggacccccugcgggugcagccccaccugaagaagugcuucgaggggaucgccaagcucgaguuccugccgaaccuggacaucaaggccauguacuccagcgagggcgagcgcguggagcucaucgcccugaucuccaccagcgcggcccggggcgccgucgagaaguggcugauccagguggaggaccucaugcugcgcuccgugcacgacgucaucgccgccgcgcggcuggccuaccccgagagcgcccgccgggacugggugcgcgaguggcccggccaggugguccucugcaucagccagauguucuggaccuccgagacccaggaggugaucagcggcgggacggagggccugaagaaguacuacaaggagcugcagaaccagcucaacgagaucguggagcugguccgggggaagcuguccaagcagacccgcaccacccucggcgcccuggugacgaucgacgugcacgcccgggacgucgugauggacaugaucaagaugggcgugagccacgacaccgacuuccuguggcucgcgcagcugcgcuacuacugggagaacgagaacgcccggguccgcaucaucaacugcaacgugaaguacgccuacgaguaccuggggaacagcccccggcucgugaucaccccgcugaccgaccgcugcuaccggacgcugaucggcgccuucuaccucaaccucggcggggcccccgaggggcccgcggggaccggcaagaccgagaccacgaaggaccuggccaaggcccucgccguccagugcgugguguucaacugcagcgacgggcuggacuaccuggcgaugggcaaguucuucaaggggcuggccuccagcggcgccugggccugcuucgacgaguucaaccgcaucgagcucgagguccuguccgugguggcccagcagauccugugcauccagcgggcgauccagcagaagcucgucguguucguguucgagggcaccgagcugaagcugaaccccaacugcuucgucgccaucaccaugaacccgggguacgccggccgcagcgagcuccccgacaaccugaaggugcuguuccgcaccgucgccaugauggugcccaacuacgcccucaucgcggagaucucccuguacagcuacggguuccugaacgcccggccgcucuccgugaagaucgucaugacguaccgccugugcagcgagcagcuguccagccaguuccacuacgacuacggcaugcgggccgugaaggccgugcucgucgccgcggggaaccugaagcugaaguaccccaacgagaacgaggacauccuccugcugcgcuccaucaaggacgugaacgagcccaaguuccucagccacgacaucccccuguucaacggcaucaccuccgaccuguucccgggcaucaagcuccccgaggccgacuaccacgaguuccuggagugcgcccacgaggccugcaacgugcacaaccugcagcccgucaaguucuuccucgagaagaucauccagaccuacgagaugaugaucgugcggcacggguucaugcuggugggcgagcccuucgccgcgaagaccaagguccugcacgugcucgccgacacccugacgcugaugaacgagcacggguacggcgaggaggagaaggugaucuaccgcaccgucaaccccaagagcaucaccauggggcagcuguucggccaguucgaccccgugagccacgaguggaccgacggcaucguggccaacacguuccgggaguucgcccuguccgagacccccgaccgcaagugggucguguucgacgggcccaucgacacccuguggaucgagagcaugaacaccgugcucgacgacaacaagaagcugugccugauguccggcgagaucauccagaugagcccgcagaugucccucaucuucgagacgauggaccugagccaggcgucccccgccaccgucagccggugcgggaugaucuaccuggagcccucccagcucggcugggagccccuggugagcuccuggcugaacagccucaaggggccgcugugcgagcccgaguaccaggcccugcuccgcggccuguucgccuggcugaucccgcccucccucaaccagcggguggagcuguuccagcugaacuaccucuacaccaccaucgucagcaagauccugaagauccugaucacguuccgcaucuccaacuacuucaaguacgugccgcucaagacccagugcaccuucaucaaguucuuccugcaccagcaggccugcuucaucuucagccugaucugguccaucggcgggagcugcgacaccgacggccggcgcguguucgacacguucauccggcucaucauccuggggaaggacgacgagaaccccguccccgacuccgugggcaagugggagugccccuucgacgagaagggccugguguacgacuacauguacgagcucaagaacaaggggcgcuggguccacuggaacgagcugaucaagaacaccaaccugggcgacaagcagaucaagauccaggacaucaucgugccgaccauggacaccauccgguacacguuccucauggaccugagcaucaccuacgcgaagccccuccuguucguggggcccaccggcaccggcaagagcgucuacgugaaggacaagcugaugaaccaccuggagaaggaccaguacuuccccuucuacaucaaccucuccgcccgcacgagcgccaaccaggugcagaacaucaucauggcccggcuggacaagcgccgcaagggcgucuucggcccgcccauggggaagaagugcaucaucuucaucgacgacaugaacaugcccgcccuggagaaguacggcgcgcagccgcccaucgagcuccugcggcaguucuucgacugcgggcacugguacgaccugaaggacaccuccaagaucacccucguggacaucgagcugaucgccgccauggggccgcccgggggcggccgcaacccggugacgccccggugcauccgccacuucaacaucugcagcaucaacuccuucagcgacgagacgaugguccggaucuucuccagcaucguggccuucuaccugcgcacccacgaguucccgcccgaguacuucgugaucgggaaccagaucgucaacggcaccauggagaucuacaagcaguccguggagaaccuccugccgacccccaccaagagccacuacaccuucaaccugcgggacuucucccgcgugauccgggggugccuccugaucgagcgcgacgccgucgcgaacaagcacaccaugauccggcuguucgugcacgaggugcuccgcgucuucuacgaccggcugaucaacgacgacgaccgccgguggcuguuccagcucaccaagacggugaucaaggaccacuucaaggagagcuuccacuccaucuucagccaccuccgcaagcagaacgcccccgugaccgaggaggaccugcggaaccucauguucggcgacuacaugaaccccgaccuggagggggacgaccgcgucuacaucgagaucccgaacauccaccacuucuccgacguggucgaccagugccuggacgaguacaaccagacccacaagacccggaugaaccucgugaucuuccgcuacgugcuggagcaccugagccggaucugccgcguccucaagcaguccggcggcaacgcccugcugguggggcugggcgggagcggccgccagucccucacccggcuggccacgagcauggcgaagaugcacaucuuccagcccgagaucagcaaguccuacggcaugaacgaguggcgcgaggacaugaaggggcugcuccggaacgugggcaugaaggggcagaagaccgucuuccugaucaccgacacccagaucaaggaggaggccuuccuggaggacaucgacagcgugcucaacacgggcgaggugcccaacaucuucgccgccgacgagaagcaggaggucauggagggggugcgccccguggcccaggcgggcaacaagcacgacgagcuguccccgcuggcccucuucgccuucuucgucaaccggugcaaggacaaccugcacgugguggucgccuucagccccaucggcgacgccuuccgcaaccggcugcgccaguuccccucccucaucaacugcugcaccaucgacugguuccagagcuggcccgaggacgcgcuggagcggguggccgugaaguuccuggagacccucgagcugaccgaggucgagcagcaggagaucgugccgaucugcaagcacuuccacacguccaucauggaccugagcgagcgcuuccuccacgagcuggggcggcacaacuacgugaccgccaccuccuaccuggagcucaucggcagcuuccgccagcugcugacccagaagcggcaggccgucauggaggccaagcagcgcuacaugaacgggcucgacaagcuggcguucgccgagucccaggugggcgagaugcagauggagcugguggagcuccagcccaagcuggaggaggccaagaucgagaacgccaacaugaugcaggucaucgagaucgagagcguccagguggaggcgaagcggcaguucgucaagcuggacgaggagaucgccuccgggaaggccgaggaggcccaggcccucaagaacgagugcgagagcgaccuggcggaggccauccccgcccuggaggccgcccucuccgcgcuggacacgcugaagcccgccgacaucaccaucgucaagagcaugaagaacccgcccuccggcgugaagcucgucauggccgccgugugcgugaugaaggacaucaagcccgagaagaucagcgaccccuccggcaccgggggcaagauccuggacuacugggggccgagcaagaagcugcucggcgacaugaacuuccugcgcgaccugaaggaguacgacaaggacaacauccccgucaccgugaugcagaagauccggagcgaguaccucaugaaccccgaguucgacccgcccaagguggccaaggcguccagcgccgccgaggggcugugcaaguggaucauggccauggaggucuacgaccgcguggccaagguggucgcgcccaagaaggcccggcuguccgaggcccagaagucccucgccgagacgauggagcugcugaaccagaagcgcgcggagcucgccgagguggagcaccaccuggagaaccugcagaugaccuuccucgagaagaccgaggagaaggccgcccuggaggaccagguggagcugugcgccaagaagcucgagcgcgcgucccagcugaucggcggccucggcggggagaagucccggugggcccaggccgccgacgaccuccagaucaccuacgagaaccugacgggggacguccugguguccgccggggugaucgcguaccucggggccuucaccagcggcuuccgccagaccugcaccaaggacugguccaugcugugcaagaagaagaagauccccugcagcgaggaguuccugcucuccaagacgcugggcgacccggucaagauccgggccuggaacaucgccgggcugcccaccgacaccuucagcaucgacaacggcgugaucgugaacaacugccgccgguggccccucaugaucgacccccaggggcaggccaacaaguggaucaagaacuccgagaaggagaaccagcugagcgucaucaagcuguccgacagcgacuacaugcgcacccucgagaacugcauccaguucggcacgccgcugcugcucgagaacgugggcgaggagcuggaccccucccuggagccccuccugcugcggcagaccuucaagcagggcggcaucgacugcauccgccucggggaggugaucaucgaguacagcuucgacuucaaguucuacaucaccaccaagcugcggaacccccacuacaugccggagcuggcgacgaaggucucccuccugaacuucaugaucacccccgagggccuggaggaccagcuccuggggaucguggucgccaaggagcgccccgagcuggaggaggagcggaacgcccucauccugcagagcgccgcgaacaagaagcagcugaaggacaucgagaagaagauccucgagacccugagcuccagcgagggcaacauccuggaggacgaguccgccaucaaggugcucgacagcgccaagaugauguccaacgagaucaccaagaagcagcagaucgccgagaagacggagcugaagaucgccgagagccgcgagggcuaccggcccaucgcgaagcacuccagcgugcuguucuucuccaucgccgaccucgccaacaucgacccgauguaccaguacagccugaccugguucgucaaccuguacaucaacuccauccacgacagcaacaaguccaagauccuggagaagcgccuccgguaccugaacgaccacuucaccuacaaccuguacugcaacaucugccgcagccucuucgagaaggacaagcugcuguucuccuuccuccugugcgccaaccugcuccuggcccggaaggagaucgaguaccaggagcugauguuccuccugaccgggggcgugagccugaaguccgcggagaagaaccccgaccccacguggcuccaggacaagagcugggaggagaucugccgcgccagcgaguuccccgccuuccgggggcugcgccagcacuucugcgagcacaucuacgaguggcgggagaucuacgacuccaaggagccgcacaacgccaaguuccccgcccccauggacaagaaccugaacgagcuccagaagaucaucauccugcgcugccugcgccccgacaagaucaccccggcgaucaccaacuacgugaccgacaagcucggcaagaaguucgucgagccgccgcccuucgaccugaccaagagcuaccuggacuccaacugcacgaucccccucaucuucgugcugagccccggggccgaccccauggccucccugcucaaguucgccaacgacaagagcauguccggcaacaaguuccaggcgaucagccugggccaggggcagggccccaucgccgccaagaugaucaaggccgccaucgaggaggggaccugggugugccugcagaacugccaccucgcggucuccuggaugcccaugcuggagaagaucugcgaggacuucaccagcgagaccugcaacuccagcuuccggcuguggcucacguccuaccccagcuccaaguuccccgugaccauccugcagaacggcgugaagaugaccaacgagccgcccaccgggcugcgccucaaccugcugcagagcuaccucacggaccccgucuccgaccccgaguucuucaagggcugccggggcaaggagcuggccugggagaagcuccuguucggggugugcuucuuccacgcccuggugcaggagcgcaagaaguucggcccgcugggguggaacauccccuacggcuucaacgagagcgaccuccggaucuccauccgccagcugcagcuguucaucaacgaguacgacaccauccccuucgaggccaucagcuaccucaccggggagugcaacuacggcggccgggucaccgacgacugggaccgccggcugcugcucacgaugcuggccgacuucuacaaccuguacaucguggagaacccccacuacaaguucagcccguccgggaacuacuucgcgccgcccaagggcaccuacgaggacuacaucgaguucaucaagaagcuccccuucacccagcacccggagaucuucgggcugcacgagaacguggacaucagcaaggaccugcagcagaccaagacccuguucgagucccugcugcucacccagggcggcagcaagcagaccggggccuccggcagcaccgaccagauccugcuggagaucacgaaggacauccucaacaagcugcccuccgacuucgacaucgagauggcccugcgcaaguaccccguccgguacgaggagagcaugaacaccgugcucgugcaggagauggagcgcuucaacaaccugaucaucaccauccggaacacccugcgcgaccucgagaaggccaucaagggggucguggugauggacuccgcccuggaggcgcugagcggcucccuccuggucgggaaggugcccgagaucugggccaagcggagcuacccgucccugaagccccucggcagcuacaucacggacuuccuggcccgccugaacuuccuccaggacugguacaacuccggcaagcccugcguguucuggcugagcggguucuucuucacccaggccuuccugaccggcgccaugcagaacuacgcgcggaaguacaccacgcccaucgaccuccugggguacgaguucgaggucaucccguccgacaccagcgacaccucccccgaggacggcguguacauccacgggcuguaccucgacggcgcccgcugggaccgggagagcggccugcuggccgagcaguaccccaagcuccuguucgaccugaugccgaucaucuggaucaagcccacccagaagucccgcaucaucaaguccgacgccuacgugugcccccucuacaagacgagcgagcgcaaggggacccuguccaccaccggccacagcacgaacuucgucaucgcgaugcugcucaagaccgaccagcccacccggcacuggaucaagcgcgggguggcccugcugugccagcuggacgacuga

SEQ ID NO: 29254 - RNA, 13389 nt, Artificial Sequence
  derived and/or modified sequence opt1 from DNAH17__Homo_sapiens__NP_775899
augaccauggcccccgacgugcgccuggaguaccuggaggagguggccagcaucgugcugaaguucaagcccgacaaguggagcaagcugaucggcgccgaggagaacguggcccucuucaccgaguucuucgagaagcccgacguccaggugcuggugcugacccucaacgccgccgggaugaucauccccugccugggcuucccccagagccugaaguccaaggggguguacuucaucaagaccaagagcgagaacaucaacaaggacaacuaccgggcccgccuccuguacggcgacaucucccccacccccguggaccagcugaucgccguggucgaggaggugcucagcucccugcugaaccagagcgagaacauggccggguggccccagguggucuccgaggacaucgugaagcagguccaccggcucaagaacgagauguucgucaugagcggcaagaucaagggcaagacccugcugcccauccccgagcaccucgggucccuggacggcacgcuggagagcauggagcgcauccccuccagccucgacaaccugcugcuccacgccaucgagaccaccaucaucgacuggucccaccagauccgggacgugcugagcaaggacuccgcccaggcgcugcucgacgggcugcacccccugccccagguggaguucgaguucugggacacccgccuccugaaccugaagugcauccacgagcagcucaaccggccgaaggucaacaagaucguggagauccuggagaaggccaagagcugcuacuggcccgcccugcagaacguguacacgaacgucaccgagggccucaaggaggccaacgacaucgugcuguaccugaagccccuccgcauccugcuggaggagauggagcaggccgacuucaccaugcuccccaccuucaucgccaaggugcuggacacgaucugcuucaucugggccaccuccgaguacuacaacaccccggcccggaucaucgucauccugcaggaguucugcaaccagaucaucgagaugacccgcacguuccucagccccgaggaggugcugaaggggcugcagggcgagaucgaggagguccucagcggcaucucccuggccgugaacgugcugaaggagcuguaccagaccuacgacuucugcugcgucaacaugaagcuguucuucaaggacaaggagcccgugcccugggaguucccgagcucccuggccuucagccggaucaacuccuucuuccagcgcauccagaccaucgaggagcuguacaagaccgcgaucgaguuccucaagcuggagaagaucgagcucgggggcgugcgggggaaccuccugggcagccuggucacgcgcaucuacgacgagguguucgagcucgugaaggucuucgccgacugcaaguacgacccccuggaccccggcgacuccaacuucgaccgggacuacgccgacuucgagaucaagauccaggaccuggaccgccggcucgccaccaucuucugccagggguucgacgacugcagcugcaucaaguccagcgccaagcugcuguacaugugcggcgggcucauggagcgcccccugauccuggcggagguggccccgcgguacuccgugaugcucgagcuguucgacgccgagcuggacaacgccaagauccucuacgacgcccagauggcggccagcgaggagggcaacaucccccugauccacaagaacaugccgcccgucgccgggcagcugaaguggucccucgagcugcaggagcgccuggaggugagcaugaagcaccucaagcacguggagcacccggucauguccggcgccgaggcgaagcugaccuaccagaaguacgacgagaugauggagcugcuccggugccaccgcgagaagaucuaccagcaguggguggccggcguggaccaggacugccacuucaaccuggggcagccccugauccuccgcgacgccgccagcaaccugauccacgucaacuucuccaaggcccugguggcggugcuccgggaggucaaguaccugaacuuccagcagcagaaggagauccccgacagcgccgagucccuguucagcgagaacgagaccuuccgcaaguucgugggcaaccucgagcugaucguggggugguacaacgagaucaagacgaucgucaaggccguggaguuccugcucaucaagagcgagcuggaggccaucgacgugaagcugcucuccgccgagaccacccuguucuggaacggcgagggggucuuccaguacauccaggaggugcgggagauccugcacaaccuccagaaccgcaugcagaaggcgaagcagaacaucgagggcaucagccaggccaugaaggacugguccgccaacccgcuguucgagcggaaggacaacaagaaggaggcccugcucgaccuggacggccgcaucgccaaccugaacaagcgguacgcggccgugcgcgacgccggggucaagauccaggccaugguggcggagaacgccgagcuguuccgggccgacacccugagccugcccuggaaggacuacgugaucuacaucgacgacaugguccucgacgaguucgaccaguucauccgcaagucccugagcuuccugauggacaacauggugaucgacgaguccaucgcgccccuguucgagauccggauggagcuggacgaggacggccugacguucaaccccacccucgagguggggagcgaccgcggcuuccuggcccugaucgaggggcucgucaacgacaucuacaacguggcgcggcugaucccgcgccuggccaaggaccggaugaacuacaagauggaccucgaggacaacaccgaccugaucgagaugcgcgaggagguguccagccuggucaucaacgccaugaaggaggccgaggaguaccaggacuccuucgagcgguacagcuaccucuggaccgacaaccugcaggaguucaugaagaacuuccugaucuacggcugcgccgugacggcggaggaccucgacaccuggaccgacgacaccauccccaagacgccgcccacccuggcccaguuccaggagcagaucgacuccuacgagaagcuguacgaggaggugagcaagugcgagaacaccaaggucuuccacggcuggcuccagugcgacugccgcccguucaagcaggcccugcuguccaccauccggcgcuggggguucauguucaagcgccaccucagcaaccacgugaccaacucccuggccgaccuggaggccuucaugaagguggcgcggaugggccucacgaagccccugaaggagggggacuacgacggccuggucgaggugaugggccaccucaugaaggugaaggagcgccaggccgccaccgacaacauguucgagccccugaagcagaccaucgagcugcucaagaccuacggggaggagaugcccgaggagauccaccugaagcugcaggagcucccggagcacugggccaacacgaagaagcuggcgauccaggucaagcugaccguggcgccccuccaggccaacgaggugagcauccuccggcgcaagugccagcaguucgagcugaagcagcacgaguuccgggagcgcuuccggcgcgaggcccccuucagcuucuccgaccccaacccguacaagagccugaacaagcagcagaaguccaucagcgccauggagggcaucauggaggcccucuccaagagcgggggccuguucgagguccccgugcccgacuacaagcagcugaaggccugccaccgggagguccgccuccugaaggagcugugggacauggugguggucgugaacaccuccaucgaggacuggaagaccacgaaguggaaggacaucaacguggagcagauggacaucgacugcaagaaguucgccaaggacaugcggagccucgacaaggagaugaagaccugggacgccuucgucgggcuggacaacaccgugaagaacgugaucaccucccugcgcgccgucagcgagcuccagaaccccgcgauccgggagcgccacuggcagcagcugaugcaggccacccaggugaaguucaagauguccgaggagaccacccuggccgaccuccugcagcugaaccuccacagcuacgaggacgaggugcggaacaucgucgacaaggccgugaaggaguccggcauggagaaggugcugaaggcccuggacagcaccugguccaugauggaguuccagcacgagccgcacccccgcacgggcaccaugaugcucaagagcuccgagguccugguggagacccuggaggacaaccaggugcagcuccagaaccugaugaugagcaaguaccuggcgcacuuccucaaggaggucaccuccuggcagcagaagcugagcacggccgacagcgugaucuccaucugguucgaggugcagcggaccuggagccaccuggaguccaucuucaucgggagcgaggacauccgcacccagcuccccggcgacucccagcgguucgacgacaucaaccaggaguucaaggcccugauggaggacgccgucaagacccccaacgugguggaggccacgagcaagccggggcuguacaacaagcucgaggcgcugaagaagucccuggccaucugcgagaaggcccucgccgaguaccuggagaccaagcgccuggcguucccccgguucuacuucgucagcuccgccgaccuccuggacauccugagcaacggcaacgaccccguggaggugucccgccaccucagcaagcuguucgacucccugugcaagcucaaguuccgccuggacgccagcgacaagccgcugaaggucgggcucggcauguacuccaaggaggacgaguacaugguguucgaccaggagugcgaccugagcggccagguggaggucuggcugaaccgggugcucgaccgcaugugcuccacccugcggcacgagauccccgaggccguggucaccuacgaggagaagccccgcgagcaguggauccuggacuaccccgcccagguggcgcucacgugcacccagaucugguggaccaccgagguggggcuggccuucgcccggcuggaggagggcuacgagaacgccauccgcgacuacaacaagaagcagaucagccagcucaacguccugaucacgcugcucauggggaaccugaacgccggcgaccggaugaagaucaugaccaucugcaccaucgacgugcacgcgcgcgacguggucgccaagaugaucguggccaagguggaguccagccaggccuucaccuggcaggcccagcugcggcaccgcugggacgaggagaagcggcacugcuucgcgaacaucugcgacgcccagauccaguacagcuacgaguaccucgggaacacgccgcgccuggucaucacgccccucaccgaccggugcuacaucacccucacccagucccugcaccugaucaugggcggcgcccccgccgggcccgcgggcacggggaagaccgagaccaccaaggaccucggccgcgcccuggggacgaugguguacguguucaacugcagcgagcagauggacuacaaguccugcggcaacaucuacaagggccuggcccagaccggggccuggggcugcuucgacgaguucaaccggaucagcgucgaggugcucuccgugaucgccguccaggugaagugcgugcaggacgcgauccgcgccaagaagaaggccuucaacuuccugggggagaucaucggccugaucccgaccgucggcaucuucaucaccaugaaccccggguacgccggccgggccgagcuccccgagaaccugaaggcgcuguuccgccccugcgccaugguggucccggacuucgagcucaucugcgagaucaugcugauggccgagggguuccuggaggcccggcuccuggcccgcaaguucaucacgcuguacacccucugcaaggagcugcugagcaagcaggaccacuacgacuggggccuccgcgcgaucaaguccgugcugguggucgccgggagccugaagcggggcgaccccucccgcgccgaggaccaggugcucaugcgggcccugcgcgacuucaacauccccaagaucgugaccgacgaccugcccgucuucaugggccucaucggggaccuguucccggcgcuggacgugccccggaagcgcgaccucaacuucgagaagaucaucaagcagagcaucguggagcugaagcugcaggccgaggacuccuucguccucaagguggugcagcuggaggagcugcugcagguccggcacagcguguucaucgugggcaacgccggguccggcaagagccagguccucaagucccugaacaagaccuaccagaaccugaagcgcaagcccguggccguggaccucgaccccaaggccgucacgugcgacgagcuguucgggaucaucaacccggugacccgggaguggaaggacggccuguucagcaccaucaugcgcgaccucgcgaacaucacccacgacggccccaaguggaucauccuggacggggacaucgaccccauguggaucgagucccugaacacggugauggacgacaacaagguccucacccuggccagcaacgagcggaucccccugaaccgcaccaugcggcucguguucgagaucucccaccuccgcaccgccacgccggccaccgugagccgggccggcauccuguacaucaaccccgcggaccucggguggaaccccgucgugagcuccuggaucgagcgccggaaggugcagagcgagaaggccaaccugaugauccuguucgacaaguaccucccgaccugccuggacaagcugcgcuucggcuucaagaagaucaccccgguccccgagaucacggugauccagaccauccucuaccugcuggagugccuccugaccgagaagaccgugcccccggacagcccccgggagcuguacgagcucuacuucgucuucacgugcuucugggccuucgggggcgccauguuccaggaccagcugguggacuaccgcguggaguucagcaagugguggaucaacgaguucaagaccaucaaguuccccucccagggcaccaucuucgacuacuacaucgaccccgacaccaagaaguuccugccguggacggacaagguccccagcuucgagcucgaccccgacgugccccugcaggccucccuggugcacaccaccgagaccauccggauccgcuacuucauggaccuccugauggagaaguccuggccggucaugcugguggggaacgcgggcacggggaaguccgugcucaugggcgacaagcuggagagccugaacaccgacaacuaccucguccaggccgugcccuucaacuucuacaccaccuccgccaugcugcagggcgugcuggagaagccccucgagaagaaguccgggcgcaacuacggcccgcccgggaccaagaagcuggucuacuucaucgacgacaugaacaugcccgagguggacaaguacggcacgguggcgccccacacccugauccggcagcacauggaccaccgccacugguacgaccggcacaagcucacccugaaggacauccacaacugccaguacgucgccugcaugaaccccaccuccgggagcuucacgaucgacucccgccugcagcggcacuucugcguguucgcggugagcuuccccggccaggaggcccucaccaccaucuacaacaccauccugacgcagcaccuggccuuccgcuccgucagcauggccauccagcggaucuccagccagcucguggcggccgcccuggcccugcaccagaagaucaccgccaccuuccuccccaccgcgaucaaguuccacuacguguucaaccugcgcgaccugagcaacaucuuccagggccuccuguucuccacggccgagguccugaagacgccccuggaccuggugcggcuguggcuccacgagaccgagcgcgucuacggggacaagaugguggacgagaaggaccaggagacccugcaccgggugacgauggccagcaccaagaaguucuucgacgaccugggcgacgagcuccuguucgccaagcccaacaucuucugccacuucgcccaggggaucggcgacccgaaguacguccccgugaccgacauggcgccccugaacaagcuccugguggacguccuggacuccuacaacgaggugaacgccgugaugaaccucguccuguucgaggacgccguggcccacaucugccgcaucaaccggauccuggagagcccccgcgggaacgcccuccuggugggcgucggcggguccggcaagcagagccugucccggcucgcggccuacaucagcgggcuggacguguuccagaucacccugaagaagggcuacgggaucccggaccucaagaucgaccuggccgcccaguacaucaaggcggccgugaagaacguccccuccguguuccugaugacggacagccagguggccgaggagcaguuccucguccugaucaacgaccugcucgccuccggcgagauccccggccuguucauggaggacgagguggagaacaucaucagcuccaugcgcccccaggucaagagccuggggaugaacgacacccgggagaccugcuggaaguucuucaucgagaagguccgccggcagcucaaggugauccugugcuucuccccggugggcagcguccugcgcgugcgcgcccggaaguuccccgcgguggucaacugcaccgccaucgacugguuccacgaguggcccgaggacgcccucguguccgugagcgcccgcuuccuggaggagacggaggggaucccgugggaggucaaggccuccaucagcuucuucaugagcuacgugcacaccaccgugaacgagaugucccgggucuaccuggcgaccgagcgccgguacaacuacacgacccccaagaccuuccucgagcagaucaagcuguaccagaaccugcuggccaagaagcgcaccgagcucguggccaagaucgagcggcuggagaacggccugaugaagcuccagagcacggccucccagguggacgaccugaaggccaagcuggcgauccaggaggccgagcucaagcagaagaacgagagcgccgaccagcugauccaggucguggggaucgaggccgagaagguguccaaggagaaggcgaucgccgaccaggaggaggucaagguggaggugaucaacaagaacgucaccgagaagcagaaggccugcgagaccgaccuggccaaggccgagcccgcgcuccuggccgcccaggaggcccuggacacccucaacaagaacaaccugacggagcucaagagcuucggcagcccgcccgacgccguggugaacgucaccgcggccgugaugauccucaccgcccccggcgggaagauccccaaggacaagagcuggaaggccgccaagaucaugaugggcaagguggacaccuuccuggacucccugaagaaguucgacaaggagcacauccccgaggcgugccucaaggccuucaagcccuaccaggggaaccccacguucgaccccgaguucauccgcagcaaguccaccgccgccgccggccugugcagcuggugcaucaacaucguccgguucuacgagguguacugcgacguggcgcccaagcgccaggcccuggaggaggccaacgccgagcucgcggaggcccaggagaagcugucccggaucaagaacaagaucgccgagcugaacgccaaccucagcaaccugaccuccgccuucgagaaggcgaccgccgagaagaucaagugccagcaggaggccgacgccaccaaccgcgucauccugcucgccaaccggcuggugggcgggcuggcgagcgagaacauccgcugggccgaguccgucgagaacuuccggagccagggcgugacgcucugcggggacgugcugcugaucagcgccuucgucuccuacgugggcuacuucaccaagaaguaccgcaacgagcucauggagaaguucuggaucccguacauccacaaccugaaggugcccauccccaucaccaacgggcuggacccccucagccugcugaccgacgacgccgacgucgccacguggaacaaccagggccucccguccgaccggaugagcaccgagaacgcgaccauccugggcaacaccgagcgcuggccccugaucguggacgcccagcuccaggggaucaaguggaucaagaacaaguaccgguccgagcugaaggccauccgccugggccagaaguccuaccucgacgugaucgagcaggccaucuccgagggggacacgcugcugaucgagaacaucggcgagaccgucgaccccgugcucgacccccugcuggggcggaacaccaucaagaagggcaaguacaucaagaucggcgacaaggagguggaguaccacccgaaguuccgccucauccugcacaccaaguacuucaacccccacuacaagcccgagaugcaggcgcagugcacgcugaucaacuuccucgucacccgcgacgggcuggaggaccagcugcucgccgccgugguggccaaggagcggcccgaccuggagcagcugaaggccaaccucaccaagagccagaacgaguucaagaucguccugaaggagcuggaggacucccuccuggcgcgccugagcgccgccuccggcaacuuccucggggacaccgcccugguggagaaccuggagacgaccaagcacaccgccagcgagaucgaggagaagguggucgaggcgaagaucaccgaggugaagaucaacgaggcccgggagaacuaccgcccggccgccgagcgggccucccuccuguacuucauccugaacgaccucaacaagaucaaccccguguaccaguucagccugaaggcguucaacgucguguucgagaaggccauccagcgcacgacccccgccaacgaggugaagcagcgggucaucaaccugaccgacgagaucaccuacuccguguacauguacacggcccgcggccucuucgagcgggacaagcugaucuuccuggcccaggugaccuuccagguccucagcaugaagaaggagcugaacccgguggagcuggacuuccuccugcgcuuccccuucaaggcggggguggucucccccguggacuuccugcagcaccagggcuggggcgggaucaaggcccucagcgagauggacgaguucaagaaccuggacuccgacaucgagggcagcgccaagcgguggaagaagcugguggagagcgaggcccccgagaaggagaucuucccgaaggaguggaagaacaagaccgcgcuccagaagcugugcaugguccgcugccugcggcccgaccgcaugaccuacgccaucaagaacuucguggaggagaagaugggguccaaguucguggagggccggagcgucgaguucuccaagagcuacgaggaguccagccccuccacgagcaucuucuucauccucucccccgggguggacccgcugaaggacguggaggcccugggcaagaagcucggcuucaccaucgacaacgggaagcugcacaacgucagccugggccaggggcaggaggugguggccgagaacgcccuggacgucgcggccgagaagggccacugggugauccuccagaacauccaccugguggcccgcuggcugggcacccucgacaagaagcuggagcacuacuccaccgggagccacgaggacuaccgggucuucaucuccgccgagcccgcccccagccccgagacgcacaucaucccgcagggcauccuggagaacgcgaucaagaucaccaacgagccgcccaccgggaugcacgccaaccuccacaaggcccuggaccuguucacccaggacacgcucgagaugugcaccaaggagauggaguucaagugcaugcuguucgcccugugcuacuuccacgccgugguggcggagcgccggaaguucggcgcccagggguggaaccgcuccuaccccuucaacaacggcgaccucaccaucagcaucaacguccuguacaacuaccuggaggccaacccgaaggugcccugggacgaccuccgcuaccuguucggcgagaucauguacgggggccacaucaccgacgacugggaccggcgccugugccggaccuaccucgccgaguacauccgcacggagaugcuggagggggacgugcugcucgcgcccggcuuccagaucccgcccaaccuggacuacaagggguaccacgaguacaucgacgagaaccugccgcccgagucccccuaccucuacggccugcaccccaacgccgagaucggcuuccugaccgucaccagcgagaagcuguuccggaccgugcuggagaugcagcccaaggagacggacuccggggccggcaccggggucagccgcgaggagaaggugaaggccgugcuggacgacauccucgagaagauccccgagaccuucaacauggccgagaucauggcgaaggccgccgagaagacccccuacgucgugguggccuuccaggagugcgagcggaugaacauccugacgaacgagaugcgccggagccugaaggagcucaaccugggccugaagggggagcucaccaucaccaccgacgucgaggaccuguccacggcccuguucuacgacaccgugccggacaccuggguggcgcgcgccuaccccagcaugaugggccucgccgccugguacgccgaccugcugcuccggauccgcgagcuggaggcguggaccacggacuucgcccugcccaccaccgucuggcucgccggcuucuucaacccgcaguccuuccugaccgccaucaugcagagcauggcgcggaagaacgaguggccccuggacaagaugugccucuccguggaggugacgaagaagaaccgcgaggacaugaccgcgccgccccgggaggggagcuacgucuacggccuguucauggagggggcccgcugggacacccagaccggcgugaucgccgaggcccggcugaaggagcucacgccggcgaugcccgugaucuucaucaaggccauccccgucgaccgcauggagaccaagaacaucuacgagugccccguguacaagacccggauccgcggcccgaccuacguguggacguucaaccugaagaccaaggagaaggccgccaaguggauccuggccgcggucgcccuccugcuccagguguga

SEQ ID NO: 29255 - RNA, 12798 nt, Artificial Sequence
  derived and/or modified sequence opt1 from DNAH1__Homo_sapiens__NP_056327
auggagcagcccaacagcaagggcuacagccuggggcgcacgccccagggccccgagugcagcuccgcccccgccguccagguggggacccaccggggccucgaguacaaccccgggaagauccugcccggcagcgacuacggccuggggaacccgcccgcccucgaccccaagcugccgcaccucccccugccgcccgccccgcccacccuguccgaccugggccagccccgcaagagcccccucaccgggaccgacaagaaguacccccugaugaagcagcggggcuucuacuccgacauccugagccccgggacccucgaccagcugggcgaggugugccgcggcccccggaugucccagaaccugcuccgccaggccgaccuggacaaguucacgccccggguggggagcuucgaggugcccgaggacuuccaggagcgcauggagcagcagugcaucggcuccaccacccggcugcucgcccagaccgacuucccccugcaggccuacgagcccaagaugcagguccccuuccaggugcugccggggcagcacccccgcaagaucgagaucgagcggcgcaagcagcaguaccucagccuggacaucgagcagcuccuguucucccagggcaucgacagcaacaagcugaugccccggcaccuggaccaccagcacccccagaccaucgagcagggccacgacccgaucuuccccaucuaccucccccugaagguguucgacaacgaggacuucgacugccgcaccccgcgggaguggaucaacauggggcuggagcccggcucccucgaccgcaagcccgugcccgggaaggcgcugcugccgaccgacgacuuccucggccacgaggaccccaagagccagaagcugaaguacaaguggugcgaggugggggugcuggacuacgacgaggagaagaagcucuaccuggugcacaagaccgacgagaagggccuggugcgggacgagaugggccgccccauccucaacgccggggugaccaccgagggccggcccccgcuccaggugugccaguacugggugccccgcauccagcuccuguucugcgccgaggaccccugcauguucgcccagcgggucgugcaggcgaacgcccugcgcaagaacaccgaggcccugcuccuguacaaccuguacguggacugcaugcccuccgacgggcagcacgucaucagcgagcagucccucagcaagaucaagcagugggcccugagcaccccgcgcaugcggaagggccccuccgugcuggagcaccugagcucccucgcccgcgaggugagccuggacuacgagcgguccaugaacaagaucaacuucgaccacgucgugagcuccaagcccgagacguucagcuacgugacccugcccaagaaggaggaggagcaggucccggagcgcgggcucguguccguccccaaguaccacuucugggagcagaaggaggacuucaccuucgugagccugcugacccggcccgaggugaucacggcgcucuccaagguccgcgccgagugcaacaaggugaccgccaugagccuguuccacuccagccuguccaaguacagccaccucgaggaguucgagcagauccagucccagaccuucagccaggugcagauguuccugaaggacuccuggaucagcagccugaaggucgccaugcgguccagccuccgcgacauguccaagggcugguacaaccuguacgagaccaacugggagguguaccugaugagcaagcuccggaagcugauggagcuggugaaguacaugcuccaggacacgcugcgcuuccugguccaggacucccucgccagcuucucccaguucaucagcgacacgugcugcuccgugcugaacugcaccgacgacaugguguggggcgacgaccugaucaacagccccuaccggccgcgcaagaacccccucuucaucauggaccugguccuggacuccagcggggugcacuacuccacgccccuggagcaguucgaggcgagccugcugaaccucuucgacaagggcauccuggccacgcacgccgugccccagcuggagaagcucgucauggaggacaucuucaucuccggggacccgcugcuggagagcgugggccuccacgagccccugguggaggagcugcgggccaccaucgccuccgcggucagcaaggccaugaucccccuccaggccuacgccaaggaguaccgcaaguaccuggagcugaacaacaacgacaucgccagcuuccucaagaccuaccagacccaggggcugcuggcgcaggaggugcgggaggugguccucacgcaccuccgcgagaaggagauccuggacuccagccucccguccagcaucaucaucggccccuucuacaucaacaccgacaacgugaagcagucccugagcaagaagcggaaggcccuggccaccuccgugcucgacauccuggccaagaaccugcacaaggaggucgacagcaucugcgaggaguuccgcuccaucagccggaagaucuacgagaagcccaacuccaucgaggagcucgcggagcugcgcgaguggaugaagggcauccccgagcgccugguggggcucgaggagcggaucgugaaggucauggacgacuaccaggugauggacgaguuccuguacaaccugagcuccgacgacuucaacgacaaguggaucgccagcaacuggccguccaagauccucggccagaucgagcuggugcagcagcagcacgucgaggacgaggagaaguuccgcaagauccagaucauggaccagaacaacuuccaggagaagcuggaggggcuccagcuggugguggccggcuucagcauccacgucgagaucucccgggcccacgagaucgccaacgaggugcgccgggugaagaagcagcugaaggacugccagcagcucgcgaugcuguacaacaaccgcgagcggaucuucagccugcccaucaccaacuacgacaagcucucccgcauggucaaggaguuccagcccuaccuggaccuguggacgaccgccagcgacuggcuccgguggagcgaguccuggaugaacgacccccugagcgccaucgacgccgagcagcuggagaagaacgugguggaggccuucaagaccaugcacaagugcgucaagcaguucaaggacaugccggcgugccaggagguggcccucgacauccgcgcccggaucgaggaguucaagcccuacaucccccugauccagggccugcgcaaccccgggaugcggauccgccacugggagacccucuccaaccagaucaacaucaacgugcggccgaaggccaaccugaccuucgcccgcugccuggagaugaaccuccaggaccacaucgagagcaucuccaaggucgcggagguggccggcaaggaguacgccaucgagcaggcccuggacaagauggagaaggaguggagcacgauccuguucaacgugcuccccuacaaggcgaccgacaccuacauccugaagucccccgacgaggccagccagcugcucgacgaccacaucgucaugacccagaacauguccuucagccccuacaagaagccguucgagcagcggaucaacuccugggagaacaagcugaagcugacgcaggaggugcucgaggaguggcugaacugccagcgcagcuggcuguaccucgagcccaucuucuccagcgaggacaucaaccagcagcugcccguggaguccaagcgguaccagaccauggagcgcaucuggaagaagaucaugaagaacgccuacgagaaccgggaggucaucaacgugugcagcgaccugcgcaugcuggacucccuccgcgacugcaacaagauccuggaccuggugcagaaggggcucagcgaguaccuggagaccaagcgguccgccuucccccgcuucuacuuccugagcgacgacgagcuccuggagauccugagccagaccaaggacccgacggccguccagccccaccuccggaagugcuucgagaacaucgcgcgccugcuguuccaggaggaccucgagaucacccacauguacuccgccgagggcgaggaggugcagcugugcuucagcaucuaccccuccagcaacgucgaggacuggcugcgggagguggagcgcuccaugaaggccagcgugcacgacaucaucgagaaggccauccgggccuaccccaccaugccgcgcacccaguggguccucaacuggcccggccaggugacgaucgcgggcugccagaccuacuggaccauggagguggccgaggcccuggaggccggcaaccugcggucccagcuguucccccagcugugccagcagcugagcgaccucgucgcccuggugcgcgggaagcugucccggaugcagcgcgcggugcucagcgcccugaucgucaucgaggugcacgccaaggacguggucuccaagcugauccaggagaacguggugagcgucaacgacuuccaguggaucucccagcuccgguacuacuggaccaacaacgaccuguacauccgcgccgugaacgcggaguucaucuacggcuacgaguaccuggggaacagcggccggcucgugaucacgccccugaccgaccgcugcuaccugacccucaccggggcccugcaccugaaguucggcggcgccccggccgggcccgccggcacggggaagaccgagaccaccaaggaccucggcaaggcgcuggccauccagacggucguguucaacugcuccgaccagcuggacuucauggccauggggaaguucuucaagggccucgccagcgccggcgcgugggccugcuucgacgaguucaaccggaucgacaucgaggugcuguccgucguggcccagcagaucaccaccauccagaaggcccagcagcagcgcguggagcgguucauguucgagggggucgagaucccccuggugccgagcugcgccguguucaucaccaugaaccccggcuacgcggggcgcacggagcuccccgacaaccugaaggcccuguuccgccccgucgccaugauggugccggacuacgccaugaucaccgagaucucccucuacagcuucggcuucaacgaggccagcgugcuggcgaagaagaucaccaccacguucaagcuguccagcgagcagcucuccagccaggaccacuacgacuucgggaugcgggccgucaagaccgugaucuccgccgccggcaaccugaagcgcgagaaccccagcaugaacgaggagcugaucugccuccgggcgauccgcgacgugaacguccccaaguuccugcaggaggaccugaagcuguucuccggcaucgugagcgaccuguuccccaccaucaaggaggaggacaccgacuacgggauccuggacgaggccauccgggaggccugccgcaacuccaaccucaaggacguggagggcuuccugacgaagugcauccagcuguacgagaccaccgucgugcggcacgggcucaugcuggugggcccgaccggcagcgggaaguccacgugcuaccgcguccuggccgccgcgaugaccagccucaagggccagcccagcaucagcgggggcauguacgaggccgugaacuacuacgugcugaaccccaaguccaucaccauggggcagcuguacggcgaguucgaccuccugacccacgaguggaccgacggcaucuucagcuccuucauccgggccggggccaucacgagcgacaccaacaagaagugguacauguucgacggccccgucgacgccaucuggaucgagaacaugaacaccgugcuggacgacaacaagaagcucugccuguccagcggggagaucaucaagcugaccgaggcgaugacgaugauguucgaggugcaggaccucgccgucgccagcccggccaccgugucccgcugcggcaugguguaccuggagcccagcauccuggggcucaugcccuucaucgagugcuggcugcggaagcugcccccgcuccugaagcccuacgaggagcacuucaaggcccuguucgucuccuuccucgaggagagcaucuccuucgugcgcagcuccgugaaggaggucaucgcgagcaccaacugcaaccugaccaugucccugcucaagcugcuggacugcuucuucaagcccuuccucccccgggagggccugaagaagaucccgagcgagaagcugucccgcaucguggagcucaucgagcccugguucaucuucagccugaucugguccgucggcgccacgggggacagcuccggccggaccagcuucucccacuggcugcgccucaagauggagaacgagcagcugacccuccuguuccccgaggaggggcugguguucgacuaccggcuggaggacgccggcaucagcgggaccaacgacuccgaggacgaggaggaggaguacaagcaggucgccugggucaaguggauggacagcagcgcgcccuucacgauggugccggacaccaacuacugcaacaucaucgugcccaccauggacaccguccagaugucccaccuccuggacaugcugcugacgaacaagaagcccgugcucugcaucggccccaccggcaccgggaagacccugacgaucagcgacaagcugcucaagaaccuggcccuggacuacaucucccacuuccucaccuucagcgcccgcaccuccgccaaccagacccaggacuucaucgacagcaagcuggacaagcggcgcaagggcguguucgggccgccccugggccggaacuucaucuucuucaucgacgaccucaacaugcccgcccuggagacguacggcgcgcagccgcccaucgagcugcuccgccaguggauggaccacgggggcugguacgaccgcaagaucaucggggccuucaagaaccuggucgacaucaacuucgugugcgccauggggccgcccgggggcggccggaacaccgugaccccgcgccugaugcggcacuucaacuaccucuccuucgccgagauggacgaggucagcaagaagcgcaucuucuccaccauccuggggaacuggcuggacggccuccugggggagaaguccuaccgggagcgcgugcccggcgcgccccacaucgcgcacuucacggagccccugguggaggccaccaucauggucuacgccaccaucaccucccagcuccugccgacgcccgccaagagccacuacaccuucaaccugcgggaccucuccaagguguuccaggggaugcugauggccgaccccgcgaagguggaggaccagguccagcugcuccgccugugguaccacgagaacugccggguguuccgcgaccggcuggugaacgaggaggaccgcagcugguucgaccagcuccugaagcggugcauggagcagugggaggucaccuucaacaaggugugccccuuccagccgauccuguacggcgacuucaugucccccggcagcgacgugaaguccuacgagcucaucaccagcgagagcaagaugaugcaggucaucgaggaguacaucgaggacuacaaccagaucaacaccgccaagcugaagcugguccucuucauggacgccaugucccacaucugccgcaucagccggacgcugcgccaggcccuggggaacgcgcuccugcugggcgucggcggguccgggcggagcucccucacccgccuggccagccacauggccgaguacgagugcuuccagaucgagcuguccaagaacuacgggaugagcgaguggcgggacgacgucaagaaggugcuccugaaggccggccugcagaaccuccccaucaccuuccuguucuccgacacccagaucaagaacgagagcuuccuggaggacaucaacaacgugcucaacuccggggacauccccaaccuguacacggccgacgagcaggaccagaucgucagcaccaugcgcccguacauccaggagcagggccugcagcccaccaaggcgaaccucauggccgccuacaccgggcgcgugcgguccaacauccacauggugcugugcaugagccccaucggcgaggucuuccgcgcccggcugcgccaguuccccucccucgugaacugcugcacgaucgacugguucaacgaguggccggccgaggcgcucaagagcguggccaccgucuuccugaacgagauccccgagcucgaguccagccaggaggagauccaggggcugauccaggugugcguguacauccaccaguccgucagcaagaagugcaucgaguaccuggccgagcucacccggcacaacuacgugacccccaagagcuaccuggagcugcuccacaucuucuccauccugaucggccagaagaagcuggagcucaagacggccaagaaccgcaugaaguccggccuggacaagcugcuccggaccuccgaggacguggccaagaugcaggaggaccuggagagcaugcacccccugcucgaggaggcggccaaggacaccaugcugaccauggagcagaucaaggucgacacggccaucgccgaggagacccgcaacuccgugcagaccgaggagaucaaggccaacgagaaggcgaagaaggcccaggccaucgccgacgacgcgcagaaggaccuggacgaggcccucccggcccuggacgccgcccuggcgagccuccggaaccugaacaagaacgacgugaccgagguccgcgccaugcagcggccgccgcccggggugaagcuggugaucgaggccgucugcaucaugaagggcaucaagcccaagaaggugcccggggagaagcccggcacgaagguggacgacuacugggagcccggcaaggggcuccugcaggaccccggccacuuccuggagucccucuucaaguucgacaaggacaacaucggggacgucgugaucaaggccauccagcccuacaucgacaacgaggaguuccagcccgccaccaucgcgaaggucagcaaggccugcaccuccaucugccagugggugcgcgccaugcacaaguaccacuucguggccaaggccgucgagccgaagcggcaggcgcugcuggaggcccaggacgaccucggcgugacccagcgcauccuggacgaggccaagcagcggcugcgcgagguggaggacgggaucgccacgaugcaggcgaaguaccgggagugcaucaccaagaaggaggagcucgagcugaagugcgagcagugcgagcagcgccugggccgggccggcaagcucaucaacgggcugagcgacgagaagguccgcuggcaggagaccguggagaaccugcaguacaugcugaacaacaucuccggcgacgugcucgucgccgccggguucguggccuaccugggccccuucaccgggcaguaccggacggugcuguacgacagcugggucaagcagcuccgcucccacaacgugccccacaccagcgagcccacccugaucggcacccugggcaacccggugaagauccgcuccuggcagaucgcggggcuccccaacgacacgcugagcgucgagaacggcgugaucaaccaguucucccagcgguggacccacuucaucgacccccagagccaggccaacaaguggaucaagaacauggagaaggacaacgggcuggacguguucaagcucuccgaccgcgacuuccugcggagcauggagaacgccauccgcuucggcaagcccugccugcucgagaacgucggggaggagcuggacccggcccuggagcccgugcuccugaagcagaccuacaagcagcagggcaacaccgugcugaagcucggcgacacggucauccccuaccacgaggacuuccggauguacaucaccaccaagcugcccaacccgcacuacacccccgagaucagcacgaagcugacccucaucaacuucacccugucccccagcgggcuggaggaccagcuccugggccaggugguggccgaggagcgccccgaccuggaggaggcgaagaaccagcucaucaucuccaacgccaagaugcggcaggagcugaaggacaucgaggaccagauccuguaccgccucagcuccagcgaggggaacccggucgacgacauggagcugaucaaggugcuggaggccuccaagaugaaggccgccgagauccaggcgaaggugcggaucgccgagcagaccgagaaggacaucgaccucacccgcauggaguacauccccgucgccauccggacgcagauccuguucuucugcgugagcgaccuggccaacguggaccccauguaccaguacucccucgagugguuccugaacaucuuccugagcggcaucgcgaacuccgagcgcgccgacaaccucaagaagcggaucagcaacaucaaccgcuaccugaccuacucccuguacagcaacgucugccggucccucuucgagaagcacaagcugauguucgccuuccugcucugcgugcgcaucaugaugaacgaggggaagaucaaccagagcgaguggcgguaccugcuguccggcggcagcaucuccaucaugaccgagaaccccgccccggacuggcucagcgaccgcgccuggcgggacauccuggcgcugagcaaccuccccaccuucuccagcuucuccagcgacuucgugaagcaccuguccgaguuccgcgucaucuucgacagccuggagccccaccgcgagccgcuccccgggaucugggaccaguaccuggaccaguuccagaagcugcucgugcugcggugccugcgcggcgacaaggugacgaacgccaugcaggacuucgucgccaccaaccucgagccccgguucaucgagccccagaccgccaaccuguccgugguguucaaggacagcaacuccaccacgccgcugaucuucguccucagccccgggaccgaccccgccgcggaccuguacaaguucgccgaggagaugaaguucuccaagaagcugagcgccaucucccucggccagggccaggggccccgcgccgaggccaugaugcggagcuccaucgagcgcggcaaguggguguucuuccagaacugccaccuggcgccgagcuggaugcccgcccuggagcggcucaucgagcacaucaaccccgacaaggugcaccgcgacuuccggcuguggcugaccucccuccccagcaacaaguucccggucuccauccugcagaacgggagcaagaugaccaucgagccgccccgcggcgugcgggccaaccugcucaagagcuacuccagccugggggaggacuuccugaacuccugccacaaggugauggaguucaagagccuccugcugucccucugccuguuccacggcaacgcccuggagcgccggaaguucggcccccucggguucaacaucccguacgaguucacggacggcgaccugcgcaucugcaucagccagcugaagauguuccucgacgaguacgacgacauccccuacaagguccugaaguacaccgccggggagaucaacuacggcgggcgggugaccgacgacugggaccgccggugcaucaugaacauccuggaggacuucuacaaccccgacgugcucucccccgagcacagcuacuccgcgagcggcaucuaccaccagaucccgcccaccuacgaccugcacggcuaccuguccuacaucaagagccucccccugaacgacaugcccgagaucuucgggcugcacgacaacgccaacaucacguucgcccagaacgagaccuucgcccugcucggcaccaucauccagcugcagccgaaguccagcuccgcggggagccagggccgcgaggagaucgucgaggacgugacccagaacauccugcucaaggugcccgagcccaucaaccugcagugggucauggccaaguaccccgugcuguacgaggaguccaugaacacgguccucgugcaggaggugauccgguacaaccgccugcugcaggucaucacccagacccuccaggaccugcugaaggcccucaaggggcugguggugaugagcucccagcuggagcucauggccgccagccuguacaacaacaccgucccggagcuguggagcgcgaaggccuaccccucccucaagccccugagcuccugggugauggaccugcuccagcggcuggacuuccugcaggccuggauccaggacggcaucccggccguguucuggaucagcggcuucuucuucccccaggccuuccucacggggacccugcagaacuucgcgcgcaaguucgucaucuccaucgacaccaucagcuucgacuucaaggugauguucgaggcccccuccgagcugacccagcgcccccaggugggcugcuacauccacggccucuuccuggagggcgcccggugggacccggaggccuuccagcuggccgagagccagcccaaggagcucuacacggagauggcggucaucuggcugcugcccacccccaaccgcaaggcccaggaccaggacuucuaccucugcccgaucuacaagacccugacccgggccggcacgcuguccaccaccgggcacagcaccaacuacgugaucgccguggagauccccacgcaccagccccagcgccacuggaucaagcggggcgucgcgcucaucugcgcccuggacuacuga

SEQ ID NO: 29256 - RNA, 2619 nt, Artificial Sequence
  derived and/or modified sequence opt1 from DNAH2__Homo_sapiens__NP_001290199
augagcuccaaggccgagaagaagcagcgccugagcggccggggguccagccaggccuccuggagcggccgcgcgacccgggccgccguggccacccaggagcaggggaacgcccccgcgguguccgagccggagcuccaggccgagcugcccaaggaggagcccgagccccgccuggagggcccgcaggcccagagcgaggaguccguggagcccgaggccgacgugaagccccucuuccugagccgggcggcccugacggggcucgccgacgccgucuggacccaggagcacgacgccauccuggagcacuucgcgcaggaccccaccgaguccauccugaccaucuucaucgacccgugcuucggccucaagcuggagcugggcaugcccgugcagacgcagaaccagcucguguacuucauccgccaggcccccguccccaucaccugggagaacuucgaggccaccgugcaguucgggaccgugcggggcccguacauccccgcccugcugcgccuccucgggggcgucuucgcgccccagaucuucgcgaacacgggguggcccgagagcauccggaaccacuucgccucccaccuccacaaguuccuggccugccugaccgacacccgcuacaagcuggagggccacaccgugcuguacaucccggccgaggccaugaacaugaagcccgagauggugaucaaggacaaggagcugguccagcggcuggagacgagcaugauccacuggacccgccagaucaaggagaugcucuccgcgcaggagaccguggagaccggcgagaaccuggggccccuggaggagaucgaguucuggcggaaccgcugcauggaccucagcggcaucuccaagcagcuggugaagaagggggucaagcacguggagagcauccugcaccucgccaaguccagcuaccuggcccccuucaugaagcuggcccagcagauccaggacggcagccggcaggcccaguccaaccucacguuccugagcauccugaaggagccguaccaggagcucgcguucaugaagcccaaggacaucuccagcaagcugcccaagcugaucucccucauccgcaucaucugggugaacagcccccacuacaacacccgggagcgccugaccucccuguuccggaagaugagcaacgagaucauccgccucugcugccacgccaucucccuggaccggaucuucgagggcuacgucagcuccagcaaggaggaccugcaggggugcauccucugcugccacgccuggaaggaccacuacgugcaggccgugcagaugcacauccaguucuccagccgcggcuggguccuggaccagaccuccaucuucgcccagguggacgccuucgugcagcgcugcaaggaccugaucgaggucugcgacugccaguaccacuucgcccggugggaggacgggaagcagggcccgcuccccugcuucuucggggcccagggcccccagaucacgcgcaaccugcuggagaucgaggacaucuuccacaagaaccugcacacccuccgggccgugcgcggcgggauccuggacgucaagaacacgugcuggcacgaggacuacaacaaguuccgggcgggcaucaaggaccuggaggugaugacccagaaccucaucaccagcgccuucgagcuggugcgcgacgucccccacggggugcugcuccuggacaccuuccaccggcuggccucccgcgaggccaucaagcggaccuacgacaagaaggccguggaccucuacaugcuguucaacagcgagcuggcgcucgucaaccgcgagcggaacaagaaguggccggaccuggagcccuacguggcccaguacuccggcaaggcccgcugggugcacauccugcggcgccggaucgaccgcgucaugaccugccucgccggggcccacuuccugccccggaucggcacgggcaaggagagcgugcacaccuaccagcagauggugcaggcgaucgacgagcugguccgcaagaccuuccaggaguggaccagcucccucgacaaggacugcauccggcgccuggacacgccgcugcuccgcaucagccaggagaaggccgggaugcuggacgugaacuucgacaaguaccggucccaccuggcccccuuccccuacacgccccuccugcagcugagccaggaguuccacucccaccuccugaccccgcuguucaucauccucagccugucccacaccaucugccugcucagcuccuucuacuucuucuucagcuccuucaucuucgugagcccccaccucccgcccugcuaccagcacuucaacuucaccaccuaccugaagacccagcagaacaagaccaugaucggccaggcccgcuggcugacccccgucauccccgcgcugugggaggccgaggugggggccucccuggagccccggagccuccgcacggccugggccaccuggcagaaccccguguccgcgaagaacaccaagaucagcugggccugguggcacaagccggucguguccgccaccugggagggcgaggucgggggcagccccgagcccggccggcagcgccugcaguga

SEQ ID NO: 29257 - RNA, 12351 nt, Artificial Sequence
  derived and/or modified sequence opt1 from DNAH3__Homo_sapiens__NP_060009
augggggccaccgggcgccuggagcucacccuggccgccccgccccaccccgggcccgccuuccagcggagcaaggcccgcgagacccagggggaggaggaggggagcgagaugcagaucgccaagagcgacagcauccaccacaugagccacucccaggggcagcccgagcugccgccccuccccgccagcgccaacgaggagcccuccggccuguaccagaccgugaugagccacuccuucuacccgccccugaugcagcggaccagcuggacccucgccgcccccuucaaggagcagcaccaccaccgcggccccuccgacagcaucgccaacaacuacucccugauggcccaggaccugaagcucaaggaccugcugaagguguaccagcccgccaccaucagcgugccccgggaccgcaccgggcagggccuccccuccagcgggaaccgguccagcuccgagcccaugcgcaagaagaccaaguucagcagccggaacaaggaggacuccacccgcaucaagcuggccuucaagaccagcaucuucucccccaugaagaaggaggugaagaccagccugaccuuccccggcucccggcccaugagccccgagcagcagcucgacgugaugcugcagcaggagauggagauggaguccaaggagaagaagcccagcgaguccgaccuggagcgcuacuacuacuaccucaccaacgggauccggaaggacaugaucgcccccgaggagggcgaggugauggugcgcaucagcaagcugaucuccaacacccugcucaccagccccuuccuggagccccugaugguggugcucgugcaggagaaggagaacgacuacuacugcucccugaugaaguccaucgucgacuacauccugauggaccccauggagcggaagcgccucuucaucgaguccaucccccggcuguucccccagcgcgugauccgggcccccgugcccuggcacagcgucuaccgcuccgcgaagaaguggaacgaggagcaccuccacaccgugaaccccaugaugcuccggcugaaggagcugugguucgccgaguuccgcgaccuccgcuucgugcggaccgccgagauccuggccggcaagcugccccuccagccgcaggaguucugggacgucauccagaagcacugccuggaggcccaccagacccugcucaacaaguggaucccgaccugcgcgcagcuguucaccagccgcaaggagcacuggauccacuucgcccccaaguccaacuacgacagcagccggaacaucgaggaguacuucgccuccguggccagcuucaugucccugcagcuccgcgagcuggugaucaagagccuggaggaccucgucucccuguucaugauccacaaggacgggaacgacuucaaggagcccuaccaggagaugaaguucuucaucccgcagcugaucaugaucaagcucgaggugagcgagcccaucaucguguucaaccccuccuucgacggcugcugggagcugauccgggacagcuuccuggagaucaucaagaacuccaacgggauccccaagcugaaguacaucccgcucaaguucagcuucaccgccgcggccgccgaccgccagugcgucaaggccgccgagcccggcgagcccuccaugcacgcggccgccacggccauggcggagcugaagggcuacaaccugcuccuggggaccgugaacgccgaggagaagcuggugagcgacuuccucauccagaccuucaaggucuuccagaagaaccaggugggccccugcaaguaccugaacgucuacaagaaguacguggaccugcucgacaacaccgccgagcagaacaucgccgccuuccugaaggagaaccacgacaucgacgacuucgugacgaagaucaacgcgaucaagaagcggcgcaacgagaucgccuccaugaacaucaccgucccgcuggccauguucugccucgacgccaccgcccugaaccacgaccugugcgagcgggcgcagaaccucaaggaccaccugauccaguuccagguggacgugaaccgcgacaccaacacgagcaucugcaaccaguacucccacaucgccgacaaggucagcgaggugcccgccaacaccaaggagcuggugucccucaucgaguuccugaagaaguccagcgccgucaccguguucaagcugcggcgccagcuccgggacgccuccgagcgccuggaguuccugauggacuacgcggaccuccccuaccagaucgaggacaucuucgacaacagccggaaccugcugcuccacaagcgcgaccaggccgagauggaccugaucaagcggugcuccgaguucgagcugcgccucgagggguaccaccgggagcuggagagcuuccgcaagcgcgaggugaugaccacggaggagaugaagcacaacgucgagaagcugaacgagcucuccaagaaccugaaccgggccuucgccgaguucgagcugaucaacaaggaggaggagcuccuggagaaggagaaguccaccuacccccugcuccaggcgaugcugaagaacaaggugccguacgagcagcugugguccaccgccuacgaguucagcaucaaguccgaggaguggaugaacggcccccucuuccugcugaacgccgagcagaucgccgaggagaucgggaacauguggcgcaccacguacaagcucaucaagacccugagcgacgugcccgcgccccggcgccuggcggagaacgucaagaucaagaucgacaaguucaagcaguacaucccgauccucuccaucagcugcaaccccggcaugaaggaccggcacuggcagcagaucuccgagaucgugggcuacgagaucaagcccaccgagacgaccugccugagcaacaugcuggaguucggguucggcaaguucguggagaagcucgagcccaucggggccgccgccuccaaggaguacagccuggagaagaaccuggaccgcaugaagcucgacugggucaacgugacguucuccuucgugaaguaccgggacaccgacaccaacauccugugcgccaucgacgacauccagaugcugcucgacgaccacgucaucaagacccagacgaugugcggcagcccguucaucaagcccaucgaggcggagugccgcaagugggaggagaagcugauccggauccaggacaaccuggacgccuggcucaagugccaggccaccuggcuguaccuggagcccaucuucuccagcgaggacaucaucgcccagaugccggaggaggggcgcaaguucggcaucguggacagcuacuggaagucccucaugagccaggccgugaaggacaaccggauccuggucgcggccgaccagccccgcauggccgagaagcugcaggaggccaacuuccuccuggaggacauccagaagggccugaacgacuaccucgagaagaagcggcuguucuucccccgcuucuucuuccuguccaacgacgagcuccuggagauccugagcgagaccaaggacccccuccgggugcagccgcaccugaagaagugcuucgaggggaucgcgaagcuggaguucaccgacaaccucgagaucgugggcaugaucuccagcgagaaggagacgguccccuucauccagaagaucuaccccgccaacgccaaggggaugguggagaaguggcugcagcaggucgagcagaugaugcuggccuccaugcgcgaggucaucggccucgggaucgaggccuacgugaaggugccccggaaccacuggguccugcaguggccgggccagguggugaucugcgucagcuccaucuucuggacccaggaggugagccaggcgcuggccgagaacacccuccuggacuuccugaagaaguccaacgaccagaucgcccagaucgugcagcucguccgcggcaagcugagcuccggggcccggcugacccucggcgcccugacggugaucgacgugcacgcgcgcgacgucguggccaagcugagcgaggaccggguguccgaccucaacgacuuccaguggaucagccagcugcgcuacuacugggucgccaaggacguccaggugcagaucaucaccaccgaggcccuguacggguacgaguaccugggcaacagcccccgccucgucaucacgccccugacggaccggugcuaccgcacccugaugggcgcccucaagcugaaccugggcggggcgcccgaggggccggccggcaccgggaagaccgagacgaccaaggaccucgccaaggcccuggccaagcagugcgugguguucaacugcagcgacggccuggacuacaaggcgaugggcaaguucuucaaggggcucgcccaggccggcgccugggcgugcuucgacgaguucaaccggaucgaggucgaggugcuguccgucguggcccagcagauccugagcauccagcaggccaucauccgcaagcucaagaccuucaucuucgaggggaccgagcugagccugaaccccacgugcgccguguucaucaccaugaaccccggcuacgccgggcgggcggagcuccccgacaaccugaaggcccuguuccgcaccgucgccaugauggugccggacuacgcccucaucggcgagaucucccuguacagcaugggcuuccuggacucccggagccucgcccagaagaucguggcgaccuaccgccugugcuccgagcagcugagcucccagcaccacuacgacuacgggaugcgggccgucaagagcgugcucacggccgccggcaaccugaagcugaaguaccccgaggagaacgaguccgugcuccugcugcgcgcccuccuggacgucaaccuggcgaaguuccucgcccaggacgugccccuguuccaggggaucaucagcgaccuguuccccggcgugguccucccgaagcccgacuacgagguguuccugaaggugcugaacgacaacaucaagaagaugaagcuccagcccguccccugguucaucgggaagaucauccagaucuacgagaugaugcuggugcggcacggcuacaugaucgugggcgacccgaugggcgggaagaccuccgccuacaagguccuggccgcggcccucggggaccugcacgccgccaaccagauggaggaguucgccguggaguacaagaucaucaaccccaaggcgaucaccaugggccagcuguacgggugcuucgaccaggugagccacgaguggauggacggcguccucgccaacgccuuccgcgagcaggccuccagccuguccgacgaccggaaguggaucaucuucgacggccccguggacgccaucuggaucgagaacaugaacaccgugcuggacgacaacaagaagcucugccugaugagcggggagaucauccagaugaacuccaagaugagccugaucuucgagcccgcggaccucgagcaggccuccccggccacggucagccgcugcggcaugaucuacauggagccccaccagcugggguggaagccccugaaggacagcuacauggacacccucccguccagccugaccaaggagcacaaggagcuggugaacgacauguucauguggcucgugcagcccugccuggaguucggccggcugcacugcaaguucgucgugcagaccucccccauccaccucgccuucagcaugaugcgccuguacuccagccugcucgacgagauccgggccguggaggaggaggagauggagcugggcgaggggcuguccagccagcagaucuuccucuggcugcagggccuguuccucuucucccuggucuggacgguggcggggaccaucaacgccgacagccgcaagaaguucgacguguucuuccggaaccugaucaugggcauggacgacaaccacccccgcccgaaguccgucaagcucaccaagaacaacaucuuccccgagcgcgggagcaucuacgacuucuacuucaucaagcaggccuccggccacugggagaccuggacccaguacaucacgaaggaggaggagaaggugcccgccggcgcgaaggugagcgagcugaucauccccaccauggagaccgcccggcaguccuucuuccugaagaccuaccucgaccacgagaucccgaugcuguucgucgggcccacgggcaccggcaagagcgccaucaccaacaacuuccugcuccaccuccccaagaacaccuaccugcccaacugcaucaacuucuccgcccgcacgagcgccaaccagacccaggacaucaucauguccaagcucgaccggcgccggaagggccuguucgggccgcccaucggcaagaaggcggugguguucgucgacgaccugaacaugcccgccaaggagguguacggcgcccagcccccgaucgagcuccugcgccaguggaucgaccacggguacugguucgacaagaaggacaccacccggcuggacaucguggacaugcuccuggucacggccaugggcccgcccgggggcgggcgcaacgacaucaccggccgguucacccgccaccugaacaucaucagcaucaacgccuucgaggacgacauccucaccaagaucuucagcuccaucguggacuggcacuucggcaagggguucgacgugauguuccugcgguacggcaagaugcugguccaggcgacgaagaccaucuaccgcgacgccguggagaacuuccuccccacccccagcaagucccacuacguguucaaccugcgggacuucagccgcgucauccagggggugcugcucugcccccacacccaccuccaggacguggagaagugcauccggcuguggauccacgaggucuaccgcguguucuacgaccggcucaucgacaaggaggaccgccaggucuucuucaacauggugaaggagacgaccuccaacugcuucaagcagaccaucgagaaggugcugauccaccugagccccaccggcaagaucgucgacgacaacauccggucccuguucuucggcgacuacuucaagcccgagagcgaccagaagaucuacgacgagaucacggaccucaagcagcugaccguggugauggagcacuaccuggaggaguucaacaacaucuccaaggccccgaugagccucgucauguuccgcuucgccaucgagcacaucucccggaucugccgcgugcugaagcaggacaaggggcaccuccugcuggugggcaucgggggcagcgggcgccaguccgccgcgaagcugagcaccuucaugaacgccuacgagcuguaccagaucgagaucaccaagaacuacgccggcaacgacuggcgggaggaccugaagaagaucauccugcaggucggcguggccacgaaguccaccguguuccucuucgccgacaaccagaucaaggacgagagcuucgucgaggacaucaacaugcugcugaacaccggggacgugcccaacaucuuccccgcggacgagaaggccgacaucguggagaagaugcagaccgccgcccgcacgcagggcgagaaggucgaggugacgccccuguccauguacaacuucuucaucgagcgggugaucaacaagaucagcuucucccuggcgaugagcccgaucggggacgccuuccgcaaccggcugcgcauguuccccagccucaucaacugcugcaccaucgacugguuccaguccuggcccaccgacgcccuggagcuggucgccaacaaguuccucgaggacguggagcuggacgacaacauccggguggaggucgugagcaugugcaaguacuuccaggaguccgugaagaagcugagccucgacuacuacaacaagcugcgccggcacaacuacgucacgccgaccuccuaccuggagcucauccugaccuucaagacccugcucaacagcaagcgccaggagguggccaugaugcggaaccgcuaccugaccggccugcagaagcucgacuucgcggccucccagguggccgucaugcagcgggagcugacggcccugcagccccagcucauccugaccagcgaggagaccgccaagaugauggugaagaucgaggcggagacccgcgaggccgacgggaagaagcugcucgugcaggccgacgagaaggaggccaacgucgccgcggccaucgcccagggcaucaagaacgagugcgagggcgaccuggccgaggcgaugcccgcccuggaggccgcccucgccgcgcuggacacgcugaaccccgccgacaucucccucgucaagagcaugcagaacccgcccgggcccgugaagcuggucauggaguccaucugcaucaugaagggcaugaagcccgagcggaagccggaccccagcggguccggcaagaugaucgaggacuacuggggcgugagcaagaagauccugggcgaccucaaguuccuggagucccugaagaccuacgacaaggacaacaucccgccccugaccaugaagcgcauccgggagcgcuucaucaaccacccggaguuccagcccgccgugaucaagaacgucagcuccgccugcgagggccugugcaagugggugcgggccauggagguguacgaccgcgucgcgaaggugguggcccccaagcgcgagcggcugcgcgaggccgaggggaagcucgccgcccagaugcagaagcugaaccagaagcgggcggagcugaagcucgucguggaccgccugcaggcccugaacgacgacuucgaggagaugaacaccaagaagaaggaccucgaggagaacaucgagaucugcagccagaagcuggugcgggccgagaagcugaucagcggccucgggggcgagaaggaccgcuggacggaggccgcgcggcagcuggggauccgcuacaccaaccugaccggcgacguccuccuguccagcggcaccguggccuaccugggggccuucacgguggacuaccggguccagugccagaaccaguggcucgccgagugcaaggacaaggugauccccggcuucuccgacuucagccugucccacacccugggggacccgaucaagauccgcgccuggcagaucgcgggccuccccguggacagcuucuccaucgacaacggcaucaucgucagcaacucccggcgcugggcccugaugaucgacccccacgggcaggccaacaaguggaucaagaacauggagaaggccaacaagcuggccgugaucaaguucagcgacuccaacuacaugcggaugcucgagaacgcgcugcagcugggcacccccguccucaucgagaacaucggggaggagcuggacgccagcaucgagccgauccugcucaaggccaccuucaagcagcagggcguggaguacaugcgccugggggagaacaucaucgaguacucccgggacuucaagcuguacaucacgacccgccuccggaacccccacuaccugcccgagguggccgucaaggugugccugcucaacuucaugaucacgccccugggccugcaggaccagcuccugggcaucguggccgcgaaggagaagccggagcuggaggagaagaagaaccagcucaucgucgagagcgccaagaacaagaagcaccugaaggagaucgaggacaagauccuggaggugcucuccaugagcaaggggaacauccuggaggacgagaccgccaucaaggugcuguccagcuccaagguccugagcgaggagaucagcgagaagcagaagguggccuccaugacggagacccagaucgacgagacccgcaugggcuacaagcccguggccguccacagcgcgaccaucuucuucugcaucuccgaccucgccaacaucgagcccauguaccaguacagccugacgugguucaucaaccuguacaugcacucccucacccacagcaccaaguccgaggagcugaaccugcggaucaaguacaucaucgaccacuucacccucagcaucuacaacaacgugugccgcucccuguucgagaaggacaagcuccuguucagccugcugcucacgaucgggaucaugaagcagaagaaggagaucaccgaggaggugugguacuuccugcugaccggcgggaucgcccucgacaacccguaccccaaccccgcgccccaguggcuguccgagaaggcgugggccgagaucguccgggccagcgcccugccgaagcuccacggccugauggagcaccuggagcagaaccucggcgaguggaagcugaucuacgacuccgccuggccccacgaggagcagcugcccgggagcuggaaguucucccagggccucgagaagauggugauccugcgcugccugcgccccgacaagauggugccggcgguccgggaguucaucgccgagcacauggggaagcucuacaucgaggcccccaccuucgaccugcagggcagcuacaacgacuccagcugcugcgcgccccugaucuucgugcucucccccagcgccgacccgauggcggggcugcugaaguucgccgacgaccucggcaugggcgggacgcgcacccagaccaucagccugggccaggggcagggccccaucgccgccaagaugaucaacaacgccaucaaggacgggaccugggugguccugcagaacugccaccucgcggccuccuggaugcccacgcuggagaagaucugcgaggaggugaucgugcccgagagcaccaacgcccgguuccgccuguggcucaccuccuacccgagcgagaaguuccccgucuccauccugcagaacggcaucaagaugaccaacgagccgcccaagggccugcgggccaaccuccugcgcagcuaccugaacgacccgaucuccgaccccguguucuuccagagcugcgcgaaggccgugauguggcagaagaugcuguucgggcugugcuucuuccacgccgucgugcaggagcggcgcaacuucggcccccugggguggaacauccccuacgaguucaacgaguccgaccuccggaucagcauguggcagauccagauguuccugaacgacuacaaggaggugccguucgacgcccugacguaccucaccggcgagugcaacuacggcgggcgcgucaccgacgacaaggaccggcgccugcugcucucccugcugagcauguucuacugcaaggagaucgaggaggacuacuacucccucgcccccggcgacaccuacuacaucccgccccacgggagcuaccaguccuacaucgacuaccugcggaaccugccgaucaccgcgcaccccgagguguucggccuccacgagaacgccgacaucacgaaggacaaccaggagaccaaccagcuguucgagggggugcugcucacccugccccgccagagcggcggcuccggcaagagcccgcaggaggucguggaggagcuggcccaggacauccucuccaagcugccccgggacuucgaccuggaggaggugaugaagcucuaccccgucguguacgaggagagcaugaacaccgugcugcgccaggagcugauccgguucaaccgccucacgaaggucgugcggcgcagccugaucaaccugggccgcgccaucaagggccaggugcucauguccagcgagcuggaggaggucuucaacuccaugcuggugggcaaggugcccgccaugugggcggccaagagcuacccgucccucaagccccucggcggguacgucgccgaccugcucgcccggcugaccuucuuccaggaguggaucgacaaggggccgcccgugguguucuggaucagcggguucuacuucacccaguccuuccugaccggggucagccagaacuacgcccgcaaguacacgaucccgaucgaccacaucggguucgaguucgaggugacgccccaggagaccgugauggagaacaaccccgaggacggcgcguacaucaagggccucuuccuggagggcgcccggugggaccgcaagaccaugcagaucggcgagucccugcccaagauccucuacgacccgcugcccaucaucuggcugaagcccggggagagcgccauguuccuccaccaggacaucuacgucugccccguguacaagacguccgcccggcgcggcacccugagcaccaccgggcacuccacgaacuacguccugagcaucgagcucccgaccgacaugccccagaagcacuggaucaaccggggcguggccucccugugccagcuggacaacuga

SEQ ID NO: 29258 - RNA, 13875 nt, Artificial Sequence
  derived and/or modified sequence opt1 from DNAH5__Homo_sapiens__NP_001360
auguuccggaucggccggcgccagcuguggaagcacagcgugacccgggugcucacccagcgccugaagggggagaaggaggccaagcgggcccugcucgacgcccgccacaacuaccuguucgccaucguggccagcugccuggaccucaacaagaccgagguggaggacgccauccuggagggcaaccagaucgagcggaucgaccagcuguucgccgucgggggccuccgccaccugauguucuacuaccaggacguggaggaggccgagaccgggcagcugggcagccucggcggggugaaccuggugagcggcaagaucaagaagcccaagguguucgugaccgaggggaacgacguggcccugaccggcgugugcguguucuucauccggaccgaccccagcaaggccaucacccccgacaacauccaccaggaggucagcuucaacaugcucgacgccgccgacgggggccugcugaacagcgugcgccggcuccuguccgacaucuucauccccgcccugcgcgccaccagccacggcuggggcgagcucgagggccugcaggacgccgccaacauccggcaggaguuccuguccagccucgagggguucgugaacguccuguccggcgcgcaggagagccugaaggagaaggugaaccuccgcaagugcgacauccuggagcugaagacccucaaggagcccacggacuaccugacccuggccaacaaccccgagacccucggcaagaucgaggacugcaugaagguguggaucaagcagaccgagcagguccuggccgagaacaaccagcugcucaaggaggccgacgacguggggccccgggccgagcuggagcacuggaagaagcgccuguccaaguucaacuaccuccuggagcagcucaagucccccgacgugaaggcgguccucgccgugcuggccgccgccaaguccaagcugcucaagacguggcgggagauggacauccgcaucaccgacgcgaccaacgaggccaaggacaacgugaaguaccuguacacccuggagaagugcugcgacccccucuacagcuccgacccccugagcaugauggacgccauccccacgcugaucaacgccaucaagaugaucuacuccaucagccacuacuacaacaccagcgagaagaucaccucccuguucgucaaggugaccaaccagaucaucagcgccugcaaggcguacaucacgaacaacggcaccgccuccaucuggaaccagccccaggacgucguggaggagaagauccucagcgccaucaagcugaagcaggaguaccagcugugcuuccacaagaccaagcagaagcucaagcagaaccccaacgccaagcaguucgacuucuccgagauguacaucuucgggaaguucgagaccuuccaccggcgccuggcgaagaucaucgacaucuucacgacccugaagaccuacagcgugcuccaggacuccaccaucgagggccuggaggacauggccacgaaguaccaggggaucgucgccaccaucaagaagaaggaguacaacuuccuggaccagcggaagauggacuucgaccaggacuacgaggaguucugcaagcagaccaacgaccuccacaacgagcugcgcaaguucauggacgugaccuucgccaagauccagaacacgaaccaggcccugcgcaugcucaagaaguucgagcggcugaacaucccgaaccugggcaucgacgacaaguaccagcucauccuggagaacuacggcgcggacaucgacaugaucagcaagcuguacaccaagcagaaguacgacccgccccuggcccgcaaccagcccccgaucgccgggaagauccugugggcccggcagcuguuccaccgcauccagcagcccaugcagcuguuccagcagcaccccgccgugcuguccaccgcggaggccaagcccaucauccggagcuacaaccgcauggccaagguccugcucgaguucgaggugcuguuccaccgggccuggcugcgccagaucgaggagauccacgugggccucgaggccucccugcuggucaaggcgccggggaccggcgagcuguucgugaacuucgacccccagauccugauccuguuccgggagacggagugcauggcccagauggggcucgaggugagcccccuggccaccucccuguuccagaagcgcgaccgguacaagcgcaacuucagcaacaugaagaugaugcucgccgaguaccagcgggucaaguccaagauccccgcggccaucgagcagcugaucgugccgcaccuggccaagguggacgaggcccuccagcccggccuggccgcgcugaccuggaccagccucaacaucgaggccuaccuggagaacaccuucgccaagaucaaggaccuggagcuccugcuggaccgcgucaacgaccucaucgaguuccggaucgacgccauccuggaggagauguccagcacgccccugugccagcucccccaggaggagccgcugaccugcgaggaguuccugcagaugaccaaggaccucugcgugaacggcgcccagauccugcacuucaaguccagccugguggaggaggcggucaacgagcucgugaacaugcugcuggacguggagguccucagcgaggaggaguccgagaagaucagcaacgagaacuccgugaacuacaagaacgagagcuccgccaagcgcgaggaggggaacuucgacacccugacgagcuccaucaacgcccgggccaacgcccugcuccugaccaccgugacccgcaagaagaaggagacggagaugcugggcgaggaggcgcgggagcuccugagccacuucaaccaccagaacauggacgcccugcucaaggucacccgcaacacccuggaggccauccgcaagcggauccacuccagccacaccaucaacuuccgcgacuccaacagcgccuccaacaugaagcagaacagccugcccaucuuccgggcguccgugacgcucgccauccccaacaucgugauggccccggcccuggaggacguccagcagacccugaacaaggccguggagugcaucaucagcgugcccaaggggguccgccagugguccagcgagcuccugagcaagaagaagauccaggagcggaagauggcggcccugcaguccaacgaggacagcgacuccgacguggagaugggcgagaacgagcuccaggacacccuggagaucgccagcgugaaccugcccauccccguccagaccaagaacuacuacaagaacguguccgagaacaaggagaucgugaagcucgucagcgugcuguccacgaucaucaacagcaccaagaaggaggugaucaccuccauggacugcuucaagcgcuacaaccacaucuggcagaaggggaaggaggaggccaucaagaccuucaucacgcagagcccgcugcucuccgaguucgagagccagauccuguacuuccagaaccuggagcaggagaucaacgccgagcccgaguacgucugcgugggcuccaucgcgcucuacaccgccgaccugaaguucgcccugaccgccgagaccaaggccuggaugguggucaucggccggcacugcaacaagaaguaccgcagcgagauggagaacaucuucaugcucaucgaggaguucaacaagaagcugaaccggcccaucaaggaccuggacgacauccgcaucgcgauggccgcccucaaggagauccgggaggagcagaucuccaucgacuuccagguggggcccaucgaggagagcuacgcccugcugaaccgcuacggccugcucaucgcccgggaggagaucgacaagguggacacgcugcacuacgcgugggagaagcugcucgcccgcgccggggagguccagaacaagcuggugucccugcagccgagcuucaagaaggagcucaucuccgccguggaggucuuccugcaggacugccaccaguucuaccuggacuacgaccucaacggccccauggcgagcggccugaagccccaggaggccagcgaccggcugaucauguuccagaaccaguucgacaacaucuaccgcaaguacaucaccuacaccgggggcgaggagcuguucgggcugcccgccacccaguacccgcagcugcucgagaucaagaagcagcugaaccugcuccagaagaucuacacgcuguacaacuccgugaucgagaccgugaacagcuacuacgacauccugugguccgaggucaacaucgagaagaucaacaacgagcuccuggaguuccagaaccggugccgcaagcugccccgggcccucaaggacuggcaggccuuccuggaccugaagaagaucaucgacgacuucagcgagugcugcccccuccuggaguacauggcguccaaggccaugauggagcgccacugggagcggaucaccacccugacgggccacagccucgacguggggaacgaguccuucaagcugcgcaacaucauggaggcgccccuccucaaguacaaggaggagaucgaggacaucugcaucagcgccgucaaggagcgcgacaucgagcagaagcugaagcaggucaucaacgagugggacaacaagaccuucaccuucggcuccuucaagacccggggcgagcugcuccugcgcggggacagcacguccgagaucaucgccaacauggaggacagccugaugcuccugggcucccugcucagcaaccgguacaacaugccguucaaggcgcagauccagaagugggugcaguaccuguccaacagcaccgacaucaucgaguccuggaugaccguccagaaccuguggaucuaccucgaggccguguucgucggcggggacaucgccaagcagcugcccaaggaggccaagcgcuucagcaacaucgacaaguccugggucaagaucaugacccgggcccacgaggugcccagcgugguccagugcugcgugggggacgagacccuggggcagcuccugccccaccuccuggaccagcuggagaucugccagaagucccugacgggcuaccucgagaagaagcgccugugcuucccgcgguucuucuucguguccgaccccgcgcugcucgagauccuggggcaggccagcgacucccacaccauccaggcccaccuccugaacgucuucgacaacaucaagagcgugaaguuccacgagaagaucuacgaccgcauccuguccaucagcucccaggagggcgagaccaucgagcuggacaagcccgugauggccgaggggaacgucgagguguggcucaacagccugcuggaggagucccagagcucccuccaccuggugauccggcaggcggccgccaacauccaggagaccggcuuccagcugacggaguuccucagcuccuuccccgcccaggucgggcugcugggcauccagaugaucuggacccgcgacagcgaggaggcccuccggaacgcgaaguucgacaagaagaucaugcagaagaccaaccaggccuuccuggagcugcucaacacccugaucgacgugacgacccgcgaccuguccagcaccgagcgggugaaguacgagacccucaucacgauccacguccaccagcgcgacaucuucgacgaccugugccacaugcacaucaaguccccgauggacuucgaguggcugaagcagugccgguucuacuucaacgaggacagcgacaagaugaugauccacaucaccgacguggccuucaucuaccagaacgaguuccucggcugcaccgaccgccuggugaucacgccccugacggaccggugcuacaucacccucgcccaggcccuggggauguccaugggcggggcgcccgccggcccggccgggaccggcaagaccgagacgaccaaggacaugggccgcugccuggggaaguacgucgugguguucaacugcagcgaccagauggacuuccggggccucgggcgcaucuucaagggccuggcccagagcggcuccugggggugcuucgacgaguucaaccgcaucgaccugcccguccucagcguggccgcgcagcagaucuccaucauccugaccugcaagaaggagcacaagaaguccuucaucuucaccgacggcgacaacgugacgaugaaccccgaguucgggcuguuccucaccaugaaccccggcuacgccgggcggcaggagcugccggagaaccugaagaucaacuuccgcuccgucgccaugauggugcccgaccggcagaucaucauccgcgugaagcucgccagcugcggcuucaucgacaacgucgugcuggcgcggaaguucuucacccuguacaagcucugcgaggagcagcuguccaagcagguccacuacgacuucggccugcgcaacauccugagcguccuccggacccugggggccgccaagcgcgccaaccccauggacacggaguccaccaucgugaugcgggugcugcgcgacaugaaccucagcaagcugaucgacgaggacgagccccuguuccucucccugaucgaggaccuguucccgaacauccuccuggacaaggccggcuaccccgagcuggaggcggccaucagccggcaggucgaggaggccgggcucaucaaccacccgcccuggaagcugaaggugauccagcuguucgagacccagcgcgugcggcacggcaugaugacccucgggccguccggcgccggcaagacgaccugcauccacacccugaugcgcgccaugaccgacugcgggaagccccaccgggagaugcgcaugaaccccaaggcgaucacggcgccccagauguucggccggcuggacgucgccaccaacgacuggaccgacgggaucuucagcacccucuggcgcaagacccugcgggccaagaagggcgagcacaucuggaucauccuggacgggccgguggacgccaucuggaucgagaaccucaacuccgugcuggacgacaacaagacgcugacccucgcgaacggcgaccgcauccccauggcccccaacugcaagaucaucuucgagccccacaacaucgacaacgccagcccggccaccgucucccggaacggcaugguguucaugagcuccagcauccuggacuggagccccauccuggagggguuccucaagaagcgcagcccccaggaggccgagauccugcgccagcuguacaccgagagcuuccccgaccucuaccgguucugcauccagaaccuggaguacaagauggaggugcuggaggcguucgucaucacgcaguccaucaacaugcuccagggccugaucccgcugaaggagcagggcggggaggugagccaggcccaccucggccgccuguucguguucgcccugcucugguccgccggggcggcccuggagcuggacggccggcgccggcucgagcuguggcugcgcagccggcccaccgggacccucgagcugccgccgcccgccggccccggggacaccgccuucgacuacuacgucgcccccgacggcacguggacccacuggaacacccgcacccaggaguaccuguaccccuccgacacgacccccgaguacggcagcauccucgugcccaacgucgacaacgugcggaccgacuuccugauccagaccaucgcgaagcaggggaaggccgugcugcucaucggcgagcaggggacggccaagaccgucaucaucaagggcuucauguccaaguacgaccccgagugccacaugaucaagagccugaacuucuccagcgccaccaccccgcugauguuccagcgcacgaucgaguccuacguggacaagcggauggggaccaccuacgggccgcccgccggcaagaagaugaccguguucaucgacgacgucaacaugcccaucaucaacgaguggggcgaccaggugacgaacgagaucgugcgccagcucauggagcagaacggcuucuacaaccuggagaagccgggggaguucaccagcaucgucgacauccaguuccuggcggccaugauccaccccggcgggggccggaacgacaucccccagcgccucaagcggcaguucuccaucuucaacugcacccugcccagcgaggccuccguggacaagaucuucggcgugaucggggucggccacuacugcacccagcgcggguucagcgaggaggugcgggacuccgugacgaagcuggucccgcucacccgccggcuguggcagaugaccaagaucaagaugcugcccacccccgccaaguuccacuacguguucaaccuccgcgaccugagccgcguguggcagggcaugcugaacacgaccagcgaggucaucaaggagcccaacgaccuccugaagcuguggaagcacgagugcaagcgggugaucgccgaccgcuucaccguguccagcgacgucaccugguucgacaaggcgcucgugucccugguggaggaggaguucggggaggagaagaagcugcucgucgacugcggcaucgacacguacuucguggacuuccugcgggacgccccggaggccgccggcgagaccagcgaggaggcggacgccgagacccccaagaucuacgagcccaucgaguccuucagccaccugaaggagcgccucaacauguuccugcagcuguacaacgaguccauccgcggggccggcauggacaugguguucuucgccgacgccaugguccaccucgugaagaucagccgcgugauccggacgccccaggggaacgcgcugcuggucggcgugggcggguccggcaagcagagccucacgcgccuggccuccuucaucgccggguacgugagcuuccagaucacccugacccgguccuacaacaccagcaaccucauggaggaccugaagguccuguaccgcaccgccggccagcaggggaagggcaucacguucaucuucaccgacaacgagaucaaggacgaguccuuccucgaguacaugaacaacgugcugagcuccggcgaggugagcaaccuguucgcccgggacgagaucgacgagaucaacagcgaccucgcguccgucaugaagaaggaguucccgcgcugccugcccaccaacgagaaccugcacgacuacuucaugagccgggugcgccagaaccuccacaucgugcugugcuucucccccgucggggagaaguuccggaaccgcgcccugaaguuccccgcccucaucagcggcugcaccaucgacugguucucccgguggccgaaggacgcccugguggccgugagcgagcacuuccugacguccuacgacaucgacugcagccuggagaucaagaaggaggucgugcagugcaugggguccuuccaggacggcguggcggagaagugcgucgacuacuuccagcgcuuccggcgcagcacccacgugacccccaaguccuaccucagcuucauccagggguacaaguucaucuacggcgagaagcacguggagguccggacccuggccaaccgcaugaacacgggccuggagaagcucaaggaggccuccgagagcguggccgcgcuguccaaggagcuggaggccaaggagaaggagcuccagguggccaacgacaaggccgacaugguccugaaggaggugaccaugaaggcccaggcggccgagaaggucaaggccgaggugcagaaggugaaggaccgcgcccaggccaucgucgacagcaucuccaaggacaaggcgaucgccgaggagaagcuggaggccgccaagcccgcccucgaggaggcggaggccgcccugcagaccauccggcccagcgacaucgccaccgugcgcacgcuggggcggccgccccaccucaucaugcgcaucauggacugcgugcugcuccucuuccagcggaaggucuccgccgugaagaucgaccuggagaaguccugcaccaugcccagcuggcaggagucccugaagcucaugaccgcgggcaacuuccugcagaaccugcagcaguucccgaaggacaccaucaacgaggaggugaucgaguuccucagccccuacuucgagaugcccgacuacaacaucgagacggccaagcgcgucugcgggaacguggccggccugugcuccuggaccaaggccauggcgagcuucuucuccaucaacaaggaggugcugccccucaaggccaaccuggucgugcaggagaaccggcaccuccucgccaugcaggaccugcagaaggcccaggccgagcuggacgacaagcaggcggagcucgacgugguccaggccgaguacgagcaggccaugaccgagaagcagacccugcuggaggacgccgagcgcugccggcacaagaugcagacggccagcacccucaucuccgggcuggcgggcgagaaggagcgcuggaccgagcagagccaggaguucgccgcccagaccaagcggcuggugggcgacgugcuccuggccacggccuuccuguccuacagcgggccguucaaccaggaguuccgcgaccuccugcugaacgacuggcggaaggagaugaaggcgcgcaagauccccuucggcaagaaccucaaccuguccgagaugcugaucgacgcccccaccaucagcgaguggaaccuccaggggcugcccaacgacgaccuguccauccagaacggcaucaucgucaccaaggccagccgguacccgcuccugaucgacccccagacccaggggaagaucuggaucaagaacaaggagucccgcaacgagcugcagaucacgagccucaaccacaaguacuuccggaaccaccuggaggacucccugagccucggccgcccccugcugaucgaggacgugggcgaggagcucgaccccgcccuggacaacgugcuggagcggaacuucaucaagaccggguccaccuucaaggucaaggugggcgacaaggagguggacguccucgacggguuccgccuguacaucaccacgaagcugccgaaccccgcguacacccccgagaucagcgcccgcaccagcaucaucgacuucaccgugacgaugaagggccucgaggaccagcugcugggccgggugauccucaccgagaagcaggagcuggagaaggagcgcacccaccugauggaggacgucaccgccaacaagcggcgcaugaaggagcucgaggacaaccugcuguaccggcucaccuccacgcaggggagccugguggaggacgagucccugaucgugguccucagcaacaccaagcgcaccgccgaggaggugacccagaagcuggagaucuccgccgagacggaggugcagaucaacagcgcgcgggaggaguaccgccccgucgccacccggggcuccauccuguacuuccucaucaccgagaugcgccuggugaacgagauguaccagaccagccugcggcaguuccucgggcuguucgaccugucccucgcccgcagcgugaaguccccgaucacgagcaagcggaucgccaacaucaucgagcacaugaccuacgaggucuacaaguacgccgcgcgcggccuguacgaggagcacaaguuccuguucacccuccugcugacccucaagaucgacauccagcggaaccgcgugaagcacgaggaguuccugacgcugaucaagggcggggccucccucgaccugaaggccugcccgcccaagcccagcaaguggauccuggacaucaccuggcugaaccucguggagcuguccaagcugcggcaguucagcgacguccucgaccagaucucccgcaacgagaagauguggaagaucugguucgacaaggagaacccggaggaggagccccugcccaacgccuacgacaagagccuggacugcuuccggcgccuccugcugauccgguccuggugccccgaccgcaccaucgcccaggcgcgcaaguacaucguggacagcaugggcgagaaguacgccgagggggugauccucgaccuggagaagaccugggaggagagcgacccgcggacgccccugaucugccuccuguccaugggcagcgaccccaccgacuccaucaucgcccuggggaagcgccucaagaucgagacccgguacgucagcaugggccaggggcaggaggugcacgcccgcaagcugcugcagcagaccauggccaacggcggcugggcgcuccugcagaacugccaccuggggcucgacuucauggacgagcugauggacaucaucaucgagacggagcuggugcacgacgccuuccggcucuggaugaccaccgaggcccacaagcaguucccgaucacccugcugcagauguccaucaaguucgccaacgacccgccccagggccuccgcgcggggcugaagcggacguacagcggcgucucccaggaccugcucgacgugagcuccgggagccaguggaagcccaugcuguacgccguggccuuccugcacuccaccguccaggagcgccggaaguucggcgcccucggcuggaacaucccguacgaguucaaccaggccgacuucaacgcgaccgugcaguucauccagaaccaccuggacgacauggacgugaagaagggggucagcuggaccacgauccgcuacaugaucggcgagauccaguacgggggccgggugaccgacgacuacgacaagcgccugcucaacaccuucgccaaggucugguucuccgagaacauguucggccccgacuucagcuucuaccagggguacaacauccccaagugcuccaccguggacaacuaccugcaguacauccagagccugcccgccuacgacuccccggagguguucggccuccaccccaacgccgacaucacguaccagagcaagcuggccaaggacguccuggacaccauccucgggauccagcccaaggacaccuccggcgggggcgacgagacccgggaggcggugguggcccgccuggccgacgacaugcuggagaagcucccgcccgacuacguccccuucgaggugaaggagcggcugcagaagaugggccccuuccagcccaugaacaucuuccugcgccaggagaucgaccggaugcagcgcgugcucagccugguccggagcacgcugaccgagcucaagcuggccaucgacgggaccaucaucauguccgagaaccugcgcgacgcccucgacugcauguucgacgcgcgcauccccgccugguggaagaaggccagcuggaucuccagcacccugggcuucugguucaccgagcugaucgagcggaacucccaguucacgagcuggguguucaacgggcgcccccacugcuucuggaugaccggcuucuucaacccccagggguuccucaccgccaugcggcaggagaucacccgcgcgaacaagggcugggcccuggacaacauggugcugugcaacgaggucacgaaguggaugaaggacgacaucuccgcgccgcccaccgagggcguguacguguacgggcucuaccuggagggcgccgggugggacaagcggaacaugaagcugaucgagagcaagcccaagguccucuucgagcugaugcccgugauccgcaucuacgccgagaacaacacccugcgggacccccgcuucuacuccugccccaucuacaagaagcccgugcggaccgaccucaacuacaucgcggccgucgaccugcgcacggcccagacccccgagcacugggugcugcggggcguggcccuccugugcgacgucaaguga

SEQ ID NO: 29259 - RNA, 12477 nt, Artificial Sequence
  derived and/or modified sequence opt1 from DNAH6__Homo_sapiens__NP_001361
augaccuuccgcgccaccgacagcgaguucgaccugaccaacaucgaggaguacgccgagaacagcgcccucagccggcugaacaacaucaaggccaagcagcgcguguccuacgugaccagcaccgagaacgaguccgacacccagauccugaccuuccggcacaucaccaaggcccaggagaagacccgcaagcggcagcagcccaucaagcucgagccccugcccgugcugaagguguaccaggaccacaagcagcccgaguacauccacgagcagaaccgcuuccagcucaugaccgccggcaucaucaagcggcccgugagcaucgccaagaaguccuucgcgaccagcuccacccaguuccuggagcaccaggacgccgugaagaagaugcagauccaccgccccuacguggagguguucagccccagcccgcccaagcugccccacaccgggaucggcaagcgggggcuguucggcacccgcagcuccgccuaccccaaguacacguuccacgaccgggaggagguggugaaggccaacauccgcgacccccugcagaucaucaagaucauccgggagaacgagcaccugggguuccucuacaugauccccgcggucccccgcagcuccaucgaguacgacaccuacaaccugaagguggugagcuacgagaacaucaacaagaacgacuacuacaccaucucccagcgggccgucacccacaucuacaacgaggacaucgaguucaucgagaucgaccgcugggagcaggaguaccuguaccaccgggagcucacgaagauccccaucuucagccuguuccgcaaguggaaggccuucuccguguggcggaagaacgugcgcagcaagaagaucaccggcugccagaagucccugcagaagaaccucuucaucgucaacccccaccuccgccccgcccugcucaagaucaacgagcugugcuaccaccugagcuucaugggccucugcuacaucgagaagugccacaccuacacccugcaggaguucaaggccgcccaggugauccgccuggcggaggugacggagcgccucggggaguuccggaacgaggccaaguacgucgugcgccgggccugccgcuucgcccugcgggcggccggcuucgugcccgacgacugcgccuucgggcccuucgaggacuaccacaagguccagagcuccggcagcuucaucaacacgccccacgagcugcccaccuacggggacuccgagaagaugaccuacacggagcaggccagcaagcgccacuacugcaugcggcugaccugcuucauccgccucaacgacuaccugaucgagaacaccaugcacauccucaccgugaacgccgugaacucccugcugaaccaccucacggacaagcugaagcggaccccgagcgcggacgucauccagaaguggaucaccgaggagaagcccgaggugcccgacaagaagggcacccugauggucgagaagcaggaggaggacgagucccucauccccauguuccugacggagcugaugcucaccgugcagagccugcuguucgagcccucccucgaggacuuccuggacggcauccugggggccgugaaccacugccagaacaccguccucagcgugcccaaccuggugcccgacuccuacuucgacgccuucaccagccccuacaucaacaacaagcuggagggcaagacgugcgggaccggcccgucccuggccgccgucuucgaggacgacaagaacuuccacaccaucaucagccagaucaaggagaccauccaggcggccuucgaguccgcccgcaucuacgccgcgaccuucgagaaguuccagaucuucuucaaggagaacgagagccucgaccugcaggcccugaagcuccaggagcccgacaucaacuucuucuccgagcagcuggagaaguaccacaagcagcacaaggacgccguggcccugcggcccacgcgcaacgugggccuccugcugaucgacacccggcuccugcgcgagaagcugaucccgagcccccuccggugccuggagguccugaacuucaugcucccccgccagagcaagaagaagguggacgccaucaucuucgaggcgcaggacgccgaguacaagcuggaguucgugcccaccaccacgaccgaguacguccacucccuccuguuccuggacgagauccaggagcggaucgagagccuggaggacgaggggaacaucgugacccagauguacaagcucauggagcaguaccaggugccgacgccgcccgaggacuucgccgucuucgccacgaugaagcccuccaucguggccgugcgcaacgcgaucgacaagagcgucggcgaccgggaguccagcaucaagcaguucugcgugcaccugggguccgaccuggaggagcucaacaacgaggugaacgaggucaagcugcaggcccaggacccgcagauccuggacaucagcgccgaccaggacaagauccgccucauccugaacaaccugcaguccgugcucgccgaccugcagaagcgcgccuuccaguacaagagcuaccagaagaacuucaagguggaggucuccaaguucgaggcgcuggaggaggugagcgccgagcucaagcugaagcagcugcucugggacuccuucagcgagugggacaagcugcagcaggaguggcugaaguccaaguucgacugccucgaccccgaggugcugaacggccaggucagcaaguacgccaaguucgugacccagcuggagaaggggcucccgcccaacuccguggucccgcagcugaaguacaagguggagaagaugaaggagaagcugcccgugaucaucgaccuccggaaccccacccugaaggcccgccacugggcggccaucgagcagaccgucgacgccacgcugguggacgccgagaucccccucacccuggagcggcugagccagcuccacguguucgacuucggccaggagauccaggacaucagcggccaggccuccggggaggcggcccuggaggccauccugaagaaggucgaggacagcuggaagaccaccgaguucgugauccucccgcaccgcgacuccaaggacguguucauccugggcgggacggacgacauccagguccugcucgacgacagcaccaucaacguggccacccuggccuccagccgguaccugggcccccucaagacccgcguggacgaguggcagaagcagcuggcgcuguucaaccagacgcucgaggaguggcugaccugccagcggaacuggcuguaccucgaguccaucuucaacgcccccgacauccagcgccagcugcccgccgaggccaagauguuccugcaggucgacaagagcuggaaggagaucaugcggaaggugaaccgccucccgaacgcccugcgggcggccacccagcccgggcugcucgagaccuuccagaacaacaacgcccugcuggaccagauccagaagugccucgaggccuaccuggaguccaagcgcgugaucuucccccgguucuacuuccugagcaacgacgagcuccuggagauccuggcgcagacgcgcaacccccaggccguccagccgcaccuccggaagugcuucgacuccaucagcaagcuggaguucgcccugaugccgcccgccgagggcaagaucccgggcaucgacggggagcccgagaagguguacaccaacgacauccucgccaugcugucccccgagggcgagcgcgugagccuggggaagggccucaaggcgcgggggaacgucgaggaguggcugggcaagguggaggaggccauguucaccucccugcgccggcucugcaaggccgccaucgccgacuaccagggcaagcugcgcaccgacuggguggucgcggggcaccccagccaggugauccugacggucucccagaucauguggugccgggaccucaccgagugccuggagaccgagcacagcaaccacauccaggcccugaagaacuucgagaaggugaacuucgagcgccugaacgcccucgccgccaucgugcagggcucccugccgaagcugcaccgcaacauccucaccgcgcugaucacgaucgacguccacgcccgggacaucgugaccgagcuggugcagagcaaggucgagaccguggagagcuucgacuggcagcgccagcuccgguacuacugggacaucgaccuggacaacugcguggcccgcauggcccugucccaguacaccuacggguacgaguaccucggcgccugcccccggcuggucaucacgccccugaccgaccgcugcuaccucugccugaugggcgcgcugcagcucgaccucggcggggcccccgccgggccggccgggaccgggaagaccgagaccacgaaggaccuggcgaaggcccucgccauccagugcgugguguucaacugcagcgacggccuggacuacaagaugaugggccgguucuucuccgggcuggcccagagcggcgccuggugcugcuucgacgaguucaaccgcaucgacaucgagguccucuccgugaucgcgcagcagcugaucaccauccggaacgccaaggccgccaagcugagccgcuucauguucgaggggcgggagaucaagcucgugaugaccugcgccgcguucaucaccaugaaccccggcuacgccgggcgcacggagcugcccgacaaccugaaggcccucuuccggcccuucgccaugauggucccgaacuacgcccugaucgcggaggugauccuguacuccgagggcuucgagagcuccaagauccucgcccgcaagaugacccagauguacaagcugugcagcgagcagcugucccagcaggaccacuacgacuucggcaugcgggccgugaaguccguccucgugauggccgggucccugaagcgcgagaaccccgaccugaacgaggacgugguccucauccgggcgcugcaggacagcaaccugcccaaguuccucaccgacgacgcccugcuguucuccggcaucaucagcgaccucuuccccggggugcagaucccggagcacgacuacggcauccugcaguccaccaucguggacgucaugaaccgccagaaccugcagcccgagaugugcauggugcggaaggugauccaguucuacgagacgaugcucguccgccacggggugaugcuggugggccccaccggcgggggcaagaccaccgucuaccgcauccuggccgagacgcucgggaaccugcagaagcugggcaucgagaacagcuucuaccaggccgugaagaccuacgugcucaaccccaaguccaucaccaugggggagcuguacggcgaggucaacaaccugacccucgaguggaaggacggccugauggcccugagcgugcgggcggccgugaacgacacgagcgaggaccacaaguggaucaucuccgacgggccggucgacgcccucuggaucgagaacaugaacaccgugcuggacgacaacaagaugcugugccucgccaacagcgagcgcaucaagcugacgccccagauccacaugcuguucgaggugcaggaccuccgggucgccucccccgcgaccgugagccgcugcggcaugguguucgucgaccccgaggagcugaaguggaugccguacgugaagacguggaugaaggggaucuccaagaagcugaccgaggagacccaggaguacauccucaaccuguuccagcgguacguggacgagggccugcacuucaucaacaagaagugcagccaggccaucccccaggucgacaucuccaaggugaccacgcucugcugccugcuggagagccucauccugggcaaggacggggugaaccuggccauggagcagaccaagcucaacaccauccugugccagaccuucgucuucugcuaccuguggucccucggcgggaaccugacggagaacuacuacgacagcuucgacaccuucauccgcacccaguucgacgacaaccccgacgcccggcugcccaacuccggcgaccucuggagcauccacauggacuucgacaccaagcgccuggacccgugggagcggaucauccccacguucaaguacaaccgcgacgugcccuucuucgagaugcuggugccgaccaccgacaccguccgguacggguaccucauggagaagcugcuggccgugaagcacuccguccucuucacgggcaucaccggcgugggcaagagcgugaucgcgaagggccugcugaacaagauccaggaguccgccggguacguccccguguaccucaacuucagcgcccagaccuccagcgcccgcacccaggagaucaucgaguccaagcuggagcggaagcgcaagaacauccugggcgcgcccgggaacaagcggaucgugaucuucgucgacgaccucaacaugccccgccuggaccgguacggcagccagccgcccaucgagcugcuccgccaguaccaggacuucggcggguucuacgaccggaacaagcuguucuggaaggagauccaggacgugaccaucaucagcgccugcgcgccgcccggcgggggccgcaacccggugacgccccgguucauccgccacuucuccaugcugugccuccccaugcccagcgagcacucccugaagcagaucuuccaggccauccugaacggguuccugagcgacuucccgcccgccgucaagcagaccgcguccagcaucguggaggccuccguggagaucuacaacaagaugagcgucgaccuccugcccacccccgccaagucccacuacguguucaaccugcgcgaccucagcaagugcgugcagggcauccugcagugcgacccgggcaccauccgggaggagauccagaucuuccgccuguucugccacgagugccagcgggucuuccacgaccgccucaucaacaacgaggacaagcacuacuuccacgugauccugacggagauggccaacaagcacuucgggaucgccaucgaccuggaguacuuccucaacaagcccaucaucuucggcgacuucaucaaguucggggcggacaaggccgaccggaucuacgacgacaugcccgacaucgagaagaccgccaacgugcugcaggacuaccuggacgacuacaaccucaccaaccccaaggaggucaagcugguguucuuccaggacgccaucgagcacgugucccgcaucgcccggaugauccgccaggagcggggcaacgcgcugcucgucggcgucgggggcaccgggaagcagagccugacgcgccuggccgcccacaucugcggcuacaagugccuccagaucgagcugucccggggguacaacuacgacagcuuccacgaggaccugcgcaagcucuacaagauggccggcguggaggacaagaacauggucuuccuguucaccgacacccagaucgugguggaggaguuccuggaggacaucaacaacauccucaacuccggcgaggucccgaaccuguucgagaaggacgagcuggagcagguccucgccgcgacccggccccgcgccaaggagguggggaucagcgagggcaaccgggacgaggucuuccaguacuucaucuccaaggugcgccagaagcugcacaucgugcugugcaugagccccgucggggaggccuuccggucccgcugccggauguuccccagccucgugaacugcugcacgaucgacugguucgugcaguggccgcgcgaggcccugcugagcgucuccaagaccuucuucagccagguggacgcgggcaacgaggagcucaaggagaagcugccccugaugugcgugaacguccaccucuccgugagcuccauggccgagcgcuacuacaacgagcugcggcgccgguacuacaccacccccacgagcuaccuggagcucaucaaccuguaccuguccaugcucagcgagaagcgcaagcagaucaucuccgcccgggaccgcgugaagaacgggcugaccaagcugcucgagaccaacauccuggucgacaagaugaagcuggaccucagcgcccuggagcccgugcugcucgccaaguccgaggacguggaggcgcugauggagaagcuggccgucgaccaggagagcgccgaccaggugcggaacaccgugcaggaggacgaggccacggccaaggucaaggcggaggagacccaggccaucgccgacgacgcccagcgcgaccucgacgaggcccugccggcgcuggacgccgccaacaaggcccucgacucccuggacaaggcggacaucagcgagauccggguguucaccaagccgcccgaccuggugaugaccgucauggaggccaucuccauccuccugaacgccaagcccgacuggcccagcgccaagcagcugcucggcgacuccaacuuccugaagcgccugcucgaguacgacaaggagaacaucaagccccagauccuggccaagcugcagaaguacaucaacaaccccgacuucgugccggagaaggucgagaaggugagcaaggcgugcaaguccaugugcaugugggugcgggccauggaccucuacagccgcgucgugaagguggucgagcccaagcggcagaagcugcgcgccgcccaggccgagcuggacaucacgauggcgacccuccgggagaagcaggcccugcugcgccagguggaggaccagauccaggcccuccaggacgaguacgacaagggcgugaacgagaaggagagccuggccaagaccauggcccugaccaaggcgcggcucguccgcgccgggaagcugacggccgcccuggaggacgagcagguccggugggaggaguccauccagaaguucgaggaggagaucagcaacaucaccggcaacguguucaucgcggccgccugcgucgccuacuacggggccuucaccgcgcaguaccgccagucccucaucgagugcuggauccaggacugccagagccuggagauccccaucgaccccuccuucagccugaucaacauccucggcgacccguacgagauccggcaguggaacaccgacgggcugccccgcgaccugaucuccacggagaacggcauccucgugacccagggccgccgguggccccugaugaucgacccccaggaccaggccaaccgcuggauccggaacaaggagagcaaguccgggcugaagaucaucaagcucaccgacagcaacuuccugcgcauccuggagaacuccauccggcucggccugccggugcugcucgaggagcugaaggagacccuggaccccgcccuggagcccauccuccugaagcagaucuucaucagcgggggccgccugcucauccggcugggggacuccgacaucgacuacgacaagaacuuccgcuucuacaugacgaccaagaugcccaacccgcacuaccugcccgaggucugcaucaaggugaccaucaucaacuucaccgugaccaagagcggccucgaggaccagcugcuguccgacgucgugcggcucgagaagccccgccuggaggagcagcggaucaagcugaucgugcgcaucaacaccgacaagaaccagcucaagaccaucgaggagaagauccugcggaugcuguucaccagcgagggcaacauccucgacaacgaggagcugaucgacacccugcaggacuccaagaucacgagcggggccaucaagacccgccucgaggaggccgagagcaccgagcagaugaucaacgucgcgcgggagaaguaccgccccguggccacccagggcuccgugauguacuucgucaucgccagccuguccgagaucgacccgauguaccaguacagccugaaguacuucaagcagcuguucaacacgaccaucgagaccuccgugaagaccgagaaccugcagcagcggcuggacgugcuccuggagcagacgcugcucaccgccuacgucaacgugagccgcgggcuguucgagcagcacaagcugaucuacuccuucaugcucugcguggagaugaugcggcagcagggcacccugagcgacgccgaguggaacuucuuccugcgcggcuccgcggggcucgagaaggagcggccgcccaagcccgaggccccguggcugcccaccgccacgugguucgccugcugcgaccuggaggagagcuuccccgucuuccacggccucacccagaacauccugucccacccgaucagcauccggcugggguccuucgagaccuacaucaacccccagaagugggagggcuacagcaagaugaagcacgaggacaagcacaugcgccaggagaaggaggccgcgcaccaggaccccugguccgccgggcucagcuccuuccacaagcugauccugaucaagugcugcaaggaggagaaggugguguucgcccucaccgacuucgucaucgagaaccugggcaagcaguucaucgagacgcccccgguggaccugcccacccucuaccaggacaugagcugcaacacgccccugguguucauccuguccaccggcagcgaccccaugggggccuuccagcgguucgcgcgcgagagcggcuacuccgagcggguccagagcaucucccucgggcagggccaggggccgaucgccgagaagauggugaaggacgccaugaaguccggcaacuggguguuccugcagaacugccaccuggccgucuccuggaugcucgccauggaggagcugaucaagacguucaccgaccccgacagcgcgaucaaggacaccuuccgccuguuccucuccagcaugcccuccaacaccuuccccgugacggugcugcagaacagcgucaaggugaccaacgagccgcccaagggccugcgggccaacauccgccgggccuucaccgagaugacccccuccuucuucgaggagaacauccucgggaagaaguggcgccagaucaucuucggcaucugcuucuuccacgccaucauccaggagcggaagaaguucgggccccugggcuggaacaucugcuacgaguucaacgacagcgaccgcgagugcgcccugcucaaccugaagcuguacugcaaggaggggaagaucccgugggacgcgcucaucuacaucacgggcgagaucaccuacggcgggcgggugaccgacuccugggaccagcgcugccugcggaccauccugaagcgcuucuucagccccgagacgcucgaggaggacuacaaguacuccgagagcggcaucuacuucgcccccauggccgacucccugcaggaguucaaggacuacaucgagaaccugccccucaucgacgacccggagaucuucgggaugcacgagaacgccaaccuggucuuccaguacaaggagaccagcacccugaucaacaccauccucgaggugcagccccgguccagcacgggcggggagggcaagagcaacgacgagaucgugcaggagcuggucgccuccgugcagacccgcgugcccgagaagcuggagauggagggcgcgagcgagucccucuucgucaaggaccugcaggggcggcugaacagccucaccaccgugcugggccaggaggucgaccgcuucaacaaccugcucaagcugauccacaccucccuggagacgcucaacaaggccaucgccggguucguggugaugagcgaggagauggagaaggucuacaacuccuuccugaacaaccaggugcccgcccuguggagcaacaccgcguacccgucccucaagccccugggcagcugggugaaggaccugauccuccggaccuccuucgucgaccuguggcugaagcgcggccagcccaagagcuacuggaucuccggguucuucuucccccagggcuuccucaccgggacgcugcagaaccacgcccgcaaguacaaccugccgaucgacgagcugagcuucaaguacuccgugauccccaccuaccgggaccaggccgccgugaucgaggccgcgaagaccguccaguucggccaggagcuccccauggacauggagcugccgagccccgaggacggggugcuggugcacggcauguucauggacgccucccgcugggacgacaaggagauggucaucgaggacgcccuccccggccagaugaaccccgugcugccggugguccacuucgagccccagcagaacuacaagcccagccccacccuguaccacugcccgcucuacaagacgggggcccgggccggcacccuguccaccaccgggcacagcacgaacuucguggugaccguccugcuccccagcaagcgcuccaaggacuacuggaucgcgaagggcagcgcccugcugugccagcucuccgaguga

SEQ ID NO: 29260 - RNA, 12075 nt, Artificial Sequence
  derived and/or modified sequence opt1 from DNAH7__Homo_sapiens__NP_061720
augagcagcgagcaggacaagagcgccagcaaggagaaguccaagaagcccgugcgguuccugccccagcucagcauggagaagcuggccagcaaggagaaguucaaggcgcccgcccgggcccugccccagcucuccauggugagcaccaagccccacuggcagcaggccgcccccuccuuccaccugagcgugaagcaggacgacgagucccccgagcccuucagcgugaagaacgagcagucccacgccgaguacauggagcgguucgggaagaaggggaagcugccccaccaggucgacgacagcuacguggggccguccaccagcaaguccaagggcaagagcccccacaaggagcgggagaacuuccgcuccacccucgugaacgucaucaugcagcaggacgccgaccuggacagcgccgugcccgacgggagcaccauccccaagccgaccgccuccgccaucgagaaggacauccugcgguacuacuacuacauccaccacgggaucgacaccgaccacguggcccccauggaggacagcuggcucgagcacguccuggaccuggugccccagcaccucaagguguucacggacuccaucgucacccugagcgacgagaugcgcgaggacuaccugcucuccgugcgcaagagcaucguggacuucguccugaaggacccccgcgagaagggggacgacaagaagaccgacgagcugccggcccaccgggccgagauggagauccuccccaagcccuggcgcaaguccuuccuggccgcgagcuccuacauccgggaccaccugaacgccaugaaccccaccaugcucgccgugcuggaccuguggcacacgaacuucaagaagcuccgccugguggacaucaaggaguuccacaacugccaggacgcccuggagcucagcuccuuccagaacaucaucaugcggcacauggacagcgccaaggagacccugcugaagaugugguucccggagguccagaacaucuacuaccagggcaacaagaagaagcagcuccccaccggggacuccagcgcgaagcuggaguccuucuucaacugcgccgccgcccugaugacccuccagcugcaggaccugacgcucgugagcaugcaggacuucaccgaccugaucgcccagccgcccgacuccgugcgcgcguucgagcacccgggcuucaucaugcggcugauccucgacaacgacaccaucaaguucgagcccgagcugagcgacuacaucgacaucuuccugaacgucuacgacgugaugaucaaggccguguccuucgucccccgcguggagaccaagcucuacagcaagugggagagcaaguccaagcccacgacccugaagccgaucauccugaacgagaucgucgacgcccacaaggagaagaucaaggaggugaucaugaaggagagcguggcccccaccgagcaccuccggcuguacgacaaguacgacuuccugaucacccgcaaggccgagcgggacgucgacaacuuccucgcggagaaccacuccuacgagaagaucaucgacgagaucugcaaguaccagaagcugaucgaggagauccaguacacgagcaucaagaccauccgccuggggauguucgagaugcacugcgaggagcugauccgggcccucgugaagcgcgccgacaucaucugcggcaagcugcuggccaagauguuccgcgaccaccaggaggugaacacccggcucugcgacgaguucgagcgcaucgcggagaaggcccuguccacgccgcccaacacggccgagcugauggagaugaaggccuacauccagaaggucgaggugaccgacaugaucgagcucgagcagcggcugguggacagcaagaacugccuggccuuccucaucgaguacgucaacuucucccccgcggacaugcgccugaacaacagcguguuccagugguacgggcggaugggcgagaucuucgaggagcaccgcaagaucaucaaggagaagaucgagcaguaccaggagggccugaagcuccggugcgagcgcuucguggaggagcuggaguccuacgccaagcagagcgaggaguucuacuccuucggggaccugcaggacguccagcgguaccucaagaaggcccagauccugaacggcaagcuggaccucgccgccgacaagaucgagcaguucaacgcggaggaggaggccuucggguggcugcccagcguguacccccagcgcaagaagauccaggacggccugaaccccuaccuccggcuguacgagaccgccguggaguucuccagcaacuaccgcgccuggaccgagggccccuaccacaaggucaaccccgaccagguggaggccgacaucgggaacuacuggcggggccuguacaagcucgagaagacguuccacgacucccccuacgcgcuggccaugaccaagaaggugcgcagcaaggucgaggacuucaagcagcacaucccgcugauccaggugaucugcaaccccgggcuccggccccgccacugggaggccauguccgccaucgugggcuacccccugcagccgagcgacgacagcaccgucuccagcuuccuggacaugaaccucgagcccuacaucgaccgguucgaggggaucuccgaggcggccagcaaggaguacucccuggagaaggccauggagaagaugaucaccgagugggacgccguggaguucgugauccacagcuaccgcgagacgggcaccuucauccuggccuccgucgacgagauccagaugcuccuggacgaccacaucaucaagacccagaccaugcggggcagccccuucaucaagcccuacgagaagcagaugcgcgagugggaggggaagcugcuccugcugcaggagauccucgacgaguggcugaaggugcaggcgacguggcuguaccucgagccgaucuucuccagccccgacaucaugucccagaugcccgaggagggccgccgguucaccgccguggacaagaccuggcgcgacaucaugcggagcgucaugcaggacaagcacgugcugaccguggucaccaucgaccgcaugcuggagcggcucaagaaguccaacgagcugcuggagcucauccugaaggggcugaacgaguaccucgagaagaagcgccuguucuucccccgguucuucuuccugagcaacgacgagcuccuggagauccuguccgagacgaaggacccgacccgcgugcagccccaccucaagaagugcuucgagggcaucgccaagguggaguucaccgagacccuggacaucacgcacaugaaguccuccgagggggaggucguggagcugaucgagaucaucagcaccgccaaggcccggggccagguggagaaguggcucgucgagcuggagcgcgugaugaucaacuccauccacaaggugaccggcgacgcgaccuucgccuacacgaaguacgagcggaucaacuggguccgcgacuggcccgggcagaccgugcugugcgugagccagaucuucuggaccaaggagguccagaccgccauccccaugggcaucaaggcccucgagcaguaccugaagacgugcaaccggcagaucgacgacaucgugacccuggugcgcgggaagcucagcaugcagaaccgggucacccugggcgcccugguggugcucgacguccacgcgcgcgacgugcuguccagccuggugaagaagaacaucuccgacgacagcgacuucgaguggcucucccagcugcgguacuacuggcaggagaaccaccuggagaccaagaugaucaacgccgggcuccgcuacggcuacgaguaccugggcaacagcccgcggcuggucaucacgccccucaccgaccgcugcuaccggacccuguucggggcccugcaccuccaccugggcggggcccccgagggcccggcgggcaccgggaagacggagaccaccaaggaccuggccaaggccguggccaagcagugcgucguguucaacugcuccgacggccucgacuaccuggcccuggggaaguucuucaagggccuccugagcugcggggcgugggccugcuucgacgaguucaaccgcaucgaccuggaggugcucuccgucguggcccagcagauccugaccauccagcgcggcaucaacgccggcgccgacauccugauguucgaggggacggagcucaagcuggacccgaccugcgcgguguucaucaccaugaaccccggcuacgccgggcggagcgagcugcccgacaaccugaaggcccucuuccgcaccgucgccaugauggugccggacuacgccaugaucgcggagaucgugcuguacuccugcggcuucgucacggcccggccccugagcgugaagaucguggccaccuaccgccucugcuccgagcagcugagcucccagcaccacuacgacuacgggaugcgggccgucaagagcgugcugaccgccgcgggcaaccucaagcugaaguaccccaacgagaacgaggagauccugcuccugcgcuccaucaucgacgugaaccugcccaaguuccucagccacgaccugccgcuguucgagggcaucaccuccgaccucuuccccggggucaagcugcccaagcccgacuacaacgaccugcucgccgccaucaaggacaacugcgccagcaugaaccugcagaugacggcguucuucagcgagaagauccuccagguguacgagaugaugaucgugcggcacggcuucaugaucgucggggagccguucggcgggaagaccuccgccuaccgcgugcucgccggcgcccugaacgacaucugcgagaagggccugauggaggagaacaaggugcagaucaccguccucaaccccaagagcgugaccauggggcagcuguacggccaguucgacuccgugagccacgagugguccgacgggguccuggccgugagcuuccgggcguucgccuccagcgugacgcccgaccgcaaguggcucaucuucgacggccccgucgacgccguguggaucgagaacaugaacaccgugcuggacgacaacaagaagcugugccucauguccggggagaucauccagaugagcccgcagaugaaccugaucuucgagcccauggaccuggaggucgccucccccgccaccgugagccggugcggcaugaucuacauggagccccacaugcucggcuggcgcccgcugaugcuguccugggugaaccuccugcccgcgagcgucuccgugauccagaaggaguucaucauggggcuguucgaccggauggugcccgucagcguggaguucauccgcaagcacaccaaggagcucucccccaccagcgacacgaaccuggugcggucccugaugaaccucaucgacugcuucauggacgacuucgccgacgaggucaagcugaaggagcgcaacgaccgggagaccuacagccugcucgagggcaucuuccuguucagccugaucugguccgugggggccagcugcaccgacgacgaccgccucaaguucaacaagauccugcgggagcugauggaguccccgaucagcgaccgcacccgcaacacguucaagcuccaguccggcaccgagcagaccagcuccaaggcccugaccgugcccuuccccgagaagggcacgaucuacgacuaccaguucgucaccgaggggaucggcaagugggagcccuggaucaagaagcugaaggaggccccgcccauccccaaggacgugauguucaacgagaucaucgugccgacccucgacaccauccgguacagcgcgcugauggagcugcucacgacccaccagaagcccuccaucuucgucgggcccaccggcaccggcaagagcguguacaucacgaacuuccugcugaaccagcucaacaaggagaucuacaagccccugcugaucaacuucuccgcccagaccaccgccgcccagacccagaacaucgugaugagcaagcucgacaagcgccggaagggcgucuucggcccgccccuggggaagcgcauggugguguucgucgacgacgugaacaugcccgcgcgggaggucuacggcgcccagcccccgaucgagcugcuccgccaguggcuggaccacuggaacugguacgaccugaaggacugcuccaugaucaagcucguggacauccagaucaugugcgccauggggccgcccggcgggggccggaaccccgugacgccgcgcuacaugcggcacuucaacaucaucaccaucaacgaguucagcgacaaguccauguacaccaucuucagccgcauccugaccuggcaccuggagaucugcuacaaguuccccgacgaguuccucgaccugacgacccagaucgucaacggcaccaugacccuguacaaggaggccaugaagaaccuccugcccacgcccgccaagucccacuaccuguucaaccuccgggacuucagccgcgugauccagggggugugccugucccggccggagaccaccgagaccacggaggucaucaagcgccugugggugcacgaggugcuccgggucuacuacgaccgccugcuggacaacaccgaccggagcuggcucaucaacuacauccaggagauccugcgcaacuacauguacgaggacuuccacgagcuguuccagcggcucgacuucgacaacgacggcaugguggaggcggacgaccugcgcagccugauguucugcgacuuccacgaccccaagcgggaggacaccaacuaccgcgagaucgccgacguggacaaccuccgcaugaucgucgagauccaccuggaggaguacaacaacaucuccaagaagcccaugaaccugguccuguuccgguucgccaucgagcacaucagccgcaucucccggauccugaagcagccccgcagccacgcccugcucgugggggucggcggguccggccggcagagcgugacccgccuggccgcgcacauggccgacuacuccguguuccaggucgagaucagcaagggcuacgacacgaccgaguggcacgaggaccugaaggugauccuccggaagugcgccgagggggagaugcagggcguguuccuguucaccgacacccagaucaaggaggaguccuuccuggaggacgucagcaaccugcucaacgccggggagaucccgaaccuguucgcccuggacgagaagcaggagaucugcgacaagaugcgccagcucgaccggcagcgcgacaagaccaagcagacggacggcucccccaucgcgcuguucaacauguucaucgaccacugccggagccagcugcacguggugcucgccaugucccccaucggcgacgccuuccgcaaccggcugcgcaaguuccccgcccuggucaacugcugcaccaucgacugguuccagagcuggccggaggacgcgcuccaggccguggccucccgguuccuggaggagaucgagaugagcgaggagauccgcgacgggugcaucgacaugugcaaguccuuccacaccagcaccaucgaccuguccaagagcuucuucguggagcuccagcgguacaacuacgucacgcccaccagcuaccuggagcugaucuccaccuucaagcuccugcuggagaagaagcgcagcgaggugaugaagaugaagaagcgguacgaggugggccucgagaagcuggacuccgccagcucccaggucgccaccaugcagauggagcuggaggcgcuccacccccagcugaagguggccagcaaggagguggacgagaugaugaucaugaucgagaaggaguccgucgagguggccaagacggagaagaucgugaaggccgacgagaccaucgccaacgagcaggcgauggccagcaaggccaucaaggacgagugcgacgccgaccuggccggggcgcuccccauccuggaguccgcccuggccgcccucgacacccugaccgcccaggacaucacggucgucaagagcaugaaguccccgcccgcgggcgugaagcuggucauggaggccaucugcauccucaaggggaucaaggccgacaagauccccgacccgaccggcagcggcaagaagaucgaggacuucugggggcccgccaagcgccugcugggcgacaugcgcuuccuccagucccugcacgaguacgacaaggacaacaucccgcccgcguacaugaacaucauccggaagaacuacaucccgaaccccgacuucgugcccgagaagauccgcaacgccagcaccgccgccgaggggcugugcaagugggugaucgccauggacuccuacgacaaggucgcgaagaucguggcccccaagaagaucaagcucgccgccgccgagggcgagcugaagaucgcgauggacgggcugcggaagaagcaggccgcccucaaggaggugcaggacaagcuggcccgccugcaggacacccucgagcugaacaagcagaagaaggccgaccuggagaaccaggucgaccucugcagcaagaagcuggagcgggcggagcagcugaucggcggccucgggggcgagaagacgcgcuggucccacaccgcccuggagcuggggcagcucuacaucaaccugaccggcgacauccugaucagcagcggggugguggccuaccucggcgccuucaccuccacguaccggcagaaccagaccaaggaguggaccacccugugcaagggccgcgacaucccgugcagcgacgacugcucccugauggggacgcucggcgaggcggucaccauccggaccuggaacaucgccgggcugcccagcgacuccuucagcaucgacaacggcaucaucaucaugaacgcccgccgguggccccugaugaucgacccccagucccaggccaacaaguggaucaagaacauggagaaggccaacagccucuacgugaucaagcuguccgagccggacuacgugcgcacccuggagaacugcauccaguucgggacgcccguccuccuggagaacgugggcgaggagcuggaccccauccucgagccccugcugcucaagcagaccuucaagcagggcggguccacgugcauccggcugggcgacuccaccaucgaguacgcgccggacuuccgcuucuacaucaccaccaagcugcggaacccccacuaccuccccgagaccagcgucaaggugacccugcugaacuucaugaucacgcccgaggggaugcaggaccagcuccugggcaucguggucgcccaggagcgcccggaccuggaggaggagaagcaggcccucauccugcagggcgccgagaacaagcggcagcugaaggagaucgaggacaagauccucgaggugcuguccagcuccgaggggaacauccuggaggacgagaccgccaucaagauccucagcuccagcaaggcgcuggccaacgagaucucccagaagcaggagguggccgaggagaccgagaagaagaucgacaccacgcgcaugggcuaccggcccaucgccauccacagcagcauccuguucuucucccucgccgaccuggcgaacaucgagcccauguaccaguacagccugaccugguucaucaaccucuucauccuguccaucgagaacagcgagaaguccgagauccuggccaagcgccuccagauccugaaggaccacuucaccuacagccuguacgucaacgugugccggucccucuucgagaaggacaagcugcuguucagcuucugccugaccaucaaccuccugcugcacgagcgcgccaucaacaaggccgaguggcgcuuccuccugaccgggggcaucgggcuggacaaccccuacgcgaaccucugcacguggcugccgcagaaguccugggacgagaucugccggcuggacgaccuccccgccuucaagaccauccgccgggaguucaugcgccugaaggacggcuggaagaagguguacgacagccuggagccccaccacgaggucuucccggaggagugggaggacaaggccaacgaguuccagcggaugcucaucauccgcugccugcggcccgacaaggugauccccaugcugcaggaguucaucaucaaccgccucggccgggccuucaucgagcccccgcccuucgaccuggccaaggcguucggggacuccaacugcugcgcgccccugaucuucgugcucagccccggcgccgacccgauggccgcccugcugaaguucgcggacgaccagggguacggcggguccaagcucagcucccugagccugggccagggccaggggcccaucgccaugaagaugcucgagaaggccgucaaggagggcaccuggguggugcugcagaacugccaccuggccaccuccuggaugcccacgcucgagaaggucugcgaggagcugagccccgaguccacccacccggacuuccgcauguggcugaccagcuaccccagccccaacuuccccguguccgugcuccagaacggggucaagaugaccaacgaggccccgaagggccugcgggcgaacaucauccgcagcuaccugauggaccccaucuccgaccccgaguucuucgggagcugcaagaagcccgaggaguucaagaagcuccuguacggccugugcuucuuccacgcccucgugcaggagcggcgcaaguucggcccgcugggguggaacauccccuacgaguucaacgagacggaccugcggaucuccgugcagcagcuccacauguuccugaaccaguacgaggagcugcccuacgaggcccuccgcuacaugaccggcgagugcaacuacgggggccgggucaccgacgacugggaccgccggacccugcgcagcauccugaacaaguucuucaaccccgagcucguggagaacuccgacuacaaguucgacagcuccgggaucuacuucgugccgcccagcggcgaccacaaguccuacaucgaguacacgaagacccugccccugacccccgccccggagaucuucggcaugaacgccaacgcggacaucaccaaggaccagagcgagacgcagcuccuguucgacaacauccugcucacccagucccgcagcgccggggccggcgccaaguccagcgacgaggucgugaacgagguggcguccgacauccuggggaagcugcccaacaacuucgacaucgaggccgccaugcggcgcuaccccaccaccuacacgcagagcaugaacaccguccucgugcaggagaugggccgguucaacaagcugcugaagaccauccgcgacuccugcgugaacauccagaaggccaucaagggccucgccgucaugagcaccgaccuggaggagguggugagcuccauccugaacgucaagaucccggagauguggaugggcaagagcuaccccucccucaagccccugggcagcuacgugaacgacuuccuggcgcggcucaaguuccugcagcagugguacgagguggggcccccgcccgucuucuggcuguccggcuucuucuucacgcaggccuuccucaccggggcccagcagaacuacgcccgcaaguacaccauccccaucgaccugcugggcuucgacuacgaggugauggaggacaaggaguacaagcacccgcccgaggacggcguguucauccacggccucuuccuggacggcgccagcuggaaccggaagaucaagaagcuggcggagucccaccccaagauccucuacgacaccguccccgugauguggcugaagcccugcaagcgcgccgacauccccaagcggcccagcuacguggcgccccuguacaagacguccgagcgccgcggggugcucagcaccaccggccacuccaccaacuucgugaucgccaugacgcugcccagcgaccagccgaaggagcacuggaucgggcgcggcguggcccugcucugccagcugaacuccuga

SEQ ID NO: 29261 - RNA, 14124 nt, Artificial Sequence
  derived and/or modified sequence opt1 from DNAH8__Homo_sapiens__NP_001193856
auggagaaggacgccgaggacggcgcccccagcgagggggccgaggccccgcccagcaccgaggaggccgcgccgccccggagcgaggaggaggaggcgccccggccgcccaccguggaggcccccgccgaggacggcuucagccccagcgccgaggacgccgugagcagcgugguggacuaccgcgaccugauccccuccgaggaggggaucguccuccccgacgaccacgaggccgaccugaaccgggugcgccagcggcuggcgccccgccccgugcagagcgucaucuccgaggugcucagccugcccuccagccggcgcuccagccgguaccgccgguccaugagcggccugcccaaccuccaggagacccugaaggagcgccaggcccgguuccgcgaggcccgggagucccgccggcugaagaucgaccccagcuacaaguacaucuucgagauccucgccgagaaccuggggcuggacaucgugaccgucgaggagcucauccuggacugccccucccuggaggccuucaccaacuucuucgccaaggacggcugcaagacccucaaguuccuguaccaggagggcgacgugcccgggaucgagugcggccgcacgaucgccggggccaccaagggcgccaagaugaugaagcuguacaucgacaacgcggcccccgacaagcucaaggggcugugcaucuucuucgugcggugccgcaacgacgucgccaucaacgugaagaccauccaggaggaggcccuguucaccgugcucgacgccagcaagggccugcugaacggcauccgggacaugcucgcgaacaucuuccugcccgccguccuggccacgaacaacuggggcgcccucaaccagagcaagcagggcgaguccgagaagcacaucuucaccgagaccaucaaccgcuaccugagcuuccuggacggggcccgcaucuccaucgagggcaccgugaagcucaagacgaucgacaacgugaacuucagcaagcugcacaccuucgaggaggucaccgcggccgccuccaacagcgagaccgugcaccagcuggaggaggugcucauggucugguacaagcagaucgagcagguccugaucgaguccgagcagaugcggaaggaggccggcgacagcgggccccugacggagcucgagcacuggaagcgcauguccgcgaaguucaacuacaucaucgagcagaucaagggccccagcugcaaggccgugaucaacguccugaacguggcccacuccaagcugcucaagaacuggcgggaccuggacgcccgcaucaccgacaccgccaacgagagcaaggacaacguccgguaccuguacacccucgagaaggugugccagccccuguacaaccacgaccugguguccauggcgcacgggauccagaaccucaucaacgccauccgcaugauccacggcgucagccgguacuacaacacguccgagcgcaugaccagccuguucaucaaggugaccaaccagauggugaccgccugcaaggccuacaucacggacgggggccugaaccacgucugggaccaggagacccccguggugcucaagaagauccaggacugcaucuuccuguucaaggaguaccaggccuccuuccacaagacccggaagcugaucagcgaguccagcggcgagaaguccuucgaggucuccgagauguacaucuucgggaaguucgaggcguucugcaagcgccuggagaagaucaccgagaugaucacgguggugcagaccuacagcacccucuccaacagcaccaucgagggcaucgacaucauggccaucaaguuccggaacaucuaccagggggucaagaagaagcaguacgacauccuggacccccgccggacggaguucgacaccgacuuccuggacuucaugaccaagaucaacggccucgaggugcagauccaggccuucaugaacuccagcuucgggaagauccuguccagccagcaggcccugcagcuccugcagcgcuuccagaagcugaacauccccugccucggccuggagaucaaccacaccaucgagcggauccugcaguacuacguggccgagcucgacgcgacgaagaagcuguaccacucccagaaggacgacccgccccucgcccgcaacaugccgcccaucgccggcaagauccucuggguccggcagcuguaccgccggaucagcgagcccaucaacuacuucuucaagaacuccgacauccugagcucccccgacgggaaggccgugauccgccaguacaacaagaucagcuacgugcucgucgaguucgaggugguguaccacaccgcguggauccgcgagaucucccagcugcacuacgcccugcaggccacccucuucguccggcaccccgagaccggcaagcugcuggugaacuucgaccccaagauccucgaggugguccgcgagaccaagugcaugaucaagaugaagcuggacgugcccgagcaggccaagcggcugcucaagcuggagagcaagcugaaggccgacaagcucuaccugcaggggcugcuccaguacuacgacgagcugugccaggaggugccguccgucuucgugaaccugaugacgcccaagaugaagaagguggagagcguccuccgccagggccugaccgugcugaccuggagcucccucacccuggagagcuucuuccaggagguggagcugguccucgacauguucaaccagcugcugaagaagaucuccgaccucugcgagaugcacaucgacacggugcugaaggagaucgcgaagaccgugcugaucagccuccccgaguccggggccaccaaggucgaggacaugcugacccugaacgagacguacaccaaggagugggccgacauccucaaccacaagagcaagcacguggaggaggccgugcgggagcugaucuccaucuucgagcagaucuacgaggucaaguacaccggcaaggugggcaagcagagcgagcagcgcaagcacguggucuucggguccgagaccggcgagggggagaacaacgacuacgaggccaacaucgugaacgaguucgacacgcacgacaaggaggacgaguucaagaaggagugcaaggagguguucgcguucuucagccaccagcugcucgacucccugcagaaggccacccggcugagccucgacaccaugaagcgccggaucuucgucgccucccuguacggccgcaagcagagcgaggacaucaucuccuucaucaagagcgaggugcaccuggccauccccaacguggucaugaucccgucccucgacgacauccagcaggccaucaaccggaugauccagcugacccuggaggugagccgcggcguggcgcacugggggcagcagcagauccggcccaucaaguccgucauccccagccccacgaccaccgacgugacccaccagaacacgggcaagcuccugaagaaggaggagcgcagcuucgaggaggccaucccggcccggaagcugaagaacuucuaccccggggucgccgagcacaaggacaucuccaagcucgugcugcugcucagcuccagcgugaacucccugcgcaaggcggcccacgaggcccugcaggacuuccagaaguacaagacccucuggaccgaggaccgggacgucaaggugaaggaguuccuggccaacaaccccagccugaccgagauccgcuccgagauccuccacuacgccacguucgagcaggagaucgacgagcugaagcccaucaucguggucggcgcgcuggagcuccacaccgagccgaugaagcuggcccugagcaucgaggccaaggccuggaagaugcuccugugccgguaccugaacgaggaguacaagaagaagauguccuacaugaucgccuucaucaacgaguaccucaagaagcugagccgccccauccgggaccuggacgacgugcgcuucgcgauggaggcccucuccugcauccgcgacaacgagauccagauggacaugacccuggggcccaucgaggaggccuacgccauccugaaccgguucgagguggaggucaccaaggaggagagcgaggccguggacacgcuccgcuacuccuucaacaagcugcagagcaaggcgguguccguccaggaggaccugguccaggugcagcccaaguucaagagcaaccuccuggaguccgucgagguguuccgggaggacgugaucaacuucgccgaggccuacgagcuggagggcccgaugguccccaacaucccgccccaggaggccagcaaccgccugcagaucuuccaggccuccuucgacgaccucuggcggaaguucgugaccuacagcagcggcgagcagcuguucgggcugccggugaccgacuacgagguccuccacaagacccgcaaggagcugaaccugcuccagaagcuguacggccuguacgacacggugauguccagcaucuccggguacuacgagauccucuggggcgacguggacaucgagaagaucaacgcggagcugcuggaguuccagaaccggugccgcaagcuccccaaggggcugaaggacuggcaggccuuccuggaccucaagaagcggaucgacgacuucagcgaguccugcccccugcuggagaugaugaccaacaaggccaugaagcagcgccacugggaccggaucagcgagcucaccggcacccccuucgacgucgaguccgacagcuucugccugcgcaacaucauggaggcgccccugcucaagcacaaggacgacaucgaggacaucugcaucuccgcgaucaaggagaaggacaucgaggccaagcugacccaggugaucgagaacuggaccaaccagaaccugagcuucgccgccuucaagggcaagggggagcuccugcugaagggcaccgaguccggggagaucaucacccucauggaggacagccugauggugcugggcucccuccugagcaaccgguacaacgcccccuucaagaagaacauccagaacugggucuacaagcuguccaccagcuccgacaucaucgaggaguggcucguggugcagaaccugugggucuaccuggaggcgguguucgugggcggggacaucgccaagcagcucccccaggaggccaagcgcuuccagaacaucgacaagagcuggaucaagaucaugcagcgggcccacgagaacccgaacgucaucaacugcugcgugggggacgagacgauggggcagcugcugccccaccuccacgagcagcuggaggugugccagaagucccugaccggcuaccucgagaagaagcgccugcuguucccccgguucuucuucgucagcgaccccgugcuccuggagauccuggggcaggccagcgacucccacaccauccagccgcaccuccccgcggugagcgacaacaucaacgaggucaccuuccacgccaaggacuacgaccgcaucauggccgugaucucccgggagggcgagaagaucgugcuggacaacagcgucauggccaaggggcccguggagaucuggcugcucgaccugcugaagaugcagauguccagccuccacaacaucauccgcuccgccuucuaccagaucagcgacuccggcuuccagcugcugcccuuccucagccacuucccggcccaggugggccugcuggggauccagaugcucuggacgcacgacuccgaggaggcccugcgcaacgccaaggacgaccggaagaucaugcaggucaccaaccagaaguuccuggacauccucaacacccugaucagccagaccacgcacgaccuguccaaguucgaccgcgugaaguucgagacccucaucaccauccacgugcaccagcgggacaucuucgacgaccuggucaagaugcacaucaagagccccaccgacuucgaguggcugaagcagucccgcuucuacuucaaggaggaccucgaccagacgguggugagcaucaccgacgucgacuucaucuaccagaacgaguuccugggcugcaccgaccggcuggugaucacgccccugacggaccgcugcuacaucacccuggcccaggcgcuggggaugaacaugggcggcgcccccgccgggccggccggcaccgggaagaccgagacgaccaaggacaugggccggugccucgggaaguacgucgugguguucaacugcuccgaccagauggacuuccgcggccugggccggaucuucaaggggcuggcccagagcggcuccugggggugcuucgacgaguucaaccgcaucgagcuccccguccugagcguggcggcccagcagaucuacaucgugcugaccgcccggaaggagcgcaagaagcaguucaucuucagcgacggcgacugcgucgaccucaaccccgaguucgggaucuuccugaccaugaaccccggcuacgccggccggcaggagcugccggagaaccucaagauccaguuccgcacgguggccaugauggugcccgaccggcagaucaucaugcgcgucaagcuggcguccugcggguuccuggagaacgugauccucgcccagaaguucuacgugcuguacaagcugugcgaggagcagcucaccaagcagguccacuacgacuucggccugcggaacauccugagcgugcuccgcacccuggggucccagaagcgggcccgccccgaggacagcgagcuguccaucgugaugcggggccuccgcgacaugaaccugagcaagcuggucgacgaggacgagccccucuuccugucccugaucaacgaccuguucccggggcuccagcuggacagcaacaccuacgccgagcugcagaacgccguggcgcaccaggugcagaucgagggccucaucaaccacccgcccuggaaccugaagcugguccagcucuacgagacgucccuggugcgccacggccugaugacccucgggcccagcggcuccgggaagaccaccgugaucacgauccugaugaaggcccagaccgagugcggccggccgcaccgcgagaugcggaugaaccccaaggccaucaccgcgccccagauguucggccgccuggacaccgcgacgaacgacuggaccgacgggaucuucagcacccucuggcggaagacccugaaggccaagaagggcgagaacaucuuccugauccucgacgggccggucgacgccaucuggaucgagaaccugaacuccgugcuggacgacaacaagacccucacgcuggccaacggcgaccgcauccccauggcccccagcugcaagcuccuguucgaggugcacaacaucgagaacgcgucccccgccaccgucagccggauggggaugguguacaucuccagcuccgcccugagcuggcgcccgauccugcaggccuggcucaagaagcggaccgcccaggaggcggccguguuccugacccuguacgagaaggucuucgaggacacguacaccuacaugaagcucaaccugaaccccaagaugcagcugcucgagugcaacuacaucgugcagagccugaaccugcucgagggccugauccccuccaaggaggagggcggggugagcugcgucgagcaccuccacaagcuguucguguucggccugauguggucccugggggcccuccuggagcuggagagccgcgagaagcucgaggccuuccugcggcagcacgaguccaagcuggaccuccccgagaucccgaagggcagcaaccagaccauguacgaguucuacgugaccgacuacggggacugggagcacuggaacaagaagcugcagcccuacuacuaccccacggacuccauccccgaguacagcuccauccuggucccgaacguggacaacauccgcaccaacuuccucaucgacaccaucgccaagcagcacaaggcggugcugcugaccggcgagcagggcacggccaagaccgucauggugaaggccuaccucaagaaguacgaccccgaggugcagcugagcaagucccugaacuucagcuccgccaccgagcccaugauguuccagcggaccaucgagagcuacgucgacaagcgcaucggguccacguacgggccgcccggcgggcggaagaugaccguguucaucgacgacaucaacaugcccgugaucaacgaguggggcgaccagaucaccaacgagaucguccgccagaugauggagauggaggggauguacagccucgacaagcccggcgacuucaccacgaucguggacgugcagcugaucgccgcgaugauccaccccgggggcgggcggaacgacaucccccagcgccugaagcggcaguucaccgucuucaacugcacccuccccuccaacgccagcaucgacaagaucuucggcaucaucgggugcggcuacuucgaccccugccgcagcuucaagccccagaucugcgagaugaucgugaaccugguguccgucggccgcgugcuguggcaguggaccaaggugaagaugcucccgacgcccagcaaguuccacuacaucuucaaccugcgggaccugucccgcaucuggcaggggaugcucaccaucaaggccgaggagugcgccagcauccccacccugcugucccucuucaagcacgagugcagccgggucaucgcggaccgcuucaucacccccgaggacgagcagugguucaacgcccaccugacgcgggccguggaggagaacaucggcuccgacgccgccagcugcauccugccggagcccuacuucgucgacuuccuccgcgagaugcccgagccgaccggggacgagcccgaggacuccguguucgaggugcccaagaucuacgagcugaugcccagcuucgacuuccuggcggagaagcuccaguucuaccagcggcaguucaacgagaucauccgcggcaccucccuggaccuggucuucuucaaggacgccaugacccaccucaucaagaucagccggaucauccgcacguccugcggcaacgcccugcuggugggggugggcgggagcggcaagcagucccucagccggcuggccuccuucaucgccggguaccagaucuuccagaucacccugacccgcagcuacaacgucaccaaccucacggacgaccugaaggcgcuguacaagguggccggcgccgacggcaaggggaucaccuucaucuucaccgacuccgagaucaaggacgaggccuuccucgaguaccugaacaaccugcucagcagcggcgagaucuccaaccuguucgcccgggacgagauggacgagaucacccaggggcugaucagcgugaugaagcgcgagcucccgcggcacccgcccacguucgacaaccuguacgaguacuucaucucccgcagccggaagaaccugcacgucgugcucugcuucucccccgugggcgagaaguuccgcgcgcggagccugaaguucccggggcugaucuccggcugcaccauggacugguucagccgcuggccccgggaggcccucaucgccgucgccuccuacuuccugagcgacuacaacaucgugugcuccagcgagaucaagcgccagguggucgagaccaugggccuguuccacgacaugguguccgagagcugcgaguccuacuuccagcgcuaccggcgccgggcgcacgugacccccaagagcuaccuguccuucaucaacggguacaagaacaucuacgccgagaaggucaaguucaucaacgagcaggccgagcgcaugaacaucggccucgacaagcugauggaggccagcgaguccguggccaagcugagccaggaccucgcggugaaggagaaggagcuggccgucgccagcaucaaggccgacgaggugcuggccgaggugaccgucuccgcgcaggccagcgccaagaucaagaacgaggugcaggaggugaaggacaaggcccagaagaucgucgacgagaucgacuccgagaaggugaaggccgagagcaagcucgaggcggccaagcccgcccuggaggaggccgaggcggcccugaacacgaucaagccgaacgacaucgccaccgugcggaagcucgccaagccgccccaccugaucaugcgcaucauggacugcguccugcuccuguuccagaagaagaucgaccccgugaccauggacccggagaaguccugcugcaagcccagcuggggcgagucccugaagcucaugagcgccaccggcuuccuguggucccugcagcaguuccccaaggacacgaucaacgaggagaccguggagcuccugcagcccuacuucaacauggacgacuacaccuucgagagcgcgaagaaggucugcgggaacguggccggccugcucuccuggacccuggccauggccaucuucuacggcaucaaccgggaggugcugccgcucaaggccaaccuggcgaagcaggaggggcgccuggccgucgccaacgccgagcucggcaaggcccaggcgcugcuggacgagaagcaggccgagcucgacaaggugcaggccaaguucgacgccgccaugaacgagaagauggaccugcugaacgacgcggacacgugccggaagaagaugcaggccgccagcacccucaucgacgggcuguccggcgagaagauccgcuggacccagcagagcaaggaguucaaggcccagaucaaccggcuggugggggacauccuccugugcaccggcuuccuguccuaccucggccccuucaaccagaucuuccgcaacuaccugcugaaggaccagugggagauggagcuccgggcgcgcaagauccccuucacggagaaccugaaccugaucagcaugcucgucgacccgcccaccaucggggaguggggccugcaggggcugcccggcgacgaccucuccauccagaacggcaucaucgugaccaaggccacccgguacccccugcugaucgacccccagacgcaggggaagaccuggaucaagagcaaggagaaggagaacgaccuccaggugaccucccugaaccacaaguacuuccgcacccaccuggaggacagccucagccugggccggccccugcucaucgaggacauccacgaggagcuggaccccgcccuggacaacguccucgagaagaacuucaucaaguccgggacgaccuucaaggugaaggugggcgacaaggagugcgacaucauggacaccuucaagcuguacaucaccacgaagcugcccaacccggccuucacccccgagaucaacgccaagaccagcgucaucgacuucaccgugacgaugaaggggcucgagaaccagcugcugcgccgggugauccucaccgagaagcaggagcuggaggcggagcgcgucaagcugcucgaggacgugaccuucaacaagcgcaagaugaaggagcuggaggacaaccugcucuacaagcuguccgccaccaagggcagccugguggacgacgagucccucaucggcguccugcggacgaccaagcagaccgccgccgaggugagcgagaagcugcacgucgccgcggagaccgagaucaagaucaacgccgcccaggaggaguuccgccccgccgccacgcggggguccauccucuacuuccugaucaccgagaugagcauggugaacaucauguaccagaccucccuggcgcaguuccucaagcuguucgaccagagcauggcccgcuccgagaaguccccgcugccccagaagcggaucaccaacaucaucgaguaccucaccuacgagguguucacguacuccguccgcggccuguacgagaaccacaaguuccuguucgugcuccugaugacccugaagaucgaccuccagcgggggaccgugaagcaccgcgaguuccaggcccugaucaagggcggggccgcgcuggaccucaaggccugcccgcccaagcccuaccgguggauccuggacaugaccuggcugaaccuggucgagcucagcaagcugccgcaguucgccgagaucaugaaccagaucucccgcaacgagaagggcuggaaguccugguucgacaaggacgcccccgaggaggagaucauccccgacggcuacaacgacucccuggacacgugccacaagcuccugcugauccggagcuggugccccgaccgcaccguguuccaggcccggaaguacaucgcggacucccucgaggagaaguacaccgagccggugauccugaaccuggagaagaccugggaggagagcgacacgcgcacgccccucaucugcuuccugagcaugggguccgaccccaccaaccagaucgacgcccuggccaagaagcucaagcuggagugccggaccaucagcaugggccaggggcaggagguccacgcccgcaagcugauccagauguccaugcagcagggcgggugggugcuccugcagaacugccaccugggccucgaguucauggaggagcugcuggagacgcucaucaccaccgaggccagcgacgacuccuuccggguguggaucaccacggagccccacgaccgcuucccgaucacccugcugcagaccagccucaaguucaccaacgagccgccccagggcguccgggcggggcugaagcgcacguucgccggcaucaaccaggaccugcucgacaucuccaaccugcccauguggaagccgaugcuguacaccguggccuuccuccacagcaccgugcaggagcggcgcaaguucgggccccugggcuggaacauccccuacgaguucaacuccgccgacuucagcgccuccguccaguucauccagaaccaccuggacgagugcgacaucaagaagggcgugagcuggaacaccgugcgcuacaugaucggggagguccaguacggcgggcgggugacggacgacuucgacaagcgccuccugaacugcuucgcgcgggugugguucuccgagaagauguucgagcccagcuucugcuucuacaccggcuacaagaucccgcugugcaagacccucgaccaguacuucgaguacauccagucccugcccagccuggacaaccccgaggucuucgggcuccacccgaacgccgacaucaccuaccaguccaacacggccagcgccgugcuggagaccaucaccaacauccagcccaaggaguccggcggcggggugggcgagacccgcgaggccaucgucuaccggcugagcgaggacaugcucagcaagcugccgcccgacuacaucccgcacgaggugaagucccgccugaucaagauggggcaccucaacagcaugaacaucuuccugcggcaggagaucgaccgcaugcagcgggugaucuccauccugcgcagcucccucagcgaccugaagcuggcgaucgagggcacgaucaucauguccgagaaccuccgggacgcccuggacaacauguacgacgcccgcaucccccagcuguggaagcgggucagcugggacuccagcacccucggguucugguucaccgagcugcuggagcgcaacgcccaguucuccaccuggaucuucgagggccggcccaacguguucuggaugacgggcuucuucaacccccagggguuccucaccgcgaugcgccaggaggugacccgggcccacaagggcugggcccuggacaccgucaccauccacaacgaggugcugcgccagacgaaggaggagaucaccagcccgcccggggagggcguguacaucuacgggcucuacauggacggcgccgccugggaccggcgcaacggcaagcugauggaguccacccccaagguccuguucacccagcuccccgugcugcacaucuucgcgaucaacagcacggccccgaaggaccccaagcuguacgugugccccaucuacaagaagccccgccggaccgaccucaccuucaucaccgucguguaccugcgcacggugcuguccccggaccacuggauccuccgcgggguggcccugcugugcgacaucaaguga

SEQ ID NO: 29262 - RNA, 13461 nt, Artificial Sequence
  derived and/or modified sequence opt1 from DNAH9__Homo_sapiens__NP_001363
augcgccuggccgaggagcgggccgcccuggccgccgagaacgccgacggggagcccggggccgaccgccggcugcgccugcucggcaccuacguggcgaugagccugcggcccgccgccggggccugggagcgcugcgcgggcagcgccgaggccgagcagcugcuccaggccuuccuggggcgggacgccgcggagggcccccgcccccugcucguggugcggcccggcccccgcgggcuggccauccggcccggccuggagguggggcccgagagcggccucgccggggccaaggcccuguucuuccugcgcaccggccccgagccgcccggccccgacagcuuccgcggggccguggugugcggcgaccuccccgccgcgccccuggagcaccuggccgcccucuucagcgagguggugcugcccgugcuggccaacgagaagaaccggcucaacuggccccacaugaucugcgaggacgugcggcgccacgcccacucccugcagugcgaccugagcgugauccucgagcaggucaaggggaagacccugcugccccuccccgccggcuccgagaagauggaguucgccgacagcaaguccgagaccgugcuggacagcaucgacaaguccgugaucuacgccaucgagagcgcggugaucaagugguccuaccagguccagguggugcugaagcgggagagcucccagccccuccugcagggcgagaaccccacccccaagguggagcuggaguucuggaagucccgcuacgaggaccucaaguacaucuacaaccagcugcggaccaucaccgugcgcgggauggccaagcugcucgacaagcugcaguccagcuacuuccccgccuucaaggccauguaccgggacgugguggcggcccuggccgaggcccaggacauccacgugcaccucaucccccugcagcgccaccuggaggcccucgagaacgcggaguuccccgaggugaagccccagcugcgcccccugcuccacguggugugccugaucugggcgaccugcaaguccuaccggagccccggccgccugaccgugcuccugcaggagaucugcaaccugcugauccagcaggccagcaacuaccucucccccgaggaccugcugcggagcgaggucgaggagucccagcgcaagcuccagguggugagcgacacccuguccuucuucaagcaggaguuccaggaccggcgcgagaaccugcacacguacuucaaggagaaccaggaggucaaggagugggacuuccagagcucccucguguucgugcggcuggacggguuccugggccagcuccacgucguggaggggcugcugaagaccgcccucgacuuccacaagcugggcaagguggaguucagcggcguccgcgggaacgcccugucccagcagguccagcagaugcacgaggaguuccaggagauguaccggcuccugagcggcuccagcuccgacugccuguaccuccagagcaccgacuucgagaacgacguguccgaguucaaccagaaggucgaggaccuggaccgccggcuggggaccaucuucauccaggccuucgacgacgcccccggccucgagcacgccuucaagcugcuggacaucgccgggaaccuccuggagcgcccgcugguggcccgggacacgagcgacaaguaccucgugcugauccagauguucaacaaggaccuggacgcgguccgcaugaucuacucccagcacgugcaggaggaggccgagcucggcuucagccccgugcacaagaacaugcccaccgucgccggcgggcugcggugggcccaggagcugcgccagcggauccagggcccguucuccaacuucgggcgcaucacccaccccugcauggagagcgcggagggcaagcggaugcagcagaaguacgaggacaugcucagccugcuggagaaguacgagacccgccucuacgaggacuggugccgcacgguguccgagaagucccaguacaaccugucccagccccugcucaagcgggaccccgagaccaaggagaucaccaucaacuucaacccgcagcugaucagcgugcugaaggagauguccuaccucgagccccgcgagaugaagcacaugcccgagaccgccgccgccauguucagcucccgggacuucuaccgccagcuggucgccaaccuggagcucauggcgaacugguacaacaaggugaugaagacgcugcuggagguggaguucccccucgucgaggaggagcugcagaacaucgaccugcggcuccgcgccgccgaggagacccugaacuggaagaccgaggggaucugcgacuacgugaccgagaucacgagcuccauccacgaccuggagcagcggauccagaagaccaaggacaacguggaggagauccagaacaucaugaagaccugggucaccccgaucuucaagacgaaggacggcaagcgcgagagccuccugucccuggacgaccggcacgaccgcauggagaaguacuacaaccucaucaaggagagcggccugaagauccacgcccuggugcaggagaaccucgggcuguucuccgccgaccccaccagcaacaucuggaagaccuacgugaacuccaucgacaaccugcuccugaacggcuucuuccuggcgaucgagugcagccucaaguaccugcuggagaacaccgagugcaaggccgggcucacgcccaucuucgaggcccagcugucccuggccauccccgagcucgucuucuacccgagccuggagagcggcgugaagggcggguucugcgacaucguggagggccugaucaccuccaucuuccggauccccagccucgucccccgccugagcccccagaacgggagcccgcacuaccagguggaccuggacggcauccccgaccucgccaacaugcggcgcacccugauggagcgggugcagcgcaugauggggcugugcugcggcuaccaguccaccuucagccaguacuccuaccucuacgucgaggaccggaaggaggugcugggccaguuccugcucuacgggcacauccugacgcccgaggagaucgaggaccacguggaggacggcauccccgagaacccgccccugcucagccaguucaagguccagaucgacuccuacgagacccuguacgaggaggugugccgccuggagcccaucaagguguucgacggguggaugaagaucgacauccggcccuucaaggcgagccuccugaacaucaucaagcgcuggucccuccuguucaagcagcaccuggucgaccacgugacccacagccuggccaaccuggacgccuucaucaagaaguccgagagcggccuccugaagaagguggagaagggggacuuccagggccuggucgagaucaugggccaccucauggccgugaaggagcggcaguccaacaccgacgagauguucgagccgcugaagcagaccaucgagcugcucaagacguacgagcaggagcugcccgagaccguguucaagcagcuggaggagcuccccgagaaguggaacaacaucaagaaggucgcgaucaccgugaagcagcaggucgccccgcugcaggccaacgaggucacccugcuccgccagcgcugcacggccuucgacgccgagcagcagcaguucugggagcaguuccacaaggaggcgcccuuccgguucgacagcauccacccccaccagaugcuggacgcccgccacaucgagauccagcagauggaguccaccauggccagcaucuccgagagcgccagccuguucgaggugaacguccccgacuacaagcagcuccggcagugccgcaaggaggugugccagcugaaggagcugugggacaccaucgggauggugaccuccagcauccacgccugggagacgaccccguggcggaacaucaacgucgaggcgauggagcucgagugcaagcaguucgcccgccacauccggaaccuggacaaggaggugcgcgccugggacgccuucaccggccuggaguccaccguguggaacacgcucagcucccugcgggccgucgcggagcugcagaaccccgccauccgcgagcggcacuggcgccagcucaugcaggccaccggggugagcuucaccauggaccaggacaccacgcuggcccaccuccugcagcugcagcugcaccacuacgaggacgaggugcggggcaucgucgacaaggccgcgaaggagauggggauggagaagacccucaaggagcugcagaccaccugggccggcauggaguuccaguacgagccccacccccgcacgaacgugccgcugcucugcuccgacgaggaccugaucgaggugcuggaggacaaccagguccagcuccagaaccuggugaugagcaaguacguggccuucuuccuggaggaggucuccggcuggcagaagaagcucagcaccguggacgccgugaucuccaucugguucgagguccagcggaccuggacccaccuggagagcaucuucacgggguccgaggacauccgcgcgcagcugccccaggacagcaagcgguucgagggcaucgacaucgacuucaaggagcucgccuacgacgcccagaagauccccaacguggugcagaccaccaacaagcccgggcuguacgagaagcuggaggacauccagggccgccucugccugugcgagaaggcccuggccgaguaccucgacaccaagcggcuggcguucccgcgcuucuacuuccuguccagcuccgaccuccuggacauccugagcaacgggacggcgccccagcagguccagcgccaccucuccaagcuguucgacaacauggccaagaugcgguuccagcuggacgccagcggcgagcccaccaagaccagccucggcauguacuccaaggaggaggaguacguggccuucagcgagcccugcgacugcuccggccagguggagaucuggcugaaccacguccugggccacaugaaggcgaccgugcgccacgagaugacggagggggugaccgccuacgaggagaagccgcgggagcaguggcuguucgaccaccccgcccaggucgcccugaccugcacccagaucugguggacgaccgaggugggcauggccuucgcgcgccuggaggagggcuacgagagcgccaugaaggacuacuacaagaagcaggucgcccagcucaagacccugaucaccaugcugaucgggcagcucuccaagggcgaccggcagaagaucaugaccaucugcacgaucgacguccacgcccgcgacgugguggcgaagaugaucgcccagaaggucgacaacgcccaggccuuccuguggcugagccagcuccggcaccgcugggacgacgaggugaagcacugcuucgccaacaucugcgacgcgcaguuccuguacuccuacgaguaccuggggaacacgccccggcucgugaucacgccccucaccgaccgcugcuacaucacgcugacccagagccuccaccugaccauguccggcgccccggccgggcccgccggcaccggcaagacggagaccaccaaggaccuggggcgggcccucggcauccuggucuacguguucaacugcagcgagcagauggacuacaaguccugcgggaacaucuacaagggccuggcgcagaccggggccuggggcugcuucgacgaguucaaccgcaucagcguggagguccucuccgugguggccguccaggucaagagcauccaggacgccauccgggacaagaagcagugguucuccuuccugggcgaggagaucagccugaaccccuccguggggaucuucaucacgaugaaccccggcuacgccgggcgcaccgagcucccggagaaccucaagagccuguuccggcccugcgcgauggucgugcccgacuucgagcucaucugcgagaucaugcugguggccgagggcuucaucgaggcccagucccuggcccgcaaguucaucacccucuaccagcugugcaaggagcugcucagcaagcaggaccacuacgacugggggcugcgggcgaucaagagcguccuggugguggccggcucccucaagcgcggcgaccccgaccggccggaggaccagguccugaugcgcagccugcgggacuucaacauccccaagaucgugaccgacgacaugcccaucuucauggggcucaucggcgaccuguucccggcccuggacgucccccgccgccgggaccccaacuucgaggcccuggugcgcaaggccaucguggaccucaagcugcaggcggaggacaacuucguccugaagguggugcagcucgaggagcugcuggccguccggcacuccguguucguggucgggggcgccggcacgggcaagagccaggugcuccgcucccugcacaagaccuaccagaucaugaagcggcgccccguguggaccgaccugaacccgaaggccgucaccaacgacgagcuguucggcaucaucaaccccgccacgggggaguggaaggacggccuguucagcuccaucaugcgggagcuggcgaacaucacccacgacgggcccaaguggauccuccuggacggcgacaucgaccccauguggaucgagagccugaacaccgugauggacgacaacaaggugcucacccuggccuccaacgagcgcaucccgcugaaccccacgaugaagcuccuguucgagaucagccaccuccggaccgccacccccgccaccgucucccgcgccggcauccucuacaucaaccccgcggaccugggguggaacccgcccgugagcuccuggaucgagaagcgggagauccagacggagcgcgccaaccugaccauccucuucgacaaguaccugccgaccugccuggacacccuccggacgcgcuucaagaagaucauccccaucccggagcagagcauggugcagauggucugccaccuccuggagugccuccugaccaccgaggacauccccgccgacugccccaaggagaucuacgagcacuacuucguguucgccgccaucugggcguucggcggggccauggugcaggaccagcuggucgacuaccgggccgaguucuccaagugguggcucaccgaguucaagacggugaaguuccccagccagggcaccaucuucgacuacuacaucgacccggagaccaagaaguucgagcccugguccaagcuggugccccaguucgaguucgaccccgagaugccgcugcaggccugccucguccacaccagcgagaccauccgcgugugcuacuucauggagcggcugauggcgcgccagcggcccgugaugcuggucgggacggccggcaccggcaaguccgugcucgugggggccaagcuggccagccuggaccccgaggccuaccucgucaagaacgugcccuucaacuacuacaccaccagcgcgaugcugcaggccgugcuggagaagccgcucgagaagaaggccggccgcaacuacgggccgcccggcaacaagaagcugaucuacuucaucgacgacaugaacaugccggaggucgacgccuacgggacggugcagccccacaccaucauccgccagcaccuggacuacggccacugguacgaccgguccaagcucagccugaaggagaucaccaacgugcaguacgucuccugcaugaaccccaccgccggcagcuucacgaucaacccccgccugcagcggcacuucuccguguucgugcucagcuucccgggggcggacgcccuguccagcaucuacuccaucauccugacccagcaccucaagcugggcaacuuccccgccagccugcagaaguccaucccgccccugaucgaccuggcccuggccuuccaccagaagaucgcgaccaccuuccucccgacggggaucaaguuccacuacaucuucaaccugcgcgacuucgccaacaucuuccagggcauccuguucagcuccgucgagugcgucaagagcaccugggaccucauccggcuguaccugcacgaguccaaccgcguguaccgggacaagauggucgaggagaaggacuucgaccucuucgacaagauccagaccgaggugcugaagaagaccuucgacgacaucgaggaccccguggagcagacgcagagccccaaccuguacugccacuucgccaacgggaucggcgagcccaaguacaugccgguccaguccugggagcuccugacccagacccugguggaggcccucgagaaccacaacgaggugaacaccgucauggaccuggugcuguucgaggacgcgaugcgccacgugugccacaucaaccggauccucgagagcccccgcggcaacgcccugcuggucggggugggcggguccggcaagcagagccucacgcggcuggccgccuucaucagcuccauggacgucuuccagaucacccugcgcaagggcuaccagauccaggacuucaagauggaccucgccagccugugccugaaggcgggggugaagaaccucaacaccguguuccugaugaccgacgcccaggucgccgacgagcgguuccuggugcucaucaacgaccugcuggccuccggcgagauccccgaccucuacagcgacgacgagguggagaacaucaucuccaacguccgcaacgaggucaagagccaggggcugguggacaaccgggagaacugcuggaaguucuucaucgaccgcauccggcgccagcugaaggucacgcucugcuucucccccgugggcaacaagcugcgggugcgcagccggaaguucccggccaucgucaacugcaccgcgauccacugguuccacgaguggccccagcaggcccuggaguccgugagccuccgcuuccugcagaacaccgaggggaucgagcccaccgugaagcaguccaucagcaaguucauggccuucguccacacguccgugaaccagaccagccaguccuaccugagcaacgagcagcgcuacaacuacaccacccccaaguccuuccuggaguucauccggcucuaccagagccugcugcaccgccaccggaaggagcucaagugcaagacggagcgccuggagaacggccugcucaagcugcacagcaccuccgcccagguggacgaccugaaggccaagcucgcggcccaggaggucgagcugaagcagaagaacgaggacgccgacaagcugauccagguggugggcgucgagaccgacaaggugagccgggagaaggccauggcggacgaggaggagcagaagguggccgucaucaugcucgaggugaagcagaagcagaaggacugcgaggaggaccuggccaaggccgagccggcccugaccgcggcccaggccgcccucaacacgcugaacaagaccaaccugaccgagcucaaguccuucggguccccgccccuggccguguccaacgucagcgcggccgugauggugcugauggcgccccgcggccgggucccgaaggaccgcuccuggaaggccgccaaggugaccauggcgaagguggacggguuccucgacagccugaucaacuucaacaaggagaacauccacgagaacugccugaaggccauccggcccuaccuccaggaccccgaguucaacccggaguucgucgccacgaaguccuacgccgccgcgggccugugcagcugggugaucaacaucgugcgcuucuacgaggucuucugcgacguggagcccaagcggcaggcccugaacaaggccaccgccgaccucaccgcggcccaggagaagcuggccgccaucaaggccaagaucgcgcaccugaacgagaaccucgccaagcugaccgcccgcuucgagaaggccaccgccgacaagcugaagugccagcaggaggcggaggugacggccgucaccaucucccucgccaaccggcuggucggcgggcuggccagcgagaacgugcgcugggccgacgcgguccagaacuucaagcagcaggagcggacccucugcggggacauccugcugaucaccgccuucaucuccuaccucggguucuucacgaagaaguaccgccagagccugcuggaccggaccuggcgccccuaccucucccagcugaagacccccaucccggugacccccgcccuggacccccuccggaugcugauggacgacgccgacguggcggccuggcagaacgagggccugcccgccgaccgcaugagcgucgagaacgccacgauccucaucaacugcgagcgcuggccgcugaugguggacccccagcugcaggggaucaaguggaucaagaacaaguacggcgaggaccuccgggugacccagaucgggcagaagggcuaccugcagaucaucgagcaggcccuggaggcgggcgccgucgugcucaucgagaaccuggaggaguccaucgaccccgugcuggggccccuccugggccgcgaggucaucaagaaggggcgguucaucaagaucggcgacaaggagugcgaguacaacccgaaguuccgccugauccuccacaccaagcuggccaacccccacuaccagcccgagcugcaggcccaggccacccucaucaacuucacggugacccgggacgggcuggaggaccagcugcucgcggccgucgugagcauggagcgccccgaccuggagcagcugaaguccgaccucaccaagcagcagaacggcuucaagaucacccugaagacgcuggaggacagccuccugagccggcuguccagcgccuccggcaacuuccucggggagaccgugcuggucgagaaccuggagaucaccaagcagaccgccgccgagguggagaagaaggugcaggaggcgaaggucacggaggugaagaucaacgaggcccgcgagcacuaccggccggccgccgcccgcgcgagccuccuguacuucaucaugaacgaccuguccaagauccaccccauguaccaguucagccucaaggccuucuccaucguguuccagaaggccgucgagcgggccgcgcccgacgagagccugcgcgagcggguggccaaccugaucgacuccaucaccuucagcguguaccaguacaccauccgcggccucuucgagugcgacaagcugaccuaccuggcccagcucacguuccagauccugcugaugaaccgggaggucaacgccguggagcucgacuuccugcugcgcucccccgugcagaccgggaccgccagcccggucgaguuccucucccaccaggcguggggcgccgugaaggugcugagcuccauggaggaguucagcaaccuggaccgggacaucgagggcuccgccaagagcuggaagaaguucgucgaguccgagugccccgagaaggagaagcugccccaggaguggaagaacaagaccgcccuccagcgccugugcaugcugcgggccaugcgccccgaccggaugacguacgcgcuccgcgacuucguggaggagaagcuggggagcaaguacguggucggccgcgcccuggacuucgccaccagcuucgaggaguccgggccggccacccccauguucuucauccucagccccggcguggacccccugaaggacguggagucccaggggcggaagcugggcuacaccuucaacaaccagaacuuccacaacgucagccucggccaggggcaggaggugguggccgaggcggcccuggaccuggccgccaagaagggccacugggucauccuccagaacauccaccugguggcgaaguggcuguccacgcucgagaagaagcuggaggagcacagcgagaacucccacccggaguuccgcguguucaugagcgccgagcccgcccccuccccggaggggcacaucaucccccagggcauccuggagaacagcaucaagaucaccaacgagccgcccaccgggaugcacgccaaccuccacaaggcccuggacaacuucacccaggacacgcuggagaugugcucccgggagaccgaguucaagagcauccucuucgcgcugugcuacuuccacgccgucguggccgagcgccggaaguucggcccgcagggcuggaaccgcuccuaccccuucaacaccggggaccugaccaucagcgugaacguccucuacaacuuccuggaggccaacgccaaggugcccuacgacgaccugcgguaccucuucggcgagaucauguacgggggccacaucaccgacgacugggaccgccggcugugccgcacguaccugggggaguucauccggcccgagaugcucgagggcgagcugucccuggcgccgggcuucccccuccccgggaacauggacuacaacggcuaccaccaguacaucgacgccgagcugcccccggagagccccuaccuguacgggcuccaccccaacgccgagaucggcuuccugacccagaccuccgagaagcuguuccgcaccgugcucgagcugcagccccgggacagccaggcccgcgacggcgccggggcgacgcgggaggagaaggucaaggcccugcucgaggagauccuggagcgcgugaccgacgaguucaacaucccggagcugauggccaagguggaggagcggacccccuacaucgucguggccuuccaggagugcggccgcaugaacauccucacccgggagauccagcgcucccugcgcgagcuggagcucgggcugaagggcgagcugacgaugaccagccacauggagaaccuccagaacgcgcuguacuucgacauggugcccgagagcugggcccggcgcgccuaccccuccaccgccgggcuggccgcgugguucccggaccuccugaaccggaucaaggagcuggaggccuggaccggcgacuucacgaugcccagcaccgucuggcucaccggcuucuucaacccccaguccuuccugaccgccaucaugcagagcacggcccgcaagaacgaguggccccuggaccagauggcccuccagugcgacaugaccaagaagaaccgggaggaguuccgcuccccgccccgggagggggcguacauccacggccuguucauggagggggccugcugggacacccaggccggcaucaucaccgaggccaagcugaaggaccucacgccgcccaugccggugauguucaucaaggccauccccgcggacaagcaggacugccgcagcguguacuccugccccgucuacaagaccagccagcgggggccgaccuacguguggaccuucaaccugaagacgaaggagaaccccuccaagugggugcuggccggcgucgcccuccugcugcagaucuga

SEQ ID NO: 29263 - RNA, 2100 nt, Artificial Sequence
  derived and/or modified sequence opt1 from DNAI1__Homo_sapiens__NP_036276
augauccccgccagcgccaaggcgccgcacaagcagccccacaagcaguccaucagcaucggccgcgggacccggaagcgcgacgaggacuccggcaccgaggugggggagggcacggacgagugggcccagagcaaggccaccguccggccgcccgaccagcuggagcucaccgacgccgagcugaaggaggaguucacccgcauccugacggccaacaacccccacgcgccccagaacaucgugcgguacuccuucaaggaggggaccuacaagcccaucggcuucgugaaccagcucgccguccacuacacccaggugggcaaccugauccccaaggacagcgacgaggggcgccggcagcacuaccgcgacgagcugguggccggcucccaggagagcgucaaggugaucuccgagaccgggaaccucgaggaggacgaggagccgaaggagcuggagacggagcccggcagccagaccgacgugcccgccgcgggggccgccgagaaggucaccgaggaggagcugaugacccccaagcagccgaaggagcggaagcucacgaaccaguucaacuucuccgagcgcgccagccagaccuacaacaaccccgugcgggaccgcgagugccagaccgagcccccgccccggaccaacuucuccgccacggcgaaccagugggagaucuacgacgccuacguggaggagcuggagaagcaggagaagaccaaggagaaggagaaggccaagacccccgucgccaagaaguccggcaagauggccaugcgcaagcugaccagcauggagagccagacggacgaccucaucaagcugucccaggcggccaagaucauggagcggauggugaaccagaacaccuacgacgacaucgcccaggacuucaaguacuacgacgacgccgccgacgaguaccgcgaccaggugggcacccugcucccccuguggaaguuccagaacgacaaggcgaagcggcugagcgucaccgcccucugcuggaaccccaaguaccgcgaccuguucgccgugggguacggcuccuacgacuucaugaagcagagccgggggaugcugcuccuguacagccugaagaacccguccuuccccgaguacauguucagcuccaacagcggcgugaugugccucgacauccacgucgaccaccccuaccugguggccgugggccacuacgacgggaacgucgccaucuacaaccugaagaagccccacucccagccgagcuucugcuccagcgcgaaguccggcaagcacagcgaccccguguggcaggucaaguggcagaaggacgacauggaccagaaccucaacuucuucuccgugagcuccgacgggcgcaucgugagcuggacgcuggucaagcggaagcuggugcacaucgacgugaucaagcucaaggucgagggcuccaccaccgaggugcccgaggggcugcagcugcaccccgugggcugcggcaccgccuucgacuuccacaaggagaucgacuacauguuccucgucgggacggaggagggcaagaucuacaagugcagcaaguccuacagcucccaguuccuggacaccuacgacgcccacaacaugagcguggacaccgugagcuggaacccguaccacaccaaggucuucauguccugcagcuccgacuggacggugaagaucugggaccacaccaucaagacccccauguucaucuacgaccugaacagcgccgugggggacgucgcgugggcccccuacuccagcaccguguucgccgccgugacgaccgacggcaaggcccacaucuucgaccucgcgaucaacaaguacgaggccaucugcaaccagccggucgccgccaagaagaaccgccugacccacgugcaguucaaccugauccaccccaucaucaucgugggggacgaccgcggccacaucaucucccucaagcugagccccaaccugcggaagaugcccaaggagaagaagggccaggagguccagaaggggccggccguggagaucgcgaagcucgacaagcugcugaaccucgugcgcgaggucaagaucaagaccuga

SEQ ID NO: 29264 - RNA, 1782 nt, Artificial Sequence
  derived and/or modified sequence opt1 from DNAI2__Homo_sapiens__NP_001166281
auggagaucguguacgucuacgugaagaagcgcagcgaguucggcaagcagugcaacuucuccgaccggcaggccgagcugaacaucgacaucaugcccaacccggagcucgccgagcaguucguggagcgcaaccccgucgacaccgggauccagugcagcaucuccaugagcgagcacgaggcgaacuccgagcgguucgagauggagacccgcggcgugaaccacguggagggcggguggcccaaggacgucaacccccuggagcuggagcagacgauccgguuccgcaagaagguggagaaggacgagaacuacgugaacgccaucaugcagcucgggagcaucauggagcacugcaucaagcagaacaacgccaucgacaucuacgaggaguacuucaacgacgaggaggccauggaggucauggaggaggacccguccgccaagaccaucaacguguuccgggacccccaggagaucaagcgcgcggccacccaccugagcuggcaccccgacggcaaccggaagcuggccguggccuacuccugccucgacuuccagcgcgcgcccgucggcaugagcuccgacagcuacaucugggaccuggagaacccgaacaagcccgagcuggcccucaagcccuccagcccccuggugacccuggaguucaacccgaaggacucccacgugcuccucgggggcugcuacaacgggcagaucgccugcugggacacgcggaagggcagccuggucgccgagcuguccaccaucgagagcucccaccgcgaccccguguacgggaccaucuggcugcagagcaagaccggcacggagugcuucagcgccuccaccgacggccaggugauguggugggacauccggaagaugagcgagcccaccgaggucgugauccuggacaucaccaagaaggagcagcucgagaacgcgcugggggccaucucccuggaguucgagagcacgcuccccaccaaguucauggugggcaccgagcaggggaucgucaucuccugcaaccgcaaggccaagaccagcgccgagaagaucgugugcacguucccgggccaccacggccccaucuacgcccugcagcggaaccccuucuaccccaagaacuuccugaccgugggggacuggaccgcgcgcaucugguccgaggacagccgggaguccagcaucauguggaccaaguaccacauggccuaccucacggacgccgccugguccccgguccgccccaccguguucuucaccacccggauggacggcacgcuggacaucugggacuucauguucgagcagugcgaccccacccugagccucaaggacaacgggugccugaucgccugcggcucccagcuggggaccaccacgcuccuggaggucagccccggccuguccacccuccagcgcaacgagaagaacguggcgagcuccauguucgagcgggagacccgccgcgagaagauccuggaggcccggcaccgcgagaugcggcugaaggagaagggcaaggccgaggggcgcgacgaggagcagaccgacgaggagcucgccguggaccuggaggcccuggucagcaaggcggaggaggaguucuucgacaucaucuucgccgagcucaagaagaaggaggccgacgccaucaagcugacgccggugccccagcagcccucccccgaggaggaccagguggucgaggagggcgaggaggcggccggggaggagggcgacgaggagguggaggaggaccuggccuga

SEQ ID NO: 29265 - RNA, 1194 nt, Artificial Sequence
  derived and/or modified sequence opt1 from DNAJA1__Homo_sapiens__NP_001530
auggugaaggagaccaccuacuacgacguccugggcgugaagcccaacgccacgcaggaggagcucaagaaggccuaccggaagcuggcgcugaaguaccacccggacaagaaccccaacgagggggagaaguucaagcagaucagccaggccuacgaggugcucuccgacgccaagaagcgggagcuguacgacaagggcggggagcaggccaucaaggagggcggggccggcggcggguucggcagccccauggacaucuucgacauguucuucgggggcgggggccgcaugcagcgggagcgccggggcaagaacgucgugcaccagcuguccgugacccucgaggaccuguacaacggggcgacccgcaagcuggcccuccagaagaacgucaucugcgacaagugcgagggccgcgggggcaagaagggcgccguggagugcugccccaacugccgggggaccggcaugcagauccggauccaccagaucgggccgggcauggugcagcagauccagagcgucugcauggagugccaggggcacggcgagcgcaucucccccaaggaccggugcaagagcugcaacggccgcaagaucgugcgggagaagaagauccuggaggugcacaucgacaaggggaugaaggacggccagaagaucacguuccacggggagggcgaccaggagcccgggcuggagcccggcgacaucaucaucguccucgaccagaaggaccacgccguguucacccgccggggcgaggaccuguucaugugcauggacauccagcugguggaggcgcucugcggguuccagaagccgaucuccacccuggacaaccgcaccaucgucaucacgagccaccccggccagaucgugaagcacggggacaucaagugcgugcugaacgagggcaugcccaucuaccggcgccccuacgagaaggggcggcucaucaucgaguucaaggucaacuucccggagaacggcuuccugucccccgacaagcugagccuccuggagaagcugcuccccgagcgcaaggagguggaggagaccgacgagauggaccagguggagcuggucgacuucgaccccaaccaggagcggcgccgccacuacaacggcgaggccuacgaggacgacgagcaccacccgcgcgggggcgugcagugccagaccuccuga

SEQ ID NO: 29266 - RNA, 1239 nt, Artificial Sequence
  derived and/or modified sequence opt1 from DNAJA2__Homo_sapiens__NP_005871
auggccaacguggccgacaccaagcuguacgacauccucggcgugcccccgggggcgagcgagaacgagcugaagaaggccuaccgcaagcuggccaaggaguaccaccccgacaagaaccccaacgccggcgacaaguucaaggagaucuccuucgccuacgagguccucagcaaccccgagaagcgggagcuguacgaccgcuacggggagcagggccugcgggagggguccggcggcgggggcgggauggacgacaucuucagccacaucuucggcgggggccucuucggcuucauggggaaccagucccgcagccggaacggccgccggcgcggggaggacaugaugcacccgcugaaggugucccuggaggaccucuacaacggcaagaccacgaagcugcagcugagcaagaacguccucugcuccgcgugcagcggccagggcgggaaguccggggccgugcagaagugcagcgccugccggggccgcggggugcggaucaugauccgccagcuggcccccggcaugguccagcagaugcaguccgugugcagcgacugcaacggcgagggggaggugaucaacgagaaggaccggugcaagaagugcgagggcaagaaggucaucaaggaggugaagauccuggaggugcacgucgacaaggggaugaagcacggccagcgcaucaccuucaccggggaggcggaccaggcccccggcguggagcccggcgacaucgugcuccugcugcaggagaaggagcacgaggucuuccagcgggacgggaacgaccuccacaugaccuacaagaucggccugguggaggcccugugcggguuccaguucacguucaagcaccucgacggccgccagaucguggucaaguacccgcccgggaaggugaucgagcccggcugcgugcgggucgugcgcggcgaggggaugccccaguaccggaacccguucgagaagggcgaccuguacaucaaguucgacgugcaguuccccgagaacaacuggaucaaccccgacaagcuguccgagcucgaggaccugcugcccagccgcccggagguccccaacaucaucggggagaccgaggagguggagcuccaggaguucgacuccacccggggcagcggcgggggccagcgccgcgaggccuacaacgacuccagcgacgaggagagcuccagccaccacgggcccggcguccagugcgcccaccaguga

SEQ ID NO: 29267 - RNA, 1362 nt, Artificial Sequence
  derived and/or modified sequence opt1 from DNAJA3__Homo_sapiens__NP_001128582
auggccgcccgcugcagcacccgguggcugcucguggucgugggcacgccccgccugccggcgaucuccgggcggggcgcccgcccgccccgggaggggguggucggcgccuggcugagccgcaagcucuccgugcccgccuucgccagcucccugaccagcugcgggccccgggcgcugcucacccugcgccccggcgugucccugaccggcaccaagcacaaccccuucaucugcacggccagcuuccacaccuccgcgccccucgccaaggaggacuacuaccagauccugggggucccgcggaacgccagccagaaggagaucaagaaggccuacuaccagcuggccaagaaguaccaccccgacaccaacaaggacgaccccaaggccaaggagaaguucucccagcucgccgaggcguacgaggugcugagcgacgaggugaagcgcaagcaguacgacgccuacggcuccgccggguucgaccccggcgccagcgggucccagcacagcuacuggaagggcggcccgaccgucgaccccgaggagcuguuccggaagaucuucggggaguucuccagcuccagcuucggcgacuuccagacgguguucgaccagccccaggaguacuucauggagcucaccuucaaccaggccgcgaagggggugaacaaggaguucaccgucaacaucauggacacgugcgagcgcugcaacggcaagggcaacgagcccgggaccaaggugcagcacugccacuacugcggcgggagcggcauggagaccaucaacaccgggccguucgugaugcgguccacgugccgccggugcggcggccgcgggagcaucaucaucucccccugcgucgugugccggggcgccgggcaggccaagcagaagaagcgcgugaugauccccguccccgccggcguggaggacgggcagaccgugcggaugccggucggcaagcgcgagaucuucaucaccuuccgggugcagaagucccccguguuccgccgcgacggcgccgacauccacagcgaccuguucaucagcaucgcgcaggcccugcucgggggcaccgcccgggcccaggggcuguacgagaccaucaacgucacgaucccgcccggcacccagaccgaccagaagauccgcaugggcgggaagggcaucccccggaucaacuccuacggguacggcgaccacuacauccacaucaagauccgcgugcccaagcggcugaccagccgccagcagucccucauccugagcuacgccgaggacgagacggacgucgaggggaccgugaacggcgugacccugaccuccagcggcaagcgguccacggggaacuga

SEQ ID NO: 29268 - RNA, 1077 nt, Artificial Sequence
  derived and/or modified sequence opt1 from DNAJB11__Homo_sapiens__NP_057390
auggcgccccagaaccugagcaccuucugccuccugcugcucuaccugaucggcgccgugaucgccgggcgcgacuucuacaagauccugggcgucccgcgguccgccagcaucaaggacaucaagaaggccuaccgcaagcucgcccugcagcugcaccccgaccggaaccccgacgacccccaggcccaggagaaguuccaggaccucggggcggccuacgaggugcuguccgacagcgagaagcgcaagcaguacgacaccuacggcgaggaggggcugaaggacggccaccaguccagccacggcgacaucuucucccacuucuucggggacuucggcuucauguucgggggcacgccgcggcagcaggaccgcaacaucccccgggggagcgacaucaucguggaccucgaggucacccuggaggagguguacgccggcaacuucguggaggucgugcgcaacaagcccguggcccggcaggcgcccggcaagcgcaagugcaacugccggcaggagaugcgcaccacccagcuggggccgggccgguuccagaugacgcaggaggucgugugcgacgagugccccaacgugaagcucgucaacgaggagcgcacccuggagguggagaucgagcccggggugcgggacggcauggaguaccccuucaucggcgagggggagccgcacgucgacggcgagcccggggaccugcgcuuccggaucaagguggugaagcaccccaucuucgagcgccggggcgacgaccucuacaccaacgucaccaucucccugguggagagccuggugggguucgagauggacaucacgcaccucgacggccacaagguccacaucucccgcgacaagaucacccggcccggcgccaagcuguggaagaagggggagggccugccgaacuucgacaacaacaacaucaaggggagccucaucaucaccuucgacguggacuuccccaaggagcagcugaccgaggaggcccgcgagggcaucaagcagcugcucaagcagggguccgugcagaaggucuacaacggccugcagggcuacuga

SEQ ID NO: 29269 - RNA, 951 nt, Artificial Sequence
  derived and/or modified sequence opt1 from DNAJB13__Homo_sapiens__NP_705842
augggccaggacuacuacagcgugcuggggaucacccgcaacuccgaggacgcccagaucaagcaggccuaccggcgccucgcgcugaagcaccacccccucaagagcaacgagccguccagcgccgagaucuuccggcagaucgccgaggccuacgacguccuguccgaccccaugaagcgcggcaucuacgacaaguucggggaggagggccugaagggcgggaucccccuggaguucggcagccagacccccuggacgaccggguacguguuccacggcaagccggagaagguguuccacgaguucuucgggggcaacaaccccuucuccgaguucuucgacgccgaggggagcgaggucgaccucaacuucggcggccugcaggggcggggcgugaagaagcaggacccccagguggagcgcgaccuguaccucucccuggaggaccuguucuucgggugcaccaagaagaucaagaucagccggcgcguccucaacgaggacggcuacuccagcaccaucaaggacaagauccugacgaucgacgugaagcccggcuggcggcaggggacccgcaucaccuucgagaaggagggcgaccaggggccgaacaucauccccgcggacaucaucuucaucgugaaggagaagcugcacccccgguuccgccgggagaacgacaaccucuucuucgucaaccccaucccgcugggcaaggcccugaccugcugcacgguggaggugcgcacccucgacgaccggcugcugaacauccccaucaacgacaucauccaccccaaguacuucaagaagguccccggggagggcaugccgcuccccgaggaccccaccaagaagggcgaccuguucaucuucuucgacauccaguuccccacccgccugacgccgcagaagaagcagaugcuccggcaggcccugcugaccuga

SEQ ID NO: 29270 - RNA, 723 nt, Artificial Sequence
  derived and/or modified sequence opt1 from DNAJB1__Homo_sapiens__NP_001287843
auguucgccgaguucuucggcgggcgcaaccccuucgacaccuucuucggccagcggaacggggaggagggcauggacaucgacgacccguucagcggguuccccaugggcaugggcggguucaccaacgugaacuucggccgcucccggagcgcccaggagcccgcgcgcaagaagcaggacccgcccgugacgcacgaccugcgggugucccucgaggagaucuacagcgggugcaccaagaagaugaagaucucccacaagcgccugaaccccgacggcaagagcauccggaacgaggacaagauccugaccaucgaggugaagaagggguggaaggagggcaccaagaucacguuccccaaggagggcgaccagaccuccaacaacauccccgccgacaucgucuucgugcucaaggacaagccgcacaacaucuucaagcgcgacgggagcgacgugaucuaccccgcccggaucucccugcgcgaggcccugugcggcugcaccgucaacgugcccacccucgacgggcggacgauccccguggucuucaaggacgugauccgcccgggcaugcggcgcaaggugcccggcgaggggcugccccugcccaagaccccggagaagcggggcgaccucaucaucgaguucgaggucaucuuccccgagcgcaucccccagaccagccggaccgugcuggagcagguccugcccaucuga

SEQ ID NO: 29271 - RNA, 834 nt, Artificial Sequence
  derived and/or modified sequence opt1 from DNAJB2__Homo_sapiens__NP_001034639
auggccagcuacuacgagauccuggacgugccccgcuccgccagcgcggacgacaucaagaaggccuaccggcgcaaggcccuccaguggcacccggacaagaaccccgacaacaaggaguucgccgagaagaaguucaaggaggucgccgaggcguacgaggugcuguccgacaagcacaagcgggagaucuacgaccgcuacggccgggaggggcugaccggcaccgggacgggccccagccgcgccgaggccggguccggcggccccggguucaccuucaccuuccggagcccggaggagguguuccgcgaguucuucggcuccggggaccccuucgccgagcuguucgacgaccucggccccuucagcgagcugcagaaccgggggucccgccacagcggccccuucuucaccuucuccagcuccuucccgggccacagcgacuucuccagcuccagcuucuccuucagccccggggcgggcgccuuccggagcgucuccacgagcaccaccuucgugcaggggcgccggaucaccacgcgccggaucauggagaacggccaggagcgcguggaggucgaggaggacggccagcucaaguccgugaccaucaacggggugcccgacgaccuggcccugggccucgagcugagccggcgcgagcagcagcccuccgucaccagccgguccgggggcacccaggugcagcagacgccggccagcugcccccuggacuccgaccucagcgaggacgaggaccugcagcuggccauggcguacucccucagcgagauggaggccgccgggaagaagcccgccgacguguucuga

SEQ ID NO: 29272 - RNA, 1389 nt, Artificial Sequence
  derived and/or modified sequence opt1 from DNAJB5__Homo_sapiens__NP_001128476
augggcggggccgaggccgagcccuggggccgcgcgccggggcccgccaucggcgggcggcgcgccggcgacagcugccccggcuggcggcgccggucccgcagccgggggcgcggccagcggcugucccacgggccccgccggcgcccgcagcugcugaccgccgccccgccccugcaggcgcggggcgccuuccgcagcuucccccacuccuggggcgaggacuuccucgccagccugauguucaagauccagcuggagccccucaagcugcgggccuggacccugaacggguucgugaaguuccgcaacaaggagaccuccgcgggccccgucgccgugauggggaaggacuacuacaagauccucggcauccccagcggggccaacgaggacgagaucaagaaggccuaccggaagauggcccugaaguaccaccccgacaagaacaaggagccgaacgcggaggagaaguucaaggagaucgccgaggccuacgacgugcuguccgaccccaagaagcgcggccucuacgaccaguacggcgaggaggggcugaagaccggcgggggcaccagcgggggcuccagcggcuccuuccacuacaccuuccacggggacccccacgccacguucgccagcuucuucggcggguccaaccccuucgacaucuucuucgcgagcucccggagcacccgcccguucuccggcuucgaccccgacgacauggacgucgacgaggacgaggaccccuucggggccuucggccgguucggcuucaacgggcugagccgcggcccccgccgggccccggagccccucuacccccgccggaaggugcaggacccgcccgugguccacgagcugcgcgugagccuggaggagaucuaccacggguccaccaagcggaugaagaucacccgccggcgccucaaccccgacggccggacggugcgcaccgaggacaagauccugcacaucgucaucaagcggggguggaaggagggcaccaagaucaccuuccccaaggagggcgacgccacgcccgacaacaucccggccgacaucguguucgugcugaaggacaagccccacgcgcacuuccgccgggacgggaccaacguccucuacagcgcccugaucucccugaaggaggcccucugcggcugcaccgugaacauccccaccaucgacgggcgcgugaucccgcugcccugcaacgacgucaucaagcccggcacggugaagcggcugcgcggcgaggggcuccccuucccgaaggugcccacccagcggggcgaccugaucgucgaguucaaggugcgcuuccccgaccggcugacgccccagacccgccagauccucaagcagcaccucccgugcagcuga

SEQ ID NO: 29273 - RNA, 726 nt, Artificial Sequence
  derived and/or modified sequence opt1 from DNAJB6__Homo_sapiens__NP_005485
augguggacuacuacgagguccugggcgugcagcgccacgccagccccgaggacaucaagaaggccuaccggaagcucgcgcugaaguggcacccggacaagaaccccgagaacaaggaggaggccgagcgcaaguucaagcaggucgccgaggccuacgaggugcuguccgacgccaagaagcgggacaucuacgacaaguacgggaaggagggccucaacgggggcgggggcggcgggagccacuucgacucccccuucgaguucggcuucaccuuccgcaaccccgacgacguguuccgggaguucuucgggggccgcgacccguucagcuucgacuucuucgaggaccccuucgaggacuucuucgggaaccggcgcggcccccggggcucccgcagccgggggaccggcuccuucuucagcgcguucuccggguuccccagcuucggcuccggcuucagcuccuucgacacgggguucaccagcuucggcucccuggggcacggcgggcugaccagcuucuccagcaccuccuucggcggcagcgggaugggcaacuucaagagcaucuccacgagcaccaagauggugaacgggcgcaagaucaccaccaagcggaucgucgagaacggccaggagcgcguggagguggaggaggacgggcagcucaagucccugacgaucaacggcaaggagcagcugcuccggcuggacaacaaguga

SEQ ID NO: 29274 - RNA, 930 nt, Artificial Sequence
  derived and/or modified sequence opt1 from DNAJB7__Homo_sapiens__NP_660157
augguggacuacuacgagguccugggccuccagcgcuacgccagccccgaggacaucaagaaggccuaccacaagguggcgcugaaguggcacccggacaagaaccccgagaacaaggaggaggccgagcggaaguucaaggagguggccgaggccuacgagguccugagcaacgacgagaagcgcgacaucuacgacaaguacgggaccgagggccucaacgggggcgggagccacuucgacgacgagugcgaguacggcuucaccuuccacaagcccgacgacguguucaaggagaucuuccacgagcgggaccccuucuccuuccacuucuucgaggacagccuggaggaccugcucaaccgcccgggcuccagcuacgggaaccggaaccgcgacgccggcuacuucuucuccacggcgagcgaguaccccaucuucgagaaguucuccagcuacgacaccggguacaccucccagggcagccuggggcacgagggccugaccuccuucagcucccucgccuucgacaacagcggcauggacaacuacaucuccgugacgaccagcgacaagaucgucaacgggcggaacaucaacaccaagaagaucaucgaguccgaccaggagcgcgaggccgaggacaacggcgagcugaccuucuuccuggugaacagcguggccaacgaggagggguucgcgaaggagugcagcuggcggacgcaguccuucaacaacuacagccccaacucccacagcuccaagcacgucagccaguacaccuucguggacaacgacgagggcggcaucuccugggugaccagcaaccgcgacccgcccaucuucuccgccggggucaaggagggcgggaagcggaagaagaagaagcgcaaggaggugcagaagaaguccaccaagcggaacugcuga

SEQ ID NO: 29275 - RNA, 699 nt, Artificial Sequence
  derived and/or modified sequence opt1 from DNAJB8__Homo_sapiens__NP_699161
auggccaacuacuacgaggugcugggcguccaggccagcgcgucccccgaggacaucaagaaggccuaccgcaagcucgcccugcgguggcacccggacaagaaccccgacaacaaggaggaggccgagaagaaguucaagcuggugagcgaggccuacgaggugcucuccgacagcaagaagcgcucccuguacgaccgggcggggugcgacagcuggcgcgccggcgggggcgccuccacccccuaccacagccccuucgacaccggguacacguuccggaacccggaggacaucuuccgcgaguucuucggcggccuggaccccuucuccuucgaguucugggacagccccuucaacuccgaccgcgggggccgggggcacggccuccgcggggccuucagcgcgggcuucggcgaguuccccgccuucauggaggccuucuccagcuucaacaugcuggggugcuccggcgggagccacaccaccuucuccagcaccuccuucggcggcagcagcuccgggagcuccggcuucaagagcgucauguccagcacggagaugaucaacgggcacaaggugaccaccaagcggaucguggagaacggccaggagcgggucgagguggaggaggacgggcagcugaaguccgugaccgucaacggcaaggagcagcucaaguggauggacagcaaguga

SEQ ID NO: 29276 - RNA, 672 nt, Artificial Sequence
  derived and/or modified sequence opt1 from DNAJB9__Homo_sapiens__NP_036460
auggccacgccccagagcaucuucaucuucgccaucugcauccugaugaucaccgagcucauccuggcguccaagagcuacuacgacauccugggcgugccgaaguccgccagcgagcgccagaucaagaaggccuuccacaagcucgccaugaaguaccaccccgacaagaacaagucccccgacgccgaggcgaaguuccgggagaucgccgaggccuacgagacccugagcgacgccaaccgccggaaggaguacgacacccuggggcacuccgcguucaccagcggcaaggggcagcgcggcuccgggagcuccuucgagcagagcuucaacuucaacuucgacgaccucuucaaggacuucggcuucuucggccagaaccagaacaccggguccaagaagcgguucgagaaccacuuccagacgcgccaggacggcgggagcucccggcagcgccaccacuuccaggaguucagcuucggcgggggccuguucgacgacauguucgaggacauggagaagauguucuccuucagcggcuucgacuccaccaaccagcacaccguccagaccgagaaccgguuccacgggagcagcaagcacugccgcacggugacccagcggcgcggcaacauggugaccaccuacacggacugcuccgggcaguga

SEQ ID NO: 29277 - RNA, 2244 nt, Artificial Sequence
  derived and/or modified sequence opt1 from DNAJC10__Homo_sapiens__NP_001258510
augggcguguggcugaacaaggacgacuacauccgcgaccucaagcggaucauccugugcuuccugaucgucuacauggccauccucguggggaccgaccaggacuucuacagccugcugggcguguccaagaccgccagcucccgcgagauccggcaggcguucaagaagcucgcccugaagcugcaccccgacaagaacccgaacaaccccaacgcccacggggacuuccucaagaucaaccgcgccuacgagguccugaaggacgaggaccugcggaagaaguacgacaaguacggcgagaaggggcucgaggacaaccagggcggccaguacgagagcuggaacuacuaccgcuacgacuucgggaucuacgacgacgaccccgagaucaucacgcuggagcggcgcgaguucgacgccgcggugaacuccggcgagcugugguucgugaacuucuacagccccgggugcucccacugccacgaccucgccccgaccuggcgggacuucgccaaggaggucgacggccugcugcgcaucggggccgugaacugcggcgacgaccggaugcucugccgcaugaagggcgugaacagcuaccccucccuguucaucuuccggagcgggauggcgcccgucaaguaccacggcgaccgcuccaaggagagccugguguccuucgccaugcagcacgugcggagcaccgucaccgagcucuggacggggaacuucgugaacuccauccagaccgccuucgccgccggcaucggcuggcugaucaccuucugcagcaagggcggggacugccugaccucccagacgcgccuccggcugagcgggaugcuguuccucaacucccuggacgcgaaggagaucuaccuggaggugauccacaaccuccccgacuucgagcugcugagcgccaacacccucgaggaccgccuggcccaccaccgguggcuccuguucuuccacuucggcaagaacgagaacagcaacgacccggagcugaagaagcugaagacccuccugaagaacgaccacauccaggucgggcgcuucgacugcuccagcgcccccgacaucugcuccaaccuguacguguuccagcccagccucgccguguucaagggccagggcaccaaggaguacgagauccaccacgggaagaagauccuguacgacauccuggcguucgccaaggaguccgucaacagccacgugacgacccucggcccccagaacuucccggccaacgacaaggagcccuggcugguggacuucuucgcccccuggugcccgcccugccgggcccugcuccccgagcugcgccgcgcguccaaccugcuguacgggcagcucaaguucggcacccuggacugcaccguccacgaggggcugugcaacauguacaacauccaggccuaccccacgaccgugguguucaaccagagcaacauccacgaguacgagggccaccacuccgccgagcagauccucgaguucaucgaggaccugaugaaccccagcgucgugucccugaccccgaccacguucaacgagcucgucacccagcggaagcacaacgagguguggaugguggacuucuacagccccuggugccaccccugccagguccugaugcccgaguggaagcgcauggcccggacccugaccggccucaucaacgugggguccaucgacugccagcaguaccacagcuucugcgcccaggagaacgugcagcgcuacccggagauccgguucuucccgcccaaguccaacaaggcguaccacuaccacagcuacaacggcuggaaccgcgacgccuacucccugcggaucugggggcugggcuuccucccccaggucagcacggaccugacgccccagaccuucuccgagaaggugcugcaggggaagaaccacugggugaucgacuucuacgcccccuggugcggccccugccagaacuucgccccggaguucgagcuccuggcgcgcaugaucaagggcaaggucaaggccgggaagguggacugccaggccuacgcccagaccugccagaaggccggcauccgggcguaccccaccgugaaguucuacuucuacgagcgcgccaagcggaacuuccaggaggagcagaucaacacccgcgacgccaaggccaucgccgcgcugaucagcgagaagcucgagacccugcggaaccaggggaagcgcaacaaggacgagcuguga

SEQ ID NO: 29278 - RNA, 597 nt, Artificial Sequence
  derived and/or modified sequence opt1 from DNAJC12__Homo_sapiens__NP_068572
auggacgccauccugaacuaccgcagcgaggacaccgaggacuacuacacccuccugggcugcgacgagcuguccagcguggagcagauccucgccgaguucaagguccgggcgcuggagugccaccccgacaagcacccggagaaccccaaggccguggagacguuccagaagcugcagaaggccaaggagauccucaccaacgaggagucccgcgcccgguacgaccacuggcgccggagccagauguccaugcccuuccagcagugggaggcccugaacgacagcgugaagaccuccaugcacugggucgugcgcgggaagaaggaccugaugcucgaggagagcgacaagacccacacgaccaagauggagaacgaggagugcaacgagcagcgggagcgcaagaaggaggagcuggcguccaccgccgagaagaccgagcagaaggagcccaagccgcuggagaaguccgugagcccccagaacagcgacuccagcggcuucgccgacgucaacggguggcaccuccgguuccgcugguccaaggacgcccccagcgagcugcugcggaaguuccgcaacuacgagaucuga

SEQ ID NO: 29279 - RNA, 6732 nt, Artificial Sequence
  derived and/or modified sequence opt1 from DNAJC13__Homo_sapiens__NP_056083
augaacaucauccgcgagaacaaggaccuggccugcuucuacaccaccaagcacagcuggcggggcaaguacaagcgcguguucuccgucgggacccacgccaucaccaccuacaaccccaacacccuggaggugacgaaccaguggcccuacggcgacaucugcagcaucucccccguggggaagggccaggggaccgaguucaaccugaccuuccggaagggcagcggcaagaaguccgagacccugaaguucagcacggagcaccgcaccgagcugcugaccgaggcgcugcgguuccgcaccgacuucuccgaggggaagaucacgggccggcgcuacaacugcuacaagcaccacuggagcgacucccggaagcccgucauccuggaggugacccccgggggcuucgaccagaucaacccggccaccaaccgcgugcugugcagcuacgacuaccggaacaucgagggguucgucgaccuguccgacuaccagggcggcuucugcauccucuacgggggcuucagccgccugcaccuguucgccuccgagcagcgggaggagaucaucaagagcgccaucgaccacgccgggaacuacaucggcaucucccuccgcauccggaaggagccccuggaguucgagcaguaccugaaccuccgcuucggcaaguacagcaccgacgaguccaucacgagccuggcggaguucguggugcagaagaucagcccccggcacagcgagcccgucaagcgcgugcuggcccucaccgagaccugccugguggagcgggacccggccaccuacaacaucgccacgcugaagccccucggggaggucuucgcgcuggugugcgacagcgagaacccccagcuguucaccaucgaguucaucaagggccaggugcgcaaguacuccagcaccgagcgggacucccuccuggccagccugcucgacgggguccgcgccuccggcaaccgcgacgugugcgugaagaugacccccacgcacaaggggcagcgguggggccugcugagcaugccggucgacgaggagguggagucccuccaccuccgguuccuggccacgccgcccaacggcaacuucgccgacgcgguguuccgguucaacgccaacaucagcuacuccgggguccugcacgccgugacccaggacggccuguucagcgagaacaaggagaagcugaucaacaacgccaucaccgcccuccugucccaggagggggacguggucgcgagcaacgccgagcuggagucccaguuccaggccgugcgccggcucgucgccagcaaggccggcuuccuggcguucacgcagcugcccaaguuccgcgagcggcucggggugaagguggucaaggcccugaagcgcuccaacaacggcaucauccacgccgccguggacaugcugugcgcccucaugugcccgaugcacgacgacuacgaccugcggcaggagcagcugaacaaggcgagccuccuguccagcaagaaguuccuggagaaccugcucgagaaguucaacucccacguggaccacggcaccggggcccuggucaucagcagccugcucgacuuccugaccuucgcccugugcgcccccuacuccgagaccacggagggccagcaguucgacaugcuccuggagaugguggcgagcaacgggcgcacccuguucaagcuguuccagcaccccuccauggccaucaucaagggcgccgggcuggugaugaaggccaucaucgaggagggcgacaaggagaucgccaccaagaugcaggagcuggcgcucagcgagggcgcccugccccggcaccuccacaccgccauguucacgaucuccagcgaccagcgcaugcucaccaaccggcagcugucccgccaccuggucgggcucuggaccgccgacaacgccaccgcgaccaaccugcugaagcggauccucccgcccggccugcuggccuaccucgagagcuccgaccuggugcccgagaaggacgccgaccgcaugcacgugcgggacaacgucaagaucgccauggaccaguacgggaaguucaacaaggugcccgaguggcagcgccuggccggcaaggcggccaaggagguggagaaguucgccaaggagaaggucgaccucgugcugaugcacuggcgggaccgcaugggcaucgcccagaaggagaacaucaaccagaagccggugguccugcgcaagcggcgccagcggaucaagaucgaggcgaacugggaccucuucuacuaccgcuucgggcaggaccacgcccggagcaaccugaucuggaacuucaagacgcgcgaggagcugaaggacacccucgaguccgagaugcgggccuucaacaucgaccgcgagcugggcagcgccaacgugaucuccuggaaccaccacgaguucgaggugaaguacgagugccuggccgaggagaucaagaucggggacuacuaccuccggcugcugcucgaggaggacgagaacgaggagagcggcuccaucaagcgcagcuacgaguucuucaacgagcuguaccaccgguuccugcucacccccaaggucaacaugaagugccugugccugcaggcgcucgccaucguguacgggcgcugccacgaggagaucggccccuucaccgacacgcgguacaucaucggcaugcuggagcgcugcaccgacaagcuggagcgggaccgccucauccuguuccugaacaagcucauccugaacaagaagaacgugaaggaccugauggacuccaacgggauccggauccucgucgaccugcugacccucgcccaccuccacgugagccgcgccaccgugccccugcagagcaacgucaucgaggccgcgccggacaugaagcgggaguccgagaaggagugguacuucggcaacgccgacaaggagcgcagcgggcccuacggcuuccacgagaugcaggagcucuggacgaaggggaugcugaacgccaagacccggugcugggcccagggcauggacggcuggcgcccccugcaguccaucccgcagcucaaguggugccugcuggccagcgggcaggcggugcucaacgagaccgaccuggccacccugauccucaacaugcugaucacgaugugcggcuacuuccccucccgcgaccaggacaacgccaucauccggccccugcccaaggugaagcgccuccugagcgacagcacgugccugccgcacaucauccagcuccugcugaccuucgaccccauccucgucgagaagguggccauccugcuguaccacaucaugcaggacaacccccagcucccccggcuguaccugagcgggguguucuucuucaucaugauguacaccggcuccaacguccucccgguggcgcgcuuccugaaguacacccacaccaagcaggccuucaagagcgaggagaccaaggggcaggacaucuuccagcgguccauccugggccacauccuccccgaggccauggugugcuaccuggagaacuacgagcccgagaaguucagcgagaucuuccugggcgaguucgacacccccgaggccaucugguccagcgagaugcgccggcucaugaucgagaagaucgccgcgcaccuggccgacuucacgccgcgccugcaguccaacacccgggcccucuaccaguacugccccauccccaucaucaacuacccccagcuggagaacgagcuguucugcaacaucuacuaccugaagcagcucugcgacacccugcgcuucccggacuggcccaucaaggaccccgucaagcugcucaaggacacccuggacgccuggaagaaggagguggagaagaagcccccgaugaugagcaucgacgacgccuacgaggugcugaaccucccccaggggcagggcccccacgacgaguccaagauccggaaggcguacuuccgccuggcccagaaguaccaccccgacaagaacccggaggggcgggacauguucgagaaggucaacaaggccuacgaguuccugugcacgaaguccgccaagaucguggacggccccgaccccgagaacaucauccucauccugaagacccaguccauccuguucaaccgccacaaggaggaccuccagccguacaaguacgccggguaccccaugcugauccggaccaucaccauggagacgagcgacgaccuccuguucagcaaggagagcccccugcugcccgcggccaccgagcucgccuuccacaccgugaacugcagcgcccugaacgccgaggagcugcgccgggagaacggccucgagguccugcaggaggcguucucccgcugcguggccgugcugacccgggccagcaagccguccgacaugagcguccaggugugcggcuacaucuccaagugcuacagcguggccgcgcaguucgaggagugccgcgagaagaucacggagaugcccuccaucaucaaggaccucugccgcguccuguacuucgggaaguccaucccccggguggccgcccugggcguggagugcgucuccagcuucgccguggacuucuggcuccagacccaccuguuccaggccgggauccugugguaccuccugggcuuccuguucaacuacgacuacacccucgaggaguccggcauccagaaguccgaggagaccaaccagcaggaggucgcgaacucccuggccaagcugagcgugcacgcccucucccgccucgggggcuaccuggccgaggagcaggccacgcccgagaacccgaccauccgcaagagccucgcggggaugcugacccccuacguggcccgcaagcuggccgucgccuccgugaccgagauccucaagaugcugaacagcaacaccgagagccccuaccugaucuggaacaacuccacgcgggccgagcuccuggaguuccuggagagccagcaggagaacaugaucaagaagggcgacugcgacaagaccuacggguccgaguucguguacagcgaccacgcgaaggagcucaucgucggcgagaucuucgugcgcguguacaacgagguccccaccuuccagcuggaggugccgaaggccuucgccgccucccugcucgacuacaucggcagccaggcgcaguaccugcacaccuucauggccaucacgcacgccgccaagguggaguccgagcagcacggggaccggcugccccgcgucgagauggcccucgaggcgcugcggaacgugaucaaguacaaccccggcagcgaguccgagugcaucgggcacuucaagcugaucuucagccuccugcgcgugcacggcgccgggcagguccagcagcuggcccucgagguggugaacaucgucaccuccaaccaggacugcgugaacaacaucgccgagagcauggugcuguccagccugcucgcccugcugcacucccuccccagcucccggcagcugguccuggagacccucuacgcgcugaccagcuccacgaagaucaucaaggaggccauggccaagggcgcccugaucuaccuccuggacauguucugcaacagcacccacccccaggugcgcgcccagaccgcggagcuguucgccaagaugaccgccgacaagcucaucggccccaaggugcggaucacgcugaugaaguuccugcccagcgucuucauggacgccaugcgcgacaaccccgaggcggccgugcacaucuucgaggggacccacgagaacccggagcucaucuggaacgacaacucccgggacaaggugagcaccaccguccgcgagaugaugcuggagcacuucaagaaccagcaggacaaccccgaggccaacuggaagcugcccgaggacuucgccgugguguucggcgaggccgagggggagcucgcggucggcgggguguuccugcggaucuucaucgcccagcccgccugggugcugcgcaagccgcgggaguuccucaucgcccugcuggagaagcucacggagcugcuggagaagaacaacccccacggcgagacccucgagacccugaccauggccacggucugccuguucuccgcgcagccccagcucgccgaccaggugcccccgcugggccaccuccccaaggugauccaggccaugaaccaccgcaacaacgccauccccaagagcgccauccgggucauccacgcgcucuccgagaacgagcugugcgugcgcgccauggccagccuggagaccaucgggccgcucaugaacggcaugaagaagcgcgccgacaccguggggcuggccugcgaggcgaucaaccggauguuccagaaggagcaguccgagcuggucgcccaggcccugaaggccgaccucgugcccuaccugcugaagcuccuggagggcaucggccuggagaaccucgacagccccgcggccaccaaggcccagaucgugaaggcccugaaggccaugacgcgcucccugcaguacggggagcaggucaacgagauccucugccggagcuccguguggagcgcguucaaggaccagaagcacgaccuguucaucuccgagagccagaccgccggcuaccugaccgggcccggcguggccggguaccucaccgccggcacguccaccagcgucauguccaaccugccgccgcccguggaccacgaggccggcgaccugggguaccagaccuga

SEQ ID NO: 29280 - RNA, 2109 nt, Artificial Sequence
  derived and/or modified sequence opt1 from DNAJC14__Homo_sapiens__NP_115740
auggcccagaagcaccccggcgagcgcgggcuguacggcgcccaccacagcgggggcgcgucccuccggacccuggggccgagcguggaccccgagauccccuccuucagcggccugcgcgacuccgccggcaccgcccccaacgggacgcggugccucaccgagcacagcggcccgaagcacacccagcaccccaaccccgcccacuggcuggaccccucccacgggccgcccggcgggcccgggcccccgcgcgacgccgaggaccccgaccagagcgagaccuccagcgaggaggaguccggcgucgaccaggagcugagcaaggagaacgagacggggaaccagaaggacggcaacuccuuccucagcauccccuccgcgugcaacugccaggggacccccggcaucccggagggccccuacagcgagggcggcaacggguccagcuccaacuucugccaccacugcaccagccccgcccugggcgaggacgagcuggaggaggaguacgacgacgaggagagccucaaguuccccuccgacuucagccggguguccagcgggaagaagccgcccucccgccggcagcgccaccgguuccccaccaaggaggacacgcgcgagggcggccggcgcgacccccggagcccggggcgccaccggcugggccgcaagcggucccaggccgacaagcgcaaggggcugggccucuggggcgccgaggagcugugccagcuggggcaggcgggcuucugguggcucaucgagcugcuggugcucgucggggaguacguggagaccugcggccaccugaucuacgccugccggcagcucaagagcuccgaccuggaccuguuccgcguguggaugggggucuggaccggccggcucgggggcugggcccaggugauguuccaguuccugagccagggcuucuacugcggggugggccuguucacccgcuuccugaagcuccugggggcccugcuccugcuggcccucgcgcuguuccugggcuuccuccagcugggcuggcgcuuccuggucgggcucggcgaccggcugggguggcgcgacaaggccacguggcuguucuccuggcucgacagccccgcccugcagcggugccugacccuccugcgcgacucccggcccuggcagcgccuggugcggaucgugcaguggggcuggcucgagcugcccugggucaagcagaacaucaaccgccaggggaacgccccgguggccagcggccgguacugccagcccgaggaggagguggcgcgccugcugaccauggccggcguccccgaggacgagcucaacccguuccacgugcuggggguggaggccaccgccuccgacgucgagcugaagaaggccuaccggcagcucgcggugauggugcaccccgacaagaaccaccacccccgcgccgaggaggccuucaagguccugcgggccgccugggacaucgugagcaacgcggagaagcgcaaggaguacgagaugaagcggauggccgagaacgagcugucccgcagcgugaacgaguuccucuccaagcugcaggacgaccugaaggaggccaugaacacgaugaugugcagccggugccagggcaagcaccgccgguucgagauggaccgcgagcccaagagcgcccgcuacugcgcggagugcaaccggcuccacccggccgaggagggggacuucugggccgaguccagcaugcugggccugaagaucaccuacuucgcccucauggacgggaaggucuacgacaucaccgagugggccggcugccagcgcgugggcaucucccccgacacccaccggguccccuaccacaucagcuucgggucccgcauccccggcacgcgggggcgccagcgggcgaccccggacgccccgcccgccgaccugcaggacuuccugagccgcaucuuccaggugccgcccggccagaugcccaacgggaacuucuucgccgcgccccagcccgcccccggcgccgccgccgccuccaagcccaacagcaccgugcccaagggcgaggcgaagcccaagcggcgcaagaagguccggcgcccguuccagcgguga

SEQ ID NO: 29281 - RNA, 453 nt, Artificial Sequence
  derived and/or modified sequence opt1 from DNAJC15__Homo_sapiens__NP_037370
auggccgcccgcggcgugaucgcgcccgucggggagagccugcgguacgccgaguaccuccagccguccgccaagcgccccgacgccgacguggaccagcagcggcuggugcgcagccugaucgccgucggccucgggguggcggcccuggccuucgccggccgguacgcguuccgcaucuggaagccccuggagcaggucaucaccgagaccgccaagaagaucuccacgcccagcuucuccagcuacuacaagggcggguucgagcagaagaugucccggcgcgaggccggccucauccugggggugagcccguccgccggcaaggccaagauccggaccgcgcaccgccgggugaugauccugaaccaccccgacaagggcgggagccccuacguggccgccaagaucaacgaggccaaggaccuccuggagaccaccacgaagcacuga

SEQ ID NO: 29282 - RNA, 1077 nt, Artificial Sequence
  derived and/or modified sequence opt1 from DNAJC18__Homo_sapiens__NP_689899
auggccgccacccugggcagcggggagcgcuggaccgaggcguacaucgacgccgugcggcgcaacaaguaccccgaggacacgccgcccgagucccacgaccccugcggcugcugcaacugcaugaaggcccagaaggagaagaaguccgagaacgaguggacccagacccggcagggggagggcaacagcaccuacagcgaggagcagcuccuggggguccagcgcaucaagaagugccggaacuacuacgagauccugggcgugucccgcgacgccagcgacgaggagcucaagaaggccuaccggaagcuggcgcugaaguuccaccccgacaagaacugcgccccgggcgccacggacgccuucaaggcgaucgggaacgccuucgccgugcucuccaaccccgacaagcgccugcgguacgacgaguacggcgacgagcaggucaccuucaccgcgccccgcgcccggcccuacaacuacuaccgcgacuucgaggccgacaucaccccggaggagcuguucaacguguucuucgggggccacuuccccacggggaacauccacauguucagcaacgugaccgacgacaccuacuacuaccggcgccggcaccgccacgagcggacccagacgcagaaggaggaggaggaggagaagccccagaccaccuacuccgccuucauccagcuccugcccguccuggugaucgugaucaucagcgucaucacccagcuccuggccacgaacccgcccuacucccuguucuacaagagcacccucggcuacaccaucucccgcgagacccagaaccuccaggugcccuacuucguggacaagaacuucgacaaggccuaccggggcgccagccugcacgaccuggagaagacgaucgagaaggacuacaucgacuacauccagaccuccugcuggaaggagaagcagcagaaguccgagcugaccaaccuggcggggcucuaccgcgacgagcggcugaagcagaaggccgagagccugaagcucgagaacugcgagaagcugagcaagcugaucggccuccgccgcgggggcuga

SEQ ID NO: 29283 - RNA, 351 nt, Artificial Sequence
  derived and/or modified sequence opt1 from DNAJC19__Homo_sapiens__NP_660304
auggccagcaccgugguggccgugggccugaccaucgcggccgccggguucgccggccgcuacgugcuccaggccaugaagcacauggagccccaggucaagcaggucuuccagucccugcccaagagcgcguucuccgggggcuacuaccgcgggggcuucgagccgaagaugacgaagcgggaggccgcccugauccucggcgugagccccaccgccaacaaggggaagauccgggacgcgcaccgccggaucaugcugcugaaccaccccgacaagggcggguccccguacaucgccgccaagaucaacgaggccaaggaccuccuggagggccaggccaagaaguga

SEQ ID NO: 29284 - RNA, 1665 nt, Artificial Sequence
  derived and/or modified sequence opt1 from DNAJC1__Homo_sapiens__NP_071760
augaccgcccccugcagccagccggcccagcugcccggccgccggcagcucgggcuggugcccuucccgcccccgccgccccgcacgccccugcucuggcugcugcuccugcugcucgcggccgucgcccccgcccggggcugggaguccggggaccuggagcuguucgaccucguggaggaggugcagcugaacuucuaccaguuccugggcguccagcaggacgccagcuccgcggacauccgcaaggccuaccggaagcucagccugacccugcaccccgacaagaacaaggacgagaacgccgagacccaguuccgccagcucguggccaucuacgaggugcugaaggacgacgagcggcgccagcgguacgacgacauccugaucaacgggcuccccgacuggcgccagcccgucuucuacuaccggcgcgugcggaagauguccaacgcggagcuggcccugcuccuguucaucauccugaccgugggccacuacgccgucguguggagcaucuaccucgagaagcagcuggacgagcugcucucccgcaagaagcgggagaagaagaagaagaccggcagcaaguccguggacgucagcaagcugggggccuccgagaagaacgagcgccugcucaugaagccccaguggcacgaccugcugcccugcaagcucggcaucugguucugccugacgcugaaggcccucccccaccugauccaggacgcggggcaguucuacgccaaguacaaggagacccggcugaaggagaaggaggacgcccucacccgcaccgagcuggagacgcugcagaagcagaagaaggugaagaagccgaagcccgaguuccccguguacacgccccucgagaccaccuacauccagagcuacgaccacggcaccuccaucgaggagaucgaggagcagauggacgacuggcuggagaaccggaaccgcacccagaagaagcaggccccggaguggaccgaggaggaccugagccagcucacccgguccauggucaaguuccccgggggcacgcccggccgcugggagaagaucgcccacgagcuggggcgcagcgugaccgacgugaccaccaaggcgaagcagcugaaggacuccgucacgugcagccccggcauggugcggcuguccgagcucaagagcaccgugcagaacagccgcccgaucaagaccgccaccacgcugcccgacgacaugaucacccagcgggaggacgccgagggggucgccgccgaggaggagcaggagggcgacuccggcgagcaggagaccggggcgaccgacgcccgcccccggcgccggaagcccgcccgccugcucgaggccacggccaagccggagcccgaggagaagucccgggcgaagcgccagaaggacuucgacaucgccgagcagaacgagagcagcgacgaggagucccugcggaaggagcgcgcccggagcgccgaggagcccuggacccagaaccagcagaagcugcucgagcuggcgcugcagcaguacccgcgcggcuccagcgaccggugggacaagaucgcccgcugcgugcccuccaagagcaaggaggacugcaucgcccgguacaagcuccugguggagcugguccagaagaagaagcaggccaaguccuga

SEQ ID NO: 29285 - RNA, 822 nt, Artificial Sequence
  derived and/or modified sequence opt1 from DNAJC27__Homo_sapiens__NP_057628
auggaggccaacaugcccaagcgcaaggagccgggccggagccugcgcaucaaggugaucuccauggggaacgccgaggucggcaagagcugcaucaucaagcgguacugcgagaagcgcuucguguccaaguaccucgcgaccaucgggaucgacuacggcgugaccaagguccacgugcgggaccgcgagaucaaggugaacaucuucgacauggccgggcaccccuucuucuacgagguccggaacgaguucuacaaggacacgcagggcgugauccugguguacgacgucggccagaaggacagcuucgacgcccuggacgccuggcucgccgagaugaagcaggagcuggggccccacggcaacauggagaacaucaucuucguggugugcgcgaacaagaucgacugcaccaagcaccgcugcgucgacgaguccgaggggcggcugugggccgagagcaagggcuuccucuacuucgagaccuccgcccagaccggggagggcaucaacgagauguuccagacguucuacaucagcaucguggaccugugcgagaacggcgggaagcgccccaccaccaacuccagcgccuccuucaccaaggagcaggcggacgccauccggcgcauccggaacagcaaggacuccugggacaugcugggcgugaagccgggggccagccgcgacgaggucaacaaggccuaccggaagcucgccgugcugcugcaccccgacaagugcguggcgcccggcuccgaggacgccuucaaggccgucgugaacgcccgcacggcccuccugaagaacaucaaguga

SEQ ID NO: 29286 - RNA, 1167 nt, Artificial Sequence
  derived and/or modified sequence opt1 from DNAJC28__Homo_sapiens__NP_060303
augaacaccauguacgugaugauggcccagauccugcgcagccaccucaucaaggccaccgucauccccaaccgggugaagaugcugccguacuucggcaucauccgcaaccggaugauguccacgcacaagagcaagaagaagauccgcgaguacuaccggcugcucaacguggaggaggggugcuccgcggacgagguccgcgagagcuuccacaagcuggccaagcaguaccaccccgacuccggcagcaacaccgccgacuccgccaccuucauccggaucgagaaggccuaccgcaaggugcugagccacgugaucgagcagaccaacgcgucccagagcaagggggaggaggaggaggacgucgagaaguucaaguacaagacgccccagcaccggcacuaccucuccuucgagggcaucggguucggcacccccacccagcgcgagaagcacuaccggcaguuccgcgccgaccgggccgccgagcaggucauggaguaccagaagcagaagcugcagagccaguacuucccggacuccgugaucgugaagaacauccgccagagcaagcagcagaagaucacccaggcgaucgagcggcugguggaggaccucauccaggaguccauggccaagggcgacuucgacaaccugagcgggaagggcaagccccugaagaaguucuccgacugcagcuacaucgaccccaugacgcacaaccucaaccgcauccugaucgacaacggguaccagcccgaguggauccugaagcagaaggagaucuccgacaccaucgagcagcuccgggaggccauccuggugagccgcaagaagcugggcaacccgaugacccccaccgagaagaagcaguggaaccacgucugcgagcaguuccaggagaacauccggaagcucaacaagcgcaucaacgacuucaaccugaucgugcccauccugacgcggcagaaggugcacuucgacgcccagaaggagaucguccgcgcccagaagaucuacgagacccucaucaagaccaaggaggugaccgaccgcaaccccaacaaccuggaccagggggagggcgagaagacgccggagaucaagaagggcuuccugaacuggaugaaccucuggaaguucaucaagauccggagcuucuga

SEQ ID NO: 29287 - RNA, 1707 nt, Artificial Sequence
  derived and/or modified sequence opt1 from DNAJC2__Homo_sapiens__NP_001123359
augcugcuccugcccagcgccgccgacggccgcgggaccgcgaucacccacgcccugacguccgccagcacccucugccagguggagccggucggccggugguucgaggccuucgugaagcgccggaaccgcaacgccuccgcgagcuuccaggagcuggaggacaagaaggagcuguccgaggagagcgaggacgaggagcuccagcuggaggaguuccccaugcugaagacccucgaccccaaggacuggaagaaccaggaccacuacgccgugcuggggcugggccacguccgguacaaggccacccagcgccagaucaaggccgcgcacaaggccauggugcucaagcaccaccccgacaagcggaaggccgccggggagccgaucaaggagggcgacaacgacuacuucacgugcaucaccaaggccuacgagaugcuguccgaccccgugaagcgccgggcguucaacagcgucgaccccaccuucgacaacuccgugcccagcaaguccgaggccaaggacaacuucuucgagguguucaccccggucuucgagcgcaacagccggugguccaacaagaagaacgugcccaagcugggcgacaugaacagcuccuucgaggacguggacaucuucuacagcuucugguacaacuucgacuccuggcgcgaguucagcuaccucgacgaggaggagaaggagaaggccgagugccgggacgagcgccgguggaucgagaagcagaaccgcgccacgcgggcccagcgcaagaaggaggagaugaaccggauccgcacccuggucgacaacgcguacuccugcgacccccggaucaagaaguucaaggaggaggagaaggccaagaaggaggccgagaagaaggccaaggccgaggcgaagcgcaaggagcaggaggccaaggagaagcagcgccaggccgagcuggaggccgcccggcucgcgaaggagaaggaggaggaggaggugcgccagcaggcccugcuggccaagaaggagaaggacauccagaagaaggccaucaagaaggagcggcagaagcuccgcaacagcugcaagaucgaggagaucaacgagcagauccggaaggagaaggaggaggcggaggcccgcaugcggcaggccagcaagaacaccgagaaguccaccgggggcgggggcaacgggagcaagaacugguccgaggacgaccugcagcugcucaucaaggccgugaaccuguuccccgccggcacgaacagccgcugggaggucaucgcgaacuacaugaacauccacuccagcuccggcgugaagcggaccgccaaggacgugaucgggaaggccaagagccugcagaagcucgacccgcaccagaaggacgacaucaacaagaaggccuucgacaaguucaagaaggagcacggcgucgugccccaggccgacaacgcgacccccuccgagcgcuucgaggggcccuacaccgacuucacgccguggaccaccgaggagcagaagcugcuggagcaggcccucaagaccuaccccgugaacacgcccgagcggugggagaagaucgccgaggccguccccggccgcaccaagaaggacugcaugaagcgguacaaggagcugguggagauggugaaggccaagaaggcggcccaggagcagguccugaacgccagccgcgccaagaaguga

SEQ ID NO: 29288 - RNA, 1515 nt, Artificial Sequence
  derived and/or modified sequence opt1 from DNAJC3__Homo_sapiens__NP_006251
augguggcccccggcagcgucaccucccgccuggggagcguguucccguuccuccuggugcuggucgaccuccaguacgagggcgccgagugcggggugaacgcggacguggagaagcaccuggagcugggcaagaagcuccuggccgccgggcagcuggccgacgcccucucccaguuccacgcggccgucgacggcgaccccgacaacuacaucgccuacuaccggcgcgccaccguguuccuggcgaugggcaagagcaaggccgcccugcccgaccucacgaaggugauccagcugaagauggacuucaccgccgcccggcugcagcgcgggcaccuccugcugaagcagggcaagcucgacgaggcggaggacgacuucaagaagguccugaaguccaaccccagcgagaacgaggagaaggaggcccagucccagcugaucaagagcgacgagaugcagcggcuccgcucccaggcccugaacgccuucgggagcggcgacuacaccgccgcgaucgccuuccuggacaagauccucgaggugugcgugugggacgccgagcugcgggagcugcgcgccgagugcuucaucaaggagggggagccgcggaaggccaucuccgaccucaaggcggccagcaagcugaagaacgacaacaccgaggccuucuacaagaucuccacgcuguacuaccagcucggcgaccacgagcugagccuguccgagguccgcgagugccucaagcuggaccaggaccacaagcggugcuucgcccacuacaagcaggucaagaagcugaacaagcucaucgagagcgccgaggagcugauccgcgacggccgguacaccgacgcgaccuccaaguacgagagcgugaugaagaccgagcccuccaucgccgaguacacggugcgcagcaaggagcggaucugccacugcuucagcaaggacgagaagcccguggaggccauccgcgugugcuccgagguccugcagauggagcccgacaacgugaacgcccucaaggaccgggcggaggccuaccugaucgaggagauguacgacgaggccauccaggacuacgagaccgcccaggagcacaacgagaacgaccagcagauccgcgaggggcuggagaaggcccagcggcuccugaagcagagccagaagcgcgacuacuacaagauccugggcgugaagcggaacgcgaagaagcaggagaucaucaaggccuaccgcaagcucgcccugcaguggcacccggacaacuuccagaacgaggaggagaagaagaaggccgagaagaaguucaucgacaucgccgcggccaaggagguccuguccgaccccgagaugcgcaagaaguucgacgacggggaggacccccucgacgccgagagccagcagggcggcgggggcaaccccuuccaccgguccuggaacagcuggcagggguucaacccguucuccagcggcgggcccuuccgcuucaaguuccacuucaacuga

SEQ ID NO: 29289 - RNA, 597 nt, Artificial Sequence
  derived and/or modified sequence opt1 from DNAJC5__Homo_sapiens__NP_079495
auggccgaccagcgccagcggagccuguccaccagcggcgagucccucuaccacgugcuggggcuggacaagaacgccaccagcgacgacaucaagaaguccuaccgcaagcucgcgcugaaguaccaccccgacaagaacccggacaaccccgaggccgccgacaaguucaaggagaucaacaacgcccacgccauccugacggacgcgaccaagcggaacaucuacgacaaguacggcagccucgggcuguacgucgccgagcaguucggcgaggagaacgugaacaccuacuucgugcuguccagcuggugggccaaggcccucuucgucuucugcgggcugcugaccugcugcuacugcugcugcugccucugcugcugcuucaacugcugcugcggcaagugcaagcccaaggcgcccgagggcgaggagacggaguucuacguguccccggaggaccuggaggcccagcugcagagcgacgagcgcgaggccaccgacacccccaucgugauccagcccgccuccgccaccgagacgacccagcucaccgcggacagccaccccuccuaccacaccgacggguucaacuga

SEQ ID NO: 29290 - RNA, 1317 nt, Artificial Sequence
  derived and/or modified sequence opt1 from DNAJC7__Homo_sapiens__NP_001138238
augugccccaagaacgccagcuacuacggcaaccgcgccgcgacccugaugaugcucgggcgguuccgcgaggcccugggcgacgcccagcaguccgugcggcuggacgacagcuucguccgcgggcaccuccgggagggcaagugccaccugucccuggggaacgccauggccgcgugccgcagcuuccagcgggcccucgagcuggaccacaagaacgcccaggcccagcaggaguucaagaacgcgaacgccgugauggaguacgagaagaucgccgagaccgacuucgagaagcgcgacuuccggaagguggucuucugcauggaccgcgcccuggaguucgccccggcgugccaccgguucaagauccucaaggccgagugccuggccaugcugggccgcuaccccgaggcccaguccguggccagcgacauccuccggauggacuccacgaacgcggacgcccuguacgugcgcggccugugccucuacuacgaggacugcaucgagaaggccguccaguucuucgugcaggcccugcggauggcccccgaccacgagaaggcgugcaucgccugccgcaacgccaaggcccugaaggccaagaaggaggacgggaacaaggcguucaaggagggcaacuacaagcucgccuacgagcuguacaccgaggcccuggggaucgaccccaacaacaucaagaccaacgccaagcucuacugcaaccggggcaccgugaacagcaagcugcgcaagcuggacgacgcgaucgaggacugcacgaacgccgucaagcucgacgacaccuacaucaaggccuaccugcggcgcgcccagugcuacauggacaccgagcaguacgaggaggccgugcgggacuacgagaagguguaccagaccgagaagacgaaggagcacaagcagcugcucaagaacgcgcagcuggagcugaagaaguccaagcgcaaggacuacuacaagauccucggggucgacaagaacgccagcgaggacgagaucaagaaggccuaccgcaagcgggcccugaugcaccacccggaccgccacuccggcgccagcgcggaggugcagaaggaggaggagaagaaguucaaggaggugggcgaggccuucaccauccuguccgaccccaagaagaagacccgguacgacagcgggcaggaccucgacgaggagggcaugaacaugggggacuucgaccccaacaacaucuucaaggccuucuucggcggccccgggggcuucuccuucgaggccagcgggccgggcaacuucuucuuccaguucggguga

SEQ ID NO: 29291 - RNA, 573 nt, Artificial Sequence
  derived and/or modified sequence opt1 from DNAL1__Homo_sapiens__NP_113615
auggccaaggccaccaccaucaaggaggcgcuggcccgcugggaggagaagacgggccagcggcccagcgaggccaaggagaucaagcucuacgcccagaucccgcccaucgagaagauggacgccucccugagcaugcuggcgaacugcgagaagcucucccugagcaccaacugcaucgagaagaucgccaaccugaacgggcucaagaaccugcgcauccugucccucggccggaacaacaucaagaaccugaacgggcuggaggccgugggcgacacccucgaggagcuguggaucagcuacaacuucaucgagaagcugaaggggauccacaucaugaagaagcucaagauccuguacauguccaacaaccuggucaaggacugggccgaguucgugaagcucgcggagcugcccugccuggaggaccucguguucgucggcaacccccuggaggagaagcacagcgccgagaacaacuggaucgaggaggccaccaagcgcgugccgaagcugaagaagcucgacggcacgcccgugaucaagggggacgaggaggaggacaacuga

SEQ ID NO: 29292 - RNA, 849 nt, Artificial Sequence
  derived and/or modified sequence opt1 from DNASE1__Homo_sapiens__XP_011520696
augcgcggcaugaagcugcucggggcccugcuggcccucgcggcccugcugcagggcgccgugagccucaagaucgccgccuucaacauccagaccuucggggagaccaagauguccaacgcgacgcuggucagcuacaucgugcagauccugucccgguacgacaucgcccucgugcaggagguccgcgacagccaccugaccgccgugggcaagcugcucgacaaccugaaccaggacgcccccgacaccuaccacuacguggucuccgagccgcuggggcggaacagcuacaaggagcgcuaccucuucguguaccggcccgaccagguguccgcggucgacagcuacuacuacgacgacggcugcgagcccugcggcaacgacaccuucaaccgcgagcccgccaucgugcgguucuucucccgcuucacggaggugcgggaguucgccaucgucccgcugcacgccgcccccggggacgcgguggccgagaucgacgcccuguacgacguguaccucgacguccaggagaaguggggccuggaggacgugaugcugaugggggacuucaacgccggcugcagcuacgugcgccccucccaguggagcuccauccggcucuggaccagccccaccuuccaguggcugaucccggacuccgccgacaccacggcgacccccacccacugcgccuacgaccgcaucgucguggccgggaugcugcuccggggcgccgugguccccgacagcgcccugcccuucaacuuccaggcggccuacggccuguccgaccagcucgcccaggccaucagcgaccacuacccgguggaggugaugcugaaguga

SEQ ID NO: 29293 - RNA, 900 nt, Artificial Sequence
  derived and/or modified sequence opt1 from DNASE1L2__Homo_sapiens__NP_001288609
augggcgggccccgcgcccugcucgccgcgcugugggcccuggaggccgccggcaccgccgcgcuccggaucggggccuucaacauccagagcuucggcgacuccaaggugagcgacccggccugcggguccaucaucgccaagauccuggcgggcuacgaccuggcccucguccaggaggugcgcgaccccgaccugagcgccguguccgcccugauggagcagaucaacagcgucuccgagcacgaguacagcuucguguccagccagccccucggccgggaccaguacaaggagauguaccuguucguguaccgcaaggacgccgucuccgugguggacaccuaccuguaccccgacccggaggacgucuucagccgggagcccuucguggugaaguucuccgcgcccgggacgggcgagcgcgcgcccccgcuccccagccggcgcgcccugaccccgccgccccugcccgccgccgcccagaaccucguccugaucccccugcacgccgcgccccaccaggccguggccgagaucgacgcccucuacgacguguaccuggacgucaucgacaagugggggaccgacgacaugcuguuccucggcgacuucaacgccgacugcuccuacgugcgggcccaggacugggccgccauccgccugcggagcuccgagguguucaaguggcugauccccgacagcgcggacaccacggucgggaacuccgacugcgccuacgaccgcaucguggccugcggcgcccggcuccgccggagccugaagccccagagcgcgaccgugcacgacuuccaggaggaguucggccuggaccagacccaggcccucgccaucuccgaccacuuccccgucgaggugacccugaaguuccaccgcuga

SEQ ID NO: 29294 - RNA, 828 nt, Artificial Sequence
  derived and/or modified sequence opt1 from DNASE1L3__Homo_sapiens__NP_001243489
augagccgcgagcuggcgccccuccugcugcuccugcuguccauccacagcgcccucgccaugcggaucugcuccuucaacgugcgcagcuucggcgaguccaagcaggaggacaagaacgccauggacgucaucgugaaggugaucaagcggugcgacaucauccuggucauggagaucaaggacagcaacaaccgcaucugcccgauccugauggagaagcucaaccgggagaagcugguguccgugaagcgcagcuaccacuaccacgacuaccaggacggggacgccgacgucuucucccgggagcccuucguggugugguuccagagcccccacaccgccgucaaggacuucgugaucaucccccugcacaccacgccggagaccuccgugaaggagaucgacgagcucgucgagguguacaccgacgugaagcaccgcuggaaggccgagaacuucaucuucaugggcgacuucaacgcggggugcagcuacguccccaagaaggccuggaagaacauccggcugcgcaccgacccccgguucguguggcugaucggcgaccaggaggacacgaccgugaagaaguccaccaacugcgccuacgaccgcaucguccuccgggggcaggagaucgugagcuccgugguccccaagagcaacuccguguucgacuuccagaaggccuacaagcugaccgaggaggaggcgcuggacgugagcgaccacuucccggucgaguucaagcuccaguccagccgcgccuucacgaacagcaagaaguccgugacccugcggaagaagaccaagagcaagcgcuccuga

SEQ ID NO: 29295 - RNA, 462 nt, Artificial Sequence
  derived and/or modified sequence opt1 from DNASE2B__Homo_sapiens__XP_011540180
augccccagcugugcacccgcgccagcuccagcgagaucccgggccggcuccugaccacgcugcaguccgcccaggggcagaaguuccuccacuucgcgaaguccgacuccuuccuggacgacaucuucgccgccuggauggcccagcgccugaagacccaccuccugaccgagaccuggcagcggaagcgccaggagcugcccagcaacugcucccuccccuaccacguguacaacaucaaggccaucaagcugagccggcacuccuacuucagcuccuaccaggaccacgcgaaguggugcaucagccagaagggcacgaagaaccgcuggaccugcaucggggaccugaaccggagcccccaccaggccuuccgcagcggcggguucaucugcacccagaacuggcagaucuaccaggccuuccagggccucguccuguacuacgaguccugcaaguga

SEQ ID NO: 29296 - RNA, 1083 nt, Artificial Sequence
  derived and/or modified sequence opt1 from DNASE2__Homo_sapiens__NP_001366
augaucccccugcuccuggccgcccugcucugcgugccggcgggcgcccugaccugcuacggggacagcggccagcccgucgacugguucgugguguacaagcugcccgcccuccgcggguccggcgaggccgcccagcgggggcugcaguacaaguaccuggacgagagcuccggcggcuggcgcgacgggcgggcgcucaucaacagccccgagggcgccgucgggcgcucccugcagccgcuguaccggagcaacaccucccagcucgccuuccugcuguacaacgaccagccgccccagcccagcaaggcccaggacuccagcaugcgcggccacacgaagggggugcuccugcuggaccacgacggcggcuucuggcucgugcacuccguccccaacuucccgccgcccgcgagcuccgccgccuacagcuggccccacuccgccugcaccuacgggcagacccugcugugcgugagcuuccccuucgcccaguucuccaagaugggcaagcagcucaccuacacguaccccuggguguacaacuaccagcuggaggggaucuucgcgcaggaguuccccgaccuggagaacgucgugaagggccaccacgugagccaggagcccuggaacuccagcaucacccucaccagccaggccggcgccgucuuccaguccuucgccaaguucagcaaguucggggacgaccuguacuccggcuggcuggccgcggcccucgggaccaaccuccaggugcaguucuggcacaagacggugggcauccugcccagcaacugcuccgacaucuggcagguccugaacgugaaccagaucgccuuccccgggcccgccggcccgagcuucaacuccaccgaggaccacagcaaguggugcgugucccccaagggccccuggaccugcgucggggacaugaaccggaaccagggcgaggagcagcgcgggggcgggacccugugcgcccagcugcccgcgcucuggaaggccuuccagccgcuggugaagaacuaccagcccugcaacggcauggcccggaagcccagccgcgccuacaagaucuga

SEQ ID NO: 29297 - RNA, 1062 nt, Artificial Sequence
  derived and/or modified sequence opt1 from DND1__Homo_sapiens__NP_919225
augcagagcaagcgcgacugcgagcuguggugcgagcgggugaaccccgagaacaaggccgcccucgaggcguggguccgcgagaccggcauccggcugguccaggugaacgggcagcgcaaguacggcgggccgccgcccggcuggguggggagcccgccgcccgccggcuccgagguguucaucggccggcugccccaggacguguacgagcaccagcucaucccccuguuccagcgcgucgggcggcuguacgaguuccgccucaugaugaccuucuccggccugaaccggggguucgccuacgcccgcuacagcucccggcgcggcgcccaggcggccaucgccacgcugcacaaccacccccuccggcccagcugcccccugcuggugugccgcuccaccgagaagugcgagcucagcguggacgggcugccgcccaaccugacccgguccgcccuccugcuggcgcuccagccccugggccccggccugcaggaggcccgccuccugcccagccccgggcccgcccccggccagaucgcccugcucaaguucuccagccaccgggccgcggccauggccaagaaggcccuggucgaggggcagucccaccugugcggcgagcaggucgccguggaguggcucaagcccgaccugaagcagcgccugcggcagcagcucgugggcccguuccugcgcagcccccagcccgaggggucccagcuggcgcucgcccgggacaagcugggcuuccagggggcccgcgccacccugcagcuccugugccagcgcaugaagcugggcagccccguguuccucacgaagugccuggggaucggcccggccggcuggcaccgguucugguaccagguggucauccccgggcaccccgugcccuucuccggccugaucugggugguccucacccuggacgggcgcgacggccacgagguggcgaaggacgccgugagcguccggcugcuccaggcccuguccgagagcggggccaaccugcucuggagcgccggcgcggaggccggcaccauggugaagcaguga

SEQ ID NO: 29298 - RNA, 2214 nt, Artificial Sequence
  derived and/or modified sequence opt1 from DNER__Homo_sapiens__NP_620711
augcagccccgccgggcccaggccccgggcgcgcagcugcuccccgcccuggcccugcuccugcugcuccugggggccggcccccgcgggagcucccuggccaaccccgugccggcggcgccccucagcgcccccggccccugcgccgcccagccgugccggaacgggggcgucugcaccucccgccccgagcccgacccccagcacccggcccccgccggcgagcccggguacagcugcacgugccccgccggcaucuccggggccaacugccagcugguggcggacccgugcgccagcaaccccugccaccacggcaacugcuccagcuccagcuccagcuccagcgacggguaccugugcaucugcaacgagggcuacgagggccccaacugcgagcaggcccuccccucccugccggccacgggguggaccgagagcauggcgccccggcagcugcagcccgugcccgccacccaggagccggacaagauccucccccgcucccaggccaccgucacgcugcccaccuggcagcccaagaccggccagaaggugguggagaugaagugggaccaggucgaggugaucccggacaucgccugcgggaacgccagcuccaacagcagcgccggcggccggcugguguccuucgaggucccccagaacaccagcgugaagauccgccaggacgcgacggccucccucauccugcuguggaaggugaccgccaccggguuccagcagugcagccucaucgacggccgguccgucaccccgcugcaggccagcgggggccuggugcuccuggaggagaugcuggcccucgggaacaaccacuucaucggcuucgugaacgacuccgucaccaagagcaucguggcgcugcgccugacccucguggucaagguguccacgugcgugcccggcgagagccacgccaacgaccuggagugcuccgggaagggcaagugcaccaccaagcccagcgaggccaccuucuccugcacgugcgaggagcaguacgucgggaccuucugcgaggaguacgacgccugccagcggaagcccugccagaacaacgcgagcugcaucgacgccaacgagaagcaggacggcuccaacuucacgugcgugugccugcccggguacaccggcgagcucugccagagcaagaucgacuacugcauccuggacccgugccgcaacggcgcgaccugcaucuccagccuguccggguucacgugccagugccccgagggcuacuucgggagcgccugcgaggagaagguggaccccugcgccagcucccccugccagaacaacgggaccugcuacgucgacggcgugcacuucacgugcaacugcagcccgggcuucaccggcccgaccugcgcccagcucaucgacuucugcgcccugucccccugcgcccacgggaccugccggagcgucggcaccuccuacaagugccugugcgaccccggguaccacggccucuacugcgaggaggaguacaacgagugccugagcgcccccugccugaacgccgcgaccugccgcgaccucgugaacggcuacgagugcgugugccuggccgaguacaaggggacccacugcgagcuguacaaggaccccugcgccaacgucuccugccucaacggcgcgaccugcgacagcgacgggcugaacgggaccugcaucugcgcccccggcuucaccggcgaggagugcgacaucgacaucaacgagugcgacuccaaccccugccaccacggcgggagcugccuggaccagccgaacggcuacaacugccacugcccccacgggugggugggcgccaacugcgagauccaccuccaguggaaguccgggcacauggccgagagccugaccaacaugccccggcacucccuguacaucaucaucggcgcccugugcguggccuucauccucaugcugaucauccugaucgucggcaucugccgcaucagccggaucgaguaccagggguccagccgccccgcguacgaggaguucuacaacugccgguccaucgacagcgaguucagcaacgccaucgccuccauccgccacgcccgguucggcaagaagucccgcccggccauguacgacgugagccccaucgcguacgaggacuacagccccgacgacaagccccucgugacgcugaucaagaccaaggaccuguga

SEQ ID NO: 29299 - RNA, 14262 nt, Artificial Sequence
  derived and/or modified sequence opt1 from DNHD1__Homo_sapiens__NP_653267
auggugcccgaggagcggcgggugggccuguccuccgacgagaccuccuccgacagccugaaguccuggcacagcaucugcgugcuggacuccaaggagcagccccuggccugccagcagaagcagcgccaguucgugaagcccgugaccgagagcgagcagcccaccgugcuggagcugcugcuggccgagcugcggacccuguucuccgccgugcugcaggacagcucccccgccgccuggcgcuaccugcacgccgugcuggggcugcugccgcccuaccgggagcugcuggugggccaccuggaccugcugcccuuccuggagcagcuguacugcugggcccccugggugcagacccaccuccaccuggaccugcucggggccaucgugcaggccuucccgcccgacagcucccugcuggacagcgccucccacgccgacugcugcccccagaagcgccggcuccaccaccggccgcccugccccgcgugccccuucgugcaggcccaguggagccggcagcaggucaaggaggagcuggccaccuggcugcgcccccucacccugcccgagcugcagcggugccucggcaucgugggggcccagguggcccuggaggaggccguguggcuggacggccucucccugcugccccucgcccuggccgccgacauccccguccgcuacgagagcuccgacaccgacaacgccgagguggagcccgugggccggaaggagacccgcagccagcuggacuacgaggucccccgggagaaggccuuccagaaguccuccaccggguucagccccgagacguccuuccucgacagccaggugaugaccgcccugaagauggagcgcuaccugaagaagauccacuuccucuaccugaacguggcccccucccgguacuuccgccccuacagccugauggucgugccgcccgacaaggugaaccccgagcacuacaucuucucccccuucggcauccuccacguccaccccguggaggggagcgagaccaugacccugggcacguggcaccaccacugcguccuguggcagcagcugcaguucauccccuucuucaaguacugccuccugcggaaguccuucacgugcuggaagaagaacgugcgccugcaggggcuccaccggcugcagaaguuccuggagaaccaccuccugcuggccgugccccacuucggcgccggccuccugcacaucagccgccugcuccaggagcugcacuccgucagcuggcugccccaggagcucgaccgcugcuacgagcugcuggaccuccagaccgcgcuggccgaggagaagcacaaggcccugcggcuccugcaccgcugccugaaccucugcaccuccauccugcggcuggugcacgaggacacguaccacaugcagcagugccuccaggagcgcgugcagaacugcgaccggauccgcaccgggcagggcagcaucuaccugcagcggguccagcacaagcagcuggagcagaagcucaagcaggccgaggccugguggcugcagcuggggaaguucgcgcgccucguggacuacaugaucugccagucccugaucagcgugcuggaggagcagaucaccuccuucgucgccaacauccuccaggcgccccgccagaagcccuuccugagcucccagcugguguucgacgaccacggccagcucagccacgugcccugcgucgagaacaugauccagacccugacgggcgggcugcagagcgugaagaccuccgcccuccaggugguccagagcgccgaccugaagaccuccagcgacucccuguacagcgaggaggaggacgaggaggaggacuccaaggacgaguuccucaugcccaaguuccagggccagcccagcgacgccguguccaucuucugcgggcccaacgugggccuggucuggcccuggaagucccaccccaucgccgggauccuggaggugcgcggcugccggcuccgcggccaguacuucccccacaacuacaagcagcuggaggaggaccuggacaacaaccccaagauccagcaggcccucaacauccagcagguccugcuggaggggguccucugcaaggugcaggaguucugccgggagcaccacuggaucaccggcaucuacgaguuccugcaguccugggggccccagaagcuggaggacaugcgcggcgggcccaucaagaacuacgugacgcucgucagccggcugaacguguggcaggcccgcguguccagcaugcccaucgagcugcucaccaagggcggccugcugcuccuguccugccacgacguccaggcggagauggagagcaagcugaacuccauccggaaggacauccucgcccacgugcagaacgagugcuggaaccugagccagcagcugaugaccgagcucaccgacuucaugcacaucuuccgcacgaucaacagcgacauccacgccaucgcccagugcacccagaagcugaacgaggccaacgagcaguacguggagcuggaggagcggauggaguacguccgcgcgcuccacgagcugauccgcaaccacuucucccuguucagcgccgagaacgaggcccucgacaucuccgugcggcgccaguucggggagagccccaucccgcccugcccgccgccgccccagccccaccuccuccacugcccccuccuggcgccccagcugcucgacaugugggaggccuuccaguucgagaagucccaggcgagcgaguuccugcuguccaagcggcacgccaucaugcccaagcuccagcagcugauggccgccgcgcuggccgagcucgagggccugcuggccaaggcccucagcgggcccuucauggaccccacccaggaccagcgcuccaccgagcaccagcuggugagccuggagcggcaguuccagaacacggucuccgaccucagcgagcugcaccacgccuacgcgaucuucaccgaggacgagaccccggugccccugcccaucugcggcacccgccccaucgugcagcagcagcggaucuggcaccuguaccgcgucaucuccgagaacaucagcgaguggaagugcauggccuucgccaaguucuccccggccauggcccaggagaagacggagggguggcucaccgaggcggcccggaugagcaccacccuggagcugcacucccccgugcuccagcacugcaugcgcauccugggcgaguuccggagcuaccugccccuccugaccaagcugggcucccuccacccccagagccugaacugccagugccugcuccgcgcccuggggcugggcagccuccagacgaucgagcugcugacccucgggcagcugcugaccuacccgcuccuggaguucgccgaccggaucaaccagguguggcagaacgagaacgagcgcauccacgcccaggagaccauccggcgccugcagcgguacugggaggcgcgccagcuccggcugcugaacuucauccuccacguccccuacgagccgcccgccuccgagcgcagcaagcgccaggugcugcgcuccccgcagugggagguggucgacaaggacagcggcacguucauccuguccgacuacagcaaccuccaggacuccauccaggagagccuccaggugcuguccaagauccucgccaucgagaaguccggcgaccugaacaagaucgcccuggaguggguggcgaucaugcacgggcucggcgcccugcuggaggucuggcucaccuuccagcagaaguggaucuuccugaacaaggugcugcacgagaugaagauccaguuccccaacgccgaccucaacucccgcuucaaggugauggacgaccaguaccggacccugaugcgcaucagcgucgccgaccccauggugcugucccucgugguccccagcgccgagcgguccccguacuuccaggggcagcagcugcagcagcugcuccaggcgggcagcguggagcuggaggggaucaucaugucccuggagagcguccucuacggcgugugcgcccacuucccccgccuguucuuccuguccgacagcgagcucguggcccugcuggccgcccggcucgagagcugcgaggcgcagcuguggguccgccggugcuucccccacgugcacgccguguccuuccgcagcugccccaccggcgagaagaacacggacgacugggaguccagcccgaacacccagacccaggucgaggcccuggccgugcucggggccggcggggaggaggugaagcugcagggcccccugccccuccaccccgaccugccgaaguggcuggcgucccucgagaagugccugcggcuggcccucguccacaugcugcaggggugcguggccgcccgccuggcccggggccccagccucggcgaggcgcugaagcagcugcccaagcagaacaagcucuaccugcagcuguacgugcagcacuggaucgaccucguccaggccuuccccuggcagugcgugcugguggccgaggaggucguguggcgcgccgagauggaggaggcgcugcucgagugggggacccuggccaugguguccaugcacaugcggaagcuggagguccucgugaacuucaugcgcgcccagcgggccagccagggcgggcagucccugccgagcgugcgccagacgucccugcucagcgcccugcuggucauggcggugacccaccgggacaucgcccagcugcuggagcagcaccagguguccgaccugaccgacuuccacuggguccgccagcucaaguaccaccugggcagcccccacaucauccccaaguccccgcugcagagccucaagaccaucgccuccagcgagcccucccugagccccgccgccugcuggaucgacgugcuggggcggagcuuccucuacaacuacgaguaccugggcccccgccugggcccgcugcccucccuccugcccgagcgccccgcgcuggugcuccugcuggcccucgaggaggucgccugcgggacggugcugggcccgaacggggugggcaagcgggccaucgucaacagccuggcccaggcgcucgggcgccagcuggugaugcugcccugcagcccccagaucgaggcccagugccucagcaacuaccugaacggcgcccugcagggcggggccuggcuccugcuggagaaggugcaccagcugccgcccggccugcuguccgcgcucgggcagcggcugggcgagcugcaccaccucuacgcgccccuguaccaggaggccagccgcaacaccuccaccaucgaccccacccagccccagcugcucggcagcuccuucuucgagaagcaccacgucagcgugcggcugggguacggcugccugcucgugcugcgcgcccuguccagcgccguccccgcgaaccuccaccuccugcuccggcccguggcccuggcccugcccgaccuccgccagguggccgagcugacgcugcucggggccggcaugcgggacgcguuccagauggccacccgccuguccaaguucuucagccuggagcgggagcucgucuccgggccccugccgugccgccugccccuccugaagcagauccuggaggacaccauccggacccucaacgugacgaaggaggagcccaagugccagaagccccgcagccuggccgccaucgaggaggccgcgcugcuccgguccccgcuguucagcauccugaacggccuccaccuccacaaccugcgcggccuccugugcgcccuguuccccuccgccagccaggugcucgccgagcccaugaccuacaagcugaugaagccccuggucguggaggagcuccagcaggucgggcuggacccgagccccgacauccugggcucccucgagcagcugagccaggcgcugucccgggccagcgggauccuccugcugggccccgccggguccggcaagacgaccugcuggcacagccucuucaagauccagaaccgccuggccgccauggaggacacguccacccagggcugccagccggucgagaucacccaccuguaccccagcgggcucagcccccaggaguuccugggcuggcuggaggggagcugcuggcaccacggcaucuuccccaaggugcuccgggcggccgggcagugcaacaacaugggccagaagcgccagaccgaggaguccaucggcauccagcacuggaucaucugcgacggggccagcaacggcgccuggcuggacuccaucacgugccugcucagcgagcugccgcagcugucccuccccagcgggcagcagaucgcccggccgcccggcaccuuccugcugauggagguggcggacaccaccggcaucuccccgacggucguggggugcugcgcccucguguggugcggcggggagcagaccuggcagugcauccugagcgcccugauggccucccuccccuacgaguaccgccugcagcaccgcaccgucgccgagcugaaccacauggcggaggugcucguccccgccacccugcgguuccugaccugccagggcgugagcagccugcuccaggugcacgggcagcaggccgucugcgccggcguggccgaggugacguccauggcgcgcauccugcacagccugcucgaccugcaccuccggcucaaggaggagaaggcccccggcccggaggaccuguccuacagcgaccccgucgcccaguccuuccgcagcuccaagagcuccuuccugaaccggagccagguggacuccgacgacgugcccgacaagugccgcgagcaccuccuggccgucagcuccuuccuguucgcgcucaucuggggguucggcgcccaccuccccagccgguucuggccgaucuucgacaccuucauccgcgacuccaucagccggcuguccaacuaccccgagccgccgcccagcgcccucguguucgaccugcacgugagccccgaggacgggacccugguccccuucaccggccaguaccucuccagccacaucaaggggacgcugggcaccuuccaccccuccauccagaccgagcgccugcucuacgugguggaccugcugcucagcggcgggcagcccguccugcuggccggcgaggccgcgaccgggaaguccgccuucguggaggugcucgucgagccccaccaccccuacaucuacagcccgauccaccccgccuucuccagcucccaccuccggcugcuccugagccgcggcauccaggggcagacgcaggccagcccccagcccggccaccaccaggacagcaagccgucccuccuguuccugcuggaggaccuccaccuggccaccagcgaccccgagaaguccugccagcccgugcuggagacccuccggcaggcgauggacggcaccguguacgcccacagcacgcuggagcugcagacccuccagcccaccgucaacuuccuggccaccgugacggugccgggguacugcgagcgcccccugugcccccgccuguuccgccuguucaccguccuggcccucgaguccaugacccaggccacccugcuggagcggcacgugcccaucauccaggcguggcucgagcgcuucccgagcguggagcgggagcgcgcccuggcccgcggccugguccgggccuccguggaggcgugggaggccgugugcaacugcuucaugcccagcccccuccacccccacuaccacuucagccugcacuccgucagccaccuccuguccagccugcagcugcugccgaaccgcacggggucccggggcuucguggacuaccccaaccaccaggagcaccuccggcgggugagcgggcugcgcgggaccugccugaccgucaugauggccacccggaacguggugcgccuguggcugcacgaggcccagcggacguucugcgaccgccucgacagcccccgggagcgcuccuacugcgccaagcugcugcucgucguggcgcaguccguguucugcugcggccccgggccgcagcaccugggcaaggaccaccaggagagcgaggaggaggaggaggaggagcggguccccgagguggaguccgagggggagcuggcccagugggaggacuucagcaacuccaacagcgagaccgaggaggaggaggagcccuacggccuccagguggcccgcgucuccaacagccgggaccccucccugaccccgagcaucggccccgugucccgcgggaugaaggagagcaucagccacaagauccggcaggagaagggcacccgcgccuccaacuaccggcuccaggugcgccggagcuucaagacgugguggcagaagaagccccagauggaccucaucagcccccugcugcucccgguccugcugcuccacccccaggagaagcccagcgaccugguguucucccaggagcugauccucgggccgaacagcgagacccccaaccuguaccuggagcgccagugggagaagcucgaggagcagcuggccaccuccgcggcccagcugaagcucagcccccaccuggcccgcugccacuccauggcccagcacguggcccggcugguccgcgugcucgcgcggccccgccagcacggccugcugcugagcggggcccucggcaccggccggcacacggccaucacccuggccuccagcaucugccaggcgcacuucuuccaccuccccuccgggagcgaggaggccauccugcagugccugcgcgacgccuccuggcacgccggcaugcugagccagcccguggcccuccugguccccuccgggguggaccugaccacccuccaccggcugcuggcgcucgccacgagcggcuccuuccccgggcaguacaccgaggccgaccuggaccgcaucggcgagcaccucccccgggagaaccugggcgucaagcagaacaucaagaaggagauggugcugcagcgcuuccaccagcaggucugcagccaccuccaccucuucuuccugaucggggacaagcaggcccacaagcagcugcccagcacccucuuccugcggcugcuccagcuggccaccgcguccaucgaccgcuacgagcccugggaccaggccgcccuggccaaggucgcccagcaccaccucgagggcgcgcagagcgugccccuggacgacggguccuggaaguacccggaccugcaggccagcauccccuccguggccaaggccauggcccucauccaccugagcgcgacccacuaccacgagcaccugugccccgcccucccccuggucacgccgaagaccuuccuggacuuccucgacaccuuccugaugcugcagcagcagaccauccucaagaucaagaacaaggcccagcgggugcagaacgcccuggagaaccugcgcaugcucaucaaggagcacggcacgcacgcgaaccugaucuucgaccuggagcagcagcucaaggacuccgggaagucccuguccauguuccagcagcagcuggagcagagcaagcuccuguacaagcagcagcuggaggagugccggcaccaggagaaccucaucgagaaccuggcccgccagcgggacgcccugcaggcccagcgcgaggccuuccucgagcagauguccaaggcguuccuggagccccugagccagcuccagguggccgacuucgaggagauccgguccuaccgcgcgccgcccgagagcgucgugcgcgugaccgacgccaugugcgaccuguuccaccacgagaccggcugggccuccgcgaagcagcugcucugcaccgaggacuucuaccaggagcuggucuucuucccgaaggagaagaucacggacagcgagcugaucaagcuccaccugauccugaaggcccccggcauggacgacgccgcccuccgggccgugucccgccccgcggccagccuggccgccuggcugugggcggugcuccacuacgggcuggcccacugccggggccugcccaccgaccuccugcugcagcaggucgaggccacccucacccgcgagcaggcccggcugggguacuaccaguuccaggcccaggagacgcuggagcacaaccucgcgcuggccaagaugguggaggacgcccaggccucccacaacugcguggccaagacccugagccaggcgcagugcggccaguaccacaaguggccgaugaaggccgcccuccugacccccaugcgcgccuggaccacgcagcugcagaagcucaaggggcggugcaugaccgucuucggcgacacccugcugugcagcgccgcgaucaucuaccucggccccuucccgccccugcgccggcaggagcugcucgacgaguggcuggcccugugccgcggguuccaggaggcccucggccccgacgacguggcccaggcccugaagcggaagcagaaguccgugagcaucccgcccaagaacccccugcucgcgacccacucccccuucagcauccugucccugcugagcuccgagagcgagcaguaccagugggacgggaaccucaagccccaggccaaguccgcccaccuggccggccugcuccugcgcagcccgacgcacuacuccagcugccgguggccccugcuccuggaccccuccaacgaggcgcugaucuggcucgacccccugccgcuggaggagaaccgcagcuucgcccccgcccucaccgagggccgggggaagggccugaugcgcaaccagaagcgggaguccaagaccgacaugaaggaggaggacgacgagagcgaggaguccaacgaggccgaggaccagaccaaggagcagaaggccgaggagcgcaagaacgagcaggagaaggagcaggaggagaacgaggagaaggaggaggagaagacggagagccagggguccaagcccgcguacgagacccagcugcccagccucccguaccugagcguccuguccggcgccgaccccgagcucgggagccagcugcaggaggccgccgccugcggccugcccgugcuccugaccaacguggagcugggccucgggugcgaggagcugcaguggcugcuccagcgggagcagcugagcccgccccagguccagcccggcuucugccuguaccucagcaccacgcugucccugugcgcgauggagaaggugcucgggugcgagcugcugaagggccucaacgugcuggaccuggggcucaacauggagauccuggaggagcagaugcugcacgagauccucugccgcgaguaccccgagcuggagacccgguggcaggaccugaagauccgcgcccucgacacgugcaaggccgucgaggccgccgaggagcgccugcugaccaugcuccuguuccagaaccccaagcggcagaagcccgcgaaguuccugcgcaacaucgugcgggcccagggcaagcucugccagcugcgcgcccacugcgaggagcuggagggccagaagcuccaggagauggugcugugggcccccuaccggcccgucguguggcacgggauggcgauggugaaggcccugagccagcuccagaaccugcugccccucuucugcauguccccggagaacuggcuggccgucacgaagcaggcccuggacagcaugaagccccgcgagaucaaccacggcgaggaccucgccucccaccuccugcagcuccgggcgcaccugacccgccagcugcucgggagcaccgugaccgcccugggccugacccaggugccccucgucggggcccugggcgcccuggcccuccugcaggcgaccggcaaggccuccgagcuggagcggcucgcccuguggcccgggcuggccgccagcccguccaccgugcacagcaagcccguguccgacgucgcgcgccccgccuggcucggcccgaaggccuggcacgagugcgagaugcuggagcugcugccgcccuucguggggcugugcgccagccuggcgggccacuccagcgccuggcaggccuaccucagccuguccagcaccgugcugggccccgccccggggcccggccccgagccccucucccugcugcagaagcucauccuguggcggguccugcgcccggagugccucgccggggcgcuggccgacuucacgaccagccugcugggccggccccucgacgagaacaccuacgcccccaccaugcccuucaagcacucccaggccacccagccgaugcugauccugcugccgccgcccgggcacccgagcgccacgcugcacccccugaccgugauccagaagcucgcggccaaguaccagcagggccagaagcagcuccaggugaucgcccugggcuccgaggccugggaccccgucagcgugguggucuccacccucagccaggccauguacgaggggcacuggcuggugcuggacaacugccaccucaugccccacuggccgaaggagcugcugcagcuccugcuggagcuccugggccgcgcgaagguggucgccgaccuggaguccgagcagcuccuggaccagcccgagagccggaacguguccaccguccaccgcgacuuccggcuguggcucaucgugcccgccgagagcuccgccagccugcccgccgugcugacgcagcacuccaugccggucuucuggaaccagagccucgagcuggggcacgugcugaucgacuccguggagcucgcgcagcagguccuguacaugcagccgcccacccaggcccugccgcuccugcugcuccacggccugcugcuccaccgccagcuguacgggacccggcugcaggcccaccgcggccgcuggagccaggugacccucacccaggugcugcagacccaggaccagcugugggccagccucuccaacccccgggcggccaugcaggagcuggccgccagcgucuucuacggcgggccccugggcgacaccgaggaccgcgaggcccucaucucccugacccaggcgugccugagccccuccagcggguccugggugcagccgcacacgccccagagccuccuggccacccugaugccccuccccgagcugcgggagcuggacgccauggccgagugcaaggcccagaugcaccuccugccgagcccgcccgagccccgccugugcggccucagcgaggggccgcaggcguggcugcugcggcgccagucccgggcccuccugagcgcccugcagcgcuccagccccguguggguccccgagucccggcgcggcgcccagcucgccgagcggcgccugcggcagcgccugguccaggugaaccggcgccucgagagccugcaggaccugcucacccacgucauccggcaggacgaguccgacgcgcccuggagcgugcugggcccgaacgcccgccggccccuggagggggugcucgagaccgaggcccuggagcugucccagcucgucggcacgcugcagcgcgaccuggacugccuccugcagcagcugaagggggcgccgcccugcccgagccggcgcugcgcggccguggcccacgcccucuggaccggccgccugccccugcccuggcggccccacgccccggcggggccccagccgcccuggcacuggcuccgccagcugagccggcgcggccagcugcucgugcgguaccugggcgucggggccgacgccuccagcgacgugccggagcgcguguuccaccuguccgccuuccggcacccccgccggcuccugcuggcccuccgcggcgaggcggcccuggaccagaacguccccagcuccaacuucccggggagccggggcuccgugagcucccagcugcaguacaagcgccucgagaugaacagcaacccccugcacuuccggguggagaacggccccaaccccaccgucccggagcgcgggcugcugcucaucggccuccaggugcugcacgccgagugggaccccaucgccggggcccuccaggacucccccagcucccagcccagcccgcugccgcccguguccaucagcacccaggcgcccggcacguccgaccugccggcccccgccgaccucaccgucuacagcugccccguguacaugggcggcccccugggcaccgccaagcugcagucccggaacaucgugaugcaccucccgcugcccaccaagcugacgcccaacacgugcguccagcgccgggugcacgugugcagcccgccccucagcuga

SEQ ID NO: 29300 - RNA, 537 nt, Artificial Sequence
  derived and/or modified sequence opt1 from DNLZ__Homo_sapiens__NP_001074318
augcugcgcaccgcccuccggggcgcgccccgccugcugagccgggugcagccgcgcgcccccugccuccggcgccugugggggcggggcgcccgccccgaggucgccgggcggcgccgggccugggccuggggcuggcgccgguccagcuccgagcaggggcccggcccggcggccgcccugggccgcguggaggccgcgcacuaccagcucguguacacgugcaaggucugcgggacccggagcuccaagcgcaucagcaagcuggccuaccaccagggcguggugaucgugaccugccccgggugccagaaccaccacaucaucgccgacaaccugggcugguucuccgaccucaacgggaagcggaacaucgaggagauccugaccgcccgcggcgagcagguccaccggguggccggcgagggggcgcuggagcucguccuggaggccgccggcgcccccaccagcacggccgcgcccgaggccggggaggacgagggcccgcccucccccggcaagaccgagcccagcuga

SEQ ID NO: 29301 - RNA, 2556 nt, Artificial Sequence
  derived and/or modified sequence opt1 from DNM1__Homo_sapiens__NP_001005336
augggcaaccgcgggauggaggaccugaucccccuggugaaccggcugcaggacgccuucagcgccaucggccagaacgcggaccuggaccucccccagaucgccgucgucgggggccaguccgccggcaagagcuccgugcuggagaacuucgugggccgcgacuuccugccccggggcagcgggaucgugacccgccggccccucgugcugcagcuggucaacgccaccaccgaguacgccgaguuccuccacugcaagggcaagaaguucaccgacuucgaggaggugcgccuggagaucgaggcggagaccgaccgggugaccgggacgaacaagggcaucucccccgucccgaucaaccugcgcguguacagcccccacgugcucaaccugacccuggucgaccuccccgggaugaccaaggugcccgugggcgaccagccgcccgacaucgaguuccagauccgggacaugcugaugcaguucgucaccaaggagaacugccugauccucgccgugucccccgccaacagcgaccuggccaacuccgacgcgcugaagguggccaaggaggucgacccccagggccagcgcacgaucggggugaucaccaagcucgaccugauggacgagggcaccgacgcccgggacgugcuggagaacaagcuccugccgcugcgccggggguacaucggcgucgugaaccgcagccagaaggacaucgacggcaagaaggacaucaccgccgcccucgcggccgagcggaaguucuuccugucccaccccagcuaccgccaccuggccgaccggauggggacgcccuaccuccagaaggugcugaaccagcagcugaccaaccacauccgcgacacccuccccgggcugcggaacaagcugcagucccagcuccugagcaucgagaaggaggucgaggaguacaagaacuuccgcccggacgaccccgcccggaagaccaaggcccugcuccagauggugcagcaguucgcggucgacuucgagaagcgcaucgagggguccggcgaccagaucgacacguacgagcugagcgggggcgcccgcaucaaccggaucuuccacgagcgcuuccccuucgagcuggugaagauggaguucgacgagaaggagcuccggcgcgagaucuccuacgccaucaagaacauccacggcauccggaccgggcuguucacccccgacauggccuucgagaccaucgugaagaagcaggucaagaagauccgcgagccgugccugaagugcguggacauggugaucagcgagcucaucuccacgguccggcagugcaccaagaagcugcagcaguacccccgccugcgggaggagauggagcgcaucgugaccacccacauccgggagcgcgagggccggacgaaggagcaggucaugcuccugaucgacaucgagcuggccuacaugaacaccaaccacgaggacuucaucggguucgcgaacgcccagcagcgcagcaaccagaugaacaagaagaagaccagcggcaaccaggacgagauccuggugauccggaagggguggcucaccaucaacaacaucggcaucaugaagggcggguccaaggaguacugguucgugcugacggccgagaaccugagcugguacaaggacgacgaggagaaggagaagaaguacaugcucuccguggacaaccugaagcugcgcgacgucgagaagggcuucaugagcuccaagcacaucuucgcccucuucaacaccgagcagcggaacguguacaaggacuaccgccagcuggagcuggccugcgagacccaggaggagguggacagcuggaaggcguccuuccuccgggccggggucuaccccgagcgcgugggcgacaaggagaaggccagcgagaccgaggagaacggguccgacagcuucaugcacuccauggacccccagcuggagcgccagguggagacgauccggaaccuggucgacagcuacauggccaucgugaacaagaccgugcgcgaccucaugccgaagaccaucaugcaccugaugaucaacaacaccaaggaguucaucuucuccgagcugcucgcgaaccuguacagcugcggcgaccagaacacgcugauggaggaguccgccgagcaggcccagcggcgcgacgagaugcuccggauguaccacgcccugaaggaggcccugagcaucaucggcgacaucaacaccaccaccgucuccacccccaugcccccgcccguggacgacagcuggcuccaggugcaguccguccccgcggggcgccggagccccacgagcuccccgacgccccagcgccgggcccccgccgugcccccggcccgccccggcagccgggggcccgcccccggcccgccgcccgcgggcuccgcccucgggggcgccccgcccgugcccagccgccccggggccucccccgaccccuucggcccgccgccccagguccccagccggcccaaccgcgccccgcccggggugccccggaucaccaucuccgaccccuga

SEQ ID NO: 29302 - RNA, 2178 nt, Artificial Sequence
  derived and/or modified sequence opt1 from DNM1L__Homo_sapiens__NP_001265392
auggaggcccugauccccgugaucaacaagcuccaggacgucuucaacaccgugggcgccgacaucauccagcugccgcagaucguggucguggggacccagagcuccggcaagagcuccgugcuggagagccucgucgggcgcgaccugcugccccggggcacggggaucgugacccgccggccccucauccugcagcuggugcacgucucccaggaggacaagcgcaagaccaccggcgaggagaacggcguggaggcggaggagugggggaaguuccuccacacgaagaacaagcuguacaccgacuucgacgagauccggcaggagaucgagaacgagaccgagcgcaucagcggcaacaacaagggggugucccccgagccgauccaccugaagaucuucagccccaacgucgugaaccucacccugguggaccugcccggcaugacgaagguccccgugggggaccagccgaaggacaucgagcuccagauccgggagcugauccugcgcuucaucuccaaccccaacagcaucauccucgccgugaccgccgccaacaccgacauggccaccuccgaggcgcugaagaucagccgggaggucgaccccgacggccgccggacgcuggccgugaucaccaagcucgaccugauggacgccggcaccgacgccauggacgugcugauggggcgcgucauccccgugaagcucggcaucaucgggguggucaaccggucccagcuggacaucaacaacaagaaguccgugaccgacagcauccgcgacgaguacgcguuccugcagaagaaguacccgagccucgccaaccggaacggcacgaaguaccuggcccgcacccugaaccggcuccugaugcaccacauccgcgacugccugcccgagcucaagacccggaucaacguccuggccgcccaguaccagucccugcucaacagcuacggcgagcccguggacgacaaguccgcgacccugcugcagcucaucacgaaguucgccaccgaguacugcaacaccaucgaggggaccgccaaguacaucgagacgagcgagcugugcggcggggcccgcaucugcuacaucuuccacgagaccuucggccggacccuggagagcguggacccccucgggggccugaacaccaucgacauccugacggccauccgcaacgcgaccggcccgcgccccgcccucuucguccccgagguguccuucgagcugcuggugaagcggcagaucaagcgccucgaggagcccagccugcggugcgucgagcuggugcacgaggagaugcagcgcaucauccagcacugcuccaacuacagcacccaggagcugcuccgguucccgaagcugcacgacgccaucguggaggucgugaccugccugcuccgcaagcggcugcccgugacgaacgagaugguccacaaccugguggccaucgagcucgccuacaucaacaccaagcaccccgacuucgcggacgccugcgggcugaugaacaacaacaucgaggagcagcgccggaaccgccuggcccgggagcuccccuccgccgugagccgcgacaaguccagcaaggucccguccgcccuggcgcccgccagccaggagcccucccccgccgccagcgcggaggccgacggcaagguggccuccgggggcgggggcgugggcgacgggguccaggagccgaccaccggcaacuggcgggggaugcugaagacgagcaaggccgaggagcuccuggccgaggagaaguccaagcccauccccaucaugccggcgagcccccagaagggccacgccgugaaccugcucgacgugcccguccccguggcccgcaagcuguccgcccgggagcagcgcgacugcgaggugaucgagcggcugaucaagagcuacuuccucaucguccgcaagaacauccaggacuccgugccgaaggccgugaugcacuuccuggucaaccacgugaaggacacccugcagagcgagcucguggggcagcuguacaagagcucccugcucgacgaccugcugaccgagagcgaggacauggcgcagcggcgcaaggaggccgccgacaugcucaaggcccugcagggcgccucccagaucaucgcggagauccgcgagacccaccugugguga

SEQ ID NO: 29303 - RNA, 2613 nt, Artificial Sequence
  derived and/or modified sequence opt1 from DNM2__Homo_sapiens__NP_001005360
augggcaaccgcgggauggaggagcugaucccccucgugaacaagcugcaggacgccuucagcuccaucggccagagcugccaccuggaccucccgcagaucgccgucguggggggccaguccgcggggaagagcuccgugcuggagaacuucgucggccgggacuuccugccccgcggcagcgggaucgugacccggcgcccccucauccugcagcugaucuucuccaagaccgagcacgccgaguuccuccacugcaagagcaagaaguucacggacuucgacgaggugcggcaggagaucgaggccgagaccgaccgcgucaccggcaccaacaaggggaucucccccgugccgaucaaccugcggguguacagcccccacguccugaaccucacgcugaucgaccugcccggcaucaccaaggugcccgugggggaccagccgcccgacaucgaguaccagaucaaggacaugauccuccaguucaucucccgcgagagcucccugauccuggccgucacccccgccaacauggaccucgcgaacagcgacgcccugaagcuggccaaggagguggacccccagggccuccggaccaucggcgugaucacgaagcuggaccugauggacgaggggaccgacgcccgcgacguccucgagaacaagcugcugccgcuccggcgcggcuacaucgggguggugaaccggucccagaaggacaucgagggcaagaaggacauccgcgcggcccuggccgccgagcggaaguucuuccugagccaccccgccuaccgccacauggcggaccggaugggcaccccccaccuccagaagacccugaaccagcagcugacgaaccacauccgcgagucccuccccgcccugcggagcaagcugcagucccagcuccugagccuggagaaggaggucgaggaguacaagaacuuccgcccggacgaccccacccggaagaccaaggcccuccugcagauggugcagcaguucgggguggacuucgagaagcgcaucgagggcagcggggaccaggucgacacccuggagcucuccggcggggcccgcaucaaccggaucuuccacgagcgcuuccccuucgagcuggugaagauggaguucgacgagaaggaccugcggcgcgagaucagcuacgccaucaagaacauccacggcgugcggacgggccucuucacccccgaccuggcguucgaggccaucgucaagaagcagguggucaagcugaaggagccgugccucaagugcguggaccuggugauccaggagcugaucaacaccguccgccagugcaccuccaagcugagcuccuacccccggcuccgcgaggagacggagcggaucgugaccaccuacauccgcgagcgggaggggcgcaccaaggaccagauccugcugcucaucgacaucgagcagagcuacaucaacacgaaccacgaggacuucaucggcuucgccaacgcccagcagcgguccacccagcugaacaagaagcgcgccauccccaaccagggggagauccuggugauccggcgcggcuggcucaccaucaacaacaucagccugaugaaggggggcuccaaggaguacugguucguccugaccgcggagagccucuccugguacaaggacgaggaggagaaggagaagaaguacaugcugccccuggacaaccucaagauccgggacguggagaagggcuucaugagcaacaagcacguguucgccaucuucaacacggagcagcgcaacgucuacaaggaccugcggcagaucgagcuggccugcgacucccaggaggacguggacagcuggaaggccuccuuccuccgcgccgggguguacccggagaaggaccaggcggagaacgaggacggcgcccaggagaacaccuucagcauggacccccagcuggagcgccaggucgagaccauccggaaccugguggacuccuacguggccaucaucaacaagagcauccgcgaccucaugcccaagaccaucaugcaccugaugaucaacaacacgaaggccuucauccaccacgagcugcucgcguaccuguacuccagcgccgaccagagcucccugauggaggagagcgccgaccaggcccagcggcgcgacgacaugcuccggauguaccacgcccugaaggaggcgcugaacaucaucggggacaucuccaccagcaccgucuccacccccgugccgccccccguggacgacacguggcuccagagcgccuccagccacuccccgaccccccagcgccggcccgucagcuccauccaccccccgggccgcccccccgccgugcgggggcccaccccgggccccccccugauccccgugccggucggcgccgccgcgagcuucuccgccccccccauccccagccgcccggggccccaguccguguucgccaacagcgaccuguuccccgcccccccgcagauccccucccggcccgugcgcauccccccgggcaucccccccggggucccgagccggcgcccccccgccgcgcccagccggccgaccaucauccgccccgccgagcccucccuccuggacuga

SEQ ID NO: 29304 - RNA, 2580 nt, Artificial Sequence
  derived and/or modified sequence opt1 from DNM3__Homo_sapiens__NP_001129599
augggcaaccgcgagauggaggagcugaucccccucgugaaccggcugcaggacgccuucagcgcccuggggcaguccugccuccuggagcugccccagaucgcggucgugggcgggcagagcgccggcaaguccagcgugcucgagaacuucgucgggcgcgacuuccugccccggggcuccggcaucgugacccgccggccccuggugcuccagcuggucaccagcaaggccgaguacgccgaguuccugcacugcaaggggaagaaguucacggacuucgacgaggugcgccucgagaucgaggccgagaccgaccgggugaccggcaugaacaaggggaucuccagcauccccaucaaccugcgcgucuacuccccgcacgugcugaaccucacccugaucgaccugcccggcaucacgaaggugcccgucggggaccagcccccggacaucgaguaccagauccgggagaugaucaugcaguucaucacccgcgagaacugccucauccuggcggugacccccgccaacaccgaccuggccaacagcgacgcccucaagcuggcgaaggagguggacccccagggccugcggacgaucggcgucaucaccaagcucgaccugauggacgaggggaccgacgcccgcgacgugcuggagaacaagcuccugccccugcggcgcggcuacgugggggucgugaaccggucccagaaggacaucgacggcaagaaggacaucaaggccgccaugcucgccgagcgcaaguucuuccugagccacccggcguaccggcacaucgccgaccgcaugggcacgccccaccuccagaaggugcucaaccagcagcugaccaaccacauccgggacacccugcccaacuuccgcaacaagcugcaggggcagcugcuguccaucgagcacgaggucgaggccuacaagaacuucaagcccgaggacccgacccggaagaccaaggcccuccugcagauggugcagcaguucgccguggacuucgagaagcgcaucgagggcagcggggaccaggucgacacgcuggagcucuccggcggggcgaagaucaaccgcaucuuccacgagcgguuccccuucgagaucgugaagauggaguucaacgagaaggagcugcgccgggagaucagcuacgccaucaagaacauccacggcauccgcaccggccuguucacccccgacauggccuucgaggccaucgucaagaagcagaucgugaagcucaaggggcccucccucaagagcguggaccuggucauccaggagcugaucaacaccgugaagaagugcacgaagaagcuggccaacuucccgcggcugugcgaggagaccgagcgcaucguggcgaaccacauccgggagcgcgagggcaagaccaaggaccagguccugcuccugaucgacauccagguguccuacaucaacaccaaccacgaggacuucaucggguucgccaacgcccagcagcggagcagccaggugcacaagaagacgaccgucggcaaccaggugauccgcaagggguggcugaccaucuccaacaucggcaucaugaagggcgggagcaagggcuacugguucgugcucaccgccgagucccugagcugguacaaggacgacgaggagaaggagaagaaguacaugcugccccucgacaaccugaagguccgggacguggagaaguccuucaugagcuccaagcacaucuucgcccuguucaacacggagcagcgcaacguguacaaggacuaccgguuccucgagcuggcgugcgacagccaggaggacgucgacuccuggaaggccagccugcuccgcgccgggguguaccccgacaaguccguggccgagaacgacgagaacggccaggcggagaacuucagcauggacccccagcuggagcggcaggucgagaccauccgcaaccugguggacuccuacaugagcaucaucaacaagugcauccgggaccucaucccgaagaccaucaugcaccugaugaucaacaacgugaaggacuucaucaacuccgagcugcucgcccagcuguacagcuccgaggaccagaacacccugauggaggagagcgccgagcaggcccagcgccgggacgagaugcuccgcauguaccaggcccugaaggaggcgcuggggaucaucggcgacaucuccacggccaccgucagcacccccgccccgccgcccguggacgacagcuggauccagcacucccgccggagcccgccgcccucccccaccacgcagcgccggcccacccucagcgcgccccuggcccgccccaccuccggccgggggcccgcccccgccauccccagccccggcccccacuccggggccccgcccgugcccuuccgccccggcccccugcccccguuccccagcuccagcgacuccuucggcgccccgccccagguccccagccggcccacccgcgccccgcccuccgugcccagccggcgcccgccgcccucccccacccggcccacgaucauccgcccccucgagagcucccugcuggacuga

SEQ ID NO: 29305 - RNA, 4734 nt, Artificial Sequence
  derived and/or modified sequence opt1 from DNMBP__Homo_sapiens__NP_056036
auggaggccggcagcgugguccgcgccaucuucgacuucugccccuccgugagcgaggagcugccgcucuucgugggggacaucaucgagguccuggcggugguggacgaguucuggcugcucggcaagaaggaggacgucaccgggcaguuccccuccagcuucguggagaucgugaccauccccucccugaaggagggcgagcggcuguucgucugcaucugcgaguucacgagccaggagcucgacaaccugccccugcaccgcggggaccucgugauccuggacggcaucccgaccgccggcuggcugcaggggcgguccugcuggggcgcccgcggguucuuccccagcuccugcgugcgggagcucugccugagcucccagagccgccaguggcacucccagagcgcccuguuccagauccccgaguacuccaugggccaggcccgggcgcucauggggcugagcgcccagcuggacgaggagcucgacuuccgcgagggcgacgucaucaccaucaucggcgugcccgagccggggugguucgagggcgagcuggaggggcggcgcggcaucuuccccgagggcuucguggagcugcucgggccccugcggaccgucgacgaguccgugagcuccggcaaccaggacgacugcaucgugaacggggaggucgacacgcccgugggcgaggaggagaucgggccggacgaggacgaggaggagcccggcaccuacggcguggcccuguaccgcuuccaggcccucgagcccaacgagcuggacuucgaggucggggacaagauccggauccuggcgacccucgaggacggcuggcuggaggggagccugaagggccgcaccgggaucuuccccuaccgguucgugaagcucugcccggacacgcgcguggaggagaccauggcccugccccaggagggcagccuggcccggauccccgagaccucccucgacugccuggagaacacccugggcgucgaggagcagcgccacgagacgagcgaccacgaggccgaggagcccgacugcaucaucuccgaggccccgaccagcccccucgggcaccugaccuccgaguacgacaccgaccggaacagcuaccaggacgaggacacggcgggcgggcccccccgcuccccgggcguggagugggagaugccccuggccaccgacagccccaccuccgaccccaccgaggucgugaacgggaucagcucccagccgcaggugcccuuccaccccaaccuccagaagagccaguacuacuccacggucggcggcagccacccgcacuccgagcaguaccccgaccugcugccccucgaggcccggacccgcgacuacgccagccugcccccgaagcgcauguacucccagcugaagacccuccagaagcccgugcugccccuguaccgggggagcuccgugagcgccagccgcgucgugaagccccggcaguccagcccgcagcuccacaaccuggcguccuacaccaagaagcaccacacgagcuccguguacagcaucuccgagcgccuggagaugaagcccggcccccaggcccaggggcuggucauggaggccgccacccacagccagggcgacggcuccaccgaccucgacagcaagcugacccagcagcugaucgaguucgagaagucccucgccgggcccggcacggagccggacaagauccugcggcacuucagcaucauggacuucaacuccgagaaggacaucgugcgcgggagcuccaagcugaucaccgagcaggagcuccccgagcggcgcaaggcgcugcggccccccccgccccgccccugcacccccgugagcaccuccccgcaccugcucgucgaccagaaccugaagcccgcccccccccugguggugcggccgagccgccccgccccccucccgcccagcgcccagcagcggacgaacgccgucucccccaagcugcugagccgccaccggcccaccugcgagacccucgagaaggagggcccggggcacaugggccgcucccuggaccagaccagccccugcccccuggugcucgugcggaucgaggagauggagcgcgaccuggacauguacucccgggcgcaggaggagcugaaccucaugcuggaggagaagcaggacgagagcucccgcgccgagacgcuggaggaccucaaguucugcgagagcaacaucgagucccugaacauggagcugcagcagcuccgcgagaugacccugcugagcucccagagcuccagccucgucgcccccuccggcagcguguccgccgagaacccggagcagcggaugcuggagaagcgcgcgaaggugaucgaggagcugcuccagaccgagcgggacuacauccgcgaccuggagaugugcaucgagcggaucaugguccccaugcagcaggcccaggugcccaacaucgacuucgaggggcuguucggcaacaugcagauggugaucaaggucagcaagcagcuccuggccgcccuggagaucuccgacgccguggggcccguguuccucggccaccgcgacgagcuggaggggaccuacaagaucuacugccagaaccacgacgaggcgaucgcccugcucgagaucuacgagaaggacgagaagauccagaagcaccugcaggacagccuggccgaccucaagagccuguacaacgaguggggcugcaccaacuacaucaaccugggcuccuuccucaucaagccgguccagcgggugaugcgcuacccccugcugcucauggagcugcugaacagcacgcccgagucccaccccgacaaggugccgcucaccaacgccguccuggccgugaaggagaucaacgugaacaucaacgaguacaagcggcgcaaggaccugguccucaaguaccggaagggggacgaggacagccugauggagaagaucuccaagcugaacauccacagcaucaucaagaaguccaaccgcgugagcucccaccucaagcaccugaccggcuucgcgccccagaucaaggacgagguguucgaggagaccgagaagaacuuccggaugcaggagcgccugaucaagagcuucauccgggaccucucccuguaccugcagcacauccgcgagagcgccugcgucaaggugguggccgccgucuccaugugggacgugugcauggagcgggggcaccgcgaccucgagcaguucgagcgggugcaccgcuacaucagcgaccagcuguucacgaacuucaaggagcggaccgagcgccuggucaucuccccccucaaccagcugcugagcauguucaccggcccccacaagcucgugcagaagcgcuucgacaagcugcuggacuucuacaacugcaccgagcgggccgagaagcucaaggacaagaagacgcuggaggagcugcaguccgcgcgcaacaacuacgaggcccucaacgcccagcugcuggacgagcucccgaaguuccaccaguacgcccaggggcuguucaccaacugcgugcacggcuacgcggaggcccacugcgacuucguccaccaggcccuggagcagcucaagccccugcugagccuccugaagguggccggccgggaggggaaccugaucgccaucuuccacgaggagcacucccgcgugcuccagcagcugcaggucuucaccuucuuccccgagagccugcccgcgaccaagaagccguucgagcggaagacgaucgaccgccagagcgcccggaagccccuccugggccugcccuccuacaugcugcagagcgaggagcuccgcgccucccugcuggcccgguaccccccggagaagcucuuccaggccgagcgcaacuucaacgcggcccaggaccuggacgugagccugcucgagggggaccuggugggcgucaucaagaagaaggaccccauggggucccagaaccgguggcugaucgacaacggcgugaccaagggcuucgucuacagcuccuuccucaagcccuacaacccgcgccggagccacuccgacgccagcguggggucccacagcuccaccgagagcgagcacggcuccagcuccccccgcuucccccggcagaacagcggguccacccugacguucaaccccagcagcauggccguguccuucaccagcggcuccugccagaagcagccgcaggacgccagccccccccccaaggagugcgaccagggcacccuguccgcgagccucaacccguccaacagcgaguccagccccucccgcugccccagcgaccccgacuccaccagccagccgcgguccggggacagcgccgacgucgcccgcgacgugaagcagcccacggccaccccccgguccuaccgcaacuuccgccaccccgagaucgugggcuacagcgucccggggcggaacggccagucccaggaccuggugaaggggugcgcgcgcaccgcccaggcccccgaggaccggagcaccgagcccgacggcagcgaggccgagggcaaccagguguacuucgccgucuacacguucaaggcgcgcaaccccaacgagcuguccgugagcgccaaccagaagcucaagauccuggaguucaaggacgugaccgggaacaccgagugguggcuggccgaggucaacggcaagaagggguacgugccguccaacuacauccggaagaccgaguacacguga

SEQ ID NO: 29306 - RNA, 4899 nt, Artificial Sequence
  derived and/or modified sequence opt1 from DNMT1__Homo_sapiens__NP_001124295
augcccgcccgcaccgccccggcgcgggugcccacccuggccguccccgccaucagccuccccgacgacgugcgccggcgccugaaggaccuggagcgggacucccucacggagaaggagugcgugaaggagaagcugaaccugcuccacgaguuccugcagaccgagaucaagaaccagcugugcgaccucgagaccaagcugcgcaaggaggagcugagcgaggagggcuaccucgccaaggucaagucccugcugaacaaggaccucagccuggagaacggggcccacgcguacaaccgggaggugaacggccgccuggagaacgggaaccaggcccgguccgaggcccgccgggugggcauggccgacgcgaacagcccgcccaagccccucuccaagccccgcaccccgcggcgcagcaaguccgacggggaggccaagcggagccgcgacccgcccgccuccgccagccaggucacgggcauccgggccgagcccucccccagcccccgcaucacccggaaguccacccgccagaccacgaucaccagccacuucgcgaagggccccgccaagcggaagccccaggaggaguccgagcgcgccaagagcgacgaguccaucaaggaggaggacaaggaccaggacgagaagcgccggcgcgugaccagccgggagcgcguggcccggccgcugcccgccgaggagcccgagcgcgccaagagcgggacccggacggagaaggaggaggagcgcgacgagaaggaggagaagcggcugcgcucccagaccaaggagcccaccccgaagcagaagcucaaggaggagcccgaccgggaggcgcgcgccggcguccaggccgacgaggacgaggacggggacgagaaggacgagaagaagcaccggagccagcccaaggaccuggccgcgaagcgccggcccgaggagaaggagccggagaaggugaacccccagaucuccgacgagaaggacgaggacgagaaggaggagaagcgccggaagaccacgcccaaggagcccaccgagaagaagauggcccgcgccaagaccgugaugaacagcaagacccacccgcccaagugcauccagugcggccaguaccuggacgaccccgaccucaaguacgggcagcacccgcccgacgccgucgacgagccccagaugcugacgaacgagaagcuguccaucuucgacgccaacgagagcggcuucgaguccuacgaggcgcucccccagcacaagcugaccugcuucagcguguacugcaagcacggccaccugugcccgaucgacaccgggcucaucgagaagaacaucgagcuguucuucuccggcagcgccaagcccaucuacgacgacgaccccucccuggagggcggcgugaacggcaagaaccucgggcccaucaacgagugguggaucaccggcuucgacgggggcgagaaggcccugaucggguucagcacguccuucgccgaguacauccugauggacccgagccccgaguacgcgcccaucuucggccucaugcaggagaagaucuacaucuccaagaucgucguggaguuccugcagagcaacuccgacagcaccuacgaggaccugaucaacaagaucgagaccaccgugcccccguccggccucaaccugaaccgguucacggaggacagccugcuccgccacgcccaguucgucguggagcaggucgagagcuacgacgaggccggggacuccgacgagcagcccaucuuccugacccccugcaugcgcgaccugaucaagcucgccggcgugacccuggggcagcggcgcgcccaggcgcggcgccagaccauccggcacagcacgcgcgagaaggaccggggccccaccaaggccaccaccacgaagcugguguaccagaucuucgacaccuucuucgccgagcagaucgagaaggacgaccgcgaggacaaggagaacgccuucaagcggcgccggugcggggugugcgaggucugccagcagccggagugcggcaagugcaaggccugcaaggacauggugaaguucggcggguccggccgcagcaagcaggcgugccaggagcggcgcugccccaacauggccaugaaggaggccgacgacgacgaggaggucgacgacaacauccccgagaugcccuccccgaagaagaugcaccaggggaagaagaagaagcagaacaagaaccggaucagcugggugggcgaggccgugaagaccgacgggaagaaguccuacuacaagaaggucugcaucgacgccgagacccucgaggugggcgacugcgugagcgucauccccgacgacuccagcaagccccuguaccuggcgcgcgugaccgcccugugggaggacuccagcaacggccagauguuccacgcccacugguucugcgccgggacggacaccgugcucggcgcgaccuccgacccccuggagcuguuccucgucgacgagugcgaggacaugcagcugagcuacauccacuccaaggugaaggugaucuacaaggccccgagcgagaacugggccauggagggcgggauggaccccgagucccugcucgagggcgacgacgggaagaccuacuucuaccagcugugguacgaccaggacuacgcccgguucgagagcccgcccaagacgcagcccaccgaggacaacaaguucaaguucugcgucagcugcgcccgccuggcggagaugcggcagaaggagaucccccgcgugcucgagcagcuggaggaccuggacucccgggugcucuacuacagcgccaccaagaacggcauccuguaccgcgucggggacggcguguaccugcccccggaggccuucaccuucaacaucaagcucuccagccccgugaagcgcccccggaaggagcccgucgacgaggaccuguacccggagcacuaccgcaaguacuccgacuacaucaaggggagcaaccuggacgcccccgagcccuaccggaucggccgcaucaaggagaucuucugccccaagaaguccaacggccggccgaacgagacggacaucaagauccgcgugaacaaguucuaccggcccgagaacacccacaagagcacccccgccuccuaccacgcggacaucaaccuccuguacuggagcgacgaggaggccguggucgacuucaaggccgugcaggggcgcugcaccguggaguacggcgaggaccugcccgagugcguccagguguacuccaugggcgggccgaaccgguucuacuuccucgaggccuacaacgccaagagcaaguccuucgaggacccgcccaaccacgcgcgcagccccgggaacaagggcaagggcaaggggaagggcaaggggaagcccaagucccaggccugcgagcccagcgagcccgagaucgagaucaagcugcccaagcugcggacgcucgacguguucuccggcugcgggggccugagcgagggcuuccaccaggccgggaucuccgacacccugugggccaucgagaugugggacccggcggcccaggccuuccgccucaacaaccccggcagcaccgucuucaccgaggacugcaacauccugcugaagcucgugauggccggggagacgaccaacagccggggccagcgccugccccagaagggggacguggagaugcugugcggcgggcccccgugccagggguucuccggcaugaaccgguucaacagccgcaccuacuccaaguucaagaacagccucgucguguccuuccugagcuacugcgacuacuaccggccccgcuucuuccugcucgagaacgugcggaacuucgucuccuucaagcgcagcauggugcugaagcugacccuccgcugccuggugcggaugggguaccagugcacguucggcguccugcaggccggccaguacgggguggcgcagacccgccggcgcgccaucauccucgccgccgcccccggcgagaagcugccgcuguuccccgagccccuccacguguucgcgccccgggccugccagcuguccgucgugguggacgacaagaaguucgucagcaacaucacccgccuguccagcgggccguuccggaccaucacggugcgcgacaccauguccgaccuccccgaggugcggaacggcgccagcgcccuggagaucuccuacaacggggagccccagagcugguuccagcgccagcugcggggcgcccaguaccagcccauccuccgcgaccacaucugcaaggacauguccgcgcuggucgccgcccggaugcgccacaucccgcuggcccccggcagcgacuggcgggaccuccccaacaucgaggugcgccuguccgacgggaccauggcccggaagcugcgcuacacccaccacgaccggaagaacggccgcagcagcuccggggcgcuccggggcgugugcagcugcgucgaggccgggaaggccugcgaccccgccgcgcgccaguucaacacgcugaucccguggugccugccccacaccggcaaccgccacaaccacugggccggccucuacgggcggcuggagugggacggcuucuucuccaccaccgugacgaaccccgagcccauggggaagcagggccgcgugcugcacccggagcagcaccgggucgugagcguccgcgagugcgcccggucccagggguuccccgacaccuaccgccucuucggcaacauccuggacaagcaccgccaggugggcaacgccgugcccccgccccuggccaaggcgaucgggcucgagaucaagcugugcaugcuggccaaggcccgggagagcgccuccgccaagaucaaggaggaggaggcggccaaggacuga

SEQ ID NO: 29307 - RNA, 2172 nt, Artificial Sequence
  derived and/or modified sequence opt1 from DNMT3A__Homo_sapiens__NP_715640
augggcauccuggagcgcgugguccggcgcaacgggcggguggaccgcagccucaaggacgagugcgacaccgccgagaagaaggccaaggugaucgccggcaugaacgccgucgaggagaaccaggggcccggcgagucccagaagguggaggaggccagcccgcccgccgugcagcagcccaccgaccccgccuccccgacggucgcgaccacccccgagcccguggggagcgacgccggcgacaagaacgccaccaaggccggcgacgacgagcccgaguacgaggacgggcggggcuucgggaucggcgagcuggugugggggaagcugcgcggcuucuccugguggccgggccggaucgucagcugguggaugacggggcgcucccgggcggccgagggcacccgcugggugaugugguucggggacggcaaguucagcguggucugcguggagaagcucaugccccuguccagcuucugcuccgccuuccaccaggccaccuacaacaagcagcccauguaccggaaggccaucuacgaggugcugcaggucgcgagcucccgcgccggcaagcuguuccccgugugccacgacagcgacgaguccgacaccgccaaggccguggagguccagaacaagccgaugaucgagugggcccucgggggcuuccagcccagcgggcccaagggccuggagcccccggaggaggagaagaaccccuacaaggagguguacacggacauguggguggagcccgaggcggccgccuacgcgcccccgccgcccgccaagaagccccggaaguccaccgccgagaagcccaaggucaaggagaucaucgacgagcgcacccgggagcgccucguguacgaggugcggcagaagugccgcaacaucgaggacaucugcaucagcugcgggucccugaacgucacccuggagcacccccucuucgugggcggcaugugccagaacugcaagaacugcuuccuggagugcgccuaccaguacgacgacgacggguaccagagcuacugcacgaucugcugcggcgggcgggagguccugaugugcggcaacaacaacugcugccgcugcuucugcguggagugcguggaccuccuggucgggcccggcgccgcccaggccgcgaucaaggaggaccccuggaacugcuacaugugcggccacaaggggaccuacggccugcuccggcgccgcgaggacuggccgagccggcugcagauguucuucgccaacaaccacgaccaggaguucgacccgcccaagguguacccgcccgugcccgccgagaagcgcaagcccauccggguccugucccucuucgacgggaucgccaccggccugcuggugcucaaggaccuggggauccagguggaccgcuacaucgcgagcgaggucugcgaggacuccaucaccgugggcauggugcggcaccagggcaagaucauguacgucggggacgugcgcagcgugacgcagaagcacauccaggaguggggccccuucgaccuggucaucgggggcucccccugcaacgaccucagcaucgugaaccccgcccggaagggccuguacgaggggaccggccgccuguucuucgaguucuaccggcuccugcacgacgcccgccccaaggagggggacgaccggccguucuucuggcuguucgagaacguggucgccaugggcguguccgacaagcgcgacaucagccgguuccucgaguccaaccccgugaugaucgacgccaaggaggucagcgcggcccaccgcgcccgguacuucugggggaaccugcccggcaugaaccgcccccuggccuccaccgugaacgacaagcucgagcugcaggagugccuggagcacggccggaucgccaaguucagcaaggugcgcaccaucacgacccgguccaacagcaucaagcaggggaaggaccagcacuucccggucuucaugaacgagaaggaggacauccucuggugcaccgagauggagcgcguguucggcuuccccgugcacuacaccgacgucuccaacaugagccgccuggcgcggcagcgccugcucgggcgguccuggagcgugcccgugauccgccaccuguucgcgccccugaaggaguacuucgccugcgucuga

SEQ ID NO: 29308 - RNA, 2187 nt, Artificial Sequence
  derived and/or modified sequence opt1 from DNMT3B__Homo_sapiens__NP_001193984
augaagggcgacacccgccaccugaacggggaggaggacgccggcgggcgggaggacagcauccucgugaacggcgccugcuccgaccagagcuccgacagcccgcccauccuggaggcgauccgcacccccgagauccgggggcgccgguccagcucccgccugagcaagcgggaggucuccagccuccuguccuacacgcaggaccugaccggcgacggcgacggggaggacggcgacgggagcgacacccccgugaugcccaagcuguuccgcgagacccggacgcgcuccgagagcccggccucccugcggcgccgggccaccgccagcgccggcacccccuggcccuccccgcccagcuccuaccugaccaucgaccucacggacgacaccgaggacacccacgggacgccccagagcagcuccacccccuacgcgcgccuggcccaggacagccagcagggcggcauggagagcccccagguggaggccgacuccggggacggcgacuccagcgaguaccaggacgggaaggaguucggcaucggcgaccuggucugggggaagaucaagggcuucuccugguggccggccaugguggugagcuggaaggcgaccuccaagcggcaggccaugagcgggaugcgcuggguccagugguucggcgacgggaaguucuccgaggugagcgccgacaagcucguggcccugggccuguucucccagcacuucaaccucgccaccuucaacaagcuggucagcuaccggaaggcgauguaccacgcccuggagaaggcccgcgugcgggccggcaagaccuuccccuccagccccggggacucccucgaggaccagcugaagcccaugcuggagugggcccacggcggguucaagccgacgggcaucgaggggcucaagcccaacaacacccagcccgagaacaagacccgccggcgcaccgcggacgacagcgccacguccgacuacugccccgccccgaagcgccugaagaccaacugcuacaacaacggcaaggaccggggcgacgaggaccagagccgcgagcagauggccagcgacguggccaacaacaaguccagccuggaggacgggugccucuccugcggccggaagaaccccgucagcuuccacccccuguucgagggcgggcugugccagaccugccgcgaccgguuccucgagcuguucuacauguacgacgacgacggguaccaguccuacugcaccgugugcugcgagggccgcgagcugcuccugugcagcaacacguccugcugccggugcuucugcguggagugccuggagguccucgugggcaccgggaccgcggccgaggccaagcugcaggagcccuggagcugcuacaugugccugccgcagcgcugccacggcgugcuccggcgccggaaggacuggaacguccgccugcaggccuucuucaccuccgacacggggcuggaguacgaggcccccaagcucuaccccgcgauccccgccgcccggcgccggccgauccgcgugcugagccuguucgacggcaucgccaccggcuaccucgugcugaaggagcuggggaucaaggucggcaaguacguggcguccgaggugugcgaggagagcaucgccgucgggaccgugaagcacgagggcaacaucaaguacgucaacgacgugcggaacaucaccaagaagaacaucgaggagugggggcccuucgaccucgugaucggcggcucccccugcaacgaccugagcaacgucaacccggcccgcaaggggcuguacgagggcacggggcgccucuucuucgaguucuaccaccuccugaacuacucccggcccaaggagggcgacgaccgccccuucuucuggauguucgagaacgugguggccaugaaggucggggacaagcgggacaucagccgcuuccuggagugcaaccccgugaugaucgacgccaucaagguguccgcggcccaccgggcccgcuacuucuggggcaaccucccgggcaugaaccggaucuucggguuccccguccacuacaccgacgugagcaacaugggccgcggggcccggcagaagcugcugggccgcagcugguccgugcccgucauccggcaccucuucgcgccccugaaggacuacuucgccugcgaguga

SEQ ID NO: 29309 - RNA, 1161 nt, Artificial Sequence
  derived and/or modified sequence opt1 from DNMT3L__Homo_sapiens__NP_787063
auggccgccauccccgcgcuggacccggaggccgagcccagcauggacgugauccucgucggcuccagcgagcuguccagcuccgugagccccgggaccggccgcgaccugaucgccuacgaggugaaggccaaccagcggaacaucgaggacaucugcaucugcugcgggucccuccagguccacacccagcacccccuguucgagggcgggaucugcgccccgugcaaggacaaguuccuggacgcccucuuccuguacgacgacgacggcuaccagagcuacugcuccaucugcugcagcggcgagacgcugcucaucugcgggaaccccgacugcacccgcugcuacugcuucgagugcguggacucccuggugggccccgggaccagcggcaagguccacgcgauguccaacugggugugcuaccugugccuccccagcucccggagcgggcugcugcagcgccggcgcaaguggcggucccagcucaaggccuucuacgaccgcgagagcgagaacccgcuggagauguucgagaccgugcccgucuggcggcgccagcccgugcgggugcugucccucuucgaggacaucaagaaggagcugacgagccugggcuuccucgagagcggcuccgaccccgggcagcugaagcacgucguggacgugaccgacaccguccgcaaggacguggaggaguggggcccguucgaccugguguacggggccaccccgccccucggccacacgugcgaccggccgcccagcugguaccuguuccaguuccaccgccugcuccaguacgcgcggcccaagcccggcagcccccgccccuucuucuggauguucgucgacaaccuggugcugaacaaggaggaccucgacguggccucccgguuccuggagauggagcccgucaccauccccgacgugcacgggggcucccugcagaacgccgugcgcgucuggagcaacauccccgccauccggucccgccacugggcccucgugagcgaggaggagcugucccugcucgcgcagaacaagcagagcuccaagcuggccgccaaguggccgaccaagcuggucaagaacugcuuccucccccugcgggaguacuucaaguacuucagcaccgagcugacguccagccucuga

SEQ ID NO: 29310 - RNA, 1458 nt, Artificial Sequence
  derived and/or modified sequence opt1 from DNPEP__Homo_sapiens__NP_036232
augagcggccacucccccacccgcggggccaugcaggucgccaugaacggcaaggcgcggaaggaggccgugcagaccgccgccaaggagcugcucaaguucgugaaccgcagcccgucccccuuccacgccguggcggagugccggaaccgccugcugcaggccggguucagcgagcucaaggagacggagaaguggaacaucaagcccgaguccaaguacuucaugacccggaacagcuccaccaucaucgccuucgccgucggcgggcaguacgugcccggcaacggcuucagccugaucggggcgcacaccgacuccccgugccugcgcgugaagcggcgcagccggcgcucccaggucggcuuccagcaggucgggguggagacguacggcgggggcaucuggagcaccugguucgaccgggaccucacccuggccggccgcgugaucgugaagugccccaccuccgggcggcuggagcagcagcucgugcacgucgagcgccccauccugcggaucccccaccuggccauccaccuccagcgcaacaucaacgagaacuucggcccgaacacggagaugcaccuggugcccauccuggccaccgccauccaggaggagcucgagaaggggacccccgagcccggcccgcugaacgcgguggacgagcggcaccacagcguccugaugucccuccugugcgcccaccugggccucagccccaaggacaucguggagauggagcugugccuggccgacacccagcccgccgugcucgggggcgccuacgacgaguucaucuucgcgccccgccuggacaaccugcacuccugcuucugcgcccuccaggcccugaucgacagcugcgccgggccgggcucccuggccacggagccccacguccggauggugacccucuacgacaacgaggagguggggagcgagagcgcgcagggcgcccagucccugcugaccgagcucguccugcgccggaucagcgccuccugccagcaccccaccgccuucgaggaggccauccccaagagcuucaugaucuccgcggacauggcccacgccgugcacccgaacuaccuggacaagcacgaggagaaccaccgcccccucuuccacaagggccccgugaucaaggucaacagcaagcagcgcuacgccuccaacgcggugagcgaggcccugauccgggaggucgccaacaaggugaaggugccccugcaggaccucaugguccgcaacgacacgccgugcgggaccaccaucggccccauccuggccucccggcuggggcuccgcgugcuggaccugggcagcccccagcucgccaugcacuccauccgggagauggcgugcaccacgggggugcugcagacccugacccucuucaagggcuucuucgagcuguuccccagccugucccacaaccugcucgucgacuga

SEQ ID NO: 29311 - RNA, 1527 nt, Artificial Sequence
  derived and/or modified sequence opt1 from DNTT__Homo_sapiens__NP_001017520
auggacccgccccgcgccagccaccugagcccccggaagaagcgcccccggcagaccggcgcccucauggcguccagcccccaggacaucaaguuccaggaccugguggucuucauccuggagaagaagauggggaccacgcgccgggccuuccucauggagcuggcccgccggaagggcuuccgcguggagaacgagcuguccgacuccgugacccacaucgucgccgagaacaacagcggguccgacgugcucgaguggcugcaggcccagaaggugcaggucagcucccagccggagcugcucgacgugagcuggcugaucgagugcauccgggcgggcaagcccguggagaugaccgggaagcaccagcuggucgugcgccgggacuacuccgacagcaccaaccccgggcccccgaagacgccgcccaucgccgugcagaagaucucccaguacgccugccagcgccggaccacccucaacaacugcaaccagaucuucaccgacgccuucgacauccuggcggagaacugcgaguuccgcgagaacgaggacagcugcgucacguucaugcgggccgccuccgugcucaagagccuccccuucaccaucaucuccaugaaggacaccgagggcauccccugccugggcagcaaggugaagggcaucaucgaggagaucaucgaggacggggaguccagcgaggucaaggccgugcugaacgacgagcgcuaccagagcuucaagcuguucaccuccguguucggcgucgggcugaagacgagcgagaagugguuccggaugggcuuccgcacccuguccaaggugcggagcgacaagucccucaaguucacccgcaugcagaaggccggcuuccuguacuacgaggaccuggugagcugcgucacccgggcggaggccgaggccguguccgugcucgucaaggaggccgugugggccuuccugcccgacgcguucgucacgaugaccgggggcuuccgccgcgggaagaagaugggccacgacguggacuuccugaucaccagccccggcuccaccgaggacgaggagcagcuccugcagaaggugaugaaccugugggagaagaaggggcuccugcuguacuacgaccucgucgagagcacguucgagaagcugcggcugcccucccgcaagguggacgcccucgaccacuuccagaagugcuuccugaucuucaagcugccgcggcagcgcguggacagcgaccaguccagcuggcaggagggcaagaccuggaaggccauccgggucgaccucgugcugugccccuacgagcgccgggccuucgcccugcucggguggaccggcucccgcuucgagcgggaccugcgccgguacgcgacccacgagcgcaagaugauccuggacaaccacgcccucuacgacaagacgaagcggaucuuccugaaggccgagagcgaggaggagaucuucgcccaccuggggcucgacuacaucgagcccugggagcgcaacgccuga

SEQ ID NO: 29312 - RNA, 1203 nt, Artificial Sequence
  derived and/or modified sequence opt1 from DOC2A__Homo_sapiens__XP_011544277
augcgcggccggcgcggggaccggaugaccaucaacauccaggagcacauggccaucaacgugugccccggcccgauccgccccauccggcagaucagcgacuacuucccccgcgggcccggcccggagggcgggggcgggggcgggggcgaggcccccgcgcaccuggucccccucgcccuggcgcccccggccgcccugcucggggccaccacgcccgaggacggcgccgagguggacuccuacgacagcgacgacgccaccgcccugggcacccuggaguucgaccuccuguacgaccgggcguccugcacccugcacugcagcauccuccgcgccaaggggcugaagcccauggacuucaacggccuggccgaccccuacgugaagcuccaccuccugccgggggccugcaaggccaacaagcucaagacgaagacccagcggaacacccugaaccccgucuggaacgaggaccugaccuacuccggcaucacggacgacgacaucacccacaaggugcuccgcaucgcggugugcgacgaggacaagcugagccacaacgaguucaucggcgagauccgggucccccugcgccggcucaagcccucccagaagaagcacuucaacaucugccuggagcgccaggugccgcuggccagccccuccagcauguccgccgcccuccgggggaucagcugcuaccugaaggagcuggagcaggccgagcagggccaggggcuccuggaggagcgcggccggauccugcucucccugagcuacuccagccgccggcgcgggcugcucgugggcauccugcggugcgcgcaccuggccgccauggacgucaacggcuacuccgaccccuacgugaagaccuaccuccgccccgacguggacaagaaguccaagcacaagaccugcgucaagaagaagacgcugaacccggaguucaacgaggaguucuucuacgagaucgagcugagcacccucgccaccaagacccuggaggugacggugugggacuacgacaucgggaaguccaacgacuucaucggcggggucagccugggccccggggcccgcggcgaggcgcggaagcacuggagcgacugccuccagcagcccgacgccgcccuggagcgcuggcacacccugaccagcgagcugcccccggccgccggcgcgcuguccagcgccuga

SEQ ID NO: 29313 - RNA, 1239 nt, Artificial Sequence
  derived and/or modified sequence opt1 from DOC2B__Homo_sapiens__NP_003576
augacccugcgccggcgcggcgagaaggccaccaucagcauccaggagcacauggccaucgacgugugccccgggccgauccggcccaucaagcagaucuccgacuacuucccccgcuucccccggggccucccgcccgacgcggggccccgcgccgccgcgcccccggacgcccccgcccggcccgccgucgccggcgccgggcgccggagccccuccgacggcgcgcgcgaggacgacgaggacguggaccagcuguucggcgccuacgggagcuccccgggccccagccccgggcccuccccggcccggccgcccgccaagccgcccgaggacgagcccgacgccgacggcuacgagagcgacgacugcacggcgcuggggacccucgacuucucccugcuguacgaccaggagaacaacgcccuccacugcaccaucaccaaggccaagggccugaagcccauggaccacaacggccuggccgaccccuacgugaagcuccaccuccugcccggggccagcaaggcgaacaagcugcgcacgaagacccugcggaacacccugaaccccaccuggaacgagacgcucaccuacuacggcaucaccgacgaggacaugauccgcaagacccugcggaucuccgucugcgacgaggacaaguuccgccacaacgaguucaucggggagacgcgggugccccugaagaagcucaagcccaaccacaccaagaccuucagcaucugccuggagaagcagcugccgguggacaagaccgaggacaagucccucgaggagcgcggccggauccugaucagccugaaguacuccagccagaagcagggccuccuggucgggaucgugcgcugcgcccaccuggccgccauggacgccaacggcuacuccgaccccuacgugaagacguaccuccggcccgacgucgacaagaaguccaagcacaagaccgcggugaagaagaagacccugaacccggaguucaacgaggaguucugcuacgagaucaagcacggggaccuggccaagaagucccucgaggugaccgucugggacuacgacaucggcaagagcaacgacuucaucgggggcguggugcugggcauccacgccaagggggagcgccugaagcacugguucgacugccucaagaacaaggacaagcgcaucgagcgguggcacacgcugaccagcgagcugcccggcgccguccucagcgacuga

SEQ ID NO: 29314 - RNA, 6543 nt, Artificial Sequence
  derived and/or modified sequence opt1 from DOCK10__Homo_sapiens__NP_001277192
augagcuuccgcggcaagguguucaagcgggagcccuccgaguucuggaagaagcgccggaccguccgccgggugaaccaggaggagauccaccgcuucagcucccaggagaagccgcggcugcucgagccccuggacuacgagaccgugaucgaggagcuggagaagacguaccgcaacgacccccuccaggaccugcuguucuuccccagcgacgacuucuccgccgccaccgucagcugggacauccggacccucuacuccaccgugccggaggacgcggagcacaaggccgagaaccugcuggugaaggaggccugcaaguucuacagcucccaguggcacgucgugaacuacaaguacgagcaguacagcggggacauccgccagcucccccgggccgaguacaagcccgagaagcugcccucccacagcuucgagaucgaccacgaggacgccgacaaggacgaggacacgaccucccacagcuccagcaagggcgggggcggggcgggcggcaccgggguguucaaguccggcuggcuguacaaggggaacuucaacagcaccgucaacaacacggugaccgugcgcuccuucaagaagcgguacuuccagcucacccagcugccggacaacagcuacaucaugaacuucuacaaggacgagaagaucagcaaggagcccaagggcugcaucuuccuggacuccugcaccggggucgugcagaacaaccgccuccggaaguacgccuucgagcugaagaugaacgaccugacguacuucgugcucgccgccgagaccgagagcgacauggacgaguggauccacacccugaaccgcauccugcagaucucccccgagggcccccuccagggccggcgcagcaccgagcugacggaccuggggcucgacucccuggacaacagcgucaccugcgagugcaccccggaggagaccgacuccagcgagaacaaccugcacgcggacuucgccaaguaccucacggagaccgaggacaccgugaagaccacgcggaacauggagcgccugaaccuguucucccucgaccccgacaucgacacccugaagcugcagaagaaggaccuccuggagcccgagagcgugaucaagcccuucgaggagaaggccgccaagcggaucaugaucaucugcaaggcccugaacuccaaccuccagggcugcgucaccgagaacgagaacgacccgaucaccaacaucgagcccuucuucgugagcguggcgcuguacgaccugcgcgacucccgcaagaucagcgccgacuuccacgucgaccucaaccacgccgccgugcggcagaugcugcugggggccuccguggcgcucgagaacggcaacaucgacacgaucaccccccgccagagcgaggagccccacaucaagggccugccggaggaguggcugaaguuccccaagcaggccgucuucuccgugagcaacccccacuccgagaucguccucguggccaagaucgagaaggugcugauggggaacaucgccagcggcgccgagcccuacaucaagaacccggacagcaacaaguacgcgcagaagauccugaaguccaaccggcaguucugcagcaagcucgggaaguaccgcaugcccuucgccugggccguccgguccguguucaaggacaaccagggcaacguggaccgcgacagccgguucuccccccuguuccgccaggagagcuccaagaucagcaccgaggaccuggucaagcugguguccgacuaccggcgcgccgaccggaucagcaagaugcagaccauccccgggucccucgacaucgccguggacaacgucccgcuggagcaccccaacugcgugacgagcuccuucauccccgugaagccguucaacaugauggcgcagaccgagcccaccgucgagguggaggaguucguguacgacagcaccaaguacugccgccccuaccgggucuacaagaaccagaucuacaucuaccccaagcaccugaaguacgacucccagaagugcuucaacaaggcccgcaacaucacggugugcaucgaguucaagaacagcgacgaggaguccgccaagccgcucaagugcaucuacggcaagcccggcgggccccuguucaccagcgccgcguacaccgccgugcugcaccacagccagaaccccgacuucuccgacgaggucaagaucgagcucccgacccagcugcacgagaagcaccacauccuguucagcuucuaccacgugaccugcgacaucaacgccaaggccaacgccaagaagaaggaggcgcucgagacguccgugggcuacgccuggcugccccugaugaagcacgaccagaucgccagccaggaguacaacauccccaucgccaccucccuccccccgaacuaccugagcuuccaggacuccgccagcgggaagcacggcggguccgacaucaagugggucgacggcggcaagccccuguucaaggugagcaccuucguggucuccaccgugaacacgcaggacccccacgugaacgcguucuuccaggagugccagaagcgggagaaggacaugagccagucccccaccagcaacuucauccgcuccugcaagaaccuccugaacgucgagaagauccacgccaucaugagcuuccugccgaucauccucaaccagcuguucaaggugcuggugcagaacgaggaggacgagaucaccaccacggucacccgggugcucaccgacaucguggccaagugccacgaggagcagcuggaccacuccguccagagcuacaucaaguucguguucaagacccgcgccugcaaggagcggacggugcacgaggagcuggccaagaacgucaccgggcuccugaaguccaacgacagcaccaccgugaagcacgugcugaagcacagcugguucuucuucgcgaucauccucaaguccauggcccagcaccugaucgacacgaacaagauccagcugccccgcccccagcgcuuccccgagagcuaccagaacgagcucgacaaccuggucauggugcuguccgaccacgugaucuggaaguacaaggacgcccucgaggagacccggcgcgccaaccacagcgucgcgcgguuccugaagcgcugcuucaccuucauggaccggggcuacguguucaagauggugaacaacuacaucuccauguucagcuccggggaccugaagacccucugccaguacaaguucgacuuccugcaggaggucugccagcacgagcacuucaucccgcugugccuccccauccgcagcgccaacauccccgacccccugacgccguccgagagcacccaggagcugcacgccuccgacaugcccgaguacagcgugaccaacgaguucugccggaagcacuuccucaucggcauccugcugcgcgaggugggguucgcccuccaggaggaccaggacguccggcaccuggcccuggcggugcucaagaaccugauggccaagcacuccuucgacgaccgcuaccgggagccccgcaagcaggcccagaucgccagccuguacaugccgcucuacggcaugcugcuggacaacaugccccggaucuaccucaaggaccuguaccccuucaccgugaacacguccaaccagggcagccgcgacgaccuguccaccaacgggggcuuccagagccagaccgccaucaagcacgcgaacuccgucgacaccagcuucagcaaggacgugcucaacuccaucgccgccuucagcuccaucgccaucagcacggucaaccacgccgacucccgggcgagccuggccucccuggacagcaaccccuccaccaacgagaagagcuccgagaagaccgacaacugcgagaagaucccgcgcccccucagccugaucggguccacccugcgguucgacaagcucgaccaggccgagacgcgcagccugcugaugugcuuccuccacaucaugaagaccaucuccuacgagacccugaucgccuacuggcagcgggcgcccagccccgagguguccgacuucuucagcauccuggacgugugccuccagaacuuccgcuaccugggcaagcggaacaucauccgcaagaucgccgccgccuucaaguucguccaguccacccagaacaacggcacgcugaaggggagcaacccgagcugccagaccuccggccuccugagccaguggaugcacuccaccagcucccacgaggggcacaagcagcaccgcagccagacccugcccaucauccggggcaagaacgcccucuccaaccccaagcugcugcagaugcucgacaacaccaugacgagcaacuccaacgagaucgacaucgugcaccacguggacaccgaggcgaacaucgccaccgaggucugccugaccauccuggaccuccugagccuguucacgcagacccaccagcgccagcuccagcagugcgacugccagaacucccugaugaagcggguguucgacaccuacaugcuguucuuccaggugaaccagagcgccaccgcccucaagcacgucuucgccucccugcgccuguucgugugcaaguuccccagcgcguucuuccaggggccggccgaccucugcggcuccuucugcuacgaggugcugaagugcugcaaccaccggagccgcuccacgcagaccgaggccagcgcccugcucuacuucuucaugcggaagaacuucgaguucaacaagcagaaguccaucguccgcagccaccugcagcugaucaaggccgugagccagcugaucgcggacgccggcaucgggggcucccgguuccagcacagccucgccaucaccaacaacuucgccaacggggacaagcagaugaagaacuccaacuuccccgccgaggugaaggaccugaccaagcgcauccggacgguccugauggcgaccgcccagaugaaggagcacgagaaggaccccgagaugcucguggaccugcaguacagccuggccaacuccuacgccagcacccccgagcuccgccggaccuggcuggaguccauggcgaagauccacgcccgcaacggcgaccugagcgaggccgccaugugcuacauccacaucgccgcgcucaucgccgaguaccugaagcggaagggguacuggaagguggagaagaucugcacggccucccugcucagcgaggacacccacccgugcgacuccaacagccugcugaccacccccuccggcggcagcauguucuccaugggguggcccgccuuccucagcaucacgcccaacaucaaggaggagggcgccaugaaggaggacuccgggaugcaggacaccccguacaacgagaacauccuggucgagcagcuguacaugugcguggaguuccucuggaagagcgagcgcuacgagcugaucgcggacgugaacaagcccaucaucgccgucuucgagaagcagcgggacuucaagaagcuguccgaccucuacuacgacauccaccgcagcuaccugaagguggccgagguggucaacagcgagaagcggcuguucggccgcuacuaccgcguggccuucuacgggcagggcuucuucgaggaggaggagggcaaggaguacaucuacaaggagcccaagcucaccgggcuguccgagaucagccagcggcugcucaagcuguacgccgacaaguucggcgcggacaacgugaagaucauccaggacuccaacaaggucaaccccaaggaccuggacccgaaguacgccuacauccaggugaccuacgugacgcccuucuucgaggagaaggagaucgaggaccgcaagaccgacuucgagaugcaccacaacaucaaccgguucgucuucgagacccccuucacccucagcgggaagaagcacggcgggguggccgagcagugcaagcgccggacgauccugaccaccucccaccuguuccccuacgugaagaagcgcauccaggucaucagccaguccagcaccgagcucaacccgaucgagguggccaucgacgagauguccaagaaggugagcgagcugaaccagcugugcacgauggaggaggucgacaugauccggcuccagcugaagcugcagggcuccgugagcgugaaggucaacgcgggccccauggccuacgcccgcgccuuccucgaggagaccaacgccaagaaguaccccgacaaccaggugaagcugcugaaggagaucuuccggcaguucgcggacgccugcgggcaggcccucgacgugaacgagcgccugaucaaggaggaccagcuggaguaccaggaggagcuccggucccacuacaaggacaugcugagcgagcuguccaccgucaugaacgagcagaucaccggccgcgacgaccucagcaagcgggggguggaccagacgugcacccgcgugaucuccaaggccaccccggcccugcccaccgucagcaucagcuccagcgcggagguguga

SEQ ID NO: 29315 - RNA, 6222 nt, Artificial Sequence
  derived and/or modified sequence opt1 from DOCK11__Homo_sapiens__NP_653259
auggccgaggugcgcaaguucaccaagcggcugagcaagcccggcaccgccgcggagcuccgccaguccgucagcgaggccgugcggggguccgugguccuggagaaggccaaggugguggagccgcuggacuacgagaacgucaucgcccagcgcaagacgcagaucuacagcgacccccuccgggaccugcugauguuccccauggaggacaucuccaucagcgugaucggccgccagcggcgcaccgugcaguccaccguccccgaggacgccgagaagcgggcgcagagccucuucgugaaggagugcaucaagaccuacuccacggacuggcacguggucaacuacaaguacgaggacuucagcggggacuuccgcaugcugccgugcaagucccugcggcccgagaagauccccaaccacguguucgagaucgacgaggacugcgagaaggacgaggacagcuccagccucugcucccagaagggcggggugaucaagcagggcuggcugcacaaggccaacgucaacagcaccaucaccgugaccaugaagguguucaagcgccgguacuucuaccugacgcagcuccccgacggcuccuacauccugaacagcuacaaggacgagaagaacuccaaggagagcaaggggugcaucuaccuggacgccugcaucgacgucgugcagugcccgaagaugcgccggcacgccuucgagcucaagaugcuggacaaguacagccacuaccuggcggccgagaccgagcaggagauggaggaguggcucaucacccugaagaagaucauccagaucaacaccgacucccuggugcaggagaagaaggagacggucgagaccgcccaggacgacgagaccagcucccagggcaaggccgagaacaucauggccagccucgagcgcuccaugcaccccgagcugaugaaguacgggcgggagaccgagcagcugaacaagcucagccgcggcgacgggcggcagaaccuguucuccuucgacagcgaggugcagcgccuggacuucuccggcaucgagcccgacaucaagcccuucgaggagaagugcaacaagcgguuccucgugaacugccacgaccugacguucaacauccugggccagaucggggacaacgcgaagggcccgcccaccaacgucgagcccuucuucaucaaccucgcccuguucgacgugaagaacaacugcaagaucagcgccgacuuccacgucgaccugaaccccccguccgugcgcgagaugcucugggggagcuccacccagcuggccagcgacggcucccccaagggcagcucccccgagagcuacauccacgggaucgccgagucccagcugcgcuacauccagcagggcaucuucagcgugaccaacccccacccggagaucuuccucgucgcgcggaucgagaaggugcugcaggggaacaucacgcacugcgccgagcccuacaucaagaacagcgaccccgugaagaccgcccagaagguccaccgcaccgccaagcaggugugcucccggcugggccaguaccgcaugcccuucgccugggcggcccggccgaucuucaaggacacccaggggagccucgaccuggacggccgcuucuccccccuguacaagcaggacagcuccaagcucagcuccgaggacauccugaagcugcucagcgaguacaagaagcccgagaagacgaagcugcagaucauccccggccagcugaacaucaccguggagugcgucccgguggaccucuccaacugcaucaccagcuccuacgugccccugaagcccuucgagaagaacugccagaacaucaccgucgagguggaggaguucgugccggagaugacgaaguacugcuaccccuucaccaucuacaagaaccaccuguacgucuacccccugcagcucaaguacgacagccagaagaccuucgccaaggcccggaacaucgccgugugcguggaguuccgcgacuccgacgagagcgacgcguccgcccugaagugcaucuacgggaagcccgccggcagcgucuucaccacgaacgccuacgcgguggugucccaccacaaccagaacccggaguucuacgacgagaucaagaucgagcugcccauccaccuccaccagaagcaccaccugcuguucaccuucuaccacgucagcugcgagaucaacaccaaggggaccacgaagaagcaggacaccguggagacccccgugggcuucgccugggucccccuccugaaggacgggcggaucaucaccuucgagcagcagcugccggugagcgccaaccucccccccggcuaccugaaccugaacgacgccgagucccgccggcagugcaacguggacaucaagugggucgacggcgccaagccccuccugaagaucaagagccaccuggaguccaccaucuacacgcaggaccuccacgugcacaaguucuuccaccacugccagcugauccagagcggguccaaggaggugccgggcgagcugaucaaguaccucaagugccugcacgcgauggagauccaggucaugauccaguuccugcccgugauccucaugcagcuguuccgcgugcugaccaacaugacccacgaggacgacguccccaucaacugcaccauggugcuccugcacaucgugagcaagugccacgaggaggggcuggacuccuaccuccggagcuucaucaaguacuccuuccgccccgagaagccgagcgccccccaggcccagcugauccacgagacgcuggccaccaccaugaucgccauccucaagcaguccgcggacuuccugagcaucaacaagcugcucaaguacuccugguucuucuucgagaucaucgccaagagcauggccaccuaccugcuggaggagaacaagaucaagcucccccggggccagcgcuuccccgagacguaccaccacguccugcacucccugcuccuggccaucaucccgcacgugaccauccgguacgccgagauccccgacgagagccgcaacgugaacuacucccuggcgagcuuccucaagcggugccugacccugauggaccgcggguucaucuucaaccucaucaacgacuacaucuccggcuucagccccaaggaccccaagguccuggccgaguacaaguucgaguuccugcagaccaucugcaaccacgagcacuacaucccgcucaaccugcccauggccuucgccaagcccaagcugcagcgcgugcaggacagcaaccucgaguacucccugagcgacgaguacugcaagcaccacuuccuggugggccuccugcugcgggagacguccaucgcgcuccaggacaacuacgagauccgcuacaccgccaucagcgucaucaagaaccugcugaucaagcacgccuucgacacccgguaccagcacaagaaccagcaggccaagaucgcccagcucuaccugccguucguggggcugcuccuggagaacauccagcgccuggcgggccgggacacccucuacuccugcgccgccaugcccaacagcgccucccgcgacgaguuccccugcggguucacgagccccgccaaccggggcucccugagcaccgacaaggacaccgcguacggcuccuuccagaacgggcacggcaucaagcgcgaggacagccgggggucccugaucccggagggcgccaccggguuccccgaccagggcaacacgggcgagaacacccgccagagcuccacccggagcuccgugagccaguacaaccgccucgaccaguacgagauccggucccugcugaugugcuaccucuacaucgucaagaugaucagcgaggacacccugcugacguacuggaacaaggugagcccccaggagcucaucaacauccugauccugcucgaggugugccuguuccacuuccgcuacauggggaagcggaacaucgcccgcguccacgacgccuggcuguccaagcacuucggcaucgaccggaagagccagaccaugcccgcccuccgcaaccgguccggggugaugcaggcgcgccugcagcaccugagcucccucgagagcuccuucacccugaaccacagcuccaccacgaccgaggccgacaucuuccaccaggcccugcucgagggcaacaccgccaccgaggugagccugacgguccuggacaccaucuccuucuucacccagugcuucaagacccagcuccugaacaacgacgggcacaacccgcugaugaagaagguguucgacauccaccucgcguuccugaagaacggccagagcgaggucucccugaagcacguguucgccagccugcgggccuucaucuccaaguuccccagcgccuucuucaagggccgcgugaacaugugcgccgcguucugcuacgagguccucaagugcugcacguccaagaucagcuccacccgcaacgaggccagcgcccugcuguaccuccugaugcggaacaacuucgaguacaccaagcgcaagaccuuccugcggacccaccuccagaucaucaucgccgugagccagcugaucgccgacguggcgcuguccgggggcagccgcuuccaggagucccucuucaucaucaacaacuucgccaacagcgaccggcccaugaaggccacggccuuccccgccgaggucaaggaccugaccaagcgcauccggaccgugcugauggcgaccgcccagaugaaggagcacgagaaggacccggagaugcucaucgaccugcaguacucccuggccaagagcuacgccuccacgcccgagcuccgcaagaccuggcuggacagcauggccaagauccacgugaagaacggggacuucuccgaggcggccaugugcuacguccacguggccgcccugguggcggaguuccuccaccggaagaagcuguuccccaacggcugcagcgccuucaagaagaucacccccaacaucgacgaggagggggccaugaaggaggacgccggcaugauggacguccacuacuccgaggaggugcugcucgagcugcuggagcagugcguggacggccucuggaaggccgagcgcuacgagaucaucagcgagaucuccaagcugaucgucccgaucuacgagaagcggcgcgaguucgagaagcugacccagguguaccggacgcuccacggggcguacaccaagauccuggaggugaugcacaccaagaagcgccugcucggcaccuucuuccgggucgccuucuacgggcagagcuucuucgaggaggaggacggcaaggaguacaucuacaaggagcccaagcugacggggcuguccgagaucagccuccgccuggugaagcuguacggcgagaaguucggcaccgagaacgugaagaucauccaggacuccgacaaggucaacgccaaggagcucgaccccaaguacgcccacauccaggugaccuacgugaagcccuacuucgacgacaaggagcugaccgagcggaagacggaguucgagcgcaaccacaacaucagccgguucgucuucgaggccccguacacccuguccgggaagaagcagggcugcaucgaggagcagugcaagcgccgcaccauccucaccacgagcaacagcuuccccuacgugaagaagcggauccccaucaacugcgagcagcagaucaaccugaagcccaucgacguggcgaccgacgagaucaaggacaagaccgccgagcugcagaagcucugcuccagcaccgacgucgacaugauccagcugcagcugaagcuccaggggugcguguccgugcaggucaacgccggcccgcuggccuacgcccgcgcguuccugaacgacagccaggccuccaaguacccccccaagaaggugagcgagcucaaggacauguuccggaaguucauccaggccugcuccaucgcccuggagcugaacgagcgccucaucaaggaggaccagguggaguaccacgagggccugaagagcaacuuccgggacauggucaaggagcuguccgacaucauccacgagcagauccuccaggaggacacgaugcacagccccuggauguccaacacccugcacguguucugcgcgaucagcgggaccuccagcgaccgcggcuacggguccccgcgguacgccgagguguga

SEQ ID NO: 29316 - RNA, 5598 nt, Artificial Sequence
  derived and/or modified sequence opt1 from DOCK1__Homo_sapiens__NP_001371
augacccgcugggugcccaccaagcgggaggagaaguacggcgucgccuucuacaacuacgacgcccgcggggcggacgagcugagccuccagaucggcgacacggugcacauccuggagaccuacgaggggugguaccggggcuacacccugcgcaagaaguccaagaaggggaucuucccggccagcuacauccaccucaaggaggccaucguggagggcaagggccagcacgagaccgucauccccggggaccugccccugauccaggaggugacgaccacccuccgggagugguccaccaucuggcgccagcuguacgugcaggacaaccgggagauguuccgcagcguccggcacaugaucuacgaccugaucgaguggcgcucccagauccucagcggcacgcugccccaggacgagcugaaggagcucaagaagaaggugaccgccaagaucgacuacgggaaccggauccuggaccuggaccucgugguccgcgacgaggacggcaacauccuggacccggagcugaccuccaccaucagccucuuccgggcccacgagaucgcguccaagcagguggaggagcgccugcaggaggagaagagccagaagcagaacaucgacaucaaccggcaggccaaguucgccgccacgcccucccuggcgcucuucgugaaccugaagaacgucgugugcaagaucggggaggacgccgaggugcugaugagccucuacgaccccgucgaguccaaguucaucagcgagaacuaccuggugcgcugguccagcuccggccugcccaaggacaucgaccggcuccacaaccugcgcgccguguucaccgaccugggcagcaaggaccucaagcgggagaagaucuccuucgucugccagaucgugcgcguggggcggauggagcugcgcgacaacaacacccgcaagcugaccagcggccuccggcgcccguucggggucgccgugauggacgugacggacaucaucaacggcaaggucgacgacgaggacaagcagcacuucauccccuuccagcccguggccggcgagaacgacuuccugcagaccgucaucaacaaggugaucgcggccaaggaggugaaccacaaggggcagggccugugggucacccucaagcugcugcccggggacauccaccagauccggaaggaguucccgcaccucguggaccgcaccacggccguggcccggaagaccggcuuccccgagaucaucaugcccggggacguccgcaacgacaucuacgugacccuggugcagggcgacuucgacaagggcagcaagaccacggccaagaacgucgaggugaccguguccgucuacgacgaggacgggaagcggcuggagcacgugaucuuccccggcgcgggggacgaggccaucagcgaguacaaguccgugaucuacuaccaggucaagcagccgcgcugguucgagaccgugaagguggccauccccaucgaggacgucaaccggagccaccuccgcuucaccuuccggcaccgcuccagccaggacuccaaggacaagagcgagaagaucuucgcccuggccuucgugaagcugaugcgguacgacggcacgacccuccgcgacggggagcacgaccugaucguguacaaggcggaggccaagaagcuggaggacgccgccaccuaccucucccugcccagcaccaaggccgagcuggaggagaagggccacuccgcgacgggcaagagcaugcagucccuggggagcugcaccaucuccaaggacagcuuccagaucuccacccucgucugcagcaccaagcugacgcagaacguggaccugcucggccugcugaaguggcgguccaacaccagccuccugcagcagaaccugcgccagcucaugaagguggacgggggcgaggucgugaaguuccugcaggacacccuggacgcccucuucaacaucaugauggagaacagcgaguccgagaccuucgacacccugguguucgacgcccuggucuucaucaucgggcucaucgccgaccggaaguuccagcacuucaaccccgugcuggagacguacaucaagaagcacuucagcgcgacccuggccuacaccaagcucaccaaggugcugaagaacuacgucgacggcgccgagaagccgggcgugaacgagcagcuguacaaggccaugaaggcccucgaguccaucuucaaguucaucgugcgcagccggauccuguucaaccagcuguacgagaacaagggggaggcggacuucgucgagucccuccugcagcuguuccgcagcaucaacgacaugauguccagcauguccgaccagacggugcgcgugaagggcgccgcccucaaguaccugcccaccaucgucaacgacgugaagcugguguucgaccccaaggagcucagcaagauguucaccgaguucauccugaacguccccauggggcugcucaccauccagaagcuguacugccugaucgagaucgugcacuccgaccucuucacgcagcacgacugccgggagauccugcugccgaugaugaccgaccagcucaaguaccaccuggagcgccaggaggaccuggaggccugcugccagcuccugagccacauccuggaggugcucuaccggaaggacgucggccccacccagcgccacgugcagaucaucauggagaagcugcugcggaccgugaaccgcacggucaucuccaugggccgggacagcgagcucaucgggaacuucguggccugcaugaccgcgauccugcgccagauggaggacuaccacuacgcccaccugaucaagaccuucggcaagaugcggaccgacguggucgacuuccucauggagacguucaucauguucaagaaccugaucgggaagaacguguaccccuucgacugggugaucaugaacaugguccagaacaagguguuccugcgcgccaucaaccaguacgccgacaugcucaacaagaaguuccuggaccaggccaacuucgagcugcagcucuggaacaacuacuuccaccuggcggucgccuuccugacccaggagucccuccagcuggagaacuucagcuccgccaagcgggccaagauccugaacaaguacggcgacaugcgccggcagaucggguucgagauccgcgacaugugguacaaccucggccagcacaagaucaaguucauccccgagauggugggcccgauccuggagaugacccugauccccgagaccgagcuccggaaggcgacgauccccaucuucuucgacaugaugcagugcgaguuccacagcacccgcagcuuccagauguucgagaacgagaucaucaccaagcuggaccacgagguggaggggggccggggggacgagcaguacaagguccuguucgacaagauccuccuggagcacugccgcaagcacaaguaccuggccaagaccggcgagacguucgugaagcucgugguccggcugauggagcgccugcucgacuaccggaccaucaugcacgacgagaacaaggagaaccgcauguccugcaccgugaacgugcugaacuucuacaaggagaucgagcgcgaggagauguacauccgguaccuguacaagcucugcgaccugcacaaggagugcgacaacuacaccgaggccgccuacacgcugcuccugcacgccaagcugcucaaguggagcgaggacgucugcguggcgcaccugacccagcgcgacggguaccaggccaccacccagggccagcugaaggagcagcucuaccaggagaucauccacuacuucgacaagggcaagaugugggaggaggccaucgcccuggggaaggagcuggccgagcaguacgagaacgagauguucgacuacgagcagcucuccgagcugcugaagaagcaggcgcaguucuacgagaacaucgugaaggucauccggccgaagcccgacuacuucgccgugggcuacuacgggcagggcuuccccacguuccuccgcgggaagguguucaucuaccggggcaaggaguacgagcgccgggaggacuucgaggcccgccugcugacccaguuccccaacgccgagaagaugaagaccaccagcccgcccggcgacgacaucaagaacucccccgggcaguacauccagugcuucacggucaagcccaagcuggaccucccgcccaaguuccaccggcccgugagcgagcagaucguguccuucuaccgcgucaacgaggugcagcgguucgaguacagccgccccauccggaagggcgagaagaacccggacaacgaguucgccaacauguggaucgagcgcaccaucuacaccaccgcguacaagcugcccgggauccugcggugguucgaggugaaguccgucuucaugguggagaucagcccccucgagaacgccaucgagaccaugcagcugacgaacgacaagaucaacuccauggugcagcagcaccuggacgaccccagccucccgaucaacccccuguccaugcugcucaacggcaucgucgaccccgccgugauggggggcuucgccaacuacgagaaggcguucuucaccgaccgcuaccugcaggagcaccccgaggcccacgagaagaucgagaagcugaaggaccucaucgccuggcagaucccguuccuggccgagggcauccggauccacggggacaaggugaccgaggcccugcgccccuuccacgagcggauggaggcgugcuucaagcagcucaaggagaaggucgagaaggaguacggcgugcgcaucaugcccagcucccuggacgaccgccgggggagccgcccccgguccauggugcgcagcuucaccaugccguccagcagccggccccuguccgucgccagcguguccagccucuccagcgacuccacgcccagccgcccgggcuccgacggcuucgcccuggagccccugcuccccaagaagaugcacagccggucccaggacaagcuggacaaggacgaccuggagaaggagaagaaggacaagaagaaggagaagcgcaacagcaagcaccaggagaucuucgagaaggaguucaagcccaccgacaucucccuccagcagagcgaggccgugauccuguccgagaccaucagcccgcugcggccccagcgccccaagucccaggucaugaacgugaucgggagcgagcggcgcuucuccgugagccccagcuccccgagcucccagcagacccccccccccgucacgccgcgggccaagcucagcuucuccaugcagagcucccuggagcugaacggcaugaccggggcggacguggccgacgugccccccccccucccgcugaagggcagcgucgccgacuacgggaaccugauggagaaccaggaccuccugggcucccccaccccccccccgccccccccccaccagcgccaccugccgcccccccuccccagcaagaccccgccccccccgccccccaagacgacccggaagcagaccuccguggacagcggcaucgugcaguga

SEQ ID NO: 29317 - RNA, 5493 nt, Artificial Sequence
  derived and/or modified sequence opt1 from DOCK2__Homo_sapiens__NP_004937
auggcccccuggcgcaaggccgacaaggagcggcacggcguggcgaucuacaacuuccaggggagcggcgccccgcagcugucccuccagaucggggacgucgugcgcauccaggagaccugcggcgacugguaccggggguaccugaucaagcacaagaugcugcagggcaucuuccccaagagcuucauccacaucaaggaggugaccgucgagaagcgccggaacacggagaacaucauccccgccgagaucccccucgcccaggaggugaccaccacccugugggaguggggcuccaucuggaagcagcuguacguggccagcaagaaggagcgcuuccuccagguccaguccaugauguacgaccugauggaguggcggagccagcugcucuccgggacgcugccgaaggacgagcugaaggagcucaagcagaaggugaccagcaagaucgacuacggcaacaagauccuggagcuggaccucaucgugcgcgacgaggacgggaacauccuggaccccgacaacaccuccgucaucagccuguuccacgcgcacgaggaggccaccgacaagaucacggagcggaucaaggaggagauguccaaggaccagcccgacuacgccauguacagccgcaucuccagcucccccacccacagccucuacguguucgugcggaacuucgucugccgcaucggcgaggacgccgagcuguucaugucccuguacgacccgaacaagcagaccgugaucagcgagaacuaccucgugcggugggggucccgcggcuuccccaaggagaucgagaugcugaacaaccugaaggucguguucaccgaccucggcaacaaggaccugaaccgggacaagaucuaccugaucugccagaucgugcgcgucgggaagauggaccucaaggacacgggcgcgaagaagugcacccaggggcugcggcgccccuucggcguggccgugauggacaucaccgacaucaucaagggcaaggccgagagcgacgaggagaagcagcacuucauccccuuccacccggucaccgccgagaacgacuuccugcacagccuccuggggaaggugaucgccuccaagggcgacagcgggggccaggggcugugggugacgaugaagaugcucgucggcgacaucauccagauccggaaggacuacccccaccugguggaccgcaccaccgucguggcgcggaagcugggcuuccccgagaucaucaugcccggggacgugcgcaacgacaucuacaucacccuccugcagggcgacuucgacaaguacaacaagacgacccagcgcaacgucgaggugaucaugugcgugugcgccgaggacgggaagacccugccgaacgccaucugcgucggcgccggggacaagcccaugaacgaguaccgguccgugguguacuaccaggucaagcagccccgcuggauggagaccgugaagguggccguccccaucgaggacaugcagcggauccaccuccgcuucauguuccggcaccgcagcucccuggagagcaaggacaagggcgagaagaacuucgcgauguccuacgugaagcugaugaaggaggacggcacgacccuccacgacggguuccacgaccuggugguccugaagggcgacagcaagaagauggaggacgccuccgccuaccucacccugccgagcuaccggcaccacguggagaacaagggggccacccugucccgcagcuccagcuccgugggcgggcucagcgucuccagccgggacguguucuccaucagcacgcuggugugcagcaccaagcugacccagaacgucggccugcucggccugcugaaguggcgcaugaagccccagcuccugcaggagaaccuggagaagcucaagaucguggacggggaggagguggucaaguuccugcaggacacccuggacgcccucuucaacaucaugauggagcacucccagagcgacgaguacgacauccugguguucgacgcgcugaucuacaucaucggccucaucgccgaccggaaguuccagcacuucaacacggugcuggaggccuacauccagcagcacuucuccgccacccuggccuacaagaagcucaugaccguccugaagaccuaccuggacacgagcucccgcggggagcagugcgagcccauccuccggacccugaaggcgcuggaguacguguucaaguucaucgugcgcagccggacccucuucucccagcuguacgagggcaaggagcagauggaguucgaggagagcaugcgccggcuguucgaguccaucaacaaccucaugaagagccaguacaagaccaccauccugcugcaggucgccgcccucaaguacauccccuccgugcugcacgacguggagauggucuucgacgccaagcugcucagccagcugcuguacgaguucuacacgugcaucccgcccgugaagcuccagaagcagaaggugcaguccaugaacgagaucguccagagcaaccuguucaagaagcaggagugccgcgacauccugcuccccgugaucaccaaggagcugaaggagcugcucgagcagaaggacgacaugcagcaccaggugcuggagcggaaguacugcgucgagcugcucaacuccauccuggaggugcugagcuaccaggacgcggccuucaccuaccaccacauccaggagaucauggugcagcuccugcgcaccgucaaccgcacggugaucaccaugggccgggaccacauccugaucucccacuucguggccugcaugaccgccauccucaaccagaugggggaccagcacuacagcuucuacaucgagaccuuccagacgagcuccgagcuggucgacuuccugauggagaccuucaucauguucaaggaccucaucggcaagaacguguaccccggggacuggauggccaugagcauggugcagaaccgcgucuuccugcgggcgaucaacaaguucgccgagaccaugaaccagaaguuccuggagcacaccaacuucgaguuccagcucuggaacaacuacuuccaccuggccguggccuucaucacgcaggacucccugcagcucgagcaguucagccacgccaaguacaacaagauccugaacaaguacggcgacaugcgccggcugaucggguucuccauccgcgacaugugguacaagcucggccagaacaagaucugcuucaucccgggcaugguggggcccauccuggagaugacccugauccccgaggcggagcuccggaaggccaccaucccgaucuucuucgacaugaugcugugcgaguaccagcgcagcggcgacuucaagaaguucgagaacgagaucauccugaagcucgaccacgaggucgaggggggccggggggacgagcaguacaugcagcugcuggaguccauccucauggagugcgccgccgagcaccccaccaucgccaagagcguggagaacuucgucaaccuggugaagggccugcucgagaagcugcuggacuaccgcggcgugaugacggacgaguccaaggacaaccggaugagcugcaccgucaaccuccugaacuucuacaaggacaacaaccgcgaggagauguacauccgguaccuguacaagcuccgcgaccugcaccuggacugcgacaacuacaccgaggcggccuacacccuccugcugcacacguggcuccugaagugguccgacgagcagugcgccagccaggugaugcagaccgggcagcagcacccccagacccaccggcagcugaaggagacccucuacgagacgaucaucggcuacuucgacaaggggaagaugugggaggaggccaucucccugugcaaggagcuggcggagcaguacgagauggagaucuucgacuacgagcuccugagccagaaccugauccagcaggccaaguucuacgaguccaucaugaagauccuccgccccaagccggacuacuucgccgugggcuacuacgggcagggcuuccccagcuuccugcggaacaaggucuucaucuaccgcggcaaggaguacgagcggcgcgaggacuuccagaugcagcugaugacccaguuccccaacgccgagaagaugaacaccaccuccgcccccggggacgacgugaagaacgcgccgggccaguacauccagugcuucacggugcagcccguccuggacgagcacccccgguucaagaacaagcccgugccggaccagaucaucaacuucuacaagagcaacuacgugcagcgcuuccacuacucccgccccguccggcgcgggaccguggaccccgagaacgaguucgccagcauguggaucgagcggaccagcuucgugaccgccuacaagcuccccggcauccugcgcugguucgaggucgugcacaugucccagacgaccaucagcccgcuggagaacgccaucgagaccauguccaccgccaacgagaagauccucaugaugaucaaccaguaccagagcgacgagacgcugcccaucaacccccuguccaugcuccugaacgggaucguggaccccgcggucaugggcggcuucgccaaguacgagaaggccuucuucaccgaggaguacgugcgggaccacccggaggaccaggacaagcugacccaccucaaggaccugaucgccuggcagauccccuuccugggggccggcaucaagauccacgagaagcgcgugagcgacaaccuccggcccuuccacgaccgcauggaggagugcuucaagaaccugaagaugaaggucgagaaggaguacggggugcgggagaugcccgacuucgacgaccgccgggugggccgcccgcgguccaugcugcgcagcuaccggcagauguccaucaucagccucgcguccaugaacagcgacugcuccacccccagcaagcccaccuccgagagcuucgaccuggagcuggccuccccgaagacgccccgcgucgagcaggaggagcccaucagccccggcuccacccucccggaggugaagcugcggcgcagcaagaagcggaccaagcgcagcuccguggucuucgccgacgagaaggccgcggccgagagcgaccugaagcgccucucccggaagcacgaguucaugagcgacaccaaccuguccgagcacgccgccaucccccugaaggccagcgugcucucccagaugagcuucgcgucccagagcaugcccacgauccccgcccuggcccuguccguggccgggaucccgggccucgacgaggccaacaccagcccccgccugucccagaccuuccugcagcucagcgacggggacaagaagacccugacgcggaagaaggucaaccaguucuucaagaccaugcuggcguccaagagcgccgaggagggcaagcagauccccgacucccucagcaccgaccuguga

SEQ ID NO: 29318 - RNA, 6093 nt, Artificial Sequence
  derived and/or modified sequence opt1 from DOCK3__Homo_sapiens__NP_004938
auguggacccccaccgaggaggagaaguacggcguggugaucugcagcuuccgcggguccgugccccagggccuggugcuggagaucggggagaccgugcagauccuggagaagugcgagggcugguaccgcggggugagcaccaagaagcccaacgugaagggcaucuuccccgccaacuacauccaccugaagaaggccaucguguccaaccgcggccaguacgagaccguggugccccucgaggacagcaucgucaccgaggugacggcgacccugcaggagugggccucccuguggaagcagcucuacgugaagcacaaggucgaccuguucuacaagcugcggcacgugaugaacgagcucaucgaccugcgccggcagcugcucagcgggcaccugacccaggaccaggugcgcgaggucaagcggcacaucaccgugcgccuggacuggggcaacgagcaccucgggcuggaccuggugccccggaaggacuucgaggucguggacuccgaccagaucagcguguccgaccucuacaagaugcaccugagcucccgccagagcguccagcaguccacgagccagguggacaccaugcggccccgccacggcgagaccugccggaugcccgugccccaccacuucuuccugucccucaagagcuucaccuacaacacgaucggggaggacaccgacgucuucuucucccuguacgacaugcgcgagggcaagcagaucagcgagcgguuccuggugcgccucaacaagaacggcgggccccggaaccccgagaagaucgagcgcaugugcgcccuguucaccgaccuguccagcaaggacaugaagcgggaccucuacaucgucgcccacgugauccgcaucggccggaugcugcugaacgacagcaagaaggggccgccccaccuccacuaccgccgccccuacggcugcgccgugcuguccauccuggacguccuccagagccugaccgaggugaaggaggagaaggacuucgugcugaaggucuacacgugcaacaacgaguccgaguggagccagauccacgagaacaucauccggaaguccagcgccaaguacuccgcccccagcgccucccacggccucaucaucagccugcagcugcuccgcggggacauggagcagauccggcgcgagaaccccaugaucuucaaccggggccuggccaucacccgcaagcugggguuccccgacgugaucaugcccggcgacauccggaacgaccucuaccugacccuggagaagggggacuucgagcgcggcggcaaguccgugcagaagaacaucgaggucaccauguacgugcucuacgcggacggggagauccugaaggacugcaucagccugggcuccggggagcccaaccggagcuccuaccacagcuucgugcucuaccacuccaacagcccccgcuggggcgagaucaucaagcugcccauccccaucgaccgguuccgcgggucccaccuccgguucgaguuccgccacugcagcacgaaggacaagggcgagaagaagcuguucggcuucgccuucagcacccucaugcgggacgacgggaccacccuguccgacgacauccacgagcuguacgucuacaagugcgacgagaacagcacguucaacaaccacgcccucuaccugggccugcccugcugcaaggaggacuacaacgggugccccaacauccccuccagccucaucuuccagcgcuccaccaaggagagcuucuucaucuccacccagcugagcuccaccaagcugacgcagaacguggaccuccuggcccugcucaaguggaaggccuucccggaccggaucauggacgugcugggccgccugcggcacgucagcggggaggagaucgugaaguuccuccaggacauccuggacacccuguucgugauccucgacgacaacaccgagaaguacggccugcuggucuuccagucccucguguucaucaucaaccugcugcgcgacaucaaguacuuccacuuccgccccgugauggacaccuacauccagaagcacuucgcgggcgcccucgccuacaaggagcugauccggugccugaagugguacauggacugcagcgccgagcucauccgccaggaccacauccaggaggccaugcgggcgcuggaguaccuguucaaguucaucguccagucccgcauccucuacagccgggccacgugcgggauggaggaggagcaguuccgcuccagcauccaggagcuguuccaguccauccgguucgugcugagccucgacagccgcaacuccgagacccugcuguucacccaggccgcccuccugaacagcuuccccaccaucuucgacgagcugcuccagauguucacggugcaggaggucgccgaguucgugcggggcacccugggguccaugcccagcaccgugcacaucggccaguccauggacgucgugaagcugcagagcaucgcgcgcaccguggacucccgccuguucagcuucuccgagagccgccggauccugcugccggucgugcuccaccacauccaccuccaccuccggcagcagaaggagcugcugaucugcuccggcauccuggggagcaucuucuccaucgugaagaccagcucccucgaggccgacgucauggaggagguggagaugaugguggagagccugcuggacguccuccugcagacgcugcucaccaucauguccaagagccacgcccaggaggccgugcggggccagcgcugcccccagugcaccgccgagaucaccggggaguacguguccugccugcugagccuccugcggcagaugugcgacacgcacuuccagcaccuccuggacaacuuccagagcaaggacgagcugaaggaguuccugcugaagaucuucugcgucuuccgcaaccugaugaagauguccguguucccccgggacuggauggugaugcgccugcucaccagcaacaucaucgucaccaccgugcaguaccuguccagcgcgcugcacaagaacuucacggagaccgacuucgacuucaagguguggaacuccuacuucagccucgccguccuguucaucaaccagccgucccugcagcucgagaucaucaccagcgccaagcggaagaagauccuggacaaguacggcgacaugcgcgugaugauggccuacgagcuguucuccauguggcagaaccucggggagcacaagauccacuucauccccggcaugaucggccccuuccugggggugacccuggucccccagccggaggugcgcaacaucaugauccccaucuuccacgacaugauggacugggagcagcggaagaacggcaacuucaagcaggucgaggcggagcucaucgacaagcuggacagcauggucuccgaggggaagggcgacgagagcuaccgcgagcuguucucccuccugacgcagcuguucgggcccuaccccagccuccuggagaagguggagcaggagaccuggcgggagaccggcaucuccuucgucaccagcgugacgcgccugauggagcggcuccuggacuaccgcgacugcaugaagggcgaggagaccgagaacaagaagaucgggugcaccgugaaccugaugaacuucuacaaguccgagaucaacaaggaggagauguacauccgguacauccacaagcucugcgacaugcaccuccaggccgagaacuacaccgaggccgccuucacgcugcugcucuacugcgagcugcugcagugggaggaccgcccgcuccgggaguuccugcacuaccccagccagaccgaguggcagcgcaaggagggccugugccggaagaucauccacuacuucaacaaggggaaguccugggaguucggcaucccccucugccgcgagcuggccugccaguacgagagccuguacgacuaccagagccucuccuggauccggaagauggaggcgagcuacuacgacaacaucauggagcagcagcgccuggagcccgaguucuuccgggucggguucuacggccgcaaguucccguucuuccugcggaacaaggaguacgugugccgcggccacgacuacgagcggcucgaggccuuccagcagcgcaugcuguccgaguucccccaggccguggccaugcagcaccccaaccaccccgacgacgccauccugcagugcgacgcgcaguaccuccagaucuacgccgucaccccgauccccgacuacguggacgugcugcagauggaccgcguccccgaccgggucaagagcuucuaccgcgugaacaacguccggaaguuccgcuacgaccggcccuuccacaaggggccgaaggacaaggagaacgaguucaagucccuguggaucgagcgcaccacgcucacccugacccacagccugcccggcaucucccggugguucgagguggagcgccgggagcucguggaggucagcccccuggagaacgccauccaggugguggagaacaagaaccaggagcugcgcucccucaucagccaguaccagcacaagcagguccacgggaacaucaaccugcuguccaugugccucaacggcgugaucgacgccgccgugaacgggggcaucgcgcgguaccaggaggccuucuucgacaaggacuacaucaacaagcaccccggcgacgccgagaagaucacccagcugaaggagcugaugcaggagcagguccacgugcucggggugggccuggccguccacgagaaguucgugcacccggagaugcgcccccugcacaagaagcucaucgaccaguuccagaugaugcgggcgagccuguaccacgaguuccccgggcuggacaagcucuccccggccugcagcggcacguccacgccccggggcaacgugcuggccagccacucccccaugagccccgaguccaucaagaugacccaccggcacagcccgaugaaccugauggggaccggccgccacagcuccagcucccucagcucccacgccagcuccgaggccgggaacauggucaugcugggcgacgggagcaugggcgacgcgcccgaggaccuguaccaccacaugcagcucgccuaccccaacccccgguaccagggcuccgugacgaacgugagcguccuguccagcucccaggccagcccguccagcuccagccuguccagcacccacagcgcccccucccagaugaucaccagcgcccccuccagcgcgcgcgggucccccagccucccggacaaguaccggcacgcccgcgagaugaugcugcugcuccccaccuaccgggaccgccccuccagcgccauguaccccgccgccauccuggagaacggccagccgcccaacuuccagcgcgcgcuguuccagcaggucgugggggccugcaagcccugcuccgaccccaaccucagcgucgccgagaagggccacuacucccugcacuucgacgccuuccaccacccgcugggggacacgccgcccgcgcuccccgcccggacccugcgcaagagcccgcugcaccccauccccgccucccccaccagcccgcaguccggccucgacggcagcaacuccacccugagcggguccgccagcagcggcguguccagccuguccgagagcaacuucgggcacuccagcgaggcgccgccccggaccgacacgauggacuccaugccgagccaggcguggaacgccgacgaggaccucgagccgcccuaccugcccgugcacuacucccugagcgaguccgccguccucgacagcaucaaggcccagccgugccgcucccacagcgcccccggcugcgugaucccccaggaccccauggacccgcccgcgcugccgcccaagccguaccacccccggcugcccgcccucgagcacgacgagggggugcugcugcgcgaggagaccgagcggccccgcggccuccaccggaaggccccgcugccgcccggcuccgccaaggaggagcaggcccgcauggcgugggagcacgggcggggcgagcaguga

SEQ ID NO: 29319 - RNA, 5901 nt, Artificial Sequence
  derived and/or modified sequence opt1 from DOCK4__Homo_sapiens__NP_055520
auguggauccccaccgagcacgagaaguacggcguggugaucgccagcuuccgcgggaccgugcccuacggccugucccucgagaucggggacacggugcagauccuggagaagugcgacggcugguaccggggguucgcccugaagaaccccaacaucaagggcaucuuccccuccuccuacguccaccucaagaacgcgugcgugaagaacaagggccaguucgagauggugauccccaccgaggacagcgucaucaccgagaugaccuccacgcugcgcgacugggggaccauguggaagcagcuguacgugcggaacgagggcgaccucuuccaccgccuguggcacaucaugaacgagauccuggaccuccggcgccaggugcuggucgggcaccugacccacgaccggaugaaggacgugaagcgccacaucaccgcccggcucgacuggggcaacgagcagcuggggcuggaccucgugccccgcaaggaguacgccauggucgaccccgaggacaucagcaucacggagcuguaccggcugauggagcaccgccaccggaagaaggacacccccgugcaggccuccagccaccaccucuucgugcagaugaagucccugaugugcagcaaccugggcgaggagcucgaggucaucuucucccuguucgacagcaaggagaaccgccccaucuccgagcgguucuuccugcgccucaaccggaacggccugccgaaggcccccgacaagcccgagcgccacugcagccuguucguggaccucggguccagcgagcugcggaaggacaucuacaucaccgugcacaucauccgcaucggccggaugggggcgggcgagaagaagaacgccugcuccguccaguaccgccgccccuucggcugcgccgugcugagcaucgccgaccuccugaccggggagacgaaggacgaccugauccucaagguguacaugugcaacaccgaguccgagugguaccagauccacgagaacaucaucaagaagcugaacgcgcgguacaaccugaccggcagcaacgccgggcucgccgucagccugcagcugcuccacggcgacaucgagcagauccgccgggaguacuccagcguguucucccacggggugagcaucacccgcaagcugggcuucuccaacaucaucaugccgggcgagaugcggaacgaccuguacaucacgaucgagcgcggggaguucgagaagggcgggaaguccgucgcccggaacguggaggucaccauguucaucguggacuccagcggccagacccucaaggacuucaucuccuucgggagcggcgagccgcccgccuccgaguaccacagcuucgugcuguaccacaacaacagcccccgguggagcgagcugcucaagcugccgauccccgucgacaaguuccggggcgcgcacauccgcuucgaguuccggcacugcuccaccaaggagaagggggagaagaagcuguucggcuucagcuucgugccccucaugcaggaggacgggcgcacgcugcccgacggcacccacgagcugaucgugcacaagugcgaggagaacaccaaccugcaggacaccacgcgguaccucaagcugccguucuccaaggggaucuuccugggcaacaacaaccaggccaugaaggccaccaaggagagcuucugcaucaccuccuuccucugcagcaccaagcugacgcagaacggcgacaugcuggaccuccugaaguggcgcacccaccccgacaagaucaccgggugccugagcaagcucaaggagaucgacggcuccgagaucgucaaguuccugcaggacacccuggacacccucuucgggauccuggacgagaacagccagaaguacggcuccaagguguucgacagccuggugcacaucaucaaccuccugcaggacuccaaguuccaccacuucaagcccgucauggacaccuacaucgagagccacuucgccggcgcccuggcguaccgggaccucaucaaggugcugaagugguacguggaccgcaucaccgaggccgagcggcaggagcacauccaggagguccugaaggcccaggaguacaucuucaaguacaucgugcagucccgccgccucuucagccuggccaccgggggccagaacgaggaggaguuccgcugcugcauccaggagcugcucauguccgugcgcuucuuccugagccaggaguccaaggggagcggcgcccugucccagagccaggcggucuuccucuccagcuuccccgccguguacuccgagcugcugaagcuguucgacgugcgggaggucgccaaccuggugcaggacacgcuggggagccucccgaccauccugcacguggacgacagccugcaggccaucaagcuccagugcaucggcaagaccgucgagucccagcuguacaccaaccccgacagccgcuacauccugcuccccguggugcugcaccaccuccacauccaccuccaggagcagaaggaccugaucaugugcgcccggauccuguccaacgucuucugccucaucaagaagaacagcuccgagaaguccgugcuggaggagaucgacgugaucgucgcgucccugcucgacauccugcugcgcaccauccucgagaucacgagccggccccagccguccagcuccgccaugcgcuuccaguuccaggacgugaccggcgaguucguggccugccugcugagccuccugcggcagaugaccgaccgccacuaccagcagcugcucgacuccuucaacaccaaggaggagcugcgggacuuccugcuccagaucuucacggucuuccgcauccugauccggcccgagauguuccccaaggacuggaccgugaugcgccugguggccaacaacgucaucaucaccaccgugcucuaccugagcgacgcgcugcggaagaacuuccucaacgagaacuucgacuacaagaucugggacuccuacuucuaccuggccgugaucuucaucaaccagcugugccuccagcuggagauguucacgccgagcaagaagaagaagguccuggagaaguacggggacaugcgcgugaccaugggcugcgagaucuucuccauguggcagaaccucggggagcacaagcugcacuucauccccgcccugaucggccccuuccucgaggugacccugaucccccagccggaccugcggaacgucaugauccccaucuuccacgacaugauggacugggagcagcgccggagcgggaacuucaagcaggucgaggccaagcucaucgacaagcuggacucccugaugagcgagggcaagggcgacgagaccuaccgcgagcuguucaacagcauccugcugaagaagaucgagcgggagacguggcgcgaguccggggugagccucaucgccaccgucacccggcugauggagcgccugcucgacuaccgcgacugcaugaagaugggcgagguggacgggaagaagaucggcugcaccgugucccugcugaacuucuacaagacggagcucaacaaggaggagauguacauccgguacauccacaagcuguacgaccugcaccucaaggcgcagaacuucaccgaggccgccuacacccugcugcuguacgacgagcuccuggaguggagcgaccgcccccugcgggaguuccucaccuaccccaugcagacggaguggcagcgcaaggagcaccuccaccugaccaucauccagaacuucgaccgggggaagugcugggagaacggcaucauccugugccgcaagaucgccgagcaguacgaguccuacuacgacuaccggaaccugagcaagaugcgcaugauggaggccucccuguacgacaagaucauggaccagcagcggcucgagccggaguucuuccgcgucggcuucuacgggaagaaguuccccuucuuccugcggaacaaggaguucgugugccgcggccacgacuacgagcggcuggaggcguuccagcagcgcaugcucaacgaguucccccacgccaucgccaugcagcacgccaaccagcccgacgagaccaucuuccaggccgaggcgcaguaccugcagaucuacgccgugaccccgauccccgagagccaggagguccugcagcgggagggggugcccgacaacaucaaguccuucuacaaggugaaccacaucuggaaguuccgcuacgaccggcccuuccacaagggcacgaaggacaaggagaacgaguucaagagccucugggucgagcgcaccucccuguaccuggugcagagccucccggggaucucccggugguucgaggucgagaagcgcgaggugguggagaugagcccccuggagaacgccaucgagguccuggagaacaagaaccagcagcucaagacccugaucucccagugccagacccgccagaugcagaacaucaacccccugacgaugugccucaacggcgugaucgacgccgcggugaacggcggggucagccgguaccaggaggccuucuucgugaaggaguacauccugucccaccccgaggacggcgagaagaucgcccgccugcgggagcucaugcuggagcaggcccagauccuggaguucgggcucgccgugcacgagaaguucgucccgcaggacaugcgcccccugcacaagaagcugguggaccaguucuucgugaugaaguccucccucggcauccaggaguucagcgcgugcaugcaggccagccccguccacuuccccaacggcuccccgcgggugugccgcaacagcgcccccgccuccgugagccccgacgggacccgggucaucccgcgccggagcccccucagcuaccccgccgugaaccgcuacuccagcuccagccuguccagccaggcguccgccgaggugagcaacaucaccggccaguccgagagcuccgacgaggucuucaacaugcagcccagcccguccaccagcagccucuccagcacgcacuccgccagccccaacgugaccuccagcgcccccuccagcgcccgggcgagcccccugcugagcgacaagcacaagcacucccgcgagaacagcugccucuccccgcgggagcgccccugcagcgccaucuaccccacccccguggagccgucccagcggaugcuguucaaccacaucggggacggcgcccugccccgcagcgaccccaaccucuccgcccccgagaaggcggucaacccgacccccagcuccuggagccuggacagcgggaaggaggccaagaacauguccgacagcggcaagcugaucagcccgcccgugccgccccggcccacgcagaccgccagccccgcccgccacaccaccuccgugagcccgucccccgccggccggagcccccucaagggguccguccagagcuucacccccuccccgguggaguaccacagccccggccugaucuccaacagccccgugcuguccgggagcuacuccagcggcaucuccagccucagccgcugcuccacgagcgagaccuccggguucgagaaccaggucaacgagcagagcgcgccgcugcccgugcccgugcccgucccggugcccuccuacggcggcgaggagcccgugcggaaggagagcaagacgcccccgcccuacuccgucuacgagcgcacccugcgccggcccgugccccucccccacagccuguccauccccgugacgagcgagccgcccgcccugccgcccaagccccucgccgcccgcuccagccaccuggagaacggggcccggcgcaccgaccccggcccgcggccccgcccccugccccggaaggucucccagcucuga

SEQ ID NO: 29320 - RNA, 5613 nt, Artificial Sequence
  derived and/or modified sequence opt1 from DOCK5__Homo_sapiens__NP_079216
auggcccgcuggauccccaccaagcggcagaaguacggcguggccaucuacaacuacaacgcgucccaggacguggagcugucccuccagaucggggacaccgugcacauccuggagauguacgagggcugguaccgcggguacacgcugcagaacaagagcaagaagggcaucuuccccgagaccuacauccaccucaaggaggccaccguggaggaccuggggcagcacgagaccgucauccccggcgagcugccccucgugcaggagcugaccuccacccugcgggagugggccgugaucuggcgcaagcucuacgucaacaacaagcugacccuguuccggcagcuccagcagaugaccuacagccugaucgaguggcgcucccagauccugagcggcacgcuccccaaggacgagcuggccgagcugaagaagaaggugaccgccaagaucgaccacgggaaccggaugcucggccuggaccuggugguccgcgacgacaacgggaacauccucgaccccgacgagaccuccaccaucgcccuguucaaggcccacgagguggccagcaagcggaucgaggagaagauccaggaggagaaguccauccugcagaaccucgaccugcgcggccagagcaucuucuccacgauccacaccuacgggcuguacgugaacuucaagaacuucgucugcaacaucggcgaggacgccgagcuguucauggcccuguacgaccccgaccagagcaccuucaucuccgagaacuaccugauccgguggggcagcaacgggaugcccaaggagaucgagaagcucaacaaccugcaggccguguucaccgaccuguccagcauggaccucauccgcccccgggugucccuggucugccagaucgugcgcgugggccacauggagcugaaggaggggaagaagcacacgugcggccuccggcgccccuucggcgucgccgugauggacaucaccgacaucauccacgggaagguggacgacgaggagaagcagcacuucauccccuuccagcagaucgccauggagaccuacauccggcagcgccagcugaucaugagcccccugaucaccucccacgucaucggcgagaacgagccccucacgagcgugcugaacaaggugaucgccgcgaaggaggucaaccacaaggggcagggccugugggugagccucaagcugcugcccggggaccucacccagguccagaagaacuucucccaccugguggaccggagcaccgccaucgcccgcaagaugggcuuccccgagaucauccugcccggcgacgugcggaacgacaucuacgucacccucauccacggggaguucgacaagggcaagaagaagacgcccaagaacguggaggugaccauguccguccacgacgaggaggggaagcugcuggagaaggccauccaccccggcgccggguacgagggcaucagcgaguacaaguccgugguguacuaccaggucaagcagcccugcugguacgagaccgugaaggugagcaucgcgaucgaggaggucacccgcugccacauccgcuucacguuccggcaccgcuccagccaggagacccgggacaaguccgagcgcgccuucggcguggccuucgugaagcugaugaaccccgacgggaccacccuccaggacggccggcacgaccuggucguguacaagggggacaacaagaagauggaggacgccaaguucuaccugacgcuccccggcaccaagauggagauggaggagaaggagcugcaggccagcaagaaccuggugaccuucacccccuccaaggacagcacgaaggacuccuuccagaucgcgacccucaucugcagcaccaagcugacccagaacgucgaccugcucgggcugcugaacuggcgcuccaacagccagaacaucaagcacaaccucaagaagcugauggagguggacggcggcgagaucgugaaguuccugcaggacacccucgacgcccuguucaacaucaugauggagauguccgacagcgagacguacgacuuccuggucuucgacgcccucguguucaucaucucccugaucggggacaucaaguuccagcacuucaaccccgugcuggagaccuacaucuacaagcacuucagcgccacccucgccuacgucaagcugagcaaggugcugaacuucuacguggcgaacgccgacgacuccagcaagaccgagcuccuguucgccgcccugaaggcgcucaaguaccuguuccgguucaucauccagucccgcguccuguaccuccgguucuacggccagagcaaggacggggacgaguucaacaacuccauccgccagcuguuccuggccuucaacaugcucauggaccggccccuggaggaggccgugaagaucaagggcgccgcccugaaguaccuccccagcaucaucaacgacgugaagcuggucuucgaccccguggagcuguccguccucuucugcaaguucauccagagcauccccgacaaccagcugguccgccagaagcugaacugcaugacgaagaucguggaguccacccucuuccggcagagcgagugccgcgaggugcugcugccccuccugaccgaccagcuguccggccagcucgacgacaacagcaacaagcccgaccacgaggcguccagccagcugcuguccaacauccucgagguccuggaccggaaggacgugggggccaccgccgugcacauccagcugaucauggagcgccuccugcggcgcaucaaccggacggucaucggcaugaaccgccagagcccccacaucggguccuucguggccugcaugaucgcccugcuccagcagauggacgacagccacuacagccacuacaucuccaccuucaagacccgccaggacaucaucgacuuccugauggagaccuucaucauguucaaggaccugaucggcaagaacguguacgcgaaggacuggauggucaugaacaugacgcagaaccggguguuccuccgcgccaucaaccaguucgccgaggugcugacccgguucuucauggaccaggccagcuucgagcugcagcucuggaacaacuacuuccaccuggccgucgcguuccugacccacgagucccuccagcuggagaccuucagccaggccaagcgcaacaagaucgugaagaaguacggggacaugcggaaggagaucggcuuccgcauccgggacaugugguacaaccugggcccccacaagaucaaguucauccccuccaugguggggccgauccucgaggucacgcugacccccgagguggagcugcgcaaggccaccauccccaucuucuucgacaugaugcagugcgaguucaacuucagcggcaacgggaacuuccacauguucgagaacgagcucaucaccaagcuggaccaggagguggagggcgggcggggcgacgagcaguacaagguccugcucgagaagcugcugcucgagcacugccgcaagcacaaguaccuguccagcuccggcgagguguucgcccugcucgucagcucccugcuggagaaccuccuggacuaccggacgaucaucaugcaggacgagagcaaggagaaccgcauguccugcaccgugaacgugcugaacuucuacaaggagaagaagcgggaggacaucuacauccgcuaccucuacaagcugcgggaccugcaccgcgacugcgagaacuacaccgaggcggccuacacccuccugcugcacgccgagcuccugcaguggagcgacaagcccugcgucccgcaccuccugcagaaggacuccuacuacguguacacgcagcaggagcucaaggagaagcuguaccaggagaucaucagcuacuucgacaaggggaagaugugggagaaggccaucaagcuguccaaggagcucgccgagaccuacgagagcaagguguucgacuacgagggccuggggaaccugcucaagaagcgggcguccuucuacgagaacaucaucaaggccaugcgcccccagcccgaguacuucgccgucggcuacuacgggcagggcuuccccagcuuccugcggaacaagaucuucaucuaccgcggcaaggaguacgagcggcgcgaggacuucagccugcgccuccugacccaguucccgaacgccgagaagaugaccuccacgacgccgcccggggaggacaucaagagcucccccaagcaguacaugcagugcuucaccgugaagccggugaugagccugccgcccuccuacaaggacaagcccgucccggagcagauccucaacuacuaccgggccaacgaggugcagcaguuccgcuacagccggcccuuccgcaagggcgagaaggaccccgacaacgaguucgcgaccauguggaucgagcggacgaccuacaccaccgccuacacguuccccgggauccugaagugguucgaggugaagcagaucuccaccgaggagaucagcccgcuggagaacgccaucgagaccauggagcucaccaacgagcgcaucuccaacugcguccagcagcacgccugggaccggagccuguccgugcacccccugagcaugcuccuguccggcaucguggaccccgccgucaugggcggguucagcaacuacgagaaggcguucuucaccgagaaguaccugcaggagcaccccgaggaccaggagaagguggagcuccugaagcgccugaucgcccuccagaugccgcugcugacggagggcauccggauccacggggagaagcucaccgagcagcugaagccccugcacgagcgccucuccagcugcuuccgggagcugaaggagaagguggagaagcacuacggcgucaucacccugcccccgaaccucaccgagcgcaagcagucccggacggggagcaucgugcugcccuacaucauguccagcacccugcgccggcucagcaucaccuccgugaccagcuccgucgugagcacguccagcaacuccagcgacaacgcccccucccgccccggcagcgacggcuccauccuggagccgcugcucgagcggcgcgccagcuccggggcgcggguggaggaccugagccugcgcgaggagaacuccgagaaccgcaucagcaaguucaagcggaaggacuggucccucagcaagucccaggucaucgccgagaaggcccccgagcccgaccugaugagccccacccgcaaggcccagcggcccaagagccugcagcucauggacaaccgccugucccccuuccacggcagcagcccgccccagagcaccccgcugagcccgccgccccucaccccgaaggccacgcggacccugagcucccccagccugcagaccgacgggaucgcggccacccccgugcccccgccgccgccgcccaaguccaagcccuacgagggcagccagcgcaacuccacggagcucgcgccgccccugcccgugcggcgcgaggccaaggcgccgcccccgcccccgcccaaggcgcggaaguccgggaucccgaccuccgagcccggcagccaguga

SEQ ID NO: 29321 - RNA, 6144 nt, Artificial Sequence
  derived and/or modified sequence opt1 from DOCK6__Homo_sapiens__NP_065863
auggccgccagcgagcgccgggcguucgcccacaagaucaaccgcaccguggccgccgaggugcggaagcaggucucccgcgagcggagcggcagcccccacagcucccgccggugcagcuccagccugggggugccccugaccgaggugguggagccccuggacuucgaggacgugcugcugucccgcccgcccgacgccgagcccggcccccugcgggaccugguggaguuccccgcggacgaccucgagcugcugcuccagccccgcgagugccggacgaccgagccggggauccccaaggacgagaagcuggacgcccaggugcgcgccgccguggagauguacaucgaggacugggucaucgugcaccggcgcuaccaguaccugagcgcggccuacucccccgugaccaccgacacgcagcgggagcgccagaagggccucccccggcaggucuucgagcaggacgccagcggggacgagcgcuccggccccgaggacagcaacgacucccggcgcggcagcgggucccccgaggacacgccccggagcuccggcgccagcagcaucuucgaccugcgcaaccuggccgcggacucccuccugcccagccugcucgagcgcgccgcccccgaggacguggaccggcgcaacgagacccugcggcgccagcaccggccgcccgcccugcucacccuguaccccgcccccgacgaggacgaggcgguggagcgcugcucccggcccgagccgccccgcgagcacuucgggcagcggauccuggucaagugccucagccugaaguucgagaucgagaucgagccgaucuucggcauccuggcccucuacgacgugcgcgagaagaagaagaucuccgagaacuucuacuucgaccugaacagcgacuccaugaaggggcugcuccgggcccacggcacccaccccgccaucagcacccuggcccgcuccgcgaucuucagcgugaccuaccccucccccgacaucuuccuggucaucaagcucgagaaggugcugcagcagggcgacaucagcgagugcugcgagccguacauggugcugaaggaggucgacaccgccaagaacaaggagaagcucgagaagcugcggcuggccgccgagcaguucugcacccgccucgggcgguaccgcaugcccuucgccuggaccgcggugcaccuggccaacaucguguccagcgccggccagcuggaccgggacuccgacagcgagggggagcgccggcccgccuggaccgaccgccgccggcgcggcccgcaggaccgggcguccagcggcgacgacgccugcuccuucagcggguuccgccccgccacccucacggucaccaacuucuucaagcaggaggccgagcggcugagcgacgaggaccuguucaaguuccucgccgacaugcgccggcccuccagccugcugcgccggcuccgccccgugaccgcgcagcugaagaucgacaucuccccggcccccgagaacccccacuucugccugagccccgagcugcuccacaucaagccguaccccgacccccggggccgccccaccaaggagauccuggaguucccggcccgggaggucuacgcgccccacacguccuaccgcaaccugcucuacguguacccccacagccugaacuucuccagccggcagggguccgugcgcaaccuggccguccgggugcaguacaugaccggcgaggaccccagccaggcccucccggugaucuucgggaaguccagcugcuccgaguucacccgcgaggccuucacccccgucguguaccacaacaagagccccgaguucuacgaggaguucaagcugcaccuccccgccugcgugacggagaaccaccaccuccuguucaccuucuaccacgucuccugccagccgcggcccggcaccgcccuggagacccccgugggcuucacguggaucccccuccugcagcacgggcgccugcggaccggcccguucugccuccccgugagcgucgaccagcccccgcccuccuacagcgugcugacccccgacguggcccugcccgggaugcgcugggucgacggccacaaggggguguucagcguggagcucaccgcggucuccagcgugcacccgcaggaccccuaccuggacaaguucuucacgcuggugcacguccucgaggagggcgccuuccccuuccgccugaaggacaccgugcuguccgagggcaacguggagcaggagcuccgggccagccuggccgcgcugcgccucgccucccccgagccgcuggucgccuucagccaccacgugcuggacaagcucgugcggcuggucauccggccgcccaucaucuccgggcagaucgugaaccugggccgcggggccuucgaggccauggcgcacguggucagccucgugcaccgcucccuggaggccgcccaggacgcccggggccacugcccccagcuggccgcguacgugcacuacgccuuccgccucccggggaccgagcccagccugcccgacggcgcgccgcccgucaccgugcaggccgccacgcuggcgcggggcuccgggcgccccgccagccucuaccuggcccgguccaagagcaucuccagcuccaaccccgaccuggccguggcgcccggcagcgucgacgacgaggugucccgcauccucgccagcaagcugcugcacgaggagcucgcccugcaguggguggucagcuccagcgccgugcgggaggccauccugcagcacgcgugguucuucuuccagcucauggugaaguccauggcccugcaccuccugcuggggcagcgccuggacacgccccggaagcugcgcuuccccggccgguuccuggacgacaucaccgcccuggucggcagcguggggcucgaggugaucacccgcguccacaaggacguggagcuggccgagcaccugaacgccucccucgcguucuuccugagcgaccugcucucccugguggaccggggcuucgucuucagccuggugcgcgcccacuacaagcaggucgccacccgccuccaguccagccccaaccccgccgcccugcugacccuccggauggaguucacccgcauccugugcucccacgagcacuacgucacccugaaccucccgugcugcccccuguccccgcccgcguccccgagccccuccgugagcuccaccacgagccaguccagcaccuucagcucccaggcccccgacccgaaggucaccagcauguucgagcuguccgggcccuuccggcagcagcacuuccucgccggccugcugcucaccgagcuggcccuggcccucgagcccgaggcggagggggccuuccugcugcacaagaaggccaucagcgccgugcacucccuccugugcggccacgacacggacccccgcuacgcggaggccaccgugaaggcccgggucgccgagcuguaccucccgcugcugagcaucgcccgcgacacccucccccggcugcacgacuucgcggagggccccgggcagcgcucccggcuggccagcaugcucgacuccgacaccgagggcgagggggacaucgccggcacgaucaaccccagcguggccauggccaucgccgggggcccgcuggcccccggcucccgcgccagcaucucccaggggccgcccaccgccagccgggccggcugcgcgcuguccgccgagagcucccgcacccugcucgccugcgugcuguggguccugaagaacaccgagccggcccuccugcagcggugggcgacggaccugacccucccccagcuggggcgccugcucgaccugcuguaccucugccuggccgccuucgaguacaagggcaagaaggccuucgagcggaucaacagccugaccuucaagaagucccucgacaugaaggcccgccuggaggaggcgauccuggggaccaucggcgcccggcaggagauggugcgccggagccgcgagcggagccccuucggcaaccccgagaacgugcgcuggcgcaaguccgucacgcacuggaagcagaccagcgaccggguggacaagaccaaggacgagauggagcacgaggcccucguggaggggaaccuggccaccgaggccucccuggucgugcucgacacgcuggagaucaucgugcagaccgucaugcugagcgaggcgcgcgaguccgugcucggcgccgugcugaaggucgugcuguacagccucggguccgcccagagcgcccuguuccugcagcacggccucgccacccagcgggcgcugguguccaaguucccggagcuccuguucgaggaggacaccgagcugugcgccgaccugugccuccgccugcugcggcacugcgggagccgcaucuccacgauccggacccacgccagcgccucccucuaccugcugaugcgccagaacuucgagaucggccacaacuucgcgcgggucaagaugcaggucaccaugagccucuccagccuggugggcaccacgcagaacuucuccgaggagcaccuccgccggagccucaagaccauccugaccuacgccgaggaggacauggggcugcgcgacuccaccuucgccgagcagguccaggaccucauguucaaccugcacaugauccugacggacaccgugaagaugaaggagcaccaggaggaccccgagaugcucaucgaccugauguaccggaucgcccgcggcuaccaggggagccccgaccugcggcucaccuggcugcagaacauggccggcaagcacgcggagcugggcaaccacgccgaggccgcccagugcauggugcacgccgcggcccucgucgccgaguaccuggcccugcucgaggaccaccgccaccuccccguggggugcgugagcuuccagaacaucuccagcaacguccuggaggaguccgccaucagcgacgacauccucuccccggacgaggagggcuucugcagcgggaagcacuucaccgagcugggccugguggggcuccuggagcaggcggccggcuacuucaccaugggcgggcuguacgaggccgugaacgaggucuacaagaaccucauccccauccuggaggcccaccgggacuacaagaagcuggccgcggugcacggcaagcuccaggaggccuucacgaagaucaugcaccaguccagcgggugggagcgcguguucggcaccuacuuccgggucggguucuacggcgcccacuucggcgaccuggacgagcaggaguucguguacaaggagcccuccaucaccaagcuggccgagaucagccaccgccucgaggaguucuacaccgagcgcuucggggacgacguggucgagaucaucaaggacuccaaccccguggacaagagcaagcuggacucccagaaggcguacauccagaucacguacguggagccguacuucgacaccuacgagcugaaggaccgggucaccuacuucgaccgcaacuacggccuccggaccuuccuguucugcacgcccuucacccccgacgggcgcgcccacggcgagcugcccgagcagcacaagcggaagacccuccugagcaccgaccacgccuucccguacaucaagacgcgcauccgggugugccaccgcgaggagaccgugcugacccccgucgagguggccaucgaggacaugcagaagaagacccgggagcucgccuucgcgacggagcaggacccgcccgacgccaagaugcugcagauggugcugcagggguccgucggccccaccgugaaccagggcccccucgagguggcccaggucuuccuggccgagauccccgaggaccccaagcuguuccgccaccacaacaagcuccggcugugcuucaaggacuucugcaagaagugcgaggacgcccugcgcaagaacaaggcgcucaucgggcccgaccagaaggaguaccaccgggagcuggagcgcaacuacugccggcugcgcgaggcccuccagccccugcugacccagcggcucccccagcugauggccccgacgccgcccggccugcgcaacagccugaaccgggccuccuuccgcaaggccgaccucuga

SEQ ID NO: 29322 - RNA, 6423 nt, Artificial Sequence
  derived and/or modified sequence opt1 from DOCK7__Homo_sapiens__XP_011540628
auggccgagcgccgcgccuucgcgcagaagaucagccgcaccguggccgccgaggugcggaagcagaucuccggccaguacagcgggagcccccagcugcugaagaaccugaacaucgugggcaacaucagccaccacaccaccgugccccugaccgaggccgucgaccccguggaccuggaggacuaccugaucacccacccccuggccguggacuccgggccccugcgcgaccugaucgaguucccgcccgacgacaucgaggucguguacagcccccgggacugccgcacccugguguccgcgguccccgaggagagcgagauggacccccacgugcgggacugcauccgcuccuacacggaggacugggccaucgugauccggaaguaccacaagcucggcaccggguucaaccccaacacccuggacaagcagaaggagcgccagaagggccugcccaagcaggucuucgagagcgacgaggcccccgacggcaacuccuaccaggacgaccaggacgaccucaagcggcgcagcauguccaucgacgacacgccccgggggagcugggccugcuccaucuucgaccugaagaacagccugcccgacgcgcuccugcccaaccugcucgaccgcacgcccaacgaggagaucgaccggcagaacgacgaccagcgcaaguccaaccggcacaaggagcuguucgcccugcacccgagccccgacgaggaggagcccaucgagcgccucuccgugcccgacaucccgaaggagcacuucggccagcggcugcuggugaagugccucagccugaaguucgagaucgagaucgagcccaucuucgccagccuggcccucuacgacgucaaggagaagaagaagaucuccgagaacuucuacuucgaccugaacagcgagcagaugaaggggcugcuccgcccccacgugcccccggccgcgaucaccacccuggcccgguccgccaucuucagcaucaccuaccccucccaggacguguuccuggucaucaagcucgagaaggugcugcagcagggcgacaucggggagugcgccgagcccuacaugaucuucaaggaggccgacgcgacgaagaacaaggagaagcuggagaagcucaagagccaggccgaccaguucugccagcgccugggcaaguaccgcaugcccuucgccuggaccgccauccaccugaugaacaucguguccagcgccggcucccucgagcgggacagcaccgaggucgagaucuccaccggggagcgcaagggcagcugguccgagcggcgcaacagcuccaucguggggcggcgcagccuggagcggacgaccuccggcgacgacgcgugcaaccugaccagcuuccgcccggccacccucacggugaccaacuucuucaagcaggagggcgaccggcuguccgacgaggaccuguacaaguuccucgccgacaugcgccggcccagcagcguccugcgccggcugcgccccaucaccgcccagcucaagaucgacaucuccccggcccccgagaacccccacuacugccugacccccgagcugcuccaggugaagcucuacccggacagccggguccgccccacgcgggagauccuggaguuccccgcgcgcgacguguacgugcccaacaccaccuaccggaaccugcucuacaucuacccgcagucccugaacuucgccaaccgccaggggagcgcccgcaacaucaccgucaaggugcaguucauguacggcgaggaccccuccaacgccaugcccgugaucuucgggaaguccuccugcagcgaguucuccaaggaggcguacacggccgucguguaccacaaccggagccccgacuuccacgaggagaucaaggugaagcugccggccacccucaccgaccaccaccaccuccuguucaccuucuaccacgucuccugccagcagaagcagaacacgccccucgagacccccgugggcuacaccuggauccccaugcugcagaacgggcgccugaagaccggccaguucugccucccggugagccuggagaagccgccccaggccuacuccguccugagccccgaggugccgcuccccggcaugaaguggguggacaaccacaagggggucuucaacguggagguggucgccguguccagcauccacacgcaggaccccuaccuggacaaguucuucgcgcuggugaacgcccucgacgagcaccuguuccccguccggaucggcgacaugcgcaucauggagaacaaccuggagaacgagcucaaguccagcaucagcgcccugaacuccagccagcuggagccgguggugcgguuccuccaccuccugcucgacaagcugauccugcucgucauccggccgcccgugaucgccgggcagaucgugaaccugggccaggccuccuucgaggcgauggccagcaucaucaaccggcugcacaagaaccucgaggggaaccacgaccagcacggccgcaacucccugcuggccagcuacauccacuacgucuuccggcucccgaacaccuaccccaacuccagcucccccggccccgggggccucgggggcagcgugcacuacgccaccauggcccgcuccgcggugcggccggccagccugaaccucaaccgcucccggagccuguccaacagcaaccccgacaucuccgggacccccaccagccccgacgacgagguccgcuccaucaucggcagcaagggccuggaccggagcaacuccugggugaacaccgggggcccgaaggccgcccccugggggagcaaccccucccccagcgcggaguccacccaggccauggaccgcagcugcaaccggauguccagccacaccgagaccuccagcuuccuccagacgcugaccggccgccugccgaccaagaagcuguuccacgaggagcuggcccugcaguggguggucugcuccggcagcgugcgggaguccgcccuccagcaggccugguucuucuucgagcugauggucaagagcaugguccaccaccuguacuucaacgacaagcucgaggcgccccgcaagucccgguuccccgagcgcuucauggacgacaucgccgcccuggugagcaccaucgccuccgacaucgugagccgcuuccagaaggacacggagauggucgagcggcugaacaccucccucgccuucuuccugaacgaccugcucagcgugauggaccgcggguucguguucagccugaucaaguccugcuacaagcaggucagcuccaagcuguacagccuccccaacccguccgugcuggugagccugcggcucgacuuccugcgcaucaucugcucccacgagcacuacgucacccugaaccuccccugcagccugcugacgccgcccgcguccccgagccccuccgugagcuccgccacgagccaguccagcggcuucuccaccaacgugcaggaccagaagaucgccaacauguucgagcucagcguccccuuccggcagcagcacuaccuggccgggcuggugcucaccgagcuggccgugauccuggaccccgacgcggagggccucuucgggcugcacaagaaggucaucaacauggugcacaaccugcucuccagccacgacagcgacccgcgcuacuccgacccccagaucaaggcccgggucgccaugcuguaccugccccucaucggcaucaucauggagaccgugccccagcuguacgacuucacggagacccacaaccagcgcggccggccgaucugcaucgccaccgacgacuacgagagcgaguccgggagcaugaucucccagaccguggcgauggccaucgccggcacgagcgucccccagcugacccgccccggguccuuccuccugaccagcaccuccggccggcagcacacgaccuucagcgccgaguccagccgcucccugcucaucugccugcugugggugcucaagaacgccgacgagaccgugcugcagaagugguucaccgaccugagcguccuccagcugaaccggcugcuggaccuccuguaccugugcguguccugcuucgaguacaaggggaagaagguguucgagcgcaugaacagccucacguucaagaaguccaaggacaugcgggcgaagcuggaggaggccauccugggcagcaucggcgcccgccaggagaugguccggcgcucccgggggcagcucggcaccuacaccaucgccagcccgcccgagcgcagccccuccgggagcgccuucggcucccaggagaaccugcgcuggcggaaggacaugacccacuggcgccagaacacggagaagcuggacaagagccgggcggagaucgagcacgaggcccucaucgacgggaaccuggccaccgaggccaaccugaucauccucgacacccuggagaucguggugcagaccgucuccgugacggagagcaaggaguccauccugggcggcgugcucaagguccugcugcacagcauggccugcaaccaguccgcgguguaccuccagcacugcuucgccacccagcgcgcccuggugagcaaguuccccgagcuccuguucgaggaggagaccgagcagugcgccgaccugugccugcggcuccugcgccacugcuccagcuccaucgggaccauccggagccacgccuccgcgagccuguaccuccugaugcgccagaacuucgagaucggcaacaacuucgcccgggucaagaugcaggucaccaugucccugagcucccucguggggacgagccagaacuucaacgaggaguuccugcgccggagccugaagaccauccucaccuacgccgaggaggaccuggagcugcgcgagaccacguucccggaccagguccaggaccucguguucaaccugcacaugauccuguccgacaccgugaagaugaaggagcaccaggaggaccccgagaugcucaucgaccugauguaccggaucgccaagggcuaccagaccagccccgaccugcgccucaccuggcugcagaacauggcggggaagcacuccgagcggagcaaccacgccgaggccgcccagugccugguccacuccgccgcgcucguggccgaguaccugagcaugcuggaggaccgcaaguaccuccccgugggcugcgucacguuccagaacaucuccagcaacgugcuggaggaguccgccgugagcgacgacgucguguccccggacgaggagggcaucugcagcgggaaguacuucaccgaguccggccugguggggcuccuggagcaggccgccgcgagcuucuccauggccggcauguacgaggccgucaacgagguguacaaggugcugauccccauccacgaggccaaccgggacgccaagaagcucagcaccauccacggcaagcugcaggaggcguucuccaagaucguccaccagagcaccgggugggagcgcauguucggcacguacuuccgggugggguucuacggcaccaaguucggggaccuggacgagcaggaguucguguacaaggagcccgccaucaccaagcucgccgagaucagccaccgccuggagggcuucuacggcgagcgguucggggaggacgucguggaggugaucaaggacuccaaccccgucgacaagugcaagcuggacccgaacaaggccuacauccagaucaccuacguggagcccuacuucgacacguacgagaugaaggaccgcaucaccuacuucgacaagaacuacaaccuccgccgguucauguacugcacccccuucacccuggacggccgcgcgcacggggagcugcacgagcaguucaagcggaagacgauccucaccaccagccacgccuuccccuacaucaagacccgcgugaacgucacgcacaaggaggagaucauccugaccccgaucgagguggccaucgaggacaugcagaagaagacccaggagcuggccuucgccacccaccaggaccccgcggaccccaagaugcuccagauggugcugcagggcuccgucgggacgaccgugaaccagggcccccuggagguggcccaggucuuccucagcgagaucccguccgaccccaagcuguuccggcaccacaacaagcugcgccucugcuucaaggacuucaccaagcggugcgaggacgcccugcgcaagaacaagagccugaucggccccgaccagaaggaguaccagcgggagcucgagcgcaacuaccaccggcugaaggaggcccugcagccccucaucaaccgcaagaucccgcagcuguacaaggccgugcugcccgugaccugccaccgggacuccuucagccgcaugucccuccggaagauggaccuguga

SEQ ID NO: 29323 - RNA, 6300 nt, Artificial Sequence
  derived and/or modified sequence opt1 from DOCK8__Homo_sapiens__NP_982272
auggccacccugcccagcgccgagcgccgggccuucgcccucaagaucaaccgcuacagcagcgccgagauccggaagcaguucacccugccgcccaaccugggccaguaccaccgccaguccaucagcacguccggguuccccagccuccagcugccccaguucuacgacccgguggagcccguggacuucgagggccugcucaugacccaccugaacucccuggacgugcagcucgcccaggagcugggggacuucaccgacgacgaccuggacguggucuucacccccaaggagugccggacgcuccagcccagccugccggaggagggcguggagcuggacccccacgugcgcgacugcguccagaccuacauccgggaguggcucaucgugaaccgcaagaaccaggggucccccgagaucugcggcuucaagaagaccggcagccggaaggacuuccacaagacccugcccaagcagacguucgaguccgagacccuggagugcagcgagccggccgcgcaggccgggccccgccaccucaacgugcugugcgacgucuccggcaaggggcccgugaccgccugcgacuucgaccugcggagccuccagcccgacaagcgccuggagaaccugcuccagcaggucuccgccgaggacuucgagaagcagaacgaggaggcgcggcgcaccaaccggcaggccgagcuguucgcccuguacccgagcgucgacgaggaggacgccguggagauccgccccgugcccgagugccccaaggagcaccucggcaaccggauccuggucaagcugcucacgcugaaguucgagaucgagaucgagccgcuguucgccuccaucgcgcucuacgacgugaaggagcgcaagaagaucagcgagaacuuccacugcgaccugaacuccgaccaguucaagggguuccugcgggcccacacccccagcguggccgccagcucccaggcccgcagcgcggucuucuccgugaccuaccccagcuccgacaucuaccucguggucaagaucgagaaggugcugcagcagggcgagaucggcgacugcgccgagcccuacaccgugaucaaggagagcgacgggggcaaguccaaggagaagaucgagaagcugaagcuccaggccgagagcuucugccagcggcuggggaaguaccgcaugccguucgccugggcccccaucucccugagcuccuucuucaacgucagcacgcucgagcgcgaggugaccgacgucgacuccguggugggccggagcuccgucggcgagcgccggacccuggcgcagagccgccggcuguccgagcgcgcccucagccuggaggagaacggggugggcuccaacuucaagaccagcacgcugagcguguccagcuucuucaagcaggagggggaccggcucuccgacgaggaccuguucaaguuccuggccgacuacaagcgcagcuccagccugcagcggcgcgucaaguccauccccggccuccugcggcuggagaucagcaccgcccccgagaucaucaacugcugccucaccccggagaugcugcccgugaagcccuucccggagaaccgcacccggccccacaaggagauccuggaguuccccacgcgcgagguguacgucccccacaccguguaccggaaccuccuguacguguacccgcagcgccugaacuucgucaacaagcucgccuccgcgcggaacaucaccaucaagauccaguucaugugcggggaggacgccagcaacgccaugcccgugaucuucggcaaguccagcggccccgaguuccugcaggagguguacaccgccgucacguaccacaacaagucccccgacuucuacgaggaggugaagaucaagcugccggcgaagcucaccgugaaccaccaccuccuguucaccuucuaccacaucagcugccagcagaagcagggggccuccgucgagacccugcugggcuacagcuggcugcccauccuccugaacgagcgccugcagacgggguccuacugccuccccguggcccuggagaagcugcccccgaacuacagcaugcacagcgccgagaaggugccccuccagaacccgcccaucaagugggccgagggccacaagggggucuucaacaucgaggugcaggcgguguccagcguccacacccaggacaaccaccuggagaaguucuucacccugugccacucccucgagagccaggugaccuucccgauccgggugcuggaccagaagaucuccgagauggcccuggagcacgagcucaagcugagcaucaucugccugaacuccagccgccucgagccccugguccuguuccuccaccuggugcuggacaagcuguuccagcuguccgugcagcccauggucaucgccggccagacggccaacuucagccaguucgccuucgaguccgugguggcgaucgccaacagccugcacaacuccaaggaccucagcaaggaccagcacggccgcaacugccugcuggccuccuacguccacuacguguuccggcuccccgaggugcagcgcgacguccccaagagcggggcccccaccgcccugcuggacccccgguccuaccacaccuacggccgcaccagcgcggccgccguguccagcaagcuccugcaggcccgggugaugagcuccagcaaccccgaccuggcggggacccacuccgccgccgacgaggaggucaagaacaucaugagcuccaagaucgccgaccgcaacugcagccggauguccuacuacugcagcggcuccagcgacgccccguccagccccgcggcgccccggccggccuccaagaagcacuuccacgaggagcucgcccugcagaugguggugagcacggggaugguccgggagaccguguucaaguacgccugguucuucuucgagcugcucgugaaguccauggcgcagcacguccacaacauggacaagcgcgacagcuuccggcgcacccgguucuccgaccgcuucauggacgacaucaccacgaucgugaacguggucaccagcgagaucgccgcccugcuggugaagccccagaaggagaacgagcaggccgagaagaugaacaucucccucgccuucuuccuguacgaccugcucagccugauggaccggggcuucguguucaaccugauccgccacuacugcagccagcucuccgcgaagcugagcaaccugcccacccucaucuccaugcggcuggaguuccugcgcauccucugcagccacgagcacuaccugaaccugaaccucuucuucaugaacgccgacaccgcccccacguccccgugccccagcaucuccagccagaacuccagcuccugcagcuccuuccaggaccagaagaucgccagcauguucgaccugaccuccgaguaccggcagcagcacuuccugaccggccuccuguucaccgagcuggcggccgcccucgacgccgagggggagggcaucagcaagguccagcgcaaggccguguccgcgauccacagccugcuguccagccacgaccucgacccccggugcgucaagcccgaggugaaggugaagaucgccgcccuguaccugccgcucgucgggaucauccuggacgcccugccccagcucugcgacuucacgguggccgacacccgccgcuaccggaccagcggcuccgacgaggagcaggagggcgcgggggccaucaaccagaacguggcccuggccaucgccggcaacaacuucaaccugaagaccagcgggaucguccucuccagccugcccuacaagcaguacaacaugcugaacgcggacacgacccgcaaccucaugaucugcuuccuguggaucaugaagaacgccgaccagucccugauccggaaguggaucgccgaccugcccagcacccagcucaaccgcauccuggaccuccuguucaucugcgugcugugcuucgaguacaagggcaagcaguccagcgacaagguguccacccagguccugcagaagucccgggacgugaaggcccgccucgaggaggcccugcugcgcggggagggcgcgcgcggcgagaugaugcggcgccgggccccggggaacgaccgcuuccccggccucaacgagaaccugcgguggaagaaggagcagacgcacuggcgccaggccaacgagaagcuggacaagaccaaggccgagcucgaccaggaggcgcugaucuccgggaaccuggccaccgaggcccaccucaucauccuggacaugcaggagaacaucauccaggccagcuccgcccuggacugcaaggacagccuccugggcggggugcugcggguccucgugaacucccugaacugcgaccagagcaccacguaccugacccacugcuucgcgacccuccgcgcccugaucgccaaguucggcgaccuccucuucgaggaggagguggagcagugcuucgaccugugccaccagguccugcaccacugcuccagcuccauggacgugacccggagccaggccugcgccacgcucuaccugcugaugcgcuucagcuucggcgcgaccuccaacuucgcccgggugaagaugcaggucaccaugagccucgccucccugguggggcgcgcccccgacuucaacgaggagcaccuccgccggagccuccgcaccauccuggccuacuccgaggaggacacggcgaugcagaugacccccuucccgacccagguggaggagcugcucugcaaccugaacagcauccuguacgacaccgucaagaugcgggaguuccaggaggaccccgagaugcucauggaccugauguaccgcaucgccaaguccuaccaggccagccccgaccugcggcucacguggcugcagaacauggccgagaagcacaccaagaagaagugcuacaccgaggcggccaugugccuggugcacgccgccgcccucguggcggaguaccuguccaugcuggaggaccacagcuaccuccccgucggcuccgugagcuuccagaacaucuccagcaacgugcuggaggaguccgucgugagcgaggacacccuguccccggacgaggacggggugugcgccggccaguacuucaccgagagcgggcucgucggccugcuggagcaggccgccgagcuguucuccacgggcgggcuguacgagaccgugaacgagguguacaagcuggucauccccauccucgaggcccaccgcgaguuccggaagcugacccugacccacagcaagcuccagcgcgcguucgacagcaucgugaacaaggaccacaagcggauguucggcacguacuuccgcgugggguucuucggcuccaaguucggggaccuggacgagcaggaguucgucuacaaggagcccgccaucaccaagcugcccgagaucagccaccggcucgaggccuucuacggccagugcuucggcgccgaguucguggaggugaucaaggacuccaccccggucgacaagaccaagcuggaccccaacaaggccuacauccagaucacguucguggagcccuacuucgacgaguacgagaugaaggaccgcgugaccuacuucgagaagaacuucaaccugcggcgcuucauguacaccacccccuucacgcucgaggggcggccgcgcggcgagcugcacgagcaguaccggcgcaacaccguccugaccaccaugcacgcguuccccuacaucaagacgcggaucagcgugauccagaaggaggaguucgugcucacccccaucgaggucgccaucgaggacaugaagaagaagacccugcagcuggccguggccaucaaccaggagccgcccgacgcgaagaugcuccagauggugcugcagggguccgucggcgccaccgugaaccagggcccccuggagguggcccaggucuuccucgccgagauccccgccgacccgaagcuguaccgccaccacaacaagcugcggcucugcuucaaggaguucaucaugcgcugcggggaggcgguggagaagaacaagcgccugaucacggccgaccagcgggaguaccagcaggagcugaagaagaacuacaacaagcucaaggagaaccugcgccccaugaucgagcggaagauccccgagcuguacaagcccaucuuccgcgucgagagccagaagcgggacuccuuccaccgcagcuccuuccggaagugcgagacccagcucagccagggcuccuga

SEQ ID NO: 29324 - RNA, 6207 nt, Artificial Sequence
  derived and/or modified sequence opt1 from DOCK9__Homo_sapiens__NP_001123520
augcaggccgacaagugccgcaccagcucccggagcgugaagaaggagcuggucaucgaguccccccuccaguacaaggacgccgcgcagggcgagguggaggccgagagcccggggcccgugcccgccaagcccaagcugaucgagccgcuggacuacgagaacgucaucgugcagaagaagacccagauccucaacgacugccugcgcgagaugcugcucuuccccuacgacgacuuccagacggccauccugcggcgccagggccgguacaucugcuccaccgugcccgccaaggcggaggaggaggcccagagccuguucgucaccgagugcaucaagaccuacaacuccgacuggcaccucgugaacuacaaguacgaggacuacagcggggaguuccgccagcugcccaacaagguggucaagcuggacaagcucccggugcacguguacgaggucgacgaggagguggacaaggacgaggacgccgccucccugggcagccagaaggggggcaucacgaagcacggcuggcuguacaaggggaacaugaacuccgcgaucagcgugaccaugcgguccuucaagcgccgguucuuccaccucauccagcugggcgacgggagcuacaaccugaacuucuacaaggacgagaagaucuccaaggagcccaagggcagcaucuuccucgacuccugcaugggggucgugcagaacaacaaggugcgccgguucgccuucgagcugaagaugcaggacaagagcuccuaccugcucgccgccgacagcgaggucgagauggaggaguggaucaccauccugaacaagauccugcagcucaacuucgaggccgcgaugcaggagaagcgcaacggcgacagccacgaggacgacgagcaguccaagcuggagggcagcggguccggccuggacagcuaccuccccgagcuggccaaguccgcccgggaggccgagaucaagcugaagagcgagucccgcgugaagcucuucuaccuggaccccgacgcccagaagcuggacuucagcuccgcggagccggaggugaagagcuucgaggagaaguucgggaagcggauccucgucaagugcaacgaccuguccuucaaccugcagugcugcguggccgagaacgaggagggccccaccacgaacguggagcccuucuucgucacccucagccuguucgacaucaaguacaaccgcaagaucuccgccgacuuccacguggaccugaaccacuucagcguccggcagaugcucgccaccaccucccccgcccugaugaacggcagcgggcaguccccgagcgugcugaagggcauccuccacgaggcggccaugcaguaccccaagcaggggaucuucuccgugacgugcccccaccccgacaucuuccuggucgcccgcaucgagaaggugcugcagggcagcaucacccacugcgccgagccguacaugaagagcuccgacagcuccaagguggcccagaagguccucaagaacgcgaagcaggccugccagcggcuggggcaguaccgcaugcccuucgccugggccgcgcggacccuguucaaggacgccagcggcaaccucgacaagaacgcccgcuucuccgccaucuaccgccaggacagcaacaagcuguccaacgacgacaugcugaagcugcucgccgacuuccggaagcccgagaagauggcgaagcugcccgugauccugggcaaccucgacaucaccaucgacaacgugagcuccgacuucccgaacuacgucaacagcuccuacauccccacgaagcaguucgagaccugcagcaagacccccaucaccuucgagguggaggaguucgugcccugcaucccgaagcacacgcagcccuacaccaucuacaccaaccaccuguacgucuaccccaaguaccugaaguacgacucccagaagagcuucgccaaggcccgcaacaucgccaucugcaucgaguucaaggacuccgacgaggaggacagccagccgcucaagugcaucuacgggcggcccggcgggcccguguucacccgcuccgccuucgcggccgugcugcaccaccaccagaaccccgaguucuacgacgagaucaagaucgagcugccgacgcagcuccacgagaagcaccaccugcugcucaccuucuuccacgucagcugcgacaacagcuccaagggcagcaccaagaagcgggacgugguggagacccaggucggguacuccuggcugccccugcucaaggacggccgcguggugacgagcgagcagcacauccccgucuccgccaaccugcccagcggcuaccugggguaccaggagcucggcauggggcggcacuacggcccggagaucaaguggguggacgggggcaagccccugcugaagaucuccacccaccucgugagcaccgucuacacccaggaccagcaccugcacaacuucuuccaguacugccagaagacggaguccggcgcccaggcccuggggaacgagcucgugaaguaccugaagagccugcacgcgauggagggccacgugaugaucgccuuccuccccaccauccugaaccagcuguuccgcguccucacccgggccacccaggaggagguggccgugaacgucacgcgcgugaucauccacguggucgcgcagugccacgaggaggggcuggagucccaccugcggagcuacgugaaguacgccuacaaggccgagcccuacguggccuccgaguacaagaccguccacgaggagcucaccaagagcaugaccaccauccugaagccguccgccgacuuccugacgagcaacaagcuccugaaguacuccugguucuucuucgacgugcugaucaagagcauggcgcagcaccucaucgagaacuccaaggugaagcugcugcgcaaccagcgguuccccgccagcuaccaccacgccgucgagaccguggugaacaugcucaugccccacaucacccagaaguuccgcgacaaccccgaggccagcaagaacgccaaccacucccuggcggucuucaucaagcggugcuucaccuucauggaccgcggcuucguguucaagcagaucaacaacuacaucagcugcuucgccccgggcgaccccaagacgcuguucgaguacaaguucgaguuccuccggguggucugcaaccacgagcacuacaucccccugaaccugcccaugccguucgggaagggccgcauccagcgguaccaggaccuccagcuggacuacucccugaccgacgaguucugccgcaaccacuuccucguggggcugcugcuccgcgaggugggcaccgcccugcaggaguuccgggagguccgccugaucgccaucagcgugcucaagaaccugcugaucaagcacuccuucgacgaccgguacgccagccgcucccaccaggcgcggaucgccacccucuaccugccccuguucgggcuccugaucgagaacgugcagcgcaucaacguccgggacgugagccccuuccccgucaacgccggcaugacggugaaggacgagucccuggcccucccggcggugaacccccuggucaccccccagaagggcagcacccuggacaacucccuccacaaggaccugcugggggccaucagcggcaucgccuccccguacaccacgagcacccccaacaucaacuccgugcgcaacgccgacagccgggggucccucaucagcaccgacuccggcaacagccugcccgagcgcaacagcgagaaguccaacagccuggacaagcaccagcaguccagcacccucgggaacuccgugguccggugcgacaagcuggaccagagcgagaucaagucccugcucaugugcuuccuguacauccugaagagcauguccgacgacgcccucuucacguacuggaacaaggcgagcaccuccgagcugauggacuucuucaccaucagcgaggugugccugcaccaguuccaguacaugggcaagcgcuacaucgcccggaccggcaugaugcacgcccgccuccagcagcuggggucccuggacaacagccucacguucaaccacuccuacggccacagcgacgccgacgugcugcaccagucccugcucgaggccaacaucgcgaccgaggucugccugaccgcccuggacacccucagccuguucacgcuggccuucaagaaccagcugcucgccgaccacgggcacaacccccugaugaagaagguguucgacguguaccugugcuuccuccagaagcaccaguccgagaccgcccugaagaacgucuucaccgcgcugcggagccucaucuacaaguucccgagcaccuucuacgagggccgcgccgacaugugcgccgcccugugcuacgagauccugaagugcugcaacuccaagcucagcuccauccggacggaggccagccagcugcuguacuuccucaugcgcaacaacuucgacuacaccgggaagaaguccuucgugcggacccaccugcaggugaucaucagcgucucccagcugaucgcggacguggugggcaucggcgggacccgcuuccagcagagccucuccaucaucaacaacugcgccaacagcgaccggcugaucaagcacacguccuucagcuccgacgucaaggaccugaccaagcgcauccgcaccgugcucauggccaccgcccagaugaaggagcacgagaacgaccccgagaugcugguggaccugcaguacagccucgcgaaguccuacgccagcacgcccgagcugcggaagaccuggcuggacuccauggcccgcauccacgucaagaacggcgaccucagcgaggccgccaugugcuacgugcacgugaccgcgcuggucgccgaguaccugacccggaaggaggccgugcagugggagcccccgcuccugccccacucccacagcgccugccugcgccggagccgcgggggcguguuccggcaggggugcaccgccuuccgcgucaucacgcccaacaucgacgaggaggcguccaugauggaggacgugggcaugcaggacgugcacuucaacgaggacguccucauggagcugcuggagcagugcgccgacggccucuggaaggccgagcgguacgagcugaucgccgacaucuacaagcugaucauccccaucuacgagaagcgccgggacuucgagcgccucgcccaccuguacgacacccugcaccgggcguacagcaaggugaccgaggugaugcacuccgggcgccggcuccugggcaccuacuuccgcgucgccuucuucgggcaggccgcccaguaccaguucacggacagcgagaccgacguggagggcuucuucgaggacgaggacggcaaggaguacaucuacaaggagccgaagcugaccccccucuccgagaucagccagcggcugcugaagcucuacuccgacaaguucgggagcgagaacgugaagaugauccaggacuccggcaaggucaaccccaaggaccuggacagcaaguacgcguacauccaggugacccacgugauccccuucuucgacgagaaggagcugcaggagcgcaagacggaguucgagcggucccacaacauccgccgcuucauguucgagaugccguucacccagaccgggaagcggcagggcggggucgaggagcagugcaagcgccggaccauccucacggccauccacugcuuccccuacgugaagaagcgcauccccgugauguaccagcaccacaccgaccugaaccccaucgaggucgccaucgacgagaugagcaagaagguggccgagcugcggcagcucugcuccagcgccgagguggacaugaucaagcugcagcugaagcuccagggcuccgucagcgugcaggugaacgcgggcccgcuggccuacgcccgcgccuuccuggacgacaccaacaccaagcgguaccccgacaacaaggucaagcuccugaaggagguguuccgccaguucguggaggccugcgggcaggcgcuggccgucaacgagcggcucaucaaggaggaccagcuggaguaccaggaggagaugaaggccaacuaccgcgagauggccaaggagcuguccgagaucaugcacgagcagcucggcuga

SEQ ID NO: 29325 - RNA, 909 nt, Artificial Sequence
  derived and/or modified sequence opt1 from DOHH__Homo_sapiens__XP_011526642
auggugaccgagcaggaggucgacgccaucggccagacccugguggaccccaagcagccgcuccaggcccgcuuccgggcgcuguucacgcugcgcgggcucggcgggcccggcgccaucgccuggaucagccaggccuucgacgacgacuccgcccugcugaagcacgagcucgcguacugccuggggcagaugcaggacgcccgggccauccccaugcugguggacguccuccaggacacccgccaggagcccauggugcggcacgaggccggcgaggcgcugggcgccaucggggacccggaggugcuggagauccucaagcaguacagcuccgaccccgucaucgagguggccgagaccugccagcuggccgugcgccggcuggaguggcuccagcagcacggcggggagcccgccgcgggccccuaccugagcgucgacccggccccgcccgccgaggagcgcgacguggggcggcugcgcgaggcccuccuggacgagucccggccccuguucgagcgcuaccgggccauguucgcgcuccgcaacgccggcggcgaggaggccgcccuggcccuggcggaggggcuccacugcggcagcgcccuguuccggcacgaggugggguacguccugggccagcuccagcacgaggccgccgugccccagcuggccgcggcccuggcccgcugcaccgagaaccccauggugcggcacgagugcgccgaggcgcucggcgccaucgcccgccccgccugccuggccgcgcugcaggcccacgccgacgaccccgagcgggucgugcgcgaguccugcgagguggcccucgacauguacgagcacgagacggggcgggccuuccaguacgcggacggccuggagcagcugcgcggggccccgagcuga

SEQ ID NO: 29326 - RNA, 1029 nt, Artificial Sequence
  derived and/or modified sequence opt1 from DOK1__Homo_sapiens__NP_001184189
augcuggagaacagccucuacucccccaccugggagggcagccaguucugggugaccguccagcgcacggaggccgccgagcggugcgggcugcacggcuccuacgugcugcgcguggaggcggagcggcucacccugcugaccgucggggcccagagccagauccucgagccgcugcuguccuggcccuacacccuccugcgccgguacggccgcgacaaggugauguucagcuucgaggccgggcggcgcugccccuccggccccggcacguucaccuuccagaccgcccaggggaacgacaucuuccaggccguggagaccgcgauccaccggcagaaggcccagggcaaggccgggcagggccacgacguccugcgcgccgacagccacgagggggagguggcggagggcaagcucccguccccgcccggcccccaggagcugcuggacagcccgcccgcccucuacgccgagccccuggacucccugcggaucgcccccugccccagccaggacucccucuacagcgacccccuggacuccacgagcgcccaggcgggggagggcgugcagcgcaagaagccccuguacugggaccucuacgagcacgcccagcagcagcugcugaaggccaagcucaccgaccccaaggaggacccgaucuacgacgagcccgaggggcuggcccccgugcccccgcagggccuguacgaccucccccgggagcccaaggacgccugguggugccaggcgcgcgucaaggaggagggcuacgagcugcccuacaacccggccaccgacgacuacgccgugcccccgccccgguccaccaagccccugcucgcccccaagccccaggggccggccuuccccgagcccggcacggcgaccgggagcggcaucaagucccacaacagcgcccuguacagccagguccagaaguccggggccagcggcuccugggacugcggccugagccgcguggggaccgacaagaccggcgugaaguccgaggggagcacguga

SEQ ID NO: 29327 - RNA, 1239 nt, Artificial Sequence
  derived and/or modified sequence opt1 from DOK2__Homo_sapiens__NP_003965
augggcgacggggccgugaagcagggcuuccuguaccuccagcagcagcagaccuucgggaagaaguggcgccgguucggcgccagccuguacgggggcuccgacugcgcgcuggcccgccucgagcugcaggagggccccgagaagccgcggcgcugcgaggccgcccggaaggucauccgccugagcgacugccuccggguggccgaggccgggggcgaggccuccagcccccgcgacaccuccgccuucuuccuggagacgaaggagcggcuguaccuccuggccgcgcccgccgccgagcgcggggacugggugcaggccaucugccugcucgccuuccccggccagcggaaggagcugagcgggccggagggcaagcagucccgccccugcauggaggagaacgagcuguacagcuccgcggucaccgugggcccccacaaggaguucgccgugaccaugcggcccaccgaggccagcgagcgcugccaccuccggggguccuacacgcugcgcgccggcgagagcgcccuggagcucuggggcgggccggagcccggcacccagcuguacgacuggcccuaccgguuccugcgccgguucgggcgcgacaaggucaccuucuccuucgaggcgggccggcgcugcgugagcggggagggcaacuucgaguucgagacccgccaggggaacgagaucuuccucgcccuggaggaggccaucuccgcccagaagaacgccgcgcccgccacgccgcagccccagcccgccaccauccccgccagccugccgcggcccgacucccccuacagccgcccccacgacucccucccgccgcccagccccaccacccccgugcccgcgccccggccccgcggccaggagggcgaguacgcggucccguucgacgccguggcccggagccuggggaagaacuuccgcggcauccuggccgugccgccccagcuccuggcggacccccuguacgacuccaucgaggagacgcucccgccccggcccgaccacaucuacgacgagcccgagggggucgccgcccugagccuguacgacagcccccaggagccccgcggcgaggccuggcggcgccaggccaccgcggaccgggaccccgccgggcuccagcacgugcagccggccggccaggacuucuccgccuccggcuggcagcccgggaccgaguacgacaacgugguccugaagaagggccccaaguga

SEQ ID NO: 29328 - RNA, 993 nt, Artificial Sequence
  derived and/or modified sequence opt1 from DOK3__Homo_sapiens__NP_001138347
auggacccccuggagaccccgaucaaggacggcauccucuaccagcagcacgugaaguucgggaagaagugcuggcgcaaggucugggcccugcuguacgccggcgggcccagcggcguggcgcggcucgaguccugggaggugcgcgacgggggccugggcgccgccggggaccggagcgccggccccgggcgccggggcgagcgccgggucauccgccuggccgacugcguguccgugcuccccgcggacggggagagcugcccgcgggacaccggcgccuuccugcugacgaccaccgagcgcucccaccuccuggccgcccagcaccggcaggcguggaugggccccaucugccagcuggccuuccccgggaccggcgaggccagcuccgggagcacggacgcccagucccccaagcgcggccucgucccgauggaggagaacagcaucuacuccagcuggcaggaggugggcgaguuccccguggucgugcagcggaccgaggccgcgacccgcugccagcugaaggggcccgcccugcucgugcugggccccgacgccauccagcugcgggaggccaaggggacccaggcccucuacuccuggccguaccacuuccugcgcaaguucggcagcgacaagauccugcucgggacgcccggcgucucccugcugaucugcaagggcgagcggaccgacgacgugagcgggaucauccucgacgagucccugcugcgcgcguacagcgugcccggcgccgggggccacucccggguccaggacagccucgggcccgugcugcgcgagccgaccuuccagggcgagcggagcuuccugaagaccuccaugcuccgcagccugcugugcuccugcagcuggcgccacccccggucccagccccgcacgcaggccagcugccuccagggcuccgacugccccgccccgcaccggaacagcaccuccgccgcgcacacccuggggaccagcuga

SEQ ID NO: 29329 - RNA, 981 nt, Artificial Sequence
  derived and/or modified sequence opt1 from DOK4__Homo_sapiens__NP_060580
auggccaccaacuucagcgacaucgugaagcagggcuacgucaagaugaagucccgcaagcuggggaucuaccggcgcugcuggcucguguuccgcaagagcuccagcaagggcccccagcggcuggagaaguacccggacgagaaguccgugugccugcgggggugccccaaggucaccgagaucagcaacgugaagugcgugacgcgccuccccaaggagaccaagcggcaggccgucgcgaucaucuucaccgacgacuccgcccgcaccuucacgugcgacagcgagcuggaggccgaggagugguacaagacccuguccguggagugccucggcagccggcugaacgacaucucccugggggagcccgaccuccuggccccgggcgugcagugcgagcagaccgaccgcuucaacgucuuccugcuccccugccccaaccuggacguguacggcgagugcaagcugcagaucacccacgagaacaucuaccucugggacauccacaacccccgggugaagcuggucagcuggccgcugugcucccuccgccgguacgggcgcgacgccacgcgguucaccuucgaggcgggccgcaugugcgacgccggggagggccuguacaccuuccagacccaggagggggagcagaucuaccagcgggugcacagcgccacgcuggccaucgcggagcagcacaagcgcgugcuccuggagauggagaagaacguccggcugcucaacaagggcaccgagcacuacuccuaccccugcacccccaccacgaugcugccccgcagcgccuacuggcaccacaucaccggcucccagaacaucgccgaggccagcuccuacgccggggagggcuacggggcggcccaggccagcagcgagaccgaccugcucaaccgguucauccugcugaagccgaagcccucccagggcgacagcuccgaggccaagacccccagccaguga

SEQ ID NO: 29330 - RNA, 921 nt, Artificial Sequence
  derived and/or modified sequence opt1 from DOK5__Homo_sapiens__NP_060901
auggccagcaacuucaacgacaucgugaagcagggcuacguccgcauccggucccgccggcuggggaucuaccagcgcugcuggcucguguucaagaaggccagcuccaagggccccaagcggcuggagaaguucagcgacgagcgcgcggccuacuuccggugcuaccacaaggugaccgagcugaacaacgucaagaacguggcccgccucccgaaguccaccaagaagcacgccaucgggaucuacuucaacgacgacacgagcaagaccuucgccugcgaguccgaccuggaggcggacgaguggugcaaggugcugcagauggagugcgucggcacccggaucaacgacaucagccucggggagcccgaccugcuggccaccggcguggagcgcgagcaguccgagcgguucaacguguaccucaugcccagccccaaccuggacguccacggcgagugcgcccugcagaucacguacgaguacaucugccucugggacgugcagaacccgcgcgugaagcugaucuccuggccccugagcgcccuccggcgcuacgggcgggacaccaccugguucaccuucgaggcgggccgcaugugcgagacgggggagggccuguucaucuuccagacccgggacggggaggccaucuaccagaagguccacuccgccgcccuggccaucgcggagcagcacgagcgccuccugcagagcgugaagaacuccaugcugcagaugaagaugagcgagcgggccgccucccucagcaccauggugccccugccccgcuccgccuacuggcagcacaucacccggcagcacagcacgggccagcuguaccgccuccaggacgucagcuccccgcugaagcugcaccgcaccgagaccuuccccgccuaccggagcgagcacuga

SEQ ID NO: 29331 - RNA, 996 nt, Artificial Sequence
  derived and/or modified sequence opt1 from DOK6__Homo_sapiens__NP_689934
auggccagcaacuucaacgacaucgugaagcagggcuacgucaagauccgcucccggaagcuggggaucuuccgccggugcuggcucguguucaagaaggccagcuccaagggcccccgccggcuggagaaguucccggacgagaaggcggccuacuuccgcaacuuccacaaggugaccgagcugcacaacaucaagaacaucacccggcucccccgcgagacgaagaagcacgccgucgccaucaucuuccacgacgagaccagcaagaccuucgccugcgaguccgagcuggaggcggaggaguggugcaagcaccugugcauggagugccucgggacccggcugaacgacaucagccugggcgagcccgaccuccuggccgccggggugcagcgcgagcagaacgagcgguucaacguguaccugaugcccacgccgaaccucgacaucuacggcgagugcaccaugcagaucacccacgagaacaucuaccugugggacauccacaacgccaaggucaagcuggugauguggccccucuccagccugcgccgguacggccgcgacuccaccugguucacguucgagagcgggcggaugugcgacaccggcgaggggcuguucaccuuccagacccgcgagggcgagaugaucuaccagaaggugcacuccgcgacgcucgccaucgccgagcagcacgagcggcugaugcuggagauggagcagaaggcccgccuccagaccagccugaccgagcccaugacccuguccaagagcaucucccucccccggagcgccuacuggcaccacaucacgcgccagaacuccgucggggagaucuacagccugcagggccacggcuucggguccagcaagaugagccgggcgcagaccuucccguccuacgcccccgagcagagcgaggaggcccagcagccccugucccgcagcuccagcuacggcuucuccuacagcuccagccucauccaguga

SEQ ID NO: 29332 - RNA, 768 nt, Artificial Sequence
  derived and/or modified sequence opt1 from DOK7__Homo_sapiens__NP_001158145
augaccgaggccgcccugguggagggccaggucaagcuccgcgacgggaagaaguggaagucccgguggcuggugcugcgcaagcccagccccguggcggacugccuccugaugcuggucuacaaggacaagagcgagcggaucaagggccuccgcgagcgguccagccugacccuggaggacaucugcgggcucgagcccggccugcccuacgaggggcuggugcacacgcucgccaucgugugccugucccaggccaucaugcugggcuucgacagccacgaggccaugugcgccugggacgcgcgcauccgguacgcccucggcgagguccaccgcuuccacgugaccguggcccccgggaccaagcuggaguccggcccggccacccugcaccucugcaacgacguccuggugcuggcgcgggacaucccgcccgccgugacggggcaguggaagcucagcgaccugcgccgguacggcgccguccccuccggguucaucuucgagggcggcacccgcggguggcggcugcuccccgugcugggccgcgggggcgccgaccagcugcccgugcggcuccaccgcccccggcaccucccccaccagggcccgcugugggccgcggccgggagcacccgccccaagucccccggcacccuggacugcgggggcgccugcgggcccggcagcccgggcaaccccacggccggggaggccgcggagccgccccugaccugcggccaggccgggcaguggcggggcuga

SEQ ID NO: 29333 - RNA, 1617 nt, Artificial Sequence
  derived and/or modified sequence opt1 from DOLK__Homo_sapiens__NP_055723
augacccgcgagugccccagcccggcccccggccccggggcgccccuguccggcagcgugcucgccgaggccgccgucguguucgccgugguccuguccauccacgccaccgugugggaccgguacagcuggugcgcgguggcccuggccguccaggccuucuacgugcaguacaagugggaccgccuccugcagcagggguccgcgguguuccaguuccggaugagcgccaacuccggccugcucccggccagcauggucaugccccugcuggggcucgugaugaaggagcgcugccagacggccggcaaccccuucuucgagcgguucggcaucguggucgccgcgaccgggauggccguggcccuguucuccagcgugcuggcccucggcaucacccgccccgucccgaccaacacgugcgugauccuggggcuggccggcggggugaucaucuacaucaugaagcacucccucagcgucggcgaggugaucgaggugcuggagguccugcucaucuucguguaccugaacaugauccugcucuaccugcugccccggugcuucacccccggcgaggcgcuccuggugcucgggggcaucuccuucguccugaaccagcugaucaagcgcagccugacccucguggagucccagggggaccccgucgacuucuuccugcuggugguggucgugggcauggugcucaugggcaucuucuucagcacccuguucgucuucauggacuccgggacgugggccagcuccaucuucuuccaccugaugaccugcgugcucagccugggcgugguccugccguggcuccaccggcugauccgccggaacccccugcucuggcugcugcaguuccucuuccagaccgacacccgcaucuaccugcuggccuacuggagccuccuggccacgcuggccugccugguggugcucuaccagaacgcgaagcgguccagcuccgagagcaagaagcaccaggcccccaccaucgcccgcaaguacuuccaccugaucgucguggccaccuacauccccgggaucaucuucgaccggccgcugcucuacguggccgcgaccgucugccuggccguguucaucuuccuggaguacgugcgcuacuuccggaucaagccccucggccacacgcugcgcuccuuccugagccucuuccuggacgagcgggacuccgggccccugauccucacccacaucuaccugcugcucggcaugagccugcccaucuggcugaucccgcgccccugcacccagaagggcucccucgggggcgcccgggcccugguccccuacgcgggggugcuggccgugggcgucggggacaccguggccagcaucuucggcuccacgaugggcgagauccgcuggcccgggaccaagaagaccuucgagggcaccaugacgagcaucuucgcccagaucaucuccguggcccucauccugaucuucgacagcggggucgaccugaacuacuccuacgcguggauccucggcagcaucuccaccgugagccugcuggaggccuacaccacccagaucgacaaccuccugcugccgcucuaccugcugauccuccugauggccuga

SEQ ID NO: 29334 - RNA, 1701 nt, Artificial Sequence
  derived and/or modified sequence opt1 from DONSON__Homo_sapiens__NP_060083
auggcccugagcgugcccggcuacuccccgggguuccgcaagccgcccgaggucgugcggcuccgccggaagcgcgcccggagccgcggcgcggccgccuccccgccccgggagcugaccgagcccgccgcccgccgggcggcccugguggccgggcucccccugcgccccuuccccgccgcgggcgggcggggcggcgggagcggcgggggccccgccgccgcccgccggaaccccuucgcccgccuggacaaccggccccgcgucgcggccgagccgcccgacgggcccgcccgggagcagcccgaggccccggugcccuuccucgacuccaaccaggagaacgaccugcugugggaggagaaguuccccgagcgcaccacggugaccgagcucccccagaccagccacgucuccuucagcgagccggacauccccuccagcaaguccaccgagcugcccguggacuggagcaucaagacgcggcugcuguucaccuccagccagcccuucaccugggccgaccaccugaaggcgcaggaggaggcccagggccuggugcagcacugccgcgccaccgaggucacgcucccgaaguccauccaggaccccaagcugagcuccgagcugcggugcaccuuccagcagagccucaucuacuggcugcaccccgcccuguccuggcucccccuguucccgcgcaucggcgccgaccgcaagauggcggggaagaccagccccuggagcaacgacgccacccugcagcacgugcucauguccgacuggagcguguccuucacgagccuguacaaccugcucaagaccaagcugugccccuacuucuacgucugcaccuaccaguucaccgugcuguuccgggccgccggccucgccggguccgaccugaucacggcgcugaucagcccgaccacccgcggccuccgggaggccaugcgcaacgagggcaucgaguucucccugccccugaucaaggagagcgggcacaagaaggagaccgccuccggcacgagccucggguacggcgaggagcaggccaucuccgacgaggacgaggaggagagcuucuccuggcuggaggagaugggggugcaggacaagaucaagaagcccgacauccugagcaucaagcuccggaaggagaagcacgagguccagauggaccaccgccccgaguccguggugcuggucaagggcaucaacaccuucacccugcucaacuuccugaucaacagcaagucccugguggcgaccagcggcccgcaggccgggcucccgcccacgcugcugucccccguggccuuccggggcgccaccaugcagaugcucaaggcccgcagcgucaacgugaagacccaggcgcugagcggguaccgggaccaguucucccuggagaucaccggccccaucaugccccacagccugcacucccucacgaugcugcucaagagcucccagagcggguccuucagcgccgugcucuacccccacgagcccaccgccgucuucaacaucugccugcagauggacaaggugcuggacauggaggucgugcacaaggagcucaccaacugcggccugcacccgaacacccuggagcagcucucccagaucccccugcugggcaagagcucccuccgcaacgugguccugcgggacuacaucuacaacuggcgcagcuga

SEQ ID NO: 29335 - RNA, 6897 nt, Artificial Sequence
  derived and/or modified sequence opt1 from DOPEY2__Homo_sapiens__NP_001307643
auggaccccgaggagcaggagcugcugaacgacuaccgcuaccggagcuacagcagcgugaucgagaaggcccugcgcaacuucgagagcagcagcgagugggccgaccugaucagcucccugggcaagcugaacaaggcgcugcagagcaaccuccgguacucccugcugccccgccggcuccugaucagcaagcgccuggcccagugccuccaccccgcccugcccuccgggguccaccugaaggcccucgagaccuacgagaucaucuucaagaucgugggcaccaaguggcuggccaaggaccuguuccucuacagcugcgggcuguucccccugcucgcccacgccgccguguccguccggcccgugcugcugacccucuacgagaaguacuuccugccccugcagaagcuccugcugcccagccuccaggccuucaucgugggccugcugcccgggcucgaggagggcuccgagaucagcgaccgcaccgacgcgcugcugcuccggcugucccuggucgugggcaaggagguguucuacaccgcccucugggggagcguccuggccucccccagcauccgccugcccgccagcguguucguggucggccacaucaaccgggacgcccccgggcgcgagcagaaguacaugcucggcaccaaccaccagcugacggugaagucccugcgggcgagccuccuggacuccaacgugcugguccagcgcaacaaccucgagaucgugcuguucuucuuccccuucuacacgugccuggacagcaacgagcgggccaucccgcugcuccgcuccgacaucgugcggauccugagcgccgccacccagacccugcuccgccgggacaugucccugaaccgccggcuguacgccuggcuccuggggagcgacaucaagggcaacacggucgugcccgaguccgagaucagcaacuccuacgaggaccagagcuccuacuucuucgagaaguacagcaaggaccugcucguggagggccuggcggagauccugcaccagaaguucaucgacgccgacgucgaggagcgccaccacgccuaccucaagcccuuccgcgugcugaucucccugcucgacaagcccgagaucgggccccagguggucggcaaccuguuccuggaggugauccgggccuucuacagcuacugccgcgacgcccucggguccgaccugaagcugagcuacacccaguccggcaacagccucaucagcgcgaucaaggagaaccggaacgccuccgagaucgucaagaccgugaaccugcugaucaccagccucuccacggacuuccugugggacuacaugacccgcugcuucgaggagugcuuccggcccgugaagcagcgcuacagcguccggaacuccguguccccgccgcccaccguguccgagcugugcgcccuccuggucuuccugcucgacgugaucccccuggagcuguacagcgaggugcagacccaguaccucccccagguccugggcugccuggugcagccccucgccgaggacauggaggcccugucccugcccgagcucacgcacgcgcugaagaccugcuucaaggugcugagcaagguccagaugccgcccuccuaccucgacaccgagagcaccuccgggacgagcucccccgugaagggcgagaacgggaagaucauccuggagaccaaggccgugauccccggcgacgaggacgccagcuucccgccccugaaguccgaggacagcgggaucggccucagcgccuccagcccggagcuguccgagcaccuccgcgucccccgggugagccucgagcgcgacgacguguggaagaagggcggguccaugcagcggaccuuccugugcauccaggagcugaucgcgaacuucgccagcaagaacaucuucggcguccagcucaccgccuccggggaggagagcaaguccgaggagcccgccggcaagcgcgaccgggacgggacgcagagccuggccgcgaacgacuccagccgcaagaacuccugggagcccaagccgaucaccgugccccaguucaagcagaugcugagcgaccucuucaccgcccggggcucccccuucaagaccaagagcuccgagagccccuccagcagcccguccagccccgcccgcaagaacggcggggagugggacguggagaaggucgugaucgaccugggcgggucccgggaggagcgccgggaggccuucgccgcggccugccaccuccugcuggacugcgccacguuccccguguaccugagcgaggaggagaccgagcagcugugcgccacccuguuccagcugcccggcgccggggacuccagcuucccguccuggcucaagagccugaugaccaucugcugcugcgucacggacugcuaccugcagaacguggcgaucuccacccuccuggaggugaucaaccacagccagucccuggcccucgucaucgaggacaagaugaagcgcuacaagagcuccggccacaaccccuucuucggcaagcugcagauggugaccgugccgcccaucgccccggggauccugaaggucaucgccgagaagaccgacuucuaccagcgcguggcgcgggugcucuggaaccagcugaacaaggagacgcgcgagcaccacgugaccugcguggagcuguucuaccggcuccacugccuggcccccaccgccaacaucugcgaggacaucaucugccacgcccugcucgaccccgacaagggcacccgccuggaggcccuguuccgguucagcgugaucuggcaccucacccgcgagauccaggggucccgggucacgagccacaaccgcuccuucgaccggagccuguucguggugcuggacucccucgcgugcaccgacggcgccaucggcgccgccgcccagggguggcugguccgcgcgcugagccucggcgacguggcccggauccuggagcccgugcugcuccugcugcuccagccgaagacccagcgcaccagcauccacugccugaagcaggagaacuccgccgacgaccugcaccggugguucaaccgcaagaagacgagcuuccgggaggccugcgccguccccgagccccaggaguccgggagcgaggagcaccucccccucucccaguucaccaccguggaccgcgaggcgaucugggccgagguggagaaggagccggagaaguacccccugcggggcgagcugagcgaggaggagcuccccuacuacgucgagcugccggaccgcaccgcccacggggcccccgacuccagcgagcacacggaguccgcggacaccagcuccugccacaccgacagcgagaacaccuccagcuucuccagccccucccacgaccugcaggagcucagcaacgaggagaacugcugcgcccccaucccgaugggcggccgggccuaccccaagcgcuccgcccugcuggccgcguuccagagcgagagcuucaaggccggggccaagcucucccuggugcggguggacagcgacaagacgcaggccuccgagagcuucuccagcgacgaggaggccgaccuggagcuccaggcgcugaccaccucccgccugcucaagcagcagcgcgagcggcaggaggccgucgaggcccuguucaagcacauccugcucuaccugcagcccuacgacagccgccgggugcuguacgccuucuccgugcucgaggccguccugaagaccaaccccaaggaguucaucgaggcggugagccgcacguccauggacaccagcuccaccgcccaccugaaccucaucagcaaccugcuggcccggcaccaggaggcccucaucggccaguccuucuacgggaagcugcagacccaggucccgaacgugugcccccacagccugcuccuggagcugcucacguaccugugccuguccuuccuccgcagcuacuaccccugcuaccugaaggugucccaccgggacauccugggcaaccgcgacguccaggucaagagcguggagguccucauccggaucaugaugcagcuggugagcguggccaaguccagcgaggggaagaacgucgaguucauccacucccugcuccagcgcugcaaggugcaggaguucgugcugcugagccucuccgcgagcauguacaccucccagaagcgguacggccuggccaccgcccaccacggccgcgcccugcccgaggacagccucuucgaggagucccugaucaaccuggggcaggaccagaucuggagcgagcacccgcuccagaucgagcugcugaagcuccugcagguccugaucgugcucgagcaccaccugggccgggcgcacgaggaggccgagaaccagcccgaccugucccgcgaguggcagcgggcccucaacuuccagcaggccaucagcgcccugcaguacgugcagccccacccccugaccucccaggggcuccuggucagcgcgguggugcgcggccugcagccggccuacggguacggcaugcaccccgccugggucucccucgugacgcacagccugcccuacuucggcaagucccugggguggaccgugacccccuucgucgugcagaucugcaagaaccucgacgaccuggugaagcaguacgagagcgaguccgucaagcugagcgugagcaccacguccaagcgggagaacaucagcccggacuacccccucacccugcuggagggccucaccaccaucucccacuucugccugcuggagcaggccaaccagaacaagaagacgauggccgcgggggaccccgccaaccuccgcaacgcccggaacgccauccuggaggagcugccccgcaccgugaacaccauggcccuccuguggaacguccugcgcaaggaggagacccagaagcggccgguggaccuccugggcgcgacgaaggggagcuccagcguguacuucaagaccaccaagaccauccgccagaagauccuggacuuccucaacccccugaccgcccaccugggcguccagcucacggccgccguggcggccguguggucccggaagaaggcccagcgccacagcaagaugaagaucauccccaccgccuccgccagccagcugacccuggucgaccucgugugcgcgcuguccacccugcagacggacacccuccugcaccuggugaaggaggucgugaagcggcccccgcaggucaagggcggggacgagaaguccccgcucguggacauccccgugcugcaguucugcuacgccuuccugcagcgccugcccgugcccgcccuccaggagaacuucuccagccugcugggcguccucaaggaguccgugcagcugaaccuggcgccgcccggguacuuccuccugcugagcaugcucaacgacuucgugacccggaccccgaaccuggagaacaagaaggaccagaaggaccugcaggagaucacgcagaagauccucgaggccgucggcaacaucgcgggcuccagccuggagcagaccagcuggcugucccgcaaccucgaggugaaggcccagccccaggccagccuggaggaguccgacgccgaggaggaccuguacgacgccgcggccgccagcgccaugguguccagcuccgcgcccagcgucuacuccgugcaggcccucagccugcuggccgaggugcucgccucccugcuggacauggucuaccggagcgacgagaaggagaaggccgugccccucaucucccgccugcuguacuacgucuucccguaccuccggaaccacagcgcguacaacgcccccuccuuccgcgccggggcccagcugcugagcucccucagcggcuacgccuacaccaagcgggcguggcgcaaggaggugcuggagcuguuccucgaccccgccuucuuccagauggacaccuccugcgugcacuggaaguccaucaucgaccaccuccugacgcacgagaagaccauguucaaggaccucaugaacaugcagagcuccagccugaagcuguucuccagcuucgagcagaaggccaugcuccugaagcggcaggccuucgccgucuucuccggggagcuggaccaguaccaccucuaccugccccugauccaggagcgccucaccgacaaccugcgggugggccagaccagcaucguggcggcccagauguuccuguucuuccgcguccuccugcugcggaucuccccgcagcaccucacgagccuguggcccaucaugguguccgagcugauccagaccuucacccagcucgaggaggaccugaaggacgaggacgagagccugcgcuccaccaacaaggugaaccggacgaaggucagcgugcccgacgccaacgggcccuccgugggcgagaucccgcagagcgagcucauccuguaccuguccgccugcaaguuccucgacaccgcccugagcuucccgcccgacaagaugccccuguuccagaucuaccgcugggcguucaucccggaggucgacaccgagggccccgccuuccucuccgacguggaggagaaccaccaggagugcaagccccacaccgugcgcauccuggagcugcucaagcugaaguucggggagaucagcuccagcgacgagaucacgaugaaguccgaguucccccugcuccggcagcacuccgucagcuccauccgccagcugaugccguucuucaugacccugaacggcgccuucaagacccagcggcagcuccccgccgacagccccgggacccccuuccuggacuucccggugacggacagcccccgcauccugaagcagcucgaggagugcaucgaguacgacuuccuggagcaccccgagugcuga

SEQ ID NO: 29336 - RNA, 4614 nt, Artificial Sequence
  derived and/or modified sequence opt1 from DOT1L__Homo_sapiens__NP_115871
augggcgagaagcuggagcuccgccugaagagccccgugggggccgagccggccgucuaccccuggccccugcccguguacgacaagcaccacgacgcggcccacgagaucaucgagaccauccggugggugugcgaggagaucccggaccucaagcuggccauggagaacuacguccugaucgacuacgacaccaaguccuucgagagcaugcagcgccucugcgacaaguacaaccgggccaucgacuccauccaccagcuguggaagggcacgacccagcccaugaagcugaacacccgccccagcaccgggcuccugcggcacauccugcagcagguguacaaccacuccgugacggaccccgagaagcucaacaacuacgagccguucagccccgaggucuacggcgagaccuccuucgaccugguggcccagaugaucgacgagaucaagaugaccgacgacgaccuguucguggaccucgggagcggcgucggccagguggugcugcaggucgcggccgccaccaacugcaagcaccacuacgggguggagaaggccgacauccccgcgaaguacgccgagacgauggaccgcgaguuccggaaguggaugaagugguacggcaagaagcacgccgaguacacccuggagcgcggggacuuccucuccgaggaguggcgggagcgcaucgccaacaccagcgugaucuucgucaacaacuucgccuucggccccgagguggaccaccagcugaaggagcgguucgcgaacaugaaggaggggggccgcaucguguccagcaagccguucgccccccugaacuuccggaucaacucccgcaaccucagcgacaucggcaccaucaugcgggucguggagcuguccccccugaaggggagcguguccuggacgggcaagcccgucagcuacuaccuccacaccaucgaccgcaccauccuggagaacuacuucuccagccugaagaacccgaagcuccgggaggagcaggaggccgcccgccggcgccagcagcgggagagcaaguccaacgccgcgacccccacgaaggggcccgagggcaagguggccggccccgccgacgccccgauggacagcggggccgaggaggagaaggcgggcgccgccaccgugaagaagcccucccccagcaaggcccgcaagaagaagcugaacaagaaggggcgcaagauggccggccggaagcgcgggcggcccaagaagaugaacaccgcgaacccggagcgcaagcccaagaagaaccagaccgcccuggacgcccuccacgcccagacggucucccagaccgcggccagcuccccccaggacgccuaccggagcccccacuccccguucuaccagcugccccccagcgugcagcgccacuccccgaacccccugcucgucgcccccacccccccggcccugcagaagcugcucgagagcuucaagauccaguaccugcaguuccuggcguacaccaagacgccccaguacaaggccucccuccaggagcugcugggccaggagaaggagaagaacgcccagcuccugggcgccgcccagcagcugcucagccacugccaggcgcagaaggaggagauccggcgccuguuccagcagaagcuggacgagcucggggugaaggcccugaccuacaacgaccugauccaggcccagaaggagaucuccgcccacaaccagcagcugcgggagcagagcgagcagcucgagcaggacaaccgcgcccugcggggccagucccugcagcuccugaaggcgcgcugcgaggagcugcagcucgacugggccacccugagccuggagaagcuccugaaggagaagcaggcccugaagucccagaucagcgagaagcagcggcacugccucgagcugcagaucagcaucguggagcuggagaagucccagcgccagcaggagcuccugcagcugaagagcugcgucccccccgacgacgcccucucccugcaccugcgggggaagggcgcgcucgggcgcgagcuggagccggacgccagccggcugcaccucgagcuggacugcaccaaguucucccugccccaccucagcuccaugagccccgagcuguccaugaacggccaggccgccggcuacgagcugugcggggugcucagccgccccuccagcaagcagaacacgccgcaguaccuggccuccccccuggaccaggaggugguccccugcacccccagccacgugggccggccgcgccucgagaagcuguccgggcuggcggcccccgacuacacccgccucagccccgccaagaucgugcugcggcgccaccugucccaggaccacaccguccccggccggccggccgccagcgagcuccacagccgcgcggagcacacgaaggagaacgggcugcccuaccagucccccagcgugcccggcuccaugaagcugagcccgcaggacccccggccccucuccccgggcgcccugcagcuggccggggagaagagcuccgagaagggccuccgcgagcgggccuacgggagcuccggcgagcugaucaccagccugcccaucuccaucccccucagcaccgugcagcccaacaagcugccggucuccaucccccuggccagcguggugcuccccucccgcgcggagcgggcccgcagcacccccuccccgguccugcagccccgggaccccagcuccacgcuggagaagcagaucggcgccaacgcccacggggcgggcagccgcagccucgcccuggcccccgccggguucuccuacgccggcagcguggcgaucuccggggcccuggccggcagcccggccucccucacccccggcgccgagcccgcgacccuggacgagagcuccagcuccgggagccuguucgccaccgugggcucccggagcuccaccccccagcacccgcuccugcuggcccagccccgcaacagccuccccgccucccccgcccaccagcugagcuccagcccgcggcuggggggcgcggcccaggggccccuccccgaggccuccaagggcgaccugcccagcgacagcggcuucuccgacccggagagcgaggccaagcgccggaucgucuucacgaucaccaccggggccggcuccgcgaagcagagccccuccagcaagcacuccccccugaccgccagcgcccgcggggacugcgugcccucccacggccaggacagccggcgccgggggcgccgcaagcgggccuccgcgggcacgccgagccucuccgccggcgugagccccaagcgccgggcccugcccuccgucgccgggcuguucacccagccgagcggcuccccccucaaccugaacagcaugguguccaacaucaaccagccccuggagaucaccgccaucagcagccccgagaccucccucaagagcuccccggugcccuaccaggaccacgaccagccccccguccugaagaaggagcgcccgcugagccagacgaacggggcgcacuacuccccccucaccagcgacgaggagcccggcuccgaggacgagcccagcuccgcccggaucgagcgcaagaucgccaccaucagccuggaguccaagagcccgcccaagacccuggagaacgggggcggccucgccgggcggaagcccgcccccgcgggcgagccggugaacuccagcaaguggaaguccacguucagccccaucuccgacaucgggcuggccaagagcgccgacuccccccugcaggccagcagcgcccucucccagaacagccuguucaccuuccgccccgcgcuggaggagccguccgccgacgccaagcucgccgcgcacccccggaagggcuuccccggcagccuguccggggccgacggccugagccccgggaccaacccggccaacggcugcaccuucgggggcggccucgccgccgaccugucccugcacagcuucuccgacggggcgagccucccccacaagggccccgaggccgccgggcuguccagcccccuguccuucccgagccagcgcggcaaggagggguccgacgccaaccccuuccugagcaagcggcagcucgacggccuggccggccugaagggggagggcucccgcgggaaggaggcgggcgaggggggccucccccugugcggcccgacggacaagaccccccugcucagcgggaaggccgccaaggcccgggaccgcgagguggaccugaagaacggccacaaccuguucaucuccgccgcggccgucccccccgggagccuccugagcggcccgggccuggcccccgccgcguccagcgccgggggcgccgccuccagcgcccagacccaccgguccuuccucgggcccuuccccccgggcccccaguucgcgcuggggcccaugagccugcaggccaaccucggcuccguggccggcagcuccgugcugcagagccuguucuccagcguccccgccgccgcggggcucgugcacguguccagcgccgccacccgccugacgaacucccacgccaugggcagcuucuccggggucgccggcgggaccgugggcggcaacuga

SEQ ID NO: 29337 - RNA, 1227 nt, Artificial Sequence
  derived and/or modified sequence opt1 from DPAGT1__Homo_sapiens__NP_001373
augugggccuucagcgagcugcccaugccgcuccugaucaaccugaucgugucccuccugggcuucgucgccaccgugacccugauccccgcguuccgggggcacuucaucgccgcccggcucugcggccaggaccugaacaagacgagccgccagcagauccccgagucccagggggugaucagcggcgccgucuuccugaucauccucuucugcuucauccccuucccguuccugaacugcuucgugaaggagcagugcaaggccuucccccaccacgaguucguggcgcugaucggggcccuccuggccaucugcugcaugaucuuccugggcuucgccgacgacguccucaaccugcgguggcgccacaagcugcuccugcccaccgcggccucccugccccuccugaugguguacuucaccaacuucggcaacaccacgaucguggucccgaagcccuuccggcccauccuggggcuccaccuggaccugggcauccucuacuacguguacauggggcugcuggccguguucugcaccaacgccaucaacauccucgccggcaucaacgggcuggaggcgggccagagccuggucaucuccgccagcaucaucguguucaaccucguggagcuggagggcgacugccgcgacgaccacgucuucucccuguacuucaugauccccuucuucuucaccacccucgggcugcuguaccacaacugguacccgagccggguguucgugggcgacacguucugcuacuucgccgggaugaccuucgccgucgugggcauccucggccacuucuccaagaccaugcugcuguucuucaugccccagguguucaacuuccucuacagccugccccagcugcuccacaucauccccugcccgcgccaccggaucccccgccugaacaucaagaccgggaagcuggagauguccuacagcaaguucaagacgaagucccucagcuuccugggcaccuucauccugaaggucgccgagucccugcagcucgugaccgugcaccagagcgagaccgaggacggggaguucacggagugcaacaacaugacccugaucaaccugcuccugaagguccugggccccauccacgagcggaaccucacccugcugcuccugcugcuccagauccugggguccgcgaucaccuucagcauccgcuaccagcuggugcgccucuucuacgacgucuga

SEQ ID NO: 29338 - RNA, 612 nt, Artificial Sequence
  derived and/or modified sequence opt1 from DPCD__Homo_sapiens__NP_056263
auggccgugaccggcuggcuggagagccuccgcaccgcccagaagacggcgcugcugcaggacgggcggcgcaagguccacuaccucuuccccgacggcaaggagauggccgaggaguacgacgagaagaccuccgagcugcuggugcggaaguggcgcgucaagagcgcccucggggccaugggccaguggcagcuggaggugggggacccggcgccccugggcgccggcaaccucgggcccgagcugaucaaggaguccaacgccaaccccaucuucaugcggaaggacaccaagaugagcuuccaguggcgcauccggaaccugccguaccccaaggacguguacuccgugagcgucgaccagaaggagcgcugcaucaucgugcggaccacgaacaagaaguacuacaagaaguucuccauccccgaccucgaccgccaccagcugccccuggacgacgcccuccugagcuucgcccacgcgaacugcacccugaucaucuccuaccagaagccgaaggagguggucguggccgagagcgagcuccagaaggagcugaagaaggugaagaccgcccacuccaacgacggcgacugcaagacccaguga

SEQ ID NO: 29339 - RNA, 4182 nt, Artificial Sequence
  derived and/or modified sequence opt1 from DPCR1__Homo_sapiens__NP_543146
auggcccagcccgugcacagccugugcuccgccuucggccuccagugcugccugcuguuccuccuggcgagcuggggcgccggggccaccaccuuccaggaguaccagaagacgggggagcuguccaccagcgaccacaucuucccgcucacccccggccuggucuacuccauccccuucgaccacaucgugcugcacagcgggcagcggcccccggagcuccccaaguccaccgagauccacgagcagaagcgccacugcaacacgacccgccacagcaagcccaccgacaagcccaccggcaacuccaagacgaucgaccacaagagcuccaccgacaaccacgaggccccgcccaccagcgaggagaacuccagcaaccagggcaaggaccccaugauccggaaccagcgcuccguggaccccgccgacagcaccacgacccacaaggaguccgcggggaagaagcacaucaccccggcccccaagagcaagaucaacugccggaaguccaccacgggcaagagcaccgucacccgcaagagcgacaagaccgggcggccccuggagaaguccaugagcacgcuggacaagaccuccaccagcucccacaagaccacgaccagcuuccacaacuccggcaacagccagaccaagcagaaguccaccagcuuccccgagaagaucacggccgccuccaagaccaccuacaagaccacggggaccccggaggagagcgagaagaccgaggacucccgcaccacgguggcgagcgacaagcuccugaccaagaccaccaagaacauccaggagaccaucuccgccaacgagcugacgcagagccucgccgagcccaccgagcacggcggccggaccgccaacgagaacaacacccccucccccgccgagccgacggagaaccgcgagcggaccgcgaacgagaacaccacccugagccccgccgagcccaucgagaaccgcgagcggacggccaacgagaacaccgcccccuucccggccgggcccaccgagaaccgcgagaugaccgcgaacgagaacacgacccuguuccccgccgagcccaccgagcacggcgagcggaccgccaacgagaacacgaccccgucccccgccgagcccaccgagcacggggagcgcaccgccaacgagaacacgaccccgagccccgcggagcccaccgagcacggcgagcggacccccuucgccaacgacaagacgaccagcuccagcgccgaguccaccgagcacggcgagcgcaccccgcucgccaacgagaacacgacccccagccccgccgagcccaccgagaaccgggagcgcaccgcgaacgagaacacgaccccgucccccgccgggcccaccgagaaccgggagaccacggccaacgagaagaccacccugagccccguggagccgaccgagaaccgcgagaccacggccaacgagaagaccacccccucccccgcggagcccaccgagaacggccagcgcacgccguucgccaacgagaagaccaccagcuccagcgccgagcccaccgagcacggggagcggacgccccuggccaacgagaacaccacccccuccccggccgagcccaccgagaaccgcgagcggacggcgaacgagaagaccacccccagccccgccgagccgaccgagaacggcgaccgcacgccccucgccaacgagaagaccacccccucccuggccgagccgaccgagaacgggcagcggacgcccuucgccaacgagaagaccaccagcuccagcgcggagcccaccgagcacgaggagcgcacgccccuggccaacgagaacaccaccccgucccccgccgagcccaccgagaaccgggagcgcacggccaacgagaacaccacccccagcccggccggccccaccgagaaccgggagaugacggcgaacgagaagaccacccucuuccccgccgagcccaccgagaaccgcgagcggacggccaacgagaagaccaccagcuccccggccgagcccaccgagaacggccagcgcacccccuucgcgaacgagaagacgaccagcuccagcgccgagcccaccgagcacggggagcggaccccgcuggccaacgagaacacgacccugucccccgccgagcccaccgagaaccgcgagcggaccgccaacgagaagacgacccccuucccggcggagcccaccgagaaccgcgagcggaccgccaacgagaacacgacccccagccccgcccagccgaccgagaacggcgaccgcacgccccucgccaacgagaagaccacccccucccuggccgagcccaccgagaacgggaagcggaccccguucgcgaacgagaagacgaccagcuccagcgccgagcccaccgagcacgccgagcgcacgccccuggccaacgagaacaccaccuccagcccggccgagcccaccgagaaccgcgagcggaccgcgaacgagaagacgacccaguuccccgccgagcccaccgagaaccgcgaguccaccgccaacgagaagacgaccccguuccccgccgagcccaccgagaaccgggaguggaccgcgaacgagaacacgacccucagccccgccgagccgaccgagcacgaggagaugacgccccuggccaacgagaagaccacccugucccccgccgagcccaccgagaacggcgagcgcaccccguucaccaacgagaagacgacccccagcuccgccgagcccaccgagcacggggagcggacgccccucgcgaacgagaucaccaccccgagccgcgccgagcccaccgagcacggcgagcggaucgccaacgagaaggccacccccucccccgccaagccgacggagcacggcgagaccaccgucaacgaggacaccacgcccagcagcgcggagcccaccgagaacggggagcgcacgccccuggccaacgagaacaccaccaccuccccgaccgagagcaccgagcacggcgagcggacggccaacgagaagaccacccccucccccgccgagcccaccgagcacggggagcgcacgccgagcgccaacgagaagaccauccccucccccgcgaagccgaccgagcacgaggagaugacccccagcgccaacgagaacacgacccccucccccgugaagccgaccgagcacggcgagaagaccacgcuggccaacgagaagaucacccucagccccgaggggcccaccgagcacggcgccaagaccacguccgccaacgagaagaucacccccagccuggcgaagccgaccgagcacggcgagcggaccaccucccccaacgacaagaucacgagcuccgccgccgagagcaccgagcaccgcgaccgggccaccuccgcgaacgugaucacccccgcccccgccgagccgaucaagcacgccaagcgcacgacccuggcccacgagaagaugacccaggucaccgagaaguccacggagcaccccgagaagaccaccuccaccacggagaagaccacccggacccccgagaagcccacgcucuacagcgagaagaccaucugcaccaaggggaagaacaccccggugcccgagaagcccacggagaaccugggcaacaccacccugaccacggagaccaucaaggcgcccgugaaguccaccgagaacccggagaagaccgccgccgucacgaagaccaucaagcccagcgugaaggugaccggggacaagagccucaccacgaccuccagccaccugaacaagaccgaggucacccaccaggugcccacgggcuccuucacccugaucaccagccgcaccaagcucuccagcaucaccuccgaggccacgggcaacgagagccaccccuaccugaacaaggacgggucccagaagggcauccacgccgggcagaugggcgagaacgacagcuucccggcgugggccaucgugaucgucgugcugguggccgucauccuccugcugguguuccuggggcucaucuuccugguguccuacaugaugcggacccgccggacccugacccagaacacgcaguacaacgacgccgaggacgagggcggccccaacagcuaccccgucuaccucauggagcagcagaaccuggggaugggccagaucccgagcccccgcuga
